United States Patent 6,833,447 (MYXOCOCCUS XANTHUS GENOME SEQUENCES AND USES THEREOF) - sequence listing, part 7

SEQ ID NO: 9864 - protein, 1281 aa, Myxococcus xanthus
MPETWEVACTLGRRHLPDVLGLDVGLGRCELDPLGSRVVVHGFSLFLPGTDSPLVAVDRAEVQLGFLQPLQGRLTLAQVKASRPRVALDLSQPSSPSEPKSNFCFLEPLEHLRVAKLDISGAELRLALPEGRRVEVDELDVRWDEQWGVIELDVEARRGRVRLGPDGRELALGQLVIAGALDPDEALLELERAEVSLDDITTTVSGRVDSLCAPRLALDAQVFLPLRALYQARLIPSPATGHLWSRVSIAGKVASPAVSLELSGNSLGYGDFGPTNLHARLSYSGEDVRLEELTLPVGAGKVRATGRLGLTPNFPLEVSLTTEDASLGRILDRAGVKGSWVDFPASLDARLSGNLLPRFSLSGPLDLRTGKFVLATHAFDTQPKDGLTILEFDKARAQAQVKLQADRVAFSHVNAEVGHSRVTGDVVLLLAGGLGLDIHGQGDVDLADFGHIAGLPWAGRGHATYAITGPASDVKVEAGLSFRDFEFWNLSLGVMQGKLAYKDSLLTFPAFSGQKGRTQYYGKAGVSFGRLLNLRLEVNVPQGRNEDLVDVVAGLSPSLAVMQGTLGGTATGRVEVDSPVEKLEGLVAFDVKDTTYLGRRMGDGAARLRFVDGKAMVLERTTLTGPLGRTWAEGTFTFEGGLDYRFGGDGLSLAEAVDPELAERMGIEGTMVMDGVVSGTADVPVVDVTLRAPRVTFAERNLGAMDLTGRMVGKNFEVWGHPFGDATGRIRMKVQENWPYEAQGSFSLPEIRPLLPDAPLWAGVSGSLSGTVSAKGLLLEPAGSQVNATVERLVLSRDDLRGENAGPIVLAYAAGRTDVQPFRFTGQHVDLSLGGWMSPRGLNVTLRGGLDLRLLESLMPAMVERSSGRITVDAEASGTLEKPSVVGSAELFDMRLALRDWPVQVRNMAGRVEMTGQRVLVEHLQGQLNDGRVSARGDVRLERFLPQRLGLTIQLDEVPYRLTEDLPATFSGLLQVIGPPKGFTVTGGMDIVKMRYQKALDVDALLKTMQKRTTHLAAGSLSSSGEPPKPWVIWDVNVHFGDVRVDNNLAKARLLGDVRLTGTDLRPGLLGRVELAEGSQAFFRNNPFTISQGQLEFQDPTQIDPVFEVQAQTQVREYVVKLHAFGKPADPQILLSSEPALVEGDIVSLLTLGFTSSDQDTAASASAGLAAEALFNVSGLDRQLQRFLPSNPVLRDLSLQISTTYNDATRQAEPTAQLESKFLSEQLKIGMTQPVSGRGTRARAEYRFDDRLSAQAQWDNENNEASFGNLGLELKLSWEVE

SEQ ID NO: 9865 - protein, 312 aa, Myxococcus xanthus
MTTYLDFFELTQEPFSNAPVSRFYYNSAQHSQALTRLMHAVSYMKGLSILVGDIGAGKTTLARRMLDSLPESEYEAALLVIIHSGITANWLLRRIALQLGVENPAQEKLALLSQLYQRLLQIYESGKKAVVLIDEAQMLETRELMEEFRGLLNLEVPERKLISFVFFGLPEIEKNLKLDPPLAQRVAMRYRLEPFTAESTEAYVKHRLRLAGCPRMPFSPEALLAVHQHSSGSPRVINTLCDNALFEAFLAREQTVSAQLVHRIGKNLGLLGVNTPAGQAAERPSASGVDAPQDDEQQGGPRGDRPLPRRAG

SEQ ID NO: 9866 - protein, 1060 aa, Myxococcus xanthus
MDKNKIIEAAAKLVAKGAYDKAIKEYQKVLEVDPKDIRVLQKMGELYQKKNDNPQAAHFFTKVAESYSSDGFFLKAVALYKQVLKLNPNLLEVNLKLAELHQQLGLMSEAMAYFQIVANHYDKAGDTKSSLDTLKKMVDLDPENVASKIKLAELYARENMTREAAQEFKRAAEYLKRNSRADDWLRVAERLSALEPDNLPLSKELATSYLQRGDQKRALAKLQVCFKADGRDVETLTLLAQAFQGLGQTSKTISVYKELAKIHQERGRVTEAEAVWTQIEVLDPEDPDLVARRAPEPAPAAPQPAAAPQPAPRPAPQPTAAAPAPAPVAPPAPAGMGREQLSKLLTETDVYVKYGLHDKALEHLRKVFSVEPENLDAHEKAYQIYVASGNMAQASEQLLNVLRLCTRTADVQRAQPYLATILQENPAHPEVPAFLSVLRTTGPVVAAPTVSVVESVGEDAILVDSSDDEILVAPPPEDALLHPPGDELALTTLPSSDSDEVIEEDSDSAVISEEALVGEAITSGEFEVYGTPDPEDLAAASVDETLVTDDDQLVLSDEPGLSVTDDEPLVASSDDDLAAVAAYSLDDESLVDDGAATSMEALSLGDDDEPQPTQMHAPTQALLDEASPDTLQVPTLDSLDVPALDDEAPPPLDLENVPTRVGAAPLTAADLDEDPFGAPALGDPMEFEEPTASHAIVTVDDESFVDDAPDLSADELSEPVAYEEPAVEVEPDPEPEPEPAVEAAADEEEPAAEECDEASFFLDQGLLEEAREILETVMIAFPGHARAAELMERLEAAEAGGGAEQEDAAAEPAQIPSVQPVTDGYEDAEETTGERDAFDLAAELAGEIDNFGDDAGASALPAEEDFQYSVEEVFSEFKKSLAKVVKPEDVDTHYDLGIAYKEMGLLDDALHEFDVARQGSAGGKRELDCITMMGMLQLLRGDASAAVEAFREGLGNPHATGEAAKALGFELAAAYEAQGEAGKALFHYQRVAAMDGKYRDVAGHVSRLAASVAPVEDPLPTPSGNGAQATSSPPAPAGAAAPTTPIPAAGASKARKVGYL

SEQ ID NO: 9867 - protein, 353 aa, Myxococcus xanthus
MLRLMGNKVRARQAAREAGLPLLPGSPGTVKDPREAEAFAREIGFPVILKAAAGGGGKGMKIVREPGALAQAFSTAQAEAVASFSNGDLYIERYVEKPRHIEIQIVADEHGNIVHLNERECSVQRRHQKLIEESPSPALTPELRKRMGEVSVNAMRRLAYNNVGTIEYLLDERGEFYFMEMNTRIQVEHPVTELVTGVDLVSEQIRLAYGEPLRFTQEDVQIRGHAIECRVNAEDPITFAPWPGKITGYSVPGGYGVRVDSGAYENYTVLPYYDSLLSKLIVHAEDRATAIRRMQRALGEYVVEGIRTNIPFHRAALAEESFQEGNYDTRFVERLLASETGSRRLKKAVEETP

SEQ ID NO: 9868 - protein, 199 aa, Myxococcus xanthus
MATKRKSTRAQAPARTEAASSGPADTGGTSLDVDALQQIVEILESSDVTRLVWKRGEEKLFIRRGQGPETTIVHHAAPAPVAASVGVEYTAPAAPRVAAPPPAATPAAPAPAAEKPVEKPGHQVTSPFVGTFYRTPAPDQPPFVEVGSIVKKGQVLCIIEAMKLMNEIESEVSGRVAEILVENGRPVEFGQALFRIEVA

SEQ ID NO: 9869 - protein, 192 aa, Myxococcus xanthus
MAGVIDTSEFRKGLKIEIDGEPFEIADFQHVKPGKGSAFVRTTIRSLLTGRVLQPTLKSGEKVGKPDIEEKDMQYLYVQGEEFYFMDTRNYEQTFLGEKVLGEAKNFLKENINVSVLFYNGKAIGVTLPNSVDLKVTQCDPGIRGDTVSGALKPAVLETGYSVYVPLFIEEGDVLKIDTRDGKYLTRVATRG

SEQ ID NO: 9870 - protein, 120 aa, Myxococcus xanthus
MSFRTHLESVVNQVEGALACSVMGFDGISVDTFQKDESAELDLNGAWVEYANLLTQLRNAAETLKTGTVSEVSVNSEKVLTVMRLVSPDYFLVLALHADGNFGKGRYVLRVTAPKVRAEL

SEQ ID NO: 9871 - protein, 188 aa, Myxococcus xanthus
MLPVRSTSPGSPVRAGHWTYRRQAVTSLRSTVRNSLSTQEVVVGEAPVTGGGDESSIYVNNVELNYETQGTGPTLRSDVYPYYFNLPANATQSSSAVLDLLGANASADLAAYFGGGGTAPVSVVVRLKLIGKTVNGKSTESNEATYPVTFYHSGFTCQAGTQLVPTGPCGLPGGQDGFPPECTEPEET

SEQ ID NO: 9872 - protein, 562 aa, Myxococcus xanthus
VKHVRFQQSSSGGRIVMKLSGTSGCKVDWLDPRSAVLTLDNARLPKKFERSLDTSALDTPVKMISAFSVPGAGGKVRLVVAADGAIEEKVSQSAGTLSWRLHVKGVNTEQVPVAQRTAGFTTEAPAYAAEGAPQQARYRGKRVSFEFKDIDIQNLLRVIAEISKKNIVVADDVSGKVTIRLRNVPWDQALDLVLRTKALGKEEFGNIIRIAPLKTLEEEARLRQERKKSLQQQEDLMVNLLPVNYAVAADMAARVKDVLSERGSVTVDQRTNVLIVKDVRSNTERARSLVRSLDTQTPQVLIESRIVEANTSFSRSLGVQWGGQARAGQATGNSTGLIFPNNLAVTGGVTGTGAGLPDNPNFAVNLPTGTGQGVGGAMGFTFGSAGGALQLNLRLSAAENEGSVKTISAPKVTTLDNNTARISQGVSIPFSQTSAQGVNTTFVEARLSLEVTPHITQDGSVLMSINASNNQPDPSSTGANGQPSIQRKEANTQVLVKDGDTTVIGGIYVRRGATQVNSAPFLSRIPVLGLLFKNNSETDTRKELLIFITPRILNRQTIAQTL

SEQ ID NO: 9873 - protein, 234 aa, Myxococcus xanthus
AMPPPSAAAPAPGARPLIQVRRITPPGRAPAQSAPSMDADGGTTDWMIMRSERREQGKADAMKKKRQKGGILSNFFGGGQSPDSLKEAELEESDAYRDEAPAAEGGVDTGAESLLSRQLANGLWEGTGEGSEPVRQARATALALLTLLREGITSSHPLHGAQVKKAVEALLSLAASLSGDAQVAELALGVAWLAAAGPRTRGRIEQAAKPLAGLNGRLGNEVALREHVDTLAAR

SEQ ID NO: 9874 - protein, 370 aa, Myxococcus xanthus
MTLATLILLATLSAQPSEAPPSSEATAPETVTAPPLVSTPDACAASSEADYSAGFDALVSGNDAKALELFERVLAACPQHPYATELARLSRTRLAPGGRLATGAASEMGREPYSSAARASLVVVQTLHGVAQGILLCAIGDCSGQGYAAVSLLGAGAGAASSLLLTRGGVTDGQAAVINSGTVWGFWFGIATLLAFDLDGDHAIGAAILGGAGFTGVGVLLAHLVNPTSGQVSLANSGGLWAGAVTALFLATSDNTDLKRFFAVELGATAAGILSMAILSKYVPVSRGRMLLIDAGGILGGLVGASALYLTAGNDAGDAILVGSGVGVLGGLALTTYLTRNFDLPDAPQVALAPLTTPRGGTGLSMVGRF

SEQ ID NO: 9875 - protein, 109 aa, Myxococcus xanthus
MIPIRRPKDGKGPAATPFTPDDYATSASVAFDKRGFFEKETRRQVSGYGDMVQVLSAYETRETADGPVMTTGVNSLQLVFDGRRWWILNIAWTDDKAAGVPVPKDFTRK

SEQ ID NO: 9876 - protein, 278 aa, Myxococcus xanthus
MGDASLRDVLVVGSYCHDLLRHGPGRETHALGGSTAYIASVLDAMGLEYAVAAVAGEDFRYADQVRHPPRIVPGTRTTQFIADFEGEARTLRVSAKAEPIRPADITVDARVALACGVAGEVLPETLLHVSERARHVLADAQGLIRALDDDGRVLNLRLEDTPFAGLLERLRVLKASEEEARAMDIERVRQRTCLVVTRGARGCTVFTADARIDVPTVAVEEVDATGAGDCFIAGFTLGLLRGLPFERCAALANWFGAQAVTQVGVPKLDVSRLPTELR

SEQ ID NO: 9877 - protein, 44 aa, Myxococcus xanthus
MYQHKRAGDLDSARQEMRDVLAAEEVPHYRAVAQGQLNLLDDEP

SEQ ID NO: 9878 - protein, 485 aa, Myxococcus xanthus
MVGFARFFARTPHDFTPRASLPTGREGMMAFLPERTAPRMTRVRHALLSALLLATPIASAAPADPIASQDDWPRLRKERIQKLLPQAMARANVDAWVVICRENDNDPLAIHVGCENAGGTAAFLFLKQDAAVRGVALSPEGEATALRDVAPLDEVVPLPRGTNLYAQLASRLAAAKPKRIAVNSSTSVAVADGLSATQRAALEKALTPALRKKLVSSEDLVSEWLSVKLPEEVDILRKAAALTSQMEIEAYRAVVPGKTRDVDVARFLRQRMAELGVGDAWAPDQNPNVQSGPTRGHSHATERVIQPGDFIQTDFGIRVGGMWVTNIQRFAYVLAPGETHPPKEALEKWEKGKKGSRIALATLKPGVRGWDVDKAQRDWMREAGSAPVMWGTGHPVGYWAHDVGPALSGAQQGKPAAGQAARIVRPGQVFAFDGFFAWPDGGEGEQRIIAVEEMAVVTETGAEYLIPPQEDLVLIPSPGPSRPVP

SEQ ID NO: 9879 - protein, 121 aa, Myxococcus xanthus
MQNVLVIDDDAFVLSVVRDILQSAGYGVVAVQSPAEAFNLDLSSVSAILCDYNMPDMNGSDVLTVMRELKDCRVPFIFLTGHEELDDLVSVAIRYGAELLPKPIQPVELVRLLVKQLASAA

SEQ ID NO: 9880 - protein, 275 aa, Myxococcus xanthus
MSGSQGSVVLITGASSGIGKACAELLSARGHIVYGTSRRPVEAAPPGYRMLELDVTQDDSVQRAVATVLSREGRIDVVVNNAGHALAGAAEDTSIEEARAQLDANFLGALRVCKAVLPSMRERRAGRIIQVSSLGGQVGLPFQSLYSASKFALEGFTEALRQEVAEFGIEATLVQPGDVRTQLTQNRVCVAKAGAGSAYRERFEAVLKAIESGERGGLAAEDVAKKVLEVMERGAPHVRYPVAQLAQRVAVVAKTVLPSRTFEQIVMSIYGLRRR

SEQ ID NO: 9881 - protein, 65 aa, Myxococcus xanthus
MAVVYFLSPVDALPDVIPVLGWLDDLGVLSAAAFFMVREVQRHQVVISGEDAQPGVAAQARSKTV

SEQ ID NO: 9882 - protein, 232 aa, Myxococcus xanthus
MLKLFGLEGFESRMPHALSGGQQQRVALARALAPGPRVLLLDEPFSSLDSALRASTRMEVRRVLKSLGATVMLVTHDQQEAMGFADRLAVMRAGQVEQVGTPEAVYATPRTAFVAYFLGGTNLLPGVGFGNGARTLLGILPVTGAPAKGNVLLSLRPEAMRLVPDTDGVALGGALRAEVLAREFQGPSAEFTVACNGLELTVRGAPDLPLRAGDRARLEVVGRAMVLEDIPD

SEQ ID NO: 9883 - protein, 506 aa, Myxococcus xanthus
MATLALVPAIYLCVRAAEADADAWGLLLRDKTWGLLGRTLGLAAAVTGCAALLSLPLAWLTARTDLPGRRLWTVLLCVPLAVPTFVSGYVLLAAFGVGGALEEPLTRWGLPVPPVYGFPGALLALTVSTYPYFFLALRAGLLSQDPAWLEGARSLGLTPARAFFRITVPLLRPAFASGALLVGLYVLSDFGAVALVQYDAFSRAIYVQYEGAYDRSYAALLGLALVSVTVGVLALELWLRGRAGYHRSAKGAARASSLVQLGRWRVPALLLCGAVVAVGVGLPVGVLVYWGVQGLSVESGPMMGPAWNSVSASMLGAVAAVVGALPLAFLAVRYPSRLTVALERVSYAGYALPPIVLALSLVFLGVQTVPFLYGTLVMLVLAYVVRFLPQAVGVVRASLLQLNPHLPEAAASLGQPPSGVLRRVTAPLLRPGLLAGAALVFLTAMKELPATLLLAPIGFETLATRVWGATAEGRFAEAALPALVLMAVSTLGVGLLVSQEGGSSPS

SEQ ID NO: 9884 - protein, 327 aa, Myxococcus xanthus
MVRLLLASLVLTLASPALAAETLTIYSGRNEKLVGPLLKKFTEKTGVEVKVRYGETPQLAATLLEEGAKTPADVFFAQDAGALGALAKAGQLQVLPKETLDKVDARFRSPQGVWVGTSGRARVVAYNTKKVKADTLPKSILGFTDAKWKGRLGWAPTNASFQSFVTALRLLKGDEAATQWLKGVQANAPRVYKNNSAIIEALGRGEIDAGFVNHYYLYSAKKNKADLPVANYFVAAGDPGALVNVAGVAILKGSKNTDAAKKLAAYLLDADAQTYFAQETSEFPLVSGVKLAEGLPALDKVGSPDLDLSRLDDLRGTVKLLQDTGVL

SEQ ID NO: 9885 - protein, 259 aa, Myxococcus xanthus
MAKSTSQKRPSKAKKPAASKAKAKKAAAPKKAALRTSAAPRRASAPVFEPAVKVPRPPVLEAEPILADEPTPGRPGPKALPSGETAGRVLPFEIDPKRMEEGLRKLQGEMVHWANKGRYTRVRFKFRGKQLLPDLPLAAVVAAEGLTFYWGGILRVLVANVVGGSVFQVELVNDAEKRVQAGKEALLSGDVDQALVLFREAVAMDRDFPSAHLNVGVALKLKGDREGALAAFEKAKKRDPEGPVGAEAERLAAPLRPQG

SEQ ID NO: 9886 - protein, 103 aa, Myxococcus xanthus
MAQSRRIRSLVFSVLAVCVSSCGVSEDEAVRPKEGESLSDAPYCGSFGCVNPYQFCAEIFLEFGRSPPICVFDDICERLECANSNRTCALFDGFPAQVKCIKP

SEQ ID NO: 9887 - protein, 130 aa, Myxococcus xanthus
MFGPAGVAYVYLIYGMHHCFNVVTDATGAGAAVLVRAVEPVEGLPPGTRTDGPGRLCKALGLTRAHNRRGLCTPVLHLRPGTPVPESAVSRGPRIGVDYAGTWAAEPFRLWVRDSQHVSKGPPPGRRKPA

SEQ ID NO: 9888 - protein, 204 aa, Myxococcus xanthus
MSDEAVMGEDRQLLARAQDGDVSAFEALVDAHRDKVYGLALRMTRSEADAAEITQDTFLSAYQHLKDFRGDAAFGSWVHRIAANHALMRLRHRRVAQAAEQELQGPEFTERGSLADYPQTDWSRDAEEKALDAELGSAIQQASDRLPEGYREVFLLKDVEGLSYEQIAEATGDSIPAIKSRLHRARLALREAIDAFYNRDSREL

SEQ ID NO: 9889 - protein, 79 aa, Myxococcus xanthus
MYNCKDSINLLLQFLDGEMSPEDTQHLREHLRGCSPCVDFLRTYRATPGLCKKALVAKMPKEVSEKLTEFLRSKIKSAS

SEQ ID NO: 9890 - protein, 296 aa, Myxococcus xanthus
MPKLAIVERRRADDGFVKYLFDSPLGGRIEAVRIPIFDEKYVICVSSQVGCALACDFCMTGKLGFKRNLQTWEILDQVLQVREEADRPVRGVVFMGMGEPLLNYKETLRAADILRHPAGFSIAGEAITFSTAGHVPAIRRYVREGHPYRLAFSVTSAIAEKRAKVLPIEKTHPLPELIAAIREYSEVRRERAMIAYVAISGFNMGREDAEALKVAFEGIRIKVDLIDVTDPTGKYLPPTPEELSAFRDHLQILKSPVARRYSGGKEIGAACGTLAATQYGGTVMPRPAEAPPSTTP

SEQ ID NO: 9891 - protein, 408 aa, Myxococcus xanthus
MTWDNAALLSPETAKRLSLEPGDLAELTYGGRKLTVPVWITPGHADDTVTMSLGYGRDGLHEQVAKAVGFNANAVRTVKAPWFDGGATLTKVRGSYKFSLTQTHWRMENRPLALDMPLSELKNPSIATQHTLHRVKSELKFGVQDNLPAFDYNKGPSNPQGYKWGMAIDLSRCTGCSACVIACQAENNIPVVGKQQVSVSREMQWLRIDRYFEGSESDPRMVMQPVMCVHCEKAPCEYVCPVNATVHSDEGLNDMVYNRCVGTRYCSNNCPYKVRRFNYLHYTADKTATEKMLMNPDVTVRNRGVMEKCTYCVQRIERVRIDARVEKRLINEKELQTACQQTCPTQAITFGSLNDPQQRVTQLHEDERAYKLLHELGTRPRTAHLIRVRNPNPALEPAASAAANQGSH

SEQ ID NO: 9892 - protein, 206 aa, Myxococcus xanthus
MVEYIDQLISALGPLGLLVLGLAAMLEYVVPPFPGDTITLLGGVYAVRGSQPWVLVFLVVTVGSVVGAAINYAVGHWLAKRFDAHPERSFLGITHARLEQVQARMRVNGPWLLLVNRFLPGIRGLIFVAAGASRMPRFNALALGAVSAMAHTGLVLGLGAAVGGNLERLTALVTRYQYAVVGLVVIGAIGVGIRMLARRRAPAPGP

SEQ ID NO: 9893 - protein, 613 aa, Myxococcus xanthus
MLLLSGAGLTESVRLTGLGIRPTPCPERPCFDSRFDVASGTCVEAPLEEGAACTPESRCQVDGRCQASVCVGHPRTCDDNNPCTVDACSPTQGCVTSRVACPAPQNPCKVGVCDRDEGCTAVDADDFSPCGPADCQKARLCFSGACREVTPPEGFVCAPATACQGEGTCQGGVCQRPDPVELAPELSLELEGVPVEADGGTVLLVSEDALYTSVCGGDAGCQLVAYTRSGLLRYASSYPDGGARTLLSASDAGVVVHAPEGLEAYAPRGSGARLWQASWASLGAGEGLPLGGAAASHIALTHEEDILAYVAWRAVPDAGGVDDGGTAPESARLVWLSGREDAGTLLGASQVEAWRGEARLGLDVLGTAYLYTVDGRLARVEVSPGVADGGGGTELKLSALLDGGVPDGGASLAIAGGRLLVGARAFVPEDGGVPVMLSEGGGGASVRVPIAEPALLSSGGQPGQLFARACARTDGVPCTAREERVVLRAVDPESGHVVWEVDALPDEVAPGTVYEAALLQGGAVAVLADAELPEGHQAWIQFFAQGARVGSCPLPSRPRVAGAAFLGQHLYVVLNRDGVWRLESYGLGRDFMTEDRGWPQRHGGPLRMKNESP

SEQ ID NO: 9894 - protein, 1244 aa, Myxococcus xanthus
MDLERMRTDGLSVKARDVDLSELMAQGPKTRIAADLDAKGGGTSLESMEGEVKLTVSPSQYLGQPLGPVELEARAKEGRYSLMRLRMLAPGVALQAKGDGTAESVNLQGGLTAGNLALLSQMLSKLMPGVVAPMAGNGTLDFSVKGPLRTPAVKVDGGFAALRYGDVAAQDVSLKLEMPDVSHPLTSNATLVVSRLKAGGRDLRDVAVTLATQERALEASVRVAGDAELGLTLSGLVDGNRQGLAIRQLALFWPEATWTLQAPTHVGFGGGNVEVEPPLRLASEGQTLSLQGTMRGQRVNARVELDAFDLSRLPRAFVPESLGLGGRLTGHAAVSGTMARPDAETDLRLEDGSAQGYEGLQAKLKARYVKDRATGTLAASLPVARLAAEFDVPVQGVLKRRRDVMSVRLNLEDLDIAGAMKLAGQPQSASGRLAGALTVEGPAREPLLDFTLRGQDVRYQSPPPGFSLPEPLAFHLRAASDREDQTLDARLDVEGLGSQTYLALRTPFTVGGLMAKPPTPDELLATTLGVEARVTQLPLTLLKGMSGVQQPDGTVTAHLDFEGSVLVPHATLRVQANAVTMNGLPPMNGQLSVVGGDKDVKLTLNAQRQDGPLAQLTATLAAPLGALQDREVYGHIPFDITGRVGPVPLKEIPGVATPASPVAEGAPPPQGGRPQGIQGVLAMELGARGTLDTPQMELTAGVQDLGVGNTGLGQVRLNYTYKDTRSRFDLLLTEPGGGTMLVNGGLGLDVSLPALNRGLQTDNAPVEVALKARNFNPAFLSGTVEMLRSIGGVLQADASVAGTLSAPRINGSLEWKDGKLGLMGLGEYRDIQLALKASRESIAVTTLSAKAGNGSLNLNSPLTAVLNTRNEYELSSPGTSDPPLVMRNFPIIVDDQLMALVSLRAKVEGTLSQRLVNLRNVTIPEATIELPEAKRKDLQALERPGDVVLVRNGEPLNRKKRKEAAQAQPPANPDGTPVEGAAPAEGVAAEGEEETATPPIVFWVNVNAPRNLWVKGSDINAELGLSDDFRVEYTDVARLFGEVRVLRGRVDVLGRRFDIQRDSQVRFTGPAMAPYINVTAEHRNDSAKVTVFVTIRGQGREITLKPTSDPPLPESEIYTLLATGRRTLERSSGASMNASAQAASVVGSLVANEARKALAAKLPLDVVSIEAGASGIAGTKLEVGTYVTDKIYVGYTGRVGANLQQGENANAVRFEYQLGTRWSLEGQYGDARSGGLDLIWTNQY

SEQ ID NO: 9895 - protein, 172 aa, Myxococcus xanthus
MRGFNGQRLSPLAALQRTADVDGDGNPDVVQDEEWDTVPVGGNSLFETSVEMRYQFTESLMVAAFYDTGLVGIEDFSHANRPKLFGPQHYHAVGMGLRYLTVVGPIRLDIARRLNIGEGLPVSTPGYIYPEAGGCFGIGSRWRPTGPTTPSGAFAGAPDGLCALHLSIGEAF

SEQ ID NO: 9896 - protein, 470 aa, Myxococcus xanthus
MVLPLLPTAPGDSSPYATRSAFGLNPLFIDLQRLPEFTAAGGEAALSDAQRAQLAEARSAPRVRYDLVFPLKDTAFARAFDVFEAQHWAPQSERAKTFRQWRDAQGEWLESYALFTAISEQEERRPWWEWPEPLRTRQPEALAQKSRELERRVRYHAWLQWVAEQQWNEVRTQARAKDVLLCGDEPFIIGQDSADVWAHPDILRRDARLGVPPDDFSATGQDWGLPYFDLAAMEKDDFAWLKTRAKKAASYYDLRRVDHAVGYFRQWIRDAQTPTGRFIPPDEESHRRLGEKTFRLLSEGAGIVAEDLGVIPHFVRHILAELKLPGYRVMRWERDDNHYRDPRQFPAVSLVTTGTHDTDTMAEWWEGAGDHERQAAARSWPELNGVAITREFTPDVHRAMLASALNANSDLCVLPWQDVLGTRDRINLPGSMSDSNWAYRIEQNVSDLLTDSRTREAAERLAWLTASARR

SEQ ID NO: 9897 - protein, 130 aa, Myxococcus xanthus
LRWRARNTRPRGPRAVSPPSATAGWPTTPDPDTFLYFLLASNAQTVVPMGYRNPELDRLTAEARVSIDPELRRQLYLRAEQLFQEDCPLIPLYHDRAHAAATPAVQSLRVHQTPPQVRFEDLWVDPISAT

SEQ ID NO: 9898 - protein, 109 aa, Myxococcus xanthus
MACLGSTEALRQFVSGFAVPFEPSLLPGRVERFLALLRDGDLLRAWGLMSAKLAALNLLPLPALAGGTFLLLPWRKGYPVWAGLLGILGLLAAVPWVLYVLYVVIKALV

SEQ ID NO: 9899 - protein, 95 aa, Myxococcus xanthus
MLNLLDGLFTLFFLQLGVAEELNPIMREAYEQSPLFFMFSKLVIVNAGLWLLCIHRHLKASRIAIRLGAAVYAVIVVYHLAFLTHLVMHWPQMLT

SEQ ID NO: 9900 - protein, 99 aa, Myxococcus xanthus
MNITDVRVFPVEEDKLKAYVTITLDHCFVIRDLKVIHGSTGLFIAMPAKKRKDGTYKDIAHPLNADTRSQMERVILMEYERHLHQAQAGMLVAAPADLD

SEQ ID NO: 9901 - protein, 247 aa, Myxococcus xanthus
MELLIMCDALKRASAGSITAVIPYYGYARQDRKVAPRTPITAKLIADLLESAGAGRVVSMDMHAGQIQGFFNIPSDHLYGSPVFLEDLRKRFPESQELVIVSPDAGGVERARAYSKRLNTGLAIIDKRRPRPNASEVMNLIGDVSGKDAVLVDDMVDTAGTLAQAAAALKAKGARRVVAYAVHPILSGPAIQRIQDSVLEEVVFTDTVPLSPAAQACSKIRLLTTERLFGEAIARIHRADSLSSLFV

SEQ ID NO: 9902 - protein, 452 aa, Myxococcus xanthus
MQRAADSAEQPALCLIPRGFEEGQKVDLGERPFSLTLGRPVQFQLYSTTSDRIDKPGDLVPLAEDLKPLPPIHTLLKGASNKVAEVPVHLQAALTEIGTLELYCVSNVADERWRLEFELRGTGGSHELTVTESMPARFVEAKDNIERVYGNKPLPIGPKDVKQLGRTLEKALGSRETWRVPVLREMWSTLFAGASKRRRSEDHERVFYSLTGFSLRPGFGYPLDGWRAEQTFGLFDALVQHHTDKAVWTEFWVMWRRIAGGLDEARQQKLYAYLQPHLARKVPPDAPPPGKLKGIQPEGLEEMVRTAASLEHLQPGDKAELGRWIAARLKAEAKSGGPWAWSLGRLGARVPLYGSSHKVVDVDTAEAWLTLLLELDLRKIDGASFAAAQLARLTGDRTRDLDPDLRERTAQALLAAKASETWVRMVREVVALEAADEARALGDTLPAGLRLS

SEQ ID NO: 9903 - protein, 357 aa, Myxococcus xanthus
MTLFAVMCAGLFPLLHTGRPWFAFWLFPYPSTLGAWPQFRSPLVWDVFAISTYLTVSALFWFVGLIPDLAALRDSSKTKLQRTIYGLFALGWRGSGRHWHNYKIAYLLLAGLSTPLVVSVHTIVSFDFAVSLLPGWHATIFPPYFVAGAVFSGFAMVITLIIPARKYLGLRDVITDRHLENMNKVILATGLLVSYGYLMEHFVAWYSQNQYELWTFYVNRATGPYAGVYWLMIACNVITPNIFWFKKCRTNIAIMWVASIAVNIGMWCERFIIIVTSLSQDFLPSSWGIYTPTWVDWSIYIGTLGLFGTLFLLFLKFVPAVAISEVKELQLELKHAAHQHGSDDALAGAGTLTHGAH

SEQ ID NO: 9904 - protein, 220 aa, Myxococcus xanthus
MSVNTSTLEAKPREGSGKGVARRLRAQGLIPAVVYGKHLEKPVHISVNPKAVRQAINTPHKFNTLIQIKVEGGDRQVLLKDYQMDPVTRAILHADFLDVRPTDKVKVNVPLVLSGRAQGVADGGLLTQARREIEVWSLPGAIPEKIEVDVTPMKIAEVLHINDLKLPEGVSVKTNVNYTLAVISAPEAVEAGPGAAAAAAAPAKDAKAAPAKDAKAPAKK

SEQ ID NO: 9905 - protein, 191 aa, Myxococcus xanthus
MKLIVGLGNPGREYERHRHNIGFMVVEALLSRARAQLNQEKFAAKVGQGTLAGERVLFVEPQTFMNLSGRSVAEAARFFKVPVADVLVIHDELDLPLGRLQLKAGGGSGGHNGLKSIVSSLGDESFIRLRFGIGKPEGPNARERVSDYVLSNFDDGERREMDALIDRAMDMTELWIREGLSVAMNRFNRKA

SEQ ID NO: 9906 - protein, 158 aa, Myxococcus xanthus
MAETQAATRLREYETIFLVKPDLTDDNVDKLKERVRGIVSREGGKVIRFTVWGKKKTLFPVAKQPRAIYVHTHFLGGAKLVAEIERNLRNLDEVTRYISVKLADEVDPETRPVLEDVKLAGDVEETRPGAPAEREGGFRSEGSEEQGGDSEEESSEEA

SEQ ID NO: 9907 - protein, 131 aa, Myxococcus xanthus
MSNGTDSKTASAPPARSGGGFGGGGSRGGDRGDRGDRGGDRGDRGGGLGGDDDKRGGGRGFGRKKVCRFCAEKNASVDFKDQATLKYFVTERGKIIPRRISGNCAKHQREVAVAIKRARGIALLPYNAVVG

SEQ ID NO: 9908 - protein, 147 aa, Myxococcus xanthus
MKVILREDIENLGKSGELVTVKDGFGRNFLLPRKKAVLASEQNLRQLEHEKAVIAARNAKLKGAAEEQAKKIGAIKVSIKRRVGDQDKLFGSVTALDIAEAVAAEGQSIDRRHIHLPEPIKALGNYEVELRLHRDVIAKIKLEVLPE

SEQ ID NO: 9909 - protein, 388 aa, Myxococcus xanthus
MSTTAPPHLTDEHRPDLDWLRVVAILLLHLFHTGMMFNTWDWHVKSAQALPWLEPPMEVLHHLRMPLLMCISGLGTAFALRRRSLGTFAGDRAKRLLGPLVFGMFVVVPPQIYLERLQRGTFQGSYADFYPSVFGFVPYPAGSFSWHHLWFVAYLFIYCLLALPLFAALRTASGQVWLQRAEAWLSRGWNVVWLFLPLALNEVLLRRFPQTHALLDDPRAFIHFGLFFIGGHLLGRCPRVMEHLVARRKALLGACGLLFAVMVPPNEYAFPLETLGRTALQWLFILTALAWARACIHVRRPWLRHARERAYPFYILHQTVIVVVGFAVVDWPVGPWGLFLAVLTLTFGLTWGLCEGVARVPWLRACFGMPARSKRAAPIHAAAPVHTA

SEQ ID NO: 9910 - protein, 371 aa, Myxococcus xanthus
MTPSPPQAGFDWKWPRIRAKPALALFGFCLLIGLWMGLTLWLTILGDGGTLPGSRPFLWEITGALGIWAVLPILYTAVVNAPSPRVGWGRFLGIHAVAFVLFTGLHTALMVGTRQLLYALLGWGTYDYGALAFRIPMEAQKDLISYTVTATLWSFLQTWKERQARALREAALEAELRAAQLQSLTGQLHPHFLFNALNTVSAVMYEDLARTDRLLSDLGGLLRASMERREATWTLAEERTQAARFVALLAARFGERVTVCWDVAPGLDGAQVPCFALQALVENAVKHNQDRTEPLEVRIQAREDGNGWRLEVEDTGRGFGVASPASGPGVGLSHLERILTLLHGGRARLERSHGPEGGARVSLWLPRETAA

SEQ ID NO: 9911 - protein, 256 aa, Myxococcus xanthus
MTRFQVLVADDEAPARAKVKRLLAEDARFALAGEATDGPQTLRQVGTLRPDLLVLDVQMPGLTGFEVLEALGPEHCPAVIFSTAYDAFALAAFEAQAVDYLLKPYDAERFGRALDKAHAVLRSGMPDTARIQSLLAELGRAPAGRPLERLVVKVGEAWVPLPLADVWHLSAEDKYVRLYTGQGEHLVRQTLRALEERLDPSRFVRVHRGDIVNLDAVARLEPWSHGDGILVLKDGSSVVLSRTWREAFLQKWGLEG

SEQ ID NO: 9912 - protein, 304 aa, Myxococcus xanthus
LKLDGQSRQVDHLTLAEELKVLGHLVSVGGPAYLMRLDQVVPIASNAVQYAQIVKDQAIRRRLAQAGREIQDLASQETGELEVLLDEAERKVFLLAEKKREGDLRPVSELMEHTLDLLDKMKAAATGITGLSTGYIDLDNQLTGLHAGELIILAARPGIGKTSFAMNIAVHAALKENKAVGIFSLEMPADQLLMRLLASTARVDMKKLRGGRLTPHDEEKFQEMAGALYNAPIYIDDSGGLSPFDLRAKARRVKQRDPRLSLIVIDYLQLMHQKGKVENRQLEVAEISRALKQLAKELEVPIIA

SEQ ID NO: 9913 - protein, 211 aa, Myxococcus xanthus
MFFDPTRLTAYFLAVLALILTPGPDTMFVLARSMGQGRKAGIVSALGIFVGCLFHIAAAAFGLSTLLATSALAFSVVKWGGAAYLVWMGVQMLRSKDTVAEAVQALPPAGLWRIFRDGVVTNVLNPKVAVFFLAFLPQFVDASAGSTGLQFLGLGLMFSVTGTSWLVLLAAFAGAFGGWMRRNPRVAAWQKRVTGGVFVALGARLALQRQE

SEQ ID NO: 9914 - protein, 181 aa, Myxococcus xanthus
MEATVLDSWVLAEFSTPDALVTATRQMREKGFEGMDTYSPYPLHGGSEALGLPPSRVPFIALCGGLTGVATALAMQTWMNTIDYPLNIGGRPLLSLPAWVPITFELGVLIAAFGIFFGLLGLSRLPQPYHPVFESEEFRTASTHGYWLSVPQATGTDAAPVMDQLKALGATQVTLVTGEKE

SEQ ID NO: 9915 - protein, 187 aa, Myxococcus xanthus
MEGKDAVGYVVAQCAGAILGAGVVLLIAKGMPGGYSAVTEGLATNGYGAASPDGFNMGAAFLTEVALTFLLVLTVLGATDARAPVGFAGLAIGLVLALIHLVGIPVTNTSVNPARSLGPAVFAGSVPMGQLWLFIVAPLLGGATAAAVYRTVFRPAVPISAEEAERALRREREARIAEDRAGTRAPV

SEQ ID NO: 9916 - protein, 87 aa, Myxococcus xanthus
MAGKHLLIIEDIIDTGLTMQFLLENLRARHPASLKVCTLLEKPSRARTKVDIDYKGFVIDDLFVVGYGLDFGEVYRNIPFIGVMKNK

SEQ ID NO: 9917 - protein, 271 aa, Myxococcus xanthus
MRDTLYSNVPFKLNEMPHHYGPHVHLVGNPFLLTQLATLCSKGVIQPQINRLVETLYVDLVKTVLNAEFPRKNVSLPTRMIDSTPQGLYQGEVIDPQVRVVTVNIARAGTLPSQVTYDLMNATLDPTVVRQDHIIMSRMIDAAEAVVGSEIGGAKIGGDVDDAFVLFPDPMGATGGSLSTAISLYKNKVPGTPRRIITLNLIVTPEYLRKMTTDHPDVIIYALRLDRGLSPPEVFGTEPGALWEKERGLDDRQYIVPGGGGFGEIMNNAYV

SEQ ID NO: 9918 - protein, 182 aa, Myxococcus xanthus
MFSGKTEELIRRVQRAVYGKQKVQVFKPRIDNRYDESAVVSHSQHKVLSTAIERAEEIFYRLAPDTQVVGIDEVQFFGSEVVAVVEALANKGLRVICAGLDQDYQGRPFEPMPQLMAVSEYVTKELAICVVCGNPANRSQRIVSSGERVVVGAAGAYEPRCRKCHVAEPAEGTPPQTLELFD

SEQ ID NO: 9919 - protein, 295 aa, Myxococcus xanthus
MNAKHPIAIERISSPTPAFFREHYLEKRRPVVLTGVVSHWPAVTRWSADSFKQRFGDHRVVVERSRASVPSNDPLEFLRNRYYEEARLGDTIARMMSGEHPPGAYYVTYANIFDAAPELLGDFESPPQTWGIPPHYPRALQDRLTLRPGFWLGPAGTVSAVHFDRQENFNAQISGRKKWTLYSPQDSRHLYYPALDMPTVIFSPVDIEAPDARRFPRFAEAQPYETILEPGELLFIPAGWWHHVRTLELSISLNFWWWTLASVGTTARVNYHFARKQLLRILGRQGATAASMPVG

SEQ ID NO: 9920 - protein, 288 aa, Myxococcus xanthus
MQNASNGIERIDNPTPEEFYREFVSKGRPVILTGIASTWPACGRWTPRFFADRFGDTPVQVEVQRSQDPMLHWGEKEVLQTTLARYVELLSSESPKYYLNFASVMAQLPELHRDVGSLDAYQVHHRPYPERVRRKLRLSPIFWFGPAGAFTSLHRDPSDNLLVQVLGRKRLTLFAPEDTPNLYAPWHENCSSGRCLGGYSPVNVAQPDLERFPRLSRARGVDVLLGPGEILFIPIHWWHYVSSVDVSISVSYWWFRRLSQWHWSTAAWVPLRSTLECQVRQWWRARAA

SEQ ID NO: 9921 - protein, 352 aa, Myxococcus xanthus
LTHGNLVHNSHLIGLGMELREGSVAVNWLPPYHDMGLIGGILQPLYNGFHGVLLSPITFLQRPLSWLQAIERHRGTCAGGPNFAFDLCVRKTRPEEREQLDLRTWQVAFCGAEPIRPETLARFARAFEPAGFRPEFFYPCYGLAEATLIAAGGVKAEPVRTGHFDARALQHGQGAPRDEGTGQDTVTLVSSGTQLPTQSLVVVDPQARTLQADGEVGEIWMSGPSVAQGYWGRPEETERVFQARLARGEGPFLRTGDLGFLRDGQLFVTGRAKDLIIIRGRNHYPQDLEQTTEQSHPAIRPGCSAAFSVDVDGEEHLAVAFEVSARQEVSPDDVATSVQQAIAEHHQLGVFR

SEQ ID NO: 9922 - protein, 414 aa, Myxococcus xanthus
MAPSHVQAGVPMEMRECPYAGSRRKHAHPMNVSSLRQFNQHWPAVVGGLAVLRNAYLKQAQRPLDGPITMVDLWKFSRLGVALSAYLLRRGQLPLQDGHLPAVTAILYRMLLGINRVAHLQVLIIISAGLYDQMEALDPAVLYEFTDANELFIGMNSVCAGPRGLIEDSFRVLISGQLPPQADPGPVSALVSRPFLEYGNLLMGLDAQKYLFGVRATSLAHELSRQLSQPRAGEPGPGELAAALEAYQRRTEEQVSSLAREVAAAEQEVRERTVRDLERFRAELDQEQHAISGQGLGAQTRELEALTFPEDTPARVMALLEKARPAGPALRPFAEALTEYLRLERANLAIFERLQGRIEHALGRDGATLQLGNTDVMKAFGPKLRDFASEFFRLDIQSGAQRTVLRHGADTLVL

SEQ ID NO: 9923 - protein, 292 aa, Myxococcus xanthus
MAYRSAILPHVRDKVVADLGCGTGILSMFAAQGGARHVYALEESEVAALARMMFRANGMEDRVTLLTGNSKDIQLPEPVDVIVHEILGIDPFFENVIPYIDDARRRFLRPGQGTLIPHKIEVCCVGVEPEFVPSIAHRARLEAREFSGMYGLDFSPYLHVLEQADEINDDATFPRRANDFRVGFFEQAILSEECVVRTIDLAGDLEAQTAGETLSSLKIRAGGRLGSLLMFFRAHLDDRLVLSTSPFSPRTHWGWAVRDLPRALSVNAGDEITLTSSLLTVAGRQKLKVLPK

SEQ ID NO: 9924 - protein, 287 aa, Myxococcus xanthus
MPGGARLQEEVRRFIADVQRDHTYSGVNTYLGNTVMKTLLPLLQRAATEQVAPPDDQTVRMMEMFHAHLRRRVQGRLVDYFERPPLLGRDVPDTVFALSQGVSDCMRWRGIPLFKTVYDLALYPRLLSDLRPRTIFESESANGGGALWLADQLTALELDCHIHTYDLVKPDVSHPRVSFMQGDSHKIQKVFTPELLRAAPHPWLFIEDAHVNVDGILTYLHEYLRPGDYVIVEDPESGRVSGEESLVEDQLGRFLWHHREAYRVDTFYTDFFGYNASCAMDAIFKRV

SEQ ID NO: 9925 - protein, 197 aa, Myxococcus xanthus
MRWLIPAAGLATLTGCNVSSEFLQRMEHQAKYEYYEASDFWADGRAMRTPPVGTVPRERFEKLPELKDPTQRQVALTGRSAGQPVAHLPITVDQNLLTLGQKKYNIVCSQCHGVLGDGNSIVAENMALRLPPSLLDLESKSDGHFYVAINEGYGVMPSFSGELDLRERWAVVAYVRALQTARNTRTDGQQPVPQENR

SEQ ID NO: 9926 - protein, 367 aa, Myxococcus xanthus
MELLPLDWLNEHLGSNNAVSLKGGEGKVDLDLRIKDGGLADDSRIDVQGQELNVRAGPIRARAPWALKASLASESQDARKGTATLSFAPVRVSGPEGTGAEVPEITLTVLARRSAEQSDWELEPDLRVARSRPLDLRMLNPWLARTMEIDSGFMTVQSREQSKFAKVQDSLRLSVDSDLVSGRMGNIKVLLRAEADVDARNLSWDTKSLALTGTTLRLTNVSTNGPVPIRAWSGVFTLPQARLSLSPTVLSAHFASKLTDTQPVAALLTSAKNLPRFLTSLLNIRDVTVTGRVQIDEGGLQLRELKADGDGFSLQGHLDLAGGELQGALLATLGALTGGIEFKPGGQDLHLLNAKQWFAKQPEPPFR

SEQ ID NO: 9927 - protein, 581 aa, Myxococcus xanthus
MPSPSRSVQTLTDLLRWRASNQTEARAYTFLQDGEGQETTWTYGDLDRQARAIAAALQEHKGAGERALLLYPPGLEYIAAFFGSLYAGVAAVPAYPPAQLQAVTRILSILQDAKPRFALTTHEILESVNALAEAYPVLKDIRWIATDALEDGLEDGWKRPAITGDTLAFLQYTSGSTSTPKGVMVLHRNLMSNEEMIRQGFSHDDPPTICGWLPLYHDMGLIGTVLQPMYLGSHSIVMSPWSFLQRPIRWLNTITKYRATTSGGPNFAYALCTRKVKPEKLASLDLSSWRVAFNGAEPVRAETLVEFADTFAPAGFRREAFYPCYGLAEATLFVSGGITSELPRHLTVDSAALEQNRAVAAQPGPSARTLVSSGRSWGDSLIRIVNPETLVACAPGEVGEIWTAGPHVTHGYWGREETNAETFQARIQGSEEGPFLRTGDLGFMIDGDLYVTGRIKDLIIVDGRNHYPQDLELTAESQHPALRPGCSVAFSVDHPEGERLVVLVEVSARFAPSEQGDGAQSLNGSALQKTIRQAVAAAHSVDVHEVVLLQQGEVLKTSSGKVQRRACRAKYVEGSLQRWAA

SEQ ID NO: 9928 - protein, 86 aa, Myxococcus xanthus
MLPLAYTIAGPLADHAFEPAMASGGKLVPLLGAFVGEGPGRGIALMFLIAGVLAVLMTLLATLYRPLRELDVPPQDAPSAEPAASP

SEQ ID NO: 9929 - protein, 188 aa, Myxococcus xanthus
QQFRKQGKSIAFVGILNTTVPVNEAPPSEAPPFADADWMASVASTAGRLYGVDLGISAEALRPLSAEARREYLTHRLVQAGLLPDGADSQQVQGFIDVYKAAYEIDYVPRDTFPVPVALFRAQERHEEDGIVPESFADDPSWGWGRHASTAVTPVTVPGDHMTMLAAPHVQVLAEFVRQGLVRAGAIR

SEQ ID NO: 9930 - protein, 299 aa, Myxococcus xanthus
LKTGVRDFGVFVDLGGVEGMIPVSELSYTRVGHPSDVVKVGDDVEVEILRMEAGQPNSPDKSKQKERITLSMRSRQEDPFQKALSEIKEGDRLQGKVVRLQQFGAFVELRPGVDGLVHISALSDRRIAHPRDVVKEGETIWVSVEKIDTQEKRIGLRRISEEEAQRPPEERTAPAAEAAAPAQPATPRPKVGQVVVGKVDRIEPYGVFLAFPGGKGLLPASETGTERGTDLRKHYSLGQEVKVAILDIDASGKIRLSVTAAIRAEERAEVEAWQKTQQPQGAGKKGFGTFADLLSKARK

SEQ ID NO: 9931 - protein, 314 aa, Myxococcus xanthus
MDADITHVLLVGGTGRFGGRLASALLARPGIHLHVLVRPGTRSDALVRLAEHGVTLVSGTLDDMRSLDSALEGVDAVVSAVSGPPEVQVAGQLRLLDSARRHGVIRFIPSDYSLDYTDADAGDAFMDAHRRVADAVVKSGVPHSFVLCGAFMETALSPQAQVFDFERGVVSYWGTGDEPFDVTAMADAARWVAEVVVDPHAAGRRLEFVGDVATVNDVAALYEALTGQRLRRLCRGSVEDLRRQLVRARPEGVSVQVSSAELSLLSQLAGKGRLREPANAEYPRLRPMTLRDFLEARWMVSTSARATLPLASQP

SEQ ID NO: 9932 - protein, 1300 aa, Myxococcus xanthus
MQMYLFAGARNSRLTANAPAEVAGDYEGGVSSTFGPQTFNVTGDVVAALDAVNTAGPTDRDGCTALTNAAEVVGKIAIIDRGTCGFVDKVTNAQNAGAIGVIIHDNVAGPTIDLGGDSTTITIPTLRVNLDDGNVLRSGLPALNVTLWRGPTAWIDGTIDNAIVAHEWGHYISNRLVANSSGLVNNQGRSMGEGWGDFTALLMMVRAEDINVPSNANWNGAYAAAGYATRADANSEFFGIRRGTYSSDQTKNALSFRHIMDGVALPTGVPFNGNTGQPNSQVHNSGEIWATMLWECYTSLLRAHPFQEAQDRMKSYLVNGYKLTPAAPTYLEARDAVIAAAYANDPADAERFWTAFAKRGAGVGAVAPDRYSTNHAGVVESFVVGSAIQIVSAEFIDDVEAGSCDLDGILDNGETGRIEVTVRNAGALPASASSVNLSSAFSGLEFGNGGQASFPAIPVFGTATVSIPVSLTGATGQQDVTIDIAARDAGQAIPGDITDSIILTTHFDERENSSNIEDVQISPSKLPWETEYDEALTPAAFSVVTFPDGNRTFYAENTASYADVRLISPELHVSATEPFVINFMHAWDFEDDYDGATVEISEDGGQTWVDIGDPIHNSVLETYPGNLNPLAGKPALSSYNPQFPGMLPATIDLGTAYAGKTVQVRFRVGTDESGGYTGWLLDDLEFNGITNTPFATIAPEDGVCVNPWPIANAGPDRSIAPGELVSLYGSAADPEGQPVTFTWAQTSGPAVTLAGANTLNPSFTAPQVTESTALVFTLTVSDGVKTSTDSVTVTVALPNNPPTVNAGLDGIVEERAEYTLSGSASDADGNALTYLWTQVSGTPVAVKDYTTPTATFIAPEVTLDESLVFRLTVSDGIATVNDTVTVTVTNANRAPIVSDTSVAFAAGTVTVTASAVDPDGDALSYSWEQTGGSTVAINGADTSAISFATPVPGSYEFTVTATDGSASASKAVPVTIIDGSLPANSAPTVNAGIDATANAGDVVTLSGSASDAEGDTLTYHWEQIGGTDVTLTGADTLTPSFTAPSTASGTTLGFILTVSDGTSTTSDAVRVIVAADPGANPSNTAPEADAGESAIVAEGATVTLNGTATDADGDTLVIVWTQIGGTPVTLSDASSLTPTFTAPASSDPLTFLLMVSDGTATVVDVTSISVTEENVAPVASARAVLSGNQTSATLDGSASSDANGDVLTYRWTQVSGPNATISGADQAVAVVNLPDLDDKTASFSFRLTVKDSAGTESSTTVQFSARNGGDSGGCSATGAGAPVGMIGLALLGLLRRRRLN

SEQ ID NO: 9933 - protein, 290 aa, Myxococcus xanthus
MTRTVADAAALLSVLAGVDPSDGATGASRGKAHADYTRFLDVDGLKGARIGVPRERFFGYHPATDALVEEALALMKSRGAILVDPAPIPAVAQVDAPELEVLLYEFKAGLEAYLATLEEGTAPRTLAELIRYNEAHAPSELPYFGQELFHMAQAKGPLTDKAYLKALQACRRLSRAQGLDAVMKKHQLDALVAPTQAPVGLIDPINGDHWLGSSSTPAAVSGYASITVPAGFVYGLPVGLSFIGGAWSEPVLLKLAHAYEHASKHRRPPTFAETADLRVHAGAGSPPAKP

SEQ ID NO: 9934 - protein, 313 aa, Myxococcus xanthus
MAELELADTIGDTPKTVEELAEASGTHAPTLRRLLRLLSGLGVLVKDESTQRWALTELGGMLRKDNPGSVYGSLRAHGHILSWQAWGDLVTALKTGKPTVEKFMGDTFFNYMTTHPDVAAIFNGSMAAYQTLNAPAVVNGYDFSSARSIVDVGGGTGMLLTHILKANPGVRGTVFEMPHVAVEARERIAEQGLSPRCDVVAGDFFECIVPEGKDVYILSQILHDWDDEQSLRILKCIRAAMRPDSRLLIVETVLPGDNVPHFGNLYDLAMLVLVGGRERTGPEYTALLEKAGLRLFNVFPTTMPPSVVEAVVA

SEQ ID NO: 9935 - protein, 106 aa, Myxococcus xanthus
MSAFLDTILAFPTAIFTIVLGVVMTYWLFVIAGAVGIDLFDGDITLESGGKALSGAIEGGGKALGGAIEGGGKALGGAIEGGGKALSGAIEGGGKALGGREGAGRP

SEQ ID NO: 9936 - protein, 415 aa, Myxococcus xanthus
MSPPVTNSHTNFGPYTGTPKLMVPAFAVGILCLLATLGGFFATDAKGETAHAYLIGFTYWVGISVAFLIMQAIFHTAKAKWLIVLRRTMETASAVIPVFFVLALTLLAMATYLYPWWEGSELTKGYSSLELEHLSHKQHGYLNNHLSFPPGVGIRHIIYFGVWTFAAWRPSVRGDLKQHTEGGLDFTVKQRKFSPGVLPFLALTITFASFDWLMSLTPLWQSTIFGVYYFAGSFLAAFCILTIVTVSAQGKDLYGSVVKLDHFHNLGKLMLAFTAFWAYIAFSQFMLVWIANIPEEAPWYGLRMFGPWRSMSIALFFLHFLLPFGILLSRKLKLQPRKLAVVAVYLLIIHAVDLYWLVWPALTGDAGPTFHWSLLTAFFGVGGIAVGFALYLARGHYTLTVKDPYIAESLRYVQP

SEQ ID NO: 9937 - protein, 171 aa, Myxococcus xanthus
MGFAGIPITVSVSFVAFIAWLLSVVSAQPLHEALGGMMPSWLLSSGLGLACFAAGTVTAGFAVRPLRPVFVTRRAPGRDALMGRVCTISSGSVTAKTGHATFEDGGAGVILNVVCAKPNELKRGQPALILAYDAERRVYEVEPVDWLLPEEMEQLQDPARAAALARVKARG

SEQ ID NO: 9938 - protein, 434 aa, Myxococcus xanthus
AMDPITAVAAGIGGIILLGGILLTIVRLYRQVDQGKVLIVNTLKNEPVVTFTGAVVFPIINRAEVMDISLKTVEIDRRGKEGLICRDNIRGDIKVTFFVRVNKTREDVLKVAQTIGCARASDQETLENLFEAKFSEALKTVGKSFDFEELYTKREEIKDQVVNVIGRDLSGYMLEDCAIDFLEQTPVEMLDKDNILDAQGIRKITELTTKQNVFTNELRQDERMAVTKRNVEADEAIFALERQREEAAAKQKREIDSIQARETAEAERVKQEEYAKAQLARIKAEEEININEQNKARQIEVAQKNRERVVGVETERVEKDRALEAINRERETELQRIAKEKALEGEKKLIADVVRARIAVEKTVAEEEERIKDLRVKAEATRRKDALLITAEAQAQEKLVKDIKAAEASNEVAKFTAKEKLTLAEAELEAADKT

SEQ ID NO: 9939 - protein, 277 aa, Myxococcus xanthus
MAQKDPVLALRRFEAAYIDQRYPPKPTPTQVSETCERILDALLGEDGEAEILDHPWARLHVVTALCRGAVGMEGPGAQLFGLVLCALGNLVSRRTLGLHMERVIFHTAGDTSPFTGLNDLPSTHLPLTRENLRLALLASGSIPLLFSGVRIPGAPAGVFRDGGVVDYHLDLDFGPGTGLVLYPHFYPYVVPGWFDKSLRWRRARPQNFRRALLIAPSPELVARLPGGRIPDRVDFERMKDAERMRAWNQVVSESERMGDALHELMATGRLAEHVRPL

SEQ ID NO: 9940 - protein, 112 aa, Myxococcus xanthus
MREDPGGPVVILNLVRFKEGGRASYEAYASAVMPFIQKVGAQPLYAGDGSTALVADPGQTWDAVLLVRYPSRAAFLQMVADPEYQHIAHLRTEALQEAVLQATTPWATSPEP

SEQ ID NO: 9941 - protein, 207 aa, Myxococcus xanthus
MGTFQASRGFAFIFTHEGRATLEARFPFLVPYLAHVLDPLHATGLLPWHERLWGSRRERPAPNAFYLNLLLLDAGRGVGRHIDATLQEPSGVPDATPRHVSVLYLQVPERAQGGELRLLQNDTPVGEIRPREGLLVHFRGDLQHEVRPFTGSQEGATRASLVCEQYVFPPEALARIPAFRIQSKAGFAAYLDHQREQPGGSSVGTLE

SEQ ID NO: 9942 - protein, 49 aa, Myxococcus xanthus
MFERGQVVNTWFDSVDELAETRSGSLHCSEKALLNMLDTSRQRRRRADH

SEQ ID NO: 9943 - protein, 107 aa, Myxococcus xanthus
MKQGKRVPGLKWVIAAFILAGCRGAEGEVPTETESRLSLKEGQVLGPACTGEQKQCPEGLSCASFNLGSGPEIRCVQSPEICDLFKCSSGECVVLESHPIQVRCSGS

SEQ ID NO: 9944 - protein, 62 aa, Myxococcus xanthus
MLTASMETYGAVSPAVLTRARGFAACRAVADIAFGQTQGRPEYIAAGQRALTGLGKHPPFDA

SEQ ID NO: 9945 - protein, 250 aa, Myxococcus xanthus
MQLASTWEFVGWQGGDDTGPIGHVPETTWADRGVDLDGPAISPAATEVPLASAWDFIQQPWQPTAAEPSDVITTLLAAAASGATEVPVGGPSVTAEHVLSALDVVSTQGTLGRVVLAYCAGRFQRAFLLGESLGLARVGHAWGPGSDSAAVAQLKVDLEAPSLLHTAMTSAGASVFDAPACPQDEAIFAALGGEGASRLAVIAIRSRGQAVAFIVADHGAEPIAALALDELTRIAQKASEAFSRLPTRSA

SEQ ID NO: 9946 - protein, 113 aa, Myxococcus xanthus
MAPPYQRHVFVCTNRRPDGNPKGCCASKGAEEVRAAFKAELDKRGLKGGMRANAAGCLDTCSFGVAVVVYPEGTWYGGVKVEDVKDIVEQHLMEGRPVERLLMPFSRKTVTSG

SEQ ID NO: 9947 - protein, 155 aa, Myxococcus xanthus
MKKTQVELESRVIVGAHGVAAEEDHLVMGKVVGVGVGALAIFAVGIVWAYTIQVRTMADIQPEGPPPRPAAMGQYEVGIVNQRLFEQDWHAVDKISGQDQALRAGWGNEPGVKQHPGIDDAMKTVIEQKRNPPPAPTPTPTPETTPGQTPPAPQQ

SEQ ID NO: 9948 - protein, 568 aa, Myxococcus xanthus
MTAFQDAALAAEWAAGVAYSVGTRVTYQGRLYECRQPHTSQADWTPVAVASLWLDLGPAGGGEPDAGSGGTDAGTGGDVTAPTVGLSASASRIIAVGPLSLTATATDDVGVTRVEILENGAVVATGSQFSRAFSGWEQNGTYVYAVRAYDAAGNVGTTTLTVVVEIPGGPPPGGKRIVGYFTAWGIYARNYHVSNVQPSKLTHINYAFSNISGDGRCILGDPFADIDKSGGWQGEWDPGQLRGNFRAFKEMKRQNPHLKLLISVGGWSWSTHFSTVASSPASRAAFVKSCVDLYIRGQYPGVDPVNGEGVFDGIDIDWEYPVGGGLPGNSNSPADKQNYTLLMQEFRSQLNAVTTQTGKPYLLTIATGASPDLLENKQETKKLSDVLDWINVMSYDYHGAFESTVNFHSALHRVTGDPGAATGFYTDGSVSKMLALGVPPAKIVVGVPFYGRGWGSVPNVNNGLFQSGVPTRGTWDDGSSGLTGVFDFKDIKANYERPGSGYTKFFHPEAKEAYVYNPATGIWIGYDDVQSINAKADYILNKNLGGAMFWELSGDDGSLLDALARKLR

SEQ ID NO: 9949 - protein, 397 aa, Myxococcus xanthus
MSFAAAVLLVVLSSSSVAAEPWTAVVRVASDEDTALLVRVRGQSSDLPVRLEVSSGAPLGEFREGPWLAAERLAGRHQARAVLWFVREGSDVRVQVAEFDSRRLFSRAARMGQSPGSLEWSTGAEALALAARSALRAVEAGAPLGDVVELALPRHTSNGEGTDTGVGHRIDDAASSDGAALGTPSSEGADVALAEAVGSASAREGVTSPREGPRLASAEEYPARQMWLTLGGHAALDGYTRTGHQGVMVGVGLQPGRWRLRAQVLASVPTRLRDARTELTLGQHAASVWAGLPWAASERLDVEAGLGAGAVVFTRRTQALTEEVEAAPPGTMLALLMGPELRARWRMGARVGLEASMAAEVLLGRPELRYAIDGNFVSRGAGWAVRPRLGLAMVVFL

SEQ ID NO: 9950 - protein, 162 aa, Myxococcus xanthus
MELLPRVRNLVRYLVRGDVDVEDIAQEALIALVRGLPSYRAEGRFQSWADRVVARTTFAWLKRSRGRDAQHADAPVELVAVPSEDALPDEYVHRRHMVTLLDRLSNEQRHALVLHHVLELSVPEISTELGIPFETVRSRLRLGRTALRSLATAEGDGGEERG

SEQ ID NO: 9951 - protein, 231 aa, Myxococcus xanthus
MKWEVKAGIAGLLFGSMLVGCGVAPEQGELGGLEDVTAESSASAETGLDAHRGYSTPVAVARYGHAVAYGDGKYFAVWADVRTGGIYGTRVKPDGTVLDPRGIRINFGEEIGRRPAIAFNGTHFFVVWDTINGVDGVRVKPDGTVVGPMFLAVQSDEVFDPARVACSPKICLVTYTVAGDDSSTIYFTRVSKDGVILSTDDHTLNASNTFADDASSTWNNSKKEFLVVWSV

SEQ ID NO: 9952 - protein, 757 aa, Myxococcus xanthus
MDSILTLARTEGMLFKYGSGTGSNLSTIRGSKELLAGGGTASGPVSFMRGFDAFAGVIKSGGKTRRAAKMVILNAEHPDILEFIRCKSSEEKKAWALIEAGYDPSFNGEAYSSVFFQNSNNSVRVTDAFMKAVVDDATWTTRSVRDGQPLDTYQARELFREISEAAHLCGDPGMQFDTTVNSWHTCSTTARINASNPCSEYMFLDDSACNLASLNLMHFRTIDGDFDVTAFRHAVDILLMAQEIIVGNSRYPTERIEKNSHDYRPLGLGYANLGALLMASGLPYDSPAGRNYAGAITSLMCGEAYAMSARLAEKQGPFAGYAKNAEPMLGVIRKHRKAAYHIAPEGVSQGLFAAQKDAWDRALALGEEHGFRNSQVTVLAPTGTIGFMMDCDTTGIEPDIALIKYKKLVGGGMLKIVNQTVPLALEKLGYPQTQSQDIISYLDKQDTIEGAPHLKPEHLPVFDCAFKPAQGERSIHWMGHIQMMEACQPFLSGAISKTVNMPSDATVEDIEKAYMEAWKRGLKAIAVYRDGCKRTQPLNTSKETVKDTRAAKATVAPEPAPAVQPEPRAVRRRLPDERRSITHKFSIGGHEGYLTVGMYEDGLPGELFIVMAKEGSVVSGLMDSFATSVSLALQYGVPLKVLVDKLSHTRFEPSGFTGNPDIPIAKSITDYIFRWLELKFLPSEEEDAVLDRVDVQPKREALPARTASVQRSDANTSKRSTWLNQADAPPCHTCGAIMVRSGACYKCSNCGATSGCS

SEQ ID NO: 9953 - protein, 118 aa, Myxococcus xanthus
MWAIGGASVRWELRSRYGNRQTCYEAGLQRVGINFRDIHTGELVYGDVGDCHDCVDGPNESSVVVYQFLRPGRYVVEMYASARDGREYFSPNNSPVIDVVAHQFPGPNSSLPVYLIED

SEQ ID NO: 9954 - protein, 271 aa, Myxococcus xanthus
MRQGSHSPIGVFDSGVGGLTVLKALMARLPHESTVYLGDTARVPYGTKSGEVVTRYSLKNAEFLLERGIKLLVVACNTASAVALPALEAALPVPVVGVILPGARAALARTQGGGVGIIGTPGTIRSGAYQRALESADPRVRAKARACPLFVPLAEEGWTTGDVPLLVARDYLAEFTRDGVDTLVLGCTHYPLLKGVIAEVVGPQVALVDSAEATADAVAALLSERDGLAPASRGTPEHAYYVTDVPERFMEVGARFLGRPITAAEQVDLTF

SEQ ID NO: 9955 - protein, 188 aa, Myxococcus xanthus
MTKTFEKAVTGFNHNIKHKGKVYHVQTEDSGVNNPHIITHLFVGGNILASKKTSYADILNAENLAEVVRELMEEQHKEMLRNLINGVYDSYESTARSYQPGQLAADTDPAQVKLQPGQSMVQRPPPPPPPVAVPAPVVVPPEVAAARALKEKPKINEIGVETLFGEDLISEKSLDEVILSYLAGEGEQ

SEQ ID NO: 9956 - protein, 293 aa, Myxococcus xanthus
MMSTRSYILPRACRAGFLAAAALVLAVAVPAFAMPGAGKTPRAILEAQQDLPPPIQGVDVQEHLGELVPMDTRFLDASGREVRLGDVVPKARPTLLTLVYYNCPMLCNLVLNAQVQSMKELGLELGKDYEAVTVSIDPDDTPAQSMERRRRHLQSMGKPETAPWHFLTGTDAEIRRLADALGFKYTYDESTKQYAHAAVVHVLTPEGSISRYLYGTTFPPSDMKLALLEAANGRVGTSFDQIILSCFKYDTASRRYGFYIFGFIRLGGIAVFCALATMLIYFWRRELKKGAAA

SEQ ID NO: 9957 - protein, 376 aa, Myxococcus xanthus
MSRRLLLLALGLWASTATAAQATAAEEAEQAAVRERLSAQRATLALVEAKKLSVLEGVELMQEMAAFSRRRVRSLEGDLAVFRRRVLLAEREQAVLAEALKLQLRRLSPRLRTLYRLMRRRPLEVLLSAEDFAALVWRARALEASMSGDLELLRTVQRVARLQRQATRELERLQASLAARMAFLQEQERLARMQQEGLEEVVGTLAGEAELARRAVRELEQADAELTRMVQDLKELPATSGFGALRGRLPRPVSGIVEVGFGKVVNPRFNTVTVQKGLDIRAAAGTPVRAVAEGTVAYAGALRGYGNLLILDHGDGYHTLMAHLSSITPELGGVVLPGDVVGEVGDTGSLKGAYLYFEVRKGGQAVDPALWLVPGS

SEQ ID NO: 9958 - protein, 286 aa, Myxococcus xanthus
MDLMGGMQKALRHMLVARGVESTTVQVGAQTVHHYALTGQGKGPPVVLVHGLGGSANGFGRTLFGMAKRFSRVYAPDLPGHGFSVEYCGGEVCVRNQFDVLRAYVEEVVKAPAFVVGNSLGGAMAVNLAAEYPEWVRALALVAPAGAQLPEAENTALLNSFVVKSPAEARAFTRRLFHRPPLPALLFAYELRHFYDTPTVRALTAEALATRACLEPEQVRNLAMPLLFLWGGSERLLPSETLKWYRAHLPAHAQVRVVDGFGHVPQLERPDELVSHLVRFADSAEL

SEQ ID NO: 9959 - protein, 376 aa, Myxococcus xanthus
MLETLDPHTVFLPPDVYREMKIDTSGEWGGLGIEIARKGERIVVVAPIDDTPAARAGIKAGDELVGIDGERTEGMDVGRALQKMRGPAGGRVLLTIMREGFSAPREIAIIRDHIRIVSVEGALHGGIGHVKVKNFQDRTDLYLRKELDRLRALNGGKELRGLVLDLRNNPGGLLDQAVAVSDRFLPGNLPIVSTRGRDGRSATVERSKDRDTEKDYPVVVLVNAGSASASEIVAGALQDHGRATILGAPTFGKGSVQTVIELEDGSGLKLTIARYYTPKGRSIQERGITPDFLVPDEPGGKVPRDVVREKDLRRHFRAEPTAATEPAAPEPRGLPENLKPWDVTAKLEDYALRVALDYLHGMASAPARTPSRAAGR

SEQ ID NO: 9960 - protein, 494 aa, Myxococcus xanthus
MKAGQRAYDELDTEKALEHFDKAVRGYEGADLSQRFTELSRARVMKAASQVANGENTAAQLEIRTALALNPEARFSPNFFPPEEMTFVEKERKAVLTGTKSSLRVSTEPVPAQVFVDGQFRGISPVDVADLTAADHYVTVVAPGYALTQRRERDGEVSLTLAPVAAQKGLQTFTEQAARKPESPERDAALRELGTLAGLSQVLALLVLRVAGTAPLEVTALRLDVSDGHNQAFALGTVPRGEGLVDGSQALLAQLVSADAPRQGGKPVTHFAGGVSNTRRTVGYVLMATGVALLAGGVYFGMEASAKSDDFKRAAQNSSRAQDLKSTGKSYALVADVGILLGLASAGAGGYLAFANGGGGGSKSTSRASRPAPSPVPAAAPQDTPPAPKEAPAAEKEPLPMPPPPAQTALASKQKEPSTSNKRAQEDEARQREEELRKRREEVERQRKELEERRKQEEAAAQREQEERRRQEERRREEEKKKRPALDDDDLRNY

SEQ ID NO: 9961 - protein, 106 aa, Myxococcus xanthus
MALSTGLSACSLLVDFDEEGQPCDELNQCLEGYTCVDNACAPDDGAPSDGGSDAGTDGGLNTDGGLTTDSGTLDPDAGSEELDAGLPDDAGTTEPGPVLEPEFPAS

SEQ ID NO: 9962 - protein, 56 aa, Myxococcus xanthus
GKRVGVLMGGWGEEREISLKTGEAVVAALESRGHQVTRIFAGPGLDRALRAGRTGR

SEQ ID NO: 9963 - protein, 66 aa, Myxococcus xanthus
SMKSCCAVLVAALFLGACVATKPSVTYSSFGEARLAKDAAVVQRYEADYDRRHPSFPSMTGNQFQI

SEQ ID NO: 9964 - protein, 192 aa, Myxococcus xanthus
MATGAAFSPDGKRIAYSLAEGESAQVYVANADGSGARALTDTPYGLNTSPTWSPDGKRIAFVSNRGGSPQVYIMNADGTGVRRLTFQGNYNQTPDWSPRGDLIVFTARDERNAFDLFTVSVETGKVTRLTQDQGSNEEPAFSPNGRLIVFTSTRNGGSQLYVMTADGNNQLPLRTEKGTYQTPDWSPLPQAQ

SEQ ID NO: 9965 - protein, 245 aa, Myxococcus xanthus
MSRFVVVSVVGHILVLVAAIAYARFSATPKVDLDTKPIRATLVRLGKPRDSKLLPRKEQLPPPPKKVDAPKPAPEAPPPEPSPAKVAVPIPGVQPEPSTSKPTPQKGETTGEDRRKRLFGAFDKTAKAAEPEEAEGAEDGDPDGDSATAEGERYFGLLQSQVRRHYSVADTIPESERLHLKAMVAVRLSRTGEVLDVSLTKASGNDLFDSAVVTDVRKAAPFSPPPDHLRNALQKSGVNLVFNAL

SEQ ID NO: 9966 - protein, 155 aa, Myxococcus xanthus
MGMGGGNRGGGRTTMSEINVTPMVDVMLVLLIIFMVTAPLIQQGVKVNLPETKAAPVEATEKKLVLSIDAGRKVYIGDAEVALEELEQKLAANAKAQADKEVYLHADRDVPYGVVVEVMAAAQRAGIGNVGMITDPSTAGRTSNTGKGKSKEAKR

SEQ ID NO: 9967 - protein, 348 aa, Myxococcus xanthus
MSELLNNILFLPEAASTFAERIDSLHHFVVGTTMVMSTAVGLAALFFFFRYRRRLPAQATEYIVPTLKTEFLFVSVPLVFFLAWFGIGFRDFTWVTTPPKDSMDVYVMGKQWMWKFSYPEGPNGVNVLHVPVNRPVRLLITSRDVLHSFYVPAFRIKMDALPGRYTQIWFEATKPGTYQVLCTEYCGLSHSKMLAEVVVLPQEEYENWIQEQRRGRLQDRQDALADNSLVPPVARMVEQGQVLAGTQGCLKCHSVDGSQHIGPTFLGMYDRVEKLDDGQTIRVDEAYITQSMMDPGAHLVAGYQNVMPTYQGKLQGPETAAIVEYIKSLRTPNVREGASEGPAYDAIQ

SEQ ID NO: 9968 - protein, 236 aa, Myxococcus xanthus
MTPHLPLALGAMNYVEIIRDASLIELAVLLLLMGVSVASWALIAMKASQLAKARAQSLTFLDTFWKASRLEAIYQTAQKLDGSPLSKVFCAGYEELTKLAQAKEGGTEGALAERLGGIENVERALHRASTAQITELENRVSFLGTVGAASPFVGLFGTVIGILSAFNQIAEQGNATLATVAAPVGNALFATAAGLFAAIPAVVAYNSFVSRIKVFDTEMSNFSADFLNIIKRHFFR

SEQ ID NO: 9969 - protein, 253 aa, Myxococcus xanthus
MEIAAIVSFVSLEVALVYRLWGTPYAGTWLLLSAVLLGYLAADFVSGFVHWMGDTWGSTEMPVLGKALIRPFREHHVDEKAITRHDFVETNGNNCLISLPVAIIALCLPMSGPGWVFCASFLGAMIFWVMATNQFHKWSHMDSPPALVGFLQRVHLILPPDHHRIHHTKPYNKYYCITVGWMNKPLTMVHFFPTAERLITWATGLLPRQDDIGAEAARALVVAAGGSEAPVVQAAKELLTQATVQEKPASTRP

SEQ ID NO: 9970 - protein, 215 aa, Myxococcus xanthus
FIVKGDSAGGSAKQGRDRRTQAILPLRGKVLNAEQASTDKVTTNKELQDIVSALGCGIGSDFDISKLRYGRVFLLMDADSDGHHIATLLLTFFYRHLRPLIESGAIHIAQPPLYRVDIGKETYWALDEPDRDRIIKEKTKGNAKPNIMRFKGLGEMTPDELKETTLDPKHRMSLRVTIDKPLETDRLINDLMGKDVSARFRFIMERASEVQDLDV

SEQ ID NO: 9971 - protein, 475 aa, Myxococcus xanthus
MLATSPAYGQSTRKKKSSKKPPATTQPVKTTKAPAADDADGDESVEPQAFGSPNGDEETAVTPLVSPDAPTVAKPAAAPGASGEPAVASAAVTASGPVALFAVARTSAEEDAAVKLEDELLSRLKASGVALVDLGAAFPPSPPVSLTRADTLFEQGRTDYDNLDPESAEAKFLAAAEAYTKHPAELSPERLAKAYLFLGASRMLNGDSTGALDAFKRAVVAEPSTSPDAALFGQDVLKTFDQARADVKARPAGTLVVESKPAGASVLVRGQELGVTPLKGVEMPAGQHPVVVSLPGYSAFSQYTEVASAKSTEVKATLEPTPGLSAVRDAAVHASTEQAFERDTPPPEARAIGERLNARYVVLAAVARGDKGHLQAELQAWDLRSNARLRGVEIALAPGAKKNGPDAAADQVRAFVNGVAAPRVAESNSFSTLIKRPWFWAVVGGAAAVTAGAVYVATSQDKGRPFNPVSGGVGF

SEQ ID NO: 9972 - protein, 370 aa, Myxococcus xanthus
MDPASEASSVQMEGYMNDALSNFAGMTVRKSEELFGMPEDPEAKASLERGRKGYSESLSAFDKKEYEEAERKVRATLKELQGAAGAMRGCSPLCDALALYAAVLHLRGEVEEAKLALIDLIALSPTHELSPKRFSREFLALRVQVATSRTSQLRGSATVNSRPSGARVYVDGEVVGYTPVTLPALPIGKHLLRVERPGFRQYGQFMEVATDDAEVTAKLVPTSAYKAFDVQLDRVAGEVNRAGEKASGVAAMAQSLGLDRVMVGTLRANGEGTDLTLGYYDARTGQRLAGRRMAVQGDEFGQLKQEMERVVNHLVNNIGEKVTKSRDPLDNRGGMEDWSSEDRGGRGKAQDKKSKPGDDPLDGVSGTEDW

SEQ ID NO: 9973 - protein, 785 aa, Myxococcus xanthus
MKPPPCRCNPAGLGFVNGSQLFYLHERNLVHDGLGDGVFLATRLLGLGLGGAMEWIRGRAEPDYRRTSLGLSLGTRTLQLGGSWHAYGSSHRDIDALDTFDVGLTARPMRALSLGAVVRDINAPTEGTLALKRQYNLGVGVRPLDERYTLGVDWLFSEGAFRQGQATYTVNAEVIPGLRLGAGVSHGFTSGVPIALQVAATVDTSHLGLTYAAGGTNAGLDHLVAVRLSSETYRSIAPRGGVVTLLDLNDALSGGTSPVLSWLGVTEADPYLRLTRWLDLATQDDRLAGVVVKMESLPGVSWGKAEELRQALLRLRASGKRVMAVVLSTDDLGYFVASAADRIYALQESILYINGLAVHLQTYGGTMEKLGVHWDVARVGRFKTAPEQLSRTEPSDASLESTNAYLDTEVAVYEKAVQEGRKVPVERLHALWALGLPHPKRAVELGLMDGIISSTELDKKVAELVPGGRFSTTYAPRDERDGRWARRRRIAVVPVLGDIIGGRSREDPLGFSRLAGAETVIRALEQAQSDPSVAAIVVRVDSGGGEVLASHLMYEAVMEAAKHKPVVASMGDMAASGGYYAAIGAHEVFALPTTLTGSIGVFYIKPAVEGLLSGLLGVHQESLTRAPLADILDVWRPWTPEEQEAAQAWADASYDSFITEVALRRRMDKAKVDEVARGRVWSGQDALARGLVDKLGGLLEAVDSARMRAGIPPDEELDLVVMGEARGFFSALGGEPGVRAALSLLPAQEPALPESLRALARSAGLNLMLLQPGVKAMLPFQITVR

SEQ ID NO: 9974 - protein, 89 aa, Myxococcus xanthus
MIQGSGRCHYHPERAGLGVCVECRRVICRECTTQFEGINRCASCLDQRLKALEGPGERREWSAGNVVLALMSLALVFGGILLLAQVAAS

SEQ ID NO: 9975 - protein, 619 aa, Myxococcus xanthus
MDAALRLCTRNAGVWALTLPGGAAVVAAMLYLAESVRMGWPLVVPSLLLTLAWFLRGLGQGATCHYVQELLLGTQGEPSAWASLKAALARMPALFIAVAYLLGLNTLVVMVTGGFGYILLQSHGVGYAAVMQGRGSPLKLYGTCSRLLGPARGTALWVRALMSVQVLAFFNLHIAFNFLLFLGRKLVGVDLTFAERFASLDNGQWLIFLAVTTFALFEPVRAATATLLLVDGRVRQEGLDLLASVQQLPSRDLGRPLPPPGAARGAAMLAVVLGLGLLTAAPAHAQDTEDAKPLAPSEALRRLGEVAEACEASADEDAADLYAPLESLGPGEAVKLDRFVRRVERQAFDEEDCDKARATLTQGLTTMGATVDAQARADARAATARAKDILARPEFAEAAPKAEKDAPEPAAPPETPGWWQRFIDWLGEQLKKLFEREPAESRQQTAQPILSGMNVANVLVVVLVTLTLAVLGMVLLRALNRDKRRTDAAGVQVSTVDASTLAGDAHHALSRPPEGWAHLADELAARGAYREAVRSLYLALLSRLHRDGAILYDETLSNWDYLSQFRGRAEWKAPFRELTRRFDFAWYGNLPVGVDGYREFRALTEPLLAAPSRPEVAGA

SEQ ID NO: 9976 - protein, 509 aa, Myxococcus xanthus
MFLFWVLLFFLVGGIFALLIRVELLTPGPTIMDAMTYNRTFTLHGLVMIFLFMIPAIPAVFGNFMLPLMLGAKDVAFPRLNLLSLYIYLAGAVLALWGMLNGGLDTGWTFYTPYSAHTTTTVAPVLFGAFIIGFSSIVTGINFIVTCHTMRAPGITWFKMPLFVWAIYATSCIQVLATPVIGLLLVLVTVENLFGFGMFDPARGGDPVLFQHLFWFYSHPAVYIMVLPSFGVMSEVVATYSRKNIFGYRAVAYSSLGIAFVGFFAWGHHMFVSGQSTFAGGLFGVLTMIVGVFTAIKVFNWVGTVYKGAVEFKTPFAYFCGFLFFTVFGGMTGIALGTVSLDVAWHDTYFVVAHFHFIMVGATIMAFLAALHYWFPKMFGRTYHEGWGLVAAALIILGFNATFIPQFLLGNNGMPRRYYEYPERFQALNVASTAGATLLAFGFIIIAMYLTYALIYGKASGKNPWRSKGYEWLSESPPPTHNFVGPQPEFPEEPHFYVDPKKAEVPDAV

SEQ ID NO: 9977 - protein, 258 aa, Myxococcus xanthus
MRTLVPPQPTPYTLGVERVEAKVQAYLELPQMAVPVLEDERLGMFVAAVVPYGQGRVLVVGAPELAMNQALARADNAQFWLSALASIGPGPIEFDEFHHGFTNERSVVDFARRYGLHFAVLQFLLGVALWSVSLKRFGRPRPPPESSRVGATDALFAMGRLYREGRHHGFSAQLILRGLTQDLALHAGLPAHASADAVTHGLRERGRADLAQGLEELTTDSRAVTRDTDLQQLAERAARLRQRLHSAGAARPSPPETT

SEQ ID NO: 9978 - protein, 332 aa, Myxococcus xanthus
MNDTLSAPSPAPAGNAVQAAHAIREAVLSEVRKAVVGQDEALELMLCGLIAGGHILLEGVPGVAKTLMAKALSRSIGAEFKRIQFTPDLMPADILGTSVFDLKTQGFTLVRGPIFTDLLLADEINRAPAKTQSALLEAMQERSVSMEGRVLPLSPLFTVFATQNPVESEGTYPLPEAQLDRFLLKIEVGYPAPEEEDAILASVHRGFDSGDLQRAGVNAAVTKDGLLAARGALNEVTVEPPVLAYVRKLVAATRASSRIRLGAGPRAGVHLLLAAKALAALRGRGFVTPDDVRFLAAPVLKHRLLLSPDAELDGATPTDVLREVVRGVEVPR

SEQ ID NO: 9979 - protein, 194 aa, Myxococcus xanthus
MAAQVDGLTKLDHAVNAALFLAFVAVRNGDRVGLAVFADGVKAYLPPAAGRTQYRKIVDTLYGTTPSLTYVDYLALFKELNLRLTRRSLLCVFTDFLDEEQASTMVAPLHRLARRHVPLCLSVKDTALQKLLRTPPPSPEEAFQHAVASELLTDREVLKARVSQGGVQMLDVQPDELSLAAVNRYLDIKARGVL

SEQ ID NO: 9980 - protein, 507 aa, Myxococcus xanthus
MAFLGWLLALLSGCTSMRALCPLEGGRPWVEVRSPHFTVRTNLDTETAEEAAQELELLREGLLQAWGGSFDPPGTVDIIVLHNRSALEEFTNIRIEDLSPIPEDGPLLVLAGHAYEVSEATSDITTQAHELTHYLSELALVRQPRWLSEGLASYLETIALRPERREVILGRIHGAFYNQVQRHGWRTLDELWEWDSKGLLGTAESRQYYASSWLWVHFFISRHGVRFEDFQKRLMQGEEPRQAFEAAFRGEEDLAGELNGYVRRPGHMNYRTITAPLAPVTSPLQTRPMRAAEVHAIRAQLFLMTPGASPMEERLPHIEREMAEATREEPGNVDAMLLRIRSTEDPFRRLAVARELVEHHPASGHAWNAMAQALDAAGNTSEEQEAARLRAVALLPGSVSAQNGLAGYYARTAQPEKGLTAAQRALSLAPGNASVLDTWSTLLFQLGRCPEALDAQQLAVDMLHEGTPQRLRRTVHDTLARYEAVCGPDAPPAAVTPPTAAPAVETP

SEQ ID NO: 9981 - protein, 95 aa, Myxococcus xanthus
MGPRLALGQRLRVPVVGVIGFVDAGRGDPKVVCAAAPLTAAERAGLERFFRVYALFKQVLHRVRGNVPDTRFMGWLPLPVPAPDAAPEATARRAP

SEQ ID NO: 9982 - protein, 336 aa, Myxococcus xanthus
MAEFIESRKPRWEQLESLLDRSESHGLRELSLEDARTLGRLYRAVSSDLLWVRARSGSADVNAYLNDLVGRAYALTYPGRRPRLADVWGFVARGFPALMRREWRMYVASLLLLLAGMGFGYVGMMVDPDAAHYLVPAEHLNLDPVERAADEAAGDGMSVGDQAQFTTYLFTHNIQVAFLAFALGITVGLGTAIMLFVNGLFLGALAQVYAAKGMAGWFWAWILPHGIPEITAICIAGAAGLVIARGMVAPRGLPRGQAVRQEAVTAVRLLFGTLVLFVLAGFIEGTVSQIHPPKLSVAFKVSFALTVGAGVYAYLLSDWLRGGRAAPDGGAGSAHG

SEQ ID NO: 9983 - protein, 122 aa, Myxococcus xanthus
LPAGPVTRGSIYSVMPFENSLLVVKLKGEDLARQLANPNALVSGFTAAGKGKFKDAKGKALDPNKEYTVATVEYLYFGGDGFEFEKLAPEPTETGMAWQTPVVDWTKDQASSDKKPLEKLLK

SEQ ID NO: 9984 - protein, 343 aa, Myxococcus xanthus
IPPIPPIPPIPDLPNAFSEETRNEMKRARDEMKRARDEVRRNMRRNGSRNVVARGQNLEVKDGQTVESAVVYGGNLVVHGHVKDDAVAFGGNLEVHGRVDGDAHAFGGNVILGPDAHVEGDVSAFGGSVERDDDAQVEGSIESFGGAGIGRMVASEIKKGVKEAKDPSESRRDRDDDGVGLAGFILTFAMLFGLGFLGQMFFPARMKQLGEEVRRKPVQAGLTGFVGLLAMIPLTVVLCITIIGIPVALVLWMAAPVAAALGYAAVASELGTRLPIFRGRKTQAVVLALGLLVLMVVGSLPIVGPLITTLVGLMALGAVVRTRFGQRPQGMPEPVIPSSEQPV

SEQ ID NO: 9985 - protein, 382 aa, Myxococcus xanthus
MRVDGVPNVYACRTPARDGMKLERQNAYPSAKVDIFDSIDWFFPKGMDHHEMLAGVPVAEQVMAKVARQLAGLGLLPKTPAPATAPARTVRTRVAVVDGGAAGLATARVLTERNVGFLLIERDDALGGRLANGAPEAGGPSLDDIHRISPSSVLTRATALGLYDDEAGRFLAVGTWEADAPRLVKVYSERFLLTPGGHPPTLPFENNDLPGVYAGRAASLLLRRYDVAPETAALVGWGAELHALANLLQERGTKVVAVVDLRDTPPAGTHATAVRGSEPKAHGLRGVSAFSYTREGGGREKVSCDAVLVSVPVSPSFELARQGGAKVPFDEKRGLFVVETDADGRTQAPDVYAAGDVTGGGTAKDAAAAGRRAAQALVGGLS

SEQ ID NO: 9986 - protein, 505 aa, Myxococcus xanthus
MSKAMICSCEDVTVDDIRHAVSRGFCDVESVKRYTGFGTGICQGKSCTAAVAALLEKEKALKPAAVVPFTPRPPLYPTELRMMASAPVDESQPPVGGLPQEVDAFPAALRPEGPVPAKAKVVIIGGGIMGLALAYNLARAGETDVVVLERGYLCAGASGRNGGGVRMQWGTPSLVELAKRSIELMKGFARELGINVWLRQGGYIFLAKTAPVAQRLERNVSLHNRFGVPTRLITPDEARGIVPGLTMKDCLIASYNPEDGVIFPWPFLWGYAQGCQKRGVRVETYTDVTGFETSGGQVRKVKTTRGDIACDTVVLAAGAWSPQVAKLADVKLPNEPHRHEILSTEPLKPFLGPLVSVLDSGLYFSQSMRGEIVGGMGDAKEPAGLNMGSTLRFVSRFAQALMEQLPEVGHVKVLRQWAGCYDVTPDNNPILGRTPGLDNLLQMSGFVGHGFMMAPAVAERMAKWMATGESDELFTRFNLRRYSDAAGHSRDFGTGTLEREDMVIG

SEQ ID NO: 9987 - protein, 187 aa, Myxococcus xanthus
MWLFLATEILLFAGLFICYGVYRFLFPEAWAAASRSLDLTLGTVNTVVLITSSLTAALAVHYAKEGKNKMVAVQIGLTLVMAVGFLVIKYFEYHHKFEIGTLPGRFYSYEGIQLPGVPLYFTVYFCATALHGIHVVIGMIVLAFSMVRALKKADFGPNNYTMVELGSMYWHLVDLVWIFLFPMLYLV

SEQ ID NO: 9988 - protein, 264 aa, Myxococcus xanthus
MFPKSVRALFLVGALSACGTEAPPDVPNADGQEPLQSQESNVIVGSVNWVSATTLSGTQRTRSRAVGYLSIPAVGSRCTAWLVSRDVIITNNHCVGSSSEASGARVSFNYEDGVSSTARVWYNCGTLIRTWAGDDMTALRCTATNGQLPGDVYGWLTVASANAATNASIYVLHQNCDYYTTSGCTPTKKSSPGVVRNANYSTTDLSYDADTLGGSSGSPVLSSSSHQVVGLHHIGLGGNSQGRGTANTGVKATRVKARLAEIGL

SEQ ID NO: 9989 - protein, 153 aa, Myxococcus xanthus
MATVSRILVPVDLSDGSREVIDYAVKLARPFKASVEVVHAWEPPQYVAPDLLVAAPGWNSQSLEHVAVEAATKELTAQMNQGEPPGVPVSQKIVVGEAASTILDLAEQDKCDLIVMGTHGRRGLPRLLLGSVAQKVVARASCPVLTIHLSERK

SEQ ID NO: 9990 - protein, 174 aa, Myxococcus xanthus
MRSSPIATLALGLALATPAFAEDDAKPPQKWKVVCATQSKDGSRAVQGTDLIIEAGEKVKDGVAVEGNVIIRKGAVVEDVVAIRGRVIVESGARVTGSAVSLGGEVRVHKGAAVDGDAIALGGKLKVDQDEAVKGDKVSLSFEIGGRDIVRGFIEDALDEETGCHIVDESDKDV

SEQ ID NO: 9991 - protein, 260 aa, Myxococcus xanthus
MLCVDVERFDIRPALAHYAEHGYAKLGRVLGDEGLDALRERADDLMLGRVVHPGLFFQPDATTGRYEDAPLGLGWQGPSLDYRKLEKLEKDPRFLAWMENPLFERIARALIPGDIVLYRAILFHKGKAGGSNLPWHQDGGRLWGLTHEPELQIWTALDDAPEDGGCLEVVPGSHRGGLVTPLGGVIPPDAVAAADAESRVLSLPARAGEAILVHNHLWHRSGRGRPGLRRRAFSACYMDAVVRCLRKKKAPRVFPPMFRR

SEQ ID NO: 9992 - protein, 194 aa, Myxococcus xanthus
MSIPLENPHRDTLIKDLAVDARQPWAREHLRMLVSLYAKRPYFASQVLPRLEPFYDAAARESGPGSLLRVLLASMALFNEPLGLTPNLVLASTLDKQGEDKSARLVAYCRQLGAHTYYSGLGSSLYLQVGLFRDVDVRVLWQRFRHPEYAQGRPGRFVHGMSLVDVLANVQLDEVRQWLEPSPWGPFAPRPPGE

SEQ ID NO: 9993 - protein, 80 aa, Myxococcus xanthus
MRGARSPPPSFALELFVKRLLSVLALPLLLLGTSAAAQTTPTLTFHGNWTIHQSEVLTEGGQVQVVYSTARLPQCRVNNP

SEQ ID NO: 9994 - protein, 286 aa, Myxococcus xanthus
MRPLPIDQGTVLIIGAARGIGRELARLLARRVRTLVLVDHQAQVLEPLREELLLNYPTLGVLVESCDVCDPQQVDALLASLESQFVRVDVLVNNAAEGDQALYAQEGWGRVEAMLRANVWVPALLTHRLLKPMLERGRGGILNIGSGAAQLILPGSATFSATQRFLDGFTEALRLEVEGQGVTVTRVAPGPLWEAGVEGAESLAPFFHLSLERCAREALAGFERGAALVYPGLGHRWVMRLLPLLPRGLKRSLGRMALRGLRREELLLPPRQAPQALPLSGEPSPA

SEQ ID NO: 9995 - protein, 313 aa, Myxococcus xanthus
MREGISGFTLLPVSTSASLVGMFVFLTWMRWWRYAGHRQVWGFQVPAPGRWTLLSGLCSAAIIGTTTLAYTLPGASIVFMMLLMRGGVLVLAPLVDVLSGRRVRWPSWVALGLSFSAVAVAAGSSVSPTLTLLATVDVGVYLAAYFFRLRAMSQLAKSGEREVSIRYFVEEQMVATPVLVGTLAVLALIGGDGVLGDIRDGFTGALSRGHLASELAVGLLSQATGIFGGLILLDGRENAFCVPVNRASSVLAGVVATVVMSVTLGQPGAGALELVGAALVVAAMAVLAVPTVLAARRKAGEPAAPPVAPSPGP

SEQ ID NO: 9996 - protein, 258 aa, Myxococcus xanthus
MNALLSIWTWIEIGLVALVGFCVQLSLAILTWAFDHKRHVTGRCFRLIGVTAAKLTPFWRFGVHGQVPDKVAPNTVVVSNHESNADPFLISHLPWEMKWLGKASLFKIPVVGWSMWMAGDVPVHRGDRDSATGAMAKCRQWLAKGMPVMIFPEGTRSKTDDLLPFKDGAFRLAIEAQADVLPLAVSGTRRALPKHSWRFATSRGLVTVGTPISTKGMTLADVETLKNLAREQILSLRASLMPLTRTEPAVPPGPASAA

SEQ ID NO: 9997 - protein, 30 aa, Myxococcus xanthus
MAYVRKAGIHPDVLGSDHCPVSVDLDPAVR

SEQ ID NO: 9998 - protein, 151 aa, Myxococcus xanthus
MGIANESRQEEQNMREEHHGAGRYWLIWGLLLVLTVVTVVTGRIHIPTWGLVLALVIASTKGTLVLLYFMHLADHRGANRLVFAVSIIFVVLLLAIPLVDLGTRFRGATPPGSTYSDLQAIDIGADAEEGRYGGAIRKQGKTGEESGAPKQ

SEQ ID NO: 9999 - protein, 568 aa, Myxococcus xanthus
MPWSFRQMLAPLSALLLFMSACGDDPEVRPVCGNGIVEAGETCDDGNRNNNDSCDNSCRRPTPDAGTEEDAGTEDDAGTGEVDAGTGEEDAGTGEDDAGTTEDAGTGEDDAGTTEDAGTGEDDAGTTEDGGSGEQDAGSDEDGGSGEPDSGTDAGTGEDDAGTDAGTVQVSLDSFGPTGTFARTGTTGATFPEALTVRLREEAPAEVWVEVTSSSAVLNVQGGLVRIAPGERSATVQVTANLAADPETDKATLTATLGNDTRAATVRVLAANQAAELATLSPEVISVSAGQTQGYTVELDVPPAQDTVIQLALEPASLGTVPVTVTVPANSLSAKFDFTAGSTGGEGQLVAALNGQSIAAAVQVTAGSSTGHVVISEFAVAGPGGASDEFIELYNPTSSAVDISGWKVQYKAYSSTNYNNSFTLPANSVIQPRGYFLVVASGYASTSGNTVSGDANWGTALNLGANSNGGHVRVGYPELALTDGISSPLVVDTVGYLNANAAEGSPLPAYPPTAGSFERKASAVSTAASMVDGAHALLGNGHDSNDNSADFILRPTRQPQNRASATEP

SEQ ID NO: 10000 - protein, 204 aa, Myxococcus xanthus
MGVRVLLDLYRRRPDLVPSMTLIAGAPGAFGSGVDSAGARAFLSATRGMLKLATPTLPLAAPVAHAVMASRFAYPLARMVGALRARAPRADIDEFMLALRRMSPRAYWYTLRGMVEGHAWDVARTVQVPTLIVAASNDLLVPLGEMERMRDAMPHAHWMRVDDAGHAGLLEAGSEIAEAVRVFLVDHGLEPPHEVGEHAPVPPS

SEQ ID NO: 10001 - protein, 690 aa, Myxococcus xanthus
MKFLCLTSDDRHPVAEELRRQGQAVFITADVVEAGAALGHGPVDVLVVDAADLVEDARWLDALRTRARPEEPLVLGLAREGTDAALEPLLAAGVDEFLVEPFTPVQVRSRRLLLERRVAARRQRRTSEAEARGEVARLSSIIQMQSDVAMAGYGLDELMRLLCERSRVLCGADGAAVALLGADTDEEVTYLVASGSLMPFIGFRLKVEGSLTGASLLQGEVMRTDDSETDVRVNVTALRQVGARSMICVPLWREGRPVGVLNVTSRRPNTFEDRDVRTLELMAGLLGAAMGNAAEAQARQELMVQNTLAMGALEESQELFASFMDNIPAVAFMKDERGRRIWVNARYSRFFGFPVGADMSNVSDVDLMPAASAEQSRRDDDAVLTSGKQSITEMMVPARDGTERHWLTYRFIVRERSGRRLLAGVAVDITDRKAMQAQLVVSDRLAAVGTLAAGVAHEINNPLAFVLSNLSFLAGELHALAPELPSGRMAELEEVLREATDGAHRVRQIVRDLRTFSRGDDEVATAVNVQAVLESAITLARSELKLRAQLVRDYCEVPLVEGNEGRFGQVFLNLLINAAQAIPMGQTEQHEVRLSLRSAGDRVIIEVRDTGVGMPPEVRARIFDPFFTTKPVGEGTGLGLSICHGIVTGFGGDISVESEEGRGSTFRVSLPVARRAKEPVDPPLRMPLVG

SEQ ID NO: 10002 - protein, 535 aa, Myxococcus xanthus
MTAALPPRPPGAVTGSRPALPPEPDEPDFPTERRGSSSPPDRRAPPPAPATLPSVIVAPPDRRGPGPSQYSGPDRRGGAASPQYSGPERRTPRRSGEEGGAGPGDRFWPSQPRTLGETGLNTTFVEELVLKALFFAGEMRGMDIAARLQLPTALVDDVIEGLRRQKYIDIRGGGGSGVGKSTMIYQLTTFVTDVLRQVLDRNRYNGPAPVPFLEWAAAVKKQTVRGNRITRARMQDKFGDLIIKDYIFDGIGPAMNSGRAIFFYGPPGNGKTAICQGMVNCFDGDIFIPHAILIDDFVVRIFDANLHKVVEDEPGTSPYDRRWVRCRRPLVVVGGELTLEMLDLVYSPEVKYYEAPFQMKASNGMLLIDDFGRQKVSPKDLLNRWIVPLESDIDMLTLHTGKKLQVPFDVFAAFSTNLDPSDLVDDAFLRRVRYKLEVQRPDEEQFHDIFQVMCRKRGVPYNAAAVDYLIDAHYRPVGRPFAACQPRDLLDQVIDMAHYQGQEPRLTTELLDSAVRGYFVRFDKDKPAGTSASAR

SEQ ID NO: 10003 - protein, 191 aa, Myxococcus xanthus
MGQSMGPLAYPTLDFSAERVLACYAQKLVKPEPRFLLIAYESDAMMPLHLFYDFNAPSRNDAMVTSREARGKELTDAFETLREMLAWGALSLFRIDRAPHTCSGSLKGDTTDFLVDLDPVMSSLGFIQPIPTGPLCRLYERPDAVMVCTGTPRAGTGNRRAFDLGGNSVGRLRRILGEISSARVAELQVKK

SEQ ID NO: 10004 - protein, 297 aa, Myxococcus xanthus
MDAALGTSFGEQPRSDIVVADVFQFRPALTLIDVQVLGAPRVEGEAEAAEQDGFLTRVASLAKEAGFKSTRVWMGEVGTMAWELESQDEEGVPVGAKREDEALRTLGADGWTVDPLAPVVAREVIRSIVKLPLEEVHHYIDWAVSCRSSMAAGTPVEGFNLTRASRLMATHYLVWKGTVLPKPTPVSEMAPKLGRARRMRRAATLVPAARVWGLVLLVAFVVPAVLYHFIFAPPVESPVKGFVLSGVMTLVWALFALVRFDDFQGRPVRLPWRLALFVGGQLVVGALMWWLHGMPSR

SEQ ID NO: 10005 - protein, 655 aa, Myxococcus xanthus
RERAFGADEVVTRLQTEAASEREARARAEEALAAEREALAQVRVDLDVERQGRGDGEAELARVQGVLGGEQQARSGAEAALAQLRATLGAEQQSLADAEASLAEARAALTAEQQTRAETEAVLAQSRDAFAAEQEARAETEAVLAQSREAFASEQQARAETEAVLAQSREAFAAEQQARSETESVLAQARAALEAEQQARAELETALSQSRESLTAEQQTLIELETALSRSRETLTAEQQARAAIEAALSQAREALAAEQQARAQAESALAQSRATLEAEQQTRADTGAALGQTRSALESEQQGRAEAEAALAQVRAVLEAEQRTRTDAESALQTLRTETSERDQARQERLAAAERVMAEQERALEAQRLAAEAREQELRDTVTRLESERAWAEDTAKEQRSALESRLSEARAAQESDAARAVALAQSLADLESARSAADAQLAERAGTIEALETQVAQLREQVAEREAEAGRVGEAATEAREALTRQEAAAQERLSAVERALDDALARAERQQGEIEALAAERDRERTALAAAQQELAHLGAARQESMRLGAQLQHAMATLHERGMHIARLDAELVDAQDRLAAQRENAELLMVQLETARRFAGKATAMENSLEAERAALETLRAELARATEATATEQARANALEAQLMDSAGG

SEQ ID NO: 10006 - protein, 323 aa, Myxococcus xanthus
MAYPQFFEMYRNAIKNTWTVEEVDFSTDLVDLRSKMTDAERHLIHRLVAFFATGDSIVGNNLVLNLYKHLNAPEARMYLSRQLYEEALHVQFYLTLLDTYVPDPAERAMAFAAVDNIPSIQRKAQFCMKWMDSIQGLDTLQTKAHRRQFLLNLICFAGCIEGLFFFAAFAYVYFLRSKGLLNGLAAGTNWVFRDESAHMAFAFESIQVARKEEPDLFDAQMERDVVAMLREAVECETQFAQDLLSGGVMGLSVQDMRGYLEYVADQRLQMLGMTPVFGTKNPLHFMDLQDVQELTNFFERRVSSYQVAVGVGAATDVVLDAAF

SEQ ID NO: 10007 - protein, 785 aa, Myxococcus xanthus
MRVRKRNGGTETVDLNKIVRAVGRSCVGLPRVDAMRVATKTISGLYDGATTRELDSLSIQTAAALIVEEPEYGRLSARLLATFIQKEVSNQDIHSFSQSVAAGHKHGLIADRLLQFVQANARKLNAAIDPSRNDLFEYFGLRTVYDRYLLKNPQTREVLETPQEFFLRVASALSGDNVNEAIELYRLFSSLEYLPSSPTLFNSGTRHEQLSSCFLLDSPADELDAIYKKYSDIAMLSKFSGGIGVAYHRVRARGSLIKSTNGHSNGIVPWLKTLDASVAAVNQGGKRKGACCVYLETWHADIEDFLELRENTGDDARRTHNLNLANWVPDLFMKRVEADGDWSLFDPKSVPHFTDLYGDAFEQAYAKAEADGLAMRKVKARDLYARMMKSLAQTGNGWMTFKDISNRKSNQTGKAGNVIHLSNLCTEILEVTSQGETAVCNLGSLNLSRMLVDGKFDFERLRANAQLAMRQLDRVIDLNYYPIPTAASSNKRWRPVGLGLMGLQDVFFQLKLAFDSAEARALSKKISEEIYFAALTTSCELAEQYGAHESFAETRAAKGELQFDHWGVVPEDTARWDALRQRIMKHGLRNSLMIAIAPTATIASIVGCYECIEPQVSNLFKRETLSGDFLQVNRYLVRDLQALGLWNENIRNRIKMAEGSVQDITELPENLRAVYRTAWELPMRSLLDMGADRGAFIDQSQSLNLFVETPNIGKLSSMYFYAWQKGLKTTYYLRSRPATRIAKATVGAGGGASVAQAAPAPVAKATEAEAVACSLENPEACEACQ

SEQ ID NO: 10008 - protein, 278 aa, Myxococcus xanthus
MNGTAQQGFGYRARRTFTRLLVFTLILGLGGVVVFLLSQLNARTFTLALQDGQLVVMKGRNAPMGAVPYRTGDPRLADAYAPVAIEGQDVSALLTRKFTDRDELDQALFPVLEGLARPRIASDEPARVDQGLYYLRRAEKLSGITEEQRLSLQKHMVDVAYYQARQKLEDARRLVSEALTQLKLAAESQSRHARSANQMLSAVAPPARDLEESLRRAVHTLSGPQAAPQAPSQPAPQPAPTAPSPAPTPQPETTGEALDGAPQAPTGTDAGGVVPTPP

SEQ ID NO: 10009 - protein, 566 aa, Myxococcus xanthus
MRIVGIDLGTTHCAVASVDPSRGAGAPVEDFALPQLVRQGEVAPRALLPSTVYVPAGHELAEGSLTLPWGDDGGPWVVGELARWQGARVPGRLVASAKSWLCHPGVDRSAPILPWGAPADVQKLSPVDASALLLTHMARAWDYAHPDAPLSKQEVVITVPASFDEAARALTVSAARKAGLEKFTLLEEPQAAFYDYTARHRADLEQTLSNVRLVLVVDVGGGTTDFTLVHAGLSPEGPMLRRLAVGDHLMLGGDNMDAALARRVEEKLFTDGRRLSATQWTQAIQAARTAKEALLGLAPPEKHGVSLVSGGSKLLGGTLSTELTRDEAQALVLDGFFPLTTPADRPRRAARMALQELGLPYVQDAAVTRHMAAFLAQHAVAGLAALGETAPAEGALPRSDAILLNGGVFNSPQISERLVEVLSAWWPNAPCIPLLRDESLELAVARGAQYYGLVRPGHGLRIGAAPRVPTTWACSARRTAPSNPRCASSPAASRKARRSTWASDPSRSPWAGRCSSSSTPPPATASTSPAIWCRWRRTSSRCRPSTRCSRAPPTRWRRCPCTSRRR

SEQ ID NO: 10010 - protein, 225 aa, Myxococcus xanthus
MPLPLRPAPLLLLCALLVPAAASAQRVTVPVDVGVGPAAFAFFGPVFDDQPIHTGLKLSVEAVLDKEWMKKNQRRVPPRYRKYAKSLDEVRISPSILIPDALIISPKLRNTGMYGATWKPLSLGVPLTSSPARLSLGAGLLLTYVYMHSDTLPNTHFLRPGAEVGIDLELQLSKSFLLGVGWESAFYVPQELGGLGLPERLRDGIFHVGQAYLQLHFRFPYTVRL

SEQ ID NO: 10011 - protein, 440 aa, Myxococcus xanthus
MREYNFDGLVGPTHNYGGLSPGNLASQSHVGEPSHPRDAALQGLEKMRFVSALGVGQAVLPPQPRPSLHALRALGFTGSDEEVITRAAREAEHLLRLTSSASSMWTANAATVAPSADTADGRVHLTPANLSQMYHRAIEAETTHSVLRAIFSNEKYFAVHAPLPGSGHFADEGAANHTRLATPGHAGVHLLAWGRSAWQDVQGPSRFPARQTLEASQALARLHQLDAKSVLFPQQHPEGIDAGAFHTDVLAVGNERFLMLHELAFVDHAGLLAVLREKLGQDFRAVVATKAELPAKDAVKAYPFNSQVLTLPDGTMAIVAPIESRETPAARQFLERVVAEDTPVKAVHYLDVRQSMNNGGGPACLRQRVWLTDEERGAIKADVFYTPALHDSLAGWVRRHYREVLRPKDLQDPQLARETMTALDELTRILNLGSVYDFQR

SEQ ID NO: 10012 - protein, 178 aa, Myxococcus xanthus
MIPEAIQHYLRRNGVRFERYWHPRAVSAQEVAESLHVSGWRVAKSVIVMADRQPWIVVVPAAGTVDLDQVRDMLGARHVRLATEPEFSGHFPDCEVGAEPPFGELYGLPVAVDESLSLAERLLFRAGSHEESLELRFQDFAILEWPLVASFIEEEQQLQAIHNTGAPSRPREEAHAHV

SEQ ID NO: 10013 - protein, 91 aa, Myxococcus xanthus
MRRFIVTAALLCSALSGLTGCKGACRELSEKLCDCSINSVEKELCLRRASQEENRVEPTAEDEAVCEERLAGCDCRAIETDEGKRACGLSR

SEQ ID NO: 10014 - protein, 848 aa, Myxococcus xanthus
MPTHTNAQATPVVVDVNADGVPDVVFNSFEGWNFKTNGVLRAISGADGSDLWAVTDPAYRTRGSASVAAGDIDGDGKVELCTVPESAQGIICFEHTGAFKFRADGPPLDWGGVSLADLDGDGSVEIIAGNHVYDSSGTLRWVGSDGVGSPANDTGPLAFAVDLDGDGLQEVVNGRAIYRHDGTLKCKAAELGHGLAGVGNFDAGPEGEIVVVWGGHVSLMDANCKVKWTVQHLGGGVGGPPNIADFDGDGQPEIGVAGASHYAVFESNGTVKWLSPTQDHSSNRTGSSTFDFEGDGRAEVVYADETALRIYDGVTGQVRFEAPHSSCTAYENPVVADVDGDGNAEIIVAQNTACGYGDFQGIRVYRDRKDGWVNTRRIWNQHAYSVTNVNDDGTLPARPVSNWLAPGLNTFRTNSQGTGTVRPFAAPDLAIGQVTATCTGEGAVMLGARVRNQGDSAASAGVQVAFYQDAVGEGGTLLGVATVPHKLKAGEETSVELALDTPESGWVLVYAVVDDDGTGTGRELECREDNNAASAQLKLACAPNEPPVALCRDVVVEADAQCRASANVDHGSHDPDGQPGPFTLTQTAPGPFGLGRHAVTLTAHDGEDSAVCQATVKVVDTTLPSILCPAPQVLECVAGGAEATYTARAEDNCGPVSVTCTPPDGSRFPLGRSVVDCNAVDGSGNACGCAFSVTVRDTRAPVPGASLGKRLWPADHQYRTVTLAECAAPAKDACMGDLSLERYGRIVRVTSDESEDVAGICDGTTCDDIDVRVNATSVQLRAERDDTGDGRVYTVHYVVEDPSGNRADGRCTVEVPRDSAGQQVHDSGPKYCVGQGCAPGLGGSPLCP

SEQ ID NO: 10015 - protein, 222 aa, Myxococcus xanthus
SARLIAEGLEKSFRGRKKVVAGVSFSVAAGEVVGLLGPNGAGKTTSFNMVVGLVSPDAGRVRIGDEDLTHLPMHRRARRGVGYLPQEASVFRKLTVRDNFLAVLELQKDLDAKAREQRADTLLDEFGLTHVGESLGGDLSGGERRRAEIARSLIPQPRFILFDEPFAGVDPINVGDLQRQIFLLRERGLGVLITDHNVQDTLCICDRAYIIAQGRILEEGTP

SEQ ID NO: 10016 - protein, 202 aa, Myxococcus xanthus
MAFFVAQPAPAVAATPAQGTPPAAVGGSAPSAGTGTRAPGPLGGKELTEPVQINGDNVTFQKSQATLTGNVKVKHRTLDLKCDRMTANYTPQREVTRVVCTGGVHAVDGDRMAKGERAEYDVPSGVLVVTGSPEARQGTTHMRGTKVRLTLGNERLEVENAVIVFESLPSNPTPARRKGRQSAPRPAPSSGTAPSAQGGTAR

SEQ ID NO: 10017 - protein, 83 aa, Myxococcus xanthus
MEGSLASKQVVASGGVIIRTGKGMEARTPRLTYDATTERAHGNEGVTVKGPDYRLRADRFELFFPDETFNFAGSVESVLGAPE

SEQ ID NO: 10018 - protein, 131 aa, Myxococcus xanthus
MLRALRNGEILGILIDQDTKVQSLFVPFFGQLAATPRAAADLAIRTGAAVVTGFCHREGAGYRLSMEEVPVPQDTDREAAALALTAALSSRIEAAIRTTPEQWVWMHQRWKTRPPVSEDVPLPEAAPASAG

SEQ ID NO: 10019 - protein, 579 aa, Myxococcus xanthus
MVGAYTAADGLWAEARTADSVEKLRQSKVALWPMLADAARAFPVLGMGRGAFEAAFPRYQSEPNPNTFTHPENAVLQVAAELGALGLVLLAVAVWGFLRLLRREGLETVDLAALAGVAALALHDLFDFSLELPACPVAALVALGAVARPRERAVEEKAWCARPSGAVLGTGLALTAVALVALVPGRHRLGDAEAELARLVTSGASAREVHARGLALVDRHPSDYLLYRLVASAHAARGREGAGEALALVNRALYLAPLDASSHRVAARALLALGRSAQGFLEYRLAHEAGDATVLLGEALPQAETLASLTVLTPRSPATAVRLLDALANTPGRLALALDYSGWAREHFAGQPEAAALWAREARLRILRGDLETAEAARAQVERLAPDALDTHLLRAEVLRAQGKREEALRVLEQMLARFPGNVALSFQLAAQQLDAGLTRRAKDTLQALAPFITDYAQRARLLAMEAACLEREGLLSHALERRQTAARLVPGADAFFAVARTQEALRRYDAAARSVHEGMRHLPAGARAEARAWVARLEGAERERVDSRRKTLSEDPREAELEYLLRGPDVDGEARDAH

SEQ ID NO: 10020 - protein, 115 aa, Myxococcus xanthus
MAYSGYVLSPLLLLGIPLIIVGMSSSNDDDAGTLLALGVGTTLGGVAGVGLLIAGIVTGSKQAGINRAHRESLVRERIRLEDELRDVKARRDARGAMQTRQWTPRAGIPLVAFAF

SEQ ID NO: 10021 - protein, 144 aa, Myxococcus xanthus
HLVVANEAQKAERDRHTYTAWGSPLTVEQFLEREQRLRAHPWSRDTMRTWLLCDDAGRVLTSCETFRTPSYLRGPDCQTTRGDSFVIASVYTEPALRGHGHATRLMDQVAAELERTEPDAQAAVLYSDVGARIYRGSGYLGVPA

SEQ ID NO: 10022 - protein, 185 aa, Myxococcus xanthus
MALKFNPLARLPEFLFGVLLGWCFVRERAAGGAKGSGAVLAALGTALLVAAGAAGSRVPYPLMHNALLAPASGLLVYGLARGGGALGWLLSRPTLVKLGGASYALYLLQYPVSEAAKGLGAWVSPWVELRTPEGLLATVLLLGVPASLWVHRAVETPLRSRIRAALTPWGEGASREPVKPVVSGT

SEQ ID NO: 10023 - protein, 432 aa, Myxococcus xanthus
MRIAIIGTGYVGLVAGTCFADSGNDVTCVDIDERKIRMLQAGEVPIYEPGLEELIKKNVREKRLFFTRDLTEAVTNAQVVFIAVGTPEGESGDTDLQYVLAAAEQIGKAMKQYTVVVDKSTVPVGTADKVREAIRKVTDIEFDVVSNPEFLKEGAALDDFLKPDRVVIGVDSERARKVMADLYSPFVRTENPVLFMDTRSAELTKYAANAMLATRISFMNDIAALCEKVGADVDFVRKGLGSDKRIGYPFLFPGVGYGGSCFPKDVKALVATARDYGLELDLLRAVERTNERQKKLLVTKAAKHYGSLEGRKFGVWGLAFKPKTDDMREAPSIEVIEGLIGKGAQVIAHDPVSPHTAKRVFGDRIRYASVPYEALEGVDGLFVVTEWNEFRHPDFERMKTLMKSPVVFDGRNVYDPARMRELGFTYYGIGRR

SEQ ID NO: 10024 - protein, 288 aa, Myxococcus xanthus
MQGLAPLAAYNLEYRLGAGNAPEWARDKLLSIYQGSVNDNVMKLVNFKRIVGALEARKLVLMGAASFADSLYPHVGFRPVPELQILMKRLHVDGFSGFLSHHEFAPEPDTENSGATKVVSDGRTVILLYSDVLGPQRREQTAGILERAKPMRVYGPSLYRPELEDAVLLVALEHARHGYAVPWLSFIDLRELVTGAKWMGGVYSRPLDVPVLLARAAEWRLERALYTSLSIVARLFPDAAADATAALPPLRRATRELLERTVVGPVCTPGRTSALKGMERVRRLLTGQ

SEQ ID NO: 10025 - protein, 139 aa, Myxococcus xanthus
GVLAMGLWPTRGLQMVALEDLAAFSVRIMEEPERFEEQRIEVASDEVTGQQAAGLLSMVSGHRIHYEQLPLDYIRERSEDLAAMYEWLDRKGYQADVLTLRHRFPEVRWHTFEDWARGQDWSALTSPAWPHAAAEPVSP

SEQ ID NO: 10026 - protein, 80 aa, Myxococcus xanthus
MFSRSEIHKGMKVRGNDGHVLGRIIKMTGDELIVEKGLIRRHDFAVSLADVREVVGGEVLLNHGRDSLFSAPREVPPTKH

SEQ ID NO: 10027 - protein, 623 aa, Myxococcus xanthus
MPQLLDMLADLIDHGPDEILTTVPDEHAMSRLDAGFDLGQVASEYALLRKCILRRMDAEAAYPAPGELERMEDALDRIVTRTVTSFSQGRQRILQALDRMTQATLDSPSMASLPSRLLTVLAESALSVDSAAFVLVEGDALVVRAAVGLGADEALGVSLERGQGFVGEVLRQRQPLTLRSASTDPRVALPTLKQEGLRAVYGVPLLDGDQLLGVAYMCSRTAFVFSEPDALLFRTMAQRATAHLVQARLRARERQAHADAQRSLAQLDALLASTPLGIAQLDRELRFVRINQALADIDGHSPEAHLGRRFREMAPVTAVGTFEPMFRRTIETGEPVDAVEFTIPGDARTFQASFHPIRTPDQGVLGLSCTVVDVSHHKQAEAVLQRAVDFREQLMAVLGHDLRNPLNAINASAFQLTRSEDLTPPERRAVDRIRKATARMGRMITDILDFARTRLGGGLPVARQPMDFVEVCQATLEELRVSAPERSLVFEASGDTRGNWDPDRVSQVLGNLVANAIQHGQEDRPVCVTVRGEADEVVLKVHNTGEPIAAELMPRLFDPFKNMPAAAPPQDVARKKRSLGLGLYIVSQIVGAHGGHVEVRSNRDQGTTFTVHWPRTLTTLGDA

SEQ ID NO: 10028 - protein, 218 aa, Myxococcus xanthus
MFFNPTKKLRIPTPEEALPGRSDVMPVPEKHEVLGTPIKGPVPEGLEEVYFGLGCFWGAERKFYQTPGVYSTAVGYAGGPTPNPTYREVCSGLTGHNEVVRVVFDPKKVSFEQLLRVFWESHDPTQGMRQGNDVGTQYRSGIYFTSEAQQRAAVASRDAYQKALAARGFDAITTELLPAPPFYFAEDYHQQYLEKNPGGYCGLGGTGVSCPVGVGVNA

SEQ ID NO: 10029 - protein, 43 aa, Myxococcus xanthus
MIGARNGQNVVALNVASSDGGKTLAGTMIYNGEGPIGFRARLG

SEQ ID NO: 10030 - protein, 379 aa, Myxococcus xanthus
MTEWMPKPNPAVDLRTLALSPEEGFVLSRLDGATSARNLPALTGLPPERLRTILSRLITQGALLPTPTASPAAPVAAPPVAFEPQRRTSPAAPEPEADLPVLDLTPLDAAPEADLPVLDLTPLEAAPAPDTAQDAEPSSEDEPEAALGNYRQLFELRLHPLPEDQRIAHAHAAEDPILSALCFDPVPAVIKAVLENARTGLPHARLVARYHRNPVGLEALCARAAFAVDTGVRRWLVRNPQLPASLFRRLWSARRLMELHKVGNDRDVPESTRRAAREVLRQRFASGPAEEKVELILNTEGRALAALIGLPVDGKTASLLCGRTYRSPMLIQNIARWSAAPPALIAHLLKQEAVRRQPQLRMLLARHPNAPADAKRGGA

SEQ ID NO: 10031 - protein, 330 aa, Myxococcus xanthus
MLSAAFLIATSLQAQTPAPTSSTPPAPAAETAPAAPLSVEERAAIAAERAAIAAERAAEASARAAEAAERAAAATVPPPAAAAAAAPATDKKQGEWDVTVGLGLISLTGNASTLTVSGLASAQRTTDHWIYAIKSYGSYGRSRPPEVTGEEAVSQVVAFNAGLELRGDRRFTDVISGYLLGGAETDHVKSVESRTFGEGGLGVLWWDEKKEKGRESYLRTDAAFRYANETRFQYYPTRMNLPDVDLGGPRFGAVFRYGLAQNVTFKEDVEVLVSVIGDSRMLFNSQTQLSVGLTKQLSLGTSFLVKHDSAPPPGKVSTDTALALNFEVLL

SEQ ID NO: 10032 - protein, 200 aa, Myxococcus xanthus
MATQQAGLDANALNQLFLDARTHNAWLDKPVADDVLQQLYALTRMAPTAANSQPVRIVFVKSREAKERLKPTLSPGNVDKTMNAPVTAIIAYDTAFYEKFPQLFPLRDMKAGFLAMPAEAREKTAYMNSSLQGGYFILAARALGLDCGPMAGFDNAKVDAAFFPEGKWKSNFLINLGYGDAEKLFPRNPRLDFSEACRIE

SEQ ID NO: 10033 - protein, 611 aa, Myxococcus xanthus
MAAEREPLEPLKPPREDTPAEDLRPYALSPREGLPVSDQSMAAHPRKQADMVRWLHPAQLLRTGLDAVVAAVFGARADQRLIEAVVRPQVPYFDYSQEPMPEGGFWLDYVSDTGDGWNSTYAVARLLALPELTLSVQGQPHADSHATQRGRLLVHGGDGVYPGASREVYDERLVQPYEAAMRRSHAPSPDLFVIPGNHDWYDGLGAFLRLFCANRWIAGRRTRQSRSYFALKLPQRWWLIGTDVQLNSDIDVPQVEYFREVASHMGPDDRIILCNAEPAWILAATERRKGSYLENNLEYLQEKVFGRRINVFLAGDLHHYRRHEDAGGRQKITAGGGGAFLHPTHAPSAHVLRDGYTLQKSFPDERTSRKLARQNLLLIRHSPLFGLMTGMLYLLLALAAYAEVGSFGISQLSDVILAVANSMVARPWTLVLGMATIGGLIGLADSAFGKWRTLAGTLHGLGHIAAAFFVAWGATYFTVSGLGVCPELAADGIHCEAGWWHLAGKFLLSSGFTFLGGFLVGPFVMGLYLWLSVNRFGAHSNEAFISLALPDWKNFLRMRIGEDGRLTVFPVGIERVPRKWKETHAGPYAPAFDPNDPKATAPVLIEPPIRV

SEQ ID NO: 10034 - protein, 202 aa, Myxococcus xanthus
SAPVFIYLTPPDGLVPLLTPARLAAFRDWLWRENTEHLNAEDLADIESDEELMALLGLVDHLLQQGAESLSKPPTRHADAMLDLLDELSDYFTREELGIPEGMELATDLKPTDKQVRASDVVIGENCPKRTFELWRHLVWGRAPDRTVAEGIGLRRNFPSMGYWTAAEVRHVRDDLRQHLSGAPDYMPMNNWARFMTSLRLI

SEQ ID NO: 10035 - protein, 76 aa, Myxococcus xanthus
MVVGGLASGTSRGAAVALVGLGPLVAAALDWVPMAALFGLPMDGPTLRRELGVSDEASLLEGFPRASMRDVSPTLH

SEQ ID NO: 10036 - protein, 462 aa, Myxococcus xanthus
MRHRVRGLLSRIGLTRPALRAWAMYDWANSAFITTVVTVVFPLYYASVAAEGLPREVATSRFATATAVALSVVAVLSPVLGALSDRAGRIKHMLGIFAGLGMVSTLALATVGPGDWAWGLLLFGLGNVGVTGSIVFSDALLRHIARDDELDRVSTAGYALGYLGGGLLLAAQLVLLMKPQWFGLADAGAASRVAFASVAVWWALFSVPLFRRIPEPKPDVSIQRPPLSLRGIFTQLAGTLGGLRQHRQAFLLLVAYLLYSDGIGTIIRLSTLYGTELGIGRGALIGALLLTQVVGVPCAVLFGRAAGRVGVKRALMFALSVYVGVTFLGYFMRTPVHFFALALLVGMVQGGSQALSRSLFAQMVPRDRAAEFFGLFSVFEKVTAVAGPLVFAATVELTGSSRQAVLSLLFFFVSGAAVLSRVDVAAGRRAAREAEARAGWRGDGAPEATAAPEGAPDASRGV

SEQ ID NO: 10037 - protein, 320 aa, Myxococcus xanthus
MRTLLLTRSDVSRNLQAPLLLEDMREAFRTDALARTVAPQRARAPLHAEGTALVLFPGSLPSIPAYSVKVHAKFPGQSPAIRGVVHLHDVATGEVMAVMDAGHLTAVRTGVVGALSADVLARPDASRVALIGAGRQAVLQLKSLRLVRSLTHVRVFDTAPERSLAFATRMYQELNLPVRMAESLEEAVSDADIIVTATWSRHPFLHPGMVRPGTHIIALGADEPGKAELSAELLRQSRFVVDHRGLAVSTGAAGAVGLGEESIHAELGEVLAGLKSGRTSEEDVTVFAAVGLPFQDLAAAWHVYQSAQGDDAVSGVDFDA

SEQ ID NO: 10038 - protein, 222 aa, Myxococcus xanthus
MAKVFTRISKDIAIAVKAGGPNPDSNSTLRRVLQNARAANMPKDKVDAAIKRASGQSATDYEIVLYEGYAPHGIALLVETATDNVVRTVANVRMHFNKHSGNLGTAGSVAFMFQRMGVFRLNPEGLDLDSLELELIDHGLQEMGEGVGEKGEKQIIIRSAFADFGQLQAAIEAKGLVPVSADSEYVALNPIELPEDKATEVLELVDALEQDDDVQRVFHNLA

SEQ ID NO: 10039 - protein, 21 aa, Myxococcus xanthus
MDLHPTCYTHFGLVLEKPAKV

SEQ ID NO: 10040 - protein, 127 aa, Myxococcus xanthus
MSDRIETYAEFWPFYLREHALPSTRWLHFTGTSLGLGLGVTAVATGRGALVPAALVAAYGFAWFSHFVIERNKPASFKYPFWSFISDFRMAGLMAIGRLAPHLERARAGGVGSGEVARAVPATQQVR

SEQ ID NO: 10041 - protein, 99 aa, Myxococcus xanthus
MGKRWTGLILRILLAGPRRFGELTDAIGSISERVLSERLKELEAEGVVSRHVDAGPPIRVAYQLTEKGQALWKVVDELARWAERWVDMKPSAARKRKSA

SEQ ID NO: 10042 - protein, 118 aa, Myxococcus xanthus
MGSELDTVAERLAERLPSACHFYPRDALAAFVIALRGGDTPPEDPRYTVLDMPLYFGEIRLVDSDFLQQCAARGKWVNVWTVDDPAEMHQLLAEGVGGIMTDRPDVLRQIMDAPSKPG

SEQ ID NO: 10043 - protein, 256 aa, Myxococcus xanthus
MSDLALGFYEGMAEEYHLLFANWPQVVERQGAMLDALLRRCEAPPPRRVLDCACGIGTQALGLAGRGYTVHATDLSPAAVARAEREARAMNVHLTTGVADMRTLDAQVEGTFPVVLALDNAVTHLLTDEDLDAAARAMASKLASGGLVALSVRDADALVQSQPRFTSERLLDAPEGRRILFQIWDWAADGRTYTVHQFILRPEGKGWHTTEHTGVYRALQRVDLERALTRAGLMDTRWHTPEETGFHQPILTARRA

SEQ ID NO: 10044 - protein, 154 aa, Myxococcus xanthus
MPDSPLKDFPVVVSFPLHWGEMDAFGHANNTRTFTWFETARIHYFARIGLTGPSGAGDERTNRDGVGPILKATNAEYLRPILFPTRLVAGCRATRIGTSSFTLEHAVAGEDDGVLYTRGSCVIVTLRYATHEKVPVPAELRAAIEALEGRSFSS

SEQ ID NO: 10045 - protein, 116 aa, Myxococcus xanthus
MATPTRFAFTQPSSPGTEFIIELTDENTIAHARRILSGEEKNEIHVHGRIIKRTQPYNPRFSFHLDPATIRFFEIAIEVCDANMVYVEDHLDEAGGAFLPGGHWCPWDSKLTREVT

SEQ ID NO: 10046 - protein, 175 aa, Myxococcus xanthus
MSIYEMTVPCFAQMLRALQGFLKKGEAHARELGCDSKNLLQSRLAPDMHNLASQVQFTCTQAQEAVLRLGQQPLSALDAPDDMEQANALIERTLQLLSSADRARIEEGAQRQLSIELPNGMAFDMTGSEYARNWVTPQFYFHLVTAYSILRNNGVQLGKADYVPHMFAYLRQPAA

SEQ ID NO: 10047 - protein, 501 aa, Myxococcus xanthus
MKLDKPENLFAAIEQCDVFAVEDLLAKGADPDEVDLDGYQATPLAYACSHGDEAAVRALLDAKAAPDAAAFQPPLVAATAHGFAALVSLLVKAGADVNAGDETGASALWTAAANGFADIARCLVEAGADREQADNDGKLPSIVALENGHVALSNYLSDPASYPATHSFWRGSKKAARQAAEARRAQVVDRATGKDVRGAAAAEPEWTFSGGIARSPWATQDFPSVAAAGNLELVGRMLDAGLDPDWTQFKGNPTALMLAARSGELGAVDLLLARRAKVNHRTDKGLTALHMALFKPSARVHGPIIRSLLAAGADPNVPDDEGQRPLQRALAHAMPTLVQALIEAGADPFIRGRVVRITVVMVPGDGKPSDASSEFLYRAHKGRWYDRGTAPIPYPRWSQGIGDGPSEACSEGCSPRQPGGTHAASTRAPTGRASPWPTSFNQHHGRRLSSPMVCGASEPGCAGAGRAAAGRAARQALPVLRCPAPTSPRCHRRGRPGWRCS

SEQ ID NO: 10048 - protein, 332 aa, Myxococcus xanthus
MALSALTALLLSTRRELTELRAQVEGLTRRIEAATFEGLIGESPSMRALYRQVERLGPTPLNVLVTGETGTGKELVARALHRRSGRRGRLVAINCAALPESLIERELFGHARGAFTGAGTERAGLVEAADGGTLFLDEIGDMPLSLQTRLLRVVQEREVTRLGEHQPRKVDVRVVSATHVALEEAVRRGTFRADLRFRLEEVRVDVPPLRARGEDVLLIAHHVLAQEARKARGFTQKASEALRGHPFPGNVRELASRVRRAAVLATDELLRPEDLELGGDAAPMIPLEEAREAFVQRYVREAIARCGGSKKDAAAALGIGLRSLFRYLGEGD

SEQ ID NO: 10049 - protein, 251 aa, Myxococcus xanthus
MNLTETTMKHVVMGLFLALTVMGCGSTKDDDGEGPDGNPNEQSAGLCSASKACPSGQFCFNGLCAIGCQSNGDCAADQYCDLEDTGMAVSFCKNKKVPTCSSNSQCLSNQVCIEGLCSLAPPANPPSCNPNTSDFKDGCDTYAVCLDAADQGSQQPYCASFAPCPEDGVCPTGLGGAVCNDGYLPNKGRFCMQGLCSDNSNCPSAWSCVKPFSGAVLGFCSPGAFGFPCAENSHCKSGQCFSAPGVMGTCM

SEQ ID NO: 10050 - protein, 634 aa, Myxococcus xanthus
MATVFLATDVRLSRPVALKRMHPGGGTGRAERFRREAELAASLHHPNVLEVHDYGEDEAHGPFLVCEWVRGEDLRALAGRLSPAPPEAVMVLGWELARALAAAHARGIVHRDVKPDNVLVAEGGPLKLADFGLAALEDQERLTSTGAVTGSLPYMAPERIDTGAYSPASDVYAVGVILFELCSGTTPHAGKGAAHLAASVMTKDAPPLTEVVPGTPAPLSALVARCLAKDARDRPRDGAALALALEELLQREVGPPADVAREFLGDPVARANRWRRARFERLLEEGRGLLARGEGARAAKVLNAALSLEPTSAEVVALLRQRPRRSAWRAGAVGAGLVLCATAGWWMRPDQRVEDVTTPRGAEPSSGQASPRTASVDGASTGERLHAPTPPGQERPASGTAPGMLDASREPAPSAESDTTNLAGALVPTERAADGAKAKPARPSVSTGRSGGMDSAKRAVSPLPTGHSAGAEPTGAARPLVPAPGPDVETTLPARPALLKVTARPWAEVFVNGESHGYTPRVRELSLSAGTYRLRFVNPLCDEVEQEVTLAPGETVTRDVVLSPRKAEVLIHAPAGARLFVDGREVGIAPLPAPVVVEHGRHTVTARRAGEPPLVREVDVVAGRRLEVALDVTP

SEQ ID NO: 10051 - protein, 79 aa, Myxococcus xanthus
MGTVLAVTQGLGLAAAGISLGTSLSLRGPDGRYSASDAGTARTLNVTYLVGAYAFAVAYAYGVLDGLVLTPAPPVRPVP

SEQ ID NO: 10052 - protein, 83 aa, Myxococcus xanthus
MKRRRVVLSEATSGKPVNTLLTVARARGCYFSEAFTLYMGAEVAATLAYAHQRTDDAGISLGIVTRDVNCVYRTMVSTDSGPR

SEQ ID NO: 10053 - protein, 213 aa, Myxococcus xanthus
MRVKVPKARRFVALAGNIGAGKTTAAKMISQAFGYELFDEPVIDNRFLRDYYADMTRWSFTLQLEFLIRRVEHHELIHSYRRSCVQDRTLYEDPEIFAKYLHGLGHLTNAELDLYYEYFQRLSRHIIRPDKVICFEVGSVEVLLQRIRTRGREEEKGIRHQFLRGLNGYYASFPLVIQEKYGVDCLTMDVSKQDIRRGRGREEFLDRVSTFLS

SEQ ID NO: 10054 - protein, 49 aa, Myxococcus xanthus
MVRNLREAEAPGASVAEVVRKHGITEQALYRWRQKFGGTEASEAARPGK

SEQ ID NO: 10055 - protein, 695 aa, Myxococcus xanthus
MTGTYTLRVRRENYVDAQQTVEVRANQPSQVNLTLLLVRGDVAGTVQLSDGATPSGVTITVTQTGANTTTNAQGQFTFTGLPLGTYNLTAQKEGYAVVQQSVTVRTGAAATVAFTLVRAQGRVEGTALLEGASSHGGITVTLAETGATTTTNGQGRFAFSSVAAGTYTVEARLSGYAVARESVQVQENQQATVSLSLARERGNVAGVIQLEGGSSPVDINVTLAGTAFSARTNTAGQFSLTGVPTGSYTLEAQKDGFATGQRTVEVRAGEQAQVSLTLSRARGSISGVVLLEDANTTSGISVALVESNASVLTDAQGRFSFSGLIVGTYTLSAYWTGYEIQERSVVVRNQETTVVNITLRRRPGVVTGTIQLEGESHHEGVTVSLSGHGATAMTDAQGHFVLEDVPQGRHTLAASKANYAKAEAALDVREGEPLPVSLALSRLGALEVSAPKLAVQGGHLTLTGSGFGAERGPFTVTVGGEAVTDFISWSDTEVVARVAHHVAPGERDVVVTPGVPWRRNTTTSVWVVPQKTVAYGEHWGVGVLASNHVSVWGGPSLADIHPIPAGLTDVVSVATSRRTAFALQADGTVVAWGGDLPSDLSVPADLTEVVAIAGGDSFVLALKADGTVVAWGESAIAPSSDVRDVVGIAVTSNASQAFLAGGTVVTWGQDNEGRATPAEQLYLPPHDLLLRIPAR

SEQ ID NO: 10056 - protein, 68 aa, Myxococcus xanthus
MQVPMTPGALKHWPLLQWLFSAHGKPKAPGLQNPRTAPEKGFTQLHAEGQFELSLQSPCMQKRPLLGR

SEQ ID NO: 10057 - protein, 121 aa, Myxococcus xanthus
MGCLGFLRSQQAQRRIGEWIGLDAGVLAEGRRADLAIINPEGLDGKLDEIAEAPMENFGGFVRLVRRNDAAVKAVLNSGREAVREGAVAPSLGRERGFGKVLRAQYLSGMKFFPASEASSS

SEQ ID NO: 10058 - protein, 224 aa, Myxococcus xanthus
MVRYTQKLRLSGLLQSLELRCREAADANLPLTEFLYRLLADEVERRDGKQLDVRLRRAAFERPSTLEDFDFSFNVSVPRTQVLELGTCTFVERHENVLVVGPAGVGKSHLAQALGQRACRAGHAVLYVSAHDMLTQLRASRADNSYERRLLRFTTPALLIIDDLGLRPLTGEEGIDMYEIVRRRYERVADFNADGRLDVAATIAAANTVSLFPGLGDGSLSERA

SEQ ID NO: 10059 - protein, 90 aa, Myxococcus xanthus
MDGAWLGSIDISIKKAFTSRAFDITTQELAKNAQPGGQFYGIHASNDGRVMIFAGGIPLKKNGKVVGAVGVSEGSGDQNHADATAGASAF

SEQ ID NO: 10060 - protein, 46 aa, Myxococcus xanthus
MNALIECSYLHGVNVFPAESFLLVESSGGACSVTDVGITEEIDRSP

SEQ ID NO: 10061 - protein, 315 aa, Myxococcus xanthus
MHDYSLDAENARLIRELGTRSGMAVPLMARGRTLGAISMGRTDPKRPFGPSDLALMEELAHRAAMAIDNAHLYQEAQEGIRVREEFLGVAAHELKTPIISMNIVLQSVLRRRNERPSAERLMQALESAEKQVQRLMRLVDDVLDVSRLHAGRLKLHLERVDFLAVVGEVVERFIETAARTGSRVNVRAEGPVEGMWDRSRLDQVVANLLGNALKFGEGRPIEISLSRGEGAAELVVEDHGIGIPPERLLHIFERFERAVPTRHYGGFGLGLYIVRSLTEAMGGTVRVDSTPGLGSRFTVVLPCQPLKEAAGESQA

SEQ ID NO: 10062 - protein, 172 aa, Myxococcus xanthus
MTDLSAKNPKDTEVVMTQLILPPDANNLDAAFGGKVMQWIDICGAVAAQRHCRQVVVTASMDDLHFHAPIKVGWVALLHGRVLAAFRTSMEVGVTVHAENPLTGERHLTTSALLTFVAIDKDGQRVPVPPLLMETDADRMAFQEAQTRRTLRLARQKENQSWLKVMTPIAGA

SEQ ID NO: 10063 - protein, 780 aa, Myxococcus xanthus
MVQQLRAAKRYQAADSLSNLDPAIKTQSKPSKLDQELQSEVALNSVSAERDGLNARQKLLDQETRTTARQTLDDIAKNPKSKAPFNVEPGATKDHAVLVRKDKDGKVTERLELSFQGDKVKVDSTKVDKSGEARRSIFESEEPGGPSTAIDARWKQDAAAPPPSREELAEGKVKGASYAETKFQVGPSASQTTTQRAPDGSLTETKKTFSQINKGDHVTGRFGEFMETVPSDKMDVTTTVIPPPGAKDEQGKPAKATVTESSSYSQGDRLRLTRTSTKAVDCPAKADRPAGAKELEKVRKESIQADDAAPRSYVLEKAGDGELNTQTFFEGQPNVTLVTRKKLEGNTVTETTEGRLPKPAQKGEDVELVDVKSTTTRTYNNQGLITASHSDQTDVTGIRRVKDFQRTETRNAKGEVEVTERTTGSEEGGGKPKRTYEQSLTTAQTPKEPQVVHAQSKLTGPEGTAEASIPPERVMVNGKSFDGPNQLKQDLPPAQAALGAYAVNGLQNELNHFTQLSALHTQALKDTPEAPESEGMGVAGDASEYGLARLAKEANSRAANAQGKPDPADNPKFFSLKPEDAFKQELTLNLNRNERLSVGMVGGFQVAAGINDIVSGVGDFKKALDEQNLLSFKGARELATAGADVLGGAVGVVEGVGLMRFAAKGSGTTISPSGLPGPLNGRVNPIKFAEWSGRLNAAVGVISGGLSVAEGISKDDTYQVALGAVQAGGALAGYFGTAAAAGALGGPAGVAVALSVGMVTIGVGSVIERERAHALAEQRI

SEQ ID NO: 10064 - protein, 201 aa, Myxococcus xanthus
MEQAHPTRRFGIKKDITFTSGQTLDGVEIVLDHAEDQPQRVNVKNLKAYGAKAYVTMDFYFGSGFLFRNEAIDTPPLQIPAMPLTPPFDLIQLHTMVLVGSEGEFGLTSASATVHTEGGSTPEVTMPPPLQLTSVPLGTMEVPAVAPLEGFSLSWNVDPAAQVVRGHLRHKGRDPSLHWSVTAPSSITSFTPFELPVDLSS

SEQ ID NO: 10065 - protein, 902 aa, Myxococcus xanthus
LQLPLPCGARGCQWTSLFFAGSESGTGTELWKSDGTEAGTVRVKDLLPGIGSSNPSELRDVGGMLYFAATDGLTGKELWKSDGTEEGTVRVKDIAAGTRSSDPRPSSLIGMDGSFFLTADDGVTGRELWKSDGTEGCTVRVKDITPGTQSSSIHPAVILNGWGFFAADDGSYGLELCKSDGTEEGTVRVKDIRPGLSSGLLPEGMVKMGGALYFPGTDSAAGSELWKSDGTTDGTVLLKNIRPWSASATVQSLTPMEGVVFFTADDGTSGRELWKSDGTEAGTVRVKDIRQGPLGSAPQWLVALNGVLYFVADDGVSGAEIWKSDGTEAGTVRVTDLLPGAASVSPTSLTVSGGRVYFLGDDVIHGRELWVLTPPAPADTVPPSVTCPAPVSAEATSTAGVQVSYPAAEATDDITLSPALSYDIPSGSVFALGETTVTVTAADEAGNTSTCQFTVTVQDSQAPLLTCPDDVVWEATSATGATVSYPAASASDDVSSVEVTYSQGSGTPFAVGTTPVTVTVTDGAGNASTCQFTVTVRDTTAPTIVCPAEVVVEAMGPAGAVAGFVLPQATDAVTASPQVTASPVSGSTFMLGSTPVTLTATDDAGNVGSCQFLVTVRDTAAPVLTCPEEVIVEATGAGGATVSYPAGQAVDVVSQVQPVYSHASGADFPLGGTLVSVTATDAAGNAAACQFTVTVRDTTPPELGCPQDVVLEAEDTQGAVVTFAGVQPRDLVTHDPSIAFSQTSGSRFPLGTTAVAVTASDAAGNEASCRFAVTVQDTTAPQVMCPSDVSVETQDPEGTVLSYAPASAVDGVSSVTVAYSLASGGHFASGTTPVVVTATDTAGNAAQCSFLVSVRVRKPTLIPAPQTGCSSSADAGGPMSLTWSVLVLAGWQVARRRLRHRM

SEQ ID NO: 10066 - protein, 307 aa, Myxococcus xanthus
GRHGDAHPRHLRGPGAGIHTRLLSGALRLPEGGGGRISRIYVDDLVESIRVVLTRGEPGALYCVADDRSAPSEEPVAWLSQRLGVPMPPRIPLAQLNETLRGDRDISNARLKSLGWAPRYPDFISGYTALLKAEGHGAGPTQLVIRRLVAEDAEAFKALRLRGLRDNPESFAASVEEDSALSLEAVRGWLVGASQCVLGAFDGGQLVGALGLNRESRARLAHKAMVWGMYVAPEVRSRGVGRRLLTALIDEARKMGGLKCLLLAVSVGNAPAHALYRSLGFRTYGVEPNALKVGETFLDEELMVLTL

SEQ ID NO: 10067 - protein, 81 aa, Myxococcus xanthus
MLSGSTELGPGEAVPLAHAYELDDAPDFERFLFVTSDAPLEVASVLEAARALARRPTDARTLPLPLPDTLGQTSFTLEKVR

SEQ ID NO: 10068 - protein, 751 aa, Myxococcus xanthus
MTRSLLFSLLLVPALAAAAPSASAPQASVRRFALLVGVNDGGEGRARLRYAVTDARSFGDVLEELGGVQPQDKLLLMEGDRAALESALVRFKAMLAAATTPGTRIEALVYYSGHSDEQGLLLQKDRFGYRELRKALESLPADVRIAILDSCASGTLARQKGGVRRPAFMVDASSAVRGHAILTSSSEDEVSQESDRIGGSFFTHNLVSGLRGAADVSGDGRVTLHEAYQFAFHETLARTEETRAGAQHPAYDIELAGTGDLVMTDLRSTAAVLVLGDLVDGRLYVRDSQGRLVVELKKYAGRTTELGLQKGRYSVMRKVLDQTSQAEFELGEGGRTVLAASAFRAVQGELTAMRGGGPLPASLSSGAGAGVAEVAAAGSGHRSRFFNVGLFPGLQTNDLMNAGEPVDNHLSMSMGVSRMARLDGVAMALGANVATDRVDGLQLALGANVVRGDMSGTQLAVGGNWAHGKAEGIQAAVGLNVARSSGSLGQLAVGANVSGTSLVGAQLAVGGNWTAGNVDGVQGAVAFNHTRDRMAGLQVAVGLNWAAEARGAQLSLVNVGGDVKGAQVGIVNVAGRMSGLQLGLVNVSRELDSGVPVGLVSIARNGQFHVEAFGNDFNYANTAIKVGSRYLYTTLVLGMGTMEGARGPSHWSLGLGLGAHIPISERFFLDVDAVTNTLYGWNLSFEGDRRLHQLRLVAGFQVARNLAIIGGPTLNVLHDSNGEPVSNLSRLSNLDAGGVLLWPGVQVGLRI

SEQ ID NO: 10069 - protein, 188 aa, Myxococcus xanthus
MSKLLFAAFNDGVSLSMAGNHEAAILAFDKVLAVDPKHVPALTAKGASLATLERFEEALRCFERAIEVDPTEAEAHRDAALCQLELGEPEAAAQLLQRATQLNPTPGYRESAAVQIYTLGNALLTRGSRRPDKARYRQARHVFELALTLSPGSAECARALADVWEHLGDPVQRDHYAQLATRLRPVPA

SEQ ID NO: 10070 - protein, 372 aa, Myxococcus xanthus
MIVMLEPDSPESVVSAVLQVASQYKGVTPRTHVIGGSEYTITEVYLLGSTAQVPVEPFEQIPGVRQVVRVSQKYRVIGRHKGQRTSAGFEYNGVTFDERSVNVFAGLCAVDNPENVDTMMAALARLGIRTTRMGAYKPRTNPYEFQGLGAACLPWVFESAGKHGIKVIAMEVTHPRHIDEIRDALERSGNATGVMLQVGTRNAQNFELLKSIGQQRVFPVLFKRGMGITLEESLNACEYVASEGNPKIIFCLRGVKTHLGDPHRNMVDFAHVPVVRRLTRLPVCVDPSHAIGQAAPPPDGLPDIFHAIGQGLIAGASMVLVDFHPHPEAALCDGPQALRMEQLPALQRYVQLVRSAYETAVQSGDGLQATGA

SEQ ID NO: 10071 - protein, 190 aa, Myxococcus xanthus
MGKTSAGFWTVLGVMLLGGCAHQSQVKVDNSEQPYRIGREDVLDIAVWRDAELSRTLPVRPDGYISMPMVGEVHAAGKTPTELADSLKEAFQPYVQEPRVTVIVREVNSSRVFVTGEVANPGAYPLRGRVSLLQAIALAGGFTDFANSDGIVVIRTDSKGGQIPVRYSDLISPDGGHEVMLRPGDTVVVP

SEQ ID NO: 10072 - protein, 280 aa, Myxococcus xanthus
MTRRLRLDTALRVFRVTDPSSLPRAGLARSTLPTFFTQATLGVTNRVAERLDVRAGYRFEAVRIIDVGQRAGYAHTPSIEGWYRATRRLGLGLEYRYQGFLYEGALSQSHGAALGLRYRLTRPTTFTVRAGPVRYLAPVAQQGGWVPRVNVELQREGEMFDLGVSMGHDLVGANGFTNALWADYASVMLARRFTQKFSLFGAASFFRNGQAPSLDWAVFRGAPRVSQGYAVSGGVEYRIDRRLSAQGAVDRIAQVGLADSASAVDLTRNVFAVRLVVTPW

SEQ ID NO: 10073 - protein, 126 aa, Myxococcus xanthus
MLGKPNVHGSIFRFEGQVTSFVPGQGPCYRCLYPAPPPPELAPSCAEAGVLGVLPGLIGLLQATEALKLILGQGAPLVGRLLTFDALGTRFQELKLRRDTQCPVCAPGATVELIDYERFCAAPTPA

SEQ ID NO: 10074 - protein, 428 aa, Myxococcus xanthus
MYEASVVVRVEPQRPGEEMVQRTVSEIIEQRLLTVRQELLARPVLQKAIEEMNLYPDIVSEKGMESAVAQMRKDLTVRVEGETAFELTYANRDPQVAAQVANRLPTIFSDETLKIRQAQAARATDLFNEEMVQLGKAVSNWEAKLSQFKVDHLGELPEQMEMNMRGLERVSHQLQTKSEELRVAEGRRSDLARARNAVDSEAGRLEAAENGLTRSLVNARTTWTEDHPEVKRLQTELDGMSARRKEAEGRLWAERAERTRVATLIGNIQQEIQDLQKQAEAYQGRLNNTPRWAHELAVMNRDYEIARTKYQSVVSRKVEAEIAQELEAKSAKSLFNVISPAGVPATPARPDRMAGMLIVFLLALGLGALTGAVLEMRDDSLRDGTEVRQRLTLPVLAVVPEMQGKTERRILMPASGARNSVSNPTSLN

SEQ ID NO: 10075 - protein, 241 aa, Myxococcus xanthus
MERAGNFLPRVDDNPTGGNAVDRRVVTLTAPASAAAEQYRSLYYRLERMRDLRPMKVVALTSAMPGEGKTVTSVNLALAAARANPERRILLVDADLRRGGVAAMLGMRNKMGLAELLAGDCEVRDVVRRFNSTRLALIPAGVTPEDTAQVLASGRMKQFLKAVREGFDEVYVDLPPALPFADAAILGHQADGMLMVIRANVTSGKAVHLAVESLGGAPIIGCVLNGAEVHSAPYLKNYEKK

SEQ ID NO: 10076 - protein, 426 aa, Myxococcus xanthus
MGAAACAALFAPEGTHTPLSQLWPTLLWMGAAFVITFQFTLYLLDLYDLRVAAEDRVRGYRFLKAAGVTAMVAGGVMLVTPLVVPMQLPPGTLLGGAMGALAGTLMVRVSIRALVGAPHSVLIVGEGPKARAVASAIDAGGEGTYRIVGLTDPRTSGEALEETAARLNAAYVVQAADDMRGANWVDGLLRCRLQGRRVYEATGFCERVLRRIPVQFLRASDFAFADELTVSPLRRTLKRGFDIAVASLLLMLSAPFLLLVVVAIKLDSKGPIFYRQERTGLFGSTYHLWKFRSMRTDAEKHGPVWAKANDDRVTRVGRFIRRARIDEIPQVFNILTGDMSFVGPRPERPVFVEQLKEQIPFYGLREAVKPGLTGWAQIRYPYGASVEDARNKLEFDLYYVKNGSLFLDVGIIFHTVRHVLLGRGAR

SEQ ID NO: 10077 - protein, 167 aa, Myxococcus xanthus
VGMDMEAPLPAEWAEARRRLELERQGNEVLQGRVDRPTRIVAIGGGTGLPMVLRGLARRATPKAREPGIDITAVVAMSDDGGSSGRLRRQHGALPPGDIRNCLVALAGGKNALKDVFQFRFGGARGLAGHAVGNLLIAALAELKGDFMEAVRMSGELLGAGPLLRHL

SEQ ID NO: 10078 - protein, 122 aa, Myxococcus xanthus
MAVYPGDDDADTLHLGVYTEGRLVGVASLYREPPPDALRATTAWRLRGMAVDATLRGHGHGAALLKACMEHAARQGGSQVWCNARMTASGFYRAQGFAQRGEPFDLPGIGPHHLMWRNLGTS

SEQ ID NO: 10079 - protein, 142 aa, Myxococcus xanthus
MAKPQYWLIKSEPSVYAYAQLEKDGKTEWTGVRNFEARNNIRAMKPGDLCLYYHSNEDKAVVGVAQVLTPPGPDSTVPDEDWAATFMGPVVPFTQPVDLATIKATAALKDFPLVTRGRLSVAPVTATHFKQVLKMGKTVLPK

SEQ ID NO: 10080 - protein, 47 aa, Myxococcus xanthus
MTLMGVAFATQMEAAVVAVVGLALYASSALLTNKAPATAATSVAKQA

SEQ ID NO: 10081 - protein, 190 aa, Myxococcus xanthus
AVGLFGVDETLAQLAPLPGPDALGQLRPVPTVASPAFGVLDGQALAMGRIRGANAASAAVLRVSDVPRREHTEPRVTVNAVTAFEPESELTDPFYTVLAELHAQVRAWEEKAPQGQTLDPAGMARLWEGALAACEKRGDKVTDAFGRRLKLSRLPVDLLALTDPRAVVSSGTRLPEDVENWNAWVAQEAP

SEQ ID NO: 10082 - protein, 110 aa, Myxococcus xanthus
MPIPEIAPARLAELLAGPAESRPALLDVRFPTENAWVALPDSLLIPLPELEERAEELEALRGRPVVVYCHHGVRSLDGAAYLMSLGIDAVSLRGGIDLYSLQVDPSLPRY

SEQ ID NO: 10083 - protein, 55 aa, Myxococcus xanthus
FVALFGDNVRRLFGASADALAGAPAPQASKSLRTFGQNNSEYDEVQAVLAPPPVM

SEQ ID NO: 10084 - protein, 226 aa, Myxococcus xanthus
MRQRHSSVTDIEIIEDFSSTARCDEGFLRVRRLRCRNRRADGSSSPVYRVDVVDRPRLDAVAVLVYRRGASGLEVLTRMNLRPAAYFRKDSRDAMTVPDPASGYLRVEEIVAGLLEPEDKGEDGLRRRAAAEVHEEAGFNVKPEDIRLLGGAFFLAPGILSEKVFPAAVDVTDLSPEEPEGDGSPLEEGTQLHWRPIQDVLDACRRGDIPDAKTEVALTRLLALQP

SEQ ID NO: 10085 - protein, 487 aa, Myxococcus xanthus
MSSLPPWLAQFLPILILLGAIGLVLTRLPKVELGHSEAFKRRRFFNWFPLGMTYAFLYMGRYNLNVATSAMGDRTSNADFGTIFAWGTAVYGVAFLLNGPLTDKLGGRKTILMAAAGSAVANVAMGGVVYAVLTHNWAPPGGLVATLSFLYAVNMYFQSFGAVSIVKVNAAWFHVRERGLLGGVFGILISLGIYFAYDWSRLIVKAAPTYWAFFVPAAILAVFLVVDYFVIRDTPSHAGHPDFDTADASSGETGPQLGVAGVLKRMLTNRAIIIILCIEFCSGFMRNAIMQWYPKFAKATGLGETFVAANWGMLLCVAGITGGMFAGVISDRVFDSRRGPVSAVLYAGMSVGAVISVFVLESVALGWTVIFMSLCVIGVHGMLSGTASMDFGGKKNAGLAVGIIDGAVYAGTALQSILLGSILPMGDEAKTAANWGNWPYAMLPLSFLGLLLATQVWNARPQPKSTPVPATLPVPSEAPANRTGTGG

SEQ ID NO: 10086 - protein, 423 aa, Myxococcus xanthus
MGSEKDVVYQAKLLSCVLRGALRRFATGVESRCEGPAALTTDACAVLESEILAMQAGVTQVLARFRVWLRAVGELHLQERSRASLRLVDEYVSLLVEGGFRRSVADMKSLPRGEPWHGLRKGLMEAVLREEAYRKEHRLRSVLSPTGDNEEYILRLGFLKKFCMNVLFLSSKRRQKRQGWEEMLFALAAGIAMTVATAVAFWAQERYAQASLNFFLILVVGYMVKDRIKEGLRRMLSRVAAMHLADRTTDLVDPVTGRVIGACEERVDYGPSLKVPDTVAALRQRDDFLTATQGELSETVIRYQKQIVLDARHVPRTQRGLTGVTDILRLNVERFLRDMDEPELALEYVDLADLSVGHIRGTKRYPVDMVFRFTVVEEETDRSQDSVQFVRLVLDRNGIQRMQRFTDPGPGMPPSRSGWKAAA

SEQ ID NO: 10087 - protein, 248 aa, Myxococcus xanthus
MAYDDFKKRIRDDWRDTLRSILERARSQGSSAVLAFDLDSTLFDNRPRQARILREYGAARSLAVLAACEPHHWVTGWDMKEAMRACGLEDALVESHFAEARRFWAERFFTSDYCVDDEAIDGAASFTHEVVATGARLVYVTGRHEAMREGSVSCMRRHGLVLPDDDRVLLVMKPTLAEDDDAFKREAHARLGRLGSVVAAFDNEPTHANDYRRKFPEATVIHLATDHSGRPVELLDGVISVPHFALGS

SEQ ID NO: 10088 - protein, 361 aa, Myxococcus xanthus
MYRKMYLIRRFEERAGQQYTLGKIAGFCHLYIGQEAVAVGPVEALRPDDYMLSAYRDHGQPLARGSDAGMVMAELMGRDTGYSKGKGGSMHIFDIEHHFYGGYGIVGGQIPLAAGMAFASRYRNEDRVTVCYFGDAAASQGALHETFNMASKWKLPVIYICENNRYGMGTAISRIAAVPEIYKRASAYDMRGEPVDGMDVLAMYEAVKDAAEYCRAGKGPVLLEANTYRFRGHSMADPATYRTKQEVEDERKGDPIPKLRAYILKQGLAQDDVFESIEAEVNAQVDQAVKFADESPEPSLDELWRDTIVEEGEEDVRPRERVLGQKVNWPTYPSGQELKVTWDLEPREQAEAADKKAGLIR

SEQ ID NO: 10089 - protein, 242 aa, Myxococcus xanthus
MPELMYREALNQALAEEMERDANVYLIGEEVGRYNGAFKVSQGLLDKFGSARIIDAPIAELGFTGLSVGAAMVGLRPVVEMMTWNFAILAMDQIVNNAAKLRHMSGGQLRCPIVFRGPGGAGGRLSSQHSQALEANYAHFPGLKVIAPATPADAKGMLKAAIRDENPVLMFEGERLYAIKGEVPEGEHVVPLGKADVKREGSDVTIITWSRMYYFCMQAAEELAKEGHQRGGPGPAHAAAPG

SEQ ID NO: 10090 - protein, 31 aa, Myxococcus xanthus
MSYAANLENATQPDAPKIIAAVKKVLYREGA

SEQ ID NO: 10091 - protein, 514 aa, Myxococcus xanthus
MTEGKIVKWLKKQGDKVSSGDAVAEVETDKSNLEIEAYDDGYLLQVLVGEGEMAKVGAPIAYIGAKGEKVGAGKQVAPAAAPPEQKPQPAPAAPAPQAAAKPASSGGGDNRIAIQMPSLSPTMTEGKIVKWLKKQGDKVSSGDAVAEVETDKSNLEIEAYDNGTLAEIVVGENQMAKVGAPIAYLTAKGAKAAPAAPAAQPKPPAPAPEKPAAAKPAAAPAQAGGRRLRASPVAKRIAREKGLDLTQVSGSGPSGRVVKRDIEEALARGPAAVPAAKKAPAAQPAPGVRPEPTVLPLSSMRKVIAQRMTEVKPGVPHFYLTIEVDMEAASKVREEAKAMDLKVSVNDLIVKAVAMAVRRYPKINVSLQGDKVVQFHSVDVGIAVALEEGLITPILRDADQKGLQAIASGVRELAERARKRALKPEEYTGGSITVSNLGMYGIDQFVAVINPPQASILAVGAVSEKAVVRDGQLAVRKMMTATLSCDHRVIDGAIGAEFLRELRGLLEHPTRLLF

SEQ ID NO: 10092 - protein, 98 aa, Myxococcus xanthus
MNDDMTRERLAQGVSELESRVGPPLPLAESLHKALDGAVFPLSARQLTWVARENEAPALVLSLLGSLPRASFGSVDAVARALEGDLEATVPQQSASSR

SEQ ID NO: 10093 - protein, 153 aa, Myxococcus xanthus
MPTEGEPISVSLHVGNFEGPEFDGPLTVTFHPTGSPSQQTKTLTRDGVNWHTQFTPDEPGPWDLEVRYRGTHLKVITARFSVASSPLPRGMGWGLILVGAGTALALGLRNVLRRVKSSGATPGATETPPPPAAPSTPEAGSVPIPPADPPSGQ

SEQ ID NO: 10094 - protein, 385 aa, Myxococcus xanthus
MNPSELPAVLYVDDDALNLRVFDANFGQRFRIFRSSSPSEALALLEQRRGEIGVILSDQRMPGMTGVELLERARTIAPDAKRMLVTAYADMQAVIDAVNRGQVTRYFVKPWDRTELQAALDDALKIARLELRIREVEGRMLKSERLATLGQVTAGIAHELMGPVGYLSQNVASLQRDLGSVIQYVSRHLQTDPEPAVAETVEDLPALIKDLADGAEHLRQVALGLRAQARGEDLEATADVAEVVSFAVKLARAEVRERARLTSNGEPVRVTFGPVKLCQVLLNLIVNAAQAMGTTGRPGRIEVRWTTTPDDVVLTVADNGCGIPMEQQERVFQPMFTTKPVGVGTGLGLSICRELVTQFGGSLRLSSTQGEGTEIEITLRRAPPP

SEQ ID NO: 10095 - protein, 51 aa, Myxococcus xanthus
MDLVGFGTSQGAVALPEKVRMLLLRRGVQRAQDRLAAALAAFRQSIAAPLP

SEQ ID NO: 10096 - protein, 96 aa, Myxococcus xanthus
MGDIGQVVHGLASFTPGEEVVVFLQKRGPRAFRVSDMAQGKFQVKREGKTALAVPEPTESQLLDPVTRKPAASALQSMTLVELKAAIREALGEQTP

SEQ ID NO: 10097 - protein, 288 aa, Myxococcus xanthus
MLALTLGQVDPYVRSRVDAGDTRTQCLYWTSNRVVWNQSTYGNPDTAGDSEFDAIRASFQSWQDIFAECGNLTLVEGPRVDEREVGYRRQGTNTNLVLFRTRDCNSVVPATDACWADDTCANTHDCWDDDDNTIAITLTTYDERSGIIYDSDISFNAARFSFTTANGGTCFPPVTTHCVATDVQNTATHEVGHLIGLDHTRATGSTMNPSAPPGEVSKRVVDSGSRGFVCDAYPQGQASQSCLHPVTSIELGPKAGGCSAAGPGGALSLVAVWSLWLARRRRREEAVR

SEQ ID NO: 10098 - protein, 207 aa, Myxococcus xanthus
EEEPSYRRTVVPRHPLCLVWPVREYVYHLDAAGSARTPGDSEVAAIEASFDSWRNISDGCSDYRFTRGEDWRAPIAVGYDETRPRDNYNIITFRETSCHEVAPADDACWTEETCGNVYQCWEHPPGTIGLTTSTFSYRDGRVLDSDIELNASQPARGYGFLFTTVDSPVCEGEPSVDCVATDIQNTMTHEIGHVVGLDHVFVPGATI

SEQ ID NO: 10099 - protein, 254 aa, Myxococcus xanthus
PVLEGQDYNLEGQEVRLTLLHTSDIHSRLIPYDFTPLKTDVDLGTIPEAGPFGGATRMGALLKRERSQGERVLHVDSGDCFQGAPIFNLNTGEVEFKFLSEARLDAAVVGNHEFDAGLLNFTQMAQQHAMFPLLAANYFWDDWRANGNHQTALEVEPYTIRNVKGLRVAIIGMANISSLNSIVEGGNSLQVTPLEQNEVARAYVDLLRPVTDLIVLVSHLGLHEDQDVIQGYEAYYEYSRAKAYVQPQRGPLPE

SEQ ID NO: 10100 - protein, 82 aa, Myxococcus xanthus
MVDSKGKSEETKHNAVGDNGYAERIEHVEGTHPEPWPGIRGRSDDEENELPTGTSRERQASVTQTQRKLEQEAHGRKEPTRK

SEQ ID NO: 10101 - protein, 62 aa, Myxococcus xanthus
MVERPGPRYALVVEYAPENAEGPLRRAVLVEDIRASETQTLHRVWRMLSNAFGLRGAGLAGG

SEQ ID NO: 10102 - protein, 135 aa, Myxococcus xanthus
MMRALDSLKRGFYKARPLGAALVALWAVSAGAEVINGAQLPDGSKRVGENRYRSPRDFDGTLEYYRAVYSTSGYPRRQIVNQPGVKAVHISNPSGKNFAGLNIYEANDEVRIYIVPTQQAAKPAKKPETTKSRKK

SEQ ID NO: 10103 - protein, 437 aa, Myxococcus xanthus
MEDTDQGRSTPESVQAILDGLNWLGIDWDEGPGKEGPYAPYFQMQRLDTYRKHADQLIAEGKAYRCYCTKEDLDAQRQVAEKAGGAFKYPGTCRERTEPPAGRNAADAVIRFKMPAGDGSVSFTDKALGTITKTHSDLDDWVMMRADGIPVYNFGCVIDDHLMDITLVARGQEHVNSTFPQLMLYQALGWTPPDFAHLPLILGPDREKLSKRKHPEADVMVHKRNGVMPEALLNFVIRLGWSHGNDEVISREQMLEWFDFSDVGTTSGVWNPEKLLWLNQQWMKQLPVETVVERLLPFLEAKGIQAKGDPRLETLVRTLRERSNTLEDIATTAANVYFRSGITLDEKAATKHLSGESLNLLRKVRETLTALPEWSVEALDGVVKQVSEASSVGMGKVAQPIRVALTGNTTSPGIGETLVLVGRDESLLRIDAALTRG

SEQ ID NO: 10104 - protein, 404 aa, Myxococcus xanthus
MGMPAWAVAKTPGPRTEAVAEPVEDAPLSGGVVDDVEPPEPLLPEEDDASQAQLEGAMAQSLPPPSQPAPGAQPPSVSPLPGADDGATAEQDANKRKQKQRPGQAQDDSLGENPDAIDDKPKGEVQTIRVIGRVSARARADERNQYQRRLSIADARVGVSTSLPNLEAEVTADLADSQMLKDAFVRLADDRKRFRLYGGQFKTPFLQRSLESSWDLPIQTRGLVEEYITETHQMGGRRMGLMGEVRLKQLWGLKISAGFFQGAIDNAGARLKEDAAARVSLRPFNFKHAHRGSQHLRLRSNGPGAQARGGRGRGAEAGGLRLHRRGHFRAAAPGALHGADAAGPVPHPRGQRMGHPARRGRGGLAASRRHGAGGRTFTGGRLQRAARHSLPGPIPDGARAAPRR

SEQ ID NO: 10105 - protein, 107 aa, Myxococcus xanthus
PTGPQDVMVQCAQKAEALQAPLKRGDVELRFQEGQWKAYDAAKAHLSKGRKSEALAQLNDCIAEGRILENRYPDFKEQKFDIGGTSMSMLELLQACAKERKALQPSP

SEQ ID NO: 10106 - protein, 78 aa, Myxococcus xanthus
MRLVGYWMGREHWGKGIATRALSEFLVLEPTRPLHAWVALNNLASIRVLEKCGFHTLRNENPHHPDGVAEVLMRLGST

SEQ ID NO: 10107 - protein, 316 aa, Myxococcus xanthus
MKEFICGGQRRVPTGVLPIVNPLEQWLLPVQGGLRATWLGHSTVLLEVDGKRVLTDPVWGERISPLPFTGPKRFHPAPVTIGQLPPLHAVVISHDHYDHLDYPTILQLIPLGVPFVTSLGVGAHLEAWGVPPERITELDWWESAEVGGLTFTAAPSQHFSGRSVADRNRTAWSSIVVRGPHHAVFFSGDTGLTQEYVEIRQRLGPFDLIMLEVGAWDPAWGDIHLGPENALQAHDLLGGGAFLPVHWGTFNLAIHSWDEPAETLVKLAPTNAPLIMPRLGQPIEPLQVQSIDPWWREVDQTETEPAPAEAVTEPSD

SEQ ID NO: 10108 - protein, 377 aa, Myxococcus xanthus
MTTTRRDLLKFGALAAASAALPGWAKPSKPIKRAAKPLNILILGGTGFTGPFQVNYALARGHKVTLFNRGKRPSPEWPSAVEQLFGDRNTGDLKSLQGRKWDVCIDNPTSLPFWVRDAGKVLKGNVGHYLFISTISVYADGSKQGITEDAPLAVYEGKDAMAETQDSLRADIEHLYGPLKALSEAEAHKQFGKRVTIVRPGYIVGPRDETDRFTYWPHRVAQGGEMLVPGDGSDPMQIIDGRDLGEWMIRLAETGTLGTFNAVGPAKPLSTTAMLKGCERVTGKKPTYTHVSPEFLEEKKVELPIWVSSKSGPYAGYGAVSNTRAMAAGLTYRPFDTTVTDLLAWFRSQPAERQATLRAGITREQEAALLKEWHAKL

SEQ ID NO: 10109 - protein, 84 aa, Myxococcus xanthus
MILAVAVLGLTACGSDDSEQSAECKKYLACIKATTPEFQATAEVTYGADGSCWNSDETARVCTAACTDGLTQLRGHHPDESACK

SEQ ID NO: 10110 - protein, 306 aa, Myxococcus xanthus
MANAAASWEYVADVDFIYDSTQDASCTNANPAVTFAVQPWTAGGACAFFPSGGGCIPRTVVIDIPSLDPAPPTSPNVTTGTVLIHELGHVLGFRHEHSASSLNPCYEDSNWRELTTYDVASTMHYPWCNGVSTSTLNLTYLDAAGAAALYGWHTNANNGDRRYPAAHTNDYTAALQMGQSFLIPFAVTTNFAEGCFLVGNGPTAAHIRYSDGMAGAVLASATSVVDTGVQCGVNASYTWHRANFPGVAMFANSVFTVVFGNGTQTLRMAINIGNPYTSGNMWDSFGGGRSLSPWDGRVRMGRLGPP

SEQ ID NO: 10111 - protein, 151 aa, Myxococcus xanthus
MTARVPIDPGLFEFWRHMFEPREREAQIEWRVENWRRLHGAVLPFDAEEFRALERRIIGHAGRHDTSTAHARADPSGLARGAELAHVTIPTLVIATPEDPTNPESNARFLARTLPRSTLVTIDGMGHSVPRAVVPSLAKALLGHIETMAPR

SEQ ID NO: 10112 - protein, 310 aa, Myxococcus xanthus
MWRLQHYGWLFPNTYYAKHSGNRLLNLPLGVYYLVLAWAPYLAAPVSLGALAWVATPTREEDPSARRSLQLALHLGGACLVYVLYIVWVGGDDRSAFPSVRLVLPVLPLLWMATVMLVAGASRHWTKLSPRACAVGVAALISLAWAEDGLQLLKASVPAGGDSRQGLLKTKLAQFTDEPHGPLPAWILEHTQPTDVIAVPWAGRVPYATGRPTLDMLGLNDTHIAHLPSLQRGIDVKMDPEYVLARRPKLIFVNVNHCYVQKECSFADAGGWKIGDRQLIELLRQSPDYDWVKDAPTDISVFRRRESLAQ

SEQ ID NO: 10113 - protein, 240 aa, Myxococcus xanthus
MGKRGLDVQEVVISRSQSTEFSSGISVAWSEDQYLVAWTDTRYGSHDIFAARVRANGSVLDPNGFIISAAPGNQNYQSVTATKYGFFVAWSDSRSGSADIYGTRLKRGSANVLDPLGIRISTASTTELSPRVASEGDEVLVSWSALTADTARVRAARVKRNGDVRDRNGFAISKGPANRQLLFGNVAYASGRYFIVYGRAPVMDEPPYQVMVGTRVKNDDVVDNPAIRISHAPSVEQLAP

SEQ ID NO: 10114 - protein, 135 aa, Myxococcus xanthus
MDCVARFLGEMKASPAPGKPGKTLLDDTLVLVMSEFGRSWASRSSNGTYNLPDDHHPYTSVMFAGGNVAANRQVGTYTTRGLGVPVDIIEETGQTQKRVPRSAGVVTTALRIMGMETHHFFIPGGYGEVVGLRKG

SEQ ID NO: 10115 - protein, 383 aa, Myxococcus xanthus
ITVRANAGDLELLRVAVGDHILLGGDNMDLALAHTLNQRMAAEGKKLDAWQFNALTHGCRQAKEALYADPSMERAPISIPGRGSSLIGGTLRTELTREELDRVLTDGFFPVTPVTELPRTARRTGLAQMALPYAQDAGVSRHLAAFLTRQAQALASSPDAPVDVSGKAFLHPTAVLFNGGVFKAGPLKARVMEVINGWLTADGGAPAEALEGADLDLAVARGAAYYGWVRQGHGLRIRGGTARAYYVGVETAMPAVPGMEPPVKALCVAPFGMEEGTQADVPPQEFGLVTGEPTRFRFFSSSLRRDDKVGVMLEDVDTELASGGLEELAPIETTMPGQPSVFSDLTPVNLQAAVTEVGTLELRCLEKDGPGRWKLELNVRMKE

SEQ ID NO: 10116 - protein, 129 aa, Myxococcus xanthus
MLGRSTAKVDNYLEGLHGSLSSVSRVRATDVASVLEKAKGIDALRSNRPAYLSIYLSEAFTYTFGNANFRLVGLDPRMDMALRLLKSDLCTSVHVSLRMDFDTHNGGGHAFSCAHGRGGWTVSRASWAR

SEQ ID NO: 10117 - protein, 367 aa, Myxococcus xanthus
MSEHQVYEFVALDRPLTAKQLVELRAISTRAEITPTRFWNEYHRGGLMADPAQLLLRYFDAHLYHSNWGDRWLMLRLPREGLDMKALKACFPARGPSTLTVSGTSVLLDFQVRDEEPPDEESPPASLAALVPLRTELQRGDLRGAYLAWLGAVQAGGVASSAKEPCVPEGLGTLSAAQQALVAWLRIDEDLLAAAAHGEKKHEDDSRAFRAWVRDLAPKDQMRWLLRAVDAPERPLGSELLRAFRAEHAPASHRPARTVHELQALMVAQRAARERAESARASAATAAAMRRLQRRLTALSRDVDGAWVRLEDRVAASEYDEAVKLAEDLRALAARDDDLAGFAARFAALRGRQSRRRGFFDRWKLRD

SEQ ID NO: 10118 - protein, 134 aa, Myxococcus xanthus
MEADAQAEAFLKWTAQRLDEALRHWGVGGKTAAGYGRLVREGPLELQRPQRPVRASPALTEFLSWVEARRADKVEQRQVLVGFEAEWLERLVSLAPEAREAGAKALRSLVKNPKLEARRDELLARMGVAVGGRR

SEQ ID NO: 10119 - protein, 136 aa, Myxococcus xanthus
MTAQTREQQRALDVYARVRTARDKGKALCAEYKPRVNGLGAAVLRDGLAAALAFLEREVKSNAAAQHLLEDLTWCLERARLPGLSEPSLKRLGLPGAVRALGLNEYMLATRESLRLLVWFRRAVQATFPLEEREHA

SEQ ID NO: 10120 - protein, 401 aa, Myxococcus xanthus
MSDASFALLPRDGLSAKDGRGWYTSEVGRGYSLPWPLPTTVRGALRAAWGHDAMAVSGAVLAPDEWERCSEEVRLRHLVALRRPLGESFSLAHRMWPFPADAVCVRDADGSEHLERLEPRPDGAATLGPDDDDAREALWHPRRNSSGKPMAAPLFWPEARMMAWLRGAVEPSSETPDALTPRTDIHLAIDVETQASQDSMLHSREVVELLRLQRHSGRTPVLEEWALGLSCAWPAPASGAPRGPLGLGGRRRLSAVEPLKVDLFAIPDGVARATRGLRLVLATPAEFQRGWLPDGFERVAGTPPRYVGRLPCIDAPVVLRAALVPWPLDVSGWDMVRRRPRPTRRWVPAGAVYFFEKHSGGDFTANELRALWLASWGGGHAEALGQVLPGVWQPPRHGQGA

SEQ ID NO: 10121 - protein, 596 aa, Myxococcus xanthus
MKYVVVLKEGPVQGYIAQSRRTRDLWYGSHLLSNLARTVAVSLTESGATLVFPHPEQAKDTSTGVANKVVALVEDAPEQAARNARRAAKERLLKDWRRVFKTCESMLIPEASVLAEEQLDTFLEIHAAWAPIADTPTGYADALHEAERALEARRGLREFVPWKQPPPAGTHKSSLDGARPSLLRRERHVGHLWRDFRIGLREELDALGVLKRVGGNPGQFVPVPSIGMAAWLQTAATRHPALLAALKAECARRGFQTVSVRNRPWVEAFPYDGQLLLPERVAPYFEEYAVPDARQAAARFVHEFVEPLRDAVRAEPFPYVACLVADGDRMGRALEALARQPDGHAAHQRISRALADFTRQAKTIVEVEHRGVLVYAGGDDLLAFVTPMDALACAQALAVAFRATLEAALAGTRAEVPTLSVGLGIGHVLESLGELLELGRRAERAAKDAGRDALAVLVAKHAGRERLWTAPWATDPVERLTRDMALLSSDTQPLPLKKVHEVAALARRFPSGTTIAPELAELLSDEAARILARAEAGRSPVKLTPEAVGLELPTSPNSLEPPHASLDRWASRLLVADVLARASGKLIPASDKEGVR

SEQ ID NO: 10122 - protein, 249 aa, Myxococcus xanthus
MPLLRGARLFRGNAGAKPRDGSEVWLIALKWLREFRQGTEPAPAGSAEQVGIARKPGEGNRAGRSNWPEADKIRRFARPSGKDSRGGFAPRSEGKAYPEVHAPRPQHSATAAWPRAGFGLPIVFHFQQKRREDNDYYQPKEPEDIQLQWEESGSEKLMDRLASPLIVKALPLADGRFEPIALWLERGAPRGGQVVMTQRGTAVPRTRVPFESSFRARDDQPLFQTLQQADNLRDAFFWWLEETRRAQEA

SEQ ID NO: 10123 - protein, 278 aa, Myxococcus xanthus
RDTGIAHVGAASEAESEGSNIAPDAELALPHRHGRRVDHLSRAHLLRDWDDLAGALTECRRAIHDAPDDVAALALAAELAGLTGRTDLAVRAHAQLGRLLPLDARPLVRQARLLVSLGRHAEAVSVGEEAVLRNPEYVEAYQVLGRAHLVQGELAKAMLRFEQAVHLHPEHGYALNNLGLTYLRAGEAQKAADVLVRAAELLPHVAYVHNNLGVAYERLGQVEEARAAYAAAMHLSPRYVQARVNADRMRRTAHADMAGARTAREQLLPSQGEAPASR

SEQ ID NO: 10124 - protein, 161 aa, Myxococcus xanthus
LSFAEGEVTKLRREFKLVLEEKTAAALGTRLSLELEGHLPSPTRIVSVYFDRPGGPLAARALLTPEDCLKVRTKEYSPDRGADGEARVVLEVKRERHGLTQKRRVWVPRSDLGRVLRGGASLLPLIAGGSLSPVLAVTYTRNVYQSSQAWRATVDQDIRYL

SEQ ID NO: 10125 - protein, 869 aa, Myxococcus xanthus
MPSSPDSSTPTPPAPPSRPGFGARLWRWTKRLLITGLVCLVLGAITLASGYAYYSQDLPSVDALRNYQPPQVTKVTCGDGTLCAEFAHERRTLIRVEDLPPHVRNAFLAAEDADFYKHEGLDFFGITRAAIKNLIPNSRKSGASTITQQVVKNLLLSPERSFSRKAREWILTPRVEEALTKDQILSLYINQSYYGQRRYGMEEAALFYFGKHAKDLNVGEAAVLAGTVQLPHRINPVTNITRAKSRQRYVLDQMARNGFVSADVAEAEKEKPIVLAPRRGKVVGPYYTEEIRRTLIARYGEQAVMEGGLRVDIAMVPKLQLAAEQSVRDGLEAVDRRQGYRGPRGALEKGQWERYRALIATRIEEAGRRQKDQGYVADLSSLAKVEKEEPKTPEIAGAPLDPLEEEGTEEQRPDLSPEDEAPLSADQLLAQSVRLKPMEEGLRLTGYVMQVDDKRNVARVDLVGRTAEVAFAAASWARQKGKSAPKKISDVFTEGELVFVRVLKAPPAPAFVEAALDQVPEVQGGLVVIRPENRHVVALVGGYDAERSSFNRATQAKRQPGSSFKPFLYAAAMGSGRYTPLSKVNDAPEAVRDPYTGKTWKPQNYDRRFHGPMTLREALTKSKNTVSVRLIEALTPATTIDVARRAGIHSPLPENLTLALGTGEVTMLEAANAYATLQANGRYAEPLLLLRVRDARGKVLEEHQPAFEETLPPAVAYLTTSLMRSVVEDGSGRAVLALERPAAGKTGTTQQSRDTWFSGYTADWVASAWVGFDNNSPLGGSETGGRAALPIWLQFMRVAHEGLPTREFEVPPGVVQVRIDPISGLLAGNSVPGRLEPFLEGTQPTAEAPPPGQVTTDQFFLDEGNRRGL

SEQ ID NO: 10126 - protein, 384 aa, Myxococcus xanthus
MLASQLSSAGLSPVVLEAPTADAAETLARAQGARTLVRLSLNVEGGELRARGDVIGTWVNFWSGRTPTRPPKPAATLVETVPADPTVLALALEGAGTSPTSPPETGPQGIRLLGAALARLEHPLAALAAGDLDGDGRDEVVALTEHDVSVFDAEGRLVARKELDSLPAGSATTREPFGALAFLPGPPRLAAWSTRHAHGELLALDKARATLRAVGTLDTAPLGATERGTFVPGQTAFAPTLKLAEGRALTVPAPFTTASMDAQRMLFVHPDGTAAFYAHAGAAPARWTNLGAGSALGDLDGDGVPELITTSTQLTPAPDVLRVHGTSGGDPGTHEPLWQGALPTGRALYVVTARLDGDTRREVIVGLWKPDGTSELFLLRQGAP

SEQ ID NO: 10127 - protein, 107 aa, Myxococcus xanthus
MLHALLLPPIPGPALAVVLDAGGRKDLLGVELPAIGALASTAARDARARERALALAASVPLVPLYVQGLGMRFAPDVGGVMMDAQGLPSLDGLHVLPPEGTAMGGRP

SEQ ID NO: 10128 - protein, 549 aa, Myxococcus xanthus
MRLRTRLALAFALLALVPLAVVVPPTLTRLRDTLSRELDARMEAATASAQESLERSSATARRAVEELVDSTSMEDLAREARDRPTRAIQAGTAEALMKSRGLSVLALFDREGRVLSSGHLPARRGDPDPALFAVTQQKSPRPVPVRVEVRTASGLRQLPALVTARPVDFGDLRLWAVGGVLLDESLAQHLARLTQTQVTLLAGDTPLASAGTAEPPTVTKALPLGDAATVRLVFSRAAAREAEQGVMRAFLLLAALGGTFAVLLGLLVSRWMTRPVEALTEGARRVAEGALESQVTVKASGEVGELVRTFNRMTSELKATTERLMASERIAAWQEVARRLAHEIKNPLTPIRMSLETLQAAQEAKHPRFQDMFKESAGVVLEEVDRLRRIVDEFSHFARMPKPQLAPVDLGELAQSVLALYATPPTGIQILPTLQTGVVARVDRDQLTQVLVNLVKNAEEAMASTGGTLRVRVRSTEADAIVEVEDSGPGIPLEHRARIFEPYFTTKDGGTGLGLAIASRILQEHGGKLEVGGEPGHGARFSLVLPRAA

SEQ ID NO: 10129 - protein, 120 aa, Myxococcus xanthus
MGAERIKVLLVEDDGDSRELLAELLESEFDVKTATDGLAGLEMFEAEHPDVVVTDESLPGMCGTELAQKVKEREPRARVILVSGYTQVQGSEHCDVVLRKPIDVERLSAAVCRLGDEARH

SEQ ID NO: 10130 - protein, 128 aa, Myxococcus xanthus
MRSRGLPLPHELDTRIFVRAGSAEDPFTAEVYAQLLQDANIPVLVRAGRSGVVDKLTTGNVLPWWEIHVPADQQVRAATLIEQERLRELATNDEAAAAAEAEERETESPAAEAKERETESPATPPPAY

SEQ ID NO: 10131 - protein, 105 aa, Myxococcus xanthus
MKKLMALVAVSGTLTACGPVKSTANILDAEVQIQAARTAGAEKLAPYEWSAANLYIGKAREEVGYSDYQAGVDFAVKASRYANEAREKAMPVAGSTEPGARTPNP

SEQ ID NO: 10132 - protein, 79 aa, Myxococcus xanthus
TERFPMRRPSLVTLLPLLFSLSCVSGSKIRADTEVLAANVERARRNGALRCAPVELATAEAHLDFARGELSQGSSFRAR

SEQ ID NO: 10133 - protein, 274 aa, Myxococcus xanthus
MQTRYVPNLTGIPETMLWTLHSRAGEAKRPDGVLKDAEALRIYGAIDYDFEKSFGRAEPSLAIRAVEMDRSIRAWLATHPDGFVVSLGEGLETQAQRLDNGRLRWLSVDLPEAVAIRERFLTPNERLMHFPVSAMDRAWMDRVDASKGVFIVAQGLFMYFEEDDVRRLIVDIAERFPGAELLFDTIPRWLSRRTLKGLHRTRAYQVPPMPWGINRDALEATLRRWAPRIRQVELKPYTFPRGFFRYGYNGLNMLPWVKERLPALVHVRFAERSV

SEQ ID NO: 10134 - protein, 110 aa, Myxococcus xanthus
MHNAVYLGIAIVAEVVATSALKSSNGFTRLGPSILVVLGYGVAFFCLSFALRTIPTGIAYAIWSGAGIVLVSGVAWLLHGQRLDVPALVGIGLILAGVIVINTFSRSAAH

SEQ ID NO: 10135 - protein, 571 aa, Myxococcus xanthus
RVPGSQEPVIVGKLRKSPVHSPSDRRPFFVSSPQTAIPFGNYLLIKRLAVGGMAELFLSQRPPDPELVVLKRILPYLSEEPEFVQMFLDEARIAAQLHHPNIVQVHELGKEGDNIFIAMEYVEGVDLRRVMAEESKFGATVPYGVAARICAQVAAGLDYAHHSRGVDGRPLELIHRDVSPQNVMIGYDGRVKLVDFGIAKAGAFMERSKPGVIKGKFLYLAPEQVSQERLDHRADIFALGTMLYEITTGRQPFAKPTTEGILYAIRYEDPSPPHLIRDDYPPALSRIVMRCLTKDRALRYQRASEVHDALESFLASGTLRQSLDVSEYIGRLLGEEEERTILHIPEAKGLGRREATVPLQGARLSQDAEPPRRPSVLESTAPTLSSTTPESDLASVPSAQLTPGLTARPTPRRASRDSVPVSFSGDEPEPATLMARPRDLPALQAEDDDEDSEMSTAVATSPVGYRATAPVVEDLDIGDGESTVPQRSRPRDVPSRPAPTPPAPVRRSSPHMAPPPARVAEPSRTRRPGPSSPSHVAAPRRPPPPEEDAAPSVSITPVPPRRAFSLDLELS

SEQ ID NO: 10136 - protein, 416 aa, Myxococcus xanthus
MVGARRALASTPLEVLAIASTQPVLGMLAAYQQNALFALAGLLGLSLLWTLMMGSGRKAADAEASSGSSDTLSLSAAMASAPAPAAVTPPPAPAPAADPFAFAPPPAADPFAFAPPPAAPAPAADPFAFAPPPAAPAPAADPFAFAPPAAPAPAPAADPFAFAPPPSGDPFANSRTAQAPMGDPFAFAPPAPPPAPAADPFAFAPPAPPPAADPFGSAEAFPFPAPPQQQPAHVGAMPFESSPESFGGPEPLSPASPRRGAFAFEDQPTAAYSLQQAADPFALAASQAAPDSPETTRVAAIPRELLQASARPPTSDAIPMPPPRSAPQPAAIPLPGLGNSAVALTDEQHFQEVFREFLTTRERCGEAADGLTYDKFVQKLRKNKEQLVQKYACKTVRFQVYVKEGKAALKATPVKD

SEQ ID NO: 10137 - protein, 205 aa, Myxococcus xanthus
MVRLKFLVFAFLVIGLGVAHLPMLSGPLRERAVAGASAQASAGAAEVARRVDSRRAEVQSLALKLAAMPEVVSVAAPPLPEQPAPRNQRERERERVEVDAAAARAFTAERFAAVRSAVEGLIPQELKGAVVAVVAQDTQFHAVAGAEPSSDAAKLDVVSLVKSGASVVDAFGAPHAFAAVPLSWNAGAPAVTLVLGAPLLDEGAL

SEQ ID NO: 10138 - protein, 119 aa, Myxococcus xanthus
MKVLLRGVHLNLSDALKSYVDEHLVRHIERFADDEAAEIDISLVDTNGPKGGMDKECRVTVRLPGLSSVHVTETADSLFPAIDASRDRLETSLKRMLGKRRDVHTNGLPEDVAVDVPTY

SEQ ID NO: 10139 - protein, 321 aa, Myxococcus xanthus
MKVVAVLAAALLSQAPAVPTPLEDVDTRPGAEALLESPSASKQLATARPAKPNGWVGLSAEARAALVSEDADAPLAGRLLRMSERFINTPYVLSPLGEGQGVDPDPTFRLDAVDCLTFVEQSMALSLAGSEDEVAPLLERIRYASSPTYEDRNHLMEAQWLPNNIRKGFLTDVTRRYAGDDAVTVTKSLTKVSWQSRSSQALGLPKAQHVVGTYPLNMLPLERVMAHARDIPSGTILVVMREDLPLKVTRITHLGFVVQRKKRTYLRHASRGGYNRVVDEDLETFLARNGRYSKWRVTGVSLFEPRRPDVASGGSVARPVP

SEQ ID NO: 10140 - protein, 170 aa, Myxococcus xanthus
MGALLVKTARKEPEVEVRAALLAAAGEAGDAKQAPALKEFLASDSESTRFAAARGLCRLGSPEGFAFAGKLLGSDDRFVRRQGLELYEGVSAKKASPALKPLLEDKDRALAAGAARILHEGGDASMLEWLVLASWNAKSDEKLAYERELETLQLRDDRRKAILRKAGVAQ

SEQ ID NO: 10141 - protein, 28 aa, Myxococcus xanthus
KVLLKARNSSDVVLAVAMAAVLALEHRG

SEQ ID NO: 10142 - protein, 67 aa, Myxococcus xanthus
MAGLFLMAHPADTARELTIAVPLPGDREIVTTCQIRRREVDGVALEFGELDWDDLIALARYLHPRLP

SEQ ID NO: 10143 - protein, 253 aa, Myxococcus xanthus
MDAHTVPHLRAGLDIALQPLHPFEAHIASFIDGDHAVPDLARAARLPEIEVKVVLKALLERGVVELHRLPGAPAMRTMTDELPILDGQDFLVPEPMALGDEEPPARPVPVMRAPHRPLPTTPTRAAPPPSPPVPPRTVRRLGIEPGSAEDFLQRAVRLEREGQVDRAIDVLTRAIAQAPEAAVLYSKLALILVHQRKDYRRAVELLERAVALEPAHPVFQQNLLKVTGLAAASPGPRKEEKRGLFARLTGRRS

SEQ ID NO: 10144 - protein, 228 aa, Myxococcus xanthus
MQRLFSWRPWVELAKTLLIVCLVGALVWSDVEEAAPDAMKTAWLGGAEGLSLAVAHVSGLASRLACLLVVLGVGDYALAWRRHIKDLMMTREEIKREYKDSEGDPRHKGQRKALHRQLAQGGAARGVQKATAVVVNPTHIAVALRYDVDECEAPYLVAKAREGDARAMREQARRLGIAVVRDIPLARSLIHYDVGEPIPEELYQAAAVVLRTAMDARELDGHPRRQTS

SEQ ID NO: 10145 - protein, 220 aa, Myxococcus xanthus
MVRLALVLSLSLFLRVEAGVVLDAPVTSAVALGGLVIRELLFGTSVGLVAALPFDAARMGGRFIDLLRGTSAEASLPLAGSRESAAGEGLYHLLVALVVSGGMWPLVISSVLRGFGVVKLGAFVPTEAATLHVVLLAGAAMATGLAVGAPITAAVLTVDCFLGLASRAAPQVNLQEVGTPLKILGGGALLWLGTGVLCERLLAGVLSVEGALALLGEVAR

SEQ ID NO: 10146 - protein, 365 aa, Myxococcus xanthus
MQLRKTLGAAALVTAATMASMAGCSGRDDDTDPLPDAGCLGTCSPDSGTGDAGTGDAGTGDAGTGDAGIQTVTIREARLLGDRPQIILEGVVVTTVVYVSSKDTGVSADFWVADPNNAQDGIFVQKYRTDPPTTYVPAKGDIVTIQGYVQNNSRFRDREGYRKVLKNNFDFRGASEATPMVITKTGTMTAPNDIAVSIDNGFGNADGGVGRPNLEHLGARVHIQGPLTLTDANPMAMKRLATPDDGEDTMHFGFEVSGGVLVNNLTTFGTTTDGGTPRCDYRVMVNDGGSVTFPDGIRGVWDTFTHAPCMDGGTSTFSCFNDAGVIPGTTNTWTTVLYPEGCDDLQGVVTEPETFRPAAPGAQTE

SEQ ID NO: 10147 - protein, 89 aa, Myxococcus xanthus
MTQDVFLTLGREALLLMVMASLPPIGASLVVGFLSSLFQATTQLQESTLSVVPKLCAAVLALVLAGPWIAGQLTRFTHQLLMLISEVAA

SEQ ID NO: 10148 - protein, 208 aa, Myxococcus xanthus
MGMLAVMSLLPFAVLMLTSFSKIAVVLSLARSAMGTQQAPPTIVLTGLAAVLTGHIMAPVMERMYDAGQVAYAEVASGSGAEMLSAASRVSEPLRAFLIKHGSAEERARFVDLARELRPVEEMDAVRETDLFIVIPAFVITELKEAFQIGFLVFLPFLVLDMVIANVLLALGMQTLSPSQVSLPFKILLFVAVDGWSLLARGLILGYR

SEQ ID NO: 10149 - protein, 114 aa, Myxococcus xanthus
MGPVAGVSTTMAARWLLGVVALAVLGWWLHRRGAVVTGASTAPRLNVVSRAGLSQRCGVALVEVDGRSYLVAFGDAFAEIRETAAPAPEFGHVLAQARRPMPRSRTIRGRREGP

SEQ ID NO: 10150 - protein, 199 aa, Myxococcus xanthus
MVTVGESRAGARLLLPSQVVQTVFQALPVERAPGIAPEVLAASLEARCLVGQTPLSANALDALVVGDVVVFEGVRTQAGQLFGPGRLVTRGFALSGDFLAEGFSLTRAQGRGIPQESDMVVVNKQEEGMPPLPVDVEIELTRVMIPLSELAALKPGALLPLHINASEPVVLRVGDRAVARAELVEIEGEVGARVLALLP

SEQ ID NO: 10151 - protein, 156 aa, Myxococcus xanthus
MERSLEKTLQSVEGVLLARVHLVVPAPPRVGQAPGPSKASAMLRVAPGNAARVRQSSETLKVLLAGGVEGLSPEAVSLLVDEVSTRVEAPTEVGVSPLTRLRALLAVLGLMVTGLSVALVLVTLRMRHYRDRTPTPSAPPGPARPVLSPGPARKVA

SEQ ID NO: 10152 - protein, 161 aa, Myxococcus xanthus
MAMDTLGPVGGAGASPAVEPSRERFSKVLDEVQGPAKGTGVPVATEGPPKPALTSAPRGVSRAEGVGPAAPGCADVKPGTRVDSVQAARSQQAAQVLDRVGQAQKRLDHILQLAQSGRSFTPAELLALQAHVYRASQELDLAGKVVEKATGGVKQVLQTQV

SEQ ID NO: 10153 - protein, 79 aa, Myxococcus xanthus
MPATADTGSAAGAGAAAGNQEAWDLLEAQKVLAAEGQKFNMAYLQLQNEMQKESREHTAVSNIMKVRHDSAKSAINNIR

SEQ ID NO: 10154 - protein, 107 aa, Myxococcus xanthus
MLSDGTVEVVCAATGLEGLKLAKSQTFHLILMDVVLPQLDGISVCRILKGDPVTAGVPLYMLTAKAKRSDMESATQAGADGYIHKPFRGAELMALVERLREARPKLP

SEQ ID NO: 10155 - protein, 129 aa, Myxococcus xanthus
MPGGRGPVFSVEALVGKNRLVIRLWGVVTEEEALQIGDASLRELERLRPGFDILSDLTGVTELPESGSGQIERVVEAARVRGFRRVVRVVGRSAMAAVRFQRSSRNVGHEAYLAFSLEEAEQLLEGGWT

SEQ ID NO: 10156 - protein, 464 aa, Myxococcus xanthus
MQQMEEAFGDMMEPDRPTIPRGDSDLFLRASLDRDNVYVGEQVTLSLYIYSRVDLSSVDAVTMPKLEGFWTEEVESPTQLSGEQRVVDGIPYRAYLLRRRAIFPVKSGTLSITPAEADITTGFLFAGHRVHRVSNALKVKVKPLPPGGPEDMPNAHVGNWRLSMDVSQTRVELGQPVTVKVSLEGVGNVKNVTPPALKGPAALKIYDPTTTDKVSPQRHRVQGRRVMEYLVMPQRTGSFTLPALEFTYFDPRARKYEVARTDPVTITVEAGAGGASSIASASPQSSSDQANEQKNVLTAGGLRPVRYQARFEAPGVPVWKRGFFVPTVLAPLGLLLGVALIGGVRGRLALRSEAGRGRQQAKAARKRLADAEKLQSSGDVGAFYGEVEKALHGFLEARLGMPVVGLTREVLAEKLTAGGADAERRAKVLFVLEACDFGRYGGGGDPAERQKVMDAAAAAMEGWA

SEQ ID NO: 10157 - protein, 131 aa, Myxococcus xanthus
MDMDSTPTTSAAPAASPASQATPVAVRLTDAAIQQVKSVITAQGFEGYFFSIRVVPAGCSGLGYDLNLVKESKAGDTVWEQDGVKIASDPMSSQYLGGTEIDYVSAITGSGFKFNNPNAKSSCGCGTSFTT

SEQ ID NO: 10158 - protein, 119 aa, Myxococcus xanthus
MDGGADGGDGDGGSDGGSDGGADGGEQGPPDKGDGGADGGADGGQDDGEGEPQDGGSDGGSAGEEDSEESEADGGSSQSDLDRQEAERLLDAMKQNEKNLQLWRFQQKKKQRKPNEKDW

SEQ ID NO: 10159 - protein, 192 aa, Myxococcus xanthus
SKALSPDAEGQGADLFDYKPPEEVPIRSWRLVLTVLGVLAAALLAWVLFRWWRNRPKHVEVVPTLPLDVRARKALDALKAEDLPSRGRVKDFYFRLSEIIRGYLGERYGFEALECTSSELMASLRRLSTPGLPEDKLMRFVSESDMVKYARADASADACRDALAFGYSLIDTTYVPPPPPQAPDNAAAPRVQ

SEQ ID NO: 10160 - protein, 148 aa, Myxococcus xanthus
MAQRGIRLELSGGPRPLTMVDVEDVVHILLLQATHPAAIGEAFLCAGPGEPLSLEKVQDLGAQALGLTPRTVRVSPALLRAMTTATDGVSQLTGRKLALSRKMAKQLLAPAWTCSGAKAERLLGFHPQRDLADSIRRSVQWYREQGWL

SEQ ID NO: 10161 - protein, 1470 aa, Myxococcus xanthus
MAALPELNVTQTFTGKRLLFAGATGFVGKVTLSMLLTRYGQDLDKVYVLVRKGSAASAERRFFDKVATSEPFQPLRDSLGDEGALAFIRQKVEVLDGDITDPWMGLEEPQVEALTGKVHAFINCAGLVSFNPSLEVGLNVNTHGLKFAAALAVRWSVPLIHMSTAFVAGNRSGLVFEDEEVRGYFPKREEMDGRDFSLEQELQDAARIVARLREQAEDRALTSTFRKKALDRLEEEGRDPNDEKTLRLAVGRERKLWLSGELVRAGMERAAHWGWPNTYTYTKSLGEQVLAATPGLRYSIVRPSIVESARHFPFPGWNEGFTTSAPLAFAGIKGPGGIPAGENTILDIIPVDQVAGATIGITAHAMDVEERRIYQLASGDMNPFYAGRSVELVGLYRRRYYRNRESGNALMNKLRSRVEPQPVSKKEFELFSAPMLSRGARFLKKAIDEVRPAWGAPAVQAMLDKAKVSLDEVDDNAQGIIALTELFLPFLYENRYVFRCDNTRSVYARMAHADRLKVPWDPEHIDWREYFLGTHLPGLEKWVFPGMESEREKRTVIPAHRDLLELMEATVHAYRHRVAFRMVAGEKEERFTYGEVHRYAARVGSFLLAAGIKHGDRVLLVSENRPEWGISYFGILRAGATVVPVDPGLSEAELVNIARRADARACLVSEDAARDFPGLFAALGDGVTVASLAEAMTGDPAHPDRIGPVRRSAAADDLASIIFTSGTTGTPKGVMLTHRNFAALVAKLAGTFDIGVGDGVLSVLPLHHTFEFAAGFLTPFWRGAEITYIDELTSDRLGEVFETGRITAMVGVPALWQLLHRKITQEFASRPQFIEQALKALMATHGELRNRNNINLGKLLFWPVHRKFGGRIKVIVSGGSALPDDVHKAFHELGFNITEGYGLTEAAPVLAVTKPGNKRQPGTVGRALPGIELRILNPDNDGLGEVLAKGPNVMPGYFGDREATEAVLKDGWLHTGDLGRLDAEGHLYLVGRAKDVIIDHNGKNIYPDELEELYQDHTHIKELSIVGLPDDAGGEKVACLCVPDYADRPREEVRRELEEHFRKVSAGMPFYRRVKVLRLWDGELPRTAKRSVKRKQVVEELKRQERMAASASKAREKAANPTTGGIADWLFPLIADVSHRPVSDVRPDALLSGDLGFDSLMLTELSSALEAAGVPLPAVEDLTQVQTVEDLRKVVASSGKRPTVETRAKEISKENERAEKVEIPGPDVVADVGRQLLSFGQKVLYGGVFDVKVTGKSFIPQNRNFLVIANHSSHLDAGLVRVALGDQGERLVSLAARDYFFNTPLKRAWFENFTNLIPIERQGSLRESLRMAGEALRQGFNVLIFPEGTRSTTGELMEFKSTLGYLALTFNMDVLPLYIGGAFDALPKGSVLPKTKTPLRVNIGPALGHADLRTRVQGMARSEGYRYVTRIAEDSMRALRDGRVLNLERVDLPPAGASPRASTSTEGKDS

SEQ ID NO: 10162 - protein, 260 aa, Myxococcus xanthus
MFELHVDSTRELLRDVREAGVKRVVLASTSGTIAVSKEAHVRDESADYPITVVGQWPYYLSKIYEEKLALAYCRKHEIPLVVLNPSLLMGPGDDRLSSTWTVVKFLNREIPAMPGGGISFVDARDAADAFVQALTRGEVYGRHLMGVNLSMKDFFQRLERLSGVPAPKLKLPSKVNVLGGKLLERWAKVRGTTPTLDPQEIDIGEHWFWLDASKAEAELGFRARDIQETLSETVQHIYGKMPPQSLPGTKGRLAELRENT

SEQ ID NO: 10163 - protein, 199 aa, Myxococcus xanthus
ILAGGAGTRLEPLTRERAKPAVPFGGRYRIIDFVLSNFANSGVYRMKVLTQYKSDSLNNHLSRAWRMTAFLGHYVEAVPAQMRTGLDWYKGSADAIYQNLNIITDEEPDYIFVFGADHVYRMDTRQMLDFHCTKKAACTVAAIPVPIEQGREFGIIDVGPDGRMRQFLEKPKDPPPMPGNPKMCLASMGNYLFSTDVLV

SEQ ID NO: 10164 - protein, 743 aa, Myxococcus xanthus
MAEVWLARQTGIEGFHKNLVVKRILPHLAEDREFVEMFRNEALIAARFNHPNIAQVYEFGEANGTYYIAMEFIHGEDLGRVMRKAASTGQWVARPLAIRIVAAACEGLHYAHSRTDDAGRPLRVVHRDISPQNILISFDGSVKLVDFGIAKAADQASLTKSGAIKGKFAYMAPEQAGGKPLDGRADIFAIGLVLYELLTGVRPLKRDSELATLQAAMECAIAAPSQVADVPEEMDPVVMRAIAKNSDDRYRDARQFQMALEEILVGQRWVAGSVQISELMETLFADRLAEEKAQGQVVPVGEDSANSGTPMPPTPPPQERGRSRTSAAADMNWEAPPGEASVRQRGSSSRTSMGPRRTSAAVPAVEPDEQGEWDAPSGIEEAPPPRRSRTSAELRRPSNPNSTQIARTSSRSDLSRTGMGEPPPPRRSATRAAQIVEDPGPPPSRSRASMAAVDERTRMEDEELDDERTMLPPPEPAPPPRRRTGMHSGIHPSEAPPRRRTSSRAEMPSPPPRSRTSSVALSRSRAEDAEVDRALEKSARSARAGVAKRNIATVGFIVGLVAVGVVFHKPILSVLNSRASDGQSVTLSVNTNEKVKVSVRHTERCGSPQPVTELGETPLVNATGVHLQDTLILVNEQQGIYKEEVDTLAFGEPGQAKSFTYEFRRGQLQLTLKPDGLRGISVKRNGQDQGTYLGNKGMKLDLMEGRHKLELQGGPLKEPFMFEVEIKPGLINKQTEDLSAFVG

SEQ ID NO: 10165 - protein, 76 aa, Myxococcus xanthus
MKEMTPSAALAEIVGAKPLPRTEVVKKLWAYIKKQGLQDAKNKRQINADDKLKPIFGGKKSVTMFEMTALVNKQLS

SEQ ID NO: 10166 - protein, 323 aa, Myxococcus xanthus
MWEKRRKGPKNRPPLRCMASAEAIVLASFPMAGDETRVTKISTLNVHAHRSTECCLVQIHGPELGKKYLIEDAELTIGRDQHNHIVVDLDNVSRRHARILGRGGKMLVEDLGSTNGTFLNDQEVLQASPLRSGDLVKVGGSIFKFLDGDNIETQYHETIYTLTIADGLTGINNKRYFLEYLEKEMGRSTRYQRTLTLMMFDIDHFKQINDVHGHLAGDYVLRELAQSIKRLVRREQCFARYGGEEFAVVLPEDGPDKARLFAEKIRRLIEGKSFVYDDKEIPVTISIGVAEQTSDMLEPTHFIKVADANLYKAKKSGRNRVVG

SEQ ID NO: 10167 - protein, 59 aa, Myxococcus xanthus
MLPLPFATVDIAPVGEQLIAVGGLVVAGLGALWAAWTRPSAQPVPIPVRGGSSRRNPRR

SEQ ID NO: 10168 - protein, 155 aa, Myxococcus xanthus
MAAGVVLALAEVVLAVASGDNPMHPVRMSAGVLLGPSAFTAAVSDSTALLLGMGVHLMISAVVGLFYSVLDAFLPPDGRSRWEFQAAVGMLYGIFVWLVNFQFIGRGSYPWFLDVPQFPQIVVHAFFLGLPLASLFTAAERRRLLLDAAESTPAR

SEQ ID NO: 10169 - protein, 107 aa, Myxococcus xanthus
MGLTQADVAERIGMASEVYGRLERGHMLPSVQNLRRLCMVLNVPPHELLGLGEGFTAPPPVKEKAAAKNREEDTPEMRRLMRNLRKLTAVQLKLMNLIASAMQHKKK

SEQ ID NO: 10170 - protein, 341 aa, Myxococcus xanthus
MRVTTVPTVATPGEDAQHTPGVQVDVYVKPGDAKRALREEALQGLCGTPKELSPKWLYDERGSQLFDDITRLPEYYPTRREREILLAHAGDIARLSGADTLIELGSGTSEKTRLLLDALEEAGRLARFVPFDVSEAFLRRAASGLAREYPGITVHAVVGDFERHLGQLPNGGRRLVAFLGGTIGNLKPAQRALFLRQLSAGLQPGDGLLLGTDLIKDRERLYAAYNDSAGVTAEFNRNVLKVLNRELGGNFDPDAFEHFAPFDEKNAWIEMRLVSRRAQSVWLSTLRKQVDFAEGEVLRTEVSCKFHQQQVASELSAAGLTLAEWWTDAAGDFALSLAFKR

SEQ ID NO: 10171 - protein, 392 aa, Myxococcus xanthus
MSPLIWDVAHVANYEEQWLLRALGAPAITDPAFDAIYDAFRHPRSTRAELPLLPPEAAFAYARRVREAVREHLHRLPEDSTAPLLAGGYVFGMVAQHEQQHAETLAATLQLMTSPEYHVPSARPRPRPGAVPQAEVFIPGGEARLGSTSPWAYDNERPTFSQHVAPFLMDAHPVTNGDYLVFVEAGGYEDPRWWHPKGWEVIQAEGLKYPGFWLPQGNHTWLRRRFGQVEPLPKDEPVQHVCWYEADAYARWAGKRLPTEAEWEKAARGSDGRPREYPWGDTPPTRARANLDGSTWGPAPVGSYPQGVSQDGVWGLLGDVWEWTASDFRPYAGFSAFPYPEYSEVFFGESYKVLRGGAWASAPVAMRNGFRNWDFPNRRQIFAGFRCARNAR

SEQ ID NO: 10172 - protein, 66 aa, Myxococcus xanthus
MTAETFHALQQVLERLGDPALREPQAANGLVARHVVPQHGLELEYAWDERSRTLTLLGLARVPNEP

SEQ ID NO: 10173 - protein, 382 aa, Myxococcus xanthus
MWAALVVEALFVLLTVAPLLWLHLKGLLSRNALVLLAVLLLLSPSMVEAMKFPVHPTTWSVLPWVLTGLAFHLRRQGLLLASLVLLFACKEEFAFGGVMLTLALFLRGERRLATFVGALSLAWLTWVYGLRPWLLGPTVDYTFRLRQGMEGGWFHYLSLRLAPPHVSRIGTLTLLFVPLGVWAWRERLRPDWTWLLVLLPMLGIRFLAMAWRFHYGVSVVAAALMGFLPVLRTRSPPWWVIASTSVVLLASNEPNLRKLTSTLVSPQTSPRHCPRTPERLASLSRGVDMLTQHSEGSALLSSNLVTLLAHRSEIYAVGGPQPDEGRVHEWVLVEKPPHGDVWPLTSTRVRELIDVWRTDASTQVIIDDENVFMARGRFTAHR

SEQ ID NO: 10174 - protein, 880 aa, Myxococcus xanthus
MFGLANARTTGYDLDALTYNGRTNRENLEFIAGRLVSEQRADGSWFHEGIFYPNAKTSYSAFGLAGYDAHLGTRYSDALVLAADWALTRQEATGRWREDFPFYPVGYGHVGVTARMMTAIAQARQRVDPAKASQYQAALDRAADYVRAHMNDWTDGPATDGQRYTHQVAWAMVGLKAAGPGANAVNTQALDTMATRLLSTRAGGGAPGWGSLEGDVPDEFATGISLYALCLAGRKPGADGRMSEALEWLKARQAVNGSWGADTRYPDIPTTFASLGLACFGDYSVGVTVSGGSRRPFEHDLPRIQSVTYPVTVRNHGYRTDSYRLSTQGGLTGWTATLSRTTLELAPDTEATLTLTITAPEGLEPSLTSDVMVVAASQEAEGVKGSVRVTTYTNPPPPTDGVPTTTTLLSPVDGQLTVALNNTLSARVVDDRGWEARGPGMGVVTFSVAGVTVGADNDADGDGVYSFVWRPRASTWSEVGVRDLRAVYSGVTLAPARENRLGSSASFAVEVHPSPFPAPSVTLCGLPGFTDALTLEVCGFVTPLAAGAEIDSATFVIQGVSHPVAPDPSGGYVDTVLPLMDGPNVIRLVATDSFGGIASEEAVVMVDNTAPELTFLSPANGAALRSYSVDVRMVVRDWSPVRVETNWVQVTDVPAGGGDVTHRVDLWPGENLILVRATDSVGHVTEQMLTVWVDAEAPWVSTGLPDGWLVGPQPGNAMPYDIGVYSASATTVTLSTGRTYTLPRGGGGVQATLDLVPGDNAFTIDVTSETGMRATLSRTVRYDDAAPVASLLLPVPGQTYSGVIHITARVTDAVSGVRWVAFTRDGSGIRAATLQPDGTWSAELDTRELVDGEHTVEVWMDDPAGNFAIQTFPFVTRNQP

SEQ ID NO: 10175 - protein, 562 aa, Myxococcus xanthus
MGRLTGPEQRFWLLVVAVGLIAGLGAVALLKVLRFTQQLFWRSAGEDFLAGVAAAPTWRRVLIPILGGALVTLLTLIVGRPMRGHGTAGIIESIWVKSGRLSLPRALLRGLVSILAVAMGAPLGREGALLSTGAASGSSLARWLRLGPGQARLLVACGASAGMASAYNVPIGAALFGLEVLLGSFALELFGPIVVSCVVATLVSRGLIADHPSFVIPHYTLLHPRELVLAMLLGVVLGVASAFYVRGINVMSDLLDRAAAWLAPFLPLMSMTVVGVTAVWLPQLLGNGYDAVNGALLGKLSLAHLLLLPLAKLALTATCAGAGVPGGLFTPSLFYGGLLGGAFGMLAEWVLPGGAPSGAYALLGMGAVLAGTTHASVSAVLLIFELTGDYPLVLPLMLSAVVSAVVSQRLEPESLYTSVLNRRNVRVPATVPHWLRQEGARALLKPVHQRVPPSAPLQQVLAFLLEQPLGQDLYVTDEAGRYRGALVLDQLKGHLPDHSQLHATIAADVMDMRVRPITPGLSLSEVAVRFTETSLERLPVVDGERRLLGTISKQDVLKQGTF

SEQ ID NO: 10176 - protein, 758 aa, Myxococcus xanthus
MAQAKQRVDPARAATYQAALDRAAAYLRANLNNNDTSAPGNGMPYTFQVAWTVLGLKAAGPGLNDVNTGAINTLAERLITRTSPGNAGWGNLPNEESNDFATGSAIYALCLAGREPATDPRLRNAIEWMKTRQSPDGSWRTGSATFDIPTTFAALGLSCFGDFSVRVSVVGAERQELSIDNPSPQQAMFTFTVKNHGYQADTYTLSTQGGLPGWTASVSPVTLFLPAGGEGTVTVTVNAPPRLLPALTSAVTLIASSGGAPGVTGSARVAAYTPPLPPVTGLPTVTTIVTPAANARVTVGNGTLLSARVTNGGAIVPGPAHGVVTFYVAGVPVGADVDADGDGIYAFNWVPAVDSWTITGAQDYRAVYSGVERQAPLANLLGSTASSTLIIDPFPHLTPMVTIGNPPAFTRETALDIWGYATPRAPGAVITYAAFIINGGAPIVLTPGNGGLIHTSITLEEGPNIIQMTARDSFGGVTTKQVNLTVDRVAPILTILSPAENAAVNTPVVTVRSSVQDQTPVRVETQWVNSSLLEFGNGTVEHPVNVSYGNQVILVRATDSAGNVTEKLLYLWVDAGTPVVSTNFADGQIYGPLPNGTFQYAINVQTVSATTVRVNGGEPFHLPRGGGQIQTSVTLAPGVNTLGISVISETGMTANLVRRVNYDVQAPTATLLSPTAGSTVSGTITVRARVTDNFGPVTNVGFSRDMSGIRVGTQQSDGTWTAQFDTREMVNGAHTIDLWMNDGVGNFAVQSFNIVVSN

SEQ ID NO: 10177 - protein, 322 aa, Myxococcus xanthus
MPTLILSAKDLRSLYTVELGLTAVERAFRAHGLGESLMPPKVYLSLPSYDGDFRAMPAFLDGAAGVKWVNAHPRNPEKHGLPTVRALYILSDPDTASPLAILDGTLLTAWRTGAAGGVASKFLAKKQPRTLGLVGCGVQARVLIDSHRALFGDNLELLLADTSEAAAKALQAEKGGRIVSTQEACGADIVCTATPARIPVVKREWFQPGVHINAMGADAPGKQELDARLLTEGRVFIDDTEQALHSGEVNVPRHDGLLRPEQIAGTLGEVVSGKKPGRTRATEITVFDSTGLALQDVALARALYDAALARGLGQSFDIIGNG

SEQ ID NO: 10178 - protein, 88 aa, Myxococcus xanthus
MLRTYFAPWLGTLPEAEQERIRQEALRRMGPDEDAFDAFRWYLGLRTRHDADHRAAVLMLRGKRLGCWCKPGPCHADILAEWVDAQPD

SEQ ID NO: 10179 - protein, 92 aa, Myxococcus xanthus
MKAWMTVVSLAVVPLAVGCTSSRELTRARVEANTLRKDADTLRGENATLKERVSELEGQLAKVQEERDTLKAAAEKPPEPVVAPAAGKKRKK

SEQ ID NO: 10180 - protein, 221 aa, Myxococcus xanthus
ISIVFIELFTRLFDVLVLLSRPRLLPPYLGLWLREVRVSPYRLKRSFETTRVLQTSGQIFKELMYGEMPVHTGVWLFWKAGLGRGSRLVDLGAGRGRTLLAARWLGAEARGVELMQHHVDLARKSVEKAGAQLIVGDATRADLQDATHVFTNWTALTPRTRARLVERFRTCRPGTRVITVTRPVEAPGFTVLSKHRLLFTWGLEHVWIHEVRDSVVGDTTN

SEQ ID NO: 10181 - protein, 569 aa, Myxococcus xanthus
MSSFRMTSKLLGALLLSASTLHAAPSWAAAPASTPVAVPNGNFEIAGGSGSLPAFWKSRGQGKASGSAAAKVEGTRGLAIENPVGGAETTVESEAMKLQVGQLYRLSAWVRTRGVQTDPQARYPTAHGACLSMKSFPFTNCSPAPAAEAGGRASVLFFATQSSDRVQLHLGRNGKATGTAWFDDVRIEKVDDITAYIPLESVRWAGKGFRYDEGGWIYVHIEGEPYERGHQFGQLVPQEIVRYMEKLGIEKDRTDASKGWNHQRLLADALFLRKYDAEFLEEMKGIADGANKAGAKFKDRELDLLDIVTLNSAVDAGQLAEANRATGTPLTGRTFLKAEEDAERAGKGDHCSSFVATKSATPDGRAIMGQIFMWGGYTGVHWDVVLDVKPTKGHRFVMQTFPGGIHSGSDWYVNAAGIVIGETTVGQSPFDMNGPPQSNRIRKGRAVRVVHRRRRPHHEGRQQRASTPTTGRWRTRRRMRARACCWGRRRRACGAPAARGRPGTPRAISRTSSGPTTTTGIWRCARSTCPTRTTLRWTCPSTPGTATSPSGSTTQSTARRASTWTPPSG

SEQ ID NO: 10182 - protein, 514 aa, Myxococcus xanthus
MAQKLMFLAHYGKTTLREKMVGGRWIPDLPGATPHLSLGYTAFSPVFVAEKLGAARKGWTPPTEPAALKRDVSKVKDALVFGRPLLWANTMFPATDGENWLVSGTAAYWKLLKDLPADGDSSDKAFEYQRNALADLNARYLFTTSREADVVPASAKTDYGRYGAYMLPRIKGTFLLHQLRLLLGNAHFSKAMNALHGRYANKNVTTADFKRAVLEATGRDVGLFVSQWVEQTGLPQPRIRTSAAQVKDGYEVTLKVEQPGSRPWHFVAMVEVRTAKGATLERVEVKGLNETFTFRTAEPPVRVVFNAGNDIPVPREQHQTLSNQLDAWEKLLLVHGTARQTESMRTLALGYREVLADAFVEYLMPIKPDAEVTDAELADRDLVLFGGAEDNALLARLATEKKLPVELGRRYFRWQGKTYGRPDDGLAVALPNPWNPKRSMYLFVSNSGLQLWHMTRAYQRGLPGWALYRGAEVSAKGFHDVDALAQDVAVTPAAPPAAPAPTPVPAPVLGQPQR

SEQ ID NO: 10183 - protein, 566 aa, Myxococcus xanthus
MDTQHIESLGLKPVSDELERVKAVKRSDALPELFATLLREGVPVPFGIFVGQDQKQATRYTVYATQLGLGLPDRDYYTKQEPRFVEVRAAYVAYIEKLLTLAGEKNAKKAAQDVMAFETALAAKQWDRARNRDREKTYNPKTVAELDALTPGFSWGRFLKASGAEATPSVIVRQPDYLESLGGLLKSTPLPVIKQYLALKVLDTRAPLLSSAFEQAHFEFRGKTLQGLEENRPRWKRGVAQVNEVVGEAVGQLYVERHFSPDSKKRMQELVANLREAFRKGIDGLDWMSPATKAQAQAKLEKFGVKIGYPDKWRDYSSLDIVAGDLVGNVRRGELFDHQRAVGKLGKPIDREEWGMTPQTVNAYYSSTMNEIVFPAAILQPPFFNPEADDATNYGAIGGVIGHEFSHGFDDQGSRSDGDGNLRDWWTPEDKSGFEQRTNMLVNQYNGFSPLDAMNVNGKLTLGENIGDLSGLTVAYQAYKLSTQGKMPPVIDGFSGDQRFFLGWGQIWRGVYRDDAMRQMLLTDPHSPPQYRVNGVVRNMPEFYEAFGVKQGDANWLPPEQRVKIW

SEQ ID NO: 10184 - protein, 100 aa, Myxococcus xanthus
MYDAKTQLLINNPIKRYLVNSAMLEMGEFKTGEDGSLTFYLQKACPRKEDGEKKNWLPAPAAPFYAVMRLYVPEPRAYEGADRWIPPPMKRAGSVSEEST

SEQ ID NO: 10185 - protein, 436 aa, Myxococcus xanthus
MALLATSARAAEPSAVEQRAREDLDRQLQEMVKTPPPEIVISFEGLPGAGTSRGYKLVEADFLVNGQPLAIPGLDKLNGPGLHRLAVLTVEEGSYTLVSHVTYANESWNLFSEESGFLWKLTASVTVQVQRGLRARVRVLPAINPTAPDPRLKLKLSHDVKAEMTAAMADVAIPDVPDAGAPVAAVAQAPAKPTPPPVTAPISPTPPVATPVKTVEAPEQGPVAPAKLLLKVLAGKRPAAATVYVKSATGAPQRVMVDRKARKPVEVMLPPGEYRLDVLSQGYLAQTRKVTLSREAVPTVSFTLAKAPVSKSQKVRLKKEVVELPRMPRFAEKQAAPRNGTTAGLALLMDMFVRDEKLRLRIEGHTDNRERPAAAARKTLSEARAAAVAKALVDAGLDASRIETVGLGDTRPKAPNLLPRGRELNRRVEFVLVRKE

SEQ ID NO: 10186 - protein, 79 aa, Myxococcus xanthus
MWGRASAAEARNDLRAEHAALRTRKAIARELDEIEGLRQPGALNYKRTLILELIQVAERELNQTRREVRDDRRTPGRRH

SEQ ID NO: 10187 - protein, 193 aa, Myxococcus xanthus
MTEQEAYVKQMDAEKRRLDARIAETEAQADVRQASDELKDMSGIRRVFDTFRIKLDELSKRQTQNFEQGKAELRKSYDDTNQAVIEMDAKMALVRAGYERKREAELRALGAQVDGWEASVAQSRAEDSRLTRQELQFIRRSLQDTESALRRLMSSHGENWSKLKKDFEDSWRELRERSDKIRRGADVQPSSHA

SEQ ID NO: 10188 - protein, 188 aa, Myxococcus xanthus
VNKAILVPAALAISALAPWAIIPLLMLGGAFLCFEGFEKVAQKFLHGKEEQAAQKQERVNAVADPSVDLVAMEKDKIKGAIRTDFILSAEIVVISLGTLTAASFGMQVAVLTGIALLMTVGVYGLVAGIVKLDDAGLYLMKAEGGVKRSLGRGILATAPYLMKGLGIVGTAAMFMVGGGILTHGIGRV

SEQ ID NO: 10189 - protein, 545 aa, Myxococcus xanthus
MTDFQFQDMLPLGKDETPYRLLSKDHVSTFEAGGRTFLQVAPEALTLLTREAMRDIAHLLRPGHLKQLSHILEDPEASSNDRFVALELLKNANIAAGGVLPSCQDTGTAIVMGKKGQYVITGGNDEEAISRGVFETYQTSNLRYSQMAPLDMYKEVNTGNNLPAQIELYATDGDAYKFLFMAKGGGSANKSYLFQETKALLNPQSLLNFVDAKIRSLGTAACPPYHLAIVIGGTSAEYALKTAKYASARYLDSLPTEGNKLGRGFRDVALEQEILKLTQRTGIGAQFGGKYFCHDVRVIRLPRHGASCPVAIAVSCSADRQILGKITQDGIFLEQLEADPAKYLPETTDGELGGEVVKIDLNRPMSEIRAELSRYPIKTRLSLSGPLVVARDIAHAKIKEVLDAGNGMPQYLKDYMVYYAGPAKTPEGYASGSFGPTTAGRMDAYVDQFQAAGGSFVMLAKGNRSPAVTEACKKHGGFYLGSIGGPAARLAKDCITKVEVLEYAELGMEAVWKIEVVDFPAFIVVDDKGNDFFANINKPSAAKKA

SEQ ID NO: 10190 - protein, 243 aa, Myxococcus xanthus
MPKLNQIIAVEKGVKNRSQQELTQAHHDLQKPQLLSGISRTYQPRDEEGERFPPESTRVQVRTQDVLKKTQEILTRLFDVTATKDLTNCHAKADVRVDGRVLLKGVPATYLLFLEKQLVDLHTFVKKLPTLDPSESWVPDPAQGLWATEPVQTAKTKKVPRNHVKSEATEKHPAQVEVYYEDIVVGYWKTVKFSGALPATRMNDLLERVEKLQQAVKFAREEANAVEVEEMKAGEALLGYLFG

SEQ ID NO: 10191 - protein, 427 aa, Myxococcus xanthus
MRGAHPQPEPYPGPAIPREKSMRACPCCREVLTAGILGLGVRRLAGSCEVCGDTVCQVCLSTQVLEAGDFRQRPVAPGHENRKARGRVCRACWWEHLTERGIKPPFPAPPGQRERAAHAARSSCQHPDVTQAMGFCPGCGDEVEWRAEHGNPVCVACEAPSHPLFNHCWACGESFDEANAPEPVAQGYRLEFDCDADDCTGKLAWLMPYCPWCGETKHWEPASGGDLECTECEHRLDRAWAHCVRCGEEAPLPDDCLRCGQDLDDAPSAARCESCRNIVCGDCFDTRVVPSASGEPQERLLCTTCGVGFDRPAPPAEPPEEEEEAEAEDTAEDADDADDTPDAEPEPEPEPRTEAPRAPEPEPVASAWEVLGITPGTPLADARRAYLSLVAQYHPDKVAQLGPKLQALAQEETRRLIEAWEYVRRKT

SEQ ID NO: 10192 - protein, 224 aa, Myxococcus xanthus
MAPMGFLVQLRPHAFASERYAFVAEVEGEVVGFLSVSPVYAREGWFLQDLLRDPKAPNGTAEALVDAAMREAAATGRCYVTLGLAPLAGPVRPWLRLARACGRPLFDFEGLRTFKGKFRPDAWVPIHLSYPEPRGGLATVYDALRAFAQGGLLRFGIATLLRRPRLLVHALAVLLVPWTALLALPSTARWFPSVQVQWAWVVFDVGLRWDSSRWCGVGGTPWPR

SEQ ID NO: 10193 - protein, 58 aa, Myxococcus xanthus
MGGLTAADACLTFVQAVAYNVPLARSPLDGALIALAVLAPATASGLLFSSRDLRLPGR

SEQ ID NO: 10194 - protein, 67 aa, Myxococcus xanthus
MRPPSGVALSLAVLLFAQAGQAQTAAKEAAPPPADLPPGVSAALWKLSVPASLAPTPERVLLGEKLL

SEQ ID NO: 10195 - protein, 459 aa, Myxococcus xanthus
MSRSWASTLEAGAVPLPPLDGELLMDTASRTAATEDFGHILHRTPWAVLVPGSVKDIVAMVRFARRQGVKIAAARGLGESHSTFGQSQVAAGIVIDMSTLSTVHEIGENSAWVDAGVRWHELLQASLPHGKSPPVLTDYIELSVGGTQSAGGIGGQAFRWGLQVDNVLEMDVVTGRGELVRCSRWRERPLFDAVRSGLGQFGIIVRARVRLVEVPPRARTYTALYNDLHRFMEDQRRLIEDGRFDYVEGSAVASNGGRAYQLEVVKYFTPGSEPNDARLLAGLGFQPGTLQVSDGSYFDFANRLAPLVELLKQLGVWGFPHPWLDMFVPARSAESFVQEVLSQTTEADMGQGPILLYPFRSSELTTPFLRTPNDRHVFLFSLLRTAIPPTPENVASLLRKNRAIFDRLTAIGGKMYPVDALPLSPADWRRHFHPGWERFEHAKRRYDPDHILTPGQGIF

SEQ ID NO: 10196 - protein, 19 aa, Myxococcus xanthus
MEAYIYAKRKGVKLDSGKK

SEQ ID NO: 10197 - protein, 38 aa, Myxococcus xanthus
MEPIAMLATWALRRREAVKQAHAAYDAREEPPAPREPR

SEQ ID NO: 10198 - protein, 226 aa, Myxococcus xanthus
MDVLGTLDTLGLSKASFAGHSLAGDDLTWLALHHPERVEALVYLDATDSRGEIAAFLEGEQLPPLPFSVLDGLPSRQAVAERLAQDLGGGLPAHEVEQAYVFDAATGAYLRERRHPGATEQSVRGAAIMDLGRVQGPVLSLSDGQGFAGWVEALVAAESLPLEFREKARDFLPDIQQHETALEDSLRRHPGWRHLQLEGAGHYIWLTNRAEVVTRMRDFFAATAAP

SEQ ID NO: 10199 - protein, 850 aa, Myxococcus xanthus
MAHPTEDKNFRLPTSIRPRRYAATLTLDLDAKSFSGQQTIDLDVAAPSNEIILHGIALALSDVTFRAGGQQRKPASIQPAQASETVVLRFDEALPTGAASLDVAWTGRFTEGLRGLYQAGKVAATQFEAADARRLFPCFDEPAFKARWALTVRVPTGLTVLGNGPVVKDTQEGNLRAVTFQETEVLSSYLIALVVGPLVGTDAQDVQGVPVRTWALPEKAHLTRFGQDVALAVLPRLQDYFGLPYAFTKLDQVGIPDFEAGAMENAGLITYREVALLLDPATAPLSVKKRVAEVVTHELAHQWFGNWVTMVWWDDLWLNEAFATWMAFKIVDQWRPEWRMWLDFDAHRASALHLDALKSTHPIHGEVRNAGEAGESFDAITYEKGGAVLRMIEGFLGEGPFREGIRQYMRKHARANAVKEDLWNALGDAAKQPVEELATAWVGQSGFPLVTATLDGRGLSLSQRRYYSEPGVQSAEVWPVPVVLRYEDSTGVREQRVLLRDAQATVKLEGEGAVKWLTANAGSTGFYRVAYDKPGLEKLATNLKSLAPSERTALLADQWALVRAGQASVADLLDLAGRFGDEEDDSVLDELVGRLAYIEGRLADGEDQVRFRAWVEKLLGPGLKKLGWQSAPNEADRVKLRRASLVRAVGGLARSQDALAEARPRVERMLQGQRDALEPNLLDAAVGMVARAGDAALFDTFLQKIPSEPDPATQRRYLMALTAFEAPELTARARGLLYTDTVKTQDVASFVAGLLGNRVGRDAWWAQMRTQWKDVVARTGGAPMLLRRIVEAMGMLRTREHLEQMQALLKAQPIPEAQQATAQTLERLSQDVALRERCMPEVSAWLKRQP

SEQ ID NO: 10200 - protein, 101 aa, Myxococcus xanthus
MYTLERGRRPRIQLWMRTAKHARVVAFRTYLRTLLHELCHHLDFLLLELPASFHTEGFFQRESSLFHQLVPRPARPRRSGARKGVTADTPDISPGRRRRGG

SEQ ID NO: 10201 - protein, 195 aa, Myxococcus xanthus
MMMRALLLPCVLLLSACSAEIAIQTEPFDQVVPVTSLLEPVYAEVALDLPEESVNTQDLDIIVNEVSATLVVVNPSPTLTLRTSARLSLTGTATPDNPRLYTNFNRPAYYDTAAEILAERTFQPDSRTPLRIDAPALKNAIGRRRVWVIVSNTVVRSGLTLPQLPAQIRLEDIVFQALLTKPFPGLGGALEAGGL

SEQ ID NO: 10202 - protein, 152 aa, Myxococcus xanthus
MAASPHRVVLGARYTHFVGASVYSDVVTSGADTPALQRFEPELSGPSFYGVYGLSLGPVLVQGEARYGLYTSDYLSFTGALAFNFAGHWSVVGEAGVRVKGGSTLRAAAGIRYGGEHFGLGVGATYVDMSDPALPGESLPVLPVVDLSWSFR

SEQ ID NO: 10203 - protein, 82 aa, Myxococcus xanthus
MWDPGELREGMAVRDEHGRRLGTVVHIGDTHFELEQGWPPSRDFMVSFHLVARVDHGEVFLHPGHGATVPTEDEMPDSGAYI

SEQ ID NO: 10204 - protein, 372 aa, Myxococcus xanthus
PEHRLRGQVVRIRFRIGTDEAAGGFGWFIDDIAFTGLANTPFTALVDEQGVCTTGHVDAQAGEDLAVDELSVVQLQGSGSSLAGGALTYRWEQVAGPFAAMSGADTATPSFTAPEVLADTMLTFRLTVLDGGLRDRDTVQVLVRQVNKAPAVSAGTAQTVDEGSTVTLQGSAEDPDGDAVVSQQWTQVSGLPVTLTGADTLTPSFTAPAVAKGSAELVFQLVVSDGQLSGEAATVSVTVRHVPLAPTVSAGDDVATFSAKSVTLTATATDPEQGTLTYAWSQSEGPTVTLQNATQARVQFTAPEVSAATEFVFVVKVSSESGLSAEDRVTVTVSPAPPAPKESSGCSSTGTTAALPLAMALLSLLAWRRRED

SEQ ID NO: 10205 - protein, 210 aa, Myxococcus xanthus
MWAVALALVAGLLPWVGYLFGLSRTFVFLPCFVAGHLTRREWLLAPRNTRGWRLVLAASLAVGLGACVGAVAMGALPAPAPQWLYGSSGYAVLGATALTGMAARAALFCGALALTWALFTLSPRQESTLTRLGGRSLAPFLLHGFVVRAAEHVGAYAFLQGPVGVALALGAGALLTVLLGQPSVVQATRPLWEPRRLFQRKRDAVPDLGR

SEQ ID NO: 10206 - protein, 145 aa, Myxococcus xanthus
MERWFEPVQPDIVSQPVWAGLIRGIAACCSQLKGERPWYVEAHQFRIDTTDGIGRPTPEGAHRDGVDFVAVLLVGREGIKGGETRVFEADGPNGLRFTLTEPWSALLLDDARVIHESTPIQPQGDTGHRDTLVLTFRAGGFQGPE

SEQ ID NO: 10207 - protein, 86 aa, Myxococcus xanthus
MTGPSDKGERLWPWVGAALGVRWFLAAGGSPTLPLFQRLGDRVTCGVVDGFTVCVPTRDSDFREALKRAPPALFSQPLPASAGPSH

SEQ ID NO: 10208 - protein, 385 aa, Myxococcus xanthus
MNEVVIYGAPVTGEPPANLPPTVSAGADQTVMLPTNAATLTGTATDSDGTVVARQWTQVSGPNTATLTGATTLSATASGLVQGLYEFELTVTDDDGATASDRMKVQVTPAPTGRGTTQEVYKSPSTPGGYGYVVYLPPGYDEGSNWPVVFFLHGMGEQGDGGVNQLKKVRAHGPQAYIDQEGKDYPFILVSPQTSTSGFWSAYEAQYNLDPFFEHILATFKTDRKRVYLTGLSMGGAGTFNYASLFPSKLAAAIPVCNGGYGSSAADALKMVQANLPIWGSHGLLDNDIFYTATAGWFTHLGHAMGGTGGVMDTYPSPARTATAFFRPGSGQWEWIDGQTNTDTTGAGPVKPVLFTLFHDGNHYIWDRVYKEPKVFAWMLAQQRP

SEQ ID NO: 10209 - protein, 200 aa, Myxococcus xanthus
MCRRLGIPLSRITAKDPDKDPVLRRPYPPGQHGATARTSVSDFARRLREKQKLKLYYGLMEKQCRAVFQEASRAPGNTGTVLLQLLESRLDSLVLRAGLATSIRQARQFVRHGYLHVDGKRADIPSFRVKPGSEVRFHAAHQKLAVVQESFSRMKSRSVPAYVQVLGEGEGLRYVRLPEREEIPVDVNEPFIVEYYAQRS

SEQ ID NO: 10210 - protein, 173 aa, Myxococcus xanthus
SRLDYLIIPILFGLGTAVLTLVGTNVGAGQHERARRIAWLGGGLGFVAAGAIGLAAALAPEVWLHAFSREPAVVAPGLDYLRIVAPFYGLLGLGFVLAFAAQGAGHVLWPFLAGTSRLVISAGVGWFVAARLDAGLSALFAMVAAGLVAYAGVTIVAVLAGAIFRREAAPRGT

SEQ ID NO: 10211 - protein, 175 aa, Myxococcus xanthus
MATTKTETEATQNEVQSSEAAAKSGLAQNVESFLKAQISQAQKRIEELEGEAGKVVKTLESRGQEAAKEAQALWAKFQAGELLTDPRVQELSKRANEASTELSRRVDAAGTELRKRFDGIQTRVVEAVGVASQAQLKDLNKELAKLSRKVDSLLKPVRRVNGAKPASSPASSPRA

SEQ ID NO: 10212 - protein, 116 aa, Myxococcus xanthus
MDNKPEAPREKHSVTETFERLWSQALLAVNTAEEEASRAVQRVAAVAGWSQDEVKRQAREFSERLAGHRKDLEHNVEERVRQTLTKMKLPRREELAAFGTRLDKLAERIQALEHRK

SEQ ID NO: 10213 - protein, 113 aa, Myxococcus xanthus
MQIKPSTLHFLAEKEGLRLSREEVTADTALCVRLGIRYLRSLQERFGGDLDLALMAYNAGPTRIRNAIKQGELERFRRYPRAVRRDFRRFREGHGLGGDWALAQREVPPEPMP

SEQ ID NO: 10214 - protein, 229 aa, Myxococcus xanthus
MKNPLFPSAALAATLALAPFGAHAGSVFLNGVKIDGVTNQKFEKATVRIDEAGNVHIDAPGYAARVTAVTPPAPAASPQAPAPASPGPAAPSAKEPPAAQQAPGAPTAPGRLTQRYWLVTEQTVPGMTGYDIDVFINSTWLRKLRGNEDQVVVDITRNLRPGANKVTFIARKGNAGDARSSSPAHVFRVIIGEGNEGGGNVMIDNPILRFQKTAADTQDATQEFTLTTR

SEQ ID NO: 10215 - protein, 618 aa, Myxococcus xanthus
MTGAPQEDSSGGGGRPNDYTGTNNQVAGVHEADFVQNDGTRIFVLSGPRLYIHRSWPAEQLTRTAVLEVEGWPREMLLDAERNRLVITSEVAEDRPGTVAGGRGTDDMPVVDCAGFGCGHAYSNTVKVTVVDVADLEAPRVLEQVYLPGGYISARRVDSAVRLVFSDGFRWPADVRFYPEYSPGFFGDRSRLVASIDALIKQNEQRIRAQSLEDWLPKGRRVAADGEVKPLAYDCTSFYRANGPTGLGLVSVLSLNLDAEDSSPSQTSVVGTPGEVYASHEALYVASRHWWWWPEPGQTTHTYLHKFDIRDPDQATYVGSGTVEGYIVNQFAMDEREGVLRVATTVELPPENPGTGNGGDTVWTPPETVNRVVTLHTRDGHLKELGRSEDLARGERIFSARFMGTRGYVVTFRQVDPLFTFDLSDPANPRKVGELKIPGFSTYIHPLGDTHLLTFGEHRNEDGTWQDRALKLSLFDVSDLAQPRETFTHQLGSMGSHSEALYEHKAFTYFPAKGLLALPFTDWDYNAYDYWSGFRSELRVFRVDTATGFSPVGTVSMRDMYQSFNFRNWSWYWQPTVRRSIMADDYVYTISDAGLRVSHVDSLQTPLVTAPFHPPMLP

SEQ ID NO: 10216 - protein, 655 aa, Myxococcus xanthus
GQLQPVGQPARGAAGGHVHHPLQGPGVEPVAGMRVVRTDGLVDDDGQAQVVAQTDGGIQRVVLLGAMVDHAPIEDEVAAAGRKREVLHHLDARRIDAEFGPREAFRHGASLIREPYSRRGGKEVRGCERGDREGRMALQFPAPEDRLWFSAVRPDRRSPCVSSLRSWSYLPITALALALVLPEPAKAQADGTYPSPGAAQPPSAPAGYAAPPQPTYRQTAPQQPADPYAQPPQTQQPADPYAQPPASAQPADPYAQPPQTQLPVDPYAQPQTQQPSADPYAQPPSSTQPVDPYAQPPQTQQPVDPYAQPQTPQGYPPAQNAYPPSDARDPARYPGDSATASDAPTLPPDPDSLRTKPQSPLTPDDRAMAKRGVPPIEDTGVMLDGRPRQGPFLSGPGSFTFIVHHTTLGALGGFFTQAFASDFNFDKSSREAMLAGTLIGAGLGFGASSWWQFNNWVDRPMATFSIANSVVGGMFTAGLMDLFTQDAGVLTWSAFLGAELGAWLTAGIGGGQLPLNDGLLISSGAGWGAAYSALLLAIIHFSGTPVSGKTWRDTLLLAPGIGAGALALATMRYNPTPSQIVRANIFGGGVGAVVLLLSGVVLGGFDQSTPYVLSFLGSAGAITTVSLLWEESVDRSALKMAGRSEKDRPYTNVWW

SEQ ID NO: 10217 - protein, 47 aa, Myxococcus xanthus
MAPEQQDEQLKTLPVFFKDPTLVPAVVARAEEKKNVTTTLGRFLAAF

SEQ ID NO: 10218 - protein, 253 aa, Myxococcus xanthus
  unsure (1)..(253): unsure at all Xaa locations
MFRLSTASCSLALLLVSSGCSHTPTEKEKRSAEIHYDLXLQAQQAGELQDALRELQVSLKNDPDYPDANNAMGILLHLAFRRPDEAVKHYTKALEVRPDFSEARTNLANVHLDQGRYDDAIKLYELVLNDMLYPTPFIAQGNLGWAYYKKGEPDRAVESIKAAVTTNPNFCLGYKNLGLIYDETGRTSEACRQFTHYRENCPDVAEAYMREGVCQAKLGQVDAAKAAFATCETKAKAGEQVLKDDCRRLLEKL

SEQ ID NO: 10219 - protein, 146 aa, Myxococcus xanthus
MTAGGCWKSSSALGIWGPVDHVDFGKYLSQQRELRGLSRDDVARETKIPPTLITALEAGQVERLPSRIFVVNYIRAYAQVIGMSPEEAVLRYEEVDKSVPAPSPVQLEQERRKRAYVGLSVLLAALLLGVYLFLVLSGKLPNPLAR

SEQ ID NO: 10220 - protein, 244 aa, Myxococcus xanthus
MERYDDDALVLSSVDYGESDRLVTLLTREHGKLTAFAAGARKSKRRFAGALEPFMRLRVHIVETRGSTVRLDGTDIVAGFYAAREDLSLIARALYAVELCRELTRDHEPQPELFALLESYLTRLDAKEAGPTSLLAFELSALAHAGLMPRFDSCSLCGGAPGERPRFDQAHGGAVCEPCGVRARESVAVPVALLSGLRALQEGARTPLPPELRARARGLLNVFIAHHLGRRLKSVDFMAQVGLD

SEQ ID NO: 10221 - protein, 331 aa, Myxococcus xanthus
MPPLDVVCFGETLVDFLPAAPGHRVRDVPAWHPCPGGSPANVAVGLARLGLRPAMLGVVGADEFGHFLRERLAAEGVDVSHLRQTAEARTGLVFISLDGKGERSFTFFRTRSAEFLLGQADVDAAFLSGAKAVHCGSNSLQWPEAQEAAVRMLGLARDAGLIVSCDPNLRLHAWEDTSLLKGLLARMLPLCTVVKLSEEEIGFVTGTEVPHEALTRLAAMGVPLPVVTLGERGALLQWKGECIHVAAPQARVVDTTGAGDGFVAGLLQGLVRWYGGAGGLRDATGEELVTLATFACEVGARVVEKLGAVDGLPRAEVLAHVMPSRPDSSRA

SEQ ID NO: 10222 - protein, 75 aa, Myxococcus xanthus
MAPTLFATLECAVRDDQAAHRVFRFLAELGFRPDGLHLERYLPGVADRYLLMLGVQRLRPVVANGEGGSSPMASE

SEQ ID NO: 10223 - protein, 905 aa, Myxococcus xanthus
MQWGEYVQWLQQQAGTKEQTAHERFWLSRRVETLPALELPIDHGRPAHRSYRGARETLRLDRATTQSLREAAAQQQSTLFMLLLSVYTTFLHRLTGQDDVLVGIPTAGRGMEGSEGLVGYCSHLLPIASHVQGEQTFSEYVQGLKQVLWEAYEHQDYPFALLIKRLGLPRSTSHTPLVSVTFNLERPLGNLQMDGLRTHFVPQPVRYAAFDLSLNVIDAEDGLVLDFDYNTDLFEAATLARWAQGFRTLLSGTLAQPEARVADLPMLTPAERRKVLVAWNQNQLGYREDLLTHQLIEQQAAARPGVHAVELDGQCITYADFNRRANQLAHHLRGLGVGPGVLVGAFIDRSPEMLVTLLAILKAGGAYVPLDPAHPVERLRFLLDDARAAVLVTKQSLAERLPAHTAKVVHLDTDAVTLASRPTENPPNTATATSPAYVIYTSGSTGEPKGVVISHGQMAVHFQDMQLHFELTERDRVLQFASFNFDASLEQILPTFMTGATLVLRGNQVWTPEELARRVVEQRLSVMNFPTAYWQQLTQSWAESPPTIGAHDLRLVIIGGDTVLPKVLELWQHGPLGNVRTLNAYGPTETLITATTFAIPKGWSATRVPIGRPLSNRPCYVLDRHGAPVPIGVAGELHIGGPLVAAGYLNRPELTAQRFVPDPFSDDPAARLYRTGDLVRYRPDGTLEFLGRSDHQVKVRGFRIELGEIESALSAHEHVQEVVVMVREEPGALAGHDKRLVAYVVPSAQGSVTPAALRQFLLEKLPDYMVPAFFVLMEAMPLTASGKLDRKALPAPDPEASAPTRPFVAPRTPTEQTLAEVWMKALRLPRVGIHDDFFELGGDSLLATQVASRLRDALKVELPLERLFKQTTIAGLAEHVDTVLWAARAAEDTSVSGASREEGEL

SEQ ID NO: 10224 - protein, 1770 aa, Myxococcus xanthus
  unsure (1)..(1770): unsure at all Xaa locations
MNTRWGGFLEDVGAFDPLFFGISPREAVRMDPQQRLLLEVAWEALERAGQAPQGLQGSRTGVFVGISTSDYAQRQFGDRSLLDAYAGTGNAHSIAANRLSYVLGLRGPSMAVDTACSSSLVAVHLACQSLRGRECDLAMAGGVNLILSPELTIAFSQAGMMAADGRCKTFDASADGYVRSEGCGIVVLQRLSDALASGAPILAVIRGSAVNHDGLSNGLTAPSGAAQQDVIQQALRQARLSPEQIGYIEAHGTGTPLGDPIELAALRAVLSPGRSAEQRCFIGSAKSNIGHLEAAAGIAGLMKSVLALGHGEIPPQVHLRVLNPHIALDATRFPIPTRPEPWPQAPGARIAGVSAFGFGGTNAHVILSEPPPRPADAPRVPERDSHVLTLSARSDAALRNMARQYQEHLLRPNAPALADVCFTANTGRNAWPHRLALTANSHAEMASRLESFAQGHAVPRLHQGEVQRGAAPRIVFLYPGQGTQYPGMGRQLFDSTPVFREALERYDAILRPHLDVPLLSVLFPTTDATAQLIHQTRYTQPALFALGHALTELWRSWGVVPDAVMGHSVGEFTAAHAAGALGLEEALALLATRSRLIQALPQNGAMAAVLTDEATVRMALEDEPLVDVAAINGPRHVVISGEREAVQRITAALQAQGVESRPLTVSHAFHSPLLEPMLDGFEQVARVLPAHAPRLPLISNLTGERMSQAPDAAYWRRHARAPVQFFKSLQTLTQAGPALFIELGPHDTLLGMAKRCVPEGASLWLPSLRRQQDAWETLLDSLGALHTRGVTVPWRAVDADRPRRRVPLPTYPFERQRYLLDSALPSPAHRPTMMTQTSAAAPVVSRKERILTELRAVVALLLQAPPEKLDPRMSFLEMGADSLVLLDAIRNVEKRFGVKLAIRQLFEELTTLDALASHLDQTLPASFALSSAPAATSVPAPLPMSTPPAAANALSAPPGSAVEQLIQQQLQLMAQQLALLGGRPSAPLQLPVAAQEAPVPKAVPTNTAKAGGASPFGAGPKSGTPERELPAVQQRHLDALIAKYTTRTKRSKEAAVRYRSKWSDVRWLMNFRAELKEVCYPIVSVRSKGSRVWDADGNEYIDFSMGFGVHLFGHNPPFIMEALQQRLAEGMELGPQSDLGGQAAELLCELTGMKRVTFCNSGTEAVMTALRLARAATGRTKIVMFTGSYHGHSDGTLVVGRMVNGEPQSLPMAAGVSPKVVEDVLVLPYGEDRTLELIREHLHELAGVLVEPVQSRRPNLQPRAFLQALRTMTREAGVPLIFDEVITGFRLHPGGAQAWYGIEADLVTYGKVLGGGMAIGAVADRGGFVDRIDGGDWNYGDASYPAVETTFSAGTFCKHPLTMATTVATLSHLKAQGPALQENLSRRAAGLVARLNDIFQREQAPIEAVHGGSVLRFSAAGNTSYLYQSLEMDLFFCHLIQRGIYIWEGRTCMLSTAHSDEDLDTIVRAITETVADMRAGGFWPRTTPPDPTRVEARTLPMTEAQRQLWVLAQMNAGGSISYNLSMSLRLEGVLQPEVLQRAIQHVVDRHEALRIHIHESGEQQTAAASLALSLALHDLSPLPAPEQAERLSAWYEQENNTPFDLHRGAPFRGPTCXKAGXXPNQGXKXPKCLRPHRAPRRGGRLVAGCHRPRDCRAIHRAPSRQEHPASTRDAVGRVRAVAPAAGRNQGADGPRALLAEPARGDAARAGAAHRPWPPRAPQLSGCPGDAATGPRHHPVPAGGGGAAAVHALHAAALRLHHVPPPPYGPG

SEQ ID NO: 10225 - protein, 299 aa, Myxococcus xanthus
MTAVVLLLGTAALAQTPDTKRWRRIERAMVLSASAGEPVQRLRLAPGVVTTVLLDSDAVLEGELPEALHGLFTRLDVTETHLLLQPAVAMPARGVPPLVLRFTDAAAPQRLVLELTTEANVVDSVIDVRRHPATVTQLEAELVALRERNALLEARLATARRQVPHPGLAGAILSGAIGITGVLGTWMDTPASEAELKVRQLDSYRSGSWVALAVNLENPPGEAPWQPGIARLTSLDSNGRPTGEPMELPLLLQEPRLLPGQSAVAVVQWPAPTRPPPAYALELWDTGRRRGVRWARLKP

SEQ ID NO: 10226 - protein, 119 aa, Myxococcus xanthus
MRQLGLDLRSRGHIQLDIQQPDDSNQTNYSIVVSDGPITSRLDGPIDRLPANTLLYGRIWTGGEKIQGRYTRVRTPDGSEYPVCFILGNETGMSKYRGSRPGHTRAHPWSNAQVVDHFP

SEQ ID NO: 10227 - protein, 127 aa, Myxococcus xanthus
VSALIAHGAVQVSAQALAYCVENDIGVHWFTSGGRYLGGLGGGAGNVHRRLRQFEALRQASVCLGLARRLVAAKLEGQLRFLLRASRGDSESRQVLASAVRDLRALLPKCEEAPSLEVLLGLEGAGA

SEQ ID NO: 10228 - protein, 95 aa, Myxococcus xanthus
MSLPSRSVVFRLTQEAAPRILYAFEPSSRAGGVELAALLRKVKSGDVPAKELVLGGQVVEGLGAEEREVLSGAELHTGVVAACRAACKRLEVRKK

SEQ ID NO: 10229 - protein, 517 aa, Myxococcus xanthus
MTPLLRAGAGGLAASLRAILGSASPAAPWPSPVRLGPGTATVEQEAIHLDWGGKAPEATLRALFGASFRVKQGFIDLPGTRPPGAPEPPPELAAALHDALKVTFLQHGKSTQGGARRRVTFEVDARPVIVESQGYDSFVHQTAWQSVLEALEVGSTSLASWAYPGAAERHIGVRVTKVEYTAAEALCACFALVGCVSYKLPQLRGGAFVALAPTNLVRFAELRPGLTPKRLRDVAVAGASDAVLAAQLVMAQEAGKKRLGAVLGTTEAVALRQMPWNAQQKIRGAVVRQDAVLEEVLDRYEAAAAALPHTLRVRKPEGKATGEASYFIAISALRAFITENLAASRPWYADFATATTAEGRFIHDYRDRDNLGALLWHERKGLIAMHPYLGEAEQWLVQSVHLALRSRFKSIYADTKESAPATRSNRLKGERERLRLSFAGAKTPEQVRAALADLWSRAGTNRELQEHWRDILQLLGPERWRAARDLALVALASYQGKGGEAAELEDADEAAGASEQS

SEQ ID NO: 10230 - protein, 247 aa, Myxococcus xanthus
MLTDVSALALNLVALWFAGKPADVKKTYGYYRMEILSALLNGVLLMGITGFILYEAWERVRSPAQVNIGPMAIVASVGLLANLGALGFLHRSHSMNVRGAFLHVLGDTLSSVGVLVGAGIMAYTGWYVVDPIISVVISIVIVIGAVRLVRDAVDVLMEAVPAHVDLAQIKELMLRAQGVTAVHDLHVWTISSGVYALSAHLVVQDPMVCNNDEILSAVKHDLFDRFGIDHTTIQIESETYSHLGEVH

SEQ ID NO: 10231 - protein, 428 aa, Myxococcus xanthus
MGTATEGFRDYLHGADVEARLQHSRAEVDFDIFGLRDGAAPGTSSRDQDRLDALRSWGADAMSCTADTVLGLVQSQRQGLYAWPGLCAACVVFDEVHAYDDRLFGCLLRFLEALPGIPALLMTASLPATRLDVLRGMCERVHGRSLAEVEGPEDLETLPRYQRLDVAEPWALVAECLRDHGKVLWVSNTVDRCMRTAEAGTSHGARALLYHSRFRYEDRVRRHGDVIEAFATEGRAAFASTTQVAEMSLDLSADLLVTDLAPIPALIQRLGRLNRRSTLERPAPVRPFVVLPFDGPPYAAPDLRDARAWMERLGTGPLSQRDLVDAWGPPGMMDAPRRQSSTWLDGRFDTWPAPCRDGSPSLTVLLEEDARAVLDGAVSAHRVTLPMNLPPESFKWRAWPRAGRLPYPIPPANALDYDGLRGARWRKP

SEQ ID NO: 10232 - protein, 203 aa, Myxococcus xanthus
MVFVDLLFPVQGGPVPLDHAYLLFSALSRHLPALHERSDMGVFSLRGVSNTRELLYLGRGTMRLRCPIEAVATLLPLVSAPLEIAGRRLSLGAPSLHALEPVPSLFARLVTFKHAMDEAAFVAAASRALEALGVQATLKVGRRRIVRITGKKVVGFALELHGLSAEHSLRVQEQGMGGRRHMGCGLFLPPGRAARVQSHGKAA

SEQ ID NO: 10233 - protein, 426 aa, Myxococcus xanthus
MQVKWHVDHRDSYSLAGLVTPPRVGRSLLRKLLESWLVLRPLGPVEIWLLSNWASAADLGRYLHGRDHCFTEAFFEQPPRGALKKHWAEWEQRLGVSAEMLRAFCKDLRLRLGVGGIADLEEQVDDRMGRLGLRMGRQPRAIAVDGLREWIEVGGGRKHVTPESLRGAIRAWGLLASREDAPAVSLWIHGWARREWEQPPTEELDWTPHFDRDTRKVPSESVWRDVLLPSLLAVRQRLSRRPDGALIDLRGKLPLSTVLAVGFHFPEVGGYRFRVEQPTQGETFLWRSDAKPSPRRLRVTGHEGDSDAAGLLVVFQMTGDARADVERFLAERPGHFRAVLYLEPEDGPHDGAVGSDADAEAFAVQAREQLRRARNELRTAVTHLILYAPAACCLFLGQRLNAVGPVVAYERTGSGGYAPALTLQTG

SEQ ID NO: 10234 - protein, 245 aa, Myxococcus xanthus
MTQELPVSREQIDGLFEKGLDFLKSNLGRITTGVLAGANFAAQAVAGGLLTVTLLFFFVKDTERLGGWVLARVSPSRRDTVRAVGLRAWGTLSGYLRGVVIVALVDAVGIGAGLAIIGVPLVLPLAALTFVGGFFPVIGATLAGVVAVLVALITNGPLDALLVLAVVLGVQQLESNVLEPVVMGRAVPLHPVVILLSITAGGVLFGVAGAFLSVPVAAVLSAAGNELRLRDEARVLEKPTASSPP

SEQ ID NO: 10235 - protein, 300 aa, Myxococcus xanthus
MKGIKFGGFKSPSIPKSSGPNKPSAPPPVESKPASKPSPVKDGFDAQGSKPSTSTVNPQPTRQPGKDVTSSFGANPLGYSGQNVLNAYNMSPSGALQGVALPTAQKPFVNASDAVVTLNAHQHQGNTNLSVSPAGGQGIPAHYMHYLSTGEGKFAGIQGVPLHPRPGEPHTVVTGALNGCAIHALHDTKNNSLSFLHHADYSKNGKAELDGFLSQHPNLKPAGSFTPSDYSHPTGKYNDPTGATPFIHYSQGAGNRPGQWTIAGQLNTFKSGGAEGGRPALMRPTDLQVPLMQTIPVDVP

SEQ ID NO: 10236 - protein, 40 aa, Myxococcus xanthus
MMNAEYELKYTVLVGDKKSDKALEDTYAATLKKICIRKSS

SEQ ID NO: 10237 - protein, 361 aa, Myxococcus xanthus
MSYREFWGWTSAPKRPPPEHGIKVKKAGATWWGQRWLEALEHVLKGESGRLARGRTYARAGRTHDLVIRRGKVTARVTGSRPTPYAVSLALRPHGEAVWEKAIAEMAGRAQYTAELLAGTMPQAIDEVFRAAGVSLFPRSREELVTDCSCPDWGDPCKHVAATHYVLGEALDRDPFLLFELRGRTKEQVLSALRAAREAGSAGAALEPRGAAKRKRAARGATAEAPEVPSVKPGKLTRDSYDVPREPLPALSFSFDAPATHGAVLRQLGAPASWGAKASPEDVLAPPVRAAAEVARRIALREPGEASAPDRAPRGRSRAKQPARRAKRGPPTQPSQQPLHTPSTSRRDGGARSKRSPVGAP

SEQ ID NO: 10238 - protein, 512 aa, Myxococcus xanthus
  unsure (1)..(512): unsure at all Xaa locations
APRALRATXRPYQSRGLHWLDTLASLGLGACLADDMGLGKTVQVLAFLLRRLEQAPDEARPTLLVAPTSVVGNWERELARFAPTLRLTRHYGAERARAANRFPRAPGAVVLTTYGLLRRDAALLARVDWGAVVLDEAQNIKNAASATARAARALRASQRFALTGTPVENRLAELWSILEFANPGLLGPLETFRRELALPIERHGNQEASARLRRLVSPFVLRRLKSDPTIITDLPAKNEMKVVCTLTREQASLYKAVVDEELRRIEEADGMERRGRVLALLLYTKQIANHPAQYLGESGPLPGRSGKLARVVEMLEESLAAGDKALVFTQFREMGDKLVAHLSEYLGHEVLFLHGGTPRKARDEMVRRFQEDVHGPRVFVLSVKAGGTGLNLTAASHVFHYDRWWNPAVEDQATDRAYRIGQTRAVQVHKLVCAGTVEEKVDRLLEQKRQLAEKVVGAGEHWVTELDTTALRELFSLSEGAVADDGDAEGEDDARVRAPRRRGRASAKAVSR

SEQ ID NO: 10239 - protein, 202 aa, Myxococcus xanthus
MQLVAKGLLTGYRQRFEDDRVFAVLKLLADRATAVVDRNPFAARRTDSDHLRDNDYHLRALRFREEELLATVSKRIRKRLSAGVEAFEAFNQVQVHLLELAHAHVERLVLEQFLKGVADVKDPGLKTVLGRLCDLYGLSCLESANGWFQEHGWLEGTKVKAIRKEVTRLCAELRPDAVALVNAFGVPDTCLAAPIGLGHLSP

SEQ ID NO: 10240 - protein, 141 aa, Myxococcus xanthus
MSPVERAAALEAQNKQRVRQLTEELYNLRMLDRIPEFIAEDFVDRSQDAPLNAVGPAFIRQQAEASFKTFPELKFDILHLVADGDLVLAHWKATAPAPQPLLLQGHSLYRLRDGKVVESWDISDRLSPLLQRGYKVVPPTL

SEQ ID NO: 10241 - protein, 82 aa, Myxococcus xanthus
MDRLFLTPKVVAGYTRLDPAPVDPDEGDPGRAVNAPNAGLGFGVEYATGMDHFSVGADLLARYIIGPNITSFAIFPKVKYTF

SEQ ID NO: 10242 - protein, 478 aa, Myxococcus xanthus
MTSRLRLLPLLALLSLTTCVRNPATGKRMLSLVSQQDEIALGKQSAEEVRGSIGLIQEPKVQEYVARVGLPMAKASERPELPWTIQAVDDPVVNAFALPGGPVFVTRGLLTAMNSEAELASVLGHEIAHITARHSVEQMSQAQLAQAGLLLGSVLSEDVARFGGLAAAGLQLLFLKYGRDDERQADELGFKYMLKGGYDVRQAANVFATLDRVGKAAGGQSLPTWLSTHPDPGDRVKTAKERAAKANVDFNQLKDGREEYLAMLQGMAYGDDPRQGFFRGNVFMHPGLRFQLTFPQGWKTANQPQQVAGISPQEDAIVGLVPIGNIAPQEAMRRFLAQEGIQPVSAAPTGFPQGTAFFQAQTEQGVIAGVTAFVSQGGTTLQLLGYTGAQQLPAYEDAFRATFSSFGELTDASALAVQPARIELAKVTSPMTLQQFNEQHPSTIPVEELSIINGVQPGDTLPAGRTVKRVTGGVRSTH

SEQ ID NO: 10243 - protein, 152 aa, Myxococcus xanthus
MSHHERERLATAYAATRYIIRPHSSTGGVEQILRAGALHPALDATLAARGHREWAFLTAWNPGSQWRSGEENRRAQERMVAQLVAGGWGAAPALGEADDGSWCEQSLFVPGLPREEAGRFGRAYGKVAVLVGRTGGQAELLFCEEARASPAP

SEQ ID NO: 10244 - protein, 421 aa, Myxococcus xanthus
MADFEDANSPTWDNVVRGQINLRDAVRGTISFTAENGKHYALNPKRAVLFVRPRGWHLPERHIEIDGKPISGSLLDFGLFFFHNAREQLARGTGPYFYLPKMQSHLEARLWNDVFHLAQAELGIPRGTIKATVLIETLPAAFEMDEILYELREHSAGLNCGRWEYIFSFIKTLQSDTRVVLPDPGQVAMDKAFLDAYSQVLIQTCHRRNVHAMGGMAAFIPIKGDAAANDAVMDKVRADKLREVKNGHDGTWVAHPGLVEIARDIFDSHMKGPNQLSNKREDVKIGEAELLKVPSGTRTEEGLRHNIRVGIQYTAAWLGGLGCVPLYNLMEDAATAEISRAQVWQWIHHGASLEDGRKVTLTLFRDALGEEMGRLEKEGAKERYGAAHLERARVLFEQLSTAGTFEDFLTLPAYDALEAQR

SEQ ID NO: 10245 - protein, 428 aa, Myxococcus xanthus
MYDATPTTADTSPHAKLHAQRFEGIKRNYTPKDVEKLRGSITVSHTLAELGAKKLWELLHTEDYINALGSLTGNQAVQMVRAGLKAIYLSGWQVAADANSAGQMYPDQSLYPVDSVPTVVRKINNALRRADQIDHAEGRKDRYWFAPIIADAEAGFGGPLNAFELMKGMIEAGAAGVHFEDQLASEKKCGHMGGKVLVPTSHFIRTLNAARLAADVMGVPTLLVARTDADSAKLLMSDADEYDHAFIDKKSGRTPEGFYRLNGGLDCAIARGLAYAPYADLVWCETSTPDLAQAKKFAESIRAKYPNKLLAYNCSPSFNWKKNLDDATIAKFQRELGAMGYKFQFVTLAGFHALNFGMYELARKYKDRGMAAYSELQQAEFAAEKDGYTATRHQREVGTGYFDQVAEAICGGNASTLALTESTEAHQF

SEQ ID NO: 10246 - protein, 135 aa, Myxococcus xanthus
MTRINSFTGPMIQPATTQAQARAASTSFGALVNPMAPANRPGDPLMVSGGAVVASALASVGSSPNNGILNSYLSAVGRGPISEDGSRGSVSQAPAGSEQAQQEQVLMELAEMSAATLSNSILHMGNKMKVDLDRE

SEQ ID NO: 10247 - protein, 282 aa, Myxococcus xanthus
LVLRDVQKTDLPGLKRLAAVLNTVNLPNNEETLSAIVDTSVKSFAGKVKNPFEREYLFVLEDVRNSLIIGTSMIIAQHGTYEAPHIYYEVSEREHYSASLSRHLRHKVLSIAYNYEGPTEVGGLVVDPPYRATPDKPGKQLSYGRFLFIAMHRRLFRPRVLAELLPPLLPDGRSLLWEACGKKFTGLTYQEADRLSRQNKEFIKELFPASDIYASLFPARVQKVLGEVGPQTRGVQRMLERIGFKYMERIDPFDGGPHFEADTADISLVRKFRTLKVAEEDF

SEQ ID NO: 10248 - protein, 208 aa, Myxococcus xanthus
MDSDSLEARMARLERSCRRWQGLTFTALALAGLGLGAAALRGEDVSSGTLVASRLVLTDARGQTRATLDTDDQGNAGLVLRDGEGRPRALLGVGEDGSPRLRFSTAEGQSLAELMVYSDEAPRLTLSTPGGGELFAVGLQVDGSSRLELSDADGRPRAILGADEHGSPGLVLRDRKGLPRVALRVSPSDGASLVVEGQDGAVFRAPGG

SEQ ID NO: 10249 - protein, 118 aa, Myxococcus xanthus
MACATGPTGRPPAPPSSAAVQTELGARDVVQAGEEYARNNSLVLAEAGEAVEIRPNFWRIRFGLADRPGRVLEVEFDELARRVVNARELEVIPENPGDSALGGSGPVPAAGQPRGPIP

SEQ ID NO: 10250 - protein, 203 aa, Myxococcus xanthus
MNVPFVIETTHRGERAYDLYSRLLKDRIIMLGTPVNDDVANIIVAQLLFLESEDPDKGINLYINSPGGSVTAGLAIYDTMQYVKCPVSTICVGQAASMGALLLLAGAKGKRYALPNSRIMIHQPLGGAQGQATDIDIQAKEILRLRSYINGLIVKHTGHTIERIEKDTERDYFMSAEDARQYGLIDEVVEKQRVIAPTPAPAK

SEQ ID NO: 10251 - protein, 361 aa, Myxococcus xanthus
MNTNEVLANRASELLGGERGERRKVHPNDDVNKGQSSNDVFPTAMSVAAVAAITEHVLPELKALRDVLAQKARAFHDVVKVGRTHLQDATPLTLGQEVGGFVAQLDHAKGHLERTLPHLLELALGGTAVGTGLNAPKGYAERVAQELAQLTGHPFVTAPNKFEALAANDALVQAHGALKGLAAVLFKVANDVRWLSSGPRSGLAEITIPENEPGSSIMPGKVNPTQSEALTMLCAQVMGNDVAVTVGGASGNFQLNVFKPLIAHNLLQSCRLLADGMRSFRLHCAVGIEPNRPRIQENLERSLMLVTALNPHIGYDNAAKIAKTAHRDGTTLKETAVALGLVTPEQFDQWVRPEDMTGHKG

SEQ ID NO: 10252 - protein, 73 aa, Myxococcus xanthus
MVKTEDLIDAQAVAGLLRLRHANSVSTYLRRYPDMPRPVLDLGTGRPRLWLRPQVVRWMRARKPEQLRAGGES

SEQ ID NO: 10253 - protein, 87 aa, Myxococcus xanthus
MELLAREAQEALRQRSHRLRARASLGVGGLSFTQAEAQELRDIEEALTRIAHGEFGRCARCGGAIGRHRLRAVPEARHCLTCAALAR

SEQ ID NO: 10254 - protein, 201 aa, Myxococcus xanthus
MLAHHNTQLVALSPAPSTLAEGATPPWPPPPLRVQPKPPAHYQGTTNTIIIGIGLPLLGAYALYENERAVAMVGFIGGLVAWIFAALRFSQEGKARQHNQAEHAEHVRRAILTWARITDSAIVEQVPDSDGRSTHYLLDLHVTPWHPSHPAPRKVPLRLRVPVAHGPHVVPGAYLGVLSDPEAAWVVPQSLLTLQGAQLPL

SEQ ID NO: 10255 - protein, 213 aa, Myxococcus xanthus
MSWSGAVLSACVLGLTAGAARAEEAWKTVAEKPYVVKVRARPGSEAKDVWAEGELAASAADVQSVLRDVDAYRHWMPYVKESRILKDLPDEGQLTYTKLDLPVVSSRDYICSVVLESRLAEDGSGVFAQRWQATPDAIPQRRGTVRIRLNEGSWRVEPRGEGKSHAVYRFTVDPAGSIPGFLARMGQKDAVEDTFRAVEKRAREHAASRARAE

SEQ ID NO: 10256 - protein, 67 aa, Myxococcus xanthus
MYRLVRSAEGALFLDVVVGGIAQFTVRVVLTEQEAEAYGRLGRPYADRLAMDVMASPAFGGRAVRVP

SEQ ID NO: 10257 - protein, 206 aa, Myxococcus xanthus
MTWTIRSLLLGVFLLSGCKHTGGGSVTPTPTQPQACDAQQAQISREADERASPWSVEQHLAKNFPGKKVSWLMTDAAYQNFVVKPNAQNFGRCNDSVCYLFAAPSETIQAAVEKSMVNGAHDPAVIGQALGLPAKNFEGPLRMMTLDLAATGVCVRLPVDSDPGVWKCTSEEDTDCFKFGGYTSGGVPELMVIDAPVSHAVVTEIP

SEQ ID NO: 10258 - protein, 121 aa, Myxococcus xanthus
LDGPTPYTFYKWQLSPRTVRPVGEVAASNWHRFGDEEADELLTRFERTDAEDAQRALMAAVQRRYSELAPSIPLFPNPSWGESNSRRFTGFPTEQNPYARLSPHAEPDSLLVLTSLAPREP

SEQ ID NO: 10259 - protein, 326 aa, Myxococcus xanthus
MAYVLRRLGFYLLAAWASLTLNFIIPRLAPGDPASAMFARFEGRVQPEAMVALRAAFGFTEAPWYVQYATYLKHLLRGDLGLSYAYYPARVSEVIGTGLLWTLGLAGCAVIISFTVGSLLGVLAAWNRGGWLDATVTPALAFLGAFPYFWLAMLALYLFGFGLGWFPLRHAYSHDLEPALSFTFAADVARHAFLPAASIVVATLGGWMLSMRNTMVATLGTDTLRLAHAKGLPPRQVMLRYAARNALLPNVTGFGMALGFVLSGSLLTEIVFSYPGTGYLLILAVRNQDYPLMQGLFLTITFAVLAANFAVDLLCLWLDPRTRAHA

SEQ ID NO: 10260 - protein, 586 aa, Myxococcus xanthus
MRDLLRRLLRQRKAAVGGSILLGFIVLALIGPWLVMDPTELVGRPHQPPSSAHWFGTTGQGQDVLAQTVVGARETLAIGFAVGALVTLMGALIGVTSGYLGRRVDDVLTLTTNVFLVIPGLPLAIVLGAYLPSGPFRMVVVLSLAGWAWNARVFRAEAMALRNRDFVSAAFVAGESRSRIVVRELLPNMASLLGSSFIGNTLYAVGAQVGLEFLGLGDVGAVTWGTNLYWAGNDAALLTRSWWVFVPTGLCIALVGFSLTLLSSAIDEVTNPALKAPPVATTAVRSARSSSADAAPPPGALLSIRDVCIEYATERGPARVVDSVSFDIAPGEVFGLAGESGSGKSTLGYALLRLLPPAASITQGRIILDGTDVTALDETALRAYRWSQVSMVFQSAMSALNPVLTLGDQFHDTLAAHGRTTRAAAHARARELLAMVGLAPQWVDAWPHQLSGGMRQRVGIALALALEPRLVVMDEPTTALDVVVQKELLQRVLELKQRLGFAVLFITHDLPLLLALSDRVGVLQGGKLVEVDTAERLRTEARHPYTRLLLSSFPHLSAADAQVPADVTLASSERAPPQAAAQGGGR

SEQ ID NO: 10261 - protein, 39 aa, Myxococcus xanthus
MSAPLLEATELLRTVPVGGFLSRSRRTLLNRVSFTLERG

SEQ ID NO: 10262 - protein, 1000 aa, Myxococcus xanthus
MNWGYTPIGENYRYSLWTEKEDFIRAVLHREMTLLRDMSVNAIRQFDDIPPQWVTYIHKNYGIYTVVNPLMGRYGTNVDGVMVPNTDYSNPNHRRALLNDLAQKVEKYRDVPGVLMWMLGNENNYGLHWTSFEIEALPGQEDTARAEHLYSLMGEAVRTIKQRDTLHPVSIANGDLQYIDLIARLMPELDILGSNVYRGPSARDLFDEVLRKLNKPVMFTEFGADAYDAKAGREDHVAQAEYLRKQWEEIYSQAYGQGRAQNALGGFVFQWVDGWWKYNQEANLSIHDTTASWPNGGYESDFVPGQNNMNEEWFGICALGPEDEAGIARIQPRTAYYVLQAAFRMDPYAPTTNPDTIREHFASIRPTELSRGYESSIALARADDLSAVRVSNLRLMMDSSLSRGSIATVRPNQVAADHTESVFFDLALQPTSGVYGRASFNVVGNVAQNRLNNIFYENRGTPPAPATANGGVGQAPVPGVGNPAGQQPLGLDRLALYQAEFKLDRADFQLEGFYRTAHYHWGEEGDFFGLYREANYGPALDIYKGNAPFGVVFTGKNNLEGLKVAVGPELYWGANPSIVAKYRRNVGPVTLTLMHQEDIARGSTQLTASVIRERVARRSTLSLGWTKGPMALEVGGILAAPQRVGEEFIWSRPTDGPSYLDSGYEVMRDEIRMLDTLGAKARLTYDLGAVRTFLQGSYRGLVADGGPEQGILLTGWSLRESGRGNHFGGQAGAVVQVGSAFQVSPNLLYQKPLIGPNPRIEDAFDPESGRYFAGVRPRNVLVDAFTVLDNRETLGAELLLTFDPTPGTWFWQWDRDMREDAPFAAGLDLVYRRQPTSRDAGIAILADGSMVAFGNAPSARDEWEATLRLVTNPVQRLKIFGAAFAGSNQSSGEDDRQVRRFGVDASVLWDTLMLTTQLHFNNWGPYDYHRVFNLTYPIQLGGDLSYGLKRPVMGTVTTRFGVRGLVRMLDQYSEGLSQTALDQGLEGREFEVGAYAILSL

SEQ ID NO: 10263 - protein, 325 aa, Myxococcus xanthus
MAPYPASLFKLLIAFRVLRWVDQGHLTWDQPWRFLRDTEDKGTRPIRDWLEPMVTESDNTATEALVKLLHEQGAMASLNAELAALGLDTLQVHGTSPVTGRSWNPGQIHMTALDTARLLLLIEGGPGVLWRTASGRDVTAKELSGASRTHLQSLLADQALHEALSSTLLCGDARAEPGIPAAVPTRWVNSEDGTVTAAETAFGRDTRPCNATAEVTFLHKTGLTENYGSDGGIVRSLPGKPWRRYIVVFLSNLGYRYYDAKVADAADFAKGEDGFPYVSTSISYTQRIPALGRQIDAMMRERQRARPQSPPAKDAAPQQAPRPAR

SEQ ID NO: 10264 - protein, 184 aa, Myxococcus xanthus
MKTWLLLACAGVVTGCYDPASFVYGESLDGLTLQFHSPDVGIYPDQSVLDDPNNPFRSSTPGAETKWDIESRAGNVAAFYSWATLLAREPGGEAQFYVGNNLLAIYQNGEARQEDLPQVRLQAIRAYQTMLDSFPDAVTYDATGTYAYDLATPAYKGIVEMEGAVQGGWVLMSTAGGGDRAVRP

SEQ ID NO: 10265 - protein, 205 aa, Myxococcus xanthus
MLLAGCRPDPGVPDYTDQGYNRPDAGGEPNDEVLPGPYPYVEGQRRLGVGFYEGGRSQDIPVDNTTVHIYLYEGTLSLEPSTTRIEGRQSDLVVHAGKTWLGFGVHWNTPRNLDGWTTLHVSLNSADPGFANVSIGMNDDQSVQLPASQYGYTNDGQWHHLAIPLADFVAGGLQLNAVQAPFVFIAGAGPAADTLLLDNVYFTAD

SEQ ID NO: 10266 - protein, 318 aa, Myxococcus xanthus
MPPIMRTGEGSPGGSAVTRIVTTVFNSAPQALSKPIQPVVLKDARTPMETSLARPVSSPAPATPRPERDTFQDTKPAAKGVPRLSVPDATGTSELPFLRDLAPENEAAQAQADKGWAPTASVIAQNSDTGCGEATLAFLSRASRSVTKGTLCEKQERETVRERASQVSGARSVHAPVDVNLDDGATPTEMATALGGMGIEVTDGFADFDAAATSKMMKAGQFGLALVDANAILNGALAARAAARRAGPAPLGHHRRRQQQRDGRHVGRLVPREGPRQWRVLGVRQGLGERRPGRQGAPRQRRHLRAGEPHGRGRTEGA

SEQ ID NO: 10267 - protein, 116 aa, Myxococcus xanthus
MSDCLFCKIRDGLIPAKVVYRDDVCVAFEDINPQAPTHVLFIPHKHIPTVNDITTEDRELVGHLFIAAAKVAQERGHADPSDGYRVVMNTHAHAGQTVFHIHLHLLAGRPLGWPPG

SEQ ID NO: 10268 - protein, 132 aa, Myxococcus xanthus
MWGLAYAMGLQNALVTRVSGAVVRTTHITGILTDIGIQVVRLGSWLREGTRGQGLLGLRRRLWALPTAVEFERTRLHLGLGSAFLGGCTLGPMLFARLGAATLAIPCGVLVMLVALDLSAVATSGPQAMPRA

SEQ ID NO: 10269 - protein, 81 aa, Myxococcus xanthus
MRKKDTDKAGPSSWYALCDVRDSNYILLDVSHQLDGRYPIRDGYNEAFPDPAYCRQIARSFSEFLAGALRSNGRWFWLPEQ

SEQ ID NO: 10270 - protein, 856 aa, Myxococcus xanthus
MGAVFAAYDPDLDRKVALKLLSVEARSADEEGGRARLLREAQAMARVSHPNVIPIYEVGTWDTQVFFTMEWVAGGTLADWRREKLRSWREVLEKYLQAGRGLEAAHAAGLVHRDFKPANVLVGRDGRVYVTDFGLARPVDNLPLDEQPTLARVRDASETSRTLHDPLTETGVVLGTPPFMSPEQFRGESLDPRSDQFSFCAALYRALYNQRPFDPDELSRAAKALRSAPAKVTAPLERAGREPSPIHEPPSDARVPAWVRRAVMRGLSLEPEARFASMGALLEALSQEQQRARARKAGGMAAATVALVGAVGGGLWFQSSVCAGAEGLLADTWGAEAKQRLSSAFAATGSPLAGDMAGRVGQVLDAYASSWAQQHTDACEATRLREVQPEALFTQRVVCLERRHKDLRALVGALSQVDKAGVEKALDAAYALPSPEDCADVESLASQQPRPADPAMRAELESLEGALSEVKALVDTSRYPQALAAANAVESRVLAARYAPLTAELRFHQGWLQAVLGEKDRGAGLLEQAVYDATSGRADRLEVSILNKLLYVEGERERFEHASQWARLGKATLQRLGGDAVLRGDLLVNEANLALMRGQTDDARALLEEANTVLTDALVPGHPKRARVTFSLGRVLLEVGAFPEAVRVMEDALRQTEAAVGPRHLDVARRHQGLSMALREQREFARALAHAQASVALHRELLGDSHLKLAEALDEEGMSLLALSRHEEALKVYEAALAVKHAQLGPDDEDLQYSYDGVGQALLGLGRTREALAPLRKAVAFTGAQEDSLGESGFALARALWKEGQGVEARTEAAKARERFTASGRALQAEAVRAWLDELPPETKAKPARPQQRRRR

SEQ ID NO: 10271 - protein, 84 aa, Myxococcus xanthus
MNRCQVNHIDPATLDMVRSHDIVVMYGTNHVSSCALDQTDGGATLVVYGTKGGPLPGEVGNRPNYVATYYDFFTSTTPPVYYTY

SEQ ID NO: 10272 - protein, 274 aa, Myxococcus xanthus
MSGSGKSTAIRALEDSGFFCIDNLPVLLLPKLTELAGGGHFERMALVVDVREGVFLKDAPRILAEVRRAGHQVEVLFLDASDDSLIRRFSETRRRHPLAPNGTVAEGIKAERQALRDLRELADQVIDSSTLNVHDLKRMVQARFSPEPAAGPSLSIMSFGYRYGVPPQADLVLDVRFLPNPYFVPEMKGLTGKVPKVAAYVLEREETQQFLEKVVDLCRFLFPRYQKEGKAYLTVALGCTGGKHRSVAIAAELTQRLTDEDTRVQLWDRDIEKE

SEQ ID NO: 10273 - protein, 139 aa, Myxococcus xanthus
GSHGPAGEVRKLANRTRDAVGQVQTLLSRSEADTRAAADLMRQGTTAAQEGLGLSTTAGEALSRLLSGVNEIGGKVERMADENTRQSASGESIAGSIQALSVRSTESVAGVQQIARSVEDLRARASKLKDLAGRFTARG

SEQ ID NO: 10274 - protein, 321 aa, Myxococcus xanthus
MKSIRISQLLEDRDYDMRLSLVAGGGGLSRIVVSSRIQKPGLALAGFTEHLHPHRVQVFGNTEISYLATLPEARQRESLAQLFGEEELACVVVTKDLDIPQALVSACEGAGLALMKTPLLSSDFIMRVQTFLEEALTESSSLHGVLMDVFGVGILLLGKSGIGKSEIALDLVMRAHRLVADDIVDVTRRKGAVYGAGNPVIKHHMEIRGLGIINIKDLFGVAAIREQKKIELVIELQEWDPHQEYDRLGVEDRHLQIVGVDIPLSVVPVRPGRNMATIIEVAARNQLLKLQGHHSAREFAERLNRAIAEGAMRRTLGEEVE

SEQ ID NO: 10275 - protein, 745 aa, Myxococcus xanthus
MSRYAIAIFASAFLLFGVQPLVGRYSLPWYGGTPGVWTACMLFFQAVLLGGYAYAHGLASRLAPRTQARVHLGLLAVAVLLLGARALLAGSPVAPGPEWRPEGTALAVPRLLAMLAVTIGLPFFVLSTTGPLLQSWFARARPGRSPYPLYALSNAGSLLALLGYPFLVEPWVGRGAQAWGWGVGFVFFAVACAVCALDVMKQPDTAPVATAAPVTATPLTEGAGGEAGAEVARPTVRATMTWLGLSTCASVLLLATTNQLSQDVAAGPFLWVLPLAVYLLTFILAFSRESFYSRTVYAVLLIASGAGVAHAQTQGPQSSLALQLAAYSVALFAGSMVCHGELYRLRPPPRHLSAFYLWVSAGGVLGGLLISVLAPAVFSAYWEYPLSLGACCVVALVGIAKEAGEATRTQRLQRVLRGAMLLLVAGHLTYTMAREQGRARFASRNFFGVVRVMEQGVGSPEDHRFTLLHGAITHGLQYVTPERRGVPTTYYTPEAGLGLAIAEHRRLREAVGLPAGLRVGVLGLGVGTSAALLEAEDTGRFYEIDPAVIALAQGEGGYFSFLGDTPAKVELVEGDARISLERELETGGAQGFDVLALDTFSSDAVPVHLLTQEAVALYRAHLAPHGVLALHISNVHLDLVPLTLAHARALGLHAALVVNETQGDALRSNWMVLSPDREFSWGPTFTRASARVRRLGLREDPDFTWTDEKSSVLHVLRRGRPSASVKDVEASSGPPGPASAQPGTE

SEQ ID NO: 10276 - protein, 136 aa, Myxococcus xanthus
MTELGIAHLSERPAEALSGGERRMLMLARGLVQQPELLLLDEPTAFLDVAHQVGSLDRVRARVDAGLGAVAVLHDVNLAAAFATHVLLLRDGQVLAQGPANEVLERGSLETLYGLPMETALAPSGARLFAPRAPSR

SEQ ID NO: 10277 - protein, 352 aa, Myxococcus xanthus
  unsure (1)..(352): unsure at all Xaa locations
ERHDDTQPXVAHNADTDPRVTRHDDTHPRVVLDAGLFKDVDGSEDEERSGVSRPRPRRARPSSPGMAPASTARRTGSVSAVRPTAPAPVVTDEEEDESDDDVRVSLTPNEETRRTTMPVRPETRSAERIAKEDTRRTTMPERPERRRKGPLVLVLVLLFFILAVVGAFFLAPPELRAQVLSQFMPEQPEGPPPAQPLRPSAPDEALAGKAANENGPPPEGDAAQAPGTPAPDVVPPSGATEGRGSLDDSFLAPLDAQQKTTEAPEKRAAPVRKIRSARSRQLTVLEREWRETNALFNQLNSEHSCVVLGLWCTRYAEVKSEVEAAGSGENPEALRKVRAMKRFLLQKQKELY

SEQ ID NO: 10278 - protein, 290 aa, Myxococcus xanthus
MSNLSASEMNTVLAQRLLSIFERSRDRKYTAAKAAKKKKPKPAASAADDADHVDDSAPPRGVLGKDSDYAQNGSDYIASLDGRGVYRVFDHSYLDEIRDLVKQTAEFPGGPPENFNPRAKDKDKKPALQKYPYAWEAHHILPGSAFYYELEDGPVFTYRQLRLILQSDYNLNHGHNIIMLPDQAWAVPVHALLQHPGDHPNYTQQVMRDMKTIAQKLQKAIDSQKEHKALIEDVFDQLHKLENKYWKLLVALSRAVVASVTAGKEYKHALVRYAPKDKKAKSRYEWGSLY

SEQ ID NO: 10279 - protein, 347 aa, Myxococcus xanthus
MGHPSTENLTPFTFEPLFLTDEALRPLFVPVLKATFDLRPRGAPTLSAEQAPLLTGGERWDGGDVASLRLEPEGAFFKAATDVVLVGHAHAPAAGTRELLAELHVGPVHKQVRVLGDRTWFKSMGGIGVTQPLPFERVPVRYERAFGGKDGSAFESRNPLGMGFREKGSRFEENLRLPNLESPTEPLRSWGQRPPPTGFGFIEPHWQPRAGYAGTYDDAWKKSRSPLLPKDFDRRFLNGAPQDQLVPGYLRGGEAVLLKHMAPGAPLTFRLPALPSPEVLAPRARGLDDLEGALRLDTVVLDTDAMKLFLVWRGTFALQREPTELRSIQVTCEGAETLEPGQPVGTD

SEQ ID NO: 10280 - protein, 536 aa, Myxococcus xanthus
FEFQLNGATVRVDGVSPNTTLLDFLRARGLTGTKQGCAEGDCGACTVALVDRDAQGNRCLRAFNACIALVPMVAGRELVTVEGVGSCEKPHPVQQAMVKHYGSQCGFCTPGFIVSMAEAYSRKDVCTPSAVADQLCGNLCRCTGYRPIRDAMMEALAQRDEGPSPATAIPSAPLGGPAEPLSPLRYEAGGQTFLRPTSWEELLDLRAKHPEAHLVAGATELGVDITKKSRRYPFLISTEGVESLRAVRRGEDGWYVGGAASLVALEEALGDELPEVKKMLNVFASRQIRQRATLAGNLVTASPIGDMAPVLLALDASLVLGSVRGERTVALSDFFLAYRKTALQSDEVVRHILIPHAAVPEGGRRLSDSFKVSKRRELDISIVAAGFRVELDAGGLVKLARLGYGGVAATPVRARRAEAVLTGQPWTAETVARVLPVLAEEITPISDLRGSAEYRRGLVAGLLKKFFSGSHSPALDAAPGFDAGEVQAPEDAGRALLHESALGHVTGRARYVDDMAQKRAMLDVWPVCCAHAHARI

SEQ ID NO: 10281 - protein, 230 aa, Myxococcus xanthus
ALSAACMSRAETILNTEKGALEQRLSEVARERDTLKASIEKERNQHQAALTEQLTRHDASMERARNQMHESNNLLAEALGEAAKKPAPSAVATATSTSSSEGLANTQTDSTQRSDAALRGDVSSSARRSSSSQGPQTAPPPRVVKPIIDTTDDTPLMCELPSATKTKANQSRASSKKKRPGVRYASECTQMKPEPSFQPAEPEEAILATPAQQTAKAPIPLVPQDADAVK

SEQ ID NO: 10282 - protein, 117 aa, Myxococcus xanthus
MRAVEAAASAKAALLEEELEQGQRPPDEVERILFHLSRHTRAAAIAQLLAYADGATFRDRLVRSGQPHRRRLQWATGELRPFNRFTATGHYGPLCDSLAPGWASWPTTLPACRRTRP

SEQ ID NO: 10283 - protein, 371 aa, Myxococcus xanthus
MRVDIGQNERAFVLVDEKPERYLVPGRYWLLHPFRKVRLVRVSTEQPLVQLDPAFLPLVPETDLQVVELSADERAILFHKGRPVRWLGRGLHQVWTVERLPSRQLTPGAPTVRVERVDTSGVTTAPLRDDVRALVPTSDYTEATATEGTVVLRYVDGVLDAELPPGRHAAWTVARKVQLAVIDLRERLLHVTGQEVMTKDRVTLRLNLSAAFRVSDARRLAVVSRAPDDVLYLAMQLAAREAVSERTLDELLASREAVAESLFTQVKDRAHTVGLDLLRFGIKDVVLPGEMKELLNRVIQAQKEAEANVILRREETAATRSMAQTAKVLAENPLLVRLKELEAYKDLASKVGQVHLVLGEGAVPTLQLKSH

SEQ ID NO: 10284 - protein, 604 aa, Myxococcus xanthus
MSSSNHYVPNLRDIEFNLFEFLDIGQASLGHAPFGDLDETAARQMLQMFAQLSTNELAQSFEEPEHNPPKLENGEVTLPPGLKKAMNAFFDAGMHLLEQPPHLGGLGAPPSLGWAAFELLVGANASLAFYTLGNLLARIIDRLGTDAQKQRFLPHMLDRRWGGSMVLTEPDAGSDVGAARTKARRVSDDVWEIEGVKRFITNGDSDMSENIIHMVLARPEGAAPGTKGLSLFVVPKYWVNEDGSLGEANGVVCTKLEKKMGLKGSVTCEMTFGDGKPCRGLLLGEVHDGIRQMFYIIEQARMAVGVKSMATLSAGYGRALAFSKDRLQGADLMQARDKTAPRVPIFRHPDVRRMLMAQKAHAEGMRALCLYTAFIQDGVERKGGHRATEAGELDTLNDMLLPLVKGYCSEKAYELLALSLQVHGGSGYLQDYPVEQYIRDQKIDTLYEGTTHIQALDLLMRKVARDGGATLQGLLSQIRETAERTGEGKELEAERAALGRALGDLETMLGTLMGKLGESIYHVGLQGNRVLAAVAEVVIGWLLVRHAEVALERMKSNPGDRAFYVGKLASARWFCHEVLPGVAHAARMVEHGNLDLMEVPEESF

SEQ ID NO: 10285 - protein, 236 aa, Myxococcus xanthus
MSSSYRIKSGDTLSHLAQRYNTSVSALMKANPQIKNADLIYAGKSLNIPGSKDSFESGSAGRAGGATGGGGSSGGAQDVQGPSSSGPGVRGPKGSPFEIASQHLGKNAGSLKLEKNGVGADMEDWVPNNVNCANFVSAVLEQSGQISDSQHDNSVMGLMAKLDRDPKFKRIDLKDAKPGDVVSMKTNGGQHVVMFAGWKDGKPTFIGSNNVNSDGSQRVTISSMNYPIMAVHQYQG

SEQ ID NO: 10286 - protein, 86 aa, Myxococcus xanthus
MTQEEGALHAKGTFGGQLTDFQVTPQTLKGDVGRCSYQLKASEEGRYQGWRSCLAGLENPVSLSIPPAIGGDDARLVATLALILSR

SEQ ID NO: 10287 - protein, 262 aa, Myxococcus xanthus
MHEVDFHIYGEDLQFVEVELDPGEAAVAEAGTLMYMEDGIEMETIFGDGSEKTSGFFGSLLGAGKRLLTGESLFTTVFLNKSGSGKRKVSFAAPYPGKIIPVNLSELGGELIAQKDSFLAAAKGVSLGIAFQKKLGTGLFGGEGFIMQRLQGDGLAFIHAGGTLHERTLGPGEMLRVDTGCIVAFQPTVDYDIQMVSGIKTAFFGGEGLFFATLRGPGKVWLQSLPFSRLAGRILSASRPGGARDEGSVLGGVGLGSLLGDD

SEQ ID NO: 10288 - protein, 73 aa, Myxococcus xanthus
MRAAGHPPPSVDFGLVMLTGALGLPSGAGATLFAVGRAAGWVAHVLEQREQGHLLRPRARYVEPAHPAGGRAP

SEQ ID NO: 10289 - protein, 54 aa, Myxococcus xanthus
MFLVLRVGGMWLFASRHPEEERPRMRRTATLTTVLALIAVGIWVYTVLQGPRGF

SEQ ID NO: 10290 - protein, 319 aa, Myxococcus xanthus
MPREPRMDGALVLDAQGELWIREGRRVRAGEHVVVGFAEDGSEGVFVNSAYLADEGEGEFKFMTSAVSREKPIDYAHMARVLVDERERGGYPIWVTGPALVHSRARADMTWFVANGFVGALLAGNAVAVHDIEASIFGTTLGMSGSGEATSGGHGLHMRAINKVRAAGSIAKAVEAGVITSGIMHACVVHKVPFVLTGSIRDDGPLPDVVTDNLEAQVAMREHAVKSTMAVMIATALHAIATGNMLPAFVTEKDGSLRELPTICVDSSEFVVSKLKDRGTHQAFGVVTNAQDFMHVLRLYVERDLAARGLPVPGDALRK

SEQ ID NO: 10291 - protein, 129 aa, Myxococcus xanthus
MNPEGMMKPDVYRKVAVATGSRQVHIAGQVAYDADGQLVARGDLAGQVAQAYRNVAIALAAAGATFNDVVRLTIYVVDWKHERMPDFLAGIEQVSKELNIVPAPASLIGVSVLFEPGVLVEIEATAVVD

SEQ ID NO: 10292 - protein, 187 aa, Myxococcus xanthus
MSALSRRLNLDWVLPSLAVGGRFPIDTAEHLAGALGIRYVVDVRVEDCDDEHVLREHGITLLHLPTEDLRAIRGDRLDDGVAWVTDQLARGHKVYIHCEHGVGRSALLALCVLVALGHPPLEALSLAKRRRWQVSPSTEQLRTFMAWADAWRQRNAATWRVPRLEELAAIAHSHLTQPPPASRGNED

SEQ ID NO: 10293 - protein, 257 aa, Myxococcus xanthus
MSHAATFSERLVDAGRGLLTGVSSASVGVARSVGVVLKAMGGGVAQCVRGRPREGLPQLGQGLTRVAQLPADAVLMVGGRVLSSVQVLVGLEPPGRRLSAEEIARLRPIFGDSLNYAVVRVKVGRLGLLGLPGRAFAHGNTVFVPPRSGGVDFGLLVHELTHVWQHQHGGTAYLSAALAAQWSGDGYDWRKGVSREKRWAQLNPEQQAQLIEDAAVAGLIPFTTSVSPRMKLRGWSDAALDLLDEAVVCLHSGRGAP

SEQ ID NO: 10294 - protein, 127 aa, Myxococcus xanthus
MLVSEEPLFRLAMGRELASDFELVPTLGIASADRRMDLGVVPEAVIVDLDSVERAAVPTFLARLVERDLAGPRILVSSYFRPEVAAAYSASSLTHFALSRPWRPGALRTLVESVMGLSGLRAMTAGR

SEQ ID NO: 10295 - protein, 211 aa, Myxococcus xanthus
MIDHINRTENLHVLTIEDPIEFIYKNIKSSISQREIGPDTQSFAIALRAALRQDPDVILVGEMRDTETIDIALKASETGHLVLSTVHTTDASRTINRLVSVFPAEEQTMVRMRLADCLKATVSQRLLPRASGKGRTVALEIMVQTKTVEQYIRDDRANELKDVIEKGRDMFGMQSFDQHLTQLYREGIITLETAQSAASNPADFQRALEFE

SEQ ID NO: 10296 - protein, 379 aa, Myxococcus xanthus
MSLGGILTLMGGLHAYIAVRLFVSPQLPLPWAWLGPVLVALLFLSLPVGMVASRREPTLWAQVLQWTSYVWLGAFGILLSAVVVVDLVGLGLSWSGVVTDALALARGKALVAVGVTVPAVVYAFITARGRATVERVTVPVAGLAPGLSGLKVVQISDIHVGPTLDGRWLRRVVEQVNALQPDVVAVTGDLVDGAVDALRDEVKPLSELRASLGVFYVTGNHEYYHGGPAWAAEVARLGLTVLQNEHRVVERDGARLTIAGVTDHDAGHIIPSHASRPELALRGAPQGVPRLLLAHQPRSALRVAEAGVMVDLQLSGHTHGGQVFPFMFLVKLQQPVVRGLATIAGVRVYTHRGTGYWGPPLRLGPSPEIAELTLVSAPG

SEQ ID NO: 10297 - protein, 688 aa, Myxococcus xanthus
MGHWELARVKAVSESPPGLRFSEPLVHAYTAPGAQVVTVPEYTDVLVSAGASVVAHPWDGRSGGILAFLATGSVTNQGLISAEGMGFRGGLFVNHADLLGCSDLDIPPEAGGAYKGEGLRMGHFGTASGRGSVAGEGGGGNCHNAGGGGGGNGGRGGVGGRTSEADMMRDVGGFGGAPVKYSLIDKFVFGSGGGAGEGNDDLGSNGGAGGGVVFIRARAFSGAGRFSADGLAASHTPGDDGAGGGGAGGVLILRAQDSLSCGSARAAGGNGGNVSYPGWVLGPGGGGGGGGVLLQGATASCPMSVSGGAAGTLTPSDGGTNGAGTGSEGFTEEYHVAYRTPGTPSVSAPVSGAVGVPHRPRFEGRADPGVRVLVFVDGVELLQVSSGADGVFTAGIPPHQAPLDVGTRTVHVVAEAMGAYSAPSAPVSFSVATTLEDGGVVVEPILVIPQDGETVGTTPLFAGVAPNGQTVGIEVDNGPEVIIPVDGAGRFRYQWPAESPLAPGPHFVTVHSHNEAGISGPYSQPIRFESQVVSGEGDGGTSGQDAGTSQGDGGTQFPEDGWPVLVVPADGEVVDSTPLFAGAATAGATVVIEVDGIEVATVTADDTGAFRYQVPRESALSVGSHSVAAQERLVTSSRVPARSRTTGFEVRGPAALDVGCGCGASPVGVVGSWVLLAGLAGLSRRRRG

SEQ ID NO: 10298 - protein, 165 aa, Myxococcus xanthus
MAPLLDVLTRERLLKDRAAAAALLPRGEPPHVSMLRLCDAGLLEGGLSVGYGVRADELVGPLTTAMGGAARRFKVVDVRERPVLELHVMGGDVTERWEVEDLSALVHNLNSLYRDAPDVRAVVELGEWEDALQLWCVDKRALPRLARQPFFAPRNARALMNPSGE

SEQ ID NO: 10299 - protein, 167 aa, Myxococcus xanthus
MSSHPHVVHEPELPWTEVTQGPRVEYRRKQLGSAAKGRKLGCSLMELPPGKHAWPRHYHLANEEAYFILAGTGRLRLGDDTLAVTAGDYVALPVGPGGAHQLLNDGAEALRYLAFSTMVEPDVMVYPDSGKVVISAGSAPGGDKAARTLFTTLPLSAEVDYWSGEER

SEQ ID NO: 10300 - protein, 259 aa, Myxococcus xanthus
MQVDFGRTSSDYVRHRAGFPEAFFERLDREGLLRSGLRAVDLGTGTGTVARGLAQRGAVVTGLDVSADMLDAARGLASGMGLGIDFRQAPAENTGLPSQAFELVVAGQCWHWFDRPAAAREAARLLVPGGRLVIAHFDWLPLPGNVVEATERLIERFNPGAPAPFVSLSQSSGVYPPWFRDAAEAGFTQLTSFSFDVSVSYSPRAWRGRIRASAKVGASMPASAVSGFDAALADLLAGSFPADSLDIPHRVFALLATRP

SEQ ID NO: 10301 - protein, 369 aa, Myxococcus xanthus
MGLSIGIVGLPNVGKSTLFNALSAAGAQAANYPFCTIEPNVGVVPVPDDRLDKLSALIKPLKKVPTSLEFVDIAGLVRGASKGEGLGNQFLGNIRQVNAVLHVLRCFEDDNVTHVEGGVNPVRDRDVVDTELCLKDLETVEKRRERSLKNTKVGGKAGEEAKAEVALLDRIKASLDNGITVRAQKLTEEESAVIHDLFLLTDKPVLYVANIGESELGKEDANPHVKAVREMAAKEGFEVVVLAAALESEIQQLPESERPGFLESAGLSEPGLHKVVRAGYKLLGLWTYFTVGEQECRAWTIHQGYKAPQAAGVIHSDFERGFIKAEVMRWEDLVKLGSESAVKEKGMLRVEGKEYVVQDGDCMHFRFNV

SEQ ID NO: 10302 - protein, 174 aa, Myxococcus xanthus
MDGAAEPLYLYEIYKGLFAAIVEPTIRIASRVEVGPWAQFSHAQMRIRCSAERTCKGSNLRFGLQGNYHWNPSGPIDLWSGVALGYDTSSVSVPAAEVTYSGPDVTLQAGFDRNFGGNFWAGLFVVGTGGQYDKLDVRLLNGSGSETLRERAFHLWIGFGFRVRVAAPHPAVTN

SEQ ID NO: 10303 - protein, 153 aa, Myxococcus xanthus
VVLKWKAWGPILSLVEEREKQIASSIESAKRERAEAEKLLADQKTAIAEARREAAEMMRRNTQEMEKFREELMAKSRKEAEELKLSARREIDEQKAKAIAEVRSMAVDLAMEVAGKLISERMDDSKQRALAEQFVQGLPLNSTSATGAVRRTA

SEQ ID NO: 10304 - protein, 210 aa, Myxococcus xanthus
TRAEPDGSGWYDSSAHMLWIGERTRQLDGGHVEFMRGIQNPIGIKCGPTMEPDEVLRLMDLLNPQGIPGRITLIGRFGADLVAERLPRLMAATRRDGRPVIWSIDPMHGNTHKAGNGYKTRSFDRILTEVCGFMDAAAAEGVHPGGLHLEMTGQNVTECLGGPQPVTEDDLSSRYHTHCDPRLNADQALQLAFLVAESMPSLRTHEARAA

SEQ ID NO: 10305 - protein, 370 aa, Myxococcus xanthus
MRLFSLSAAQFGTLVSSYTLASAAMGVLGLAWVDRFGRRSTLLVILGGFITATLACGAAQSHAWLLVARSIAGGCAGLMGAVIMSIIADTIPGERRGQAIGTVMSSLGLSAVAGVPLSLGMANMLGWRAPFWAIGVLGALLWFGLLAVLPRLDAHVTTDSDRQAPSVTALFTPGFALGWLLTFSVAFSSFLLIPYLSAFMVGNLGLKQTDLPWVYLAGGAATLLAARQVGRWVDRFGPARVLGLLLVGTMVPHLGFTHLPAAPLPVVMVAFVLFMSLTSTRPIPTIALISAKVPPPLRGRYMAMNMAASDGASGLAAWASGLMLATTPGGALVGFGLAGWLAVGVTTVSLFILWTFGRSAVPLNAAPTPR

SEQ ID NO: 10306 - protein, 490 aa, Myxococcus xanthus
IVGTAGHIDHGKTSLVKVLTGIDTDPLKEEKRPRITLQLGFAHLTLDDGPVAGVVDVPGHERFVKPMSADSDGVDLVMMVVTADEGVMPQTREHLDICRLLGVRAGVIALTKSDTLSELGPEWLALVEADLSALTVGTFLESAPVVACSARTGAGLDALRAALTRAAAALPERPSEGPAFLPVDRVFTIKGFGTVVTGTLLSGALAVGDAVSLLPGLPGPLRVRGVQRHGDAVSVVEAGQRAAVNLTGVEPEALRRGMVLVRAGELPEARMLDVELTLLPAAPSPLPRRSKLLLHLGTAQVEATVALLDVERLEPGETTLAQLRLGASVGALVGQRFILRGARALPGRGATVAGGRILSISPPKRRKGGASAVAPLLEADPAGQVAWLLRQAGYRGLTQPELFGRSALGPRVLTRALELLGARGGALLIDRERRLYLSGEVFEALQGRALALLATFHEREPLREGLSREELRQRLSCECMLRPVKRPGRA

SEQ ID NO: 10307 - protein, 192 aa, Myxococcus xanthus
MDDDAPVAAKPARKAPARAAKTATVGGSSLARFGRPKGASAEGKPARRSFGGDEGAPRGRSFGGDKAGAPRGRSFGGDEGAPRGRSFGGDKAGAPRGRSFGGDEGRPARRSFGSDEGKPARRSFGSDEGRPARRSFGGDEGKPARRSFGSDEGRPARRSFGGDKAGSPRGRSFGSDEGRPARRSFGGDEGKL

SEQ ID NO: 10308 - protein, 57 aa, Myxococcus xanthus
  unsure (1)..(57): unsure at all Xaa locations
PAFTKRMEKSXXASEAALQDLQEAMAAADWTQKVSSSVLDTTPPEPETGDTTGPKPE

SEQ ID NO: 10309 - protein, 125 aa, Myxococcus xanthus
MSKSLSRRILALPLLAALFAAPAAMAEDAPRGRPYVFTTVDDYSIRLDGRIDVTGVLQGEAEPRTVTFKIVLSHGAQESLQTLASRCDRMALLAMSKPGAYLLTMSVEDHPNNYIQFACKLARVP

SEQ ID NO: 10310 - protein, 682 aa, Myxococcus xanthus
AAEDGRVLFRKNLTEDAAHSYRVWADATSPFTPFAGPSGNSHIPHPTGTPDGEVPLFVERNLVTLDNAPFSRNDPWLPVDARESVGNNVDAYADLAAPDGFSEGDMRAALSGPATFDYPHSFNLLPYETPQQIQSSVTQLFYVNNWLHDAYYDAGFNEAAGNAQHDNYGRGGLGGDSIRAEAQDFGGVNNANMSTPADGARPRMQMFIFPGGTAQSSVEVTAPASIAGPYTFVSSQFAPRVFSVSGRVVEGLDAENADGPSTTDGCTALTNAAEVEGNIALFDRGTCSFHRKALTAQAAGAIGVVIANIDGMAMPEGMGIENGLSPSRIGAVMIPKGDADRIRGTLTEGVQLSMIHRPEGDLDGTIDTSIVAHEWGHYISNRLVHDGAGLGTNQARSMGEGWADFHALLLSVREEDAQVASNPNWTGVFPVGDFATRNMSADAAYFGIRRVPYSVDFRKNPLTFKHISNGVRLPSGVPYAFGADGSSNAEYHNAGEVWATMLWECYVGLLRDSSRLSFNEVQRRMMSYLVTAYTLTPASPTFLEARDALLAAAYAGDPADYQIFAEAFARRGAGIGAVAPDRVSTSHAGVVESFRTGADVVFVSAELTEDGSENTCDADGYLDNGESGVLRVTLRSTGTAPLQATSITVSSNSQAVQLANGGAASFPAMGLYETATVEVPVR

SEQ ID NO: 10311 - protein, 149 aa, Myxococcus xanthus
FWGVQDARPLQRLELQYSTDNGTLNVSFDLDPGAEPGRGDPMTHFGFAELLVPRWADVKDHKPSLVGLDGAKLAAREDGTWGTPEAHAKLEEHLGKMLVATLLELRDSSQFEALRASATAELGVEEYEGHFGWPDYEERGRENRIASSP

SEQ ID NO: 10312 - protein, 66 aa, Myxococcus xanthus
MSILGARTLIPGAEGFGIARREPAVAERHRSVCFSEIPLDQLARLVQRRSLYGIGFSKTYILSQGG

SEQ ID NO: 10313 - protein, 120 aa, Myxococcus xanthus
MDNPEVVQPQGKVPAGMVGRWNLWVPGGIWYSTDGSRIYRNYTQGAAMNSLTIRANGTYNWGGTAGRLTEIRPWFAQPGERYFAVQLDADLKYMARHDAGKGKIDLFFWGVGGHAATGTR

SEQ ID NO: 10314 - protein, 70 aa, Myxococcus xanthus
TDSSPSLHLWLWNADWGPCKLESEIAAGSWLFTEATAEAVLGHEPSKLWDTTLRGMGVDPAMLVMGRGMN

SEQ ID NO: 10315 - protein, 85 aa, Myxococcus xanthus
MLDAEFIRARILEALPGSEVEVRDYTGTGDHYEARVVSPDFAGKAMVQQHQLVYAPLQQWLKSGELHALALKTYSPEQWKKLGTR

SEQ ID NO: 10316 - protein, 106 aa, Myxococcus xanthus
MTPELKARLEQETRSHKIVLFMKGNALFPQCGFSARALQLLQPLGQVHTVDVLADPEIRQGIKDFTNWPTIPQIFINGQFVGGSDILMELAERGELADLVAGKSPA

SEQ ID NO: 10317 - protein, 100 aa, Myxococcus xanthus
MAVFFFGGFIYDVLTISRIDDTLTLAQNFGYLLVLTGLLLLEQRYPDGVEPPKFLQKVWRWREDGIHFLFGSLLSAFMLLLFKSTSGALPYLFVVGLFAL

SEQ ID NO: 10318 - protein, 40 aa, Myxococcus xanthus
SRPLEGMRAWMPPGDAVRAVAAAGGTAVLAHPVQKRNPWK

SEQ ID NO: 10319 - protein, 569 aa, Myxococcus xanthus
MAAVGLSTGAYAYLTGPALRFVLSGGEEGFASAQRVPWLANLPREAALWGFPLVMVIVGAAKGVGYLAQFYFMGLFAQRVVKDLRRDLFQRLTALSPAQLARERMGDLLSRFSSDVSAVEAAAMYTVGSYLRDTLQVIILAGVALAMSPMLGGLMLLVIPLAALPASKLTRKVLKRTREGQTQLGNLAGQLHEGLGGLRTIQAFNGQAAELARFSAFAQAHEKAVVSAAWARGAVPGLMEVLAAAALAGALAYAASARLMEPEALLSLLTAVILVYQPVKDLGRVTQFAVQAGAAGERLFSLLDMKHPVEDAPDAVPAPTLSRSIQFEGVRFAYGERPALDGLTLELKAGQVTALVGGSVGGKSTVTSLLLRFERPQKGQLLLDGVDADRYTATSVRAQFALVTQEPLLFHGTVLDNLRYARPDATREEVEAAAKVAHADGFIRALPEGYDTRIGERGVALSGGQRQRLCIARAVLAQAPVLVLDEATSSLDPESEREVQAALAAVLPGRTALVIAHRLSTVVNADVLNVMEAGRVVESGSHAELLQRGGRYAALWRMQTEGSSERGAA

SEQ ID NO: 10320 - protein, 295 aa, Myxococcus xanthus
MVIAEVIVLTRQLFERSQEVHAGQWRKVATGSHEVRGKTLGIIGYGHIGSQLGVIAEALGMRVLYFDVMTKLPLGNAQPAVTLEELLGASDFVTLHVPALPTTHMMMGAEQIAQMKKGACLINASRGTVVDIDALARALQSQHLGGAAVDVYPEEPESNSDGFVTALQGLPNVVLTPHIGGSTEEAQASIGKEVATSLLKYFKAGASTGAVNFPNIEAPLIPGTHRILNVHRNIPGVLRDINRIVSDLNANIHAQVLSTDANIGYLLMDLDQDVSTPVCEAIAGLETDIKTRILS

SEQ ID NO: 10321 - protein, 73 aa, Myxococcus xanthus
EAFLTSSQERVTGDVRLVLHPRTQVVEGVRSPHSLMDAKVATYGEANVLWNGSEAAGFAKLYGVAQMLSHRAK

SEQ ID NO: 10322 - protein, 353 aa, Myxococcus xanthus
MKVFVDKVGSVTRNLGLGRTVHLASEVKAEEGAVVAVRIHGEKSTYNQLEDVHGRLVTLHAGDIVVGALGHRNALHGYEGVVPASVTVGERLHMLNMGGVIGKCTSHNHGVGLPFEAEVLGQVLEFPELMSRTGQPAHVSSGALKGTSSPVKCPVVYVVGTCMNSGKTFASAAMVRKLAQAGFRVGGAKLTGVSLMRDTLSMQDSGADVVMDFTDAGIVCTGPRTGARVARVLFSELAAENVDVIVAETGDGIMGEYGVQGILADPELKSLAGAWVLCANDPVGASGGVRHLREAYGIEVDVVAGPATDNAVGVRFVEQVVGIPARNARADAAALGGLILEKIAPKLGAGRKS

SEQ ID NO: 10323 - protein, 245 aa, Myxococcus xanthus
  unsure (1)..(245): unsure at all Xaa locations
DTTYRVARLPARLRAFALPDTSTPPEGYVEAGDYLVLEEKARYPTPDTDYSRLVVPQLGVLGMWVCTRWRTQRYATLASRERAPAMARLSFDDERLAVPEERLTTLLGAFLDYRYDGSRAYYPWALPGVRVQLAPPRLNNCCTFVEALLVKAFSEVHGAAFSWDARRHRQMMIASTQDYFSPVTAAVESGMAPAGAVGGRASPPLDTHPGVAQPVGLGAHLPCRGPPPRRRTRCWCWSXTLXSGS

SEQ ID NO: 10324 - protein, 388 aa, Myxococcus xanthus
SGLLVVDLGQVERISSFGVRRWIEFAAKLPQGALGLYVVHAPPVIVDQLNMVEGFAGVARVLSMLAPYTCRACNEDRLRLVNLLDEAQVISEERAPDHSCPVCQEPLEFADLPGEFFDYARRQQFGQVDPVVMRYLRASMPAEQPELSQHLKIIQDDITYITLASALKGDLNVRRLASGLEGRVGFDFSHVSKVEPEALPKLEQVLETAAQGAHVVLCRVPPPALAVLARSAKVLPVRLATLWLPCDCRNCGQVSHQRLQAADYLARLRAQASGVEVPCPICGGNARVPHMPQLQGLLARVQLTDRPLEDLEALETRALSQYLFGATNIDPAARQGASTDISNSLGSTKLNIIRRLGQGGMAEVFLAKQVGVKGFEKFVVMKKILPQF

SEQ ID NO: 10325 - protein, 168 aa, Myxococcus xanthus
EKVLNYIGGELLPARGGGWLDKPEPATAETYAHVPDSDASDVQHAVEAAARAFPAWAATPATERSRMLRRIADGIRSRLDAFARAESIDTGKPLSVASTVDIPRSILNFEFFADAVTQFSSEAHQTDDVALNYTLRAPLGVVGCISPWNLPLYLLTWKIAPALAMGNC

SEQ ID NO: 10326 - protein, 85 aa, Myxococcus xanthus
MKRGILTGFTTGLLMGTAGSACPTCRPDVVATILDEHFWGRLSLTALPFLILVIVLGARFFVAREIPPPVPVKQRARKQGRERSR

SEQ ID NO: 10327 - protein, 41 aa, Myxococcus xanthus
MVTVAIASILLAAALMGIQTPVNRQRENEATRELWAFTLRA

SEQ ID NO: 10328 - protein, 439 aa, Myxococcus xanthus
GNIANVRVVVSWQEQGAQRPAGGGAPDEDGPVKTTLTRHRRRSLHGFTLLEVMIATAIGLIVLGAGLVAAMQMQRRALFEEQTMLAQVTGRTVKELIAADLQRAGSGMGNAPIVFSDTRTHPAIQMWTEPDLSMPDLTRPFPEDPAFSLPPAGHLEEEVSDVLRIHWGDTRGMVTLSPCAGTNVRADTRTFCTVENPSPRLQPTTAPTTPALLVNPARNLACHVEVTNVDAAGRRINVVPGTGIETTTTDRCGDFASEPNFWNTEPDRESWRIMPAQSATYRVNWASGTPTLEYLGPGAANWVVLSRDVERLSVRLGVAAIAQPFGGMRWFPDVANGRPNGLDACTITTCPIEQHPNELVAPATDEELRQRLFQRVREVEVTLVVRTPRQDREAFDPDQPIGVDRERFPIDGFKRRTFTFRVMLRNFAAGGLQPLLTEN

SEQ ID NO: 10329 - protein, 76 aa, Myxococcus xanthus
MTNLALAFLAAGLGAGLSIIGAALGIGKLAAAAMDATGRQPAAGGDIRTTMIIAAALIEGATLFALVVCILLATKA

SEQ ID NO: 10330 - protein, 280 aa, Myxococcus xanthus
WHVPLKAGACAPRMTEHGKEIPAWMDGCLDLSITKHTVMMWLAALLLMATLFIWGNRDKTKLVPRGAGANILEMLVLFVRDELAIKNIGKEEGPRYVPFLLTVFFFILFMNMLGMVPWMATATGNLAVTMALALCTFVITQVAGIRAAGLGGYLKHLTGGVAPWLWPIMVPVEVLGLFTKPFALTMRLFANMLAGHIVYFFLLGLIFLLGHPAVAAVSVPFAFAIFLLELFVAFVQAYVFAMLSALFIGMSVAMGHHHDDHGHDHPEAGPSHDQGKAHHA

SEQ ID NO: 10331 - protein, 1073 aa, Myxococcus xanthus
MPYLPLRCDWTHFAPSQETLAVTYDPPDEGRLVSVQLEVRDYADALVYRSDALDCRGGPAAITWSGALNVGNDAVQEPFATPLRAPYTLRVEAVIEEDAREDLRQPEDLPNTELGSVAPCESRRDESLPEEEARELPLPPPTTARVNVLYHSVEVVRGPWLATGEVFVRGTAASICHKLNQLGYYAGPPARAAATPDLLDKAKERFRRNHGDLRIIPAPTNDDFENALDGALGHAHGARPTLVDDQSNPVPEGTAIPGGNGAPLRVYVEAVGFDEDLANQTDEFMRQIPSNRGNAAIDWSTLHNKTRSEAGKLNRPLVPLEAVIYLKGHDGSRVAAPQAVGAVRVDWSALEPGEDVSHLPLNHDLHLGTRAYVNRVLGSDFVDLAGDGGTNCPVAYGGIRTQDGNFRNPFWREPQSYAPYATPTEDARAKKLWVPAFTDGAAHPNRVGRSGIYLQPSLIAGDRYQVRARLSYAGRGNAMQLEAANPVCQYETKPIVVWRRVEVFGIVSWPLRNHGNLPQKCRDRYAEAYLEVDFSHTQYRRISQVINDTDYSDWFTHIRTHVKPSVASVVGLLDTTHVHDASPVVRLRPDVELSANQKNNIWFFVSDMFNELVSTANVRSAGGFLLSRISDRLRTGDAPCGGIVMLEYKLSDDIVDALETSDAGEVPTTSNGNGDLLGIIDQSVDANPDFVFTHEVGHCFWLTHHEASSGVVPQHHDPLDHNCMMSYPDWEQKRPQFPHNAPDRLDPHFCGKCNLKLRGWDITHDDILALDPAAPVDQLSTLFYYDRADPGLQWNVELGHVSNAFALASRGPFRERFFDRDANFDTWVNQLGDCDIYHHVTHGNVRCSKHAMRLASMDMAYPRYPTWCRNDQSKVEGLAAKEEELCVETGFDPVALTQWAKESLIMPKLGWSLLSPDHTLRSVIQWTVDDNDSSRDVEFTYEAIEQAFKRGKKPPRLLAFFSSCLIGWEHHFARLFINHGTPYVIAFRSRYQTSQALPFSQEFYRILALGKLEPQFIHRAFQTAATGHPHAEPCLFTKDNIVRCVAKTKAGEAEFHDVKWDSKEFYEPRFPAQ

SEQ ID NO: 10332 - protein, 200 aa, Myxococcus xanthus
AWVQFALATPVVLWGGWPFFQRGWTSVRNRHLNMFTLIALGTGAAYGFSVFATFFPGLLPHAFTGHGGHVPLYFEAAAVITTLVLLGQVLELRARHATSGALKALLGLAPKTARLLREDGREEDVALDGVHVGDRLRVRPGEKVPVDGVVLEGESAVDESMVTGEPIPSEKTPGSRVTGGTVNGTGGFVIRAERVGRDTV

SEQ ID NO: 10333 - protein, 166 aa, Myxococcus xanthus
MDSDVAPERLVVDGNYSDERFIDMMAAHHQMATEMAMVEEQRGTRQELRALATKMIQDQRQEIEELKALKQANFGSSDVPTMMSESEMQNSGMLMTAELARQPDVDKAFIDSMMPHHSSAILMASVALRRTSNAEIRALARGIIDAQTKEIGQMIEWRKSWYGSQP

SEQ ID NO: 10334 - protein, 191 aa, Myxococcus xanthus
MSLHRIVVFALVTVLAAPSAALAQDDFLAPLTAPSKPKTGKPKVVKKKPAKKPARAKAPPKGSKKPAAEDDLLLAPLTPVKTEVLVRMTGNVRGAKLFVDGKEFGVLSSATVPVEVRPGEHHLVVRRQGYADFTRRIDVKSGTQAEVLVSMDATMGFAHADGGRGGRGGDGGRAAGGRRAAGQRVAAPGFA

SEQ ID NO: 10335 - protein, 332 aa, Myxococcus xanthus
HLNREFSLLTQAQSIFLDGHFIIEHTARNRAGCFFNFNGTAGIWRRDTISDAGGWQHDTLTEDLDLSYRAQLKGWQFVFLPEVISPAEVPVDMNAFKSQQHRWAKGSIQTAKKLLPTILKSDLPLVVKREAFFHLTNNMAYLLMVLLSVLMPISMVVRFQHGLYGTLFLDLPFFLTATASVCFFYVAAQRERGAKGWERVKYLPFLMSLGIGMAISNAKAVAEALLNQQSGFARTPKTGAEGKKAVTVKKAYRGSKSLLPLVELLFAAYFTGALWFAIDARIYTSVPFIVLFLAGFLYVGSSSLLQGLSGRMKLVESTPAVDAADEQPRRAA

SEQ ID NO: 10336 - protein, 124 aa, Myxococcus xanthus
MWIESIIMPREDDSEPYVPAPQRDRRSGLAAALEESRKLRDRVQRFVSAHDLSDGVRWLSEPGLLPVITIHCTDFALAKLREAADFVVGCAAPIDVYPALVGTQGQVAPEALLTSAVSHLQRRV

SEQ ID NO: 10337 - protein, 217 aa, Myxococcus xanthus
SAPQGRWIGGIVHPANAAEKREGALWLGYLSVPDVDRAVTEVSARGGKALDGPIDVRNIGRAAVVADPQGAAVGFVRSRPGDPADTGVPDEGQFLWMEYLAQDPVAAADFYKELLGYEVRDRPLGGGPHYVLAQGQHPRGGVLANPVKGARPNWLTYVRVKDPATLASRAQALGGRVLMAPRPDARGGSLALIADPSGAVLALQRYPFETSKSATAP

SEQ ID NO: 10338 - protein, 414 aa, Myxococcus xanthus
MFGESFKERVVEAVREQIVSAIEDRLGREVRERVGEAIRHAMFERGGGMPQGYGMMPQGYGMPEPERIADALCSRLSETLRERIASVVHERIRDGIRERLAECVRAALFEQWQMSSHGFGAPDTERLAEAVRTRLLESLRERINTAAHDGVREALRERLADTLRSVMSERMPGFSPHEAERLADAIRGRLAEALHEGLVYSLRERVREALRERLSDGLRGVMTRQWGGMAAGAFDPERIAMTLQDRLSEGLRERINSAVRERVREVLRERMGEMLRGAMARHRGMMGQGGMMPQGMMMGQGMQDVERLADAIRTRLADSLRERFMSSMRSELDSALRSQLPEAVRSALGEAMRAGPSMMPMQQGGGSVDPERIASAVRESVSADVRERVGEMVRERVSEVVRNELSNGVHAPQA

SEQ ID NO: 10339 - protein, 143 aa, Myxococcus xanthus
PLGPEDDVRVGPETFQALHTPGSHYLLAGDALVSGDTVFINGCGRCDMSGGNPEDMYRSLSQVLAKVPDSAKLFPGHDYAGVPMASMETVRRKNPCFAFDNVDAFVAFRMRPRKDWPVPRRRCLAANGASHRRHVYPECVPVY

SEQ ID NO: 10340 - protein, 161 aa, Myxococcus xanthus
STDAGYLDDAKSVAVGPDGGVYLAGETFGSLDGNANNGTVDVLLARYDNAGNRQWSRMLGGAQTDYAFGVSVTTSNVVQLVGYTCDALDGNPPAGSLDAFLTRYDALGTKLGTRTLGTPFQDIARGVAVDSAGNAYVAGNTFGGLGGNTNAGGYDAFLARF

SEQ ID NO: 10341 - protein, 516 aa, Myxococcus xanthus
NLDDLRRLAAAGHDIGGHTLQHSELAVLTPEKQRQEICEDRLRLLSWGFSPTALAFPFGSNDAVVNQTAAACGYNAARDVRGLVDTCGSCPTAETIPPLDPYEIRTPATVTRDDGLKQLQSWVTSAEAAGGGWVVVVFHFVAPDCTKRTYCVKPDVLREFMGWLSQRAPMGTEVRTMQDILGGAARPAVHPVSQPPTATLKNPSLEDDANGDGVPDCWQLGPAHGGAVRAERSAEAHSGAWSYRLERVEASGGAASLQVLRDDGTCAPAVTPGSGSRVSVWYRSSTPLHLEAAVKGADGMWKVWNRGPSLPPAEAWTEASWELPIALPADAFELSVGVALEGVGWALVDDFGLADATAPAARLVLDAPTGGEDFVVGQDVEVRWSTLGEVRTLDVAYSTETSASWVPVATSVENTGHLIWRVPDVPSQEALLRVASAEDETVSGTSAPFRILPGAPQQPGIVEPPPEEQPPEEIRGDGQVNGESGGCGGCEGAGTGQLFLAVAGGLIALSRSRARI

SEQ ID NO: 10342 - protein, 395 aa, Myxococcus xanthus
RAEVEFLSGMARGFKGRAHDVLDGHQRPVSVHVTDVAPGRLLIRGAAEDSKTLRQLLGWLESRPEVQVATCQRSTGLVKVHYQEASRFPGAFALRVRDFAFTLHQLPPKPFQVEVLHALPGRVRLHVRGLEDDDILKLAAWAATLAGVHKASASPAIHSLVVSFDPEMLNASQLMAALRTSDPSTWPAAPEPPRREWAATVFNSAVLAACVVNAAPMPVLAAGVALTSLPLAQRAFQSVAERRITVDLLDLVAVGVSLATGQVRTAALITSLLGIGDLLIERSADRARSAISRLMRLEVLYAWRLRVDGEVEQVRADRLKEGDLIVVHAGESVPADGTVVSGTAWVDEKALTGESEPRVREAGDRVLAASVVGEGSLRVRVVRAGVETTAAKILH

SEQ ID NO: 10343 - protein, 194 aa, Myxococcus xanthus
MRLDPDSGAIEGEWLLLVHHSPGRLRVRASCFRDDSAVADRVRGELGETQGVFGTVHSPLTGSLLVEYSPDAADVESLLAAIVDTAGLDGIVDAKFMAKSRRAPAEHLVRGARWLDGRVRELTGAGLYELIPVVLTATGIYSLVANPSQKGWLPRWDNALYWAYSVFRDGVREQELEDAARVSGTVPFRPRPHV

SEQ ID NO: 10344 - protein, 75 aa, Myxococcus xanthus
MARSTVDNSRGAVVSVATAAFDLVAWTRRVIATEREYLSDLVAEARSRANLHQAHSRRAADSGARPVADSREGHA

SEQ ID NO: 10345 - protein, 308 aa, Myxococcus xanthus
MFTLDTGFVGALVAVPVAGSAMGLDTMLRSLIQARMMCDVASAFGVRIDPDDPWDLLHLNALTAGSETWEDADHGGAGLVGRMLTEDTEAAERKLGNRLMGEGVLRNLLPFASVLTSSVTSWRHTRRLGEASVEYARYRRALDDAFSAVRAVDARCVELLIEGAWCLFGTDGVLSSEATVMLAHLLRNSPSAARKRLLERLGEDEAQWVERLHEVPEPARDAFLHALEVIAAVDLSMSNAEWLLLRQAAAALNRPVRRERVQALLKQFRTHGVVRSPQGDSFEPRDGRMPSSPVAGLGADAHAAPGGL

SEQ ID NO: 10346 - protein, 113 aa, Myxococcus xanthus
SSPRPAVRHLARGHVIAGALGDLRNASILEQKPAVAGFADAASHLCEVWAAVTTNEADAETNPWARAKAAAGAMVTALVAQRGQDEKDPAAKAQARVELTELLRAVRAAITVR

SEQ ID NO: 10347 - protein, 202 aa, Myxococcus xanthus
MKLFYSPGACSLSPHIILREGGFSFTTEKVDIRAKKTAAGEDFHAINPKGYVPALQLDDGSLLTEGPAIVQFLADQVPDKKLAPANGTLERYRLQEMLNFISTEIHKGFSPLFNPAFPDDVKRLTRERLAQRLGVLEVVVAKQAFLLGDQFTVADAYLFTTLNWAGHTKVDLEPFPALRAYHARVADRPSVQEALKAEGLAK

SEQ ID NO: 10348 - protein, 385 aa, Myxococcus xanthus
LNPDIRLALTFDDVLLVPGESSVVPKDVDLTTRLTRNLRLNIPLLSAAMDTVTESRTAIAMAQEGGIGVIHKNMTPEQQALEVLKVKKFESGMVVDPVTIEPEAPLGRALELMRLHGVSGIPVVKGQRLVGIVTSRDVRFETNFTQTVESMMTRKLVTGREGITQEDAQKLLHEHRIEKLLVVNDAFELKGLITIKDIEKRRTHPNAAKDGMGRLLCAAAVGVSADREARVEALIKAGVDVIVVDTAHGHSTAVLDGVRDTRKNFQGFELIAGNVATAEATRALIQAGVDAVKVGIGPGSICTTRVVAGVGVPQVTAVDDCVREAQKHDVPIISDGGIKYSGDIVKALAAGANTVMVGSLFAGTEESPGDVILYQGRSYKSYRGM

SEQ ID NO: 10349 - protein, 690 aa, Myxococcus xanthus
MGLRFLNADAPTRRFLDSLVVTLPHAQSDVPPVPPNVGPPDYTVTPTEQAPVALASELYAPAPVPGSASAEAAAAPPRMISNAALNLSSEDPKRAGVVIGIDLGTTNSCAAYVRNGKPGVLPSREGHNTVPSIIAVNTRGKLVVGHPAKGQMLTNPRQTVYGAKRLVGRPFASPVVEQLKDRFHYEIAASENGDAGVKLGEDVYTLQQISALILREVREVAQNQLGHQVSRAVVTVPAYYNDNQRQAVREAGKLAGLYIERILNEPTSAALAYGFGRKLNQRVLVYDLGGGTFDASVLELNDNVYEVISTGGDTFLGGIDFDSSLVTYLLDEFQKTTGRAFQGDRVALQRINDAAERAKCALSERSEVRVHVAFVTMIDSKPCDLDVMLSRQKLVELTEGLVDRTLQVCEEVLRAKKVTPQDIDEVILVGGQSRFPLVHEKITKFFGKPPSKGVHPDEAVALGAALLAHSLGQLEGVVLIDVLPMAIGVGLPGGRFKAVMERNTSLPSTKSYTLATHRDGQTELELTVFQGDSDKAADNEYLGTLKLEGLPKLPRGAVQVNVTFEVSNESLLKVTAREASSGREVTSTFTTRDTPEAVKARLAQLESEAPPAPGPAAAARSAGHAGATATGPAAPVKVPMATAASASAARPVLVRPASSAPVSSIPSVSVAVAPKQKGFMGWLKGLFGRA

SEQ ID NO: 10350 - protein, 54 aa, Myxococcus xanthus
MDMNPRLTSVVFRLNREKLDALKDLSRTTRIRQSEYLREAISDLLAKYEERLVD

SEQ ID NO: 10351 - protein, 1154 aa, Myxococcus xanthus
STELLDFGLAESAFAEEELPASAAGTDVPASPGPSPKDTRPMPGPRPVDTRLPAAPGVTDAVSSPGPRPTDTRPLSVMLGRDTGPRADEARQDFVPGTPLYLAPELWRGEPASRASDVYALGILLYELCAGHAPHEGVPLEQLGAAIQERPPPPLSERAPGLSPAFAAIVDRCVDADPARRYESGDALREALEALSTPTRASAIPTGNPYLGLRAFDAAHRSVFFGREPELREVLDRLRGDTFVLLAGDSGVGKSSLCRAGILPAVSQSGLEDGGPAWAVISGTPGRRPLETWVELLAPVVGESADALRARLTTEEPGVLARALRRRPTNAPPLLLFIDQLEELVTFSESTQAARLAEELALVLRRAPRFRLLTTARSDCLTRMVALPGLGDELPRALHLLRALSEHGLREAVAGPVRVLGMRFESPAMVDALVASAARAEGGLPLLQFALEALWEARDSQRQLIPAAALEALGGVEGALARHADAVVVRLRPEQRPRARAMLLELVTPEGTRLRRTQEELLRGPDDDAGRAVLDGLVRGRLLTAGEAEDGDGVYTLAHESLVTGWDTLRGWLGQDEQRRAVRMRLERAAAEWERLGHPPELLYGERQLTESRAAGLSHVEKPRERDFLSRSRRAVRRRRVTRWLAVALVPLVLGGVVGVTRVQARAQLDARINRHLDEAKVQQVALDMRRAELDQLSAEAFTLFDTPGPQNREAAEAVWSRAQQTRQAVEETALRAMSELEAAWGLAPGNPRVSPLMANLLVTRVEFAEQERQPEQRAQWLARLGAHDPMGELRRGLTAPARLTLTSEPAGARVRLLEPTPEGEPVPGRDLGQTPLHEVALPAGSHLLVMEAPGRFPVRVPVLLASGERLALDVPLPAAGLVPEGFVHIPAGRFLQGASESEYLRRAFFFAPPLHRVDTGAYLIARHEVTFAQYIAFLETLPPEERAARMPGSRRRLTVVDLAHEPDGRWRLTLRPASASYSVRDGERLRYGKRDRRQEQDWLRFPVSAVSFDDALAYVAWLGRTGQVPGARMCTEREWERAARGADGRRYPAGDWLAPDDANHDATYGREPWGFGPDEVGSHPRSRSPFGVDDMVGNVWEWTRSDVAPEKPSAQGGSWYQSDLTAHSANRDRVERTQREALIGFRVCATPRP

SEQ ID NO: 10352 - protein, 1269 aa, Myxococcus xanthus
SMMDRGGALDGQLEYSLELFTPDTARRMVEHLRVLLAAVADGAGAQRLSELPLMDAGERQQVLSTWNATQAAYPVDATVPSLFAAQALKTPHAVAVEHDGRTLTYAELDTRSNQLAHHLNALGLGAEARVGVFLHRGLDLLVGLLGILKAGCAYVPLDPEYPAQRLAFMAEDSGVAAILTEAALEDELPAGAQVVIVLDDEWTWIERQPSTPVTGGIVGPDQLAYITYTSGSTGTPKGVAIPHRGVVRLLIGSRFVDLGPSEVVLQLAPLAFDASTLEIWGALLHGARLVLYPQRTLDLAELGQALERHHVSVLWLTAALFDQMQQHQPEALRKVRQLLAGGDVLPAPRVRERLAQGVGLVNGYGPTESTTFTACHRMAAGDAVGDSVSIGRPIANTQVYVLDPAMRAAPVGVPGEVFIGGDGLARGYLGQPALTAERFVPNPFGPPGARLYRSGDRARWLADGTLQFLGRVDFQVKLRGFRIELGEIETALRSHSEVETAIALVREDSPGDRRLVAYVTPEDVDTASLREHLRQRLPEYMVPNAVVVLSTLPLSPNGKVDRKALPAPDLSPAEDTQTAALPLLQQQLATLFREVLRVERVRPQDDFFELGGHSLLATQLVTRVRAELGVEVPLRTLFEAPTLAGLAERIEALMMQASRASMPPLEPVPRNAALPLSFAQQRLWFLSQFQKGHAVYNVPFALKLFGPLDMDALRRTFAEVVSRHEVLRTSFPVTEGLPRQQVNPAPAVWDLPVEDLSAMVGPARDARVRQRMIAEAHFPFDLSTGPLFRSVLLRLDADAYVLLLCVHHIVSDGWSLGVLVREVSALYAAFSEGKPSPLPPLAVQYADFAAWQRQWVLHDGIQTQLTELRSHLQGVPALELIGDLSRPAVRTVRGSSQFFTVSPELVQSLEKVARDQGATLFMVLLAAYEVLVSRYSGQQDFCVGSPIAHRTQSELEPLIGFFVNTLALRARLEGAPTFAELVSRVREEALAAYVRQDVPFDRLVEAMGVERGGGKSPLIQVMFALQNSPMQLPALAGMRVEPLRSATETARLDLTLSMMDLGDGALEGALEYSTDLFTPEAAKRLIRHFQTLLEAIVRDPEMRIQSLPMLPEDEQHQVLKGFQGREMAPASEASIHALVEAQVARTPDAVAVAFESERLTYRELDARANQVAHHLRGLGVAPESLVGVCLERSVDMVVALLGVLKAGAAYVPVDPAYPKERLGWMLEDTGASVLLTHEKWKSVLPPSAARVVCLDSAAGEVAKQPVTKP

SEQ ID NO: 10353 - protein, 646 aa, Myxococcus xanthus
AQPSGVRIEVSADQHGAVLEDVPSTKAQTISVVARNAVGDSPAATAGEPVKSQPTPVEVTRLDTPSAVRGCQPVTYTLRQVDGERADVLVEFDATGSGAFTRATQAADSYYERASGLVSLSTSTQGTEHTFRWNRPTDLPGTAPEARLRITATVPGTASATRTHTVALTAPERRCEVNLDTGPVQRVTQEVAGMSHGLALGDFNQDGKLDLAARHDNSPGVTFLRGIGNGAFEAENTPHLSVTAEHLVSADLDRDGVLDLIAAEANYCRCVSFLRGQGNGAFEQPVINYVLDAVSHSSTYDITPPAVLDIDGDGAPEVVVSQRDSLLVLRHTGGGRLAVAFREPFAPRGSVVTGDFDQDGLVDLMVVGPSLHGFYGRGLLTFTKEFLGTLDGPVPHAVTTDFNGDGHLDIVALVVGNRESSIHLLTGDGHGRFTAPVRLHQHTWHSFGNRSHLIAGDLDGNGTQDLAYVHADSDTLTLLQGRGDGTFESRTLATGMNPSYLVAADFNGSGKTDLAVLSGMHNTVHVIWDLELPTRPDIGWLFATGDFDGDGHTDVASLVDGGVQAHLTRTGGGFEHRGPAPVPPGIWKLLADRFDSGPTMDLLAMSATSTPPNRSLVLLRGNGDGTFAAAEELSLEGVTSGALSSL

SEQ ID NO: 10354 - protein, 139 aa, Myxococcus xanthus
HAAFQHIFTLPFGSDTVTDFAFREPPPLTLTKVSDSGSLRRQLGWGALALGVASAGAGMWATLEARDIRSSVSPELPQQEAAAHNRRIRTYNTASGVLYGVGGAAVLNGALLFLWPDSDTVPLATLSSDGAALGLTGAF

SEQ ID NO: 10355 - protein, 418 aa, Myxococcus xanthus
LGLIQFSSGSTVDPKPVTLTHEALLAQVAALEMAMPLGAGVPRVGVSWLPLYHDMGLIGCLLSALYYPGSLVLIPPEAFLARPALWLRALSRHRGYISPAPNFAYGLCLKRVKDAELDGVDLSSWRHALNGAEPVSVDTLRRFSVRFERWGFSARALRPVYGLSEASLAVTFPPEGRGPRALGVDAGLLAREGRVAEGSRELVSVGMPVAGFEVEVRGETGEALAERCVGRVFARGPSLMAGYFADAQATDRTLTRDGWLDTGDLGFIAEGELFLTGRAKDVVIIRGANHAPQAFEEPLHSVAGVRAGCAVALGFTPEGGEDEALLILAERSGQEADDVVEERIRAAVVETTGVRPHTVRMLVPGTLPRTSSGKLRRAEALRRYLAEELAPPKKVGAVGLAVEMARSALAMVRAESDT

SEQ ID NO: 10356 - protein, 314 aa, Myxococcus xanthus
MAVLERLGVLPLLDDQGSHPFVGIRYVQEDGSTAEGKFPGKGALGVRRVALATALVSRARTVGVELRERTQVLSHQRDGNGVVLHTAEGPVEAAMLVAADGLASPLRRAEGLEVEPTGPRRFGLRRHFQVAPWTPYVEIHFAHGVEAYVTPTGVRRVGLAFLWEDGVVEGRVSFETLLACFPKLSERLSGSEPDSQPRGAGPLARVARARIADRFALVGDAAGYVDAITGEGLSLAFVCAESLGNLLPEALVHGATREALMPYEQCFQRVFRKYSRSTGALLMLARRPWLRRPVVRLLGKTPWLFERILHAVVT

SEQ ID NO: 10357 - protein, 30 aa, Myxococcus xanthus
LTDPIYSDRPSPVPFIGPRRVRPPGILSRA

SEQ ID NO: 10358 - protein, 378 aa, Myxococcus xanthus
MEATALAGYGAGLRSRIMESRVAALFAHVREHAENRPGVYRMLGPSDEVLYVGKSVRVRTRLLSYFRAEAHEKAAEIIAHAHRIVWEYTPSEFAALLHEFRLIKSQRPLYNVEHKRDRGHCFIHLTREPVPRLRVVSRASSERGDYYGPFHGRSAMSDVVRAVSDLLELRDCAADTPMRLADQGQLFPLKQEPLCMRGQLSRCLAPCAGGCTRAEYDARVAQARAFLEGTSDTPLTLLRERMALAARRLLFEYAAELRDRAERLELMRGWVVELSQMLKRLSFVYTVPGHGGDDRVYVVRRGSVRAELPAPVTLEQQQALEAKAREILEQPEPETLGFRAHEAQEVMLIARWFRLHPVELNEGPYQPVGPFCFTRASR

SEQ ID NO: 10359 - protein, 182 aa, Myxococcus xanthus
MVPSAFERKLYRIRKLTENLIQARGVDPKGRFHVASLSSETLVYKGLMLPVDLPRFYSDLQQPDFVSALGLVHSRFSTNTFPTWELAQPFRFIAHNGEINTMRGNRNWMTARRGLLQTARLGGSLEALQPIIVPGKSDSAQFDNMVELLYLGGRTLPHALMMMIPEAWEGDALMSDKRPRLL

SEQ ID NO: 10360 - protein, 962 aa, Myxococcus xanthus
MLLVDTTEGRILEDEDVKRDITTRWPYRRWLQRNVYTFDNLPSVAAPVRLRGEELWRAQRAFGYTAEDVRSVLTPMAETGKEPVGSMGTDTPLAVLSDHAPSLFSYFHQLFAQVTNPPIDPLRESLVMTLATALGPESNTFEETPEQCHRLSLPGPILTNGQLARLAAINDEGLFETRRLSLLYALDGGEGALEAAVEKLCNEAVDAVDAGASILLLSDRGVDAAHAAIPALLAMSAVHQRLVRDGIRMYTGLLLETAEAREVHHFACLFAYGAAAVNPYLALDTLRALADSGELAVDAEKAQDRFIRAVEEGLLKVMSKMGISTLQSYRGAQLFEAVGLQRSLVERHFTDTASRVEGVGLPELGREVAERHARGFGAEADAEAGMLPVGGQYRWRRLGERHKWNPATIAKLQAAVRANDAATFAEYSRLADDETREHSNLRGLLEIAHEGRTPVPLDEVEPALSIARRFVTGAMSFGSISAEAHETLAIAMNRLGGRSNSGEGGEESRRYTRDENGDLRRSAIKQVASARFGVTTEYLVNADELQIKVAQGAKPGEGGQLPGHKVDERIARVRWSTPGVTLISPPPHHDIYSIEDLAQLIYDLQSVNPAARVSVKLVSEVGVGTIAAGVAKAGASCVVISGYEGGTGASPLSSIQHAGLPWELGLAETQQVLVHNGLRSRIRVQADGGMRTARDVLVATLLGAEEFGMATASLVAVGCIMLRKCHLNTCSAGIATQDAGLRERFQGKPEDVVNFFLLIAEDLRQRMAALGARSLQELVGRVDLLRQPPGGGPLEGEARGPVRAAGRTGRAGQRAAPLHRAAHQGRVRPPGPRAAARRQRGAGRRTAHAAQRAGGQHPPRRGRPAVGGDCPASRGPGVAGWPAPRADEGLRGPELRRLRGEGRDVGAGRRRQRLRGQGPVRWTHHRLPAAGQPLHRRGQRAGGQHRALRRHGRRGLPAGARG

SEQ ID NO: 10361 - protein, 413 aa, Myxococcus xanthus
KGSAGQSFGAFVVKGVTLELEGDANDYVGKGLSGGRIIVYPPQASRFTAEDNVLVGNTALYGATAGEVYLRGLAGERFAVRNSGAQAVVEGVGDHGCEYMTGGAVVVLGPTGRNFAAGMSGGIAYVLDREQSFRQRCNLEMVDLESLVDESEIWLVHGMVERHLHHTGSALAAAGAGQLGADGAALRESDAHGLQAGPSNTARGAQTTGAHIRGAAPVPRRGGPEPWVSQLDSSSGSASTRTSRDKAGPGWGDWREFALPLAPDEAKRQAGRCMDCGVPFCHQGCPLGNLIPDFNEAVYRGRWREAYDLLSRTNGFPEMTGRLCPAPCEAACVLAIDRDPVTIEQMEKEIVERAFTEGWVKPRPPARRTGKTVGVVGSGPAGLATAAQLNAAGHTVTVYERDARAGDLLRELR

SEQ ID NO: 10362 - protein, 162 aa, Myxococcus xanthus
MPYTPIIGTLGYVMSPDGHRVLLVHRNARPDDAHYGKFNGLGGKMERDEDVAACMRREIREEAGIECTQMVLRGTISWPGFGKHGEDWLGFVFRIDRFEGTPLERNPEGSLSWVPVADIQGLNLWDGDRHFLPLVFDADPRPFHGVMPYSGGRALSWSFSRL

SEQ ID NO: 10363 - protein, 102 aa, Myxococcus xanthus
MKVYLDDERATPDGWVRVRWPEEAISLLASGQVTELSLDHDLGDDTHGTGYDVLLWLEEAVATRGFVPPRVVQVHSANSSARQKMTLAIARIERFVQDGQGG

SEQ ID NO: 10364 - protein, 38 aa, Myxococcus xanthus
  unsure (1)..(38): unsure at all Xaa locations
ALRPGKKEAERAQRNAETLIXXXRAYQARHGQLPDTLV

SEQ ID NO: 10365 - protein, 77 aa, Myxococcus xanthus
MQGRVASVGKDHVVVRDAESGDTFNLFVTNTTRISANGKRVSPQQLSEGTPVQAAFNYIADGDTYATQIRAYPGRRR

SEQ ID NO: 10366 - protein, 419 aa, Myxococcus xanthus
MLVGIASGAVAGLVANVVAGGAPWLAFVVDNVASPVGQIFIRLLLMLVVPLLFSAIVVAVAELDLKQVGRLGARTLGYTVVLSSISVLIGLVLVNTLEPGAGLSDEARALAQGGMTIQAAAAPGASSFGAVLVSMVPTNPIKAAADGDFIGLIVFSLIFGMGVALTPSEPVQRLRESIQGLYDVMMKLIDGVLSLAPFGVAALLFAMTARLGFGIFVQLASYMGTVLLALGLHMFVVYSLSVRFLGGRSPIEFFRSSRLAIVTAFSTSSSSATLPTALKVAEEHLKLPRSVSRFVLTAGSAMNQNGTALFEGVTVLFLAQVYGVPLSLSDQALIMFICILAGIGTAGVPAGSIPVIAMILGMFKIPVEGLGLILGVDRFLDMCRTTLNVTGDLAAAVYVARGESADSPAEEGAVDPSAS

SEQ ID NO: 10367 - protein, 264 aa, Myxococcus xanthus
  unsure (1)..(264): unsure at all Xaa locations
MKGDEATPGLEAGVPYWSTPGHRVTYASGKPAGKTVRLHLRPSGGEQSFTWRDGAIENGFIGSPDDLLNFEATVYVRVHEDNGTHHSMSWKMRGGQHTKPEVARSSCVGMDVPFGGVSPQAYRELDHPTYDHLSLTPYFDYQLQEGRWLGVKVVSYLVEGGTRNLLFLDTNXFHGYRPPRKQFHLLTELHHRDSYSTAHYNRAAIVGTLAHDVPRGWLAAGRLRLPLGTRDXXXYSVRAPAFPALAVAGMVAPPDRDRNTSGRR

SEQ ID NO: 10368 - protein, 180 aa, Myxococcus xanthus
MRLPVPLLAASVLFALPARADITLFPERETWLSVGPLYSAAFGADAPGTGVGGELTLNWFKGVGALGLFAQAQKMERGSARLCAGLQGTLLFGGVELGVMHETASRTRVATTGLHVAPYLAFVFGSLGVRFGIPLAGDRDIGPGGVERTRHAREVGLVLTLKLPIALSSHSVWGPLFPWN

SEQ ID NO: 10369 - protein, 161 aa, Myxococcus xanthus
MRVAKDSVVSLEYRLHLGDGQVIDQSAPEQPLSYLHGHRQIVPGLEGALEGMSFGESKQVVVAPGQGYGEHDPAGVRTVPRSMLPPGFSPQAGQSLMAQTDQGDIPLRIQEVRDDGVVVDLNHPLAGKTLHFDVTVKGVRAATQEELSHGHVHGPGGHAHG

SEQ ID NO: 10370 - protein, 574 aa, Myxococcus xanthus
MVIGAVMCLSNLYVILKTGWSLGVTITACILAFAVFGTLRSIRVLKTEFTDLENNAMGSVASAAGYMTGGGNMAAVPALLMLTGTLPSSGWLMVWFAVISALGVFAAIPIKRQLINVEALPFPTGTATAETIRALHGHGEVARRKSRLLGIAGGIGALVVALRDARFTWLANIPEKVSLPFTMLGKKASAWSLSFEFSLLLVGAGALVSFRTGWSMLLGAVLTYGFLAPAMVSQGAIGEVTYRAINSWMVWTGSAVLVSSGLLSFAFQWRSVARSFKSLSGLFKGKNAKEEDADPLAGIECPPAWFPLGFAILGPVAVFLMAYLFQIPWWAGVLAMPLAVVMGVIASRVTGETDTTPTKALGPVTQLIFGGLAPGNIPANVMSANATGGVGLHSADLLTDLKSGWLLGANPRQQFVAQLFGVVAGAAVVVPVFKILVPDASMLGTEEFPAPASMVWAGVSKLLATGVAALPGSARMGALCGAALGIFLVLLERWAPAKAKAYVPSPAGFGLAIVIPGSSSIAFFLGSAIAELLRRTKPKLAEDMVLPVSSGFIAGESLLGIGIAMAKAFGVMPK

SEQ ID NO: 10371 - protein, 92 aa, Myxococcus xanthus
YPTDVRVDFHQDRDEKLALRTGELVHPSISSVLFLNRVRGGALVVTPELPDPANPCLAATRLDTSDLVTPQPNRLVVFDGTLTHSVLDADNQ

SEQ ID NO: 10372 - protein, 208 aa, Myxococcus xanthus
MVLPTATGVLRWLQVSAEVPFIVTQGGTRFRDFNAPEGSGMGTPWLGLRAALKRQDFGFQMAADVSPALPVGSTALLARDDYTVHPRLQVGFLAETWQVGGEAGVLVRKKHELSSVSGFSQDVIGSELRLGATVTSRAGESTRGEVSLVAGLPLQGGRPGGELLLAIRKHALSWLDLYVLGGPGVGAGMDTPTFRFVAGASFSTFRVD

SEQ ID NO: 10373 - protein, 93 aa, Myxococcus xanthus
MVYLQITLQISPANRPAAADVYKRYKAPFLEKVVGAKSKELLVRDEDVQVLHGFDTAQQANAYLKSDLFTADVVSALKPLLDAAPEVRIYQAA

SEQ ID NO: 10374 - protein, 94 aa, Myxococcus xanthus
PPEERQAVLEAASGARETLPKDAHIHALFEAQVARTPDALAVVAGAESVTYRELDARANALALRLRAAGVGLEQPVAVCVERSVELLVALLGVL

SEQ ID NO: 10375 - protein, 99 aa, Myxococcus xanthus
MELSSPEGRWGLGLVLGLLVIGFWPLLLLAVLDVSGTPRKVLVALGPASICLGFALLILVCGYRYGESLRWSRAQTWGLAALFLGMGLAGGAGLWFSEG

SEQ ID NO: 10376 - protein, 211 aa, Myxococcus xanthus
MNMLGDLRYVNPGEMASFADQSPEQDSAGSPPGLNGHRVAYSLQGRYGQWLRKHAAVVRINDTLFVHGGVAPGVPGGNLAELNRWVRQDFFPDHPPGGARDAQGPLWFRGYALGEPRDAEPALDAVLKRYGARRMVMGHTTNRDGKVKVRFNGKALLIDTGLSTGYGRNLAALELRGGKVNALYREGPVTLDSVEPSAAPARPAGPKPRKK

SEQ ID NO: 10377 - protein, 113 aa, Myxococcus xanthus
MSALPSCPKCNSAYTYEDGSLYVCPECAHEWSTVAAAAPGEEKREVRDAYGNLLQDGDSVTVIKDLKVKGSSTVVKVGTKVRSIRLVDGDHDIDCKIDGIGAMGLKSEFVKKA

SEQ ID NO: 10378 - protein, 388 aa, Myxococcus xanthus
MSLGLPGIFLAGLLTFLSPCVLPLVPLYLSFLAGVSLSQLREAGSGVRRPWGVALAFSLGLGSVFVALGMAATAMGGLLAEHRSGLLQFGGLALFLLGLKQLGFIQIPWMDGEVRPLLGRVRRGGSLLGAFLFGAAFALGWTPCIGPVLGGVLTYTASSTSEPLMGALYLGTYAAGLSVPLLLVAAAAPLALRWMERAKRHLRKFEVATGVLLAGLGVLLFTDSLELLVPSAEGGEASAPVMERRASSSPAASETACTSEEGGDGTCALPEEGGVPSFIGPSALARVERPTMVEFVSQSCPVCQRMEPTVALAEQHCSGKGVEVLRLDVGTAAGRRAAVQYGVRGVPTFLFLDAAGQEVARRVGEQSLTSLWQGLEVIAGGRCAGLLP

SEQ ID NO: 10379 - protein, 52 aa, Myxococcus xanthus
MAHDDLAAGRLVRLFPEVEFPSRLAYYVVYRPECATLAKLVAFREWLVREAS

SEQ ID NO: 10380 - protein, 147 aa, Myxococcus xanthus
ACGFCMTGTMGLKRNLTPSEIVAQVHAVNREVRKNEGHETLRPLSNLVFMGMGEPLHNFENLKTALSILQSEDGPNFSHRHITVSTVGLVPMIERFGKETDVKLAISLNASTDEQRSKTMPVNRKWNIAALLDACRKFPLRQGRRIT

SEQ ID NO: 10381 - protein, 145 aa, Myxococcus xanthus
MAIERTLSIIKPDGLEKGVIGKIISRFEEKGLKPVAIRLQHLSQAQAEGFYAVHKARPFFKDLVQFMISGPVVLMVLEGENAVLANRDIMGATNPAQAAEGTIRKDFATSIDKNTVHGSDSLENAKIEIAYFFRETEIHSYPYQK

SEQ ID NO: 10382 - protein, 216 aa, Myxococcus xanthus
MEAADAGVALIIVITEGIPVNDMVRAKRYLQGKPGIRLVGPNCPGVITPGALCKIGIMPGHIHKPGRIGVVSRSGTLTYEAVHQLTQLGLGQSTAVGIGGDPVNGTDFVDVLKLFNADPDTDAVIMIGEIGGDAEERGAEYVAREFTKPIAGFIAGQSAPPGKRMGHAGAIISGGKGTATEKIKAMEAAGILMAASPAELGTTLQEALKRGAPKKR

SEQ ID NO: 10383 - protein, 386 aa, Myxococcus xanthus
MKIHEYQGKEIFRKYGVPTPKGILAVSANDAEAAAKELGTSVVVVKAQIHAGGRGKGGGVKLAKSPAEAKELAKQMLGMKLKTIQTGPEGQTVHKVYIEEGLAIGQELYLGVTLDRATSRITFMASREGGVEIEEVAEKHPEKILRESVDPAVGFQDFQGRKLAFGLGLTGPTVNKFTQFCSALYRMFMDTDASLVEINPLVILKDGGVVALDAKVTFDENALYRHKDLLEYRDLAEEEPREIQAKEWDLAYIALDGNIGCMVNGAGLAMATMDTIKLVGGSPANFLDVGGGANKEKVTAAFKLILADPAVKAVLVNIFGGIMKCDVIAEGIIAAAKEVQLKVPLVVRLEGTNVEKGKELLSNSGLAITPADNLRQAAEKAVAAVK

SEQ ID NO: 10384 - protein, 189 aa, Myxococcus xanthus
MNINGRVRMACSALIDKLEQPITLEPMSKFPVVRDLTVNRDRMFDALKRIKGWVPIDGTHNLGPGPRQAPVDQSVMYVLSTCITCGSCLEACPQVTQENDFVGAAAISQARLFNMNPTGKMNSEERVRSLMGPGGIQDCGKAQNCVKVCPKEIPLVTSIAVMNREVTKLTIKDIFFQDEAPKGHGSGPG

SEQ ID NO: 10385 - protein, 626 aa, Myxococcus xanthus
MMAPAARFTVVGGGLAGLMTTIKLAEAGHQVDVLSLVPVKRSHSVCAQGGINGAVNTKGEGDHPDIHVKDTLRGGDFLAEQVSVKGMCHAAPGIIYLLDRMGVTFNRTPEGLLDFRRFGGTLHHRTAFAGATTGQQLLYALDEQVRRYEAEGKVTKYEYWEWLGTVKDDSGRCIGSVAVDLRTMEIRTFPAEAVCLATGGPGIVFGRSTNSIINTGTAAGRAYMEGAHYANGEFIQVHPTSIPGEDKLRLMSESVRGEGGRVWVPRKKGDTRAPQQIPEAERWYFLEEKYPKYKNLVPRDVATREIFMVCRELGMGINGRDGVYLDVTHIPAPVLDAKIKGVMEIYEKFVGDDPRKVPMVIFPGMHYSMGGLYVNFEADPKTQTPAEGSPKNQSTTIPGLYAAGEADYAFHGANRLGANSLLSCIYSGMIGGPAMVSFAKSQGTSAAAMPEKHFQAARQYWQDRFATMLKMSGTENPYGLAKELGDTMTENCTVVRYNDRLKKTIEKIRELKERWKNVNVLDTGNVANRALSYTNQLWNMFELGEVIATSALLRDESRGAHYKPDFSLPEPKTKDPTQDPEWMSLWRARHEKWAKTTVATYSEAGPKIHYEDIPTPVLDPEPRWYA

SEQ ID NO: 10386 - protein, 103 aa, Myxococcus xanthus
TLYTAHRVRFPVEKVRASLVYLNEGKEQDVAVDPEAMASFHRHFEQSVAKMRSLLKDAATNTPLDASAFPPTESLTSCARCVFRRPCGREGAAPEAPQPQQVV

SEQ ID NO: 10387 - protein, 484 aa, Myxococcus xanthus
MAAEASSDVSPEIVSAMRRDLGLTEQQVHQRLSFEAKAPGLEQTMREQLGDAFGGAWLDAEGGQLIVGVTDEARLAKTRVAGVRTVHVARSLARLEQVKAELDQNVQALSPAIHSWYVDLPTNSVVVYVDASSQTKLRADAFIAQSSGLKDGSLRVVASTHAPEPAYDLRGGDPYYFSNYRCSVGFPVNGGFVTAGHCGGAGTPTTGHNGVALGTIRGSVWPGSDYGWVATHGSWTPQPWVNNYSGGNVTVAGSQEAPVNASICRSGYTTGWRCGVLQAKNITVNYSVGPVYGLHKTNACADGGDSGGSVISGNQAQGVTSGVAGTCANGNPPQTFYQPVNPILGAYGLTLRTTGGGGSGRSFVSRLNGKCIDVPNSNFSDGVQLQMWDCNGTNAQRWTFINGTVQAGGKCMDVAWASTANGAAIQLANCSGNPAQQFVLSGAGDLVSVLANKCVDIVNHNTSSGARLIIYECTGNPNQKWDYR

SEQ ID NO: 10388 - protein, 497 aa, Myxococcus xanthus
MTKRVVISALCGVLLVLSTGCGDECVDVFDCRSDKGPPPAGKDWTCRSGNCELRDVQRPPEGDAGTEEDAGTEGDAGTEQDAGTEEDAGTDAGTADGGGVVVIGTGAKGDACTSSADCAAGLRCEGTTEAMTCQALHVAFTAMDDTDEMAAVVTRFDAPEPTRLSDAEENSLYPRWNPAGNRIAFVQGATETGTSTGNLAGELVARDVPLVAGAPTMLANGTTGSTEGFLYLEWEPGDSLLYVRRAGDSISGISRVPAEGGTVEQVTALGSSPAWRNGNTFAFSTATVGISTATVGGAPTPLAIAGTTAEQPHYNRVNDQLLFLRPDDTRPVGLNAALYIVPVRGAAVQTIAEFTTAAVEGGSVDSYIANPTWAPDGSWVAYVRAYFFNPTTGEPELCGAGDSPCAGDPGNIIFLRRINPADGTPVGDEVSFAEGATLPSFSPDGHYVAYIQTGQLYVQQIDPAAGAKVGDPIVHPLGGYTLQTSRGDDHRPRWQPR

SEQ ID NO: 10389 - protein, 83 aa, Myxococcus xanthus
MRRSLVPGFLLFTACATAPAHRLDEGSGGTAAEEPQSLAAPVRLETRSGSFLVHPNNAADFEKLLAGEPTRQRYSAGILMAGD

SEQ ID NO: 10390 - protein, 128 aa, Myxococcus xanthus
TLTPEALFSQWEGFQVLDVRERSEFERGHILSARHAYVTELEECLSELGLREDHPVAVVCSTGHRSGLATSILLRNGFQQVSNVLGGMSAWRRLELPVRTGPPSEVEFEQATRSMGTEEQDASPPSPS

SEQ ID NO: 10391 - protein, 251 aa, Myxococcus xanthus
VTMGTGCGDECVDQFDCRTDKGTPAAGKQWTCNSGTCEQRDITQGPDAGTEEDAGTEPDAGEGDAGTDPEGCTSNATCGLTETCNTTTSTCEDSGFVTPVATTSTQIQAVRDAADGALDPALAIEGAFVTFIKPAVTGSSELPGFFVQAEAQGPALFVSDATALAAVAVGDRVSFSVSSKATDGGLRSASAVTGTTVISQGHPVQTQSTATPAGLAVNRSADTSDTLVTGLDSVESELTYLTGTIAAAGSF

SEQ ID NO: 10392 - protein, 239 aa, Myxococcus xanthus
NDIAVLVNLRARRGSEGMGGLVQRFLPRARVALTRSLDEARAWISDTLRPNPPSLLLAGGGDGTITGLLNELRTAGVALPAIGVLPMGTGNAWARVTGAPRPAEALKQIAAVGERLPPLRPFALVRVEGKVAPFAGTGWDAEMIQDFKNQLAASGPLRSTQAGLRGYLGAMFTRTVPRHLFGEGNPSVSVYNLGDPALTVDARGSVQPVPHGDKGALLYRGPTGVSGAAPTPQWGFGFK

SEQ ID NO: 10393 - protein, 91 aa, Myxococcus xanthus
MHGLLPRTFERTMNGVTEAHHFEKERQGHTSGTLFRPMAEGTGTSGGHHAAGKQWLRRLLVAGGVAAAAFSLGKKREARGLKARFAHALGV

SEQ ID NO: 10394 - protein, 247 aa, Myxococcus xanthus
KSAKWAALPLLLLAACATTGRQGAADDSPPRLMSWSEQISEREAWLEKRHGMLLDMMRRHGVGMWVVVNEEFHDDPLTQFIAPPRPYAGNRDIFVFVDAGPEGLKRVALSGYSEATLARFFELPEEGRKPQEVLADLNTRYQPRTIALGIGGKRGVTRSLTKDSYAFLVDSLGAEAEARFVSAAPLIEEYLDTRIPEEWLHYQRLVMLTEAVVKEAFSPEVVVPGKTTVGDVRRFLYDRLWALGVDT

SEQ ID NO: 10395 - protein, 956 aa, Myxococcus xanthus
MQLELLGFHVMGDPRVLAHEQEDAPETWMASDAPTTRDTAEVPRRPYWRWAPFAVGAVAAAIVLVLVVKSAGVRGSQQEVWLAQTSSRLIEARVAYARADGHRPYEPLRAGVSGPPGGAGSALPLRALADLEDQGDLHGIAAAYLVRKDLRQASDFLHRMSPSPDRDSDLAIVALEQGHPEQALALLDGVLRQAPEHAQAQWNRALVLREMGLTLLAAEAFDAVVKRGEPGWSEEARIRARALRQQTQARGRAWKGARAAVRDLMVDAQARLPLEEAKRFPGIVRLAFYDAVRAAPSREWTLRLLPLADVLDGVQGGEVLRGYVLRVAERDFSRRAPLAADYAKLVRGELSSPARFLETLRRSGEDDLYLGGLINQTAGARHLEDFTRLARAAEDPWLSLLAERELAGAEERAGEWWKAEARLRAAVGACQGKGLSYRCATLKKRLSDLYLALNRPAEAFEQAWSGWLASREQEEWELEQQFLQELAHIARYRLDVTSARAYLRESLARTPDACEQRTYVHRNLAYLSWLEFDAHEARNELELAQECGRPLGLPGALLLSYLARFGADSQDADLLRRTLAELHRGQPSPGKLAQMRFAEGQFVLERDRVAGLELLRGAIQLAESLPNDVDARKTRMGAYNVLAHEAGRTDAPGEALALMGAALQVEVPARCVLGVAVDYERSVVALRGATGELQGHFDASRAEPLGRDASGLVPPSLQAALKGCERVDVLALPPVHGLRGLLPAELAWSYRVGRPGGASPVPARGSGPHLVVNGVEAPAALGLPRLLPLEPPLAPDPQRIELSGMQATPTRVLAAMAQASEVEIHAHGAFSPEMSDASLVVLAPEPDGRYALSAPQVRALKLERAPLVLLATCSAARATPFLHESFSLPVAFIEAGAATVLASTVEIPDSAGRFFEAVRERIRSGAPAALALRDARRTWLAAHPSSDWVHGILLFE

SEQ ID NO: 10396 - protein, 116 aa, Myxococcus xanthus
MTNHFLDQCRKRRSELLEQDRPELRLVREGVAAPEPEAMEVWEHISAKDFKAAIAQLSNPRVREAYSLHASGLRYRAIALRMGVPEGTVGSWLYQARKELKALLLPLTGSDGGGSA

SEQ ID NO: 10397 - protein, 383 aa, Myxococcus xanthus
CAVLISAALFIRNTALESSALVTRGMANVIMVAGFEAFRDTEGLPDPSALNAFLAAHREGGLRYVAVVDDDQVLASAGEVKLGRLLLHEGSPLVVEGARARLVSRLRRPRPAFGPLTQEEVRAMSAQGDSLEPRKHLRIVYEFEPLTALALESRSQRLLGVAVASCVGILVLAFAFSRSLAQREALSEELERGRRLAALGTMSAVLAHELRNPLASLKGHAQLLAERVERDAVLAPKADRVVSEAVRLEQLMNDLLGFVASGELRRVEADPNDVLRAAVESTGAARVEARYLPDRTPWPLDAGRLQQALENVLRNAVQASPEGQRVEATVERQDSSLVFTVKDHGPGIAAGEEERIFEPFITGRMRGVGLGLAITRRILRARE

SEQ ID NO: 10398 - protein, 201 aa, Myxococcus xanthus
GEIIRVAFDAVLANKLRSLLTMLGIVIGIAAVITMVALGEGAQRSVAQRLQGLGTNVLTVRPGQAFTGGMIRAQASMTIDDAEALRENARHIQAVAPEIESRFQVEYGAKNANLSVVGTWPDYFHVNQGQITNGRLFTDAEDKGRRRVVVLGALAGAQLGLTDTASLVGESIRIRGIPFEVIGVLAEKGAQGFNNPDESCR

SEQ ID NO: 10399 - protein, 436 aa, Myxococcus xanthus
  unsure (1)..(436): unsure at all Xaa locations
MEVVAESAGLVEPLRVVEVKSQASGEVLKVHYDTGDTVAEGTLLAEIEPRDVQNALAQAQADLESARVRLNTTEAQRQRMEALRKDGYVTQQEYETAVDASATARATKVRAETNLQLARERSRDVTILARSPGTILERTIQPGVIIASATNNVSGGTALFKMADLSVMQVRAKVDETDVGQIKPGQKARVTMEAYPGRTFIGEVVKIEPQALVEQNVTLFPVLVRMDNPDGLLRPGMNAEVAIEISRRRNALTVPNTXVVGVRDARSSAAAVGVSEEALRAVMRPPGAPNRPGAPSGPTTVSAVGEAGVGATAAVANGAGPGAVPARGQGGMGEGQGGGGQGRAGRRAREDVQGATDTRQGVVFVQSPTGPQPRRVTLGLSDWESTEVVSGLEDGEKVVLITVAKLQKQQQQNTERMRQMSGGVIPGAGGGPRGPR

SEQ ID NO: 10400 - protein, 179 aa, Myxococcus xanthus
MNLIGCLDVPSEGQYWLNGQPVAGMSENALARIRNRELGFVFQSFNLLPRASALDNVALPLIYARIPKKERRERAAAMLDKVGLGARMDHRPNELSGGQRQRVAIARALVTQPALLLADEPTGALDSRTGEEIMALFGELHGQGQTLMLVTHESDIAAHAQRVLFLKDGVIERDERNRD

SEQ ID NO: 10401 - protein, 152 aa, Myxococcus xanthus
MFATERGTVETVEALAQAILATPGIEGLTLLGGEPFSQPGPAAALCERVRAAGLSIMVFTGHTLAELRAQARDDVDRLLATVDLLVDGRFEKDQPETARRWIGSRNQVMHFLTGRYAQDDACFTAPNTAEVHFVGGKLVINGWPALADRLRP

SEQ ID NO: 10402 - protein, 461 aa, Myxococcus xanthus
MPTLTPLKSPADALCWVAPPAENPELTSEDPLALDYVSQQVGLWGLPTLTTRSSRAQAYAMVLYGLQLVERAIEHHSYPATDEVRRELFERWERFWALATLEFREGQLPRGDWDSMRGVRGARNAWRSGASSLPLDFQLISRQQELGNLGAYLAPLRRSGLVIEGSLRPGPGALALIDAFWDEPSENKHRGRYEEYALVALDRKSTSIARVHGRLTLAQVGRFSRLSSLVERGRTAQQHRLFEALFVHARDPHSFAMSQLVESAAKAGVAAPRDILDAALAGRLGRLSDELLALLLTARRFGEVMQGLVGAFDRVYSCLDGAGWVAPRERIGREALDAETLGALKGACAALLSSPRVGAIRRLPMHGAAFLRLVEALVDADSLAALDLLLLYHSNVQRERRRGEGWIRNEAGKLVLIVTSYTARPESARFPSFKLDVVRTLLTDLGRLPMSRELDVLEGAA

SEQ ID NO: 10403 - protein, 431 aa, Myxococcus xanthus
MTALALGFLGLVTAPGVGLAQATTTMTTVSLEEAIARALKTSPQVAQAAGTVTTTGAAERSAFGAYLPNLSASANTSLASSQRLDPTTGAVFNAPSDTYSAGLSASWNVFTGGQRGATSKQAQARSSAARAGLIAQRASAVLDVERSYYEVLRAGGLEEVAVSRIERAKQNAEAADRRLAVGSATRSDVLRAKYDLTAAQEALLSAQTQHAAAALSLGRLIGEDGPVDAQPLELQDVSTFALTDEALTDEITAQAPSIQAAEADLRAAEASVKVARSSYLPTVRLSGGYDWFNDEPALNGGRTSWSVRMGLSYPIFDGFVREERVVSARTQASVAQATLSDTRRALRSSVGTSLNQLKLASNRIALATESVAVAQEDLKVQQERYKLGATTIIELLTSQENLVTAEINLVASRFDYRIARAELEALAGRPL

SEQ ID NO: 10404 - protein, 215 aa, Myxococcus xanthus
QRVLEDLVTAFLARGHVLLEGVPGVAKTLTARSMAGALGLLFTRIQFTPDLMPADILGTNVFQPQDHAFRLVKGPIFTEVVVADEINRTPPKTQAALLEAMEERQVTIDGVSHALPPHFFVVATQNPLELEGTYPLPEAQLDRFLMRVRVGYPEASAETTMLRAFHQREGKPATTRQVLDAPTLLELQSRAARVSCDDSIIQYVVAIVRETRTNP

SEQ ID NO: 10405 - protein, 280 aa, Myxococcus xanthus
MYLSEINHYSLLKVEEEQELARRFLKGDLAAGHRMVTANLRFVVKVAYEYRSYGIKMSDLIQEGNIGLMKAVQKFDPDKGIRLISYAVWWIRAYIQNYILKSWSLVKLGTTQAQRKLFFSLARTRRELEKFGSGDAAVNVDDIARRLHVKPGEVREMEQRMGGRDLSLDAPMGEDGGNSHVDFVVSAAAPQDDEFADKEEAGLINARVRTALMRLDPRERFIIEQRVMNERPMTLKELGEHFGFSRERARQLEIRAKDKLKSELAALMAEVDPEAVAAQQ

SEQ ID NO: 10406 - protein, 514 aa, Myxococcus xanthus
MKVEQQNFLLLGESLFSEDTPLPYKFFRDGIRQLIFRPGLTVEEMTTFTLIALSEPERGAEDVLAQLWRASMEHVEYVVVEGFSMENASEEEVQVEVDKVVGYLYSRLQTNSDDYLRFARVSAEDLDAKLDGVEQIRGLVVGGRHASDELKAKLQREVSEEENARLFPKLVSAVFQVVEGGVDDASLLEEIFVQLLDMLLLQDDFGTINQIVLKLRALSQREGSEDLAKMLENFLHKMGEEQRLMRLGESLKSTRPKNPADVSRYLQVLGRDSIIPLLSVLESIEVADNRTLLCDALAGFARELPDPFVARLMSERPQTVRDMVYILEKSNHPDRVKMFGQVLKSPNLVVKLEVLNIIGRGRTGEARRIIADALTDSISQVRMLAAKLLPEFDRDKGYADLMRLVRESGFDKKTPDERAAVYAAIGSTGTPGALSMMQQMLATKPSLLNKKRVLEDKLLAIHGLGGACSIQGYKLLQAVVEDKNQPLEVLTSARKAMYQTKKALFGDSALSEEA

SEQ ID NO: 10407 - protein, 419 aa, Myxococcus xanthus
MADNLKITQAQDENTNEFGREHNEKLQGLARSLVAGLYMLVRSVKMYDPENAVFQKPLHQLQDIINQIISKEGRLELTGVKESFYLNGMLVKVDLNSIENQRYLLTELRSKDVGGFTLTKPVTVPELKNFIWIFSKEQTTASEEDGLSNRKLLNMRVAKFSKLKEKLNKDLDNPGDQKVDRKKYAMTIYARAVFFLTKYLESVRAGKPINASKALRLVQDFVDISYEQRTHFLGMTTMRREDDYLVYHQVNVCLMSVVFGAELGLTKPQLRDLGYIALFHDAGMATLSEELSTKRGALTPEEKQTVQRAPLISVRNILMEKGFSRSTLLRVVTTFEHKTDFGTAVRDSRGNIQMIIPKTNLGVYAKIIAICDAYDALTSKRPYRDAYGPEVALMLMWSEMRNKFDPELLSVFMRVMAIL

SEQ ID NO: 10408 - protein, 92 aa, Myxococcus xanthus
MSLRSGAPRGGAPDEQTGVSLVAGLTTSNVVAPECQHGFSRVDVYWPWWSPVVYAATFGIVAPLRTEYVCAEAAAAAGSVRPEPVPSSHSPL

SEQ ID NO: 10409 - protein, 89 aa, Myxococcus xanthus
MRGAGRVLPPGGLLVLYGPYFVEGRETAPSNLEFDASLRARNPAWGVRSLEAVTAEAALHGLERERVVDMPSNNLTVVFRKPRPQVSPH

SEQ ID NO: 10410 - protein, 264 aa, Myxococcus xanthus
MPEDVLFASAFRGHETEAWSRQRTLMLVLAVIGLHAAALTGAASFWHGTPRRLEGETTRGEVLVLRLTAMSPSAPVGDVTGPAPAPLRPRTARRPRPSRAPSPPRTAAAPRASELAEPLSVGRPASIPAHDRDSLAGRAVAGITQRALGPGFPGLLVEPPPATAPDNREDMARRYFEQMFRDRFEDVPYPHEARMAGIEGSLVLRISVGVQGQLVALGVLGPCPHPLLCEAAQEAVRHAAPFPPPPPALGDRVTVELPFNYHLE

SEQ ID NO: 10411 - protein, 731 aa, Myxococcus xanthus
MMIESRRLIEQVLVSEQPCLGAVFCSYTFDPSYFEDRILRALLRLQGDPEEEAVRYHEEARAALRETPVACFVDARVRRGGRRLPYDLQLIRERTFHPKVILVLYDGEARVAVGSGNATRPGHEQNAELFFTRTLRYDVPADAAFLRNVDRFLRSCAALATHPGTQLTLVRSALAARISDTPFPSGQAPTDALFVDTFSASMLDHLREALPEDARVTRVGILSPFFELDDLDIANDTTGLASVLSELLALRPGSPPPLDLGVPWEDAPLAPPYGGGTPVLAEGEGRLWASRYRESVDGEDIERLEYFGVNRVTAKRVEIQLGSGRPGRYERDAFEHEVAEGRMWPVEPPTVHAPRRILERIVREHEIQLWLHPTATLTPAGRASRRPLHAKLFLLTVTTAGRTLTYALIGSANASAAALSCGVEQGGNVEAGVLLCLDGEVRLSEMLPSLVCAPFESARFEERDAPGAEVDFSAWLEDVVHDAAARTLTVTWSQQGPGGLGGWAWWYLDRELAKGVGPRSGPVVLSDFDLAAAGAELEFRAAGRSWLVPIRVADLAMLPTSAHLAGLGVRELLALLARRVGAERLSTLREQRGVAGVDSVLDSVFGEGFGPTDVFKAWWGLKEDLLAASTVSAFRYRLLGPTGARTLWERLRDLPRDSVSDDEIWVYGCELLRELEQLVLPESADLEAKQALLAELRTLLRADLTRLRPRGAGWLDGVVRFYGLEGTHGKT

SEQ ID NO: 10412 - protein, 252 aa, Myxococcus xanthus
MPAGRYACTFQARGTGEVRNAFFDDDYSSYSSYTAVDSATWTQVAYSFNLANEVFDTFELIFSIRNTSGEHLSIDDVRCTRAAEPCDAVSCESWERCVNATATCEPLAGRCNAAEDCSEWQACDETNTCVVAADRCTRHADCAGTPETPVCDTASHLCVEGDPCAGVVCNHPATSCNPTSGVCELSAGACFTTYDCVGELPACDTATGRCVSADHPANIILNGGFESWSTTYIPYHGNHLIPDYWYGLDNGI

SEQ ID NO: 10413 - protein, 167 aa, Myxococcus xanthus
DYGKFKYEEKKKASEAKRAQVTVLLKEVKLRPKTEEHDYEFKVRNTRRFIEDGNKAKVVIQFRGREITHREQGTAILDDVAKDLKDVAVVEQMPRMEGRLMFMILAPTPKVAQKARELVRQAATAAKRPPPPGAPGAGKSAAGASSGAEEKAEETAEEKKEAQAFRA

SEQ ID NO: 10414 - protein, 43 aa, Myxococcus xanthus
MRYRVECFFHDLKRFRAVATRYDKTATSYLAVLHVASMLLWLR

SEQ ID NO: 10415 - protein, 579 aa, Myxococcus xanthus
MNAALIVALALASAPVPGGSTSLQQLVERIPEVVDDGGGIGTDAQELASRIQAHGAAAIPYLLPLFREESEPIRDFAGYILRDLEGLTEEHLNALIQARLHGDGWIPPAIARIGTPRAIAFLVEDLKDEPQTQSQLTHALVIAGRKAAALLAEPFGAAAPVHELYASAVCEVFHEMGSNSGPAVAPLLRVATGGESLLENQAHAIQVLGCIGPSAAAAVPALQALRKNAALRKTVDGALMRMGPAAATPVFVEHLRTKPTVYLLRDLAELRERGKGAGSAVVALLKNEDPQLRFAAARTLGYIQFTAATDALITMLGDVRDWRMAFAAAESLGRLRATRALAPLKAVATKHWAPPVRDAARKATKVINGKETYPAGNPNFAFEYFAGDRMRFDQQASLEPALVAAPDELPEASFGPLTYESEVRSVGVDGERRTPIKQAPQFGLRVSNGHLVGASRGEWGGELMHIPTDAAAKKILDANATGIHKVGEHIVAVTGLSHIVTNDGMLYRIVPRDGAYVAEPWRVLPGAPRRSGLLSDGRLFVSCLGADVVITPEGDMRLATPENISGTQEQAPPAPPRRK

SEQ ID NO: 10416 - protein, 865 aa, Myxococcus xanthus
MMYLGSQVGWQGLSTLLRAVEVAAREEEVRLSVVGARHADCQPHLDDLVKELGLSDRVEFQPPVHHDDLAKVLALADVGVLPMDDVERNRVQGGPLSKVSEYCATGRPIIAADLPVTRELIPAGAGVFFPPGDSQALADRIIELARDVKRRMELGQVARAHAEAALDAGLIRGKLLDLYDSLLEKRSEPVSTTSEDNLPALTTVTGTPTNRLAALLPPEPAPTAAPVSKKAPEPRKDKDAPAAGRAREDLPLVMGQVLDEGLDTRLIKTELETNPIEPPVVMGAPLRERSAAAADAATTTVRESEASASSVAGNDATPEGSAHDASDDDDSENALPIVQATEVEDADEPPSPTPIVKAPIPSAQASSTVSGDTSEHAATTPVVKAPSSSGRFSSVQSDDGSEASGTTPIVKAPSSSGRLPSVLNEDGSEASGTTPIVKAPSSSGRLPSVLNEDGSGASATTPVVKVPPPPGRSPSPVGADSSETSSVTPIIKAPAALNRTDVGTSEASGDADEAPAPTPVVRSPVIEARYEPPSHTPVVRSPYDRQRDEPPAPTPIIRVPTELHQELIPTRASSSGGTDSSSRPEEYPTPTPIVPAPSSLSSRSISARMETPVGRMTALTPQQRSTNTERPPPISRPGASEAERLPPIRGGASANTPERPPPILHPSTSTPEADQPPALPPRAAAPPPVPPQRPPRLQSVDGPPRLEPVSPQAFKASVSVPGGEDEEPEEISEDEAQSIDEGDDDSHSRARPQPEEPDEISSDEVEEAEISATSAAQLIESDDDLEEADADVAPEPHDDGPAPEPVPSTLNPWFAQLAHGYCPPDGIRFDRHTPPTTFPGRDEPTNPAHPTPSVRSEVVVRGKGS

SEQ ID NO: 10417 - protein, 411 aa, Myxococcus xanthus
MLGLGGGIAALVTLVRDGLGRLPYVFPFPGTLSGMSLERLGFGFEMSLLPLGAGALLGLRLTASWFLGALLIHGVVAPRVFASGLLLPDGDFLAWSLWPGTAALTTASLLHFALEGRVLGRALKGLFKRPSVAPHPVDALQVPGRWLLAGLVVLTPATLAVAKVGFGVPLPHAALAVALSFVLCLIACRVTGETDVTPVGPLGQVTQMTYGVLLPRNVEANLATAGITVNAASSAADLLSDAKTGHLLGAHPRRVFLAQLVGCAVGAAAVVPLFFLLVPDRSALGGERFPAPAATVTASIAQVLASGFSGLEPGTRAALGWAALAAAVLTLTERLLPERVRHWVPSPLGMGLACLLPASTALGFFLGGVAAALARRANPGVQEGRVVTLAAGLIAGEGLMGVVIVLSQALW

SEQ ID NO: 10418 - protein, 1163 aa, Myxococcus xanthus
MERLHGQTLAAWMEALPGSGAASVPRVRELLRGLCAALERVHAAGVAHRDLKPENIFLREGGALSLLDLGLARFLDAPEDGESPEPEGLTLVGQRLGTPYYMAPEQCLDAREAGAAADVYALGVLLYELLTGAPPFIGGAEEIRHGHVSLRPARVSERAPVPTALDAVLSRCLAKAPSERFSRASDVLAAFDAACTQSLSMAPPEGAPAAVPTSSGPGAGERWVALLGVRADIPVDVLRLTFEPQGGTLARVHARGYLVAFSESLSAEANLRAGALVARKLMEEGKAATVLHLSRLHVLPGATTTRVAGPALESAGDWWPEDLSLGEARVTASAAARLGPGAMEHSPDGARLRLHDGGAATSSADAPPLSGRDAVLAALEAEASRCIEEGVPGLCVLTGDVGHGTSRVLEALSTRLEAAGRCLVVRLRASAPDAASSESLLDALRATAEPARVVQAPTLPLADARHAAARCLAEGLQRQAQAAPRVLLVDDAHLADPTSLDALEVATLAGVRAPLWVCVAARPALLGLRPHLGERSARVARIALPPLTPEASRSLLLHLLRPAEHVPEPVLARLEQLAQGVPLSLVELAGALRAAGALRASPGGGWYIAPDALLDVSVTPLFERLAARALAGLPAAHRVLARLCAVLGTEVEVSRVDAALRHLEPSDEMARVTSLDAGAGLQRLARSGLLRPTAPGHFAFRHPLLREALEALLPAPSRRVLHAAALRATPRDGMAERRRWAHHAAACGAHAEAITAFLSLAESARRAHLSVEAEQHYTRALALLPEGDVERRALALSGRGRVRHRLQRFREGLADLGAARALAVARGDQAQQVELLLEEATARDWMEDVEGSSACTREALERIERLDDPRLALRCSLARGRLHVRLGEWGAAVRVLTGVVEGAERVHDHETLVVSLALLGSALTFLDRTDEAATRFDMALLRCEQAGDALHRAATLINRVLLWLRLGNVARMEEDLRRAMVLGRELGHAQVERWSTFNLAEVLYMQGRLEEALPLARRVHELGVRFFREHPVPVDALLLARMAAALGDLEEATRQLRWIDAHCPPESLPPTAVMRRLVELQVQDARGGGSAREAWLALADDADTLASADEKAEILLQAARGALQAGRTDEARTWVVRAERAVEEGAPLWRARLESLRVALFDV

SEQ ID NO: 10419 - protein, 174 aa, Myxococcus xanthus
MEYVVGCALTVDQEIAYYDPREPSPGVRKWLGQAGLCPDWDDSPPSRSCLERVSACVLARNNAEGRRVELSMRGEHQFYASGPNIYTLDAKTRPAAHVPITGNALASFGDCGLGESGEQRDCGWTPDGIGRCTPSTTVVVGAGGAAVLRGAVSHRGLQCEWAHRPAGVRGHRGV

SEQ ID NO: 10420 - protein, 207 aa, Myxococcus xanthus
MTAPASSTTVEWLANVEAYPDSASTYGLSEQQVYSVREGAFYGNIFLPNELGAEVDVVALGDGDKKRYVVVGADVIVRGSIYRKMFSCYDPAWSSGAAYAVNRVCALPSSGSNCAARVTGPCFTSLSPPVAGKCEILDGPLTPRDGDYEACHDDDDVLWNQSVTTYLHAPCDTVAKEMRTQSCGRSSGPVKPLPTGEELPFPFPRKK

SEQ ID NO: 10421 - protein, 316 aa, Myxococcus xanthus
MYLVEVQGPTGKLGGPPVRFLLCALNPDAGASLEHDPYRPRAWEAEPAVTLTADDHGVLRGLLAEASARAIVVWEGRYGQNTLSLRRIEPSPVSKRLQAVLDEAPMRPLAALHERSPTLAAVVPLSDPGLELLPIHRALKGVETFKEETFLTLVTAYARVYELDEPLNNPRGLAVARERLATLITGHHAVLLVLPGGRGRILRFRQGLDLAHLKGAPRNPTLRSLDLALLNALVLRTVLGIKDPEAPGHSQVYPVQGLESLVQGVESGMFQAGFALNPPPLWEVRAVMEAQATLPPSTLRVEPLPPAGLLYLDREA

SEQ ID NO: 10422 - protein, 309 aa, Myxococcus xanthus
  unsure (1)..(309): unsure at all Xaa locations
ASGDEEALYGEELGVGALVSDWLVEQVHYRGPVSTLYRARHVRTGALAALKVLLPQPSDVALRRFRREAETLQRLRHPHIVDVLGYGTLADGRPFIAMEWLEGRDLAAELASRGPLSPGEALEVLEQVGGALRTAHQAGVVHRDLKAQNVVRLSTGSGAPRVKLVDFGVAKGLTPDAPGASTLTLTGVSLGTPLSMAPEQIRGEPPDARTDLYAMGVLLFQLVTGQPPFQGATRHEVEDLHLNAPPPRPSERAPVPAALDAVVLRXMGKRREDRYPDIDAWLDALRRAVKGSPTEDQPTLAVALYAEAR

SEQ ID NO: 10423 - protein, 162 aa, Myxococcus xanthus
MNVSIVSRDEIKLVGIKVVGRRSELSHRVPLAWLEHLSRLDELPGVVDRDVFHGCVPGSDHEQPGDDPVYQYWATTEVRVLDGVPEGLKALTIPARDYAMTPVQGTADAINAAYGRLANWLQSEGRRSAPAAYVLERYGQRRQPVTPPYERFDYELLTPLAP

SEQ ID NO: 10424 - protein, 49 aa, Myxococcus xanthus
  unsure (1)..(49): unsure at all Xaa locations
REVDGAEAAQATQALGVLARTRXAAVVAHVPLAPAEALLAGERPVEARH

SEQ ID NO: 10425 - protein, 45 aa, Myxococcus xanthus
MQGYDAGTGGSGHEMQGYDAGMGGSGMMNDHNTKDTGTHSPEGQQ

SEQ ID NO: 10426 - protein, 417 aa, Myxococcus xanthus
MPFKFVHAADLHLDTPFRGVATQGPLLGRFQDSTFRALTRITEVCLRERVAFLLLAGDLFDVKDRSVRARLALRRELGRLDAAGISTFIVHGNHDPLSGDTGALGLPPSVKVFGPDWEEVEVKREGRRLCRVQGISYPDVEVRDDLSARFRRTGDGFSVGLLHANLGRAEGHANYAPCTTAGLGSRGLDYWALGHVHTRAEHMLPGGGVAVYPGNPQGRHANETGPRGCMLVEVEDGGMRRRFIPVDGVRWHKLEVPLSGVSTLDGLLATVMEGVEARCAPELDGHAVRLTLTGRGPLHRELARPGALAQLEVDLREQLARSHPPVLLESLRDSSRPEVDLEAVCAAGGFARTLLDEVGFLAEDPAALARLWEEEAMGALSQRLKRLGVDALEAPRAEWVVQAGLHGVESLHEEETS

SEQ ID NO: 10427 - protein, 1074 aa, Myxococcus xanthus
MKPGLRIDALRVLGFGRFSGLTRDLGPGLHLLYGPNEAGKSTLLAFLRSMLFGFEKRGQPERYEPAHGGAFGGELTLTTHAGPLLVRRIASRRSSEGELSVRDAEGKELSKESLESALAHVSRELFFDVFAFRLDELAGFERLTEQRGASEALVAASMRGARRLPEVMDQLRKRIEKIYKPNGVTPSLNVTLKALEDVQVRLRQEGDRPARYFAEKERLGALVEEQRTLEAALLETGTGLERLTRLEAALGDVAALAQARAELATLPALETFPEAGESRLEDGLHRRRSYRAEGARLAERLATVEAGLERLSAPSGVRGREEALSQALAAYTEGAALLRALPSRRAALAEKQRQVELALRELGLPVDGPGLLALDLSVSVRVTLEELALRLGAAEVAHREAEGAWARAVSERERLDGALARVDAELSTLPEERASRIRQQQAGLGRLRTVRAEVERLSEQRAELHRQFESVRTQGEPQATAAVLPTWWVPAVAAVVVALAVTAWLLAGNVVGALCLVGGLLLTGVLELARRRVETARDADVEAQRARQRWRQQEEERLRAALMGLSAREELLHRELLSAASEAGLNLVATAADMAAREAVLADALERAGRREQLERERETLHAEHTAARREEHRASEAVGEAESRQEQLGTELTALLSERHFPPTLAASAALTLWRDAAALRQRLLDVGAEEAALTVDAQVCALVTSRLWAEAVVAELIPGATEARELDAGVMEPLASRVAAALEAERAQSLERRTLEERRHELRAEKARLDGLCHDEEAALATLLAEGGSPDEETFRRRAAQARRYVELTGRTRELSHRIEARTGLSETLARQALIDVGGEQGLRVELESLRDRQAEAQDRLKAVLTERGALSHQLEQWENDDALAKLRIVEESLRARAAELAKQYAADRLTLALLARARRRFEEEQQPRVVQLASEHFATLTQGRYQRVFIPTGEERELRVGDGQRDWSAAQLSRGTREQLYLAFRLAVVRDFGETRGALPLIVDDVLVNFDPERARGAIHLLAKLSEHQQVIAFTCHPWLRDAFAAEGARVQALDASTSEPPAPVSVLKTG

SEQ ID NO: 10428 - protein, 89 aa, Myxococcus xanthus
MEKAIARHELTCELQDVVRAADHLLVPRGALFMVYPASRFGELTSVLRLHRMEPRTVRCVHPLADRPAKLVLHGDDEHAFTDEVNAMLM

SEQ ID NO: 10429 - protein, 113 aa, Myxococcus xanthus
MLADCEYWLSRGVPILMFPEGTRSSDGVVKPFKDGAFALALKQRCPVIPVVLTGTARTLPKHGLVLETTARCHVQVMPPVDPSAFTDVASLREHVRNLIVSEKARIEALTPGA

SEQ ID NO: 10430 - protein, 1059 aa, Myxococcus xanthus
MRKQPVVMVALGGLALALAVALVHAQDDSSARPPPPTAQHGPSLRKLDAPTPPPKGNHSLRGRVLDPWRRPVAGIQVSATREMPGESLSALPCDTRAPDLSLSSGDCIGVPEEQVRGLVEVGHGGAPVVAQAVTSAEGTFRLEGLPEGTVALWGIGEHHATLALDVSTGAQDVTLVLAPGLFLPGRVIVESGASLPGARVTLFHQEHSRFFDARTGADGRFAFGPLPPGDYTVVATSDGLLTDSLQNVEMEDLNPIVLHLPRRLSGRVLAQDTPVAGAEVHVAYTSSVTVTDDQGRFSFEPLSPGDYEVRAEHQGAYGFAMVTLTEEDGDADTTVHLGTLIYLEGTVRDESGRPIPEAQVGAGAARGRAPPVDYATTMADGRFRLGPLRREPYIFNVLASGYLGTLRDEVAAPGLRLDFTLARAHLIRGTVIDAQGTPVPDVDIDLDRESLPDTETDLQRVDATTSDEHGRFELAVPHPRRYEIVFISQGHLEARVTADAPGPELRVVMEATARVEGTVTSAQGLPVHHMAIHLEDDSDTGNSHTVESDEEGRFSITGVLPGTYRLHAGTNTHPATRAASRTVTVHGSEVVNASLRLETGAPVSGIVVDERGRPVANATVEGQSLSGRRSDLPPSVTTSDDEGHFTLHHLAEGECSLRAAKGRYVLEATEPRAPGASHPAVLAQSGARNVRLVLRSQGNVHGRVVRANGTPITRFTINQEPFRDPEGSFRFDAPVVGTQRLTFEAPGLTRAVREVQVPAAEDLDLGQVRLEAGRNVRGRVVDAATSKPIEDAIVEVHLPGEGGAFEEVTALAVDVSQRDGTFAFPLLEARPLDVLVQTNQGHPILRHRIGTGDETLELQVYPGAQVEGTLNDRDGKPAEAIVQLVAEDRDYSASVDEGLGAFQARNVPAGTYTLSASMGQNAEGRSVAFLPQRVKVPPMGKVTFAFTEATGGGTMRLGIRMPPVKPDVGIYKALLSGTLPPTVSGRELRTRARFGDIRASTKSLEGVLVYEQLPAGAYTFIVLLEEGKPARFTVHREELFLAEGETLERDVQVTPRPLP

SEQ ID NO: 10431 - protein, 284 aa, Myxococcus xanthus
MSDKRPLADTTELELDWRGRAPRKPEAPSSAALEPLSEVEVPSGAGKGLPGDPRHMSIELRQSVQGMMETPALRMRQMREGLEIFFGAQTRNRYEVCDDTGRVALYVEEEARGFGAMLRRTFSPFYKARMECMTLGGIVALVVERPWSILLTKADILAWDGRLMARIQQRFTLLGRHLDIVTPGGAVIATVKGPLFRPWTFRIFQNDVEIAVVRKRWSGFLQESFSAADTFTLDFQPQCTDFRLRQLVLAVALLVDLTYFENNSPRAALGPGLDLFDALMFWKK

SEQ ID NO: 10432 - protein, 910 aa, Myxococcus xanthus
MSTSTSDALSAADLERLVRAESPDLADAVLALLEQPEQTPEKPLPKDAFTFDALLRTLTQARAHYESDGRRQASSEAWQRYLAQQDVPRPPRLALADLLVALYQRGTQASRAALMDIARRADLRFGLWGGLKRIYKLAEANHDAELFGVLAWRFDVERHRPSASREVSGGTLTYLRRRAWRYLRHLGAAVPELYPQFAVEVLRHYATNTSWYGVWVAHHIWAHGSGKYTQDSFAMPPPGDMVKHRAFPDAWKRSPDALMRLLDVCESDPAASFAIQGLRKDFPEALRKVTPAWLDRLARRPLGSAHDFLVETLQGSPEFHQGRLRELGLHEAVLALLLSPSAKARAYAIEYARAHAQDLPAERLEELVAQGAPDVKSFAAATLEKRNPRELGVALLGRLLQHKATSTFAASALAQSFDRAELPADFLRDMYLGTGEQLNWVKGFISSKYGATELPADFWKALLDDPRLQKKPHPVEGLAMRALSAYPAAAIGPEWLLEKAAHPRISHMATQALMRADSLPGLDVEQVKARVFSAKYRGVALGLLGNRKLFTARQLTVPWLLALARRADPELHGFAHRYLLENVAPADFSDAGDAAAGLERLFELALGAKQPAPVRAFAQTYLRCHHPVIGPEQPESKSYNLKPRAPRKAYTPELLWPALTDSRDDVRRFALAIARAELRAWGWHTRVYELADAEAKEIRNLAYDALLRAGEEGADARHTLQPEELDPVKVFSLTESTKRSTREVAVELIRRHYARLGGAERLAWLMQSADREVGLFAVRLLWEKHRPTHLPEGWKPAGAKEAPAASGTERFANVDALRTFLRKMLFGLPPGRAKEAREGEVQKRLSASVAKRRVIELVRDLGLDDAAFARVVAPVLEEFTGSLAKGEWQSCLASLVQLRAAHPDAQLGSA

SEQ ID NO: 10433 - protein, 295 aa, Myxococcus xanthus
MLLDELLNGFPRERFLQEHYLRRPFTGASAAERLQRLGTWETIDFLVEETACDVLLARQGVPYPGDRPTTAKAARELFAQGYTLALRQPDLHHPDLAQLARAFSAELHGRINLHIYCTPAGHHGFGWHCDPEEVFILQTAGRKDYLLRENTLHPVPLPESVPSGSLAAQEKTPVETHSLSAGDFIYIPGGHWHMAQATEEALSISIGLMPPTLLDLLDGVRAALASSPVWRRRMPSLGRASSLDDPSKLALLRTLLSELGGEVQRQLADPGYPLRFLAQTARFYLRSTGIRGNGR

SEQ ID NO: 10434 - protein, 162 aa, Myxococcus xanthus
PVLAIGNIEKVRALAANARLLLVGGARASTASRLTAFEPGTNKVLWSTELPSAVNALALSGGQWAAAGADGTVRIGTLSDGQVQFQLNDVHPGGVTALASSADGTLLFSAGADGVVRAWDWESTRKMHEWKASTQPLRAVAVDPSGTYAAGAGDDGVVRVFI

SEQ ID NO: 10435 - protein, 56 aa, Myxococcus xanthus
MAPEETLSAAPAHSEPATSEAAHSEVSAAPEKLDEIEEIDFLLEEIESKIAPLALA

SEQ ID NO: 10436 - protein, 127 aa, Myxococcus xanthus
MPPRVDRTTLTYDVTLPFAAKLAFKPTLFYVHTVYAIASPLSEEKMRCFYFASYHPRLRNHFPDMFVKSELAILEQDRRTLEGVRPRAQPLDFASEVHTPADRLPIEYRRGVIALRLGKPVDGPAPE

SEQ ID NO: 10437 - protein, 324 aa, Myxococcus xanthus
MRSHLLFLLLALSACQRNESPPPPAKAPAASAPSPRAPAVPAVTASADAAKLERGRYLVENVLACGSCHTPRDWARYGGPASGPALSGACWDDAAWELPGRVCAPNITSDPEHGIGRWTDEELMRALRDGTGRDGKTLFPLMPFLLYRELSDADAHAVIAWLRQAPATPRASARSVIPDEVYAQYKDMAAPMKTAVPEPAADDVSRGRYLATMAQCAACHAGMDEAGTPFVGGRPLPTPHGPEVVSNLTPHAHGLGAVDEAAFVARFTAFKDLAPAPARAGQVNKLTMPWGFFAGLAEADLKALYRYLRTVPAVAPAAPSASGK

SEQ ID NO: 10438 - protein, 494 aa, Myxococcus xanthus
MRKESRFKDLDWSGVTVGRDEWTNDFDSTFQRETYYENAAWMRSLDDTFLIEVLDADGAVRTSITYSRRDFMGEGATTGRTRASWLVADLARPRFPGDPEVSLLPDGTEPTYKTMVKASFSGATNPFKTLTMPQLSGEGLIRVTWSQLPLKPFLFPIVFAPEAERPATCYRLDESGLATDEQVPCGFGLTQAVRVNRPTNGSYFMPGDSVDFMVSLRDGDGNGLHPRNRMPSYNEYMGESSNGLAYFNEEMLLTYREASSSESGFKVVGPLQDLQVSRGSYTLPYFSFPLFSEPHFYLPPGSNQLAGGGDAQPPTHYSVTLPPNAKAGTYAIILKGHRTFMGERLNRLDPFFFQVGQAQPTTYPGRVGNCQVCHNGVNSLSNVHHGMSVDHVEACKTCHIEEGYGYLPDIIHRIHNSSRKYNQNKGDCTMCHLTRESTLWPSLMSCNGCHVASHGTEYFDLRFEPMQNTPNGYGNCAESCHVTTPAGEHILPPR

SEQ ID NO: 10439 - protein, 69 aa, Myxococcus xanthus
VNHRAEQNHALDAAIGLGNHLGLPVVVYQAIRPDYPHACDRLHAWALEGMMDMATGCAARGLTYWLELP

SEQ ID NO: 10440 - protein, 365 aa, Myxococcus xanthus
MKVRSLIASTLSAAVLSACADSSAPPPPKLDAEAPYTDLPDRRVPVSGVIFDPEAMFYTFVMWPPDPEDPEAGPPLPALLYGMPTVMRASVWGAQVSMVGPTGEVVDTSGPAMPPWGNFQTEGIPSDPTVPYLMRAEPAPGLSVGAADMFPEEEGHAPIPAVPYYATTSLRPIAATGTQCLIQSPAIVGEAGALGALAQVISEETGTSVSPASLADASSGRSVALLWVYSPSPVLDAFLFPSGDIAAETTAGTLYAIDWAPPGSFPGQTEMGYFAIPGGMSSLGYYALVVQPGAPSALTVSFVDTLEDEEEGRPWEVPPFFVEGLPPGVSFTRLFAMEASPPVEENPYEEPAPPPDFGFLCYPEG

SEQ ID NO: 10441 - protein, 460 aa, Myxococcus xanthus
MRGGSGSEEDSGVAAYAGLQPREWLTSAGEALEGFTRHHAPSQAELFLAAERRLSFEYDAGTGRSIVNQGETMDAMARVSWDARQGMLTAPVGETGALPLLLERTARQATSGRASPLPELPAQSDSPSVSSPPPLQPERAARRMKHFIETAVPPGSVVQAALLTQVSTWRALVRASGARRARTEWREELFVRCETPRGAVVDAVAFPETAADDTVIIPLRHRLAEAVAALTGPAESLDRDLPLVLRPAVAAPLAAGLIWLLRGDVAAATPALARAVGRKLFPSVLSVVDDPNHPTGTRRVSMDDEGLSTDTLSLVDAGVLRGFLHASDTASRLGAPLNGRGFRTSMSPPTPEAVNPFLVPGETAVLPAHYTELVARVETFTTMPRPGTVTLVAGGWEVRDGRRVRRIAPVELELPVLETFRALRGVGTDLTFFPTAEGCGTPTLVFPPLLSGAQGGQAAR

SEQ ID NO: 10442 - protein, 214 aa, Myxococcus xanthus
MSGQSLAAKMLEGAREWAKRLPNALSNDMAVDVSRRRVRLSHARVETVVSQLLARLKNFELREWSSRENVYDIRFSVHGWKLRVETALERVELASGRYRLWLKTPGVVALEESRTASSLMMGVLRAGAGRAAMRVLAERLLPPGIRWDGQVLQVEGPLPEEGVLPARLFDSASLAMTAEHQSEGLWLAADAWPGLMDLLQVVFGTELPRTPPGA

SEQ ID NO: 10443 - protein, 649 aa, Myxococcus xanthus
MPPLPVRALAAAILLWSLTVSAEPWNGTEPGTTTLQQVLLSFGPPTRQVHEDGAVVLTYQRKAAPGGTRSTRFHFDARQGVLRRVEVVPTKPPTQAGLVALYGPACGAAKASEGGPDCHEEEAAPARQRWWHYRARGLSVLLDKQRRVKSMRYSEPLASASPAPARGSMASAGSEGATVPAAAAFDVPRATPATGTLPPDTDSASGLATAAVDPSGAGAPDGFEDLLDAPAPAPAPRPAGPSGAIVEGWQGPEGEAADPWHETAQERQQDVLAVGGIYFQRAELTGLRSQGKTSYQPVLPALADIYLDATPSKHVRGFMMGRLAYDPLSTEANGPAAVLGQMWLKFDVAQRLFVTAGRQEIRWGSSQIWNPTDFLQAPNPDPLNIFDLRTGVDMVRLTVPWEAMAANLSLLGTANVEDVSEDLRRVRYGGGVRAEMAVGTGEIAATAVFDQSRRPRYGLDATMALGLLDFNAEVAWVGDGNTRLWARDGDSFVERTLEGRKLLVSAGVSATFNFAELYRAVIRVEGFHNPLGYDDRAFLPWLSSQGDFRPLFHGRYYALGQVNIGRRGVSQLSLIFTTIANVQDASYLSRLAFNSSPFDIRDIFVQTFVEVPYGERGSEFRFESLPADPTISGSGLGVFRAGVSLYVRI

SEQ ID NO: 10444 - protein, 368 aa, Myxococcus xanthus
MPEALAYQARPLLDAEPRLASDTEAMVSLVRQLEATARAAGAQHLDVLLREVERRTLSASDAHQREDHQRHALLEVKAFHDTGAGMAELWRCAAWPDVTGARTALPSLEALVESMARELRDTTPMVPCPRDVLPIVFPPGAASGCFFHEVCGHPLEGDVVARGGSYLARRLGQQVAGAHLSVSDDPTDGHGALGFAWDDEGHAALPVTLIREGRVDAPLLDARSAAALGRAPNGHGRRVSYRHPPLPRMAHTRVDAHQGHLEALMADIPHGLLVQHLTPRQMDLLSGDFSFYIVEAREIRNGRPGRRVGPGILRGNGLEALAAIDAVGADTKNLFATRGCRKLDHGPLPVSFGQPTVRFRGLTVEPSR

SEQ ID NO: 10445 - protein, 302 aa, Myxococcus xanthus
AVKAAEMMLAALRPLLQAMPAGAPLRPALLLGVALGANVGGIATPVGSGPNALAVSAASEYAQVTFAKWMSFALPLTMLLLLAGFGLVLLRFRVGGRLTLPPEAPVSLARSGRRVLWVSAACVVAWLAEPLHGVPAPVVALAATALLFGSGLLKREDLGRLDWATLLLIAGGIALGRLLEHSGLIARALAGADLAGWPVPVQLGVLVAVAAVLSALMSNTGTAALLIPLATQLHPAVSTPVLVALGCSLGMPFVISTPPNAMTVGEGLASSELMKLGVPLMLGGCLLVSVSGPAVLRLFGLP

SEQ ID NO: 10446 - protein, 412 aa, Myxococcus xanthus
MDGLTLLKTAREQGSDATFVMMTAFASVETAVEAMKSGADNFLLKPLDADQVLVTLGKVLEKRSLRQEAEALRDQVRSRVRRFHDIIGESPQLQGIYDVIRRAAGTRATVLILGESGTGKELIAQALHQESPRKDKPFIRVHCAALSENLLESELFGHEKGSFTGALARKEGRFELADGGTLFLDEIGEISPAVQVKLLRVLQQREFERVGGTQTLKVDVRIVAATHRDLVAEVKAGRFREDLYYRLNVVSVTLPPLRDRKSDVPALVNHFLEKYSDSYGKQVRGLAPGTLQALLSHDWPGNIRELENAIERAVVLAQGQELSTDDLPPVLRGPRPHGTSTGALIPGATLAAIEREAILRTLEMVQGSTSRAAEVLGISVRKIQYRLKEYSTPDGAPLKVVADEAEDLAAES

SEQ ID NO: 10447 - protein, 269 aa, Myxococcus xanthus
MEDWITSDLDLSSLDFGWMRQMHAFDHWNAIPRASIAPGKPFDLMSASFPEFSLLVLWSKLRLRHAIEQGTPLEAVRDVRQLAWLAYRTDTLLGGMVALSLLTVEHRIHATLENPPPDWRPMSLEQQRRFKAVLWSASAFSSIASPVEVSEKARTCEPAIGRCIGLVEAALRGRYLEPYAKGTHQQAYLELKTASAAGHCPTQLLASIWEQGLTVTDDDTGPGAGDERPLAARLIPTSALRGPFALQILASSLTTLDPLRELKALAPAP

SEQ ID NO: 10448 - protein, 667 aa, Myxococcus xanthus
SPDKLLTDPYSKALHRDHDWSKGSTASGPARTQVTYAASAKSVLVKSGDYQWGEVEQQWRANRQDENWQGHGWQDLIVYEVHAKGFTADPASGVRFPGTYRGFGEKAAYLAELGITAVELLPIHEKPLDGGYWGYQTINFFAPELSYAAFKEPHQVINEFKWMVEQLHKHGIEVIIDVVYNHTGEGGLWREKLETDDVMPGEPLESLDPAETAGLYSFRGIDNQAYYALNPDLRTYWNNTGVGNQTRPNHRPTRKLIIDSLRFYVEELHVDGFRFDLAPILGERDGDYNRWDDPRNTVLQDVIDDPVLQKYNTRIMAEPWSAGGWYCMPLGEFPNAKTQPGNGWYEWNGRFRDWWRAFMNQDGWKLNSNEGSLCGRPGTVDGGFLMYGSQEWFERNGRRPYHSMNFITVHDGFTMYDLFAYDEKQNRCGPLNPVCCDTPNSPFCDKVSGEEHNRSRNWGPIGDERAESMRRQMIRNAFMSMMISHGTPMILGGDEWMRTQLGNNNAYSTLSDNPFNWYQWGTYLARDERHRMFEFVKAAIRLRKEHAYAFAPKDYGKGAPLAWKSAQNTEAAWDSKQLMIHYHDASYGPELLVLINMEPRAVTFTLPEGRKWTRLIDTQAYFDSSAYLTTAGLDSRSTGNSWLDAPSPVNGPTYGMPERTIVVLRAE

SEQ ID NO: 10449 - protein, 131 aa, Myxococcus xanthus
MTTHALPQPTRAELAILRVLWKQGPSTVRQVHELMRGTQDKDTGYTTVLKLLQNMTEKGIVQRDESERTHVYEAAISETRTQRDLLRDLMDRAFGGSATSVVAQALSMKRASAEELAEIRRLLDAHEKRGK

SEQ ID NO: 10450 - protein, 637 aa, Myxococcus xanthus
MDARYLHALEQALLGFLWQGAVVALAVAGILSLTSQRAARTRYATACLGMVAMAVLPVVTFLTALAEASHAVTFGAFGSLTQSSMLTVATTETASLAAPHWTEVLRPWLLPAWCCGVLLLSARTVGAWIITHRMARQETEAPSAHWREALTRALHHVRLSRPVRLLASTRVDVPMVIGLWRPLILVPAGAITGLSAAQLEAILAHELGHIRRHDYVVNLLQSFVETLLFYHPAVWWLSHCIREEREHCADDLAVQCCGDALLYARALAHIEELRLAPSPHPALGVSDGSLLMRVRRLLSASEGMTPRRSWRLASGLGSAVLAVALGSSQLPETAHATEPVSTPPLHAEATPGTVQRLSSATPMHHLLVAPATFSAQTPQAPAPIERPKAAAKAERAPAAKPRPTRPAPLLIPDMGTIARTELSRVPYSLDGEPAAPVLLEDTSLESPDATLAEAASAHADEHAAELPRVVVSAPAPSRASAFDAVYKAMKAPAPVKTLRPGITPPRFLSGERIHLPSIVYGIQSHFGGFPKGAVVARCIITTQGSVTDCQPIQGLRGLEEGVIRTLSTWRYEPATLNGKPVAVRYVFDVWFTKEPGGGTHESRHFAGLDLSDVVGAAAPGTCDDCDTFEFHSPTARR

SEQ ID NO: 10451 - protein, 226 aa, Myxococcus xanthus
MREPEFQDRYEGGRVLADHLRRHARQPGTLVLALPRGGVPVGAEVARKLGVPLDVFLVRKLGTPGHEELAMGAIASGGVRVLNREVVNELNIGREQIEAAARREAVELQRREESYREGRPPPNVRGRTVLLVDDGLATGTTMRAAVAALRLLEPAAIIVAVPVAAAESCESLAQVADEVICVRMPEPFYSVGLWYRDFAQTEDDEVRALLAEATREGAASEAQPSA

SEQ ID NO: 10452 - protein, 474 aa, Myxococcus xanthus
DVTPVGFAFFDRELRYVHINTALAAMHGLPTERHLGRHVTEVMPDLGKLIAPRLQLALSTGASIQDTLLQVETPAAPGESRFWFGSYLRVCGANGEVLGVIAAMSELTERMRAEESLQEHEGRLDVLTRSLPDYLWGGKLRGGRLRDFYCTPVIERTTGYAASAFVQPAPDGGPPPLWAEMIHPEDRARYRASIEGLAPGAEAELEHRLICADGRVRWVRSRAAASALDAQAELHVGCVVTDITDRRLADDLRQRLHDSFRRSAQEWRRTFDAVASPLMVLGADGTVQRLNAAAIALFGGMDPSGQPLFTAASAPPWSHALPLVEELRRTRASATRELGDPVSRRTWEVSATWVEEAGGEDSRIILVATEVTRLLELQASLRRSETMAAMGAIVAGVAHEVRNPLFSISAVVDAVEATFGARAELKPYVDVLRGEVKRLNHLTQELLEYWRPTRGEWVEGPVLPVMMDALSACA

SEQ ID NO: 10453 - protein, 261 aa, Myxococcus xanthus
MKPCAPQELLLTLEQAMRQVRLHAEKRELARRAQVTEKLAAVGTMTAGLSHEIRNPLNAAALQLSVLERRLRRLPDGQQAPLLEPLLLVRDEIRRLDHILEDFLQFARPREFRPASVDVNEMLRRVVDLLSGQAASRKVSLEVTPREAPVPSVAGEEERLRQVLINLCLNALEATPAGGTVTLSAGHEGGRVWLTVDDSGPGVPQEARDRIFEPFFTTKAQGSGLGLSIVHAIVTQHGGSLEVDTAPGGGARFILRMPLAG

SEQ ID NO: 10454 - protein, 237 aa, Myxococcus xanthus
MRQYLLLDDNVAFAENLAEILRDGGDAATVVTSGDEAVRLARTTRFDVLLTDMRMPGMSGADAVHHLRRVDPGLAAVVITAHPRQDDLETARREGLLAVLPKPVPIPTLVELLSGARRDGLVVLVEDDPALSDNIAELLRGRGFSCVTAASVLDADRILCVQPFAALVDLRVPGGPDGEALRRLRARYPHLPTFVMTAYTDAAPLDGTTGVFSKPFNPGALMEVLETAHAARPTHAL

SEQ ID NO: 10455 - protein, 396 aa, Myxococcus xanthus
MAETLFEELKRYVGFSSADEQALVTLHATAKPHFARFARVFYDRILEHEGARQALEGGESQVGHLRGTLQVWMDQLLRGPWDEVYYALRCRIGRMHVRIALPQHYMFGAMNILRQEFNSHIDATYLEEPAALRAARSAVGKILDLELAIMLHTYREDLLAQQARSERLSTFGQLVGSIGHELRNPLGVIETSLYILRGRPGAMDERTTKHLDRIGDQVGIANRIVSDLLDMIRDRPLHRQEVWLDEVWQEALKAVQRPDAVVVSAEGLTSLPAVQGDAGQLRQVFVNLLDNAVQALEETGGTVSLSAATREPEMVELVLEDSGPGVSDVIRRRLFEPLMTTKARGIGLGLALVKRIVERHGGSIAYVPRPGAGARFVIRLSLVASEETHAPVPPVG

SEQ ID NO: 10456 - protein, 74 aa, Myxococcus xanthus
MKGFRGLCEMVSHGVGLGIVPERVANRHQREGTYRKVPLSEAWAQRRLCVCFQDWDGLSSPVRALLEYLLGGGE

SEQ ID NO: 10457 - protein, 192 aa, Myxococcus xanthus
MLGTRAFTNLGLRRLTGMGAGRRAITLHKDINVNAPVEEVFAFWREMQNFPRFMTHVDEVIPGVEGRSHWKVRGPAGLHFEWEAVVTKFVPNKVLAWKSVEGTAVENLGVIHFESTPRGGTRVDIRLSYNPPAGAIGHAFAKLLGADPKKQMDDDLLRFKSLLERGRATGRETVTREQIAPRRMSSRGPLTH

SEQ ID NO: 10458 - protein, 304 aa, Myxococcus xanthus
MPYGTFLVQRCFVELPRLIEALEHKARESLFDCYAWESGEVGFTPGLPPSARAIGLKLSLSTLHRDAVSRQREWSMFRDIFPRMDTTFRVFREFAVETYSEEEDVLLDLAASGATLGELLASAREAPLFAARWVLHLYRRGALAPRKALGPRLGEAAELEELLTLVKRFLEAGQYDHAVALAAQILEQGPVPEAHALYREAEIRLTLALSDELFALDGRLVFEPIPRPTPPDLTADDLYLYSKLRGSRSIRQALRTAAMGELAASRSVHRLMASGLIRVAPLPGSGPRRAHTDPFGLPIHGVGS

SEQ ID NO: 10459 - protein, 498 aa, Myxococcus xanthus
MRVLPARLGAILLTFLPLIALADAPRDRFGAAGYFRIMTRPDFAGGSGQLGYYWLYGRLLNESPYGELNLRLDALQATPGTDEVWAEVHSRISGRSFRSADPGNGSLVNFSADYLFVRAGNILLDRVTWQLGTLEDRWNDLHIYDQRPGTLLWDTVGLSGTYQGDRYDVLLAVGDSGYTLRPNNYNTVLTGAASFRYRLIPGHLEVGIRGQVGYEPAVRGNRNALYASPGTSYENFARREVVRRYFEANPGAEDLVPDLKARSALSYRAMGYVGFGGVGPLVWSNLYLTFEKRHPQPFYTENFRGRDWTVYVTDQTDERYDGNLGNEAYLRIIPDKLEALWGVWAGYSFNKDNKIAAGEDNRVIASTVLRLQYFLTDKVHLLVESTVAREKSLNGNLYRNHVDSVFTSTDGMADARGLEFGDSDTRDTWQFKAGVVLNPTGRSIYARPSLRLLYGLQRSTQHAAFGNSFVDSLDQYNVYVGPERHWHSVVAIEAEGWF

SEQ ID NO: 10460 - protein, 231 aa, Myxococcus xanthus
MGGLVALRLLGPDFVDQQRLASWLEPFGKWAPIAYIGFLAIRPVTLLPGQLLTAVGGMMFGTLAATLYSLTGGLLSGLLLFAAARKLGTGLMKRLAGSKYPALVRAARRHDFLFAFTACINPLCPTDVMLAAAAASGARLTPTLAGALIGTLPGTFLTAQLGSGLAQGRTTMTAVAAAGLVVSLVLGAYIGRRFYKELNEDAPEPQPRAEPPPPARRPIRHSEETAKPAAV

SEQ ID NO: 10461 - protein, 140 aa, Myxococcus xanthus
MNNDVRVGKESIRAYYDEMMRGPNRVVDRIQAKFEVDDLTRLYGDTGIARGSSRDHYVLTDGTDIVIDGRWTCTLVREGDRWRIAAFHYSTNVFDNPLLTRVKHLALAGATVIGLGALVAGAAIGRRLRRRSPGPTPHAP

SEQ ID NO: 10462 - protein, 286 aa, Myxococcus xanthus
MPDLGIDFALRLDGLSLLMALLITGLGTLVVIYAGRYLVHHEVLGRFYGWLLLFMGGMLGIVLADNTLLLFVCWEVTTFSSFILIGFEHKEDAARESAQRALLITALGGQSLLVGLLLMGDVVGTLSISGTIAASDTVRDSPRYLAILLLVLGGAFTKSAQMPFHTWLPGAMTAPTPVSAYLHSATMVKAGVFLLARLSPVLGGTPPWETILTIVGTMTMVLGALLALGHTDLKLVLAYATVSVLGALVMLLGQGTAVSIQAMVTFLTAHALYKGTLFLVAGSVDH

SEQ ID NO: 10463 - protein, 39 aa, Myxococcus xanthus
DRKLVKILGKREEVGRPILYGTSREFLEFFALKDLSALP

SEQ ID NO: 10464 - protein, 206 aa, Myxococcus xanthus
MASTLAHLKSRMLLPRQDVASAQEGAEVLAVAEETEDPRAELVRRLLEYQKYKDAAEQLATQDLLGRDVFARNVPVEAVPIPEEEVGLQEFSVLKLVEALDRVLERLQPKLQHEVVRERVTLSEAILRVVERLRPHGQVLFESLFTEEETPSRQEVVITFLAILEMVKRRLIRVVQDEPLGPILLLPNGDALEKLAPTEVDDSDYR

SEQ ID NO: 10465 - protein, 141 aa, Myxococcus xanthus
MSKSYGNTIELFGDEKEIKKRIMSIKTDSTPVDAPKPLPTQSPPPGLVSDAPLYDLLKLMLPESEFAEVDATWRAGGKGYGDYKKKLLEAYHAAFGPARQRYAELAADPGEVERILQDGASRARAEASRLMDRVRKAVGVP

SEQ ID NO: 10466 - protein, 222 aa, Myxococcus xanthus
MADKDPTEDLDTPRSARKLPSFLTLEEVEQLLAAPDERTSTGVRDKAMLEVLYATGLRVSELCGLGINDVQLTAGYLVAKGKGAKERLVPLGSVAIEKVQAYLAESRPAVLGRRKSQALFVTPRGSGFTRQGFWKLLKRYALKAGILKPLSPHKLRHSFATHLVERGADLRAVQQMLGHADLATTQIYTHVNAARLRSVYDEFHPRSDVFVPKAKKARAAAR

SEQ ID NO: 10467 - protein, 256 aa, Myxococcus xanthus
MLLVLLVGAPVVTQVLGLALMTAGLPLERGWVLSALFCSAVGLLVAQVLGLAAGVLLGSLSSLATLVGLHATAADAFGPELGGVAGMVVGVCLGSVAGLACGSISGIAIGRGPSVVRVQMAAILASLTPMLLWSGTTNASYAGAVAASALVAFLVSAFRLPLYALEVLASAVAYAVERWTGRPTLGWVPVRHHNLSYLPHPFLGRHLALAVRSRPAEVLAVADACLRSPGNIVVGWPWVVQALESASPEGAREPRA

SEQ ID NO: 10468 - protein, 203 aa, Myxococcus xanthus
MAAPILEVDTEHPSPRHIQRAVEVLERGGLLAYPTDTYFGLGCDLSSKKGIERLYQLKGRDKKKPLSFLCPDLSDVARYAHVSNFAYRTMKSLTPGAFTFILEATRLVPDLMMSKQKQVGIRVPDSALVRELTRALGRPLVTTSATNTEGEPLTDAKDIKADLGHGLDLILDGGVTLNEPSTVISLIGDSLEILRQGKGRLED

SEQ ID NO: 10469 - protein, 432 aa, Myxococcus xanthus
MTGAVIRLLLLMVLLAIISRAQVLRADSGTPVMLAAGALLLCGLFAGKVAKGLGLPRLTGYLLVGVAVGPYALGFIPNAGVKGLELVKGLAVSLIALVAGTELRLGLIRRVGARVALLCAAVCGVTFLVCFGATFALKPLLPFLADMTVPQALAVSALLSTVVVSFSPTVTIAIVQETSARGAFTEFLMALVIIGDLLVMVAFALAAGLTKASFGGGLDVTELLGGVGWELFGSVVVGLVLAVGMLVYMRGVKQELPLFLVGLCFAAAEGGTRLHLSPLLVSLAAGALIANLDEHAGERIHNAIQQAGLPVFALFFAAAGAGLKLDSLLTVGPAAMLLVALRGVAIWLSCRRFAPADDPRLKRYLWMGLISQAGVTFGLAALVSRTFPTFGPQVEVLIVAMITAHELVGPVLTRRALAASGEIRADDAQGTA

SEQ ID NO: 10470 - protein, 344 aa, Myxococcus xanthus
MRPVMALGLGTAGVLLGLNLEPRLLRLLPRSVYLSGLAHSGTAFFFVALPLLVPLVFTSARGLLGAVGAAAMLGAAASLSSGHSAVLAWRAGRLDRARGLGVALLTMLDDAVGLGVLALALMIGAASNVGEGLGLVCLALLLGVMCGALLAFLTHSLKDLAELTTVTLGGVVLVSGAAAYLRVSPLLAGVACGATLAVVGGRTSERVARALGRVERPVFLVLVFLVGCAVHARDYWAWVLMPAFVGLRFLGKMLGGRFARRLVQQTLVLPPRLGYALIAQGGLALCLVAEYGMLVPGGLSRRVLDVVVMGAVVNELLAGQAFQYVVDPPRSISENPADSDKVAA

SEQ ID NO: 10471 - protein, 36 aa, Myxococcus xanthus
MERLVQRVQLEMDADEPPMGRLVAMPVISAPTHRRS

SEQ ID NO: 10472 - protein, 153 aa, Myxococcus xanthus
MSDKDNKGSMTVAEAGRKGGETVRNERGREFYETIGRKGGATVKAERGRSFYEEIGRKGGETVKAERGAKFYEEIGKKGGDRVKATRGPNFYEEIGRKGGQKVKKLIEEGKRAARAAMAAQEGAAGAPPQEGAAPAPSTPPSSGEPAGPVQNE

SEQ ID NO: 10473 - protein, 264 aa, Myxococcus xanthus
MAQHSYRALNDIWVNIREADLYRKLPWPLIDLLVGLFRKLGLYDNTPMRELIQRHLVRHRFRVPAHVGRVSLVSGNYELVPSDSRDFLDAVWQSSTLPILWEPVGATALVDGGLRNATPLGDALEFGPTEIVVIVCSPSQVERAKPPANLLEVATRSLADITLNEILLNDVDAFVRINDIVRQAYDAGLTVRRPDGVPYRYCRITVIEPARPMGDMLDFAPEVIRMRLRHGEEMARAVSLPTGVGPGERVQRRVELFPEPPMHA

SEQ ID NO: 10474 - protein, 478 aa, Myxococcus xanthus
MATGFALFFVAVYGGASWLTGFYTGGLRVELSFERHIPFMPPWALVYVSMDVLLLLSLFVFRTWRDMVPFALALCVETALAAVCFLLFPVEVAWPPRAVEGAWAGVFQLADTLNLERNYLPSLHVAFACTAALAYAERAGVLGRILFGLWALAIAASTLLIHEHHVVDVVAGALLAWGTWRWVAPWARRTAFLEALRVEALCARESYRFARRHLRYGLIALVLYRYAVSRWWREARGARVGFCFLQLVDDVLDGDRAVDGEPLDWVDALLWELESGRGEDRGTAATLGRVLLEQLGDDTARAQVFALVRTMRKDRERVKAGQWWSAEALRAQQRDTFCLSVDLMLHVAGAGVRAEDAPALMEAFGWCSVMRDLREDLAQGLYNVPEEVAAAVRGDGADPTDIDALLGTEAGRAWMTAEHVRARALLDGTAGQLAALEGRPGLALLRLFHRSIESFWRKRLPRRHPFLAEVTARRLQGA

SEQ ID NO: 10475 - protein, 307 aa, Myxococcus xanthus
MTTEGEGVGTPIPAALNAVLLVCAMAACAGCLWLASHAERLAIQALAAVVFSFVNNTVFSLLHEATHGVLHPVRWVNDTLGRFAAAFFPTSFTMQRAFHLNHHRHNRTHLEQFDYFRPGDNRFLKRAQWYSILTGLYWLFVPVGAVVFALVPGLLHRLRGTGTRYGEQTGADAYLGRLEAASGGAIRAEVLLAACVQAGLVVALDVSAMGWGLCYAAFAVNWSALQYADHAWSPLHVRDGAWDLRVAAPVRWLFLNYHYHRAHHRHPHVPWLYLGRYVDPEVARPSFLRIWLSMWRGPRPLPAAMEE

SEQ ID NO: 10476 - protein, 253 aa, Myxococcus xanthus
MGAHLGGGTVVGDSLRCPLHHWQFDGSGACPGKTAQRAFPVVERYGAILVFNGPVVLFPPPEVGSGALRWGTSARFAVHCDWLPVVANAFDLEHLRTVHHRELRDAPVVERPDPFTLRVRYTSRVTGSGLSDRVMKFLSGDRIGVTLTLHGGTLLSVESDLGRTRSALLAGLHQSEEGLFVRLAFAARRSRLPGVDWLALQVSRWLFTSFLRRDLSVLDGMRFNRAGAAADPVLRQVLDFTDSLPEAPDDDRG

SEQ ID NO: 10477 - protein, 452 aa, Myxococcus xanthus
MRVAIYERTVTCVIIPNDVQEEAYHKPPHAHGTVHSSVGYSVPRVLPRERDLRRAADVLNAGKKVAMLVGAGAQAAADEVMHVAELLGAGVAKALLGKAVLPDDVPYVTGSIGLLGTKASWDLMSDCDTLLMVGTSFPYSEFLPKEGQARGVQIDLDGRMLAIRYPMEVALVGDSQETLKALIPMLEHKKDRSWRDSVVKNVRQWEKTAEALAMDRANPVNPRRVFFELSSRLPDGVILTADSGSGTSWYAQHLKMRKGMMASLSGNLASMGCGVPYAIGAKFAFPHRPVIALVGDGAMQMNGNAELITVAKYWKEWKDPRFIVMVLNNRDLNMVTWEQRVLAGDPKLPASQDLPDFPYAAYAESLGFLGIRVDRPESLGRAWDEALSATRPVVFKAYVDPDVPLLPPHITFEQAKHYAQALAKGDVDTGGILKQSLKGMVETLLPRGGGKS

SEQ ID NO: 10478 - protein, 133 aa, Myxococcus xanthus
MPVLRYAFTLNAVRELGRLAPDIARARAEAALDTSLLHIREACTAALGMEFDTLMCFDARSVVRLFSHAEQARILARLVDERARTLARLGRFQEALEDTVYAGQLLACSRQRFGLPKDARAAETLEREVPELR

SEQ ID NO: 10479 - protein, 704 aa, Myxococcus xanthus
MLENGAKVILTDNQKVAQFVTGLSIALPDIPAAGPKALNASALASVVDAVAPTFRLEPGNLVFKKAHTDKQGDSHYRYSVKHNDIPVLGGELILHARNGKVFAANTNVRSDLRAELKATIAGEIATSAVDSDRETLKGWVTDKNPELVYWRVDDELRLMYKVVQHGNKADGTPVRDWVLVDARNADVMLRIPQIKESLDRRLHNGNNTSTLPGAVVRIEGAAPVADPVVNTNYDHLGTVYDCYNTLFGRDSIDNAGGTLISTVHHRVNYVNAFWDGTQMVYGDGDGVTATNLANSLDVTAHELTHAVTDNESDLIYSGESGGLNESMSDVFGAVCEWYGDGADEVSPRHWLIGDDVWTPSIPNDALRYMNDPALDGDSLDHYHNYVPGTGVHYSSGISNLAFYLLSQGGTHPRGKSTIVVAGIGIEKAAQIFYKANTLMVPTSNFEAAKTISEQAAAQLGYDAATIESVSNAWKAVGVSVPVPPPPTDPIVKDTPVVVSGGANEKKYFEVTVPEGAYNLRFTLSGGTGDADLYVRYNNAPTTALYDCRPYAGGNNEVCTFAAPQHGKWYAMVNGYRAYSDATLTVTWEGGFVPIESGIAVENLSGAAGSSQVFILDVPERRPGQGKNNIYIQTGEGKGNPDLYVKRGGAPTHADYDCRSVKDHQSEKCNLINAPAGRYYIEVYGAKDGFEGIVLIGSFLEPLPK

SEQ ID NO: 10480 - protein, 26 aa, Myxococcus xanthus
MRRAKQLDRTSIRILSVLAAQFKPRG

SEQ ID NO: 10481 - protein, 149 aa, Myxococcus xanthus
MRFISLVPMLCGLAVVAQAGLNRRFGGQWGLMSAVLLNMVVATVATFAVYFVVRTVPGLWPEAAAGQGRLSGFTPWHLLPGLCGVVIVLGMPLAMSRLGAVQSVLLLMAAQLLTSLVWDAMVEGRPVTFPRVLGSGLAFIGATIAVWKG

SEQ ID NO: 10482 - protein, 135 aa, Myxococcus xanthus
MRRVLIVSPHAPSRELLRRILEAPDLAISVTGDADDAFASLTSRPPALVVVDVRRPDEDHPLFLGLLRKRHPTLPVIALVPGRLRIFDGRHERVVEAHGDTAESLHQMLVSLQQAMHELLAQDLLRLWRPPVGRA

SEQ ID NO: 10483 - protein, 200 aa, Myxococcus xanthus
MGVVSALAAVGVLLTAQAAPASGLQRRTQDPERLAPFGLMLDASAPEGAGLSLSFRPTRMLRLHVGGTHNGVRPGARVGLTLLPLKGRLTPALTLEAGHARPANGEGLERRIVDRTQMPIHSLERVGYSYASALLGFEWQAPKRLTFFVRGGFSIMRLYSPGIVGVDEQFRDALEPANFHGWSLSNIEPTAKLGILLSFG

SEQ ID NO: 10484 - protein, 31 aa, Myxococcus xanthus
KRDCPMDVSGAQARAEDIPEGVALIIVTPEG

SEQ ID NO: 10485 - protein, 194 aa, Myxococcus xanthus
MTVGVVLLAAGGSSRLGHPKQLVRYQGSTLVRRAAEAAASLRCGPVVVVLGASRDAVAAELTGLPVRTVDHADWAAGPGGSLRAGLGALRETEPPALNAVLVLLCDQLRVDAAHLRTLLDTFERTRASVVASAYEDTRGVPALFARDVFPELDALSPGQGARGVIARVASRVVDVPLPGGGDDVDTPEDVSRLT

SEQ ID NO: 10486 - protein, 370 aa, Myxococcus xanthus
MKDLDAILRARAQARGPLVLATVVEVSGSAYRRPGARMLMSEDGWLAGGISGGCLEADIVRKAFFWTTTGPRLLRYDSTSNTAEDEGAFSFALGCNGVVDVLLERWEAGAGEALSFAAEAREAGRRAVVATVYRGPANAVGSRLKLRDDGTEAGQLSGALGDAVREAAREALEAGRTWSGPCGGADVLVEVVEPPHPLVLFGSGFDVAPVVNQAAALGWHVTVVADRPAQALRRRFPQAHAVVSAKAPDAPSAVPLSPRALAVLMTHSLPQDRELLARLLPRPLRYLGVLGPRSRTDRLLAELPSPPTDAHLEKLHAPVGLDLGAEGAEEIALSIIAELQAVVAGREGGKLRERRAPIHTAAPLPAQRLA

SEQ ID NO: 10487 - protein, 242 aa, Myxococcus xanthus
MAFSFGLGGFAEVAAIQPEMVFPIPADWSFEAAAGVVMNYHTAHFALHRRGRLKAEESVVVHGAAGGVGTAAVQVARGAKARVIAVVSDERKADVARRAGAHEVLLSTGDWVAQVREKTGGLGANVVVDPVGGDIFDKSLKCLAPEGRLLVVGFASGRIPEVQVNRLLLRNIDVVGVAWGGFLLHEPSLTPTIAKDLEAMADRGVLTPVVGPVFPLEQGAQALRELDARRATGKVVLRMREG

SEQ ID NO: 10488 - protein, 276 aa, Myxococcus xanthus
MKLYAISDLHLRHNDNRLALQALPAHPEDWLIVAGDVGETLAEMELMLSTLTQRFRQVIWVPGNHELWTMPSEQPQLKGEARYQRLVSLCRSYGALTPEDPYPRWPGPGPERVIVPMFLGYDYTFRPDHVPADKALEWAWEDDLLCTDEVLLHPEPHASRAAWCAARVEATRARLDALPPGCATVLVNHYPLRYEHVRLPRIPRFSIWCGTKQTEDWHTRYRAEVVVSGHLHMPATLWRDGVRFEEVSLGYPVQWKYRGVHAWESCLRVILPGPTP

SEQ ID NO: 10489 - protein, 119 aa, Myxococcus xanthus
MLTFLFVDEDPRSLAALRRLVRDLPGGKRFARCVEEALALVKEEAPSVVVTGDLLPDGDGLGLLEQVRASHPRTACALHAVMPPLARDITWMDRAAPPSEVHALLRMLGIGAASMGSPR

SEQ ID NO: 10490 - protein, 327 aa, Myxococcus xanthus
MRQAGRYLPEYRAIRGNIAFLDLCKHPDLAAEVTVQPVTRLGVDAAIIFSDILIPVEAMGITLELGDKGPHFPDPVRSAADIDKLGVPDPVEGTGFVAEAIRRTRKALNDSVPVIGFAGAPFTLAAYMVEGGGSKSYILIKRLMFEQPELAHRLFGKLTDTLIPYLKMQVEAGASIVQIFDSWGGALSPWDYERFCIPYLKRMVSELKATGVPVIVFGVGMSSHLSLLKSTGADVVGLDWTLPMDEGRKVLGPDVAVQGNLDPLHLFLPREELDGRVKDILRRAGPEGHIFNLGHGILPPTDPDAAKFLVEAVHRHGVALRQGTLGA

SEQ ID NO: 10491 - protein, 401 aa, Myxococcus xanthus
MLTRELLNFRVRQGVLRPVFVKRDDTELLTFAQDLLAEVAASRGGQRDDIEESLGLKAGAFTKPKVARGLVKLVLDRLLFDEPAPGVTEARWERIKAAGQVLRALPPDATVEGFEARLAQTLPVPLSEAREALYSDLPGHRRLVGWDGEALNAQDLLDRYNLALAQGPLLSARRLRLRAQAPDLLRVRKVLRWLKFCRLVAEVWRDDDNWALDVEGPGAMLALQKKYGLQLATFLSVVPVLERWELTATVELSRRQATLMLSHKDPLRSPLPAALGHIPPEVASLAEGFADDAWELDLTPLPRHVGASGLCVPDLTFRHRASKREVALELFHAWHAAPLARRLTELRSRPDAGLLLGVDRALAKEAVEREALEAHPQVVLFNGFPSARKLRERLAKLEPGR

SEQ ID NO: 10492 - protein, 459 aa, Myxococcus xanthus
MPSPTELHFDCGTLVAPTLPEDARLRALFQKDGRTGVYRAPAWHYREAVLRLRELGIPYEDKAKRFEPLELPLTSPIQPFPHQQQALEAWTRAGGRGLVELPTGAGKTLLAVLAIAHVKRPTLVVVPTLDLMTQWQGVLARHFSAPVGLLGGGVNDRQPLTVTTYDSAAMQTEFHGNRFGLLVCDECHHLPAPSYRFIAEGSLAPYRLGLTATLERADGGERVCEELLGPRVHRSDIRELQGEYLAPYEVKRVEVPLTPDEKARYDTARALYLGFVRRLSVPLSAPDGWARFLAQSQRSDEGRAAYRAYREQRRIALTSSGKQEVLWRILLEHRDDRVLVFTDDNETVYTLARRFLLPALTHHTPVPERKALLAAFASGELPVLLTSRVLNEGVDVPEARVGVVLSGSASVREHVQRLGRILRKRPGKRALLYEVCSAQTAESSISERRRQHGAYQEGG

SEQ ID NO: 10493 - protein, 288 aa, Myxococcus xanthus
MELPDGDFVDLDTFDGAAGAPHVVALHGLEGSSRAGYVTAILRGARTRGWGATALNFRSCSGEPNRLARSYHSGDIDDALRVLNETRARVTGPLFAVGFSLGANVLCRLLETLGDDAPVEAAASVSAPYDLSACCRKLDAGGPFHRLYRERFLRTLKQKAREKLRHFPEAFDGQAMEAARTIRAFDDAVTSELHGFRDAAHYYAESSAGPRLHAIRRPTLLLSAADDPMLETPVIPPAAAANPHLSVVVTEHGGHVGFVGGQVHRPHFWAEAQALAFFDAVLSQPRVD

SEQ ID NO: 10494 - protein, 115 aa, Myxococcus xanthus
MSAPHSKPVECTRCGACCVAPDIAALDKPLGLRCPHLQEDNLCGVYEERPAICRDYQADEVCTLIEAPTLEERVEKYLSLFGLQAEARALREQGCASMRMARRLDTLRRPDGAKD

SEQ ID NO: 10495 - protein, 185 aa, Myxococcus xanthus
MPVNGTGEVAGVADIRACVSVQRGTRRVPDGTERVCRTKSRKVACGTEEKCRRKDMGNGFMEEVCEDVTKYCRESYEDCQNETRYRREPVYADQCTYDTHEWKPLTRREASGTDDAPRWPELAVGAADRLRREETYTVRLRYEDDGAHEHVLEPEDERTFLVWKKGQGARLTVTNLGTVEKVVPR

SEQ ID NO: 10496 - protein, 169 aa, Myxococcus xanthus
ALSDSQVDALLEDADVPSALERMRRPEVPFYLWPGASQVDWHLERERIYAELLRRPRPRACGAVVGASTALWAMMARQGELVVLMLDARSEDDAAALLEAAGAQAHKAGLSKVVLWEEPGTMPWVGPASRSHPERPGMARCPWCGPCARACPPAKTSPLVAPFGRERAA

SEQ ID NO: 10497 - protein, 90 aa, Myxococcus xanthus
MDDSKKGSRRTIRALASPAALTVLFGAFASNAATLKPVVNDTIGVSNVSFPTTEVQQQQQQQQQQVVKPGTMASGKPVMLQSLVADLGLA

SEQ ID NO: 10498 - protein, 316 aa, Myxococcus xanthus
MNLDPSTQKFVSDLAASNSPPLYTLTPEQAREVLLEAQSIPVPMPDADVEERKLPVGPRGSVRTLLFRPKGSKERLPVLMFVHGAGWVMGDARTHERLVRELVKGANVAAVFVDYGRSPENKFPVAIEEAYAATKYVAEHPDEFNVDARRMALVGDSVGGNMATVVSMLAKERGGPSIRFQVLFYPVTDANFDNGSYQEFAEGPWLTRKAMKWFWDAYLPEAGKRVDPHVSPLRASLDQLNGLPPALVITDENDVLRDEGEAYAAKLSEAGVNVTQVRFLGTHHDFVMLNALAQTPAARGAIALTTTKLREWLHAN

SEQ ID NO: 10499 - protein, 253 aa, Myxococcus xanthus
MGESAEKMAKENGISREEQDRIAFNSHRNAAKAWKDGLFDNEVMHVVVPPKFDKTAERDNIVREDSSMEALGQLKPAFDRKYGTITAGNASPLTDGAAALLLMSEEKARALGYEPLGFLRSHAYAATDPGDQLLQGPAYAVPTALKRAGMTLADIDLVEMHEAFAAQVASNIQALASQAFAKKAGWSAPVGEIDRERLNVTGGSIAIGHPFGATGARIVTQAINELKRRNKNTAMCTVCAAGGLGAVVILERA

SEQ ID NO: 10500 - protein, 87 aa, Myxococcus xanthus
MASVPTQNTVTWNDGSQSVIEFIDGVDVRPVGMTMVTLLGRVSSGRYENALAIKTLDVSSVPGVTQCVLGGVRSATKNVSLSLLRLF

SEQ ID NO: 10501 - protein, 106 aa, Myxococcus xanthus
WLGVTAAAFARSYGETAGSVGGQLAVIFVVSLGAPAVGVDAALARAFWLLFGGLWAMTLSLVLWPLRPYRPARRAIARVYGELKKESWYLGRLSREGASSQGWVEA

SEQ ID NO: 10502 - protein, 815 aa, Myxococcus xanthus
MARIADGVGDIASDFKFAVRMLRKDPVFTLVAVLCLAFGIGANAAIFSVVDAVLLRPLPYHEPGQLVRLFETTPARDPTWLGSVSWPNYQDWSTQLPSLEGVAAYEFQGRNLMTPEGAERVSVVAATANLFQLLGTSPKLGPGFAPGDDQPGAAPVVVIGEGLWQRRFGADPGLVGRTLTLDGQPHTVVGILPTAVGFPAGARMEVFIPFVPSADRVDNRGSHFLSVLGRLRPGVPPQTLAAELKEVARRIEEAHPAQQAGRSAAAVSLAETVTGNVRPTLLLLQGAVLLVLLIACANVANLLLARTATRQQEIAVRFALGASRGHIVRQLLVESLLLSLLGALLGVLLGAWGVNTMGNLVRASFPLTGDLPLNGRVLGFLLLISVGSALTFGLTPALQATRTPLRASLAEPGAKQSPSRAHHYFRGALVVTEVALSLVLLVGAGLLLRGFVTLLGTEPGLEPRHVLTAHLPITPNQYPREEVVERLFQPILEKARTLPGVESAALISLLPIQTAWTSGDYAVEGELPAEPGKTLFAEFRTTSPDLFKSLGIPLLAGRDFTEDDGRSAEQVVIVNQALARRHFAGSEAVGRRLLIGGQPVEIIGVVGDVRQAGLDQQPLPEVHLPYNHPRSTLWYFQAVTLVLKTRTAPASVAATLRGAVRAVDSEQPLYNIMTMEEIIQQSVAGRRLSLTLLGAFALIALVLATAGLYGVISYLVSQRTQEIGIRMALGAPPGRVVRLVMDQGMKMAGLGIGVGLVAAFGLSRYMESLLYGVSGTDPLTFGVFAVLLGGVALLATWLPARRASRVDPIIAIQKR

SEQ ID NO: 10503 - protein, 347 aa, Myxococcus xanthus
MPTKGKHATRSVPTNAPGNKFRPTTRIGLGGVAIGNGFASTSDAQAQATLEAAWAAGVRYFDTSPWYGLGLSERRFGRFLHTRDANEYVLSTKVGRILTAADAPPPKLLWSDASPFNYQYDYSAAGVRRSVEDSLQRLGVSRIDIVFIHDLSPDNQDMGDKWTEYFDQAIKGAIPELTKMREEGLIKAWGFGVNRAEPALRALEVSDPDIFLLATQYSLTNHEEALSKTFPALEKRGISVVVGSPLDAGYLAGRNRYLYDGTIPPGVQEKRARMSAIAAKHGIDLRTAALQFAAAPSVVSSVIPGARTPEQVKANVQSMTVAIPDAFWEALKKEGLIARDAPIPSKA

SEQ ID NO: 10504 - protein, 129 aa, Myxococcus xanthus
MFKVKQNHTFQNPMRQQIDQTTQGKQSDYAHAVGGVNQILDRHNIGISSRSQASVIDNVKKVETGERSEVNAHQREALNFGRDAFESAKKGNYKQAGVEAFGSTVNGLASMFKSIYTETPSEKQGIAPH

SEQ ID NO: 10505 - protein, 307 aa, Myxococcus xanthus
MNRFALRDLTDRLDAQTQHEDIVRILATREFPWDVEQALSFALFRTYAVPSIGVLLHDTDEFTQRTQKRYDDTVLILDTILEHGMASQEGRSAFRRMNQMHGAYDISNDDMRYVLSTFVVMPVRWIADFGWRPFTPHEVTGWTNYYRAVGRHMGIQDIPETYEAFTSLMDGYEATHFAFDARSKAVADATLELLTTFPPTNLAPKRLVTLFARTLMEDALLDAFHYPHPSSLSRKVFRLALKARGTFVRYALSPKKEPAYARQRANIRSYPDGYAVESLGTFPRTCPVKHGAAAEGSPQRAPSKGGP

SEQ ID NO: 10506 - protein, 461 aa, Myxococcus xanthus
MVGRRRWAIGVLAFGLLLVGCGERAHAAARAPGLEVAGSAAGEGEGVLAWTRPLVLGDSEAPHAVVAPDGDVLVAATYREPLDLGAAPLPFNHVSRAPHLLVARFSSEGTLRWAHGLTPEADTARAHVGGLTVDGEGNAWLGGLSAGFAQGAVKIPPGAFLARLSPQGALERVRNFGGTGALTVNALAPDGTGGVVLVGDFQGQRDFGDGVRESPQGQRSAFAVSLDASGQTRWSRTWAAGSEGLVTARAVAVDVFGGVHIAGAYAGSVCFGGPALVTVRQRTPFVLKLSSGGEHAWSRDLRGTEGTANALAVGPDRVFVGGNFSGRFYFQGKPHTSSGYQGFVTVFDTHGKERWARSFAATATALATDDAEQLTLAGSHDGGLDLGDGDVPAGLYVARLHPEDGASLWVRSFTSPSPTLARTVAVDSSGYTVAAGALARSLPEGTPYPRPRDGFLLRLRP

SEQ ID NO: 10507 - protein, 166 aa, Myxococcus xanthus
MAKMLTRGLLCAVLGMSPVAMAQDAEPAAAQVKAPDADAVRDTWNYFYKGQGQGPVLVEAKVCTEVAKEGPNKYECTAEVGPEGIKAGTSVMLWQAYLVPQGDSVEDIMVQSKQGAVVRETKDVKIKGEGWRARQWTGLRLNKPGTWTVSVLRGDQVLKEIQVKVL

SEQ ID NO: 10508 - protein, 382 aa, Myxococcus xanthus
MALVMFTGYLLALTGPVRALLERAARVPRTPRGAAAWMAFVSMALAYVNWGLSLVASAMLVRFMVKRRPDVDYRLLVACAYFGLGATWHSGLSASAPLLVATPGHFLEKSLGVLPIDRTLFSPFNIGLTLAVVAGLTLLAWLLHPKPENTVRVDPAVLESLGDFTPPPRPSERGFAAWLDHSRLLNTVIGVLGLVWLARHLWMNGGWRALNLNVVNFTFLVLAVLLHGTPARLLKASEEAGTVLHGIVLQFPLYAGIYGIFKATGLTERIGELFVSLSTRETFPAIVYLYSGVVNYFVPSGGSKWAIEAPYLLDAATRLGVAPEKVVLAYAWGDMATDLIQPFWALPLLAVARLEFKELLGFLLVAFLVYLPLVTLAFFLFG

SEQ ID NO: 10509 - protein, 129 aa, Myxococcus xanthus
MLPEDVESGFRKWLGSEAGKPDAVVLVAELDGEVVGYAYGRVEGMDWNALLDRSGGFHDIWVDEKARGAGVGVLLAEEMMKRLTALGVPRVVLHTAAQNATAQRLFAKLGWRPTMVEMTREAPPRDATE

SEQ ID NO: 10510 - protein, 464 aa, Myxococcus xanthus
MSTAVLPTSSVNSPRTELRALARLAVPIAIAQGGQALMGLVDTLVVGRAGTSALAAVGLGNGLYFAVSSFGMGLMMGFDPMISQAIGARQFTRARALLWQGAWMAFCAGVMLATLMALAPRLLPLAGISETEAAGASQYLMWRAPGMPMMLMFLTMRSYLQATAFTRPLVIATVVANIFNLLGNLVLVFGGANLPAWFGPLRSVPALGVAGSAMATSASIGIELLIAVLFIRSRKVEGARASRLPVWADLSRAIRLGLPIGLHICAEVGVFALAGVLAAGLGPASVGAHQIAISFASVSFTVAMGIGNAGSVRVGWAVGAHNTPQARLSGFMALAGGAGFMALSGLVFALFPHTLAKLAGAPADVLPLLIPLLMVSAIFQVFDGAQGVGAGVLRGAGDTRFTFLANMVGHYAIGLPVTLLLAFKLGLGVVGIWWGLCAGLISVAVALVWRFNRMSAGTLRPVEA

SEQ ID NO: 10511 - protein, 662 aa, Myxococcus xanthus
ATKAEELEVKQGFSYQVEGGVAVITFDLPDSPVNTLSPETGEAFLRVMMRAEREPEVKAVVFTSGKKDSFVAGAKIDFLQTIKTAEEATAISRNGQEGFDKLADFPKPVVAAIHGACLGGGLEWALACDYRIATDSPKTSLGLPEVQLGLIPGAGGTQRLPALIGVQAALDLILTGKSLKPAKAKKLGVVDEVVPTPILRAIAVLRAKELADGKLKVDRRHGQGFKGVAANGKAKGLAGFIQGLANKELWAEVALEDNPLGRKVLFDQARKQLLKKTRGKFPAPEKALQVVRVGLESGHKAGQEAEAKAFGELVVSDVSKRLVEIFFATTALKKENGTSNPDAKPREVKKVAVLGGGLMGGGIAYVTSVLQGVPVRVKDKDDAGVGRAMKQVQSILDERVKRRSLTRREATAKSALVTAGTDYSGFKSADLVIEAVFEDLKLKHRIIAEVEAVTGDQTIFASNTSSIPITELAKGSRRPAQVIGMHYFSPVHKMPLLEIITHAGTADWVTATCVEVGRKQGKTVIVVNDGPGFYTSRILAPYMNEAAYLLAEGADIAELDRALVEFGFPVGPITLLDEVGIDVAQKVGPIMEAAFGKRMAAPKALEKVVADGRLGRKTQKGFYLYEDGKKQEVDSSIYALLPHGTERRSFDRAEMAERVVLL

SEQ ID NO: 10512 - protein, 486 aa, Myxococcus xanthus
MRWLSTRLTGVLVAWVLVAPLAEAANRKQEVDRYIHGFHQKGMFNGTALVATEGGILLKKGYGSANLEWKVPNAPDTKFRIGSITKSFTATVILQLVAEGKLQLDDPITKHLPDYRGDTGGRVTITHLLNHTSGIPSYTSAPHFRADSVNPYGVAEFVKKSCSGDLEFEPGTKYAYNNCGYYLLGALIEKLTGQTYAQAVQARIFGPLGMKDSGYDVTATVLPKRASGYTPRPGGYVNAPYIDMGQPYAAGSLYSTVEDLYRWDRAFYGDTLMPAELKQKMLTPGLQHYGFGWAIAPVQLHDGKTKLPGIFHSGGINGFSSLLVRLPERKEVVILLDNATHGDLQEIAGGVLSILHGIAPRQARMPIGTVMMESLGKGSTAEAIANYRALKKTKEAQYDFSESQLNTVGYHLLRDGRVVDAIEVFKLNVETFPKGANCYDSLGEAYAAHGDKEQAIANYRKSLELDPKNENAVKMLKELEQPAATR

SEQ ID NO: 10513 - protein, 298 aa, Myxococcus xanthus
MALAPLCVLLAAAGYLVVNGHRIGQGLLHPSPIPVTRPPAEPALSPLEDVAFTTSDGVPLKGWYVPSRNRAAVVLVHGFADNRAQLLFEARTLAGAGYGVLLFDLRAHGESGGDTVTWGDRERRDVTAALDFISRRPDVDPGRLGLFGFSMGGTTSLLVASEDARVKAVAAAGAYPALEADIYAGYGRWGAMSAEPVLWTLRRAGVTVDAVRPIDGMCRLGGRPLLLVNGDVDPDAPAKLQASLFQAACEPKSLWVVEGAGHGQYARVAPEEYARRLLQHFGAALQALPQASSGGATH

SEQ ID NO: 10514 - protein, 283 aa, Myxococcus xanthus
MSVIDVSVVMPTHKREKEVVEAIRSVLRQEGVNVEVLVLDDTPEGTAREAVEGLKDERVRYLVNDPPSKGRPAVVRNHGATLARGRYLHFLDDDDMLAEGALHAMVSALDARPDAGVAVGWVVPFGDDADWLKDKSEYFEWAAQVGASTPNSAWTVAHILFRGTLYVNSACMVRREHFAPLGGFDATIPVYEDVDFYLRGIRAFGHVYVNRPILHYRTGRPSLMHNLGKDGTLVVQSNEMIHGKYRKTNGMLEYRLMQAALRVLPFEVARRLPLRLRNQGRAS

SEQ ID NO: 10515 - protein, 480 aa, Myxococcus xanthus
MSLKSRLLGTARRQVKQTLRPVLQRAMAPARNHIPASHWGLRDVPGQGLSLEGVPLAQLVERWGSPLHVVHMAALRRNAERFLAVPPGRTGGCEVYYSYKTNPVPGVLSFLHGLGVGAEVISAYEMWLALKLGVPPERIVYNGPVKSEASVREAISRGIQLLAANHAEEIAVFARLAAELDRRPRVAVRVTTNSGWSAQFGTPIAGGAALRAYQQARGSKHLDVVGLHAHRGETIRTEGDFTAFVESVLDFTDTLHQELGLDLEVLDLGGSLNTPTVEHIAERDWRLNLTFFRDVPAPDPAASLSIDRYVALAVEMVETHYARRGRQRPRIFLEPGRAMTGDTQLLLGRVHALKAGEDRTWAVLDAGINHAECVRNEYHQLFHVNRPDAPADKVYTVVGPICTPGDTLYHAKRLPDLRVGDTLAIMDAGAYFVPFATSFSYPQPAIVALEDGKERLLRRAETFDDLVTFDALDSRAALTG

SEQ ID NO: 10516 - protein, 207 aa, Myxococcus xanthus
MPFHELGHAMTAWFCGRSAFPTLWKTAIFGRSYVLALMLAAVLGAWAWWGWRRRQWLWVACGASLLALQAVGTLLLSPQTVDMLITFNGDGGMMVLGTVMMLTIYAPAGSYLHKQALRWGFLGLGALSLMDGLLTWWKSKKDFNAIPFGRMEGVGLSDASKLVGMPHNWGEHQLIGRYLTVATVCFAVVAGVYVVQFVRGRARLAAR

SEQ ID NO: 10517 - protein, 419 aa, Myxococcus xanthus
MSTGQLFLPDGGAPPAWGTQARITDACLAEAGLSVAQARERLPLMVASKFAENFFPGSANQAFPFDGSPAWLGAPGDTNVWYDVKVNQPEYDYIVDAGLYNAANQLALVDSGVPVVLPQGAYQPAPGSVGAIELKSAWMEVPNPSDARWNTYKLSPAVVVDPSTQRCRTATVALVGLHIIHATQSQPSIIWATFEHEANAPDQGTDAGTGAWNFFDAACSPRTLTVPANCAADGKSTEVTVGCEPNVPPPYHIGGGCPGPVPIQVTRLTPIDPMAQRVNQLVQQNIAMHFPDSVWKHYVLVNVLWSTNPSPSPTKPVKAPLPFAAPTPSGSVAIANTTMETYIQRTADFGQGPQASNCIVCHRNATLAGKTGIASDFSFVFGLAQGLPPSQAPSLKSMRLTPSQKAAVAHPPTMRRIIQ

SEQ ID NO: 10518 - protein, 324 aa, Myxococcus xanthus
MHLTSTPNTLQTEIGLASAATVPRPVGNSNPQTLICCAQYGQPARNSDPHIGLSVNQLVAPPNPQRPSNKATLANPPGLYIQMPDFSGYQTPDQTNAAEFWTIVRGTSSLTDPDGRPMPGNYILHATFRVPPNKRYTVSDITINGQKIRWAGQVAQTFLMQITGMGLAQPSRAPVQDCVGVPSTELAQPLQLFHSSVFSALAGTNVPNFMGVPMNLASNSTLIAPTVRAGDTNVPMLLTALLPDISALPTVAVDGGGITVQVQDMKSVDYAVPGNTYPGPVAAIRILVSVQADAAPGPRGVFVTGAGQTKTPTPFPSALHVASR

SEQ ID NO: 10519 - protein, 562 aa, Myxococcus xanthus
MTTTNETQGLNFLQEIIEEDQRTGKYAGRVHTRFPPEPNGYLHIGHAKSICLNFGLAQQYGGKCNLRFDDTNPVTEDTDYVEAIQRDVKWLGFEWEDRKFFASDYFPKLYDFAVQLIKQGKAYVCSLSPEEIREYRGDFTTPGRNSPYRERSVEENLDLFHRMRAGEFSDGQHTLRAKIDMASPNPVLRDPPIYRIRHAHHHRTGDAWPIYPLYDFAHCLSDAIEGITHSICTLEFENRRVLYDWIVDNLVSGDRPYQYEFNRLNLNYTVMSKRKLLKLVTEGFVAGWDDPRMMTITGLRRRGFTPASIRDFATRVGVGKAQQLIDMSLLELCIREDLNETAPRAMAVMRPLKVVLENYPEGQTELLEVQNHPQKPEMGTRQVPFMRELYIEADDFMEDPPKGFFRLAPGKEVRLRSAYFIKCEQVIKDAAGNVVELRCSYDPATRGGNAPDGRKVKGTLHWVPGNAPVAEVRLYDRLFSVEAPDADDSKDFTTFLNPTSLQTLRDARVEPMLVDAAVESRYQFERTGYFYVDPKDSKPGKPVFNRTVTLKDSWTKEQAKGK

SEQ ID NO: 10520 - protein, 336 aa, Myxococcus xanthus
MFFHHRPHPKSQSDRIPQRTEVVWGTDAFEYRRGMLPRFFWRLVREARDVDVIVAGQEGRAALLACLAGRLLRKPVVGMIHFDWGAFHLEQPRRQLWGLRWLYPRMSRIVACGHDSAKAFRDLVPVRPEQLHVIPNFVDGDRVRAAGEHPLPAWAEPIFRKPVVIAVGRLEHQKAFDVLIRSHALMRQAGVDQHLLILGEGSLEAELKALVKSLGVEDSVFLPGFAPNPHALMRRAAAFALSSRFEGLPMVLLEALALGCPVVSTDCPSGPAEVLEHGKHGVLVPMEQPQALADALARIVQDDVHRADLSARARRRSEELSADRALKAWESLLSSL

SEQ ID NO: 10521 - protein, 249 aa, Myxococcus xanthus
MAFLLAHEVESPRACSYLPEREASLENLVLEDVTPEEYEHLLVRGWRRFGLVYFRPACVGCNACVSLRIPVEGFRPNRSQRRARAACAHLRVEVGPPRVDDARLALYRQWHSEREAVREWEPSPITAREYSLQFSYPHPSAREVAWYDDGAEGGPRLVGVGICDETPRAWSAVYFFYDPAYAHLSLGTANVLHQVELAKARGIPHVYLGYRVLACASLRYKGAFRPHELLEERPALDAAPQWVAPPEEA

SEQ ID NO: 10522 - protein, 524 aa, Myxococcus xanthus
MPHRVTFAVDAVKPAVLPLEEVGLTEALSGRLDAKVLGASHREARFVRPEATHPLLSAVHLAFSGHRPLVLSPDILWITIAQGLALHITRNAEALRFDLVRHQGRKQLVVTRDASQTDLASDDFWPGVVDDFSGMIQGHSPALHDLMVCDFSTTGPVERVVSQIVLMDAMREYFDYVVMCICGIPTITLEGSPEDWRKLRDKVGQLPRYGMETWARHLLPLCDQFIRASEGREDRKFWQSIYKLHHAYGSDTFNGWIGKLFPFLRNQLTGEYDFPNPMLEAQALGKPDATEKGETLSSDRLPTGLSRVSLLLAVATDSGMVKARMALTAGFMGTLQSAETLALRPVPGWVVHEDLGLDAMLRRIKDEHRMADALSEARHSKWRDLWGECGIPADISQFYAACDGASLFGQGDAAVYRIRASGALEFHDGTRWNKTRLADPQSSGYPHGWTRFCDVGEHGFLAYRFNSQQHGKLPLYWVESAQSRTGVCVAASLTEFLHKALNSQGRVYFQEPGFTPGEVEELWF

SEQ ID NO: 10523 - protein, 423 aa, Myxococcus xanthus
MEGRPSVLLFSAGFYGTLAAARCFGRNGIDVTVADPGKLGPASWSRFVGRRVQCPPESQAEAFVEWLMDLGRREPMRHVLYPTSDELAWLVSVHREALSEYFHLYDPGIDAVYGLLNKRKLFEAGQAAGLKLPRTWFPESEADLNVVSREARFPVLIKPTTQILYSTHRKGQPVQAPEQLAEEYRAFSRDGYAPMLVRFDPAVSRPMVQEFHPEAAEGIYSLSGFVDETGELFEVRGAMKVLQRPRRLGVGVCFESAPVREELAAGLQRLCKRLGYHGVFEVEFIQTKDDFLLIDFNPRYYGQMGFDIARGLPLPLLAYHAALGDRDALRRELRAARDWRGNGEVFCNRIALEMLLNLQRLSGALPEDEARQWRSWLASHRDVAVDPLIDSDDLMPTAVEVAQILYGSARHPRAFIRMMVLNR

SEQ ID NO: 10524 - protein, 157 aa, Myxococcus xanthus
MNLLRQGAPERVPEVHRTLTRYLLPSGLLVEGSADATGAVMAAHLLRRGVGEGAELPLREALLFHTDFSLGFAPMLFRDWLPRDLRRRVRPGEPIHDFFSAWSAAWQQARTLGHTHPPDAFREAALGLSARMEGVATDPWLLSQGYVVWRPKGGVCF

SEQ ID NO: 10525 - protein, 114 aa, Myxococcus xanthus
RLMAGPEEALRYGALLGARYVVPCADGGAPWYWREGMGPRYAGYPGEPVSGASHLDENPDADPYPERLAEVRRTMKDVPSPLVLRPGESLRWKGARTPEVVRHPGFVWPFGDAA

SEQ ID NO: 10526 - protein, 367 aa, Myxococcus xanthus
MAVQAGPRVQVPHSHPGRRPDGSSFLPRPTGGGSALPMSPSPLRIVTYNVRYFGHMLRGLASTVGPKRRVAAALASLDPLPDVVCLQEVETSSLRSNIADRPKQPGETQLTAFMGRMVETFDRLGREMPYEAFYFRAHHYKLREVSLYTTGLAVLVNTRKLEVATHNVGAPQAITHHHVQRLKDRKQSRICAHMRLLRREDRHPFHIFNTHLSLPTPFAREFWATRDKMGGGVNQLHEARKLTEFMQGLTGDEPYIVCGDFNSPPASPVYRYLTTDGRLTCAQAAVGQIDPNVSRGFPTAGFLHMRMHLDHVFSGAGVRWLDTQETSPFGDLRSRFHGLSDHMPIVARFALDSGKTLITPPPTSLLL

SEQ ID NO: 10527 - protein, 681 aa, Myxococcus xanthus
MAQPHAPYLVTLVVGEFEEATDTAGTVPLRYLFPKGRKEDALRCVRRTPEMVRVFQEVTGEPYPWSSYAQVFVTEFILGGMENTSATSLTDTVLHDARAQPDYNAEPLISHELAHQWFGDLLTCRDWPHGWLNEGFATWLEMLWKERADGQDEADQHRLVDLEAYLGEARERYARPIVARRFHAPMDVFDRHLYEKGGLVLHELRRRLGDDLFFKGLRHYVARHRHGSVETVDLARAFEDATGHNLDAFFDQYIFAPGHPELKVDVRYDAEEARLRLQVRQTQSTADGVPLFRLPLDVALTVDGRDTVHRLEVTDAEHAFHLPCPSAPSQVRVDPRRGVLGTLTVDKSAGLWMDELRAAPEMRARTEAAVALGRDGSPRAVDALGTALADARLFWGTRAACAKSLGRIRTPDSRARLLDALSTEHPRVRRAVVASLGEFRRDAEVTARLRALVNGGDTSYFVEAEAARSYGRVRAPDALGVLEAASTRPSYQDVIAVGAVDGLAESQDPAAFSVVLARTAYGHAAPLRRAATLAVAKLAEVAGRKREAVDLLAELLRDPLFRVRMGVFEAARTLGDSRLVPALEQTPLLDAVARRAARETVRFLREGEPQVREVASLREEVDRLKEETRALRERLEGLSLKPPEPPRPPRGGAKPARKQVTARTKTAARKAGGRKRKATRR

SEQ ID NO: 10528 - protein, 420 aa, Myxococcus xanthus
MVELTVGASGKGRDERIVLNFRRLHEVVDTLAEPVERTLHGLESESVPGDALFRTVVEHAPMGIIYFDRSAIVIACNELFVSIIGSPKRLLVGLNLLSLRDEGILHCVRETLAGHTCEYEGEYRAITSGRKTPVHVRFAPCFNAAGQVEGGIGIVEDISERRRAERERERLYREAQEAIRVRDDFLSIASHELKTPLTPLSLRLATLERRLARGELVESSTLRQARLYLLRITSLINDLLDSSRIEAGRLALHREATRLEGLVEHVLHELEPQRGNHTVRFDAPEQPVQVNVDPFRMEQVLANLVENAFKYSPNGGTVRVSLRQRGGLALLSVSDEGIGIPPDQQKLLFDRYFRARNASAHSFGGLGLGLYISRDIVERHGGRIWVESEPGHGSTFHVALPLMAGAPAQPNVEEPGQLIH

SEQ ID NO: 10529 - protein, 184 aa, Myxococcus xanthus
MASAEEILSFWFGQPRERWFLRDEAFDDECRRRFLPAVERAAEGELDDWRDEPRSCVALLLLLDQFPRNLFRGTPQAFASDARAREVARHGLARGLDMALPPLWRWFMYLPFEHSESVNDQRLSVALFEVLALYHSDSRAALDYARQHRDVIQRFGRFPHRNVTLGRPTTPEETVFLQEPGSSF

SEQ ID NO: 10530 - protein, 765 aa, Myxococcus xanthus
MLGVAVLATTLAAVCLHFDAKLGGLLEEAERTAYDTVVTRFTARREVSSQVVLVTIDQPSLERIRANEQYALNFGSWPYSRNLWARVVEQLEAEGARAIVFDAVMDERGTDESMDLAFAQVLQETSIPFYLGVSTHANAPLLPPADFGAAVAVDRPTQEEDTFPEEAGAETFEDGALEAVLPSASPEQLARAIAFPVRANGRTLPALDYATSSGERLPSHPVPPIPVLVGAVDGFGLVEPESDADGFMRRTRFVYSDGPNAFATLPVRVAAGLLGASAIEFSGRTLRLGSRTYAVDADGSAGIDFGGQLHDRFTSVPLISVLDAWVHRGQGQPTGLPPDVFRGKVVIIGGNAVGLNDVKATSFSSHEPGVVKQAAVLDTLLGNGRFITRAPLGVSLALVFAVAFVSVVLLMTTRWTPLEIAWPLGLYAGMSWVTGPALGLTNTYVLTALPALAGVLASVSAVAFNHLVANEEAAFIRQAFSRFMEPKLVEQMIAQRELPRLDGENVEITAFFSDIRGFSTFSERFKDDPRNLVRLLNTYLTRVSAALLKEGGCLDKYIGDAVVCLFGAPMRQADHALRGCKGALAAKAAVDRLRDEFRAQGLPDMYTRIGVNTAVNFVGNFGSEQLFSYTAIGDGMNLAARLEGANKAYGSVIMIGPRTYELAREHIEVRELDRVRVAGKTEAVTVYELLALKGGLDARKRKTVERYHAALALYRAARFEEAAAVLNARRAEDPEDGPTQALLERCQRYVKAPPQDFDGVANLDK

SEQ ID NO: 10531 - protein, 190 aa, Myxococcus xanthus
MKTRVAWTTALLALAIPAGASAVKVGEPLYVKAKNTRVQVSPSGSDNAVAVLQPGERVTWGGADAKHKQWHRVTTATGKKGFVFQTNLSTTPPNMELVTQGNGTQQVDPKKFVASGAAVKALSPGAEQYGKDKGGDHGKAVQDIKALEALAKSVSTADIAAHVTAAGLFPVVGASDTVAKAGTNKRSGNR

SEQ ID NO: 10532 - protein, 328 aa, Myxococcus xanthus
MMRTGWKVLALVGLGALTASCKGFNASSLTRGENILGKLSAASAEAKTCKKLRAAPSVQEEYALGGALAINFVRRGGGLLLDGPNDALHRYVNVVGKNLAAQSARPTLEWTFGVLQDTSQFNAMSAPGGYVFVTRKLLQGLENEGQLAGVLAHEIAHVTLKHAIHQYGDAKVKTCELVTYGEAVLSPTAVKVLSAGRNGDGTLDLDQDPGLLGHLSEKTIDLIDKGNAKEQELEADRIAVELMLSAGYTPDDYLALLAKTKDGGSTFANHPGKDERRRNILAHVQALKQPAGAFSGLATEGLRSPPLSPAFAAVRGGNNPRGVAKDGK

SEQ ID NO: 10533 - protein, 545 aa, Myxococcus xanthus
MHENGVSEKVRRTVMVYANGRVTQVLHYNGAGERVVPSTGEPYPTRPANLPEKAEYREDQDQWASVSLNAKAERHGLCRFWDREGQLLWECEFHEGSRHGRYHSRAVDEYADPRVRFDEGEMEDDFACGTWKLLDAEGNAVVTRDLGVVQDHETLDASEVFSNLPRSAAEWRAFAEQARADRRYREALLAMARASAVSLDAGPLKAWLESLTLPRTEASARENAEGVMNSAGDERAALADAMMRGAEAAMLLRGFAVLHDQQDRPRAALDFILAAMLLAPERSAYLFTRSLILANLGLGEQMQKDAEALAPAEPDSWKFLSAYRRVLFPRFEFWPGREPAHCTFDEVPDGPTKELDAVQAVVRKYATRLQLLRAEILSRFKPGTNVPWLPPDVSSLLPDGPVELEQTEVEDADGDSVDVDETLSTKGMGIPALSRAARGDWSALTWLLWACGVDSIRMPDALTPPADFGQAAGQATQRLWQCRNRRSRGRIDPDLPTFDFEGVALQELHPNLAGIAEEQYAETQAMFFWLTDANHVSPWQANLRG

SEQ ID NO: 10534 - protein, 50 aa, Myxococcus xanthus
MAGVEGAPTLAEDPPEYRERPEVRRLLRTVRKLDAPRLRLLGQVANALET

SEQ ID NO: 10535 - protein, 256 aa, Myxococcus xanthus
MCLLGWAICFWNYAVLHNHMHVSIARPPLAHWVVSRSLGMACGFPYRGYFIHHFNHHRYDDGPGDWGRRRPGERVFRYCLRSALTPWLWPYETLGQVWQWAKKKNQRLELAVDFLVVDGALLALIVWKPALGLALWGVLLVTQFCIHWLNLAAHFETDSEQKDALGTTSYSAFYNRWFFNAGYHQAHHLKPQVPWYELPALTEELARTSRLRPELTTGLSPINPLWVARVVKRYSAKPCDRQTESKITAGTPTAVT

SEQ ID NO: 10536 - protein, 225 aa, Myxococcus xanthus
MAFAALVKYMQPREKDFSTSVLKQALVRPEGVVGAVVGGFYTLLSGAYPSRAFTAPDTALQWLGQPEAEAAALLAELNGLVAEATGQSPLLRELHQVMRGRLPEVNLSDVAREMGMSERTLQRRLKEASTSFQAELNAVQVRMAQSLLRESNMKLTAVAVEVGCASLQHFSSLFRKLVGESPSAWRDRQKQPQGDGTPPPAEALMEEVAGAPGKGPVAATSEVPE

SEQ ID NO: 10537 - protein, 226 aa, Myxococcus xanthus
MRPPEVREPFATLERLHGDVLSQVLVADEGTSDGMWRDPLGDLGDRLHPGSRDDAYAASTGYLLLRDGRPAAVVRKQGTPFEDLWFLQEALSRLTPRVPPPDPAQRPGRRRAEPAPRSPPRPASGGTNARATGTRERTGWDDEATPPRGTRVPPPEPPRKDPWTVLGIAPGTPLDVARKAFRALVVQYHPDKVAHLAPEFHALAELRTREILDAWEEVERALSGGA

SEQ ID NO: 10538 - protein, 170 aa, Myxococcus xanthus
MPDPVRRTALNPTLRKESVVALGVFGALTLGAAALGARVSSADTRWYRRLHKPSFQPPPKVFGPVWTVLYGLIALSGWRVWTAPAGAARSQALAWWGIQMGCNAAWSWLFFGRHQPRRALADNLALLASVTAYVAVTKDVDRPAAWMVVPYLGWVGFANVLNAEIVRLNP

SEQ ID NO: 10539 - protein, 333 aa, Myxococcus xanthus
MDAALREPDDAPVYEEPPPEPEAVADVPVTYGAPPEAEALLDTEPHAGPVTFAAPPPALHFDAVSPPPEAHPMTQASAPVSMPHVTATVAEPVARVEAPPTEVEVQRPAPPREDGQDSSARRERLKARLKAVRENPRPEPLPATVAEAGQRAVERITHLQAELVKVKALNLSLTQDLEVSRRQAEKATEEARLRMDEARRLSSEMEGRVKLLADLERELSALEGERDEALLSLQETRQALQAAAKEREALEEEVARGKQSLVDSLAEEERLAGELESAKDESTSLHRAVEALQGERDVLAQQVASLTAERAELLEARKALESVHRALSQATVR

SEQ ID NO: 10540 - protein, 319 aa, Myxococcus xanthus
MEAPTYSSKQVAEMLGVSPKQIPEESRKDAYTPDDIWELRTTLDRFPARLGHRRQLFLNFKGGTGKTSLSTSYAWRLAELGYAVLLIDLDSQGHATKCLGYEGEDFEKTLLDVLVRKTPLAKVIQKSSLPNLDFVPSNLTMSTVDLALMPMAGREFKLRNALKDVEAQYDVVVFDAPPSFGLLNLNALMAANDLFVPVLADFLSFHGLKLLFETVQSLEEDLNHVLDHVFIVVNSFNATFKLAKEALEALQTHYPEFLLPTIIRQCTKFAQASSEGRPVFVADPSSKGANDIQAMIDNILPRLVAAAAVAQTKGTQQAG

SEQ ID NO: 10541 - protein, 645 aa, Myxococcus xanthus
MEHLKREVAETHQRELGLRREVAELEVRVGRLQAEREELARLNQALRGERNQMMDKLLDVGRIRATAQERDDEDDDLGLDLASFISQLRSEVLLRGEAGPVARGLVVPTRRSPVPLRETAASVPVTPAPVSEPPVAAVVGGDGLSPVAREAQRFLQAGRLGVSAAQHAELSSHAGFGGPTDETLFGFSIRELSAQDGAARVRAAERLKALSQPAAAPALASALHAETDPTAQVALLQAFASLCQEEGASVVSPLLASPVPEVRIAALKALLTLAPKDAAPHLAQAMKDPDRSVRRRASLLALGLEGETARRLGEEAIHDADPEARALAALALGAGAGENARTLLLGALGDREQRVRKAAAQSLSRILGQDVSSVVDLDETHRRREIRRLATLPVKPVRARLEQPRPVVASVQAVAPAVAVAAVVQAPVAAVEQPAHAVAAVGAANRQAVTVGLAQGAGPVGPVQGRAGPVGAPVAPTPAPTPQAVAPVQRPPAPTPQAATPVQRSPAPPPQAAAPVQRPPAPAPQVTPSHSSPAQAPRAPAARLSPVQAALVAMGAVPGQAAPAPRVPAAAAGPSRPAAPSRPSASPVESLCSQMLAEVRVAVRGRSLVELAVALSAPSELAQEALTLLSARGAVIRRGHKYFAA

SEQ ID NO: 10542 - protein, 747 aa, Myxococcus xanthus
MDIRTQSALLASIIGLALGVSMLLRPGRPRVLTLYSVFALTVAGYYLSLFFHSVFPAGDYPWTSRIFVGATILVGSLVPGAAVAFFLEFLGVSKGTNLVGRRLALLSAVLGLTVAVTPLADKLWARVGMGVWVLGTLLTYGSLLLHRVRTTESRIEKFRLAYLASGAGAAILFSALDFLVSFGIPFPTLGSVFSTLYLFFLAHTLLRLRLMDLHELLGKIASQTVLASILAAVFTVLTAWGKENTGLFLFNTVVAAFVILILLEPLKVKVEEMVVRIFFRERFALLDSLGALRVRIANVIEISELARLVLDTLHETGRVTHASVYLLAEDRPGYRLLDSRGPLPVAFLDTAVARGLLFAAASGQKAVLRENVERRMATMRLQAVEGKRYRDELKRLNDTRTALVQVKAGIAVPLMGNDRVIGFLNLWDERVPEAFASDEIAIILEVAERLATVLENSKLYEKIRERDRLAALGEMAAGLAHEIRNPLGAIKGAAQCLDPVHYQGEDAEFLEVIVEEVNRLNGVVTAFLDYARPLKQSFGTTDLNEVVTRTMRLIQNDVPSNLHLAVELDLMLPRVDGDAEQLKQVLINLVQNAVQALETREGRISVRTEKPERFGELRSAGAEFVEVRVSDNGPGIPSDQHPHIFVPFYTTKQKGTGLGLAICQRIVKNHGGSISVQSKMGEGTTFVIRLPALPTEQPPAEASSVDGLPAGKRPSQSLPVSDELRDAGKPSHVDGRAKRERRKRLRA

SEQ ID NO: 10543 - protein, 120 aa, Myxococcus xanthus
MEVCSGCAGVALDEGELQQLQDAVETYRDEPLDARATVRLEGPPCCTACRRKLRLEHGFVAEERLYCGSCAPSGATPYRETFSSHDIPMFVPTRRGGQTFNLAGYASEGLMWLLHRMLTR

SEQ ID NO: 10544 - protein, 311 aa, Myxococcus xanthus
MQEILAEVEASVLPSEGLAAQSDDADDDGSDDSDDEESDDADDDESDDSDDEESDDADDDESDDSDDEESDDADDEDSEESSDEDSEDDASDEDAEESSDEDSEDDASDEDAEEEDSEDDSESEEAASDDEAEVPAGSGVKGDVSSDDIAAELAALGIEDEPAEAAKVEAPVATPITARPLVARPVPKIRPPDEAATILEDQSAETTNIVKAPAPLEVFVQWAQGAPVAVSTERFTIGRGPRCSLVVKSERVSREHAVVTRVGDEVFIEDLNSSNGTWFNNERITRQQVSDGDEYMLGTEAVSFTMRPAGG

SEQ ID NO: 10545 - protein, 520 aa, Myxococcus xanthus
MGMVFRATQTSVQRPVAVKTLNPSLAAAPQFFERFRREAELASRLRHPNVITIFDFGRSPDGTCYYVMELLEGESLKETVKRQGPMSLRRALSLVEQASQGLAHAHAEGCVHRDLKPHNIMVQQLSGQDFVKVLDFGLVKAMESEEEEQLTSTGQVLGTPQYMPPEQAGGESVDQRSDLYSMAGVLYFCLTGSSPFGANTVRKALTASLTQAVPAVNTKRQGAPVPAALDAFFKKALAPEKEDRYQNAQEFIDAMLDTVADLTSEELDAMPSGGVPSASERGSNSRSRSSRQGSQSGIRSSRVGAAPSLGRGATPFNVVVARPQGGASGSSSFSSRVRSQTSRSAPPPPPPPPEPEGMSTGKKVALVAVPLVLLGIGAAVVLGKPGGSAPATPVVVNVPRDAPPATTQTATGTTGTPEEASVLTVSLDSTPSGASIYEGEEMVGTTPTKLQLRRDKVHSFSFRLPGHQDKELTLNLRRVAGDTQSANVVLEPVRAAAPGRSPRPPPKPASPSGPDISVFE

SEQ ID NO: 10546 - protein, 161 aa, Myxococcus xanthus
MAEVTLDLRGMPKAEAYAELKQHVRAVLEGIDDDITGMATMSCLLHHAFGHLWTGFYRVVTPGRLLRVGPYQGTLGCLEIPFGKGVCGASAAKGESVVVADVHAFPGHITCDGRSASEIVVPVFGRNRELLAVLDIDSEHKNAFDEVDRRELEELVRWFQR

SEQ ID NO: 10547 - protein, 163 aa, Myxococcus xanthus
VVHPGAGHASGTLVNALLHRVKDLAGVGGELRPGIVHRLDKDTTGCLVVAKNEQALVALQKAFKTRAVEKTYLALVHGVPPAEGRIETLYGRHPIHRQRFTGKVKEGKNAITEYRVLETFDGAALVEVDLLTGRTHQIRVHLSEAGHPLLCDALYGAGRKALE

SEQ ID NO: 10548 - protein, 87 aa, Myxococcus xanthus
MTDEEKVKAMRLARAIASDISLYNEQKIIKGIEQDNLFEVLKEELEEGRELYKSRVSQEIFTKMNFFERAINDIVLRSKAHVKSKIW

SEQ ID NO: 10549 - protein, 53 aa, Myxococcus xanthus
MHLENVEADRYNLLPPSVYLRGILMSLARELGLDPLRVSKSYLALSSEKSGRK

SEQ ID NO: 10550 - protein, 287 aa, Myxococcus xanthus
MVSANLGVALAQSGANVLLVDVDLGGANLHTCLGVGQPNATLSDFLRRNKAQLEEVIVPTGVPRLSLIAGAQDALDAANLKYAQKQKLLRTLMGTSADYLILDLGAGTSFNTIDFFILADHGVLVMLPEPTSVENAYRFAKAAFFRKLQQVESQYGIEDLVDDALTTREGALRTLHDVLAQARRKDPAIADRLERELSAFRIRLIVNQARTDADLSVGTSVAAAWKKFFGIEMDVLGAIRYDDEAWRAVRKRKPVLIERPDSAAATAILGIATRILTLDGSPQRSTP

SEQ ID NO: 10551 - protein, 197 aa, Myxococcus xanthus
MINSAVLVLNRYYQPVHVTSVKRAFSLLYLGVAKAIDSQYRLYEFADWAELSATQDCITTIERTIRVPRVLVLSAYDHLPRGRVRFSRLNIYARDNDTCQYCGKNLPRSELNLDHVMPRTQGGKTTWENVVCSCVPCNLRKGGRTPEQAHMKLLKKPVRPRWTPLFRGATRKVTYQEWLPFLHLADASYWNVELLDE

SEQ ID NO: 10552 - protein, 465 aa, Myxococcus xanthus
MGAPSNSGDGGKNALLRALPSVEQLLRRPSLEPLLSGVPRARAVAALRLAVDRARGRLVASGGPGFEDADVQHALDTLATPGLRPVLNATGVVLHTNLGRAPLAASTVARVAEVARGYSNLEYDLDEGERGSRYAPLVGLLRSLTGAEDAVVVNNCAGAVLLVLAALASGRECVVSRGELVEIGGGFRVPEVMRQSGAKLVEVGTTNRTRLSDYSAALGPESALLVKVHRSNFALVGFTEEVEVAELSALGRARGVPVFQDLGAGALVPLKGEGLSRELTVAQAVAAGADVVAFSGDKLLGGPQAGVVVGRSVLLARIKAHPLMRALRVDKLTVAALEATLALYRDGRAEEVPVHRLLAQSPEDLRARAVRLQGLLAGQGVRARVASVEGQVGGGAMPLARLPSSACILTLGTPEEFLERLRGGMSPVIGRIADGEVLLDVRCLEEEELQAVADAVAAAIPGNPP

SEQ ID NO: 10553 - protein, 49 aa, Myxococcus xanthus
MQDGGGEDLFCHHTAIQTQGFRTLQEGQKVEFDVARGPKGLQAQNVRPV

SEQ ID NO: 10554 - protein, 557 aa, Myxococcus xanthus
MAIADIAAEKKDKAAERAALWRLWAAHPLSALSKQAEKRLKGQTPPVDARVGRGEALVELHRNKAGLEQLEPLLPKLALPDPLACRAHFAFGKGMRKERQHTRAIQVLTPVAEKCQDRDLLARVLYVLGSSRSIVDQARGTETYERLAREFPDHSFADDGLFYAADLYLKTGRPKEAMARLDTLARLYPQGDFLGEALFKAFWIARTTGVEDSGLSFLDRIEAQFAKADESYDVERARYWRARTMQEKGNIQGAAELFEKLSVDHPATYYGLMARSQLAKVDPPRLEKVSAEIFAVPEAASPWPLFAGPMGEDPHFRAGVELYRLGFKEAVSSEMLAVNRTNLPAESVRLLVLVLHEAGDERSAHAVARLALRKDLSGRITPETRVVWEVAYPNAFRDSIEKHTADAGVEPDLLQALMREESALDPKALSWAGAMGLTQLMPSTAKGVARELKLKRFSVDQLLQPDLNIRMGAHYLGGLLKRFNGHTPYAVGSYNAGPGAVNRWRSDRPDLALDAWVEEIPISETRGYIKRVLRSFNTYQLLYGRAPKLPVLKSAAK

SEQ ID NO: 10555 - protein, 199 aa, Myxococcus xanthus
VFYASGYYVSLNAGRRELTTLLAANQLSIEHRFFLPSRPEPADWSQLTIKQSADDFHRVAQAIKQIYSASWVSTGVSKGGETMVFYRRFHPEDVDATVAYVAPLVRGEDERFPAFQATVGGPQLEGCREQIHTFQRAVLNRRQEMVALLRAYAVNQGLTYNHLGFERALEHAVIETYFAFWQYSLPQYCDAFPDDTASA

SEQ ID NO: 10556 - protein, 612 aa, Myxococcus xanthus
MKILAGVSQADSGTVQYSRKARAGYLPQEIAGLPDGTVVEAVMSTVPGRDAMEARLKETEAALAAATDEEDQLELSQSLADLHAELDDFENRYGRHHAERILKGLGFRDTDLAKPTSALSGGWRMRAALAGLLLQDPDLLLLDEPTNHLDVPTLTWFDDFMRRSNKALVLISHDKDFLNRQINRVVSLEVEGVREYAGNYDEYKRLRAEEKELLRARAEKVESRRAELQGFIDRFGAKATKARQAQSRAKMLEKLEKVQVLEERTSMKFRFPEVERSGRDVVTLEGITKRYGAQTIYDGLTGRVERGQRIAVVGANGAGKTTLLKMVAGELAPDTGTVTLGHNVVVGYYAQHHADKLNRQNTIIEEVRPLAADKPESYVRGVLGAFLFSGDEVQKPIGVLSGGERARVALPKLLLVPSNFLLMDEPTNHLDLDSAEMLIEALKGYGGTLLFVSHSRSFINGLASHVWEVADGKLTPHPGNLDDYLYHQQKLQQAAAEASALAAGQARGEKVASGPMTDKDRKRLEAEARQRRSVVEGPLKKEIAKLEARIAEVEAGQKEREAQLADPALYNDFARAKPLMDTHRASKEELEDLYARWEAAQEKLAEASASLG

SEQ ID NO: 10557 - protein, 133 aa, Myxococcus xanthus
MHGNLFKTRCSRCGRPPFEDATVYPAGAVPECDACGKLLRPHIVWFGEYLDPADIQRIEDFSLRAATSGGRFVFLAAGTSGAVYPAAGIVDQVRKAGGKTWLVNLDPAENSNRFEHRIVDKSGEVLPTLAKLA

SEQ ID NO: 10558 - protein, 128 aa, Myxococcus xanthus
PVIGVGTDELPSFYSGGSGIPLEHRADDVDTAARIARARFESLKQGGVLYTVPPPEETSLPRNEVELHIAATLADADRQGIRGKAVTPFLLSEMAKRTGGKTLKANLALLTNNARFAGQLAVAYARAS

SEQ ID NO: 10559 - protein, 68 aa, Myxococcus xanthus
MLETGERMFRGASSRLDEQSVEAFLDRTGQFVRQRPGLLLTGLLGAGLLAGRMFRASGAGDVEGEAES

SEQ ID NO: 10560 - protein, 96 aa, Myxococcus xanthus
MRQHPVGAGLGVLALGFLSASLLPASALERRAYTRVAGKARDLADRVDASGRLEDVLATVRQMAADAAAEQLASLRPEPEEGPTRRKLERVDRKGG

SEQ ID NO: 10561 - protein, 227 aa, Myxococcus xanthus
MLGAAEWRRKGLAVPGLTGLLHPHYGVYLPTRTDYVELLNSVTEVKGKRVFDIGTGTGVLSFILLQRGAASVQATDCDSRAVACSQENAERLGLGKRFQVAEADLFPKGTADLVVCNPPWIPEPPKNRVDRAVFDEDSQFLRRFLEGLSASLAPGGVGLLLLSDLAVLLGLRPPGWLEAEFERCGLSVQWARSTPARHSKAKDASDPLHMARSRERTTLYCLKPVSP

SEQ ID NO: 10562 - protein, 508 aa, Myxococcus xanthus
MCGLFIPRTASAQAVVVSGPPVAPLPEMTGAGLCVATSVSQNPAADFPQAQSTYIAGINAFMEANRGNRVTSVLRTPLDLSNNLNDGRTLSYGDFTGAVAGCPVGGCDFGYSDAVTSFATRLRGFIAVTSDMVDRPLHFGFYADDSVSLALFDRDQTSYPVINRPLTLGFPTWRATNTVHFAQPGLYGVEVLHTNVGEHAALEMSVYDGVFTDFERAATMPPIINLATEGFVLVTPGMFHQTESGQPSFPTPTECAQCNRQFANAPGNGGCETGYRCNAAALCAPCDSSLFCGESCAPCGASTPYCVSQTEGFVCAQCQDANDCVAPDECHLPICTETGNCASTPVEDGTECTGGTCQQGECRPVDAGTPDAGEADGGEADGGAADAGPSDGGATDAGAADAGEADAGPSDGGATDAGVTDAGATDAGGPGEVDGGSNPGVDGGSTDTDGGNPTADSGVPAGDAGSLAGGSPEDPSEPESGCGCQGGPSALFPMALLALSLVVRRGRR

SEQ ID NO: 10563 - protein, 330 aa, Myxococcus xanthus
MLPSLSRSGLPIWTLVLAMLLCGTANAQFTGKRRAYASSFWGGTGASGKTISWSALYVALPLDYGYNAANNTIVNLAGVTAAQSDLRTSSTRSLKWGTQIRITNRHPGHAGYGRSVLTTLQDSGPADSILSDAALGGRAASPYKPLGCWIDVTPGVKQALGSTKPETENLIVDFEVVNDLGSSLDLDSNPNLAFGMAASASDSENTGISAPIAAVDGNGAYHLENYRSAWRSAYHANTSDTVWLNVNLGRAEAVRRVVVKWGSFVPPGYTLMGWTPGMSSWVTLATRTGAGGGTHVHSFTSDQTYQYFGLSMSGATRYDVKELEVYRWDY

SEQ ID NO: 10564 - protein, 234 aa, Myxococcus xanthus
MERRGLARVSVATMGRALATLGASLKAAKPVVGCPWPGWKRRRRLFELRCLEACARSDEPVLYVDEVDIHLNPKVGRDWCLPGQRRVVLTPGNNKKRYLAGALDSKTGRLTWVEGKSKASSLFIQLLWRIAGEYPGAPRIHLILDNASIHSSQKTRKALERLGGGLVLHFLPPYCPDANRIERVWLDLHANVTRNHRCRTLQKLMRRVHAYLHARNAQRRASPILRKVHLRSAA

SEQ ID NO: 10565 - protein, 224 aa, Myxococcus xanthus
MKPEQEKTLHEEVVATVDRLVLKHPELKKELEQVQGYAVFPSLGRASLVLGGSYGHGEVFEKGKPIGFATLSQLTLGVQVGGQTLSELIFFEDRDAIEAFKGGKAAFAANASAVIVKAAASGTINYAKCVAHAYSRGGMLLEASLGGQKFTFIPRSSGASERGNGGLVQRFRRQDASEENGADDTGQRSRLQASQPPPALTTGLTAAALLLTRIIKAQASARHE

SEQ ID NO: 10566 - protein, 404 aa, Myxococcus xanthus
MELLKGQTLKWLLNKDGPLPVERAGAIAHQVANALVVAHQAGVVHRDIKPDNIFLVDTGTEALHVKLLDFGVARLMHEDDATALGTESGAWVGTPSYMAPEQIRCRPVDGRADIYSLGACLYQMVTGQRPIDVADNVALLSAVMHQVPAPLNGVRTDVPDGFSQVVARTLEKDPATRYADSHELAQALEHWIHAASVAAPSAPQPEVASAAPLEPANTAPVPSTPVAAEHVATPHTSSGPQPVLVAAEHVPPPRTRSRLQTLLMVASALAVGLAATGGLVLTASGMTPTEELAHLRVIELPRLTENGAVAPAPRGYADGWVAESIEGRLPALDSCYARNGEDVACRQDTYAVVYSPEGIVLGARMHPPQLIPLAQCINKALRGLSLGKPREAIDGAATVTLRRE

SEQ ID NO: 10567 - protein, 119 aa, Myxococcus xanthus
MSSVENEFRGILNAIKLYQNDRLYNEYDGLCQLIADLAPYFTYNANYPASQYPSQKLPYSSAYFTIALAIYSARWRYFDQIYASAPWPAKREAFRLWVAETHIQSNRIATWRYRDEPLS

SEQ ID NO: 10568 - protein, 153 aa, Myxococcus xanthus
MWGYQHAYINFTGAQNVSDLDDYKFTLFGSSSPGSAKVGDHIESLVTGPQTWLIAIDSFQMFSAQPADWPGASAARNGAITQLAIVEQKALFATISNDLESLVGALINLIPDIGGFLSSLMGIFWPSTTNPNLIWEAISGTSSRPFTSALSHR

SEQ ID NO: 10569 - protein, 421 aa, Myxococcus xanthus
MSKTNAPSGLGSEYHPLDSPQLENPHPFLARARSEEPVFFSPALGAWVVTRHADISAVVADTTRFSSAESITVGAATTPPEVVTALMDGYPLVPSLVDNDPPAHGRFRSLVSKAFTGRRLAEKEPFIRTLVDALIHSFRHERQADLFLRFAHPLSCSIIAEILGIPSSDIHRFRRWSDELSTVLAAHGPIEHQVACAQGVVEFQRYLASTLKEREVSPREDLLSDIVTGAQGMTPPMSMAELVSLLMQVHFAGHETTAGLIVGAVELLLEHPEQLRALRDDPGLIAGAVEEAVRMISPVHAMFRTALEAVEIGGVPIPKGAHIRIVYASANRDEARFHEPERFDIRRPEVKKHLAFGQGLHFCIGAPLARLEARLAVEALLRSLPGLRLVPGQKPGFLRSVTVRRHESLEVAWDVQANQAL

SEQ ID NO: 10570 - protein, 43 aa, Myxococcus xanthus; identical to SEQ ID NO: 10414

SEQ ID NO: 10571 - protein, 279 aa, Myxococcus xanthus
GTDAHNEHILAPFARGEKLGCFGLTEPEAGSDAAAQNTVAVRKGDEYVINGSKNWITNGPKADAIVLMTMTNKEAGHKGITAFMVPTDTPGFIRAEPDKKMGISAAWSCSMFFEDMRVPAKYMLGKEGEGFKIAMSTLDGGRIGIASQALGIARAAYEEAVRYSGERKSFGKPIREHQAIQFMIADMATEIDAARLLVWRAALQKDKGVRHSAESAMAKLYASEMASRVANKALQVHGGMGYSKEMDVERHVRDARITEIYEGTSEIQRIVIAANLLRE

SEQ ID NO: 10572 - protein, 39 aa, Myxococcus xanthus
PFTPDSIRQVVQYHQRRIQECYEDHMAEKDRTVEGRLMI

SEQ ID NO: 10573 - protein, 122 aa, Myxococcus xanthus
IPDRPEALDLGERVIVGYKAGTHRYVAALSVDAIGEVTPLYPEAGASAPVAPGSGQHWLPGGWEFTGSGDERVIVVLSDEPLPQETLVEAARRAFAQADGDVGRMAELEVPGAQTHWVLQKP

SEQ ID NO: 10574 - protein, 120 aa, Myxococcus xanthus
MSRLPGLTRALARVLALTASAADADTLRRFALVAGDDQGGADTRPLRFARDDAGKMHALLLRLGDTRLGFDDLKRWLAEPSSSIRIAILDSCRAGAMTRTKGARRAPDGRGMAVLDVLAG

SEQ ID NO: 10575 - protein, 424 aa, Myxococcus xanthus
MSKPSILEVLKSPRIWLLVAVGFASGLPLWLTGVTLSAWMKDEGVNLKTIGVFGLVSMPYTFKVLWAPLMDRYTLPFLGRRRGWMLVTQVLLMGAIAAMGLVNPKDAPVTMAAMAVLVTFLSASQDIVADAWRTDILTVEERGLGNSTYITGYRLGMLTAGALALTLSDIAGWSQTYFIMGLLMAVGVVATLLAPEPQGSKPPRNLTDAVVKPFVEYFTRKGAVAVILFLVLYKLGDAIAAGMVTPFYKELGFSNTEIGALSKGLGMVSTIAGGLLAGVLMVKLGTRRSLFVFGAAQALTNLMFMGLALVGKNDLMLAATITVDNLCGGLAVTAFAAYLMSLCHKSFSATQYALLSALGTVANRLISASSGYLAEWLGWPTFFAGTVLLAVPALVLLAFLPENAATPSDEPPETAPASPSVSTA

SEQ ID NO: 10576 - protein, 545 aa, Myxococcus xanthus
MAHPLAGKPPPEDFLIDPEKLRAAYFSGRPDVDVPEQRVAFGTSGHRGSSARNSFNEGHILAVTQAICEYRQQQGIDGPLFLGMDTHALSSPAQQTALEVLAANGVQVRFTDGATPTPVISHAILTYNRGRTAGFADGIVITPSHNPPEDGGIKYNPPNGGPADTNVTSVIEKRANALLGAGNEGVQRIPHERARTAPTVKPYDFITPYVEDLGTVIDMEALRGAKLRIGADPLGGSNVAYWEPIATRYGLNLHVVNPTVDPTFRFMPLDHDGKIRMDCSSPHAMANLVRLKDAYDIAFGNDADSDRHGIVTRSLGLMNPNHYLAVAIDYLYRNRPGWKPGTAVGKTLVSSSLIDRVAKDLGRRVVEVPVGFKWFVDGLLDGSLGFGGEESAGASFLRRDGTVWTTDKDGIILDLLSVEILARTGKDPGEHYQSLAAKFGAPHYTRIDQPATAAQKAALKKLSPEAVKATTLAGEPILQRLTRAPGNNADIGGLKVVAENGWFAARPSGTEDVYKIYAESFRDEAHLQDILQEARAIVGEAFAST

SEQ ID NO: 10577 - protein, 878 aa, Myxococcus xanthus
MVYRFKRVDDGLQLERLVVRPDNTARLLARSLASLLTNPVEAARIQTQPCDLLSDKLLLKPTRGALPPERLNALLRVLEPARTVLFDGALVSVTSEPLMPRVTVEDRGENTVLKVEKDPRVTEVVSPGLALCSGTLCPLGEQGLTGPWLEKLPQERAFAPHQMGDLTGKVLPDIARRMPVDVRSQRLPPIDRTLKPRISLELNQLDTGLSVLPTLVYGSPPTVRIDSGRMVYLKGAAPVRDEAAEQMLIHQLRDELNMAPGRRVTVQGKEAVQLADKLRRWRGGLTGDGAAVVTNPNVQLRPVLKVDTGAVTEGVPHVGFSFDFQVEGEDRESPRSVDAAAVMRAWEEGLGLVPLEGGGWAPLPAEWLKSHGQRVADLLSARGRDGRLANHAIPQLTGLCEALEHPSPPGLERLAPLVKGFEKLPEPQLPEDLTATLRAYQLQGVSWLTFLRQAGLGGVLADDMGLGKTLQTICTLGPGTLVVAPTSVLPNWEAEVKRFRPSLKVSVYHGPGRALDESADVTLTTYALMRLDAEVLGAKQWSTVVLDEAQAIKNPDSQVARAAYGLQADFKLALSGTPIENRLEELWSLMHFTNQGLLGGRKDFEERWARPVADNHKGAAERLRARIRPFILRRLKRDVAPELPPRTDAVRHVTLTERERAVYDAIYAATREEVVSQLEAGGSVLKALEALLRLRQAACHPALVPGQQAKTSSKVQALVEALGTAVEDGHKALVFSQWTSMLDLIEPALQEAGIGFIRLDGSTANRGAVAASFQDPKGPPVMLISLKAGATGLNLTAADHVFLVDPWWNPSVEAQAADRAHRIGQQRPVMVYRLVSQGTVEEKILTLQAKKRELFEAALGGGSGATAITRADLMQLLE

SEQ ID NO: 10578 - protein, 78 aa, Myxococcus xanthus
MARVTVEDCLPLVDNRFALVLLGAKRARQLMAGARPILEQSKNKPPVLSLREVATGRVKFDRDVREALSGKYTGDEPK

SEQ ID NO: 10579 - protein, 96 aa, Myxococcus xanthus
MKIRPLQDRLIVKRVAEENKTKGGLFIPDTAKEKPLEGKVIAVGNGKVQEDGKVRPLDIKAGDTILFSKYAGTEIKLDGEEHLILREEDVLGVIEK

SEQ ID NO: 10580 - protein, 115 aa, Myxococcus xanthus
MGTRGPSSLWAGWRHALLALTLVNTKEETPVKPVKIFTTTYCGFCVRAKDLLKRKGVDFEEVDVTGDDDLRAKLVEMSGGQRTVPQIFIGDTHVGGYSDLSRLDTEGRLEPMLQA

SEQ ID NO: 10581 - protein, 134 aa, Myxococcus xanthus
MAGEERQTGTRDEQYNLISVLYHLLKGASTSEAYIRDAEEIGDPELAQFFRDWQEEQRNLAERAKNLLGARMAGVSRAGTGRKRSAQEGRRGAGSVEKQPTNASVASGGNDTTRDAVDEELLETFPASDPPGRY

SEQ ID NO: 10582 - protein, 336 aa, Myxococcus xanthus
MLLMVAILAAACRSTPFQVRGAVPESLGASAVVVQPFGFQWAEPDWRSVELSQRLVNVALAQTGDAALFFGPTELQVARPGEDGGNGLTRAVVATLASYGVRPDGLMVLRPSAEKRIQSGERELIDTEGYTVGQSATEVVMYVGRVEVLHPATHEVVLEVFGEATVNPYADILDEGADPAPELTSLMEALTREALRGLSSHLKPPRAPSPALATSLAWAPWDVLDMAAWMPKDMTDLEAPLRTEAGQDPRSLRMQRLRFANPHADAALLETLARRPGGLYVRAAPEGAKLSAGDLVLTLDGRPALPQTLARARLALVPVEARVQQPSGRIVPLVLP

SEQ ID NO: 10583 - protein, 459 aa, Myxococcus xanthus
MDRPEVTQTTQTEQEGRTTRIPIPEWTVEVVAGPDKGKKVKTQDGLVRVGSDSACDLVLTDATVSRRHLEVERTARGLMLRDTGSRNGTFLDGRQVVQAYLTSGDKVELGKTKLSVKVAPRPTEVDVAGAESFGALVGASEKMRWVFTELRRIAREDMSLLVEGETGTGKELAARAVHQHSARRHGPFKVVDCNLISEEKAERELFGGLRAGDGEDREARGVFEAARGGTLFMDEVGELPLPVQGKLLRVLETREVPSLDGQPVAVDVRVIASTHRNLEEDVRQGRFRADLYFRLAVARVRLPPLRTRRDDLPALAQALAQTLRASITLTPQTLALFEGYEWPGNVRELRNVLERGALMEETGNSSWLDFLAQPSRRAEGQPPTTQVATLVGTLPYHEAKDRVLADFERLYFAEVMKTVGFDMKAAEQRTGLSMQSLYRLLKKNGLRLKDLKNAEGLEK

SEQ ID NO: 10584 - protein, 30 aa, Myxococcus xanthus
MLSALLTTRPQVMECLVYPKHPGAEKSTTV

SEQ ID NO: 10585 - protein, 46 aa, Myxococcus xanthus
MAAKDAENWGDVVTATQKNVDESVKELADAEKMAAQDKAACPKKKF

SEQ ID NO: 10586 - protein, 30 aa, Myxococcus xanthus
TSSHVLDTSLALTLRDALDLILKDVPRVMP

SEQ ID NO: 10587 - protein, 96 aa, Myxococcus xanthus
MAPLGEIRYVYQFRGQRIFKRVHFFLFRYQEGELGPLPGPRIEVDEVRWVPVVQLVPLLGYKGEKAVASRAVRWLRSQGLLPEAPSPVSIAGKEGG

SEQ ID NO: 10588 - protein, 213 aa, Myxococcus xanthus
MIGRVQDHLEAIYGFTCEARAEVFVVDTEAAAQLGGTGRADEELLVHEADDALELALYLSPALLDRLKPYESGPLGYVLDSDLAGYCQLAEGVSHFLYVAHTAAHGRTVSLLELEAQAEVDKFAVCLLHRWGEGVGAWARELLQRLFDRVSYRKQLSVQERWRYEEANRLSRRFCSRLMGHVAARRLDRLLADLRYAYRLGAEAKLRHFAHGG

SEQ ID NO: 10589 - protein, 199 aa, Myxococcus xanthus
MSGLVASLSLKEFFTPLLGEVTGRQRVELAEVTEFYLVNLLSEFAVTHKLFTCEEGGRKDHEPLAILYHQALQQERAERIRTLRRLGDVSLYTVGFFSGALQSGVVGPDYYIQMGGTAYGHVAELTPAAGFAQVYRELCEKFRKVVEVLEEISARGMVRAGPSGVLKVYEAWVRTGSDRLERVLLDAGMMPRPKGQLAN

SEQ ID NO: 10590 - protein, 1200 aa, Myxococcus xanthus
MRIKRLDITGFKSFMERSVFTFDEGVTGIVGPNGCGKSNVVDAIRWVMGEQSAKNLRGRGMEDVIFNGSENKPPLSMAEVSLTFIVDDTDQLAPQYQGFSEVTVTRRLFRNGDSEYLINKTLCRLLDITELFLGTGVGTKAYSIIEQGRVGLIVSSKPEDRRHLLEEAAGVTKYKARRKAAERKMEATDANLLRVTDITNELEKRLDALSRQAKKAEKYKKLKARMRDIDLHAATHRQLELMAEKKMLQSRLENLGSEERESLDRVKELEETITRRRTELEAETAALQALAAEVHTLESSLQRDTQEMTYGKRDLEETRARVAAAQVELDGLLARKAEMSEAMAAREAELSGIAGSWKEDEVAMQVAQEELRRVSQLQTEVALRLEQERAGLVAVATRLANHESNLVNLARQRGDLGARRAKLQGELETLRAQEQTLENVRGDVAKRVEDTRHLAAELAERKGQEEDALTRTRAAFTENEIEVIALREELSDKRSRLSTLEDIQKNYDGFDRGVRAVMTRAGVQAREQGIFGLVADVINVTPRYERAVEAALGERLQHVIVESRDKGVELVDYLKGHAEGRGSFLPVPALDTLPAPLEPDFSQPGVLAHALREVTCEEALTPLVQLLLGDVVIVQDVATARAWTESGGPACTLVTVEGEVFRPDGTIVGGESEGAAVGALQKKREIAELATEVARVEERYNEILTRHYTLQKQMGHAEGVLKGLAKNQHAEELNLASQEKDLHKAGEDLARVRERVRALEVEEGQLTQSHQALEHEEEASRGEVAHGQADREGREERVKQLVSEQESLRLRAETANGELTGLRIKVAAGSERGESARKELDSLVSQRQDMETRITRLQATVVEGGARVEELARRTTDTEGGLSQRAEEHRLAAEGLEAHRAAHTTASAEVREQDATFRELRGRVDKLMQGLSQISLREREIPLELEHLAGGIHERHQVELANELHKYHMLAALAPETEADLKDLRAQVEKMGEINLTAIDEHAELSKRYDFLTAQKKDLQSSIEQLKEAIQRIDATSRERFKQTFDVVNEKFQAIFPRLFGGGRASLILTNEGPGGEPGVEIVAQPPGKKLQSVNLLSGGEKALTAVGLIFGIFLIKPTPFCLLDEVDAPLDEGNVGRYNDMVKEMSKQSQFILITHNKRTMEVSNTLYGVTMEEPGISKLVSVRMREAGAANDDKVTAA

SEQ ID NO: 10591 - protein, 463 aa, Myxococcus xanthus
MGNEWLFLGLAILLVFANGFFVATEFAIVKIRATRLQALVDEGAPGAPTAMKMVEKLDAYLSATQFGITLASLGLGWLGEPAFARLLEPVLVQLVPEGAATTLAHSAAVVIGFSIITFLHIVLGELAPKSLAIQRPEDTTLAVALPMRVFYVLFYPAIVLLNGLAAWVLRVFGLQSVGEAHEAHSEDELLVILHSSAQAGAITTARAELLERALEMAQKTARQVMVPRNQVKFLDVEEPLEKCIADARAAGHTWLPVCRGNLDEVEGVVNAKDLFFLLSRGELRSLAQVQRPVLFIPEGATLEQLLAEFRRRRRQTALVVDEHGGTSGLVTIADVVAEVVGDVAELGRRMDEVRALPGGRFELPGTAQLDDLEERLDVNFDLDEDEEGEVTTIAGYLMTRLGRVPVKGDTLRLDMWRIVVDAVEGPRVVRVTVEPQARTASARTVSDGSAGAGEPPSGASNES

SEQ ID NO: 10592 - protein, 77 aa, Myxococcus xanthus
ALREAERAYERARALNPEDLLLNYNLSALFALWGRPKDAVQYLQKSLTADRPKVMGWLSTDPMFDALKGDPDFEALF

SEQ ID NO: 10593 - protein, 192 aa, Myxococcus xanthus
MLPSERVERDLDVAVRQVRKLVELVDDLLDVSRISVGQLALERVPADLTALLREVVARYLPQASQLGSTVELDAPAPVQGEWDTRRVEQVMTNLLSNALKYGGGKPIHVSLRAEGGMALLSVRDEGIGIAPEALPHVFDRFMRAVSGRNFSGLGLGLFIAHQVVSAHGGDIQVSSVPDKGSTFSVRLPLGPT

SEQ ID NO: 10594 - protein, 482 aa, Myxococcus xanthus
MFTRITHAAALGALIALVAGGSALAQDGTTVSLGVGSQKVITIPGLSRVALGDPSVAEVKTLGSGQLLITGQAEGKTTLLVWKSSGQRVSYLVAVRKQDPNEVISEIKRLLGEIEGVSVRMVGDRIYLDGQAYTTQDADRIEQVVGLYPNVKSFVKIAPNAKKLVAQNLNAAFQKAGLKNVQANVVGATIFLEGSVESQQDLQKAELITKAIGEKVENLLVVGIKRMILSEVQFVEIRRNSRDRYGIRYPTDITGTATAIASISQELFPGTFGSGVSTLTLNANADFSFGFQGNDGYGRLLAQPKLVCASGEKAEFLAGGEVPIPLITNNQFTVEFKKYGVILNLRPTADRNGNIQTEIEAEASEIDTSVAVSFGGSASIPGFRTRKVKTNVTVRHGETIVLSGVFSHDEQKSVSKLPGLGHIPIIGELFKSRGFDSTKRELVIFVTPRIVNPDSDKVRTIIEDVKSRYKQARSEVNFNIFD

SEQ ID NO: 10595 - protein, 314 aa, Myxococcus xanthus
MKGCVAALLVALLPAAVVAQQPARPRVVAVKSAHLAPYASVIAGFAAEARAEVQEVMLDESAGAAARLFKKLAAQKPALVLALGPLAANAARRSLGEDVPVLFAMVPYYEKYGLDGANVTGISLTSDMGPELEALKAVSPKVKRVGILHDPRFSSGTVTQARAAAASRGMSILPLELEAGGRAEKALDGAVGKVDALLMVADKTVGNAAVVQALIAFAAAHRVPLAALTPSQVKEGATLALSPSPTAIGQQAGRLANRIIHEKVNPGALAVVQPEGLDLSLNLTAARKLGPSSDAVLELLRLAARRDFAVKVYE

SEQ ID NO: 10596 - protein, 90 aa, Myxococcus xanthus
MGGVGAVLGFPAVLAAAAFISLVGALQAVVTLLWQGAVWDTLAAVVRRWTVWVRLASTHAQPAPQRHIPHGVAIALGTVWALWWQHGTLG

SEQ ID NO: 10597 - protein, 264 aa, Myxococcus xanthus
MAQQMGSDRDALINQALFMFARLNGFLEVKSRSEAAVAPVAAAPVKPVQAAAAAPPRPAAPPVLAPAPRPESTPAPARPPVRATPEERAPANGLDNDPVRREVAERVLETAAELERLIKGKNSEPPPPADDMVEEDEEPLPEAEDPGLMDEEPPPDEAEEEPADDLAEEEEVGALYLVTESGDQEQIVKDRFVIGRGKHCDFVINSGKVSREHAVIVHEGDDWIIEDLGSSNGTWFNKQRIKRRKVEDGDEYFICSEKIRLLVR

SEQ ID NO: 10598 - protein, 434 aa, Myxococcus xanthus
MDLSEGFGNVPVRLLVSHPRILIPDVEAINAGRYIFGVRDEASCSAARECSGVLAVDTESSPPGQTARDLSGAPMLPIFPAGGLPTGLTLVPDAQLRIVLDDGSATEVRVPLLGVMPSSNGYISLFSASDLRQFDLSGASARSTVALLDSNELPIVIETADLVTVTQDQTLQSTVLYEGSVPNGFYRIIYQGALPGLSGLPREPSTPRLFEVEATAAASARAGDIIVLEGTDVVCAVDLPIASVEPVAGTTRVRFAIADSQEIPTDCASLTRFTVRAGGDQPFVLFDEAGTFLSRDVTGGSSYSIPTEYFFHPDTFYFDDDSNPQTPPVPNLSKFPQPPPPLRIRVAAVGREVRRGDRYVVTVISGIRNYVFTPDVRAGTQLAFYTLPGPVVAAQDRSARFAYIAYPSADGILQVGFQGLTDNRAQSLALVPFE

SEQ ID NO: 10599 - protein, 222 aa, Myxococcus xanthus
MGALPARFILRLVDRTVAGRVLETDLELSYSVREARGVAVVPSATRVPDPASPELTIVDERVYLLARGPDTLLILDVLNAAGTAPDAGTTPSVRIVSALPVPAGASELEVIPRGPGRGNLVAVTGSGDEAVAIFDEEVGQLVAQVQVGDNDPNQPSQPFGLAADVRGNSARIFTSTFGDGRVAIIDIPDLDRPQNARLVARLGARQGRDPRQGTSLCQETSP

SEQ ID NO: 10600 - protein, 703 aa, Myxococcus xanthus
MARDLLLEVGAEEIPASFIGPALDDLKRVITERMADARLKHGEVRTFGTPRRLAVWVKDVADAGEDIIKEVLGPSAKAAFDAQGKPTKAAEKFAESLKLAVDQLGRATTAKGEYLSARVEEKVRPAADILKDTLHAAVHGINFRKSMRWGDVDTSFARPVQWLVALLGSDVLPVVFGDVTSGRTTRGHRFLSPDAIELKAPAEYEVALEKAHVVADITKRRAQLVEKVRAAASKAGAQLLEDESLVDQVTNLVELPSPVVGTFEERHLDLPPEVLVQEMKSHQRYFSLVDSAGKLQPKFIAVSNTPVRDEQLSLRGYQRVLRARLADGRFFFDEDRKTPLIDRVEKLGRVVWQGQLGSYLEKVERFRTLAVWLGQEAGRAGEAATIERAATLAKADLVTGMVGEFPELQGIMGREYARAGGEPDAVALAIAEHYLPRGAEDALPTQDPGALIGIADRLDSLCGIFAIGKAPTGAADPFALRRACIAIIRLVLGRGYRFSLSAAVDESLRLLAPKIANAKRKAGEPAPREQVLEFFRGRLKALWGEQHRTDVVEAVLSAGFDDLVAAQKRLEALSHIVGRADFQPLAVAFKRVVNIVEKQGRDVQGGETNPQKLVDEPERNLHTAFTQARSTVSGLVRVDDFSGALREITGLKPAVDTFFDKVMVMAEDKALRENRIRLLVEIGALFNQVADFSKIQAETAAAA

SEQ ID NO: 10601 - protein, 197 aa, Myxococcus xanthus
MEVTQFTYFQQCGGFDCKPVSVELTYGLERICMYLQNVENVFHLEWVKGVKYREVFHPNEVEMSKYALQESDAQMLFALFDAYEKECKRFIERQLPLPAYDFALKCSHAFNLLDARGAISVTERANFIKRVRDNARLCAEGYLQMRERLGYPLLKSPWTVGEQPPVLEGKPASDYWKTVVLNKPVEKKQKAEVAHGA

SEQ ID NO: 10602 - protein, 766 aa, Myxococcus xanthus
MQGGAGDDPDRGRRIGKYEILTRLSIGGMAELFLAYTSGPGGFRKFVAVKQILPDIKKDEQFVQMFLDEARITAAFSHANIGQVFDLGEDGGELYLAMEFLPGQNLEQVMKASTRQGYALPLGFVGRVIRDTCLGLHYAHHFTDPSGRPAVVVHRDVSPKNVMLTYDGVVKVIDFGIAKARGRLGRTQVGTVKGTSGYMSPEQVRGVATLDGRSDLFSVGVMLHELLSGQRLFSGPHEAAVMMQIVEADVPPLRGINPDVPEALEAVATRALSRDVSQRFTNCREMARAIEAALGSELFDEDAMTAVMGDLFADKRQKTRTLLELASRAEDARVSEAAGALQQEDSADSAPTSQMPAPRARPGAPSAPHSSAPKPVPQRRPAEGGVALRGPSVAGNGSAPKPAPQRRTSEAASPVSRTPRGGQDSAPAARTPRPRPTARQEVPAESESLDEPSDLQTQRFRSRPQRPGADGARVSGRSARPDTSRASDTPVETPAARPPSRWASRLFLLLLLGGLGWAATLPAVRAQLLPGFEAAKAWVSAELNPPPAEDPANQPWPPQQAGPPPGFRQAEPSQAVAQVEQAAGGEGSDEEAVDGAPEAKAPTKAPPGQKAKEGASSPSRRAAAPKAEAEPVSAKAAPPVQASPPPREPAPRVAAAQPAAEPVTTVTQDPEGMAEVLDTSTAKGAAKAGLGWMTLYTVPRAAVFDGATELGTTPLKKFPLPVGVYRLRVVDPTGVESVSRLLSAPIKPGEETKIQIRLADLPPYKE

SEQ ID NO: 10603 - protein, 399 aa, Myxococcus xanthus
MTESAGGQGEGSGRLRTPVEGALRAVRSLVELEDTDRAAQLYEELGDAQRERIRHEAEQGPAKERRGFVEVLRRARDFLGAARLMDGQGEDATAGDLYFQSGKYMAAAESYLRAGDAERAAAAFERGGALERALAIYRELGSREAMAQCLVRLDRPFEAATLYRELGQAHAEVEALGGVRAEDPRFVEAVLRICQLLDAEGFTHRALAVLADAVSSSEDARGDPALVTEKARLLRRMGMEAEAEAMLIRRSGGASAPAANGYRFLKAIPIFGELSLEDMKDLYRLARQVVIAPGAVLLEKGAPGLGLFVLMDGSVDVFSGPEEDARHLNTLGPGAYLGEISLVQDGPVSAHVRARTSVRALRISRVDFERFVDTHEAAALRIFRLFTQNLAGRVRALST

SEQ ID NO: 10604 - protein, 122 aa, Myxococcus xanthus
MRGGGTQGLTFDAVRALALSLPGMEEGTSFGTPAFRVRKKFIARFHEDGESLVVKVEPGVRDVLIQAEPDSCYITEHYAGYPEYLLVRVAAARPALVRQLLEDAWRRTASQRQLAERARDAD

SEQ ID NO: 10605 - protein, 390 aa, Myxococcus xanthus
MRHVTCPVAALLGAALSFLSGCGGTMSSNPSPIDAQSQTATSQQAAEAWKRARVGDRVTYAFSATQGPTPRAADAARTLDGQLTLDVVSVQQPWVYVRVAFTDAAGNPLTQTRLARDLVVPVRSDMTRSLDVPRPGQVTAERPSFSGRNWEATRYVSDQRPVDGPLRTRVYANDSALLYLTRGLLEASTESAGFRTPGGIRLSLREFQEGSTGASAPVPALERPLGPGAYYDRKVDMAPTHEVLRVCFTAERGYILRAEGPLGTGSEPCADFSKAEPESLEEVVMGLPWEALVSGEWPPSKDGARGTFTVGDRNVPSITEQRTEDLEGTQHVFMDTYAAEPWAPGLAGLPYEARFQSLSSGSERVGPGGQREFAGGSRIVQWGPWLGGQP

SEQ ID NO: 10606 - protein, 739 aa, Myxococcus xanthus
MRVAKKLNHPNLLRVYEEGVDGDRPFITMQLLEGMTLRRMMEQRTARGQLFSLKEVEPLLAQMAAALDAAHRFGPHSDVKPENVIVLPDLLKVTDYGLGLAVPHLPFVQAQKGQRADVYIAPEYVGGGELDTRMDVYSLAAIVGEMLTGLVPEDGVIPGLTMHHPDLPTSIEALYRRALNFNPLARPKTAGEFLTEFSNILARTPAAVVSRARSLPAPPGSSAANTARQAARPPPPVPTGMLPAVQEEDLPPPPGVAAPKPPAPIPDLPPPVDATQPLDAASLAAIMGRGKPAASPAPQHLTEQALPFIAPPVVAAKAAPSAQGSASRPASSPPVPSRAAPARKDSEDASERGAPSEAALSRSTAPTQVDAPAVTDGRSTAAMTLDEAPAVPAGRPAAPTLDAAPAVGRSRSRARDGAQDEASSRSREGGAEDTGSRARGRASEDSGVRTRRRGSEVAESGARSGAKRSEPSEGSSSRAAPRGAVLTKSATRAAKPQRSMWRLVLLVLGCLALGAGGGFLAIKALQKSRGQGTAPVAGPGGAAALAAPVGGCPAGMRLVSGGAFKMGRSDDDALASPDERSVASIQVSSFCVDEYEFPNRAGAMPKVAVAWEEARGMCEREGKRLCTEEEWEKACKGPGNSRFPFGEEQAVGACNTAASPGGLAASGRFERCKSGYAVMDLAGNAAEWTATRVGAQAYALKGGAFDQPDPASRCSARSNGVPTVRSNAVGFRCCASVRQ

SEQ ID NO: 10607 - protein, 351 aa, Myxococcus xanthus
MGCSEDDGGVDTPNPLTNPKDGPPAGNQNPEATCAIPAEAGLADVARPTTVVGTGSPESCTSDAFIQAVARGGVITFDCGPEPVTITLERTAKIFNDTGPEIVIDGKGLVTLSGAGRHRILYMNTCDRDQVWTTAHCQDQDHPRLTLQNLTFVDASSKTEAEFDGGGAVWVRGGRLKVINSRFFNNVCSDVGPDVGGAALRAFSQHRNQPVYVVNTTFGGKAGYGGACSNGGGISSIGVSWTIINSLFSHNRAVGNGANPARPGTPGGGSGGAIYNDGNTMTLSLCGTRIEHNEVNAHGSAIFFVSNDHSGDIRIDRSVIRNNTGGSWYPTHPQISNHDDTPIVVTNSTIE

SEQ ID NO: 10608 - protein, 749 aa, Myxococcus xanthus
MYGSIKIRGARENNLKNVSLDIPKRKITVFTGVSGSGKSSLVFGTIAAESQRLINETYPAFVQQFMPHYGQPDAESLENISAAIIVDQQRLGGNSRSTVATVTDAAQMLRVVFSRLAEPHLGSPGFYSYNDPRGLCSECEGIGQVASMDMDAVIDKSKSLNEGAILPKDYAVDSWYWAIYARSGFFDVDKKLSKYTKEEMEKLLHLDDGRKIKLDKMNLTYEGLVPKLRRTLGAKDPETVQPHVRAEYERIFTRATCPSCKGGRLNQAALGSHIQGKSIAECSAMQVSDLAAFVRKIAAPSVGPMLEALAHRLDNLVTIGLGYLSLDRESSTLSGGESQRVKMVRHLGSSLTDVTYIFDEPSVGLHPHDVGRLAGLMQQLRDKGNTVLIVEHKPDMIAIADHVVDMGPKAGNKGGQVVFEGTYEGLLTSGTLTGNHMKKHQPLKTTPRKPTGQLQIKGARLNNLQDLSVSIPRGVLTVVTGVAGSGKSSLIQGCLPKAYPETIIIDQNLARGSRRSNTATYTGILDNVRKAFAKANKVDAALFSANSKGACPDCSGLGVIYTDLAHLDPMVTVCETCEGKRFTEEVLAHRLRGKSISDVYEMAVSDAVAFFTEPAIAKILQGLDDVGLGYLTLGQPLSTLSGGERQRLKLAAELGRSGNIYVLDEPTTGLHMNDVDTLIGLFDRLVDAGSTVIVIEHNLDVVSRADWVIDLGPGAGHEGGQVVFEGLPAQLAAHPRSLTGQHMARRGKA

SEQ ID NO: 10609 - protein, 200 aa, Myxococcus xanthus
ARHPTDFHLTLWGSLLAGTVFLGLTACGGRSEPAEPAVCEPPASPEVRAFAQCGPTLDFTPINSYVGELSDIIQDREDAVVLIDGRCTGTLIQASAGPVVLTAGHCVNLGDIPLIVFNFEDDADGDPLITEGTVIEQSMEPDYALIQLDVLPDVTPIPLTAQATEQLAIIQHPRGRPKVITEEPLSGRVQQPHLLRGPGH

SEQ ID NO: 10610 - protein, 263 aa, Myxococcus xanthus
MFKKMFKGAAVLAVTGSMMLTGCGTDVQADSQHEQDEIISNLVEAGFPADDILLSDGQVYVGRDAHVTLEASREMLQTDLKTQEQYRTTNLVAASITRICIVPNSAYAANTTLMSALDRAIANYNALGLSFTMQRGGSGCSATISARTMSGAGGSAGFPSGGRPYGIINIGTGTATYGVAVVEHVVTHELGHAVGLRHSDYYNRSISCGGAATNEGTAGVGAIHIPGTPTTATRGGSLMNSCFGSSETGNFKSSDVTALQYLY

SEQ ID NO: 10611 - protein, 100 aa, Myxococcus xanthus
MDRIITLVLDYVHGAVRNAAREKMVKDLTGMTDEEWWYRVAPFLETIDFTPYPVLSRVGKTAGETYGAHDPRGAFAFGLERVLDGLAVLIDGKAPGKKRR

SEQ ID NO: 10612 - protein, 1427 aa, Myxococcus xanthus
MTKGADEGRILKQRLFDIAPGETAFSLNARCYTLGMETFAELAEELVAGTSEAKEQDFAQRSYFGLAQRPEAAGVVDLHGDVDVAHALVSALDYGGYPNPLSFAKVWLGNGPIAISEARRAEPASESAPGTVLDIEGDALTVALQGGDLTLKGPKGLCGAPLSWADVLGARMLARGDALPAAAPELRARLTEVGTQAGKAESFFLRRLETLAPPDLSFLGGSSKDVGTHTLKFEASDLTPGWVTDLPPEERLLFTAMAFLARLSPEPRFDVGYADASTRAHIEGVEGFFASQLPLRIELPMKDAPEQAAGAFRKALTQLRDKGVLARDALGRSAQLSNLQRHGGEVAYPVALRIGAANPAVGGAALVIDVDAQGRHAHLHFDATRVDKARVDDVARQLNAFLASLRDAPGKAVGEHDLLGAEERQLLARWNDTRRDFPRDATLASLFQAQARRTPDDTALICRGTSLTYRELDARAEVLARHLRGAGVGRDVRVGIFMERSLEMMVGVLATHKAGGCYVPLDPAYPAERIAFMEEDAGCHLVLTQERLLSRVPSAAKAVLAVDQQWERIAAAPEAQTPPATPDSLAYVIYTSGSTGKPKGVMIEHRNVVNFGVGMDERLGTERGTWLAVTSLNFDISVLELLWTLTRGFTVVLHAERHDTAQAGKHASRAMEFSLFYFSSDEGERPEGRYDLLMESARFADTNGFCAVWTPERHFHAFGGLFPNPAVTSAALAAVTRNVQLRAGSLVSPLHPTLRIAEDWSVVDNISHGRVGISFAAGWQPNDFALRPETFPDRKRIMFQQIEDVRRLWRGEALETKSGTGHTVKLRTLPRPVQKELPIWVTTAGNPETFEEAARAGCHVLTHLLGQSVEEVAQKIALYRETWAKAGHPGKGTVSLMLHTFVGDSEASVKEVVREPMKSYLRSSVGLIKEAAWSFPAFKAQTTLANGNFGTDHLSAEEMDALLDFSFERYFQSSGLFGSVDACVALVDRLKGLDVDEIACLVDFGVPTELVMKHLPLLAEVRQRANSGVGQPGAEPELDGSIPALMERHAVTHLQCTPSQASMLLAEERSREGLKRLKKMMVGGEAFPVPLARQLSETVSGDVINMYGPTETTIWSSTHPVKNVGEGVPIGTPIANTQFYILDAQQRPLPIGAAGELYIGGEGVVRGYHHRPELDRERFVPDPFSSQPGAQMYRTGDAARWRHDGLVEYIGRLDHQVKVRGFRIELGEIESRLGEHPAVRETVVIVREDIPGDKRLVAYLIAKPGEPPAADALREFLRTRLPEYMVPQSFVTLSTFPQTPNKKVDRKALPPPEQAQARGELVRPEGETEALIASIWQDVLKLDKVGVEDKFVDLGGHSLLMVQVLEKLKAQVEKPLTLVDLFRYPTIRTLSGFLSGDSGEEEALKEVAARGEARAAARRAMQQRRRR

SEQ ID NO: 10613 - protein, 138 aa, Myxococcus xanthus
MRWLTETHPAAAQDIHLVGFSMGTMSALAAAHALRAQETPARSLVLFAPFQAMKVGRMGLIGSLVGRHRYDNQPLLQPKRLPPALVLHGGADSALPPVQGERVSRGLRAPLKTYPGIGHAELLKHPPALADARQGLGL

SEQ ID NO: 10614 - protein, 1431 aa, Myxococcus xanthus
YEQKPVFRRALDECLSLLEQHQSLKLRPLLFPEAGAEKEARAQLEQATYALPALLSVELSLAALWKARGLTPQSCMGHSMGEYACAQLNGVFSVKDALGIVACRGRLFDQLPAGAMLSVEMPEAELKPLLGEGLDLGAHNAPGLCLVSGEVAAIEALEAQLKAREVEARRLHIRVAAHSRMLEPILAPFREFLGTVRFTKPTGPWISNVTGTWVTPEEATSPDYWVRHLRQPVRFAEGAGVLLADKARVYLEVGPGQTLTQLLRAQVEKPQAEQLVPSLRHPNDTVADLAFFQLALGRLWAAGVDLDAAALFDGQKRRRVALPTYAFERERHWVEPGSGTFMARREGERPLVREENVSRWGYVPRFREQAGAAPEAPTENERWLLVGEQHLLLSELARELSARGAQVMRVLPGDAFGRADEGHFTLRFDAREDWEALWDALGAEGRVPPRIVDITSRDKAPLGWELAVSRYFLTPLALMQSLTSESLPPGLRYMRVTQEALPAEGHATSPEQALSFGPLLVGPKELPELKARVVDLQLVVNVMGQARELADELLRPDVEAPVALRGGRRLVQVMERTALDEGPTPLREQGVYLITGGLGGIGRTLAELFARKVKARLALVSRSAASASHAELQRTLEGLGAQVLLLKADTTDAGQLRAAIAQVRERFGALHGVVHAAGTLEDGPLEAKTRDSALRVLAPKAMGALALEEALQGAALDFFVSFASTSAWLGPPGQVDYVAANAYLLAQATRLEATGIAKRALALGWGVWQEVGMAAAQLAPQLPPGESVIHPLLQRRVEAPEGHHVFRAIYDAKAHWVLDEHRMRGGGPVLPGTAYVELARAAWALARPGEPLELSQLSLVSPLDVPDGEVREVEIGLAPEGDGFTFRVRSRAAGNAWTEHATARLHQATGQRPTALNVSAAKVRCGERPLTFGEGEQSLPQDALIAFGPRWKVLRSAGFGTSEALGRLELPAAYREDLSTYGIPPGLLDIASGFAFSLLPDAGQPGKLHVPVSYRQLQVWGPWPQVALSHVRVRQEEGRGALLDVTLTDTDGNVFCAIEGYLVASVEARRFGRSPQKKGSLLESWLPLGIKPAEGQDAFLRALSLEDTPALFVSSMDLHTLAARMRPKQEAKPAAAAAATAQAGAPSGVAAADAPRDDVERKLAELWQQLLGAPKVGLKDNFFELGGHSLIAVRLFARIKKTLGADLTLATLFEAPTLEQCAALVREAAGIPFTPDAGPGDAAPAAQAPGVKAVPKSWSPLVTIQKGGNTLPFFCVHGAGGNVLNFRELAQTLGKEQPFYGLQARGVDGKLPPADSIEEMASIYLESIRQVQPHGPYLLGGYSGGGVVAYKIAQRLHALGEPVALVAFLDTFHPSTQERRQSLHERLRELRREGAGSYVSRKLRTKVERDGTRLLSQLKLRWYEQRGEALP

SEQ ID NO: 10615 - protein, 97 aa, Myxococcus xanthus
MVHMSPRNLRRRFLDATGKTLVDYLTEVRLARARALLLSSNEAVSQIAYRVGYEDASTFTALFKKRHGLTPSAYRKTSAGPAGLSPAYDGERRTAIT

SEQ ID NO: 10616 - protein, 61 aa, Myxococcus xanthus
MSCRSCVSHINTALRKVEGVQDVNVRFEQRQVLVKHDAATANVNILIEALRDAGYESAPTA

SEQ ID NO: 10617 - protein, 748 aa, Myxococcus xanthus
MKKDLGLPEQPAVPRVVTAEPLAHVAEDGRAHLLREHLEAVGQWAAMLAPREDLRAPALVTGRWHDLGKYTRDFQIRIRKENGFEAHLEKEGALERDHSTAGALWSLSRDRHLMPLAFAIAGHHSGLPDASNLRNRVGRTEKQALLSDARARCDAPALLDGPLGFSPEALDKLEPRQVELWTRMLFSVLCDADFLDTEAFFDANRSAAREVPVSLSQLAERLRGFLREKQRRAPDTEVNRVRREVLTAAVEAAVQRPGVFSLTVPTGGGKTLTSMAFALEHARTQGLQRVIVAIPYTSIIEQSAEAYRQAFQGLEHAVIEHHSAVDPDRETPLNRVASENWDAPIIVTTTVQLLESLFARRPSACRKLHRVARSVIVLDEAQTLPASLLEPILDGLGALVRDYGCSVVICTATQPALGRRPDFQEGLPEVREIVPASVRAFERLRRVRVRWPSSGRKLPYAELADAVAAERDVLAVVHLRADARRLCELVDERLGHEETLHLSALMCPEHRSQVLADIKARKRRREPVRLVATQLVEAGVDLDFGVVYRGLGGLDALAQAAGRCNREGLMEGLGELRVYEPETQPPRGVPRAAQDVTRGLLEQSPDLDLFAPESFQRYFARLYATRHRDEKGIQALRAKFQFEEVSKAFKLVEDDWSASVVVPYVGHAPLVNALRERGPSRERLRALQRFTVTVPRKLRDDWLARELARLAAETVAYLGPEHTSAYHKRFGLLPDHVGIFDPSFLIPA

SEQ ID NO: 10618 - protein, 151 aa, Myxococcus xanthus
MSSPLTVKVRRVRTHAEPLPLPRYETAQAAGLDLRADIDGERVLGPLDRLAVPTGLALALPAGYEGQVRPRSGLALRHGVTLLNSPGTVDADYRGEVQVILINLSHEPFTLRRGDRVAQLVVAAVPPVSLLEVEFLEETSRGGNGFGSTGR

SEQ ID NO: 10619 - protein, 157 aa, Myxococcus xanthus
MKKSLMGLLAALPLIAAAPAVACDEHAKHGEHASHGEHAKHGDHSALGGTAKKAAAPAQKPASAPATRNGVQTVDLTVTPKGFEPSDVKVKAGQPVRLVVTRKTAKTCATEIVMADLGINKPLPMDTPVTVEFTPSKSGTLRYACAMDHISGLVTIQ

SEQ ID NO: 10620 - protein, 464 aa, Myxococcus xanthus
MLAALGLGQEDDAAMATLRQPRVAPPYPEDTPSTGRVREFELVAAPTALPLLDGRSLEVWAYNGQVPGPTLRATHGDTVRVRFTNKLPQPTTIHWHGIRLPNGMDGVPGVTQPPIPPGGTFLYEFKVKDAGTYWFHPHLRGSEQVERGLFGVLIVEDQKPGPFSRELVWVLDDWRLDASGQIDGRFNTRHDLAHDGRWGQVSTVNGAVQPEVPLQPGERVRLRMVNVANGRVFAPSFEGLGASVIAIDGLATDRPQPASRLELAPGNRVDLDFTVPEALSNQRMEVMDHFTRRPFPLATLVVSGEVVRPPEVAAVAPPPSPDLSPARALQPAETFRLNARRGGPFGIEWTINDEAFHHEGEHASAHHKVYRLPAHQWATLRFVNESSRLHPMHVHGQFFRVVARNGASVDEGHWRDTVLIRPRETVDVAMFPQDVGAWMLHCHIQEHAEAGMMTLVDVHAEGSQ

SEQ ID NO: 10621 - protein, 367 aa, Myxococcus xanthus
MRRTTTELDRLFREALVPAVLREDHATAAREHARALELVDVIQESADTLASHYERAIGNFEEHASTVQHASFQWTVAILAAAALLAAGVGLYIGRSVARPVSLLEAGAARIAAGDLMTRIALDRPDEFGRLAQQFNRMTAALREHQERLVQSERLAGIGRLAAGVAHEINNPLGVILGYVRLLQRKAEGALADDLRIIEEETLRCRDIVEGMLDLSRPLQVPGETLELRELVEEVVSRQRESAQHSAASLTVEGEAQVAGHPQRLRQVVTNLVKNAMEAAGPSGQVTVAIQAHEGEVALSFRDSGPGLSPEAQKRMFEPFFTTKPHGTGLGLAVSQAIAQAHGGRIQPRNLPGRGAEFTLHLPRSTP

SEQ ID NO: 10622 - protein, 224 aa, Myxococcus xanthus
ELRRMALQAAVAAADLSARLRAAGNITELELASEQAAAEGARLELAEGELALVEAREHLNRLMGLWGPRTQWTLSEKLPPLPDQEVSLAHLESLAIRHRLDIDAARKQVMLLWNALELARSTRFFGRVDVGVHEHRDADGPRLFGPTLSLELPIFDQRQALIARLEAQHRQGERRLMELSVNTRSEVRAARARLLALRLVADRYRRVVLPLREKVVEQSQLLRE

SEQ ID NO: 10623 - protein, 129 aa, Myxococcus xanthus
MAETTAGREYFEKDAFARELGIELLEVGPGTSRVRLPTSSRRSNGLGTTHGAVIFALADVAFAVACNSHDQRAIGVQANIAYLAAAGDGAIEARATEISRGRKLATYDVRIVDAEERLVAAFQGTAYLR

SEQ ID NO: 10624 - protein, 694 aa, Myxococcus xanthus
MANITELATGFPGYDARQKPDKAAIGAMLHQHGYASFALGKWHNTPSEESGPSGPFDRWPDGPLFGFDRFYGFMGGDNNQWYPKLYAGREAIDPPRLPQEGYHLSEDLADKTVDFISNHASLTPEKPWLAYLAFGACHAPHHVWPEWIEKYRGKFDMGWDRYREQVLARQKQLGVIPANAALAPMLEGVPRWDDLSDDQKRLFARMAEVYAAFLSHADAQIGRVVEYLERSGQLDNTLLFVFIGDNGCSGEGTNSGLFNEGALGTERPETVETLEGNLQRIDRLGQPGSYNHFPVGWALAMNAPFKLCKQYTHFGGTRNPLVVHWPKGIQARGEIRTQFHHVIDIVPTILKAARIEAPAVVNSVSQAPMEGVPMNYSFDDADAPTHHPTQYFEMLGNRAIVNGKWKAVTYHGRKPWENHAAWSFDEDHWEVYDLEKDPTECHDLMAQRDLSKQDDPAVKRMIHLVGLWWAEAGRYNVLPLDDRFQERLLGRAELAKKRTRFTFGLGAVRIPEAAAPDTKNRSWAMTAEIEIPEQGAEGPIVVMGGDTAGWSLYLKGGVPTFCYNFAAVEYTYIRAQQKIGPGRHTLRFEFEIQPEHRTDTGKPVIYGAGGMGRLAVDGKWVAEGRIPQTMAFMYSLDETFDVGCDKGAPVTDEYEPLAAFTGKVVEVTVDLHPETALEPARHTDAQVTQAMARQ

SEQ ID NO: 10625 - protein, 236 aa, Myxococcus xanthus
  unsure (1)..(236): unsure at all Xaa locations
MGKAETLREDESLTAWFYSVLRNAVIDHYRRRGTTERALASLASELEEGHAPEAELAQAVCQCVGRLAGTLKPEYAEALRRVEVEGVSVPAFALEAGITSNNAAVRLHRARKALKKQLEVSCGTCASHGCLDCTCATQGAEKKAGGCGSAKALTLTESPKRHARLFQSNGLSQAGRSPSPSGLHAQVGCHSLGAGSHEGIGVGNDWWNAWAXRXVRTRGQFMRWGRIRTRRRGAPR

SEQ ID NO: 10626 - protein, 363 aa, Myxococcus xanthus
MPVKHTFAPGLEVEAWGYNGSTPGPTIEAVEGERLRIYVTNRLPEPTTVHWHGLIIPNGMDGVSGLNQRPIAPGETFAYEFTLNQPGTYMYHPHYDEMTQMALGMMGMFIVHPKRPRGPKVVRDFALMTHEWKVLPGMRRPDPNAMSDFNVLTFNSKAFPATEPLVIGRRERVRIRLGNLSAMDHHPIHLHGLSFEMTGTDGGFVPESARYPETSILVPVGSTRVIEFVADEPGDWAMHCHMTHHVMNQMGHAGPVTLGADARAIDRRVQALVPGYMTMGQDGMGGMEEMGMPMPANSIPMKGGKGPFGPIDMGGMFTLLKVRENPDTEDGSGWYVHPKGTVAEKADPVRMDADGINPDVRFG

SEQ ID NO: 10627 - protein, 434 aa, Myxococcus xanthus
MAGLTSEALRGEDADAAVRALLAQPLTADTAVRIALLNNRDLRAAMHALGIATGNLVQMSLPPNPEVELEMRKPTRGGQPLQGDIGLEYDLSELILLPQRRGVAQAERAAERALTAGEVLHVAYRTRLGFYEVQARHQQLELRNRALQVAQAGYGTAVELEKAGNVRALEVATERSAVESARLAVAEAENALLDSREALNVLLGLFGPRTQWTVDSPLADPVNDLDSGEGLEARAIEASLDLAELRGRMEAADRRHRLARTEGFLPHLSGGFHGEKDEDRWEMGAHLTVGLPLFDRKQGVRMAALSSRESLKARYEATATAIRASLRQASGRVESTGRRARHVRDVLLPARRQVLDETVLQYNAMQVGVFEVLRAQAAVTDTASTYVETLLDHHRARSALEQLLAGRHQGLELGSIRVSSMSASSGPAAAADAH

SEQ ID NO: 10628 - protein, 81 aa, Myxococcus xanthus
MVDGGYRPDRIVVRAGVPVKLNVLRTDRSACSEQIVLGDLGVSRTLPTGRVVTIDLPALTPGAYDFTCGMSMLRGRLIAEV

SEQ ID NO: 10629 - protein, 111 aa, Myxococcus xanthus
MHTGVDLGVPVGTPVVAVADGVVRRASEDAVNGRVLVVDHGRGVTTAYCHNSELLVKVGQRVRRGERVAHSGNTGRSTGPHLHYQLELAARPMDPLKFRTALRPVAKDPAP

SEQ ID NO: 10630 - protein, 598 aa, Myxococcus xanthus
MNVLVALGTGAAFIFSVVATVWPTFMVTGDHGGHGGHGAAPPIYFEAAAAVIAFVLLGRFLESRARTRAGDAIRRLQALAPSIATVLENGVEREVPLAEVRVGDRVVVRPGQSIPVDGSVVDGASSVDESMLTGESLPVEKAAGAEVFAGTMNGTGRLVFRAAKVGSDTALQQIVQVVERAQGTKAPIARLADVVSGVFTPVVLLIAIATFAAWFVLAPEETRLTMALLNAVAVLVIACPCALGLATPAALMVGMGRGAQLGVLVKSAASLEGASRIDTVVLDKTGTLTQGRPAVVRVLTASGMTEEEVLTLAAAAESASEHPLARAVVSEASNRGLKVGTPESFTATPGHGVEAEVGGRKVLVGSRRMLDGRGVSGSEDAERVLTTDGQTPVLIAVDGRWVGAIGIADPEREEAATVVQSLRSMGLHVVMLTGDHDGPAARVARALGIDRVFAGVLPSGKAHVVRTLQTEGRRVAMVGDGINDAPALAEADLAVAMGTGTDVARDAAGVALLRSDLRGLPAALGVARPTIRVIRQNLLWAFLYNVLGIPVTAGLLYGLTGWLLSPMLASVPMSLSSVSVLLNSVCLRRLRLPAPQAA

SEQ ID NO: 10631 - protein, 178 aa, Myxococcus xanthus
EFLVNNAGFGSCGPFLAQDLAREAEMVEVNCTALLKLSHLFARPMQERGSGRILNVASTAAFQPGPFMATYFATKAFVVSLSEALAHELKGTGVTVTCHCPGATHTEFTQRAGNGQTRLFQQPGVAKAEDVAAHAYAMMMRGRVLSIHGLLNWVGTLGVRFSPRVAVRALAASLNQQG

SEQ ID NO: 10632 - protein, 261 aa, Myxococcus xanthus
MTATVDHEALAHFLDSARLERREVAPLTREQPALSVPDAYAIQEAGIRLRLSHGERVVGLKMGLTSEAKRKQMNLDSPVYGVLTDRMQVPAGGVIQLSQGVHPKIEPEIAFRTARELRGTVTRDEVLDACESVFAAMEILDSRYRDFKYFSLPDVVADNASSSLFVLGTAEHPPRAMDLTRLEMTLSVNGEPVQSARADAISGDPVVSVIQLCELLAQRGQVLPAGSIVLAGAATAAHMLRPGDRVQLTVEGLGIVAVSAE

SEQ ID NO: 10633 - protein, 195 aa, Myxococcus xanthus
MREPIIDQREHGAVAQALLGWPLPEQTEDIVSMAWLVERLRSSRVDWGLLDKLVRFEPSGYTRQTIARTTACELLLVSWLPGQASRVHDHGGSGGASWLVRGMLRETRFAWAGDRLVPEVIVGANEGDLLVEFPDTIHRIDNASRHGAVSLHLYAPPMQGMTPYDASLAPESLRPPRPLAAKREAPGRRRRPRAT

SEQ ID NO: 10634 - protein, 514 aa, Myxococcus xanthus
MDITARKLAEQELHRQSLIFESIYDGVVITDLGGGIIDWNSSAERMFGRQKSEALGQTLFSVLHPDEPDRLTGLVLTALDKQGRWSGELEFKRHDGTTCWCESVVVPLRDSEGRAIANIMVHRDTTERKQLQAHLVVADRLASVGTLGAGVAHEINNPLAYMLVNLHLIREGLERLESQAPAAPVASLQQLVRETAEGAERIATIVRDLKVFARGEQETRLMPVDVRRAVELACKMADNVIRHRARLVTEFEPVAPVEASESRLCQVFLNLLLNAAQAIPEEGTPGVEHEIRVVIRAGEKDRVVVEVRDTGMGMGQEVLGRIFDPFFTTKPVGVGTGLGLSICHGIIESMGGSIQAESEPGRGSTFRVVLCAATRELEVLPRLSATMQANVRARILVVDDEPNVTLALQRSLAADHEVSTANSAQAALRLVSDGGRFDLILCDVMMPGMTGMDLYHELGRCAPEQAGRMVFMTGGAFTPRTVSFLRDVPNAKIAKPLDLMQLRELVGRSAEAGR

SEQ ID NO: 10635 - protein, 592 aa, Myxococcus xanthus
MSHPVSGLSGTDPSEVAPAPSLALVTERPAPLELTTRALGMGLLIGGLLAITNVYMGLKTGWWESGSVTAAVLGFSALASVSRRRGAPYTPLENNLTQTAAAAVGAMPAAAGLLGALPALALLGTSVPGWGVAVWSVALGVLGVLAAHLLRRRLVAQEALPFPTGIATAELITAMHASTGDTVRAGRGRLLAGAGVAAVAVTAARDAFKWLPGMTALPGTLAGLPAASLTWGVGWSPMLLAIGMMTGPRLGLSMLAGAAVAWGLLAPGLAGMGALADTRYETLSAWLTWPGVGLMVGSALAALLAQARDFLSAARDVSSLGRGAAVPSWALGAGLAACVLAVVVGSALFGLGVPYMLLALVLVLPLCAVCARGAGQVDVSPVTQMGQVTQVIFGALLPGAMAPNVAAGAVVSGAAAQTGVSMWSLKAGHLLGASARHQLAAQLVGVLAGSVVGVPVYLLLSRTYGLGSEALPAPFAHQFRAVAEVAVRGLDGLPPHAALAACVAVGVGALLTWVSRGRAARWLPLPVALGIGFILPAYYAVTLCLGALGLAAARWRWPQAADRNTSTLAAGAIAGESLAGVLIAALMAFGLT

SEQ ID NO: 10636 - protein, 202 aa, Myxococcus xanthus
MRYPSIIAALLFTATTASAQEYDEHAHDGFYLRLQVGGGYLRAKATDVSPDLVVKGGGANINAELGFALVNNFILYAKFYGASAPNPSLQVGDLTVEGQNENLSENFGAVGLGVTYYIMPANVYLSGALTYTQLSVTDDGEKVAESDIGGGLHLGVGKEWWVSKNWGLGIGAELALGRIRNESNSDSWNVTNVSLVFSATYN

SEQ ID NO: 10637 - protein, 439 aa, Myxococcus xanthus
MGALADDPEHFLRWVRRELPDTAPGAFVSRQRYGRYLESVLREARAHAAQGVHLEVVTSDVASVEETDDGAVRVALASGGQLEARTVVLALGNALPSNLRVPDGGLYASRRYHRSPWAQDALRGVSATDDVLLIGTGLTMVDTVLSLMEMGHRGHIHALSRHGLLPHVHQEIPRAGATTYASPGIREALRALRQEVRRERGDMSVTGTHSVPVRIRPILHLLRREVRRAAEAGADWRTVVDALRPVTIPLWQRLPVGERQRFLRHLRSYWDVHRHRMAPCIGETVERLRREGRLTLHAARVRSFALEASGVEVRVRPRGQGEEETLHVQHVINCTGPEGAMTRGHPVLGGLVEAGLVRPDVLGMGLATDADGALLGAGGRASGRLYTLGPPRRGELWETTAVPEIRGQARELAWHLLQRLSSTRAPRPVMEAAGAPLDG

SEQ ID NO: 10638 - protein, 333 aa, Myxococcus xanthus
MTLRARVMLMSAVAQRRGTLRRAFDTLQGPTVNGVRLRAPRSSTREAALLEETVRERTAALEAANVKLSRSLEQLRATQAQLLFADRLIALGRIAAGVGHEINNPLAFILSNLEYIHQELQQKEHLSEQDRQEVLEALAETRDGAERIRLIVRDLQTLSRAEDVGTGPSDLGSVVRTAAKMAMHELRHRARLVVECEGLPPVQGNGARLGQVFLNLLLNAAQSIVPGEVEKNEVHIVACESKAGRVAVEVRDTGCGISPEHRERIFDPFFTTKPLGVGTGLGLAVCHGIVTSLGGTLTVESAPVRGSIFRVTLPVAGAFAQAPRASQQADAVA

SEQ ID NO: 10639 - protein, 233 aa, Myxococcus xanthus
MRYIIRCAVKENQQRKYTNPVTGVKYTWEGGLGLALNWATGAPATAQEEEIVSACLAAHANKFGLPVAISVLGRNARGGALPYTEQELSTFSEREACFFGNLFDGTGVFAATDRGYLREDESTVRACGLPSNPAHSDCLPIIHAGTCESLCQRAATAALPFDRDADRKNPPPYGEPPYYETCTYNGRTFQPLTTRLQPRDIHRCGDGVCQLTERCGDGVEAGSCQADCGTCPY

SEQ ID NO: 10640 - protein, 114 aa, Myxococcus xanthus
MRWLRPLATAAVVLAGACAVARLIQGSVYLSWRELFGDGAADVAARALAVASLVGVLVSLGWRAVLRNLQHADAVCEEAGGRAALRRGLLGCAVVVPLAVAAVVDATPVLSFFR

SEQ ID NO: 10641 - protein, 943 aa, Myxococcus xanthus
MKRRTPLSLMAALMMVAGTPVWAQTPAPANKAPATQSVVTKSKAKGRVLAPVTSVEGISEYRLPNGLKVLLFPDPTKPTVTVNVTYFVGSKHEGYGETGMAHLLEHLMFKGTPTTRNVPQALTERGARPNGTTWLDRTNYYETLPASDANLRWALSFEADRMVNSFIAKKDLDSEMTVVRNEFESGENDPRGILFERVMSAAYIWHSYGKSTIGARSDLENVPIDRLQAFYRKYYRPDNAMLVVAGRFDEAKALSMIQDTFGKLKKPSLPLPATYTAEPTQDGEREVQLRRVGDTALLTSLYHVPEGAHPDFAAIDVLTLVMGNNPSGRLYKSMVETKKSSRVSASNLQLRDPGIIVFSAEMRDDQPVAAAREALLKTVEDASRTPFTEEEVNRAKATLSKYIDLTINNSERVAINLSEWEATGDWRLLFLHRDRIEAVTPEDVTRVAAAYLKSSNRTLGTFIPTPKPDRAELPAPVDVAKMMDGFKGRDAVAQGEAFDPSPANIESRVQRGELPGGVKYAVLPKKTRGNMVNVSLSLRWGTEEALRGKSDAAQYAGRMLMRGTKKRTRQQLQDAFDKLKARVGVDGSSTGASASIECPRESLPEVLKLVAEVLREPAFDEKEFAMLKQERLASLESERSEPQTLGNIAFWRSLSGHYAKGHPYYVATLDERIAGVKDTTLEQARAYHKAFYGASNGELAVVGDFEPKDIVALAGTLLGDWKSPAPYQRVQQVFGGGAPASVALETPDKANAYYMAGQSLKLRKDDKDWPALVLGNFVLGGGFLNSRLATRIRQQDGLSYGVASSLDASDVDEVGTFFTYAIYAPENAARLETAMREEVTRAVQKGYSAEELQKARTGILEYRQSARAQDGSLARQLASYLFLGRTLAFDAALEQKLTQLKPEDVRKAMDRHLDWTKVTQVRAGDFATAQKKAAPAAKVPAAP

SEQ ID NO: 10642 - protein, 615 aa, Myxococcus xanthus
MGLRYDVIVVGLGHAGSEAALACARMGLATLGLTLKRERSAVLSCNPAVGGTAKGHLVRELDALGGEMGRAADQVGTHFKTLNASKGPAVQASRLLCDRDAYAVGMQAVLFSQPNLTVREGEVAALVAGGGRVEGVVLGDGTQVSASAVLLTTGTFLQALMHVGEQKEVGGRLGDDAARGLSESLRALGFTLGRFKTGTPARLARASIDWDALEPQPGDTRVRPFSWRTKVEGEGGMPFPRQPSVTCALTETTPRTHAVLRDNLHRSPLYQGDIVGRGPRYCPSLEDKVVRFASRERHQVFLEPEGPTSPLVYPAGLSTSLPADVQLTFLHTIRGLEQVEVVRFGYAVEYDYAPPTQLKATLETKAIAGLYFAGQLNGTSGYEEAAFQGLWAGINAALQLKGEPPLLPGRDEAHGAVLVDDLVTKGVDEPFRMFTSRSEHRLKLREGNADLRLARHGHRVGLLPREALERVEARGRAVTEEVARLKRTGLAARLRRPEVTYAQLGEGREDWPVLSPDVAEEVEVEVKYEGYVAQAARAAAREAESTDRWRIPEGYCFHEVRGLSSEAVEKLTAHRPGTVGQARRIPGLTPAAVSLLLVALKRGTEAPAVCAQPED

SEQ ID NO: 10643 - protein, 185 aa, Myxococcus xanthus
MSELLKWNAKVNLTAITAPEEVLEKHFLDSLAVLPEVTGAATLLDLGAGAGFPGLPLKLALPALGVTLVDTVGKKVAFIKAAAASLGLQGVRGLHARAEGQPETEGIPRAEVLIARAFMDLPDWLALAPAYVEPGGRVVAMLGKPQTDAELAARAAERQLRVVSARAYRLPFSGAERQVAVFAKE

SEQ ID NO: 10644 - protein, 102 aa, Myxococcus xanthus
MDETGNRYDVAQSPERAHVACFARILEDRAHKQSYYVEFRGTPADEDAARKDWAVIRQDEYGNRAEVARLQCEQGARAFADVYEADPRHKQTYFVEPVAPRS

SEQ ID NO: 10645 - protein, 152 aa, Myxococcus xanthus
MTRKDILEAVKSFVGVLDEQNHFEDREGVLRASLDRLALAYHFADAPFDPTKYPDAPRADYRSLRECIAPLFPALGLYNEALHIADKVGESEFSIGDAIDDLTDIAMDMHSVLFRWENTSEGDALWHFRFGFETHWGLHLRSLQLYLHQRAC

SEQ ID NO: 10646 - protein, 160 aa, Myxococcus xanthus
MRAAPGARRFVDTEDDTRELLLRRILEAGALGEPRARSFRWFVEADGQLVGTVSARDLSRVHGRIELGYMMADAHHGRGLGSRAVGLMLEQLFTLPYLQRVWLTTLAENTGSQGVARKVGFTMEGTLRGHCLFQGQRRDQQLWGLLRPEWDARRAAFVAG

SEQ ID NO: 10647 - protein, 285 aa, Myxococcus xanthus
MHPYAAELSQELGLRPEQVDRTLALQEDGATVPFIARYRKEVTGGLDEVQIQTLFDRATERAELDSRRDTILRSIEEQGKLTPELAKALKAARARTELEDLYLPYKPKRRTRAAIARERGLEPLADLVWKQDGRRGEDVAARVRPYVNPEKDVPDQAAALAGARDICAERVAEDAGLRREAREVSARRGTLCSNVVPAKKGETTKFENYYGHEEPLSQAPSHRVLALLRGEEEGVLKVKLSLPDDEVKGLLAGRVVTKPQSIFSQELRAAVEDSWDRLMGPSLEP

SEQ ID NO: 10648 - protein, 60 aa, Myxococcus xanthus
KRFFIGALAFVGALSVLFVVGLVGLMLLASASKPGVPSNLVLELDLEDPLSEHGGGESLM

SEQ ID NO: 10649 - protein, 722 aa, Myxococcus xanthus
MLKKSVKIGESELSIEVGRLAKQADGSVVVRYGDTMLLVTAVSAREKKDIDFLPLTVEYQEKLYSAGRIPGSYFKREGRLTEKETLASRLVDRSCRPLFPEGYAYETQIIASVISSDPENEGDIHGITGASAALWVSDIPFDGPIAGIRVGRVGGQLVANPTAKQREQSDLDLVMAVSRKAIVMVEGGAEEVSEADMVAALDFGFTTAQPALDLQDELRRELNKQVRSFEKPAAVDEGLRAKVRELAMDGIKAGYGIKEKGARYEALGKTKKEALAKLKEQLGDGYTPLVEKHAKAVVEDLKYEHMREMTVNGGRIGDRGHDVVRSITCEVGVLPRTHGSAVFTRGETQALVVTTLGTSDDEQRLEMLGGMAFKRFMLHYNFPPFSVNETKPLRGPGRREVGHGALAERALRNMVPKSESFPYTVRLVSDILESNGSSSMASVCGGTLALMDAGVPLKAPVAGIAMGLVKEGDKIAILSDILGDEDHLGDMDFKVCGTSKGITSIQMDIKITGLTTEIMSRALEQARQGRLHILGEMLKTLAESRKEISQYAPRITTIQIRPEFIKNVIGPGGKVIKDIIARTGAAINIEDSGRVDIASANGEAVKAAIAMIQALTREAEIGKIYTGTVRKIAEFGAFVELFPGTDGLIHISELSDKRVKSVSDVLNEGDEVLVKVVSIDKTGKIRLSRKEAMAERAAQQGAAAGEAAAQPAPAPTQPDAKA

SEQ ID NO: 10650 - protein, 110 aa, Myxococcus xanthus
MDAWFTPILQNAKPHTHESVMRWLHATPREVVVGALESMLTFNSDRVLERYKGPLHTLVVDAFIQPNAYHLLYPGTPHTVFSGVSHWLMMDAPERFNAALDAFLATLPPR

SEQ ID NO: 10651 - protein, 312 aa, Myxococcus xanthus
MRFVQALGGSVALVVPRAVVRDLWSGANAARTMSRLMLVMGVAPILAPLLGGMVLQYSGWRAIFVVLAAVGAVALAFVLKSLPETAPPHVGAQSMRSRMGALMKDPDFVGPALAGGFAQAGMFAYIAGSPFVFISLYGIPEEHFGWFFGVNAMGLIAVAQLNRKLVTHLPLHRLLRLALSLCVVAAVAVLAVAWTGFMGLWGIAVTLFFFVSAMGLVGPNAAAIALERHATRAGMASAALGALQFTAAAGASWAVSTFNNGTAMPMAGVMTAMALLAWLAAFFGLRARTRQQEAGEGAQAHGPRIVSSSSAP

SEQ ID NO: 10652 - protein, 504 aa, Myxococcus xanthus
MDDEQRAHRSLWTVTAPPRDFPALPGDVTVDVAIIGGGMAGLTTAWLLKRAGKRVVVLDMHRILSGQTGQTTAHLTEVLDTPYATLRRDFGEKGAQLAASSSRAAIEQIAARVDELGIDCDFQRVPMYRYAETERELAELHHEVTAAREAGLLATFTQDVPLPYPVKGALRVEDQALFHPRKYLLALADRIPGDGSHIFENTRVTEVHDGAPCRVVTDRGTVTAAAVVEATTTPLNRVAMHTKLYPYRTYVVAGPLNGPLEPGQYCDSQEPYHYIRTQQVNGRTYVIVGGEDHKVGTDEDTARRYAALEAYTLRRFPVTDITHRWSGQVIEPADGLAYIGRNTASRHVYVATGFSGTGMTFGTLAGMILSDAILDRQNPFAALYSATRVKPQAGAKDFIQENAEVAFRFVADRLSRPNEHRLADVAPGEGKVLEVAGQKVAVYRAEDGITHAVSPVCTHLGCHVHWNGAERSWDCPCHGGRFSPTGKVLNGPAVKDLPAKKLPT

SEQ ID NO: 10653 - protein, 162 aa, Myxococcus xanthus
MDAIELLAQQHDEVKKLFKKYEKLSEGAEAKRQELFEMITDRLSAHASIEEQYFYPAAKAQDTEDLLREAAEEHLSAKRLIADLLDLEPSDEEFDAKMQVLQEQIEHHVEEEEGELFKKVRKLLSKEQLVDLGVQMQQEFEELMEGEPRTQVPAETEHAAPI

SEQ ID NO: 10654 - protein, 224 aa, Myxococcus xanthus
MPRPPPDVIRYPSYYTPSVRRALSRADPTLGALMKSVGPFRLQVRPLHSPFGALAESIVYQQLHGKAAATIFGRVCERVGSGRKFTPEALLAVPDTSLREAGLSANKLAALQDLARKTLDGTVPPLAKVRRMDDAELIEHFTQVRGIGQWTVEMLLMFQLERPDVLPVDDYGVRKGFMKAYGLTEMPKPKALLAYGERWRPWRSVASWYMWRSAELPDAPTVEG

SEQ ID NO: 10655 - protein, 448 aa, Myxococcus xanthus
MALTVGIVLGAGIFKAPSLVAAQSGSGEAMLLTWLLGGVASLVGALCYAELASAWPHPGGDYHYLYRALGKGPAFLFAWARLTVIPTGSIALLAFVFGDYATQLFPLGLYSSPVYAAMLVVGLTAVNIAGLRQGTRTQNLLTALEVLGVGAVVIVGLLFTPALVPAAAPPAPAASSGTAWGLAMVFVLLTYGGWNEVAYLSSEVRGSRRTIAWSLLASIGLVTALYLLVNVAYLRGLGLEGMARSEAVAADLMQRAVGSGGALVLSVIIAISALTSANATVLTGARTHYAFGRDSVLFNGLGQWHAKSNGPSRALLVQGAISLALVGLGTLTRQGFETMVEYTAPVFWLFFLLTGVSLMVLRVREPDAPRPFRVPLYPLTPLLFIGICAYVLYSSLAFTGLGALAGLAVLGTGGVLLAVEAVRTRRGSQGTSPKASSSPRLQRTKEAT

SEQ ID NO: 10656 - protein, 188 aa, Myxococcus xanthus
MAANAASVSTAQQTVTVQVRGPAGSSIQSPEVPFVPTPEGAVDGMLALAGVKPGDTVYDLGSGDGRIVISAVQKHGAKHAVGVDINPERIAEANQNASQAGVKNKVEFRQGDLFDADIRDASVVTLYLLPSVNERLKSKLLSELKPGTRIVSHSFDMGDWAPTKTVQSEGRTLYLWVVPERGTGGAPR

SEQ ID NO: 10657 - protein, 409 aa, Myxococcus xanthus
MVVPLCAGDRCYGVLSLDRAECETYPQPVVDLVEVYGQMLATAIQSAEQRATFERLHRQDHEHAKLLEAQLGGDSEGILETSKSPVMRDLARRARQVAETDTPVLITGETGTGKERLARAIHRWSARADQPFVTLNCAAIPAGLLESELFGHVKGAFTGATKDRAGRFQMAHGGTLLLDEVGELPFDLQAKLLRALQEKTFEPVGSDKTVRADVRILAATHVDLQQAIAQKRFREDLYYRLSVFPLRLPPLRERREDLPQLCAFLLEEQANRTGRRGMRVTPEGLVRLEAYEWPGNLRELANALERATILTRGTELGPESFDVPTRGAAVVAALPEEPAPAAGGPKRGPVLTLAAVQREHIMRVLTLTRGRVYGANGAAALLGLKPSTLQSRMKKLGIARLEQFVVDEA

SEQ ID NO: 10658 - protein, 73 aa, Myxococcus xanthus
MRNVTDLGRATQALGESYRRLRDTEREARSERHRLDRVLDSVPDPLILSDPAGGMVMMNSPAEKLLGTQTDSG

SEQ ID NO: 10659 - protein, 409 aa, Myxococcus xanthus
MLYFVQGLPFGFQATALPVYLRSQGVSLTTIGLLGALWLPWALKALWAPLVDRYGSTRIGRRKSWILPMQVGLAASCAAAAVAASRDALPALLALVFLMNLFAATQDIAVDGFAVDTLRPSELGLGNTAQVVGYKLGMLTGGGLLVWASARIGWSGLFVAMALLCLAVFMVMLFARESPPEAHATPSAATARQEPDWRELFQRLKKALLLPGAGWLLLFITTYKLGESMSDVLFKPFLVDAGFTAAQIGLWVGTWGTGASIVGSLAGGLLASRMPLLGAVGLTASLRVIPLVGRWLLATGGVTDAGVIGITMAEELFGGALTTVMFAFMMSRVDRRIGATHYTLLASMEVWGKAPAGPLAGWLADAKHGLSLGYAPVFLLGTVLSVAFLVLLVPMRRQKHAPSTTLNTA

SEQ ID NO: 10660 - protein, 89 aa, Myxococcus xanthus
MSLHQERKSELVSKFRTHESDTGSPEVQVALLSERITMLTEHFKTHKKDHHSRRGLLKLVGQRRRLLDYLKSKDVARYKKLIDGLGIRK

SEQ ID NO: 10661 - protein, 363 aa, Myxococcus xanthus
MEYAPVAGLWEVRESIASLYNRLYRRGMPSQYSAENVCLSGGGRAALTRAAASLGAINLGHFLPDYTAYEELLDVFKAFTAIPILLEGERGYAFTAEDLRREVQGRGLSALLFSNPCNPTGKLVHGEEMARWVSVAREHECALLVDEFYSHYIWTGRPGHLPVESAARYVEDVNKDPVVLFDGFTKNWRYPGWRMTWTVGPRQVIDAVASAGSFLDGGGSRPLQRAAIQLLQEEPVVAETMAIHNTFREKRDRFHSRLERIGIRTDRAPDGTFYVWGNVSGLPPPLNDGMGFFRAALDQKIIAVPGEFFDVNPGKRRARPSRFRGYVRLSFGPSMETLEKALSRLEAMVLHYSRTPGQPPPAP

SEQ ID NO: 10662 - protein, 89 aa, Myxococcus xanthus
MRAGMPVFGGTSLVLDGPGELTGPQGTDRLTLTGLHYEVGEYLPKEGTAVLETADGRRVEARFQPVLWRLGKAEVTVDDLEPVTVPIVR

SEQ ID NO: 10663 - protein, 158 aa, Myxococcus xanthus
MYRSPSPLPEKARAAIAESLNERLADGLDLHSQIKVAHWNIKGPQFASLHPLFETFAVSLATHNDSIAERAVTLGGKAYGTSRHVGKTSRLPEYPQETTRDMEHVKLLAERIEVYLDGLRKSRALFVENGDSDSEGLTTDIITEFEKHAWFLRASLEG

SEQ ID NO: 10664 - protein, 94 aa, Myxococcus xanthus
MAMNNVYYRFRHMIGKESYSTKRAGLRMNRLAQVLTNKVDFELVCLAVSAINGCEMCMQSHEKVVLDGGLSEDQVHDAVRIASVIHAAAVGLES

SEQ ID NO: 10665 - protein, 184 aa, Myxococcus xanthus
MLTVGDKIPNFKVKATVSLEKGKEFQDITNETFKGKWLVLFAWPKDFTFICPTEIAEFGKKNKDFTDRDAQVLGLSTDSEFVHHAWRTHHPDLKNLPFPMLADIKHELCNALGILHKEEGVALRATFIADPEGIIRHVTVNDLSVGRNVSETIRTLDALQTDELCPCNWTKGEETLTQKLSKAG

SEQ ID NO: 10666 - protein, 414 aa, Myxococcus xanthus
MSGVSQFESPPARQQPVALNAPAALARGPSVAPGSYPTAADVRNIAAMQDPVARNHAITQGYSDLSNAMGQLLGTENANWSTFATWASKQAGVSIRGEDMPKFFTDALKGADGVMGPMSKVDDLLRKLGLPSLPLGDIASAGNQALQNVSKAIADGNKLVFEEVGQEFARFVETFQGDTQYDAAKAEQYLSGFPADKPLLKEAFGHYAQAMFEKDPNKKAELMLLANDKVGLHEQTQLQPYVEKALNSPVKDTFRDILKQTVEAQINALPFPANLAGKAALKTGLVDAALNPVVDGVANVFRRVATEHMMKLAVPGSALKLGNDLPPPPGMESTLFPPHLRSIENPELRALLGQLDKSQDSLKGSGAKDWSKLDQRMNYIVDLFRSRQSDPALFDPPFGQRGTYPVAPSAPRVS

SEQ ID NO: 10667 - protein, 297 aa, Myxococcus xanthus
MTGWLDITGVGAPVTVQDAGRPGKMHHGVPPGGPLVPELLALANLAVGNASGTAALEAFGRLELRARGRSVRVSMGGHAFALADGERLTVPAPESTSVRYVAVDGGLAVPEVLGGRGTLLVARLGGHEGRLLRSGDSLPLGDTNERAEARAPGASLDAAAPIRVTLGPDNRRFGPATVATLLSGAFTVSAATDRVGMRLQGPSLTHGDEGTGTSRPMVRGAIQVTLSGTPIVLGPDHPTTGGYPLIATVIRADWGRLCARRPGAAVRFQEVSLEEAREAWRHHAEHFGVGGRPTPPP

SEQ ID NO: 10668 - protein, 75 aa, Myxococcus xanthus
VVTWRDDEIVYEMVTDMDESDIRRMLAERDSGEKLARKSAPEADEPLYSLPPAPRTPHSWPPISVEPVTYPTYPQ

SEQ ID NO: 10669 - protein, 562 aa, Myxococcus xanthus
MSKKILIVESDTALSATLRSALEGRGFTVDETTDGKGSVEQIRRDRPDLVVLAVDLSAGQNGYLICGKLKKDDDLKNVPIVIIGNPDGFAQHRKLKAHADEYVAKPVDADQLVERAGALIGFPELPATEDVVDESLTLDALGDEPMTADFGEEISVETAEEPSVTGEELDLDAAFGDLSAPEETPSFEEEVVVAPPEAVVEGVEEDFSTLDSLGTDSVDPLEGLDDASDEKTVIGFIAPAPVAAPPPEPPRAVAPPPVPRPSAPARPAPPPVAVAPAADAAELRSLRAKVAELQAELDDSRGAASHAEERVRDLEAQLESQATELETARASSGKNDKDTFALRDAANKKDKEILRLKTELNQKDQEIIELKDESLELEQKASTAESELAQRDAQLKTLSARAESLATDRRRVDQQLAAAKEEARGASAQLTALQTELDQHQAQAHAYAAELEELRARAGQLEADVQAAQHEAEDLRVQVGQAQVELSEQSSRASAEADELRGRIAELEAATARNEERVTRLYARIKSEEKLREKTKKALVIAQQLLDEPASSVADDASEAAA

SEQ ID NO: 10670 - protein, 550 aa, Myxococcus xanthus
MSRGAARGTAGLLAPLLAAGEVWLSLPGKPEAWRVPSPPFLTALELSRLAVELARAVELGESRFELAPAGAKPSLLVDLKTGQAKAGRTGTPFPLTGTVLAAALFHLGESLAAAFAEADHALVANPYRMELAERCREGLSHLRGPVQPPEAKGAAREKKARATGQGTSRPLKVPGRLRRLRFAKLWEKRGLPDAEESRLLLGRHGPVYCAPHLASAFSRKDGELLWRRAAALGVAASADGHAVAADIARVYGFTGRGGGARWLHDHDGIPLGPLLLRKDGLLLTLSEDRTVVAFAEATGREVWRLAPPRTQRSWLATQGHRALVGTDSGYLYGLDLEDGQVRYRMRAPMPFHGPPVAWGRRFLAMLGRGSHWAVLLADAHTGESVWTYEPDLSHLSAPLPVGSRVFIAGEREREGMLLCLDTKGRRLWERPLNLGPGPFALASLPRAVVVTSASGAATRVAASGTVDWRVGAAGEPLISALPAHTARDITLVPGERVRAVDPRGGQVLAEVQAGVGLVALQADVRLNLYFLDDAGTLSAYRLGSHFTVVE

SEQ ID NO: 10671 - protein, 53 aa, Myxococcus xanthus
MAPVNRVRDTYHLLSAAGVSARFLELPGPGDHAALLQDAERLHAPLSDFLRRC

SEQ ID NO: 10672 - protein, 222 aa, Myxococcus xanthus
MNSAFLRAPVETEQALAASAASAARYFSAGKHGWSFVICDDWLAPSVRDNAPSILAWYGLKSEMDVTGMVADRLAPSIHPRHPFAVRPVTDTWGRQAVADINANVYDVPRHFGREAFDEDTLYTPDCQGFVACRDEEAAASTVVLRVDAAAYVALVATQPQHRRQGAAEAVMRHALAKAHQDWGTERTVLHATSAGEPVYTRMGYRPVTRFRMYMAPPPGQG

SEQ ID NO: 10673 - protein, 186 aa, Myxococcus xanthus
MGTERDKARLSFIALHLGLCWLLLGTERDAREWMQLAHRTAVEAMKDILVEASKHQGLTQNRYLDPALTFFMFFTSTATLGAGYLFWDRVLSKRTGTVMRRALGQMQALADYVDMLGDVRLHLGELPHDVARYELTHGVDEQQSVARITIRKLINDREAIYFNGRETRKVTWNDQERSEVITRELI

SEQ ID NO: 10674 - protein, 97 aa, Myxococcus xanthus
PELDGLAVCREVRRKHELPIVFLSSRDDEVDRILGLELGGDDYLTKPFSPRELVARVKAVLRRARPAPAPEVEAPAARMQSRGPLRMDAERWRAWWH

SEQ ID NO: 10675 - protein, 323 aa, Myxococcus xanthus
MVGALYMLTFDPDANVRETAAKTAAGLPDRILGSALRDEEVQPQVLGFLLGLVKGNEAYAEMLVLNASTPDDAVADVAKDCSPKLAEIIGQNQLRLLRHEDILRNLCANASAPVSLVDNVCDFAVRSGLTLMDVPQMKAARVRVFGPEAAEAPPPQGPTAEEVLQEFQEAADESAAPMEEGKRLTLAQRVMRMSIAEKIKLATLGNKEARTALIRETNKLVAVAVIRSPRITDGEVLSCAANRAMMDDVLRVIYSNREWTKNHKVKMALVKNPKVPLTVTMKFLNSFRDAELKDLSRDKNVPAAVQGFAKKLHEKKTAPKKQG

SEQ ID NO: 10676 - protein, 256 aa, Myxococcus xanthus
MLLAIDVGNTNTVLGVFEGRRLLDHWRVETSTRRTSDEYGILVRQLFTHRGIDPMKVTAVVVSSVVPPLQSNLEKMSERYFRVRPMFIGPGVKTGMPILYDNPREVGADRIVNAVSAYERHHAGVLVVDFGTATTFDAVSPKGEYLGGCICPGINISMEALFQNASKLPRVEFARPPHVIGRNTVHSMQAGLVYGYVGMVDGICARMQAELGFPVKVVATGGLASLVASESKAIHQVDEFLTLEGLRIIYGRNHAS

SEQ ID NO: 10677 - protein, 195 aa, Myxococcus xanthus
MGGAAVLAALVLGTGCSKNVDAAAGASASTDDVSEYYPLAVGNSWTYRINGRDDKQVTVEILKEEAGVFHDSQGGQLSLDGYGLRDPKRYLLRGPVRTGHSWTNVVSVSSTERYHIVQAGDSCETPAGTFPRCVQVEGRNRVDAKATLVNTMTFAPGVGMVRIEMAVETNGQLMPQTSLELTAWQLRDGAAPPSG

SEQ ID NO: 10678 - protein, 226 aa, Myxococcus xanthus
MTLDVPFTREVLKDGDPRSFAEVGANLVLERFGGSLPQRYELVGLGEAPVEEDSPAGRQMAMRTALTNVLRQVTESAVMQLTALDRSDEALVLDLKATDSRVREFSLRTLAERQHPAAAPLLIDRLKEATDAETVRRTMGSLVEMKARVAVPVLIDLARGRDLGFVQEIVFAVGEIGGPEAEAYLYTMAQGHDAPAVQAAAQQALDTLYASRKHSPAEARGPGRAD

SEQ ID NO: 10679 - protein, 295 aa, Myxococcus xanthus
MTFYEAALRILESEGRPLHFLEITEKSIQQSLLSHVGKTPEVTMLSRLAAMARRTRDRKVLVTAKDTFALVDWSIPEDVEALAQTGVVEPHPEEELPPLRPPERHPEPRTDNVRVAGRGSDRKRRRDEDEERGGRRKRFPPLPEVVFEILSESDIGLRTEQIIEHARVKELCAEDTTVEAVLTALLEDNQRRIDAGRRPQYAFNKDSKRCRWSALAPRARPRRWSSRPRSRRRWAFRWRRAVRCWASRLPRARPLRMPRWCPRCAPRSRTRAAPWRVGCASAWASWTSVRSRSPS

SEQ ID NO: 10680 - protein, 253 aa, Myxococcus xanthus
MRANPDEASYRDELKPFFKNYFEQVDAHLTRFKGNTKFDDYLLELEKREESGAKDDRAKDRKAFYEYTRKTFDSLREGRYRPVWSATDKGMRLDIISSDVVMVLGKPQIRLQLAVWGAQRVLKDDGKVLKMVTSATFDTVWKLTDAKGKLLGEMRGADPSMKIDHPERFVRAFPPQMMLGHYDLDLLPNEVAKVEMTINLSSSAASGGTAASTYVWKLDVPSEWKLGAGETWEGATQEERPEEEIDPSKAAAN

SEQ ID NO: 10681 - protein, 211 aa, Myxococcus xanthus
MASPLVVGIAGGTASGKTTVARKVREALADCRVAFIDQDSYYRDLKDLPLADRREVNFDHPDAFDRELLVQHLQALKSGQPIQKPVYDFVTSSRTPQTKKVDPGDIILIEGILVLHMKEVRDEMDVKIYVDADDDLRILRRLTRDIKDRGRDFDHVVSQYLRHVRPMHMGFVEPSKHFADIIIPHGGNNEIAIGMLVGALRGKLSGAVNRD

SEQ ID NO: 10682 - protein, 393 aa, Myxococcus xanthus
MAKLHARTGAPLLLDLGHLLSHQLSAGLPLQTGLDGFPLDQVIELHIAGGVVTHRGPRSFYVDDHTQPVREELFDLLASLIPRCPALRAVTFEGDGHPPEVARMSLRRLRQWVPAGARPPLTWRVPAAVAAVPPLTEDSQPWALFDAGYAAAPAASVEDEAGTLADQDFRLAVVAEVLDRDWPLTRLLLAGTREGLAAFTGSKEYRKLFDSVARTPGQSFASWAMRRLRESPDEGASAALTLEMLLPSLFTRRVPAPAPGQVGLMEDVRVGSLPVDLSELVHSARAVRRHLTARAWACGTLELSGLDSLNQVARRPGPGPWSFVARRRAGGPEVMSVPPALGEFLGMLAVRPMVEAEVAPGLLEAARARGLIRQAEREELSGSGPNRWPGGQG

SEQ ID NO: 10683 - protein, 157 aa, Myxococcus xanthus
MVAQRVAEARKLDAETAMLAAVMAGGSLGRAMALDVDALSRRKDTLTAFEALRGEDAVGLLRFAEAHGGSREEAESTLELLALWTRDVALVKSGLESGLANRDMVDLARQVAARTSDILLHRRHSLLDAARAAIARNGAPRLQLERMLIDLFTEASR

SEQ ID NO: 10684 - protein, 439 aa, Myxococcus xanthus
MDDVLASVKGGKVAPVYLLVGEEFLVRKGADELVKLLVPDAAMGLNLAVLDAGSPREVAQELATLPLFPGRKVVLVRDPEFLAPKKGRGDALGKAREAWKAGKRKEGARRLLALAARAGWGVDQLDPSTPGAPSVEKWKDELNVELADVDVAFLKEAAAFCREERISAPEGDASALLDLIQKGVPAGHALVLAASDMDAKNPLVKLAHDKGYVVERKVAARHKDLDLTDIAKEFLAPFKKKLGPGALDELKERIGGNIRLLQSELEKLATYSEGPAIERADVAALVHHAREEEFFELSEALQKRDFGGALSYANDAMGQGTHALQLLGAVASIVRGLLESHEWLWRYAGGNPPRTAKDVEARVFPRLEAELKGSKRKMPNAWALTFSMKAAAGYERRELLGALVACAEADLALKSSANGRLVIERLLATVCVRQHGAGY

SEQ ID NO: 10685 - protein, 152 aa, Myxococcus xanthus
MADKRRFDLFADFLVERFNAPRVFDVAGGQGKLNEALTKRGRAVTTFDLRHKHLPVTYAQRIFTLEEPCEAELVVGMHPDGATRIIIQYAAAHRLPFAVVPCCSDNGMPYNPWMRHLAELARESGFTIVEEVKLSMDGRARVLVGEHGAAAS

SEQ ID NO: 10686 - protein, 703 aa, Myxococcus xanthus
MAERTLVTSALPYANGPLHIGHAVEYVQTDIYVRFLRSCGRDVVYFCADDTHGTPIELNAAKQGLKPEEFIARFHEEHQRDFHDLDVRFDYFHSTNSPENRQYAELIYGRLKEKGDIERRNIEQTYCENDRRFLPDRFIKGTCPNCKASDQYGDACEKCGKAYDPTDLIDARCALCGTPPVRKHSEHLFFKLSRHEDFLQDVLRKPGFIHPGLATQLQGFFEKGLSDWDISRDGPYFGFAIPGETDKYFYVWLDAPIGYIATTEKWAKETGKAKSALDYWSADADTRIIHFIGKDIVYFHALFWPAVLNVAGFHIPSEIKVHGHLMLNGEKMSKTRGTMVPVRDYLDQLDPSYLRYFYAANLGPGVEDLDLNLKDFRQRVNGELVNNVGNLANRALSLLAGPLEKRLAPGRAEGPGRELVEAALARVPEVRDAFDKLEYRSAIRVITEIASAANGFLQTAAPWAQVKKDAEVARADLSDAADVAYLLGALLAPVTPRLSEKLFAQLGAEPLTFQALEGAKYPLLDRSRPIGTPEPLLPRLEEERVNAIIKLPEGAAAPDAAEARPAKGAKTEKKPAEAPAATQAAAPSAGAAESPGEIEYDDFAKVVLKAGKVLAAEKVQKADKLLKLTVDVGEGSPRTIVSGIAEAFAPEALTGRNVVVVANLKPRKLKGIESRGMLLTAGPGGKELSLLDPGDVAPGSEVK

SEQ ID NO: 10687 - protein, 211 aa, Myxococcus xanthus
MLEDGTFEVRFEAARGIASLHHAAGLEVLLEALDADLLRFRALGALAELGDARALPQVKKLFGRWLLPAFDKTQAAGVLAKLGDSDGPTYLIQRMAKKRWSPDRALAVELCGEVKVPGALERLKEVLDDVKDPCRGAAARGLGRLGDARALPWLVGLLQDAQASEDTRLDAADGLWRLGGAEAREAVRNAVSTFPSPEARAELEELLQEEP

SEQ ID NO: 10688 - protein, 258 aa, Myxococcus xanthus
MKFVDAHCHLEVKDYPDVVAVLDAARAAGLVHAVVVGQFHGPGNWGNALEVAAAHPEFLSPTLGIHPHEAARATEEDLATLERTCARPEVRAVGEAGLDYYYDHSPREAQAEVFRRQCALALRLGKPLVVHVRDAHDDCDAILGETGVAKGVIHCFTGDTDAARRYLDRGFLLSLSGVITYKKTEALQDAVRFAPLDRLMVETDSPYLAPVPHRGRKNQPSHVVETAKKVAELKGVTLEEVASVTTANAAALFNLNLR

SEQ ID NO: 10689 - protein, 45 aa, Myxococcus xanthus
AAYNVHVSVEFFGRLDRALLTRCVNEVVRRHESLRSTLRSPGEIR

SEQ ID NO: 10690 - protein, 64 aa, Myxococcus xanthus
MGNEQERADTQKGLEAAKGFVRREVTSAVNLRVSPEIFFSFDESVGEGDKIDRLLREVRNKEGW

SEQ ID NO: 10691 - protein, 712 aa, Myxococcus xanthus
MSTGSGPKCTFPHRLRMVGSRRSIALATRMIVVSEGGSSSVLRNAFCACTFMVWAETMSATLRRDSRPRRAMRSWSWRTCSTRSSRLGVPVKSDRPASPRDTRSSSGITQVTSGWRPLSTRWQLAQAPQPTSGCSGHVRAWASPTAASSLPTPSGPAKRYAWWTAPLRRAAWRASTARGCPSTVASVMARVSPLTRHASTAALTPMEMAGDIPPALLPFLQSNLSLAVGALLIVVLMGVRAAAQDADLRQDLKSANRLLIAFIVLRLATWALPATAPEGLKKALQVSWMLMFTFGGIRASVALALKVIRLRAPAVGTPKILRNVIDFTLYPLAVLPLLRTQFNVDLAGLVATSAVLSVVIGLALQETLGNLFAGLSLQLDRPFEVGHFIRIGTHTGRVVFIGWRSIRLANFRREVITLPNSMVAKELVLNFTQDPNPVGIDVEFRLSRDAAPNQVKHALLETMRETPLILPEPSPIARTLGYEDSAIRYMVRFFIGDYGLADAVKEDLHSRLWYRLRRANIEIPYAQRTVHVRQEMARTELSEDTIRSLLGAVDLFQSLDTEELDRLRQESLVRRFGAGERIIQEGDEGRTFYVLASGEVSVRTGKSQSEVTRLGRGSYFGEMCLLTGERRSATVVAVEDSLLLEVDRPTFARLFTEYPGLARQLSSMLAQRRTQLRAVAEASGTSNDAIPAEVGRILGRLRQIFGLNATHE

SEQ ID NO: 10692 - protein, 156 aa, Myxococcus xanthus
MPFNLLYGDAQRLRVAYARRTDRQLRREDVPPGVHVLPNDVLNAPELPKVERARLLTTEVAKKPWPELAEGLKAVLADPTLPTEELIPPPGAGEDLPRDFLQRLQALCIHTPLYGTRSSAVVALAPGRVGHYLASDTPPCQGPWKDVTGLLTGPTE

SEQ ID NO: 10693 - protein, 660 aa, Myxococcus xanthus
MVKRLGERLIEAGLVNAGAVEQALEHQKITGHKVGDCLVELGLLQEAALLRFLAAEFQTRFVSADKLAKARIATEVLDRLPVRLAEAQNVLPLAVDPERKLLSVVAAEPQNKSLMDEIALVTGMSEVYAYVGLRSAISAAIRKHYYGDPTAFAALLEGANAQGQAPAAPSRPGAPEHGRTYAGSGTGTGAGNRGGLSLNFRVETDARMRLQRGSSTGTPAVRPSTQRREPGGPRGLVSDSDYVETLGIMVGLLEQDRQRHRGHSAQLARQAGIVGQRMGMPHKELAALAIAAYLHDLGKPAERHFSLASNAVNPEWKAQAKVACRIPTRMFETVHLPAQTNTILAQMYEAWDGSGTPQGAKGEDITLGARILAAVDSFLELTKNPGNALGRVLPKEQALEHLRKYAGALYDPVVADIVIQLQSGELLRHRLESEGRQVLVVEPDETARGELLEAVLKQGLVAHALSTVEGAQDGLARQDCDVLVVSLRLGLQDVTDLLAQARSAPETAGLPIAVVGEPDNATRERLLMAGATDVLSPADKPAIAKTVQALYDDRVQHNGPGRVVRGSFDELPPRELLRTLGGGHKSGRLNLRQHTLEGYLHLERGRVVFASFGGHSGEPALQALLKLKQADFQYDPDALLLDVPQMDQDLAALAGGLNAG

SEQ ID NO: 10694 - protein, 262 aa, Myxococcus xanthus
PGGLAEHILSVMRLTLRVADQYPMADRDLLLAGALLQQVQKAADASETSDEGRLVGNLVLTAQKLREKALAIPGFPPLLEQHLTHLVISQHGDAQHGSPKSPVTLEAQIIHSLESLDARIASWLEAMQRDSHDKWTDVVRPYERQLWKGPSPTSRGRAPVEGGGRRKGREEKRKARAEKQQQPGTPAEGAPQQEQAQRPPRKERPPREERAREERPPRPPREERPPRDASSLPKELTFKPFSALTSLPSDSGNKGGEGSSES

SEQ ID NO: 10695 - protein, 690 aa, Myxococcus xanthus
MSGHASASQAAEFKENAFTERVVDIIAEAGAITGGHTCYFRKELGNRHLKANGYNVGEDEEHLDIIISIYRDTPVPPTLRMTEVYQAIQRALNFVSAAAADLSSKMEQAHPAYDMAERVREVFSKASVQRVNVIVLTDCVVREHQLQKPLKISKQSRIDVRADIWDIERLYRSMSSGCVRETIDIDFGEFERTIPCLPVPISEGEYGAYLAVVPGEVLFRLYDEYGERLLELNVRSFLQARGKINRGIRDTLLKEPQLFFAYNNGITAVAEDVKTKLLPDGTTALVWIRGLQIVNGGQTTASIHRAGKKDQAELSRVFVQMKLSQVRLVHLETLVPRISLYANSQNKVNEADFSANDLFHQKLESLSRTIWAPGEQSRWFYERARGQYQVARGKASTPAKQRQFDSIHPPSQMFTKTDLAGFEHSWGQRPDLVSKGSQKNFVEFMLLFKAQQPDFSPDEQYFTQLVAKAIIFRKVQALAREARIGAYRANIVTYSVAYLASRVGARLDLAEIWRAQKLTPQLEAALRGLLMPIEEAIKRTAEGRNVTEWCKKAECWRAIKAMNFPVPANVAGALYAARAGRKGAAKEVQENLRKAALPKLAEAVNIALISFARAGQKADAASIADAITKTLAPGGLEVINNVPSGGVLWVVGGMELSSIMREVREHGLRAEFREGGGRATEHRPAWYITC

SEQ ID NO: 10696 - protein, 151 aa, Myxococcus xanthus
MRLVAPLRDRVLVHVDLHETTDSDEAEFRPALAARDGKPFEPDHTPDGFYVVGDTENPRLDFQQAVIAAVAKVTHIAPPDADGKIIGSPVVAPGVIHYALRQLGLCAGITRARYVTTTEVYPDSPRATPAQCSDAQVAAVTAALDYALAHP

SEQ ID NO: 10697 - protein, 126 aa, Myxococcus xanthus
MGKPFHADELRARIRSVLRRPAQARQLQPVRCGAIEYDLGSRQMTVQGRPLLLRRREASLLAALMRRARRVVQRDTLIKEVYGFDEEPSANTLEAHISRLRRRLEDCGAGVVLHPVRGVGYLIDEP

SEQ ID NO: 10698 - protein, 490 aa, Myxococcus xanthus
MKRLTDSLAPRLIAAVLATQLIVITGLMLFWMVFSHSVSHDDLSAATSQRRVAESITLDPAGAPRIEPSSALRAYQARRPQLAYAVYLDGRLVSGSSQQLAHAISPRGWAAPGANLEPAPTLADLYRHFPDLQCVQLLAECGDPVIALGEGQRANVSMFPIHGIGTAVVVTSGNRLGLDDLPTALLTLIPRVMKLFGSAVLATVLVLPLMLRRALQPLTRAANAASGIGLETLDQRLSPDGVPKEIQPFVTAINQLLERLERGVSRQQLFVANAAHELRTPVAILCARLDSLGDSPATRDLRRDATRLGLMVDQLLAAFRMQGQTPADWRALDLVQQLRDLISDMAPLALRSGRAIALEAASPSEMVLGQADGLRSALANLLDNALRAEPAGGTVIVRMEASTSSVTVDVVDHGPGVEESDRENIFEPFWRREGQWSGTGLGLAIARRISEGHGGSLQHLPTEGGGATFRMRVGRSPAGRSIDPSACCKD

SEQ ID NO: 10699 - protein, 54 aa, Myxococcus xanthus
TQTPELTIQTALGMSPETFWTMPFEKLLPPTEPLNEGRDSVALAHRLGNAVDDI

SEQ ID NO: 10700 - protein, 150 aa, Myxococcus xanthus
SLALAVVGNERRHVDEQLEKIIHSVEEMYVAPLLSRETEILGFGDQLFASGQAASRGSFSAQAVDEDVEELDLSPEQAAAHSEAAIARFLRGERGSLAEAEGLGEWESRHEGGMDGGTSRPSPSSGGRMTFDEARARARSLRNPRDWEKK

SEQ ID NO: 10701 - protein, 256 aa, Myxococcus xanthus
MTAERLIADTEEMIHWARKELGKEKIFLLGHSWGSYLGLSVAQRHPEWLHAYIGMGQATDVLESERRGWRFAMDRARAAGNEEAIRELQSIAPYAAHGAALELPVVAIQRKWLGFYGGQVHGRTGGQAEAEGFALSPEYTDAELASVWTANELSEEKLFPAVLRADFSNVTRLECPMLLFNGRHDYNVSASVAAEWFERLHAPIKHLVWFENSAHEIMNEEPGKMLLSLVRYARPIAEAAGDAPKPAPRDAATGAR

SEQ ID NO: 10702 - protein, 194 aa, Myxococcus xanthus
MGRPRGFDRDEALVEAMRVFWARGYEGTSIQDLVDAMGVNKPSLYSIFGCKEELFREAVELYDRLEGIHTTRSLEDAPSARAAVEEMLRANARAYTASDKPRGCMIVLSSLLGSPENERVRTFLAENRLRGERALKQRLERGILDGDLPASAEVGMLAAFYTTVLEGLSIQSRDGASAKKLAAIIDAAMLAWPT

SEQ ID NO: 10703 - protein, 367 aa, Myxococcus xanthus
LRGQRFDLEAKYRGATSSVFPKRSLTLKFPDEDLFTEPVFGNGFEDRKRVVLITTFNDNSYIRSRLAFDVWSRMSPGHIHLRTYSAVLYANNKYVGLYTAADHVNKRLMAAHGIDKDADAFKAVDHRANFSRLRKDGTTKSSLHEGFEKSEGDPEEGEPGAFAPMEALTAFIADSNADAFRAGFPQRMNARDYEDWWIFNTLILGVDSQAKNAYHAYDPATGGPWRFIPWDLDASFGQTYDTTRTSPTARPNFRADNLLFQRMLADPTIAGPLRERYRALLHGSLNVEVMQALIDGYVQETAPSARRDWAKWGAKHRAFGDPNDPWGGHGNFPHWHTRKDFNSYEKEIEYVRQWIRTRWDALESQLP

SEQ ID NO: 10704 - protein, 342 aa, Myxococcus xanthus
MATRKTSKRNVVARNRSTEATKAAFEELARKARNKPIVSTKEQDAQEAHAKNVLADVSSLTAESAVKKVTEAGLTINKTLAGINEQVISLVEELKQLDEAIQLKTEELNGLHGKDVAASAIDVLVAEYDKKKAELEAEMERLQKDIEDTRAKAAADQSSERQATEVSRKRAEEEYAYDTQLQRKKEQDAFAESLRQQAATERDRKEKLEKDWATREDALKQREKELEDLRKQVADFPLVLKKETDTAAAITGNRVKSEWELKLTLATKDAETAQRVAAMEISSLKETATKQAQALQTLQTELAEAKRQVQAIAEKALESASGARALAEVQGVIASRDYSKGK

SEQ ID NO: 10705 - protein, 125 aa, Myxococcus xanthus
MEAQGLHGRVELVGGSFFEPGLPSAEAYLLKHILHDWDEESATAILRNIHAAAPAGARLFVMELVMPDNQTPSPVPLMDLNMMVLADGRERTANEFQTLLTRTSWELVGIRPTQAGTCIIEAVKR

SEQ ID NO: 10706 - protein, 46 aa, Myxococcus xanthus
MGIPGRAQAHSDHPVVALEQGDFLLVSLIRTSPEEIPQTTSIRWRP

SEQ ID NO: 10707 - protein, 269 aa, Myxococcus xanthus
MDTEALARIPGVNPNVPNAARIYDYTLGGTHHFEADRQAAEYLFSLVPSTRKWVPMLRACLRTAAQRLAADGFHHWVDFASGLPTGDHVHAVLPDARVLYSDVNPLTITTAHHLLGDTPRVRYMECDIRQAGAFLRRPDVNAFLGGERRVAFGANGITVFLSAEENRQFFRDLYDWAAPGSKLFTTFETKSPDLSTPKWEQFVGMFRQMGESFQLYSLPEYLDLCGPWARDATGVLPVREFLGLPPEHITDEDREGVGIEFYAVVLEKR

SEQ ID NO: 10708 - protein, 97 aa, Myxococcus xanthus
MEALKDLRESELAEADAKLSQAEYEALKTNQDVRAQNLSEADFASATADAQRKVEESQRKLQSQQQQERQARATWERMRNQVQGYGGSGTEHKQRNP

SEQ ID NO: 10709 - protein, 532 aa, Myxococcus xanthus
MYYIVRCEPACGGAIVTSDEFQATVRGLHNGFAYTFKVAAVNINGEGPASVQSELVTPQPGLSIPNPTVPGQPRGVRATPGNGHAFVSWLAPASYGGRPLRQYRLTAEPGGVSVMVDAPAASAVIPGLVNGVPYRITVAATNEKGEGPVAVANTIQPRAGGEPTEWVTGYFVGYQLWMQPVDAVDLAGITHLVVGRVKPNPNGTLNANFDANIDDSHGRAMAKALATRAHQQGRKALLMLGGFGEHEHFVHAASEAQRAHFIRNIIQLMDELGYDGIDVDWEPIILAADIPEGAPMEPDDGEPLLALLEGLRAARPDIILTVPVDWLNSNFKMSRYRADFMKQLASRVDQLNIMSYKMSGHWGGWESWHSSPLYGHSQFHPTSVSHSVEGYLDAGVPAGRLGMGIGFFGTCWGGVTEPNTPLDGREGVFEGQSDNFMSYTNIMTHYYRADASRWDDEAKVPYLSFPTGHGPGLCNYVSYEDPRSISVKGQYAREKNLGGAIIWTISQGHFLQPTNGHRDPLLDAVKHAFLDP

SEQ ID NO: 10710 - protein, 291 aa, Myxococcus xanthus
MFRVSTLDAVNPPRTSDGKIDWHKDFFGKEAYLTVSGQLNAEAYALAMSKVYTFGPTFRAENSNTTRHLAEFWMIEPEVAFADLNEDANLAERFLKHVFKAVLNDCAPDLKFFEERVQKGVIERMEKFINSSFERIDYTEAVEILKKAKKKFEFEPEWGKDLQTEHERYLTEEHVGRPVVVMNYPEAIKSFYMRLNDDGKTVAAMDVLAPGIGEIIGGSQREERLDVLDQRIQKFGLKPESYQWYRDLRRYGSVPHAGFGLGFERLIVYMCGLQNIRDAIPYPRVPGSAAF

SEQ ID NO: 10711 - protein, 480 aa, Myxococcus xanthus
MTAQSANGQSLAVVVPRPDAEHARSVLVTELAQELSRREVEPLEVRQPVTLLTLVAETMGHGVNVAGRFFSALGAVGVNVRASAQGASSRSLSCVVDAADTAVAARTTHAAFNLAHQQVSLFVLGRGTVGGQLLAQLRAQQALLRDRHGIALRVVGLADSKRALFDAAGLTLDGVEARLEGVTPEAPQARTLVPLLDALRRLPVPILVDCTAAGGLEALYTEAFQRGIHVVAANKKPLALPWEAREALVDTARRNHVAYHYETTVASSLPVIDTLANLVRTGDTVRLITASLSGSLGFICNELTAGVPLSRAVRTARERGFTEPDPREDLSGTDVARKALILARELGLPLSLSDVALEPFVATDECASVDSFFQVLATQDAAYAERVARCRHAGTVLRYLARIDPSKAGTGSPVIRVGPVGVEAGHPAADLRGSESFVSFTTTRHSDFPLTVRGAGAGGAVTASGVLADILRISQTLRGR

SEQ ID NO: 10712 - protein, 458 aa, Myxococcus xanthus
MALGNFLGGHLADRWPRQEVLAGSMLLAAASCLLIPPIHQWLVLKGYFDGLGLQARIVGYTAAVFLLPVTALGTLSPQVLRLALADVERAGRTVGRLYAWSTAGALLGSFLTGWWLIAKVGVYPLVMGASLGLVALAAFVGQVWRRPLFVGATAGTLALAGMFGALGLFASPCTEETDYFCIKVNQVEHDGRRLLAMQLDHLTHTMVDLEDPSYLGYPHGYIHSEVVRHVAARTAEPRVLVIGGGGYVVPRWVETYVPQVRMEVVEIDPAVTRIALERFGVKPDTRIASFSLDGRQYLQEMAERGAYDLIVQDAVNDLSVPYHLMTREYDMLVRSLLKPDGLYLLTVIDEIPRGSFLRSALRTMQEVFPHVELLHDARSGSKGQGVYIVAGSARPMELERLPELLRGVGIEQPRTGRVPRAEIDAYLAAGPALLLTDDFAPVDNLLAELFLLREQVAP

SEQ ID NO: 10713 - protein, 484 aa, Myxococcus xanthus
MASRSFALPLCVMLLALAAPARGAVVRPGLPPPEEVMATLRQLETARARGRASAMDSELEEQSRVRPGDLMPRMYRAWLTFPSDACWNELKALSTLDPENPWPFVGMGLIYVRWGLLAEARPPIAAALKQVPGFAPALWAQGVLLQAEGKPAEAEVRLREALAQLDAPQIRTSLAMLLAGIPEREADARAELTRTVEAWPEQPEALRKLAQLARAANDVRAAATAGEKLVALKPRDKDAHRLQADLWLAASEKEKAAGSLERYAELGGMEPAALGLLVRLYRELGRADVEDKALVRLVAAAPEDPEPLLRLAELAEARGDSKAAETHLVKASERAPARADIHVLRARLVLKQERHQDALAAYRAALAAPERRVAEAESEAAALVRHFRLPSQPARGTQDQIYNRVSLGLVALYMNRLQQTPGIKGNLKVQVQVDASGRATGVTVLYDSLNEAVITGHAHFAFMDAQYPPGPDTPVFQYVFRPPK

SEQ ID NO: 10714 - protein, 583 aa, Myxococcus xanthus
MVNPHRRSRLASALLASLLFTLVACNGGGGSTKPDAGTGPNTPDGSTPDAGDDCGDGQRQSGEACDDGNRVDGDGCNATCTTVEGGFICEVPGAPCVHLVNCGNGRVEDGEECDDRNLVSGDGCNGSCRVERGWACPAQGGRCRAKECGDNIIAGDEECEDGNTTPGDGCSDVCRLEEGWKCPPGQPCSRTTCGDGITEGTEQCDDGNTVMGDGCSPLCTKEPRCSDGNCEETCGDGLILPNSAVEECDDGNTRANDGCSPDCKLEDGFACVLIEQEPPAQVSIPVVYRDFRGWDLPADPANDLPRGHEDFQNRNAGREDGIVENRLDANGRPVYAKEGQASNNTSNRANFDQWYKAVENVNKTIVGSFVLGRQSDGSYVFDNDAFFPLDDVSGSWVAEGHEPLRRDLARQQRNFHFTSEARYWFEYKGSEELTFRGDDDVWVFVNGRLALDLGGVHGPADGTIFMSGQASTLGLRRGGIYEVVVFQAERHTEGSSYRLTLNNFLTARTECTATCGDGVVDADAGEECDDGVNAGGYGECGRGCLWGPRCGDGETQENEGEECDDGNTVSRDGCSSTCRLEIG

SEQ ID NO: 10715 - protein, 408 aa, Myxococcus xanthus
MREQYPRLHQALKREPVGAHSVLYTWTGTDASLRPALLLGHLDVVPVEPGTEASWTHPPYSGLVADGYVWGRGALDDKGSVFGILESVEALLAAGFQPKRTVLLAFGGDEEVGGREGAEAMAKLLRERGVTLESVLDEGGMIVSGTVPGVASPVALVGVSEKGFASAELVADGEGGHSSMPPPQTAVGVLSRAISRLEDAPMPAKLRGGSRALFEFAGPEMGFGMRTLFANLWLFEPLVLRQLTAKATTNAAVRTTTAATMFEGSERDNVLPARARAVVNFRILPGDSVAGVLEHVRRVVDDPRVKVRTLGFISEPSPVSRMDSEAWSQLQRSVRQVFPDVVVAPYLMLGATDSRYFTGLSENVYRFMPLRLDGADLSRLHGKDERVSVKGYADAVRFYAQYVRNVAQ

SEQ ID NO: 10716 - protein, 313 aa, Myxococcus xanthus
MGYDGNTCGVMVAIEGQSQDIARGVDNKKDQGAGDQGMMFGFACDETPELMPAPIHYAHAITRRLADVRRKQHPWIRPDGKSQVTVEYRDGRPARIDAVVVSTQHSDEVSNKKIQEAIREDVIANALPKKLIDNKTKFFINPTGRLVAGGPMGDSGLTGRKIIVDTYGGMGRHGGGAFSGKDPSKVDRSAAYMGRHIAKTVVAAGLARRCEVQVSYAIGVAEPVSVMVETFGTATVPEERIALAVRKTFGLRPREITEYLNLLRPIYQKTAAYGHFGRTEKEFTWERVEEKKDALRDAAKSATPSGGRRLKAV

SEQ ID NO: 10717 - protein, 297 aa, Myxococcus xanthus
MSLLEAIVLGLVQGLTEFLPISSTAHLRIAPELFGWRDPGAAYSAVIQLGTVAAVLIYFRKDIVSLVAAFFRGLARREPFGTLEARLAWFVLVGTLPVGIAGLTLKKFIENEFRSLYVISGSLIVLALILLVVEKRASHQRTLADMRWKDGILIGMWQALALIPGASRSGTTLTGGLSLGLKREDAARYSFLLSIPATTLAGVFELKHLLEAETRPSAMALWVGTLVAFASGMAAIAWLLRFLRTRTTLVFVVYRVALGVLLLVLLQTGKLSPMSGVENVEVPGEPGAPPVEKQITD

SEQ ID NO: 10718 - protein, 40 aa, Myxococcus xanthus
MGAERDLYFYTYGTHVIWGATARILRDFLNHVTQVPGGAG

SEQ ID NO: 10719 - protein, 252 aa, Myxococcus xanthus
MLKPLRSRVKEDPSLAKRQPFKAILEGDLSELSTMDKSKLMKVLGVTHAGMTEEAFIRKVRAFFQHARHPRWSVPYNQLAYAPMLELLRYLRANGFQTWLASAGGIDFMRVISEDTYGIPPQQVIGSHLKKTFDDAHAPSVLRREARVAHVNDKAGKPVGIDEHIGRRPVFAAGNVRSGGDIQMLQYTRKRPRPGFALLIHHDDAAREFAYEEKDGASLKAAREGGWAVVSMRRDWRRIFDETRARTGNGRG

SEQ ID NO: 10720 - protein, 64 aa, Myxococcus xanthus
  unsure (1)..(64): unsure at all Xaa locations
MTQVVAPRRSPADFXRXPFAPLFLPGMFDPPTAARELSDSAREEEPELLSASGELPTLRETRNR

SEQ ID NO: 10721 - protein, 241 aa, Myxococcus xanthus
TAPAATARLPVTVLSGFLGAGKTTLLNHILQNREGLRVAVIVNDMSEVNIDGRLVKTGGGALSRVDEKLVELSNGCICCTLREDLLLEVSRLAREGRFDYLLIESTGISEPLPVAETFTFTDEQGQGLSDVARLDTLVTVVDALNFLRDWSAADDLATRGLAAADEDERTVVDLLVEQVEFADVLVLNKTDLVPAEELARLKDILRKLNPDAHLVTSERGRVPPSAVLNTGRFDFERARGA

SEQ ID NO: 10722 - protein, 195 aa, Myxococcus xanthus
MKAERVSYEVMTPSAARGVLEAILWKPAIRWHVHEIAVLAPVRWTSFRRNEVNSRATVGKFDYAADEDRAQRNTVALRDVDYVITASFALVPGKAGPDDNVRKFEDMFERRLERGQFFHAPYLGCREFAARVEPAEDVLLPHESGQGRRPLGLMFYDFVFDIPGEPVRPEFFQAFLEDGVLRVPPRAQVLGGGVP

SEQ ID NO: 10723 - protein, 54 aa, Myxococcus xanthus
MPKGNRTIIHLVSSAGTGYVYTTTKNKRKSQEKLQLRKYDPRVRKHVLFVEGKP

SEQ ID NO: 10724 - protein, 198 aa, Myxococcus xanthus
MMKRLLPVLGLGLLSGCSAVKNQRLRSDYDTVDKHQVKRLVVVTQPLPDGKVAVGELWSLIARQWVNQNRDFLVKESAALPDVPTDATFKTLCVEGLEGVLWLSPQIQLRGSGAEAAVSAKLVRCRDGEEVWSADAAGSWNSKDEDYEQRVGQYVQELGEEVAPYVVPSSKLLTATLATLPNPELSEADKDEKIELGE

SEQ ID NO: 10725 - protein, 863 aa, Myxococcus xanthus
MLALLAVSLWGTSKLHINSNQLDLISQDLEEVKDVKQVIDMVGGSGFLMVALRSEDEAALKRTADDLAKIMQDDKENVRNVSYKLPVEFIQQNMVLFVKTEDLVEGKRRIMAFLRDKLKRSNPFFIDLGGSKPVELDMQDLVDKYSSIGKKSIRDDYNISNDKKMLMLLVKPMWDNTEIGKTKDYLERLKGQIDAYSAQPGKVKLVEDYKLMGDGKTIAYGFTGSYKTTVDDSFAIEESLEPVTLIALGSIFLITIIFFRKLAPTFLVVIGTVVGTIYTLGFTYATVGELNMITSILGGILLGFGIDYGIHFVFRTRLELGAGKPYDVAIRDAVMNAGRPAAVAAVVTAGSFFVLMVSEFRGFSQFGFLAGMGTLILGLTLFCWSAAILALAGRINPELPQKLIGVMKPPPTNSATTGKELRIPKPKMVLGISTAIVALICAAAVPWAGSEEPPKGVELGFFERLKYGVSFNYNTRALIPDGMSSVLLQDEINERFNISSDPMAIYTKDLDEAEGVYRELTQNAHKYPSIDQVVSIFTFVPPAETAAANAKVLEEWKAEMQQLEDEGFSVAALPPEMQANADFFKKVLDAKPFDVHGVPANYTAQFRNLPSAKPENHGYLTYIYASVDLMDGQKMLKFSDETKVIKAAYTPGKFDQDAWDPKAPTVEKEFRAAGATQLYARLARIVLWDGKVTVVLTAIWILAMHFLDFRNVKLALASVIPLGVGVAMMLGIMALTGLRLNFMNIIILPILLGFGVSHGLYLLHRFLEGTSPLVALRSVGAAVASSTLTAVVAFAALLAAAHNGLRSMGLVACIGLITTLVVSFTVLAAVMQLMYDRRQRESGASSGEGGSTGGGKDSEPKAA

SEQ ID NO: 10726 - protein, 687 aa, Myxococcus xanthus
MQYAPRAPGHSAVRDLYRLLCDVPEGGLEDRLQWVERWMQWLRERIPAHALVDASEPEVSAADSRLALMVRVLEGEPAMRAALTRLVAAVFEGSRGLKLFAQVGLPAGQGFFAEASDRLARSLLPAPPERGKLSELLLRLCPNPDDADWLARLSPARLAQLAALVGEPASPEPMPAARVRADLMDALLLLAVQVAALGIAEDVRDRSPETSFRASPFLRMRLVCDAVLARDAAADTLRDLSQCVADCRQVVASVSRHLEDSGVSVDLVYRLERIRRGLERMEAIARVLGAPRGEARWREAMTLVSDLLRRAHADRSVVELVKRNMRMLARKIIERAGHSGEHYITSTREGFHAMVHSAAGGGLVTAIAVVTKTFLSGLMLAPFFSFLAVGLNYALAFLLIQALGFTLATKQPSVTAATLAGAVGEGARGQRLASLVELIPRITRSQLAAFMGNLGVVAPTAIVFALGYEFITGHTFMSPAKAQATLASLHPWKSGTLIFAAITGVFLWMSSVAGGWLENFVVYRRLPEALAHHRVLRRLLGEARARRLADTFQHAASGLGANVTLGFLLVLGPLVGGFFGLGLDVRHVTFVLGLISLAGTAMGPGAVLQPEFLAALAGMAFTGLINFGVSFSLALGVAVRARDVPAREALPFLRAVLSHLVKHPRSFLLPPKEPENDVLRVSAPPAH

SEQ ID NO: 10727 - protein, 191 aa, Myxococcus xanthus
MNARFRTLAFLATFAFALPALAAKEDPIAKPVKTVVQSVRYERDALALKHFGSQEQGKFLLGDNWDKGTDAQRKEFVTLFQDLFANIAFPRVRENFKNLDSITYEPSQVQGPEATVASTVFIKHPLKTQEMKLKYRLVKEAAAWKVVDVTVLGSSMLQDIRDTQVKPLMEKGGWDLLLERMRTELAKVKKK

SEQ ID NO: 10728 - protein, 476 aa, Myxococcus xanthus
MTAATKSLKQDYAIADLSLADWGRKEIRIAESEMPALMAIREEYAKTQPLKGARVTGSLHMTIQTAVLVETLQALGAEVRWASCNIFSTQDHAAAALVQAGTPVFAHKGESLKEYWDFTHRIFDFGPAGSDHEGPNMILDDGGDATLLMHLGKRAEKDASVLANPQSEEERELYAAIKAKLAEDATWYTRKSAKILGVTEETTTGVHRLQEMSAKGTLLFRAINVNDSVTKSKFDNLYGCRESLVDGIKRATDVMVAGKIAVVAGYGDVGKGSAQALRALSAQVWVTEIDPICALQAAMEGYRVVTMDYAADKADIFVTATGNKGVITHDHMAKMKDQAIVCNIGHFDNEIEVASLEKYKWEEIKPQVDHIIFPDNKRIILLAKGRLVNLGCGTGHPSYVMSSSFANQTIAQIELYSHSANYEVGKVYVLPKHLDEKVARLQLKKLNAQLTELSQEQADYIGVKTSGPYKPDTYRY

SEQ ID NO: 10729 - protein, 121 aa, Myxococcus xanthus
MRSRYSAFALREVAWLWKTLHPHHPDRARPQDEVLRELRAFAQAHQYPKLVVMDRREPDADGLAQVLFFAKVFEKGKDRSFVERSDFRHDGTGWRYLSGVALAPKELAVPPESLTLATFPR

SEQ ID NO: 10730 - protein, 38 aa, Myxococcus xanthus
MRRLKHGLNTLAHALHNTQVEQKHPELVPWLQFRTRLV

SEQ ID NO: 10731 - protein, 141 aa, Myxococcus xanthus
MVIVKATKNSEAGVMPGEQLMTEMGKYNEELMKAGVLLAGDGLHPSTKGKRIRFADGKKSVIDGPFAETKELIAGYWIWQVKSMEEAVEWARRCPPPMPGEESELEIRPVFEAEDFGAEFTPELRAQEEKLRAELEQKQKA

SEQ ID NO: 10732 - protein, 247 aa, Myxococcus xanthus
MYNLLISLGVGIAVALLVKVAGFSIWAGLVPGILALVGTYIVLARRVASRVQSLMTVVQKDLQSQPTSQKDAQSRVDRAVKTLEQGLVYDKWQFLVGPELHSQIGMLKYMVKDHEGAKAAFEKGSGRNYMAKAMEGALYFQRKDFDAMKKAFESATKSGKKESIVWAAYAWCLMQNKDKDGALRVLARGVEQNPKDEKLKGSLAQLQNDKRLKMKPYEPTWWQFGLEAPPPVMPPMGGRRMQFSTRR

SEQ ID NO: 10733 - protein, 318 aa, Myxococcus xanthus
MERRGRTSERSLLLIIEDDAQVRESLVDLLSVRFDVLAAPDSNEGLELAREHHPDLILLDRFLPSGDGLAVLELLQRESCTEAVPVIFLTGDADEATLERCLEMGAVDFIHKPASARELLARIDRALRQSEQQRRLQILAQTDGLTGLANFRALSIRMEEEFRRAQRYQYPLSVVIIDLDHLKAINDGMGHDVGNRAILALATQLKHELRESDFAARFGGDEFVALLPHQTALEAAVFAERIRTGLRAVGVQKSDGRPAPFGLSVSVGIADHTFEGPREDTESLMKAADAALYEAKREGRDRVVVFGRPANSPPAQRH

SEQ ID NO: 10734 - protein, 577 aa, Myxococcus xanthus
MMLGNRLATGSRVAVVGGGIAGAGLAASLLFNGRARGLALDVRVYSGGTQERTAPPAVLTPECRSRLAALGCRIPSEWRAHELRGVEIIAEGRRELLSSTPGGLWVVDGWPQGLGGLEQVRDVLATAASAQGARFLPRHVERVERQAPAPDAPAAVRGAGSLVVRAQGSGDRFHAVALASGAGPLMGDAFFKGFRPAPTIPAVQARLRHASPRLELAPVARLWIAPLPAVDGLFLLPGANSVYALAFGPAVTPADLCQVLMMAARDGLVEEGFELAALETTRLPYGPGRTLVAPGQIAVGPAAFGHPLQVGLSETLASCSRAAVALLDGGLDTGLLERRYVREGLGEMLEDAAAGARTMTWLRRAGPRAPEAFVRAKGRRTLGGTFGGGVLGLSGPSPIALLGAARWEGLKELVGSWLRTTVEPVPSVVPELEPDLYYVVDDDPDAREALTALLESTGATVVSFADELALFCAVARRPPTAILLDVVLHWVDGLRLAEGLKQHPLTRNTRVLVMSGLNRPHVRQRALDAGAEAFLPKPVDPDRLLRILTGRVPVLEPAPAPHAADDTRELAADRYAS

SEQ ID NO: 10735 - protein, 209 aa, Myxococcus xanthus
MGELISELAQVHAVSTGEEAVEALEAGRFVLVISDLRISGGELGGRTVVEAARKRHQAVAIVSAATPDEVIQAVQPQVADAMLLKPFQIDDIYALVERFIALRQDVEQLATQGQRPAASVWSPRGAHVQIAREDALRAMWVSVTAGGDFGWTFHPTPSGVGVQVVEGVLEVDDVSYSAPGYFFLGAGQAPRMRSPEGCLVVAVGLKGQG

SEQ ID NO: 10736 - protein, 289 aa, Myxococcus xanthus
MVREIVARVLICVLWAVGVTAVHHHTKPLDIPATVHTLAGISLSLLLVFRTNASYDRFWEGRKLWGGIVNETRNLARASSVFMRRDAGLYGTLVRWISAFPYAAAASLRGERDLGPVASELPRDEADAVLGSQHVPLAVSQKMSAVLDEGRLRGYYPEHVQMQLDQNVQLLIDYIGGCERIHKTPMPFAYMMHLRRALMVYCYTLPFALVDSFGWITVPATFVVAYVFFGIEEIGVEIEDPFGHDDNDLPLERICETIHGNLKALMPGSAEAIHAPVSVVAIPGGGQDA

SEQ ID NO: 10737 - protein, 171 aa, Myxococcus xanthus
MVLLGIVALGAAFFTSLVSAILFGAMLAAAGVMEVISAFRTRKEGGPFWLYLLSGILSVVVGLFILVYPAAGLGAMTLLLAGYFFASGLFHAVTSVMDRYPRWGWDFFYGAVSIFLGIVVMRQWPISAVWLVGTLVGIGIFFRGVALMAGALTVRKVLRSGGPTTPASISH

SEQ ID NO: 10738 - protein, 66 aa, Myxococcus xanthus
MRSVGYVQARAVVEGRMTREEAIHDTAQETRRYAKRQLTWFRKEPGAVFLAPPYEAALPLGGCCSP

SEQ ID NO: 10739 - protein, 54 aa, Myxococcus xanthus
MLLVNALLPEATPVGRGGLLGAAGRLLSEVSPVRLVFARDASAAAVIQGALANG

SEQ ID NO: 10740 - protein, 987 aa, Myxococcus xanthus
MDEASELTVDVRNNTSSGSPLFRRINEVWFALPSGYIPLASIPPPGWTVDYIASERWVIFYNQDSCNGSGDYGLGQDESARFVLRVVPPTSNNDQNNERFVASQTFARDTCAGGDFTTSVATSAASWSRSGLYTQVDVRPRVMGVGGDIDARMVVENRTGTNHNNTTVEGPSTGAGAVTFQVVDTEPTPFRMNIANRNAGVYSARVRTGSAGTLVARVRGVSGNGNTVSPSMDARMVNVGALPVAMDVDTDDAFNNETVRVRLTVTNPSSTDTFLNVTPRAPVFQGTAAVSLVSGPGPASVPRLDPGASAHFVWTYQLTGTPFANYRFRGQVDATRNGASVTSNLVDSNQGRIVQHRVRTNISALAANSTNRSVIYTIQNRGPMPLHEVRLLRPALNYFTVGGVLQTPTGWRMASNNATTGITWESTNATGIPVNGERSFTVVYSNFGAGASLSGPTTFRHRFHLIDDYGGPQIRIETPMTLAQGTVPDVNRLTGVARDGSVTLTWDNPAVHGGVLILRAEGAPPNLCPTQGLNYAVGAYLGNAQVVYADDVGAATTFTDTSVTNGTTYYYRVFNSDDLRWYSPGNQPTSQALVATPRARVGAAPLWCYSVGLNASQQPITELGTGIFSAFNDSVVANLTQVTNPSADGAERWRPRPLAGLIGSRFPVVPLHGLSGQYILVGDQGGVASALNAATGQVLWRWDNGGQPIGTIQSFPVTQLFDYANAAYRAAHPNRDLVFFATRLADASRNRVVALNAATGALVWSYQPGNLGMVAGGMVVDYTNNRLFVATRAHAGSPNTLRVLNTLTGQVLAQLPVGDVELSLVRNAYSNLILVTDSDGFVHGVDAATAQLVWSLPVTTRPAPNTPAFTSFVRPQGSGFVASLAAGRVALYDVSGPAQSPPVLRWSTPIASPSGTFSFNRNGAVRIYVGSSDGQVHQLELLDGSDSGQVSIGGAQRIGTPTIDHTVSRLHVGSEDGRICAFPVPFP

SEQ ID NO: 10741 - protein, 175 aa, Myxococcus xanthus
MRTRLAFLAAAVMLASCTDGVAPYAPVHAPPAQEPVAPTDVLPPREGSEARPPPAPVEEPEVPPPPVVPRGSATVIDLGEGSRALLSVAQVDVDLTVSGVRGRHTVSVEFVPPSGLPYERRSAEVDSRVDESRTVRFSLPVAGTTVATSGMSGTWQARFFLDGAPLTAASFTLDP

SEQ ID NO: 10742 - protein, 43 aa, Myxococcus xanthus
MERVGNTRVGRLLVDLQGSADAVSQALAYLREQGLTLEEAANG

SEQ ID NO: 10743 - protein, 98 aa, Myxococcus xanthus
MSTDFAADHAPRWREGVSGQRFGSDFIVLDAEGNTLRGLNGTAIEIWELCDGTRTARALVEQVAQRHGWDVEQVLTDTLKFFSELTRLGLIDELEEAR

SEQ ID NO: 10744 - protein, 112 aa, Myxococcus xanthus
MWPSLRSGDHAGVEPLEGAPRPGDVLLARFDHALVLHRLRRWEAGAVALRGDNSPQDDAPLDPSRVLGRVRRVRRGGVVLEAGWDRGPRWLGRVRVAVKWRLAALLGRGGAR

SEQ ID NO: 10745 - protein, 415 aa, Myxococcus xanthus
MNDLLPGEIEIWQHVEAQARELFGRFGYGEIRTPMVEDTALFVRSVGEETDIVGKEMYTFNDKADRSLSLRPEGTAPAARAYIEHSIANQEPLTRWFYAGPMFRYERMKTGRYRQFYQIGAEAYGAKEGAQDVEMMDMVVQFLERLGLKDITLNINSLGDEVCRPTYHAKLVEYLQAHREALCGDCQKRMEKNPLRVLDCKNEKCQAIAAAGPNVLESLCEPCRAHFDDVQRKLTALGVRHVVNPRMVRGLDYYTRTVFEFIASHPALGTASTVGAGGRYDKLVKSLGGPDAPAVGFACGLDRLVLLLKESGQQFTVRPDVFVAVADAGSHDAALVLASRLRREGLRVEFDTRGGSLKSQMKRADKSSAEFTLVLGEAERTSGQAKLKPMAGGEPIPVALDEVARVVRERKVVSA

SEQ ID NO: 10746 - protein, 280 aa, Myxococcus xanthus
MNDQTFMKLMQVLPKSALSTVVGMATRLPVPAPVHQAAMRAFAKAYNVDMEEAEHSFEHYPTFAQFFTRGLKPGLRPVDAGEKVVVSPVDGRVSQVGYSDYGRCLQAKGIEYTVDELLGDSEAAKPFYGGAWTTIYLSPRDYHRIHAPLGGTITGYAYIPGEFWPVNPASVKNKQSLFCVNERLVTYLDTVAGKCAVVKVGATCVSRIKAAYDEVTTHTGQPGKVHRYGSAMPVEKGGELGRFEMGSTVILLFEPKRVTWDDSLQEEAVVRLGKRIGVIT

SEQ ID NO: 10747 - protein, 143 aa, Myxococcus xanthus
MAVAANERDEAVASARELPPGSYTAPSTEEQAPPAAPVEAPDAGPPDAGAGGGPQAGTAASELVAGFRGCFQRGTPIDVQGRGMRETWQLADRTACRLEYPQHQDSFLLIEEGKVLTLLPKSAVQTVPVTPDGGPAPATDAGR

SEQ ID NO: 10748 - protein, 265 aa, Myxococcus xanthus
VVSVVGEDFPEGHLNFLRGRGIDLEGLTRETGRTFRWKGRYSYELNEAQTLDTQLNVFQAFSPKLPESYRDTPYVFLGNIHPELQAQVLDQVKAPKLVAADTMNFWIKGSRAALLKTLSRVNLLFVNDAEARQLAGEHNVVKAARAIMAMGPQRVVIKRGEYGALLFEAEHIFACPAFPLAEVFDPTGAGDTFAGGFMGALATSSGVLDQALLRRAMVMGSVMASFTVEKFSLERLREVTRPEIHARFAEFRKLTHFDDLGSLER

SEQ ID NO: 10749 - protein, 83 aa, Myxococcus xanthus
MYAKLSQRIGTQVRAARHRVGLSQAQVAEAIHVPTLVLSRLERGRLLPSLPTLVDLCGVLRVSVDLLLSGEGLAFPAPEGAGR

SEQ ID NO: 10750 - protein, 115 aa, Myxococcus xanthus
MNEELATRIGSAAREARTQLGLTQAEVAEKLGLAHMVYSRLERGKMLPSVQTLLRMCAVLRIGSDELLGLADAEEGKGARGPGGAPRLRQLTGLARKMDEEQLDALVKVAQVLLR

SEQ ID NO: 10751 - protein, 223 aa, Myxococcus xanthus
MDSQLPRLLGVATGETLYMTSVASALVLLAGLPLGVLLVVTDRGGLWERPALNRVLGTLVNVGRSIPFIILMVAIVPLTRLLVGTTIGTTAAIVPLVVAAIPFMGRVVEQSLREVDAGLVEAAIAMGSTHRRIVFQVLIPEALPSLVRGTALVIISLLGYSAMAGAVGGGGLGDLAVKYGYMRFRTDVMLGCLVVLLVLVQLVQWLGDALASRFDHTGARSSR

SEQ ID NO: 10752 - protein, 287 aa, Myxococcus xanthus
MFADLWRWQEMLKPAMAALSSLEPGQMEAAAQDVPALVGQLSGELAATIATVRKGAENVAKMLVLKDAIEALTLLSALKFSLPPVSPSAPALLGIGLSVGGNGVMMGTRTVVSAEWVEMMRQLVRAGVLSLSVVSAAVRIQAGQVMLAQAHGELPQGVREALGDGPEVRAMRVTGKAGAGMAEPPRHHVLPKEFREWFEKRGFTGDMDIDQFCVKLEQAHHEAIHGGGDWKLGRTWPGEWNRMIMSRLLEAEVLAGRMLTRNESLEIVAKNMRDYKIPMNFTRWRGR

SEQ ID NO: 10753 - protein, 254 aa, Myxococcus xanthus
MSTSFEFDSALDPAKVVLEGEERFSLVDLGRSTLRLVPSEQLLPGERLLLTVRFQDGSVPLDAAFVLVAHPARGERIVEVWRQARTAESYQQEAKEARAETQQCHEENARMRAEQREPSGIAGLLANGVIQKEEGVAAKLLRVNEEVRQHPGNALWAHRAWSYRAPVRVAVAVEFENPDAANPWTAEGASLVSKPGTSLKILTVWQKAPISRYPFGRVVVEAEATPDAAQGPFTLKLWGPGGLRAITLSGVTFP

SEQ ID NO: 10754 - protein, 164 aa, Myxococcus xanthus
LYLHSENREAIAKELCVRGFQDLLAMLEPAAQVEDPLERLPKLAEAYVRFGLEHPETYRLIFMEDPKLSTALFGDHPEGPGPRAFGVLVQVFVDLLATGRLEEGTKPEQLAEVLWAGVHGIVSLRLTCTGFPGTPAEELTQVLVTTLVKGLPGLKAGRAQKKTR

SEQ ID NO: 10755 - protein, 310 aa, Myxococcus xanthus
LEAARRGDHADPRLAYYAGLVHERMRRFADAAEAFAGVPAEADVYADARLRRARSLSLLGEHSRALTLFRAAMQESPADVEVRMQFARALERGGTPNRAELLLREGLSAGPSAALYDALAATLHRQGRGREALTLLRGAVARFPRDEDLLYVLGAAHERQGDVTGALARMRAVLAVSPDHAAALNFLGYLLAQAGQNLDEAERRVRRALELRPDTGAYLDSLGWVYFRRGDYARAVDALERASTLAPDEPVILEHLGDAYQRVARTDDAAAVWRRALEVLTLDPESCEPPGQRAALERKLNALPTRAPDR

SEQ ID NO: 10756 - protein, 279 aa, Myxococcus xanthus
MARSDEGFFPGRDRTRLCWKPILADAEPVPHVAVVHGYGDHFGRYGFVTDALLADGFAVHGFDYRGHGKADGRRAYCEKWPDYLEDLEVFWERVRAVSEGKKAFVLAHSHGGLMSATWASSRRVEGLTGLVLSAPYLKLAITPPASKLMAARAVGKLVPWLSISSGLKVEDLTHDTDVQRATREDPLHQAIATPRWFVESTRAQGEAVLLAPKIQVPLFVLCGAEDGVAAPAAAREYFERAGSPDKKFKEYPGMRHEPLNEVGRAEVFRDISGWISAHL

SEQ ID NO: 10757 - protein, 113 aa, Myxococcus xanthus
MATGETGIIGKGIVIKGNLTGGGDLVIEGRVEGQIALKNHLTIESTGKVQADIRAEELTINGEASGNIDASSRVAINASAKVAGDIKAPRVVIEDGAVFNGSIEMDVRLPDDI

SEQ ID NO: 10758 - protein, 107 aa, Myxococcus xanthus [sequence omitted]

SEQ ID NO: 10759 - protein, 76 aa, Myxococcus xanthus
MLEKALATEDTLAPEGVEEEIDADELAQEVAQRLGAINQDLSLLADVFAALDESRKAELLMQLRYSSELVTYLEGL

SEQ ID NO: 10760 - protein, 277 aa, Myxococcus xanthus
MKSPSRSLLTPLLLSVTLLLTACQKQEASSGESSGVRTLKVGVNPVPHGDILRAAAAVALREGVRVDVVEFTDYVQPNIALSDKQLDANYFQHVPYLERFAGDRKLALTSAGPVHLEPLALYSTKFRQLAELPEGAQVTLPADPSNLARALRLLEAQGLLRLREEAGATATVRDVVGNPRKLDLREIDAEQQPRTLEDVAAAVINGNYFLEAQKHLKLDAKVLAREAARENPYANVLAVRQGDEQRPEVRTLVKALQSDDVRRYIESTYGGAVVPAF

SEQ ID NO: 10761 - protein, 188 aa, Myxococcus xanthus
MAEPLVRDRARLLELLTERSFEQRRVVLSSGKESDFYIDCKRTALLAEGHFLIGRLFLDAIRREAPEAVGVGGLTLGADPLASAVSLTGYLSGTPLAAFIVRKEPKGHGTGQWIEGLSGLGQGAAVAIVEDVVTTGASTLKAIERAQLEGLKVLGAFALVDRLEGGREAVEASGHRLHTLFTRKDFIP

SEQ ID NO: 10762 - protein, 116 aa, Myxococcus xanthus
MLAEEQAKAAQAHEFFLGVHFNDFVYADFDYKHSIWRLALVTPAGEVTPSRIRRLGRVNMQTRAYYPYTSIFWVGWEIQFPTQMSDGSPVIPPGTETVTFRMASSLGKADMQVSAQ

SEQ ID NO: 10763 - protein, 228 aa, Myxococcus xanthus
MRAYSAFLSVAVLALPLSAGADAIYRYVEKDGTIIYTNVQPSGSKRAKTLKGTFTKAPAKNTPVVGRKRTPPELDPHITAAALRYRIPPALVRAVMHTESNFNPNALSHKGASGLMQLMPATATDMYVKDIFNERDNIEGGVRYLRVLANMFDGDMVKMVAAYNAGPEAVKRYGGKVPPYEETQGYVRKVLKLYYHYKEREAAVSSGPSEPTSQNDDAREGAGGDEPR

SEQ ID NO: 10764 - protein, 448 aa, Myxococcus xanthus
MEKAQNLLGLCYFKLGLYDRAAELYEMLVRDNPVDPTLRVNLGLVYLKTSALQRAAREFETATDLAPEHQKAQNYLGLTLAQMGEYGRAREHFLLAGSDVMAEKMSRAIAGESYAKPASAAVPPLRSAPVEPLVAEPPPPAAEPEEEEEIRFAEDEGPSALSGASASEATDAAADIGVAREAPPESAFEETADTVATSVPLAPVPLTRLHLRKVPATSLAPTSPAPESSPVRDGGRSSLAELAGSVVLPGAEASRPFCAGPGCYTVAVEGELLTRLDGLVALAGQLSFQPEMKRFRGRATDKSFGEGAARMVRARGQGVLYLEPAATRTFLAVDLGEDSAYFRDECVFAFEEPVMFENGRVPSDIAPDLDLVHLRGQGQVLLSLPGPLRAVAVHQEQPVTVPLTHLVGWQGNLTPRMVPVLKSPSGEPLRAAVELGGEGFALIALGVR

SEQ ID NO: 10765 - protein, 75 aa, Myxococcus xanthus
MATDRAARKQRKREERARKRAARKPSVLVQEFWNLPNMLTLGRILIIPLFVWLTYDADPLNSVVEGLVFEVARHP

SEQ ID NO: 10766 - protein, 85 aa, Myxococcus xanthus
MVIASGHDGKWNTSLQLVGIISLCVHYVHPLEFGTFSVPVDYNLVGQVLVYLSGAFSVWSAVVYFRAFLAMLAKRGGEPDPAKSV

SEQ ID NO: 10767 - protein, 260 aa, Myxococcus xanthus
MIRLVRELYQYRGLLISLVQRELKARYRGSFLGFLWTFLNPTLHMLVYVLLFTVVMRQNIPNFPFFMFVGLLPWIWFSTSVGGGASAISDRRDLLTKVRFPAQVLPTSVVVTNLCNFVLSLPLMLVLGMAYGQWPTWHVVLFPVVVLIQLTFTLALTYILAAINVTFRDLQHIVSNLLTLWFFATPVLYPLSTIQDESARSLMLALNPMVSLMTSYQAIFYEHRLPDAEPLMALAAVSVVLLWAASSIFESRREEFAESI

SEQ ID NO: 10768 - protein, 433 aa, Myxococcus xanthus
MDAIILKDVVKSFRKRTIRGEYTTFKSELLRWLRGKRQSRDASLITALRGINLTIPKGKTVGIIGRNGSGKSTLLKLITGIYTPTSGDLQINGRISALLDLGAGFHPDFSGRENILINGIILGMTRAEVRARMDEIIAFSELGEFIDEPVRTYSSGMYMRLAFAVATHVDPDILIIDEILAVGDEHFSKKSLAKMMDFKRQGKTIVLVTHELGTVERWCDLAAWIDGGYVRRVGKPSEVTAEYREAISLAEAQSAAFTPPALTEGGGALPQVPSESLPAEGPVRIHRVQLLDARGESLEVLSPEEGLEVRADFSVEGPCEDVDFHVRLQAADGRTLYETSTRSEAVVLSRMPNPGVLRFVVERLGALGGDYSLVVSARASKGESSGRCAFRVVSATEEEGVFRPPHRWLVEPGANSQAGVPFEPGTSPRVEVG

SEQ ID NO: 10769 - protein, 1275 aa, Myxococcus xanthus
MWQKWADVTQGHVAAPGPGDFAQMVAVLRKVLEERQPCAPEQCDERSALEGALRLATEHLHRALPDGGQGMSSLQEAARLADPAAFSIPASHRARGGTLVTSAKRAFVNGLEPFHVEMLRPQGNFNRALVRVLEYLTVHRALGLRDDVSSWAVAQLEPLAVPTRWVVGSHRGRVAGALVGFAKRGYLYTLGPVLEAVLQGQARWNLAMVEAIRAAAGAQAPGEAEARRHVADVEALREPLAGRTLPGALRVTQPLWGEVLRRQSRFNAESVLALANLLGTRTAPPQPPSLADYPAWCAAREPARVTAAQEAVARLSRRPLISLVTPVHDASEAFLRECLASVSSQVYADWEWLLVDDASTAPHLARILREAAERESRIRVLTASSEGDTARATNEGFAACRGDFVGFLGAEDTLSPHALAEVALAFLAQPELALLYTDEDGLDAQGHRSAPFFKPDWSPDLLRSVDYVRHFLVVRRETLAQVGGLREGFDGAQGHDLMLRLSEATSSIGHITEPLYHAREGSAASASRGAGLDTATKAGVRALSEHLARQGESAEVTSPAPIQYRVRYPVRGTPKVSIIVPFKDRPDLLRTLVDSLLAQTRYPHFEVLLVSNNSTRPETFALLEQWVDPRLVKLTWDHPFNYPAINNWAAKQASGELLLFLNNDMEVVDPSWLDELVSQAQRPEVGAVGCKLLFPEGTVQHAGVVVGMTGFAGHPFWRLPEGPISTPFGHTEWTRNWLSVTSACVILRREVFESLGGFDERFQVCGSDVELGLRLNAQGLRVVCTAQTRLIHHESASRRADAIPEADYWLSYAAYRPWLGPKGDPYYNPHLTLTATDCGLRRHPEDGEQLAVRTLGRDVPSARDVRGEQRARAQRHLIEHLEAWDFTPEQAQTSRESAPAALAALRAKGRVETATWFVPAFGHVYAGIHTIFRFADLMQRRHGVRSDFVIYDQPNVRPGDIEARVAAICPGAVGAVRVLRRPEDVALLPACDLALATAWTSAYRVLHHPRAGLRGYFVQDYEPLFHAAGTPSALAEQTYGLGFYGIFNTPGLYEHVVGLHGMEGAWFEPAVDGTLFHPRRPPRQGPVRVFFYGRPGNERNGFELGLAALAQLKRELGPAVEVLAAGAEWDPEAYGVRGLVTNLGMLPAERTGALYRECDVGLCFMFTRHPSYLPLEMMACGVTVVTNDNPTNRWLLTHGENCLLAEPTPSGVLARLRDAVSNGALRARLGTNAAERVSRTSWEAEVDRVMKGLLNTGAHPAATLDDRASSLEHAS

SEQ ID NO: 10770 - protein, 408 aa, Myxococcus xanthus
IRTRQDAGNPGYGQQEALLTKLMQTEQRALGRPLDVLEFGCGFGRHASYLASLEGVRYHGYDFSEAMMEPLRHAPPVGLEPVEERLFCGPDALTAVGDRTFDVVFTVSVLIHNPPERLPGLLESLGKLVRPGGLLCLVENQLVPFGVWENAWHQGCWLHPYAELTPAGWDMHHGGGLLATHDVYVFKRNASQGRRFFQLQSVEEPRDERREVTLESLNVESLPRLRAWTEHAGEVLREGNGLTGMQVSELTERLTVELKRSERRQRLLSLSDELVRLRAEPVVTARAPADALAPRYGHDNAAEAVVVDAPLDTTWAHVDPRLSRVVHLFHQEWYGIRAASGYAPGHKIGITANRALTAADHQRIAETCERLGARSVIFQGFSPNALEVMHMLRRVFGSTLKLCCVWHV

SEQ ID NO: 10771 - protein, 311 aa, Myxococcus xanthus
MALRFKNLDGSGPQPFSSIFKWAVADKLAGRRRKAPARAEVPRVEPDLALLATPPATGEGARLTWLGHASWLVQLDGLSLLIDPVLRDAISGVIRRNVPPGVPLEKLPPITASLVSHNHYDHLDLPTLEKVGAPIVTGLGHAPVFRGSGLGVTELDWWRSTQVGAVTVHFVPSQHWSRRGLNDVNEMLWGGFVIEGSSARVFHSGDTAYFEGFKEIGLRYPGIDAAMLPIGAYDPAWFMRRQHMNPEEAVQAFEDLGAARFLAMHWGTFKLTDEPLDEPPRRLDAEWTRRGLARERVEVLPVGGTLTVRHG

SEQ ID NO: 10772 - protein, 150 aa, Myxococcus xanthus
MGAVADGALAAGGNVVGVLPGFLGAKELAHRGLTELHSVGSMHERKALMAERSDAFIALPGGFGTLDELFEIVTWAQLGLHRKPMGLLDTRGFFQPLLAMARHHAEEGFVPLEQAVPFAVSASPTALVDRLLAGPTMPPAEKWLKRSSQT

SEQ ID NO: 10773 - protein, 139 aa, Myxococcus xanthus
MSVVVTLGFTLERGIGSLRFFGLSLVTALGASTFSLIFDFDVPTVGASGMILGWAGAMLPVATREGRRDLFIWLAQVAVLSLLPFVSWAGHLGGFLFGLPCGLALRMGRQVYARALPILLFLSLVVALYAAHPERRGGF

SEQ ID NO: 10774 - protein, 301 aa, Myxococcus xanthus
MEFYQFHPTCLYHPEAKSFLISEALRGEGGKLKLKSGASFMERYHPMGALAPRDVVARAIDAEMKRTGDDCVYLDMTHLGRAFLAERFPNIYATCKAFNIDMAVQPIPVVPAAHYMCGGVVTDLEGRTNVPSLYAIGEVTCTGLHGANRLASNSLLEGLVFGHRAVQVAAEEVRAQPSPSEDPPPWDSGSAVESDESVVVTHNWDEIRRLMWNYVGIVRTDKRLMRARRRLELLREEIRDYYWRFKVTRDVIELRNIADVAYLIVDCASRRKESRGLHYTLDYPHPDDHRWLRDTVVSREP

SEQ ID NO: 10775 - protein, 306 aa, Myxococcus xanthus
MQQDGFDLGGGKAESLGKLLEGALAIINTLAQLQQAMQAGGAAGGAQGASYGQGISGAQGAQGASSSKCFLDSSFSPASARGGRPPVELNPSAQGPSPFMNEPVEGLTSAPAAGGPAPAPAPVSDIEGAPVGGIGAAPSVGASTGAGGASLGGNLPPALEKLRPALESAAAKTGVPVEMLAAQVWAESRGKVDASSTNGGNGMTDTGLMQVNPNTFKGLQDKYPELQGKNLSDPETNILAGACYMKDMKAQFGNWDLALRAYNSGPNGVDKSNPHAIPAGLGSADYVRNVNQFASTLASGQGALPA

SEQ ID NO: 10776 - protein, 136 aa, Myxococcus xanthus
MSLRKDYIERLIEEFAAALARIIKARREKKLADAQRLIQETALSSLGMEYAALLMADPGATARLLGSPTRVKVLARLVAEDGELSAEQGDTATATSRIHYALALYDEVQALGLTPDADDTATIARLRGLLAVPDAR

SEQ ID NO: 10777 - protein, 330 aa, Myxococcus xanthus
MWMFPIAVTLGNAFILKPSEKVPLTACALGELMCEAGYPAGVFSVVHGGKEAVDALVAHPDVQAVGFVGSSAVARHLYAEGCKRGKRVLALGSAKNHLIVVPDADPELTPQAVVDSFTGCAGQRCMAASVLLAVGNVESLLQEVVRRAAKLELGPGMGALIDRGSLDRLETAIARAEAEGARVLLDGRGHKPQGEPWSGGNWLGPTLLDGVRPEMEAARRELFGPVLSIVRVPTLSAALAVENASPYGNAASIFTTNGGVAQTVVEGVRAGMVGVNVGVPVPREPFSFGGTGDSRFGHGDITGPSSLDFWTQVKKVTRKWSARTDGSWMS

SEQ ID NO: 10778 - protein, 417 aa, Myxococcus xanthus
MAEKKNLNHIRLTSHPDGDVPSVPIRWGDGEPTRRGPVVATLTEAGHRNVIGTHAGAYAVYRALAVAAGMLPQDHRADLKNTAPAAQVGPHPSWSDPQRIVSLDPWGAIAPQAFRPFAEQGIDFRPTIAVTKAHINFPEVRDAIDAGRLTPDGDLLRGNGDIKVTKAAVDPVWYLPGIAKRFGMTESALRRGLFEQTGGMFPELITRPDLHVFLPPIGGLTLYVFGGIETLADRDVPLTVRVHDECNGSDVFGSDICTCRPYLAHGIEECVRTAQAGGAGLIVYLRKEGRALGEVTKFLVYNARKRQEGGDSAATYFQRTECVAGVQDMRFQELMPDVLHWLGITRIHRFVSMSDMKHDAITRSGIEILERVPIPDELIPADAKVEMEAKKAAGYFTQGPVADAAGLAQVKGRDLDV

SEQ ID NO: 10779 - protein, 257 aa, Myxococcus xanthus
MFMEGRFSSDPDRPLRVDAEALGRLTREALAQGMQVTDANPVDGLEGRLHLLHGLAKVLPRPGALLDIITAQQRSVRAAELLGLVLEVLGPIWPGRVMVDAVNLGDVWPHPALGSVESLEALVPFHKLSQWLTYSLVEPLSEAGVVVTELDGLTGLPEYRNGGLLVDLGVLSPREPRLFTQSFHPGDEPIVEWRALTVALLDRVAALVRGRLGLSAEELPLGKVLQGGTWTAGRRVAAERRPGGGPPIRVDSDGTVF

SEQ ID NO: 10780 - protein, 211 aa, Myxococcus xanthus
MEFPNCTVVDHPLVKHKLTQMRRVETSTASFRALLQEISLLLAYEALRDLKVREEDIQTPMARTVAPVLDGKKLVLVAIMRAGQGILDGMLQLVPSARVGHIGLYRDPETLSPVEYYYRVPGQLADRDVVVCDPMLATGNSAVAALQRLKKSKPGSLRFVCLLACPEGLTNLREHHPDVHVYTAAIDERLDEHGYILPGLGDAGDRLFGTK

SEQ ID NO: 10781 - protein, 159 aa, Myxococcus xanthus
MRVWLGCASVLGLSGIARAESEPCACSTSNQSVVSEVPCLIFRASVSCGLSNVRNACAQTVTLVDWPLSSCPDSVCTQALAPGEEASFLFGREESERERFVEQSYTVQVDGVDQRLAISAEVTCWDVRDSDGCAAAPGALGAAGVALLVGAVARRRRGA

SEQ ID NO: 10782 - protein, 583 aa, Myxococcus xanthus
MTLHQAPSSLTTVSEQSGWTRTGRYSEVESLCRAFPKAFPGKVRCDTVGTTPEGRPLLALVASADGTLTPAAAARKQRPVVFFQGGIHSGEIDGKDAGFWLLRDLLAGKEQPGVLKRVTAVFVPVFNVDGHERFGPNHRPNQNGPEEMGWRATAQNLNLNRDYAKAEAPEMVALLKYLHAWDPLVYADLHATNGAKFEHDVSVGIEPQKSGPAALRELGVKLREELFTELESQQHLPVPFYPSFIEDDDPSSGFAYGVPPPRFSHAYWAAHRRFGVLVETHSWKPYAERVKATRNIVASLLRLVARDGAALRAAVKAADAADAAGKTREVVLTWKNTEQKRTIDFRGYAYERGASDVSGQTWIRYDDTKPQVWKVPYFEEIQPALTASLPAGGYLVPPAHATWVEAKLAAHGLRSQRLAKPVASAAVESFRATEAKWSIQSVENRQTLNVKGAWEPQSQTLPAGTLYVPVAQEGVELVAHLFEPTGPDSLLSWGFFNAHFEQKEYVEDYVLEPFARELLAKDASVKAEWEAKLKDPAFAKDARARLRFFYERHPARDVQLRVYPVLRIQAAPQGLAAVKPAKP

SEQ ID NO: 10783 - protein, 278 aa, Myxococcus xanthus
DATDDVALLGKLAAMGERAQLPVVAAVSAPLLGVAQAELAVALEEEREHVPEAWTELRQDESARWLCAVINRAVVASEGRGAARRVSFTSPALAVAAMLAASFRDTSAFARIMGQQGGLKAPAMWELPTGRDTGLSIPTEHFLPIRAQARLEERGILGLGSGRNADAVLLPPAPMVFGARLRGAAARAVAHRAHRPLPHLGAAPVARGHRRRRRGRHLLAGRGGVPLPGRHGERTTARPVGGHGQRPRGARHRHRPPGARGHALPARLHPATARLKSV

SEQ ID NO: 10784 - protein, 256 aa, Myxococcus xanthus
MRVNLFQSIARLSETRTQQSVPPAASGPAQTQAPQQPSVPDVVARYLTDSFEAAGASEVIKQTKDSNCGAAVATLLSRTAGKDSASAAQKMDTLESRFTDGGGTTPEELAKMLAHEGLEVKKGTSNFDMPSVNEALARGQQVVVQLDTNRLATGVDSKIAGDSHWVVVDGMDDKGNYQVKDTNTGTKYSVSGQQIADSVGSAWELHQGGGMLVVGDPQSAMDEGTLVEKSSLHTSVLGNTDGGGSRARGSFGRESS

SEQ ID NO: 10785 - protein, 417 aa, Myxococcus xanthus
MVLSGPESGQSHALTRPEYVLGKAPTCDIVLTDKTISREHLKLTVHDEHVVATDMGSRNGSSCDGRRFTELELHPGTVITLGTTELKLVPEESAKRTLLLSNRDRFGALVGNSRRMREVFTLLERLSPGGADVLIQGETGTGKDLCAEAIHQASRRASGPFVIVDLAGVAPSLIESELFGHVKGAFTNAQSDRAGAFERAHNGTVFLDEVGELPLELQPRLLRVLERRQVKRVGANDYVTVNMRVVTATHRDLEDAVRQGKFRRDLYHRLAVLRVTMPSLRERPEDIPLLIDTMLEQTGRPPSTLSDQTRALLTQYPWPGNVRELRNVVEQVVNLGEEALPELEPADSERGHSAADLDLPFKEAKERLVEGFERDYLRNLLERCEGNISRASREADIDRVYLRKLLKKHGIEPSGGA

SEQ ID NO: 10786 - protein, 866 aa, Myxococcus xanthus
MGVVYAAYDPDLDRKVALKLLHADSRTDSEEARARLLREAQAMARVSHPNVIPIFDVDVWGDRVFLAMELVDGGTLASWVKEGQRSWREILESFLAAGRGLQAAHEAGLVHRDFKPANVLVNKAGRVFVTDFGLARPVGTLPKEEPLSEDAEALIPSERRMLDTPLTEAGLIIGTPSYMSPEQFRGDDLDPRSDQFSFCVALYWALYRQRPFEPAKMEAYASSRKPQAQPVVEATEPLNVTAPLEREAPKPLPPPVLIQEPPRDVKVPAWVKQAMMRGLSLDPAARFASMEALLGALSQEHRFTKRRRWVAGASTVAAGVALVGGVLYQQSQVCAAAGARMDDVWSPAARQQVEAAFLATGKPFAQELAGKVSQVLDGYASAWKQQSTEACEATHVHGVQTEELLTRRTVCLARRHKDVRATVALLSSADASLVEKSVDAVHALPSLHECEDEESLAEQQRLPSDAAKRADIEKLEEQLAGVKALVDAGRYPKALETARALEAPVLATGHLPLTAELRFHLGWLQEQNGQSPEASKQLFHAVRDAEAGRADRLKVAILNKLLYVEDGQQHFTQASDWGELAHATLQRLGGEPVLEADVRMNQANLAVSQERFEDARTLLEQAKALQAHALPLGHPKRARTTFLLGGVMLDLGKPEEAVKLLEEALTLTEAAVGPWHPDMAQRHGMLSLTLRELKQDAKALAHAQAAAQVRKATQGETSVLYAETLDEVGMCLHAMKRYDEALKAYEEALVIKRAALPADDERLQYSYDGVGQALLELGKANESVAPLRQAVSFASAPPDVLAESGFALARALWMTQQPPAARGEAAQARARFTEAGLDARVADVDAWLSTLPPEPAPRPARRKPRR

SEQ ID NO: 10787 - protein, 189 aa, Myxococcus xanthus
MAKKYFQLADNVSIPGRWELGHPGDARGHEVDDPWMFREGHPVEVSQRFTVPIEEPGKALDFSLAGFSTPVVSASVANIFLEMAPKDVQLLPVDIHGPLDPYFILVATRLIRCIDDAASEEVLHWRPEDGRPEKVGQYRDVYGMRVDLAQVGNAQVFRTWGWSIALIVSEDIKQALERAKATGVKFTPV

SEQ ID NO: 10788 - protein, 447 aa, Myxococcus xanthus
MRAHAVIWLVLALAVTGCSTTRLVRLDTGDGHLIVHTPFAEEGDGPVELADDEFEETMVALARGVRPFSNPLREARQRFGVPERSGVYLYEGHGPRLIPQDEGKDPGGPHLLEVYADDELTRAYGRWCERKSQPGDCLRLLSEGPLLASDGKYSLAMAIAMDSVWEETAEALEDMADPQALLATVSASVSMYLLLWSLPEPVSKGLAALLTASAIAYLGVDTVWRILDGWMALVREVDRATTFEQLSEAGEAYGEVLGENAARVFVMLATAAISNTAGLATQSSRLPGSAQAALAVETQAGYQYLTIGSVQSVAMTAEGFTVALAPNAVAMAAQGMSGGRSENHHLATNKNGVSTVRGGPWTPRFKRIFKKAGMELEDPENIVPVKGHKGPHPQRYHERVYARLEEATKGCRKMTECREALVNELRQLAKEAGAPGSGLNKLLTRTE

SEQ ID NO: 10789 - protein, 464 aa, Myxococcus xanthus
AMGAPEVVLRRCALKDGCSSSSVLAEVDGLARQGMRVLAVAYREVTVSHVALRMEDVEGGLRLLGLEGMIDPPREEAMAAVRACHEAGITVKMITGDHPSTAAAIGAQLGLLKPGEEGVTGARLATTDDAALEEVALRSNVFARVAPEHKLRLVRALQRRQHVVAMTGDGVNDAPALKQANIGVAMGITGTAVAKDAADIVLTDDNFASIVAAVEEGRRVYDNLIKSLAFVLPTNLGLALILLFGVSLFPIQEVGGRLVPLMAMLPTQLLWINLVATVSLALPLAFEAREPDVMRRAPRDPEAPVLNRFVVMRTGLVALLMTAGAIGLFLWEYRRDIPRTGNAHALAEAQTMAVNTVISFQMFYLFMCRSLMGSVRKVGLFSNRSVFVGMGLLVLLQVAFMYLPFMQRVFGTAPLGLEDVGLSILVGAVVLPVVGLEKWLRQRKDDTDASSGRGAARLRERVPT

SEQ ID NO: 10790 - protein, 349 aa, Myxococcus xanthus
MEPTPKVIRHFHPVLSARALGTRPVRVEVAGRAYALFRDGTGQPAALADACPHRFAPLSKGTVRADGRLQCPYHGWRFDAEGRGSNPSQPELRHCDARSFQVVERYGYLWLAERDTPLSAMPDMGDEGYVFGGAFSTHFAAPLHVSLDNFSEDEHTPYVHTRLGWDDPNAGRVEFEARNLEDRTEVHYRAPQRPAPIMTVLGVRDGDFFQNDWVTRFDPVRSQYTIRWVAPDGSPRPFITRANIFFVPETARTTRLHVFSFLRTEQRLLRPLLPVAARAAMALTWWEVRDDARFITTVADTPYSHKGMRLDRFDAPLVHQRRLMERIYYGAGPKMTGAVVPLSREAPGG

SEQ ID NO: 10791 - protein, 118 aa, Myxococcus xanthus
MRNFPALAAEFDLSPVQAHVLRQLGEGPLAMSTLAAYLSCDASNVTGLVDRMEARGLVVRRSSEQDRRVKMLVLTEDGAALRERLLERIFEPPDAICGLPEEDLCALRDIMRRALGAQ

SEQ ID NO: 10792 - protein, 397 aa, Myxococcus xanthus
MAASEERRFQALVLAPIRRVQRRLNAVAWAEAGIVPMWATATACVLARFLLRGAFVWALPPLLALGLGAWFLRARSRRVSLEQAAVLADRSANAGGLLLTRLERPVGEWELAVNQFAGGVKPPDVKWRRPAAALAGAVLFAVAGFLLPLSAPQGRAVNAAAAAKVAAVQAQAEALAKEEVLEEAVEEELRRLAEEVSEGRFDAGDWEAADALEKRLAEQAAEAAAQLAQAAEAARALEDALGAAGGAEAATREREALEQALMALGGGKEGGSSDSADGTGEDGVPHDSENGEAAQADATRASGQGTQGAEGQQGTEGSRSERSGEAQSAARARASGSPDQIAQPARGAGAQASVAGEPLRFEQPQRFQFAGPSPGFWRPELGAGAPRAGAVGARRRG

SEQ ID NO: 10793 - protein, 910 aa, Myxococcus xanthus
ALKRTGTNPLAPDSDGDTCSDGDEDVNRNGIVDGNETDPRVADCAASIPDADFDGIPDSVEVATGTDPNNADTDGDGIPDGVEDKNRNGRVDAGETDPRLADTDCDGLQDGPGRNGFRGEDTNGNGRVDPGETDPTNPDTDGDGLLDGLELGVTTAQAPRQNCGYVGDADPTTTTSPTNPDSDGDGIQDGAEDANQNGRVDAGELNPNDSADGAANTPAGQACRTSNLRTVTFKEENGADLRLALPSTFTDANLRTIRDGNNAVGIIGWDATKQVTLIAYKRGRVGSSSNPTNDEAGIRSASFNSATRDFQQTFNTWDGYAALSARYAMSGGADLKTFTNTLTRSLVPGSTGELTGTAGITGPFTMQAQYVHRSDQSVVVVLAITPTSRYNEAGSLFTTADTAGGSALAQFGDADAVQCEKFTVRQAVVDFIFVVDDSGSMASSQQSLANAATAVADKLANATLDYRLAMVSTTYTYGSGSNSGLLRGFTPNINQFRAWLTQNSTCGGNGQCTTVTIPAGTQPTTCSSNSQCWVGQSGNGTERPLEAARAVINLLASSGGTAETRFRAGAKVVVVILTDTRDQSNGTIDTYSQYFLGTGNEPGTNRNPLNQPIDVHGILCPHENATNDTSTWCQTQEDPRNPRHLDIIQATGGVYGSIRDSNAITTTINAIIDSVIASVGYRTQKPPIGASLKVAMDAVANASQCPTPGDLPRSRTHGFDVDGISRAVSFYGGCRPQNAGTTQAALSYRYWTDRTTNPNGIPAPCAADPYHDPNDPDFCEGKLTCNRTTDQCECPADCGGGGDPGQVCNTDPAVCAFTCAPDCGGTCGTYETCNTDTCSCSCAQTATCAPGFTFSQDACGCVCDTAALNCGDRYQADPNTCACACKSDCGGCGPNAVCNQSYCACEGIIG

SEQ ID NO: 10794 - protein, 304 aa, Myxococcus xanthus
MLDQESVVEQVVVAVLARGHVLLEGLPGLGKTELCKALARLLSLPFRRIQFTPDLLPGDITGTYVLEGDGRRDFVFREGPLFASLVLADEINRSSPKTQSALLEAMQERSVTVLGQTRPLPDPFFVLATQNPIELEGTYPLPEAQLDRFLFRIQVPPVGAKTLRALLTTRVRGAPPELSPVLDAEGLGRLFAAADRVHLPGPVADFIGRLVEASDPRQPSAPDAVRRFVRYGASPRAALALAAAGRALALLQGRPNVGFDDVVAAAPSALNHRLVLAYEASLEKVSAADVVRALLQAVPEVPRA

SEQ ID NO: 10795 - protein, 308 aa, Myxococcus xanthus
MLGESIPGPVNPAGAAPRWERSNLLAGGITPLLDHANTPVGRFLLLIFAFVLAVGPGGLMLARRRGPVAVLVAVPLVSVLTCVALVTWSVLVDGFAVHSARYSLTWLDAERSRAVTLGVSAWYANVSSGPVRFPATSALLAPDNADEMLADLDWTNGLTVTHGFLPPRTYREWGEVAVLPSRARLVVRREGGTVRVQNALGARLVQGYVRVGSQSYALPALEDGAEGTLGEPLPAGATPVSQLVSSVGGPSLAEGRLSGGEVNFRAPLPEGGFIARLEGLGPAPSSAVDVELEAGMHLVRGQSEGGRP

SEQ ID NO: 10796 - protein, 328 aa, Myxococcus xanthus
MSLLEVKGLRRDYGALRAVDDVSFSLEAGSILGFIGPNGAGKSTTLRILATLDVPTSGEVLLDGHSLVDSPDRARPLIGYMPDRYGTYDDVTVFEFLDFFARAYGLKGAARRQRVESVMAFTGLTPLADRLTTALSKGMRQRVALGRTLLHDPSLLLLDEPADGLDPRARIELRELLRALADQGKAVIISSHILTELAEICDTCAIIEQGRLLATGKVADLLQQQEVGAAVTPELTVRLAVGDAGNAVWERAERVLLEQPRVKRVAREGEALRVRLELDAGAGPAQVDAAAAVLLAALVAAGLPVCAFSARERNLEDAFMTVTKGRVA

SEQ ID NO: 10797 - protein, 193 aa, Myxococcus xanthus
LLACLAVALVAYVDTREGAYARRGQGYFFSFFVCLGVAHFFVIPYSAYRSLAREREDETWVLLVLTGLGPRRILRGKVASFLVQAALYASAAGPFLLFSYFLNGITLPTILVVLALGGAWLVFLTVASVCAATLADGRMGRAFVHFGLLGALGLALVHGLGAAYAISEMGDRFLNDVELLYLVGTALMLMLMD

SEQ ID NO: 10798 - protein, 340 aa, Myxococcus xanthus
MTLGVGSMRAQYKSTTIPAWNGLRVTRGELEGRAAPVPLGYAPAPVATSSAPRRRPHVFAVLLAVAALLGAGGALHVQGLLPARVPSPATPFSYHDYEKVLRHVRPDGDVDFASVGRERKTLDGFVDSLASFSPHNRPDVFPTPEDALAYWLNAYNALVLQQVVDGYPYLETVQQPLLGRFFWGRSWALGGERLTLWALHNRVLRREFADPRIHLALFQAARGGPRLDGSHFQPEFLDSQLNEAGRRFVGDRRNVRLERDTVYLTSLFEEYREDFLAALPEGRGGNVLQFVWAFLPDTCEERPGCDTRSDLDRACGPRLDQCRIAFMERDWTLPDAAARP

SEQ ID NO: 10799 - protein, 69 aa, Myxococcus xanthus
MAEGQWGNCKGCRYFANQTPQSAGETHRCMQPELAEFELEVSGESGCNAYEARTGVATPAHEEPSPSLH

SEQ ID NO: 10800 - protein, 467 aa, Myxococcus xanthus
MSSFLALSLAATLAAAPPPTLTLEDALNRARKENLDLKAAQARLAQADTASRKAWAGYLPNVTVNGAITRNSIEAVIPAGPLAPVEIVIQPRVQMQAQGQVRQALIAPQLWAGIQAAYKAERVAELNVEQARREIFFGVAQAYYGTVAQAQAVAVQERLVELNSARAKDTQVRFEAGTVTRVALLRAEQDLARAEQDLIRARNAEASAKLVLATLLALDNPNFDVAPPPEPQVPEKTDTGVLVERSLEQRADVAAARESVELAQINKRGVWLSYLPNVQVSGTYNISNAAGLVGSNRIWLITLGASWTLWDGGLREANLQEASAVIAENRALQRKAELTARQEVNTAQLDLESALANRLKASQAVELARESHRLTEVSFKEGVATYLEVADANTALTQAEIGLVGERLQASLAGLRLLRAVGAFGARPLTTDLKVETSEAPFLQPLPEQTQPTQPTQEGPADAPRQP

SEQ ID NO: 10801 - protein, 213 aa, Myxococcus xanthus
MVMVEVVKPPPPPPEPPKPEEPPKPPPPKPKVVKPPPVKVAEAPKPLPPPPVDAPPPPNDTPPPPEPQAKPPPLVVGMTMSSTTSAGSFAAPVGNTAYGRTGPTAKDPKDVKGYSAPKYAPIYQVDSEPTVASEVKIPYPEEARRAGVEGTVTLSITIDHEGKVVAVKILKGPGYGLNEAARDAIRRFRFKPAIKGGEPVSTEMKYSYTFLLD

SEQ ID NO: 10802 - protein, 144 aa, Myxococcus xanthus
MAGGAQDNDDEITGINVTPLVDVVLVLLIIFMVTANFIVRETVEVDLPRAANGGETVQGLVNVVLDKEGKLFFDGTEMTEKDLEKRVQEAVAKDKETRAIISADQSLPYGRVMRLIDVVKGQGIAKFALNIEKDVAPAAAPAAP

SEQ ID NO: 10803 - protein, 240 aa, Myxococcus xanthus
MTPFLSLAQTNHTELGWLSSKLLGVTLTSAEWVLWVLVILSVLSIAIMLERTVYFARHRLPDSEALAVRLARGEYDVARKAIEGKTGMEAAIIREALASADQGADTVEQVIASTLSRERPQYERFLSYLGTLGNNAPFIGLFGTVLGIIKAFNDLGKMNAQGGGGAMQQTVMAGISEALVATAVGLAVAIPAVVAFNVFNRQLKTLTSRANALGYALVGSMRAERPASNTATAGRAAEAR

SEQ ID NO: 10804 - protein, 258 aa, Myxococcus xanthus
MVFQSYALYPHLDVARNLAFPLKVAGVAKADIDARVREVASLLGLEGLLSRKPKELSGGQRQRVALGRALVRRPKVFLFDEPLSNLDAALRTQMRGEIKKLHEQLKATFVYVTHDQAEAMTLSDRVVVMNQGEVQQVAPPRELYDAPANLFVAGFFGAPRINLVKPRTLGLPDADVVLGLRPEHLEVGQGTPPPEALEGHVYLVESMGAESWVTVDVAGERMVARAAGDFRVPTGAPVWLRYDAAKLRRFDAKSGRAL

SEQ ID NO: 10805 - protein, 332 aa, Myxococcus xanthus
MHFRKLGRSGLVVSEISYGNWITHGSQVEEEAALACVRAALDVGITTFDTADVYAATRAEEVLGRALKGERRAGYELFTKVYWPTGPGKNDRGLSRKHILESIDGSLRRLQTDYVDLYQAHRFDVETPLEETMLAFADIVRQGKALYIGVSEWTADQIRQGAALARELRVPFISNQPQYSMLYRVIEPQVIPASDEAGLGQIVWSPIAQGVLTGKYLPGQAPPAGSRATEANAVRYGITRFMTDDVLTRVQQLVPLAKDVGLSMAQLAVAWVLQNPSVSSAIVGASRPEQVHDNVKAAGVKLEPELLRRIDAVLGPAIERNPAVTDVPAQRP

SEQ ID NO: 10806 - protein, 160 aa, Myxococcus xanthus
MSFAILLLSFFLLLHLPPLRRIPALSTPTARAAVAAGLFFVGAGLMHFLMPARYAAMIPPRLPAPAFWVYLSGAAEVAGGLGLLLPRTRRLAALGLIALLLAILPANIHEAQANTATHVLPFPDWYFWLRIPFQLVYVAWVAWAGGWWPVRGRARLAAHG

SEQ ID NO: 10807 - protein, 231 aa, Myxococcus xanthus
MHLVLCRQGTLSVRAQGMKTAEQAAGVLVGPDILHALDARDSEVIILFVEPESDDGARLQAALDGPIRLFETTQRDALLGGLPTAGALTHEAVGGWMESTLATLSGTPEAPRHLHPRVRKLLCHLRAEAAPEDTSLEALAQVAGLSPGRLMHTFTESVGVPLRPYLLWLRLQRAAGAIAAGHTLSEAAHAAGFSDAAHLTRTFRRMFGTTPSSLQRRGPRVQAQGRNGATR

SEQ ID NO: 10808 - protein, 471 aa, Myxococcus xanthus
MPTNAPDTTVAYDSPRGRGVLLASVLGSGMAFLDSTAVNVALPAMGRELHTGLSGLQWAVDAYLLTLGSLVLTGGALGDAKGQRRVFLLGMLAFTVTSVLCGLAPNTWTLAAFRAAQGVGAALLVPASLALLRTSFPPQDRQRAVSAWAGLSGVTTAVGPLLGGWLVDAGSWRFVFFLNVPLAALTAWAALRHVPDIAPKTGARGLDVAGSVTAALGLGGLIYALIEGPAHGWPLAAIGAAAGGAVLLAAFFVLEARQREPMLPLTLFHSRTFSGANLTTLVVYFALGGATFLVVLALQQQLGYSALGAGAALLPITLMLLLFSPSVGRLAGHIGARPLMTAGPLLAGVGLALLTRIQRGGDYVSTVLPGILVLGLGLALTVGPLTAVVLGAVEDRYAGIASGVNNAVARLAGLLAVALLPLLGGLAGDTGMDFLVGTRRALWVSAGLCAVGALCSLLTIPREAGRTTSAQ

SEQ ID NO: 10809 - protein, 735 aa, Myxococcus xanthus
MSPIITGLLLALAIPIFVMTMSGRVGVLLAMKKENRLDNIPFRVAQLVRFGLGQKRLVDPEEFTPGLFHVLIYAAFMVLALRTVMLFAMGFSTTALDVLTDLGHPFWAEQSALLFVYKVYLLAKDVVAALALLGVAYYIWVRWKVKPDRLTPSWEAYLILCFIGGLMVSEFLFGGSHMVAAHAAQAQVGAAQVPQSPAALVWWEPFTSLTGLAMMPLGATAAHVVGAAGFWVHLVIILAFLNFLPIGKHFHIITGLPTVFFQRTHSTGKLPTPDLEKEEFGTATVKDLTWKQGLDLYSCTECGRCQTHCPTYITGKPLTHKGVNQDLKHWIWGNEQWVEEGYGPNGIKEPLPEIVGSALSAETVWACTSCGWCEQACPVFIENVPRLIDMRRYQVQVKAEFPPEIQRVFEGIERQGNPWGLGQDRRDEWAEDLALPTWGDDGGPYEYLFFVGCAGSYDDKQKKVSRALVKILREAGVSFATLSKQEMCNGDSARRMGNEYLFQTMAKTNVETWNSMGVKAVITQCPHCFNTIKNEYPEFGGEYRVINHTQLINELLKEKRIKLSAVMNSKLTYHDPCYLGRHNGVYDAPREVLNSIPGLEVVEMQRSKREGFCCGAGGGRMWMEEHIGTRINHNRLNEAALTLKHAEDPNTPYPNAADKKKPGQVGDYKEKGGSGIVAVACPFCSTMLSDAVNDTGREENIKIKDITELVADALETKSGAVGTVAPSATVSAKPE

SEQ ID NO: 10810 - protein, 228 aa, Myxococcus xanthus
MNATRVQRPGGKGEVTVTLSNGEQVVADEILVAMGRVPRTEGIGLETVGLVGGKPVEVDDQLRAKGVDGGWLYACGDTNGRNLLTHMGKYQARMVGDVIAGKQARAWADAKATPQVVFTHPQVASVGLTEAKAREAGLPVRTVEQQLQDVSGTSLVGKGLTGTVKWVVDEKRRVLVGATFTGPEVGEMLHAATIAVAGEVPLDTLWHAVPSFPTMSEVWLKLLEAYGL

SEQ ID NO: 10811 - protein, 361 aa, Myxococcus xanthus
MAAERFWEATDIYRLSDGHMPFKYAPITAPLFLPFTLLPARAAVALWNLGSIAALAAVARLTMRATPSSGEATPWAWAPALTTLALLPAFTFELFYGQVDAVILLLILLCTLGAERGQVWGPGAAFDEAFLLKAPAALVGLFFLWRRHWRVIGATAVVGGILTLPTLARYGWDGTLVQFQLWSDTLARTTPPWALQSNTQGLPTVLLALVYPPDTVVPPGDMSLAQAVAMVLFVAAVVWARPGPADLIAVCCLGVTLLSPLAWRANYVLAWPLIRAAVESRHRPNLVLVALIALTGLLVSDSGLGAEWSRHVLLWRPFALVYTGLLIVLLSQMRRMGAPRAVADADAVSRLPRCFGGGLAP

SEQ ID NO: 10812 - protein, 131 aa, Myxococcus xanthus
GIAAVTAAGKVTEVIKEKKGTDVVFRPPPPPPPPPVVEAKPPPPPPPPPKPKLAPKPAPPAAAKAPPPAAPTVAPAPIVVPKEVPLEKPPEAATETVAAAPIAVGGTGALVPGGVVGGVPGGDTLAGGGGC

SEQ ID NO: 10813 - protein, 80 aa, Myxococcus xanthus
MTMADNKGSPVRGDERMDTTRPEELEREARHQKGPVRGDVTDEDVGEDRILQKGIGGYGAQKGTEPAREAPPLSDDHGRH

SEQ ID NO: 10814 - protein, 193 aa, Myxococcus xanthus
MKQVFTALALGTLLIGAPALADAEVGKPAPTFTLKDESGKEHTLAQYKGKVVVLEWTNPECPFVQRHYKNDTMVTTLKGFDAKKVVWLAVDSTAHNTPEKSAAWKKDEGFPYPVLQDASGTVGKSYGAKTTPHMYVIDETGVVRYAGAIDDDPRGKNAKPANHVKTAVDAVVGGQQVPASTTTPYGCSVKYKS

SEQ ID NO: 10815 - protein, 91 aa, Myxococcus xanthus
MTVRTATGHVIGRVAGIGDTHFELEQGLVPIPRRDYLVEFSDVDFIRGHDVYLVNADHPLLALEVDDDGGALPPRHSEGLEREPVNVDVES

SEQ ID NO: 10816 - protein, 430 aa, Myxococcus xanthus
MGLGLALVFAFFGGALLNLMPCVFPVLALKAYGFTRMVQQEQGRVGAHAAAYAAGIIGTMLLLASVVLAVRAGGASVGWGFQFQEPLFVAGVCAVLVAFALNLFGVFNVGLDGTALAGKVDQSHGLMHSAGEGVLAVVLATPCSAPLLGTAVGFAFAAGPMTVLAVFTALGLGLALPFCVLVLVPGLAKKLPKPGAWMERFKQVLGFALLATTVWLVWVMGGLAGVDGMARLLAFLVAVGLVTWLYGQGQAQDGVRKLATVAVAAGVLVASGLLTLRFDDQDPVEAPRVGSTVAQAQPWSADAVNAALAAGQPVFIDFTADWCLTCKFNERTVLSTDEVRDAFKKHQVAFFIADWTRRDASITTKLAEHGRAGVPMYLVLSPGAPDKPEVLPELLTPGVVTDAVTRAAACAPSKLGNGANVLCAAGFPSH

SEQ ID NO: 10817 - protein, 369 aa, Myxococcus xanthus
MRGVPLLAAVQAAQALVERASPRDYLGLLTFDAEPEQVLPMRAMDPNARAQLLKVLARLESGEGTALHEAVERASESARRVLVPGARPQVLMLTDGEPSVGPSQLAEFKTQGARIAESGVMLHALGLGRHYLPDILEALTSPSGTGFVHVDDPEGLPMAVGQLGAELFGEVVADARVHVLPTGFADVRCRHRYPSRVEGDAMSATLGAISQAFPRRVLFSGMLGDAEWNLGVSTFYSERGDTRRISVPVTRVLPDSDAGRFVRAVSAELDLVAGEAAAWKALGRRHQDAAERALEAADVALYKLARLGSAEVPAQRHVERLADLRRVIERRANKLPALVMRRAHSEVSRITMSRVGPAAPALLPWKTED

SEQ ID NO: 10818 - protein, 72 aa, Myxococcus xanthus
MPHARADDQDLARTLLSGLGITDLRLDAPPPQDNSFRRKLASAGAYVSGKLGDDGATKRLERVLRSEKQRKP

SEQ ID NO: 10819 - protein, 39 aa, Myxococcus xanthus
MRERDPELTDSIGESALIMAAAHGHTEVCPVADASRARG

SEQ ID NO: 10820 - protein, 88 aa, Myxococcus xanthus
MGLIQEPSATPLLDALLESPPPEAALRPTEAHVDGKRVVIEGQDEVVLKCGEASITLRRNGKVIVKGTYLESRASGTHRIKGGTVEIN

SEQ ID NO: 10821 - protein, 302 aa, Myxococcus xanthus
MLGGCEPLDDGGGGGIGGVLFTRGFAFVREDDRNVYVVDDGGDANSPQRLTNVGGAYWPSVSRDGRSVVFVQRSGGTTTLLTVPTSGGTPSTLFRANDSTCARGCSNFRTPTFSPDGRSVVFVFSPGNSSQTALARINTDGSGFQELTPNNVIAYGAPSFVPNGGAVLAGAGSGLNQLDQLAHVPLNGGTITYSSLSAGVQFVENRVAVSPNGSQVALDGRLSSGGTRIFVAQLSGSNVGALQRVTIGGAGEESWPSWTGASQLGFLISAGGSDTGIYRANLSTGSVSLAVPSATEPSYGPI

SEQ ID NO: 10822 - protein, 146 aa, Myxococcus xanthus
MGVAAVVSKTVLPTPAYAFNKDRGQYHCNAIMRRLTPMQEPGQFAVLGISDVDLFVPDSPFVFGEADRESKTAVMSLHRLAQGAASEMLRRRAQVEVVHQAGHLLGLSYCEDPRCVMFFAQTPQDCDRKQLSLCNLCRNELQKLNR

SEQ ID NO: 10823 - protein, 95 aa, Myxococcus xanthus
MGTASYVAEGRGEPRAFRSCSHGAGRVLTRAEARARIRPAALEHVLRRVVYDKGRAAALVEEAPAAYRDITEVLEDEADLVRPLLRLTPLAVLKG

SEQ ID NO: 10824 - protein, 675 aa, Myxococcus xanthus
MSTQRLDHTATVLPNGRVLVAGGQSSTSAEQYDVATARWLSAGSMNVIRRRHTATLLPNGKVLVVAGDVAAATTGTAELYDVATGTWSSTGSLDSLRSGHTATLLLNGKVMVMGGEDGTGTALRTARLYDANTGTWSATHSMTAPRMGHAATLLPNGKVLVSGGRSSSWGTVLRTAELYDPATGTWSSTASMSSPRTGHASTALLNGKVLVSGGLVDDITATRSAELYTVETGVWGSAGGLMPVERAHHTATVLHSGEVFIAGGSDGSEPYLQSAALYDPVNALWTSTVSMGTSRLGHTAALLGTGDVLVAGGSPDGVLRTASAERYVPPTLPWRAANAMLSARYHHSLTVLSSGEVLAAGGTANGSTASTGAERYSEATGHWLQTGTLLTARYLHTATLLPNGKVLAAGGQSTSSSYLPSAELYDAATGTWTSTGALAAPRARHTATLLPNGKVLVAGGRMSSSFSGMLATAELYDAATGTWTATGVMSRRRQYHTATSLPSGKVLVVGGNTQDGDTSSAELYDVSTGQWTLTGSLSGPRYGHMAVALPSGKVLVAGGWGARGALATAELYDPATGTWTSLTSMQHSRYGPMSALLPSGRVLVLGGDGGGTVGLLASAEVYDPASGQWHSAGTLPTALTSAGVVTLVGSGRVLVSGGLGPNGSLSSAGLYSPAP

SEQ ID NO: 10825 - protein, 332 aa, Myxococcus xanthus
MGGFDDLLGYDYWGNDFGTFVGEACESRFDTNCNSDLDPGQRAFVAQVAAFQSSEVRGLDLADDIEGFMATTGVSKVSIIGHSQGGIDARKAARVLRERRGATSVAVLASVSSPHRGSPVAKYILDQKPGVTSVIAALARYYGDSVYAPGNDAYAAAKQLVFNDYSSSDGVVTGMKAFNEKYPVSSNYAERYVSLITAQFGGNVNPALYLLKEFLFDIDGNGYCVGDGDNDGAAGCGDGVRNEADDDGMVGINSQQMGRRLRYHDAFFGFDSVTDDASIPTLNDLNAPSRLQSTSMSSVVPQDHVDVVGVGPDAFDEPEFYAALIHYISLHD

SEQ ID NO: 10826 - protein, 85 aa, Myxococcus xanthus
LTALNDFARERGLTDDPLYEVKPVDFFIRISAKGKFIKLESLAREDGRGNAMPIPRLPQRSVNIAAGFFADNSKYVLAYETLEHV

SEQ ID NO: 10827 - protein, 289 aa, Myxococcus xanthus
MGGSNGLAMGALADAEVYAPDTGTWTEVRPMGVARNDPAAVLLADGRVLVAGGTDVDQRPLRSAELFDPATGMWSAASPPGFSRGGAQTAVVLANGKALFVSGLQAELYDPVTGLWEKAGLTGGAAGTHRLAHSVTLLPDGRVLVVGGTTARAAATAEVYSPETGVWTLVGAPKVPREHHATVVLPDGAVLMMGGEHYTTGALASVERFDLKTETWSSAPALDEPREKLGALALGDGAVLVMGGGNEAAGMLSESERYVPDACVVAPCAARELGGAEAVMELSVAGQVE

SEQ ID NO: 10828 - protein, 483 aa, Myxococcus xanthus
  unsure (1)..(483): unsure at all Xaa locations
MELEKERGISVTSSVLQFSYRDHSVNLLDTPGHQDFSEDTYRTLAAADAAVMLIDAAKGVEPQTKKLFKVCRLRGIPIFTFVNKLDRYGREPLELMNELEHVLGIRSYPMNWPIGMGPDFRGVYDRQARVVHVFSTEGSHGESEVSERSVAIDSDEIKTVLTETELAKLHEEIELLDIGGDEFTREKSDAGQLTPMFFGSAMTNFGVRPFLDAFLDLAPAPTSRLTTHGPREPTHPKFAGFVFKIQANMDPAHRDRIAFMRVVSGRYVKGMSAFHSRLGKDVRLAKPSQFMAAERTSIEXAWSGDVIALFDPGLYRIGDTLAEGTGVEFEGVPRFSPEFFAVVRSRDPLRRKQMEKGLEQLSEEGTVQIFQQLQMGMKDPIVGVVGALQFEVLQYRLEHEYGAKIALDRLPFSHARWVVGANFDPKAFDWEGNRQTVQDRDGLPLVLFRDDWALQHAEDKHPELKFVSEAPQLRQATPLASGG

SEQ ID NO: 10829 - protein, 138 aa, Myxococcus xanthus
MSERHPLPHEVVRAWRQCQLPRPSSPALLDLFERGFQALWRRGRSALGEVTLVVILERVLQRVVQAHPHLSALVVTSEGLRFEGLHPVVAEFDPERLEESLVVLVEEWLRVLGALTGEVLSAALREELLAVEGTRPPR

SEQ ID NO: 10830 - protein, 343 aa, Myxococcus xanthus
MESPPSQAVAHAASAYAYLVGLERVTLQGRDVIEGVFKAEPARVPGVVTLPLVAKEGVLGVLHVESVGLGEDGLVLLDAVANLLAVALPKEHVLRREVRRRERAEALFFQAQEAVRWRDELLTVVSHDIKTPLLAVRMNAEMILNAGTAPEKEHRRRRYLENIVLAEQQMSSLIGNLLDRARLRGMPIPLTLQPLPVDALLAQSLEVLRPLALEKGQVLTVAQAPELPPVLADRERILQVLANLVSNAIKFTPPGGVIEVRARLVEGAKVCVFVKDSGPGIPAEDAPHLFERFWRASHSPGRGTGLGLSIAWSLVAAHGGTLNVESHEGQGSTFSFTLPVALP

SEQ ID NO: 10831 - protein, 501 aa, Myxococcus xanthus
MNPGMDTWLLTRMQELRDLQGLIGLATWDMETYLPSKAGPARSHQLSTLQGLHHERLVDPRLGEALAQAASQADLSDDARAMVTVLTREREREVRVPAPLVRALAGAISDAIQAWREARQARRFTVFQPALQRLLSLRREQADAYGHDGERYDALLEGHEPGMRVARLTPVLSALREHLIPMVGKLTAVSRPVAPFLMGRHYDKDTQWAFTLRLLKDIGFDLEAGRQDLSIHPFTGGTHPLDVRLTTHVDTATPFPSIFSTIHEAGHGLYEQGFAPELYRTPLAAAPSMGLHESQSRLWENMVGRGLPFWRHYFPVLRAAFPEALSGTDLETFHAAVNAVGPSLIRIESDEVTYNLHIALRYELELLLVRDELPVEDLPAAWNARMEKYLGITPPDDTQGVLQDIHWAWGELGYFPTYSLGNLYAASLYRAAKRDLPELEAHLGRGELLPLRDWLRTHVHQHGFRHSAEERVKQVTGQGLTDTDFLAYLKEKYGALYGVSL

SEQ ID NO: 10832 - protein, 190 aa, Myxococcus xanthus
MLLGWGAGAIGVGAYIFLSPYLSPPAEPGNISSPTLAKLLNESIDAAIERMNPTHSPGLIPEAAANSRAFLKEVSEVVARCSKGRFEPGQKYNKLEYHLLRTDGVRYERIYTGIRCHEATLIYRAVFKDGRVAEAFTDGRERQYPVGQVRGAVGEFGKKVTWSDRDYHPARYYVPPPAQPTQADIAKQWE

SEQ ID NO: 10833 - protein, 358 aa, Myxococcus xanthus
MLEVYAGSAVVDVVAGEVVSAGLVLQRNPVNCPGTTNGGIDITGELETGEPTPDGGSDGGVDPDAGVVLGGAEFAFSYQDATLTHDGVIHFLDGNANRIRRLDLTTRSFLSAYVGTGDATSMAVASDGQTAYLAYTGGRIDAFTSTEGGTARFFAAAPASVSRMVVADRYLFTIDGSGAWGTHALYQRATGARVAAADWRNSAVSLLFSEANNTIYFADSGVSPQDLNRVQVDMEAGTLGAEIDSPYHGAYNLRAPLRLWPDGSAVVTGSGLLFNTADLTYRTSIGLSFVDIAFHGERLYLIDTVGDRTQLRVLNHRFDILSAAYYPGAAQRVFVHNGQLVLLTSTGSNGFQARLLDL

SEQ ID NO: 10834 - protein, 300 aa, Myxococcus xanthus
MGVAWKDNIDVADALERVADLLEEQDAMPFRVGAYRKAAGTIAQWPQPVAELLAEEGEAGLRKLPGVGKSIAAAMAELIRTGQLSLLQRLETEHSPEQLLASVPGIGAGLARRIHDELSVRTLEELEQAAHDGRLERVEGFGPRRSEQVRELLGARLGRERRSAARRSEGRDEGPRPDVGVLLQVDEEYRRRADAGELRRIAPRRFNPSGEAWLPVLRKKLAGWNFRALFSNTALAHQQNATHDWVVLYFDQEGDEGQCTIVTAHGGPLDGRRVVRGREVECLAYYGVESEEVEAPQPGA

SEQ ID NO: 10835 - protein, 320 aa, Myxococcus xanthus
MDERATVGGWVLVAAVLFTMLAATLSTFAVVHPLLQRLRRLHRAAGMLGASRYHSAADGQDDELGELSRVLDATHARVQEDATRIEAQKHALERHLADVAHDLKTPIASLQLSLELASTTPTEPTAALLRQGIEDTVYLTSLVDNLHLACQLGEGIDPTAGDPRVELGLTVERVVRRLQQLARLLGLTVECSRPDEALWVRCNPTMLEQALGNLLHNAVTHGEAGGHVVALLEDAEPGRFRLTVLDDGPGLSAEELERLGERGFRAQATRRRATRGSGLGLSIVRELCHRVGFSLAFAPNPPRGLKVVIEGPRASTSEPG

SEQ ID NO: 10836 - protein, 229 aa, Myxococcus xanthus
MNPSARILVVEDDAPIAAGIVRGLKLAGFQVVLATDGVLALEMAEREHPDLVVLDLNLPGQDGFELLEAWRFRLRVPVIVLTARQELEARLRSFGLGAVDYLPKPFWMEELVARIRARLLLQEERPRRVLHWDDVSLDLDAREASREGTGALPFTRHEFDVLAYLAERPGRALTRAQIAQHALPPSEERDDRTVDSHIARIRKKLGPAGARIQTSWGIGYRFVPDEEPR

SEQ ID NO: 10837 - protein, 320 aa, Myxococcus xanthus
MSSISKSFKKAVKKVKKTAKKAGNTVVDTANKAADTVTDTAGTVTNQVSREAEQLAREVDTLTRDTAKLAEQAYAESLAAGEAAWNEMVELSTRFLTDALSDVAEALAEDVYRKHLALLESMAETGSALLTNPTRRKEVDFLVGQSSQKKKDEDTNKTVSSLSQDESVQRTGNEARSKGLGTLSIGSGGSATFGLGPEGNVGIAFDHPGQTQVRGFFGIGGVAGATKGISMNFQFGAWADMPSKLAGPVLTVSLGAGVGKFCGSAQVVFKMPITEKEWTAFATSGRLDLAGLVMCLGAEVSTFAKDGVSATVGGGYTWVY

SEQ ID NO: 10838 - protein, 124 aa, Myxococcus xanthus
MNPWKASLVVCVWLVACGGSEAPQRSYAGWSERVAASACAYEEQCGTLTVSREQCEADRIAAYAAVEPDLSRTESGAKAGCVQCMRARIDELDAATASGCQQSIDEARLLAVCGVDGAACAGVP

SEQ ID NO: 10839 - protein, 26 aa, Myxococcus xanthus
MVEVSRLISPEILVEIEADAVVADGV

SEQ ID NO: 10840 - protein, 180 aa, Myxococcus xanthus
MANVIQFFMSPDDELAFFRFLERFVLEVYPRRVPQDWETFRANTENLERLPPEDLYMVASELGAAIVDKVKRGPDKGYWRIDEVRSPVIFMERCRTNEEGELLSGKMWAELDITAQTGRKNAAPDKFRSLFLEVEEYIKKTYRKGDPKGFFVGPKTARLCKEGLVLRDSAFRGGTVLPYK

SEQ ID NO: 10841 - protein, 121 aa, Myxococcus xanthus
MQLLALKSIADGVRSQSAIAERMLVDAPSVSRLVARLEEDGLVKRSIAEDRRCARLELSPAGQTELNLLRDALIWTDVELLRYLTVQEMAEFKRLTVKLLTGLLQARGPVPLEGGCGPSDT

SEQ ID NO: 10842 - protein, 493 aa, Myxococcus xanthus
MLKTVKHRSFLVRGAALALTLACMTGCGDDDEPTPTPDAGTNTDAGTDAGTNPTPDAGTGALDSDIAVVRFNEDGTHDTTFGAGGVTHVDFGTGRDGTRDSLWDVRVDGTDRIVLFGNKRADGTRVDTDRVVARLTATGALDTTFGSTETPNGFSVLNLSNLNDGMRYGFIQPDGKIMTSGYTSMPTGVGAQAANRIVLQRLNDNGKADDSFGWKGVVTSAPFQAQSETNPEWGMAEAYAAGMQSNGSYVTTGYGRSASSGKVDLVSFRYTSTGALDPTWGTGGAVVLDLVGDDDRGRNLVVLNDDRVLHVGSGSLGAQNIQALLLMQTQDGQPDTTFAPEGYKTFSLDRPEQAFFGVAKSSDGNWAAAVGYRAGGNQNADGILAIIPTNGSAEEVIIKATPISTTENDRFWSVAFDSTNRIYAAGFVTEGGDNGDNQMVVARFTTEGNLDTTFGTGGIAKINVATAGTEEAARGIAIQSDGKIVIGGPIEKR

SEQ ID NO: 10843 - protein, 312 aa, Myxococcus xanthus
MPEMSVEDVDLSTAFLGKRLRYPLLVTGMTGGTERAGAVNRDLALLAERHGLAFGVGSQRAMSEDASRAASFQVRQVAPTVALLGNIGMFQAIGLGVDGTRRLVDGIGADGLALHLNAGQELTQPEGDRDFQGGYRVVELLVKAFGDRLLVKETGCGIGPDVARRLVDLGVRNIDVSGLGGTSWVRVEQLRASGVQAQLGAEFSAWGIPTAAALASVRRAVGPDVHLVASGGLRTGLDAAKVLALGANLAGMALPLFRAQQAGGLEAAEAALEVILASLRQALVLTGSRSCAELRQRPRVVTGELKDWLAAL

SEQ ID NO: 10844 - protein, 223 aa, Myxococcus xanthus
SDTVTSRLPGFHKLPMEERHAHLSRMFRLTPEDLQQLLGSEALQPVLANQMIENAVGTFSLPLGLGLNLQVNGRDYLVPMAVEEPSVVAAVSFAAKIVREAGGFIGEADPSLMIGQVQVSRYGDPTVATERILEHKEQILALANSFHPAMVARGGGAKDVEVRVLPAPEGPRGEPLLIVHLIIDAQEAMGANLINTMAEGVAPLIEQVTGGKVYLRILSNLAD

SEQ ID NO: 10845 - protein, 1048 aa, Myxococcus xanthus
  unsure (1)..(1048): unsure at all Xaa locations
MFVDFFIRRPVFAIVCSILLTLVGLIAIPTLPIAQYPDLAPPQVTVTSTYVGASAEVVESAVTIPLEQELNGVEGMRYITSTSSNDGTSQITITFEATRDIEVAAVDVQNRVSRAAARLPSQVNQTGIVVNKASSQMLLTVGLFSEDNRYDAKFLSNYADVSLKDAIKRVPGVGDVRIFGERKFSMRLWLDPTELARRKLTPQDVTRALQEQNLQVAAGQIGQPPSTEDQPYQIAVRARGRLVEPAEFGDIVLMRDTDGTSIRVKDVGRVELGAENYGSVLRFNGKTGVGLGIFQLPTANALDVRDGVYAELERLSKQFPPGMQFQTGTDTTLAVRASINEVIKTLVEAIVLVILVIFLFLHGWRSVLITAFTLPVSLIGTFAFVHLMGFSINTLTLFGLTLATGLVVDDAIVVIENIERLMVERRLSPVQAAREGMKEVTGAVIAISVVLVAVFVPVALFPGTTGAIYRQFALTIAASVALSTFCALTLTPALSAKMLKHHEGPKWVFFRWVDTVLDGTKALYGRGLRKLLKHPVLVLLAFLACIGGTALLFRAAPTGFIPDEDQGYLIISIQGPEGMSLAQTEKVLAEAEAVLQAQPEVRAMFAIGGFSMMGSGPNMGTIFSSLTSWEERKGKDQSVAALVERLRAPLSRIGGARVMPFQPPAIRGVGSVGGFQYIVEDIDGTSSLDDLAAATQMLVAKANEHEQLRGAFSTFNADTPLLDVEVDRQKAKALGVPIEQVFGTMQVYMGSQYVNDFNYANRTYRVYVQAEQQFRDSPSDIGAFYVRSDTGDMIPLESLVKVEPTVSXQVIRHYNLFRSAEINGQPAPDVSSGQALEAMETLATQHLPQGMSAEWTGISLEQKESGGQTAIIFALGLLFVFLVLAAQYESFSLPLVIIFSVPLAIMGALGLQLARGFANDVFCQVGLVMLVGLASKNAILIVEFAEQLREGGKSAIDAVVEAAEVRLRPILMTSIAFLLGVVPLMTASGAGAASRNSLGTAVFGGMLVSTVVNFVFIPGLYVLMQKLRGDAKRATGEDEAVPTPAASH

SEQ ID NO: 10846 - protein, 380 aa, Myxococcus xanthus
MKAMWGVTLLAVVAGCSAQKAAPPAPPPREVEIVTLTPREVRETGEYLGSLMSRQSVNVLPQVAGYVRKIHVRPGDKVEAGAALIEVDSREGTAALDSAQAQLSSTQVSLELARRTLERTEALYKEGLASAQELEQGRAQVEAAQAAARSSAAQVTQRQVQLQYHVVRAPFAGTMGDVLVRLGDYVGMTTPLTSVAQSDVLEVSVSVPSPRARSMKPDTALEILDSTGKVLITSNVFYIAPQADPRTQLVEVKAAFRNTVGLRPSELVRARLVYSARDALQIPALAIVRQSGQPFALVVLAKDGKTVVERRPITLGALGEMAYVVESGLQSGDQVAVSSLQALRDGMAVKPKQANAPNAPTGSGPPRASGNGGGTVGGSR

SEQ ID NO: 10847 - protein, 468 aa, Myxococcus xanthus
MRTRTLLLAPLLLSTSCATVSPKAQAPDATTAEAKSPAPERPFGTLREQAKRQQAWLAERVEKALPQLMRQYGVDMWVIPMREYNEDPVFKALVSPTSFAARRRTIYVFFDRGPEQGVERLALGGGSQGGLYTPRRAQRQVDGGGVSREAELWGPEQWQVLKQVVEERQPKRIALNVSRTFAFADGLSHGEYEGMSEALGPDWVKRFTSVDGLAVDFIAWRSADEARFYEEQTKLAWNIIETAFSNQVITPGVTTTRDVEWWMRQRLADLGLETWFQPSVDLQRQGVTEKELGEDPIIQRGDVLHCDYGVTALGLNTDTQHMGYVLREGETDVPAGLKAALKTSNRLQDIVFEELRPGRTGNDILRTSRERMRAEGIDGTVYSHPIGLHGHGAGPMVGLWDRQEGVPGNGDHKVIANQWYSIELQATSVVPEWNGQQVRSAQEEDITIDAEGRVHWAWKRQTDFHLVR

SEQ ID NO: 10848 - protein, 180 aa, Myxococcus xanthus
MNERTDLVASRAQLESARDSRQQATAGYLPTLGLSSTAVGLTTDPGFGRVAIWSVSAVLSVPIWEGGLRGGLIREREGLERQAAEALESTRRDVSIQVAQARRAVEVAEALVTTAVASRDLADRTDRLTRRSFEVGRGSSLELVQSGAALRQAELTLVLREFELVQARLDAFLTEARCDW

SEQ ID NO: 10849 - protein, 209 aa, Myxococcus xanthus
MESKGRRPQPAPAAPIAAPATQVAAPAQEGEAVIAAVVPVVPTATETVPQERGQRRYRELNDADREKMERLEQAANKDRLRAVELEKELRRVKGRNETQQRVYAATKHDLDLSRDKYKALEKRLNRTLLERDLIRRAIKDLEKKTGMLADRTELTPEEVAASDQRTEETSRVRAEAEAQATPKTEAPADTEQQAPESAPADAESKPAQA

SEQ ID NO: 10850 - protein, 260 aa, Myxococcus xanthus
MNFGSYWFSDRIALAIHGARPLPYEQAPWLHDMVARLASRAGMPKPKVYILPTAAPNAFATGRNPSHAAIAVTAGLMELLDRRELEGVLAHELGHVRNRDTLIGTVAATLAGIISYAAQMLFWFGGSMLSRGDNDERGGLGSAFANLGLLLVAPIAATLLQLAVSRSREYGADQTGAELAGDPDALANALLKLERSAEAIPYDKAPATSHLFIVNPLHRGGVMALFSTHPPIPERVRRLRELGARLGARTGGRGGWEYAY

SEQ ID NO: 10851 - protein, 222 aa, Myxococcus xanthus
MFPFIMVTGALVFFEASWPRRLFHGLRARLARTSVATSAASETPATPAPSAPGWKGQVALGLALTYAVVQVAIPLRTHLYGGNVLWHEQGMRFSWRVMAREKNGSVTFIVRDPASDREWHVAPSQYLTRLQEREMSVQPDLILQLARHIARDFEAQGKGRVQVHVDAQVSLNGRPAELLVDPDVDLAREVDSLAPKRWIRPAPESPPIRLRAPLRGATAERP

SEQ ID NO: 10852 - protein, 412 aa, Myxococcus xanthus
MNTESSRPLSVLRARAIALAVPALLSLSACKSDKVTPPDAGTDNPGDTVAATRAALLESSGACVLQTAREFQTAATALESAVAAHAATPDATTRDTAREAYHQAMDVWQMAEVMQFGPAAPRSLPGGAEIRDNIYSWPLVSRCAIEEQLVNRSYESESFDSSLVSRRGLYALEYLLFFEGNDTACPGTSVIVSQGTWAALSADERAARKRAYAAVVAADVHRRADALVNAWAPDQENFGRTLTTAGSGNAVYPSTQAALNSVSDAIFYFEREVKDLKVARPLALRDCATSTCPEHLESQFAARSKANIRANLVGYRRITEGCGENFSGTGFDDLLEASGADALAAKLRERNAAAAAGIDAVPGEDLATVLAQDKAAMRTMYDVIKSVTDVLKTELVTVLDLELPQSVEGDND

SEQ ID NO: 10853 - protein, 76 aa, Myxococcus xanthus
MGRDDVTNRFESRGMPTLRALLTHLTDSGRFTLAGCTGSLGALGAEARADASGIALWLGWSAILQRTAGVTDRFYL

SEQ ID NO: 10854 - protein, 333 aa, Myxococcus xanthus
GELLGLSSVAPTDSFFELGGHSLLAVTLISRISAKLDIEVPLNEVFDRPSVESLAHWIDEHSSKVTALIRQLPACVVALKPLGHKPPLFLAPPSAGSPAVYVTLARHLDAEQPVFGFQMPGVMDDQLPPETIEDTAALYVAALRQVQPRGPYRIAGWSYGGLVVCEMARQLEALGEQVALLGLIDGAALDRLSAHDGTPQEIPAGSQLIKVLGEAQMPRDYASLRLIGEWMGISLPEAWADLLRRDTDGQYSYLWRFLRDSALTARNFLATRRSEQLYTFSSYGGSATLFRTGPVTIGGDPLVDSVRRFALAGTEVIPVPGNHMTLIMDERNL

SEQ ID NO: 10855 - protein, 485 aa, Myxococcus xanthus
MTARLDPFVPAASPQAVPTPELTAPSSDAAAKREARRLAHEALLVRAKAIDEAGGADDWVQAQLVSKGLAVEDLDFSSASEKDKKAWKEKKKAEATERRALKRQAHEAWKATHVGHLGAGVHWAEDRLADAFDVPHREERARANGLTELDSAEALAKALGLSVSKLRWFAFHREVDTATHYVSWTIPKRDGSKRTITSPKPELKAAQRWVLSNVVERLPVHGAAHGFVAGRSILTNALAHQGADVVVKVDLKDFFPSVTWRRVKGLLRKGGLPEGTSTLLSLLSTEAPREAVQFRGKLLHVAKGPRALPQGAPTSPGITNALCLKLDKRLSALAKRLGFTYTRYADDLTFSWTKAKQPKPRRTQRPPVAVLLSRVQEVVEAEGFRVHPDKTRVARKGTRQRVTGLVVNAAGKDAPAARVPRDVVRQLRAAIHNRKKGKPGREGESLEQLKGMAAFIHMTDPAKGRAFLAQLTELESTASAAPQAE

SEQ ID NO: 10856 - protein, 461 aa, Myxococcus xanthus
MLWMLHRMRQSLGYLAETDDQRKVRQSVQSTTFAWPFHPHAFVDDVDNPYTTPEDQPFTWIRARQVGGRTSVKAHGRQFYRLSDFNFKAGTQDGQGPDWPLTLADLAPHYETVERWMGIHGNADGLDILPDSVFAGSITMTPAEQRLKEQVERRWPERRVIVRRTAGAPVTMPAALKTGRLALRTNAVVDQVLYDAATGRATGVHYLDARSGKSYEAHARVVVLAAGAIESTRLLLNSRCSAFPDGLANTSGQLGRNLMDHTYMLGIEAKMNLPPEAQRQEHSWAYIPQFRNVATKEQDFARGYGVQVFTFGDNCHFVPFGEMVPRAENRVTLSPTVKDRWGIPAAHIECRHSANELKMAEDALAACKEMMEAAGFTVEKANATLSTPGMAIHEVGTARMGTDAKTSVLNPHNQSWDVPNLFINDGACFPSQGPQNPTLTMMAIAVRASAHIVKEFKAGRL

SEQ ID NO: 10857 - protein, 33 aa, Myxococcus xanthus
MAVLAEQLAQRGHTVSIESLTRSVRAMLGARLA

SEQ ID NO: 10858 - protein, 122 aa, Myxococcus xanthus
EAHPGASLARYPPERLHALADRLATLARLPELTALQIDFDARASEYDAYVALLQALRQKLPPSMALSITGLASWCTPGSWLTHAPVDEVVPQLFRMGPEAPTWRAHFARGLPAPCRGSGGSL

SEQ ID NO: 10859 - protein, 238 aa, Myxococcus xanthus
MQPVPIVVGLVLRVVLPLAFVSALRRSRRAIVAVDTHQWTLTLRGGARMEIPFEAVSAVRPWRLPLPGPGLALRMRSGRAFSHALEVEDALPLLNSLGQHGAPGAAQSHTLIRYAHARHALWRRRWYHLLVKFVFFPLVPTAILFYSYQVISFGGALGEYRMYGLDAYLRSFGRYYAPISLCLLLFACFWRVVAEGASLLAAWLLPAWARGVRRAAEWFCWLVYYVGTLGLIGARFMM

SEQ ID NO: 10860 - protein, 423 aa, Myxococcus xanthus
MQWLLLGGLVGVVCGVASAVFLYLLDEATHFREGHPWLVYALPVAGLVLGAVYGKWGRPIRGGNNLVLDTVHASDAQVPVRMAPMVLVGTVLTHLFGGSAGREGTAVQMGGSLADLVARRFRVGPDTRRELLAAGIAGGFGSVFGTPVAGAVFGLEVVVVGRMGYEALLPALVASVVGDMVTRGLGIHHTPYPAPGALPLTVAVLAKWLVFAVAVAVVAVVFVELMHRLKKLLEQRVQVLPLRMALGGLAVLLLWLLAGTDDYLGLGVPGIQRAFEDPALPVSAFAWKLAFTVVTLAAGFLGGEVTPLFFIGASLGNVLARLLGLPLDLGAAVGMAALFAAAANTPLALSIMAVELLGANVLPHVAIVATVAYLLTGQRGIYPSQRIARMKHGGPLLEKLVALRELAREDRAPPSGPEGRGGG

SEQ ID NO: 10861 - protein, 296 aa, Myxococcus xanthus
MKWRWLLGGALALGLLAALAVFGRALRHSEAYFHYPRPKAERPADFAEAKDVSLQTSDGLTLRGWYVPSRNRAAVVLAHGLSQTRADLLPEARILRAAGYGVLLFDLRAHGESEGGFSTWGDLERRDVRAALDFVRAQPDVDPERVGALGFSIGSAAVAEVAAEDPAVRAVVLLSPFNTLWLAATYDFRRFGFVSQSGALVPFWRRGIALEEVRTIDAVERIRPRPLLIVMGTEESGQPLADELFAKVREYAQTWRIQGAGHGNFSATEPEAYPRRLTDFLNAALLARGTSATDAR

SEQ ID NO: 10862 - protein, 496 aa, Myxococcus xanthus
MVPWLAALDRARSAREALSLGVLLSVTFTAAVFHWFPGALQAYSRAPTVVGWALFLLVAPLLQLQFVAAALARYAARRLAREGQGWLPPLVGTLVYVGVEGVTPKLFADTLGHGLYASEWLRQGADVAGAPGLTLVLLLGNECVLAALRQSQRGLRAAWRPVAGLAALVLVLSGYGAFRHAQVREATRREGGLVVGAVQANITRYEKLKAEMGAYEVVRMVLDTHYAMSDALLRDGPVDLLVWPETVYPTPFGAPRSETGAALDAEIAGYVSERGVPLVFGTYDLEGEREFNAAMFLGPSSPGGAFERAAYRKTMLFPLTEWVPDAIDTPTLREWLPWTGRWKRGPGPRAVSFTLRDGRQLRVAPLICYETIFPEYVAQGVRQGAELLLTLSNDSWFTGTPAPRLHLMHAAFRSIETRRPQVRVTNSGVTALIDITGAVVAEVDDNQRAGLTMRVPETTALTTLALAWGDWLSPIALVSSVVGLAGAALARRRARP

SEQ ID NO: 10863 - protein, 102 aa, Myxococcus xanthus
MDSELTGMQLYRPGTKPIKKGLVVPDDFELPPGYVRHFQYKDSGEIVAAVLMFHPDHQPVDANGQPIPKPADGLVPEELAPPGMPIQRLELPEGAESGAPSP

SEQ ID NO: 10864 - protein, 327 aa, Myxococcus xanthus
MASTLNQNTSWTIDQPSTSTKYRVVAYGDSIYAGYNGSVFFWNVARRAAPVVQGEDLARKWNADVEVIRRTKSGAKADDIYNNKIVSERSYMQAANTRVVMFEMCGNDYLQARSAFSGQTGTCNYSGLEAALATCTTYMERAMQTINQYAPATATKIISNIYYPGFNADNVNTQCRDSATGQVVNKREKFLPLLARSNWRACSLAARHGFKCADSFAEYMAADYDSNGDGKVDSEAIRYIEGESEAAYVQRISVTLRSTLRDSNTHFVNASTSYDYLQSDDTHPTYTGGTISSSGGTGALPTDTSTWNKTGHDRMGWESAKFNPARP

SEQ ID NO: 10865 - protein, 501 aa, Myxococcus xanthus
METGFVNRVWYLDRDRDSFGRNGPGTEACDPPSELHVEVTGDCDDERADIHPNAVEACNSVDDNCDGRADELFTEGPGALGTACTEFCNGTYACNDTQTGTVCVGTPPTLLYSDADSDGEGEKDSAPVGELCPDAPMPSMMADNTRDCDDADPGTNTLATEVCDGLDNDCDGQVDEEMSCGSLKKVVDPVLAGGNWRTVAVHPSGYPVWVAGLGGRLAVKMDATSAFVSHSGDTTNRCGPAGNKLDWHAAWVNPNNSNLVVVGEDGHIGEHTGSTCYPIQFDLPGKNDYFSGVVGIGNPAQVFAASTLGHLYEITGAAQRHDSPGRYWGLHALGQDALFAVGSTGESSPLTPVVNLYTRPPPPETPWGTPAVHNLQGTAGYNGGLRAVWAADATLIYAVGDGGLVVKGSGQSRDWERVLPQAGPVLNYVSVAAPPGTMNAYVIGNEGNAGRLQRLTPHGWAKAPAFTPSAPNVPLRDIAMTSSSNFWIVGDDGNVYHFPEP

SEQ ID NO: 10866 - protein, 371 aa, Myxococcus xanthus
ALKLRTADVGVVNLETPVTDNTKAVARELLFNAPSAMVHALASAGVKVVSTANNHARDQHPAGMLETLRHLDAAGIRHTGTGATKDAAWEPAFVDVRGVKVGFLSFTRMLNGFSNPKDAQAPHVALVPYSGHETHRGIQPEQAVEAVRAAAAQCDALIVLAHWGTEYKGEPRPEDRELGRALLDAGARAVIGHHPHVLQPLESYQTVDGRKGLIAYSLGNLVANQDRFYQHAAGTKSSGGDRRDSMLLRLSLVRPMPGVSVALEEVAVLPVWIENNAVGRARNESRNIQPVLIDREVEEVTARLALLAARPAPLDKETRAQKALLERRLEGSKHRRERILRMLPEGFAVASPELRQRGTAAVPPGRLASQP

SEQ ID NO: 10867 - protein, 384 aa, Myxococcus xanthus
MNDSLETLLADGIIEAIIGQLKTGKEAEVWLVQHAGQVVAAKLYKERHERNFRNNAGYREGREVRNSRTRRAMEKGSRFGQNAAEDAWKSAESDSLYKLHAQGVRVPTPVLFYEGILLMEVVLDPEGHPAPRMVEAPPSTPEDAHALYVDLRAQVINMLCADLIHGDLSPYNILMSYAGPVIIDFPQTVAAARNNRAEFYFRRDLDNVRNFLASTAPWLHSIASDTSEIWNAYVRRELTQDFVPSGNFREGPRHHGRGGPRNQGFQPQGDERRGGFRPPPPAPVEQAAAPQRDMTPEEAAEAELRELEALVLRQGGGERGKPAVAAPPPRGGRNRGFGGGRPPPRGGGNGARPPQSGQRTGGGAPGRPNEPRASGGVQGRPARE

SEQ ID NO: 10868 - protein, 209 aa, Myxococcus xanthus
MPCAGCHQFGFPVLTSAGQRVRLSPTQLQQDTVGEWRRWQTQSGDTRHCTSCHMPQGDHGFGGTRRTESLKAALRVVQASAFLRISTREVGHAFPSGDVMRWVSVEVSEGPLFETSRTVATFGRSLEVREWPHEPLPHLGAVKDTRLLPGETRQVLLPKGARYARVVYHLVSREQEDSGLYPPGLSQLVLWAEPLQPFPSSHTPKERTP

SEQ ID NO: 10869 - protein, 210 aa, Myxococcus xanthus
MKHIMALLQPDRGTVLVDGEDIARMNEAALDQMRRKQGILFQANALFDSLTVFDNVAFPLRERTRMPEAEIAETVNKTLERVGLSHATQRFPGELSGGMQKRVGFARATILQPKILLYDDPTAGLDPLTTAAVNEIITTGKQQLGATSLVITPDVASAFGMADHLALMHEGRIVEYGPPDAFRESQHPAVMAFLRNWLRRRAQNKRAAQA

SEQ ID NO: 10870 - protein, 194 aa, Myxococcus xanthus
MESDGIVRIAGLLHLGDASFFEADASQAQMLASIEKLDKKEAQQTKACISKCEKRRAGTREDSYDCSCADECMGCDDPNLPASEKLKHQVTGGDFLLGSLARPTAFLRGKSELSGSRESWYAFRQTLVTYAGEKADVVLTNDHTDMMMEGTVALRIHVIDWGESNGKASPTTITSFLVSETRVQVLRYRPAPRA

SEQ ID NO: 10871 - protein, 309 aa, Myxococcus xanthus
MGAQVNALKTLPSFVIATPGRLVDLMENTAIRFPHLEALVLDEADRMLDMGFLPQLERIVAHLPRRRQTLLFSATLGPDVTRFAKSRLYKPVRLEVTRSGTPAERAEQRLYFLRPEEKTPLLLTLLAQDSATALVFTRAKERVDKVQRALQRAGHRTAVLHADRTQNQRKQAMEGFRNGTYRCLVATDIAARGLDVEDVGHVINYDLPHAAEDYVHRIGRTARAAASGVASTFATTREGQVITRIEHLMRSEIPRVQVPREDPVFKEAWEAFLAAQKDPGPPQKDHGQSKRAPDLAPGRHARSHGKRRS

SEQ ID NO: 10872 - protein, 332 aa, Myxococcus xanthus
MVDAAADLPATMEARADTGAAFNVAEDFTRLTLRIASSTLFGADVSSATHDIATVMSRLQVFVYKRLTQPVPLSLRLPLPAHRQFERDVGSLNRVVHGIIAKRRRESGEHHDLLQMMMEAHDDDTGERMSDSQLRDEVLTLLLAGHETTASALAWTIMLLSQHPGVRRDMESELARELGGRNPTHEDLPRLELTHRVVDESLRLYPPAWALSRIATKEDLVGGFRIPKGAHLLIAPWVTHRHPSIWDNPEGFDPDRFLPEREQARPRFAWFPFGGGPRQCIGNQFALMELVLVLATLLQRVRLNLTPGQVIHPTPAITLRPRPGVWVTASRP

SEQ ID NO: 10873 - protein, 129 aa, Myxococcus xanthus
TSSPPPPPGAVAFVDRWRELFDARDWSGLRAHEHPDFPEAGPPRQNDSFIRGLGTSGFRVTSATLKPFVQPRWSIFRTQRLHPQPTYWCDLVLKNAKGHETEAFIALAPWEGTEGAFRASYYVAIPLRL

SEQ ID NO: 10874 - protein, 269 aa, Myxococcus xanthus
ARYDFDLFTIGGGSGGVAASRRAGAHGAGVALCEDRDVGGTCVHRGCVPKKLLVYGAHFREEFQDAEGYGWTVQEPLFTWSKLLAAKDKELDRLRGVYARLLRDSGVTLLEGRGRVVDPHTVEVAGKLYTAERILIATGSRPYLPPDITGIEHAITSDEALSFPELPRRLAVVGAGYIGVELAGVFHGLGSKVTMLIRGASVLGGFDDDVRSFLTDEMRKKGIELMTDTFIRDIEKRAEGGVSLLTGGGETVEADAVLFATGRLRAHEE

SEQ ID NO: 10875 - protein, 198 aa, Myxococcus xanthus
MATKSRKTAVAKKSSRRTATAKKATPKKAAGKAHGAKKTTTKKKTTAKKTTAKKAAAKKAPAKKTTAKKAAAKKTTAKKATTRKAATRRTSKSRRERPTTGVPFVEQVETTSAGLQPLAPTHAAVDEFTSSGDEVLDIFQRYDRDRTGTIDRAEFARLLEALGQNISDEELEIAVDIVDTDRTGKISWNEFKAWWNSR

SEQ ID NO: 10876 - protein, 292 aa, Myxococcus xanthus
MVEGRYNPRQKLPLIPNSDAAGVVDAVGPGVTRVKPGDRVMSLFSQAWSAGEPTRAAQVSTLGGPLDGALADTVLLHEDGAVPTPAYLSDEEAATLPCAAVTAWSALVTHGALKAGDTVLLQGTGGVSIFALQIARLLGARIIITSSSDAKLARARTLGAHEGINYGTTPDWDKAARALTGGVGVDHVVEVGGAGTFEKSLRAVRPGGTVSVIGVLSGGAGTVPLTPILMQNLRVQGIFVGHRQSFDALNRAFALHTVRPVVDRVFEFSEARAAFEHLKRGAHFGKVVVRVG

SEQ ID NO: 10877 - protein, 91 aa, Myxococcus xanthus
MACPGGTSVFISDVVQSYTPAWTTAGCTARASQLMAEQWAFRLWDEDLASDDTITDVLGMRFTEQHFAAGTVTIGASGGMTSLTVQLQKQP

SEQ ID NO: 10878 - protein, 65 aa, Myxococcus xanthus
MLLELSAVEARDVKQALDTALRALLEEMAHADPHAHRDLLRERYERLDQLNRRLDMSLEGEQVYA

SEQ ID NO: 10879 - protein, 150 aa, Myxococcus xanthus
MPFTPLPVVLDTNVVLDLFVFDDPYTRPLAEALAARTLTAWTDADTLAELGYVLASRNFQPGLGAPHRTAAFERYRAQVHMAPSAESVPTPSLPRCRDRDDQKFLSLAARAGAAWLVSKDKRVLSMADRAGLSFAILTPRQAVARLPPRG

SEQ ID NO: 10880 - protein, 293 aa, Myxococcus xanthus
MAFSPHKGRSLAHKARQRSPGHHYNASFMSAADRAEALSWLATLHPLWEERYSKHFPPPPGQSQRRLLRPVYWLGNWQFACLDYYHPPKGILNRCVQAEPFPAVLQRQVTKIEELARRMYRGPDMPPRWHLNTCLVNFYGSRLEDGRWVDTARVGEHKDFEPGPVASLSFGERALIQFVTSSRPGERDAVVLEQWLDDGSLQLFGGARWKDQTFHRVQRVDTRTGKTLAPELPDFRTRRINLTFRYVPDEHVIPFAALSPEAREDVRPYMAQLARGSAFFRDALAREAPGTPA

SEQ ID NO: 10881 - protein, 375 aa, Myxococcus xanthus
MRPHKSHQNGRDVDVGFYYPTVDPIRTRAREHVIDVRMNWEFIRSVLVKTDVQMILVDRRVRKVIYDHAVRAGEDKAWLDSIFNDGPMGIVRHARGHRDHFHIRFHNPRAQELGRRVQPFLALQPEHNVTTHRIRNGDTLGGIALKYGSSVAMIKKANRMRNNFLRAGNRLSVPLRGPCTHCPVPPPLVLPTRRLPPNVVAPAMVAAAPAAKAENGCVRTEGAVAQGAATVVPAVGAASVEAASTVLASAPVGESAPVVTSAVGNSVDAAAVKPAAGGALDVAAVKPAGGTSVNVASPVKPANAVNVASTVVPVAAEGALATTPAATDTAVAQPASVKAAPAEQTAASSPAPAMQPTVVPTREKGEGAAGITHGR

SEQ ID NO: 10882 - protein, 221 aa, Myxococcus xanthus
MPGDPLRARYISDRFLEGAREVTSVRNMLGFTGTFRGRRVSVMGHGMGVPSISIYATELIKTYGVRVIIRVGSCGALSTDVKVREVIVATGAGTDSNVNRMRLMGHDFAAVADFTLARRAMEAAERRNKPVRAGPVFTSDLFYHPQEQLNATLARMGVLAVEMEVAGLYGVAAESGARALGLLTVSDHIITGESLTPQERQTTFDEMIELALDVAHAEPTP

SEQ ID NO: 10883 - protein, 115 aa, Myxococcus xanthus
MALAAAGSPQLQAFFQQDLTSADYQQKVYSRVAGKWRQPGAKGTPGLGKKTVVRAVIGRDGKLLSADVSTESGSKTWDAAALLAVKKAAPFPPLPANFPGATLDAHFHVAWVAGP

SEQ ID NO: 10884 - protein, 421 aa, Myxococcus xanthus
MDVLDLLVRNTSEVLTVEGSHRERAEDALTPRPGAVVGVREGRIAYVGPEAGLPTGAVGPGTEVVDAQGGFVGPGFVDPHTHLVFAGERSAEFDLRNQGATYLEIAKAGGGIASTVQATRAASEEELVRLALPRTKRLLEQGVTTAEVKSGYGLDLATELKMLRAVRRLGTLTPLELVPTLLCAHAVPEEYRGKREDYVRLCIEEILPAVAREGLARFCDVFVEDSAFTVDEARRILSAGRALGMVPRLHADQLTVCGASELAAELGAATADHLEQVTDAGLKALADANVTAVLVPTSTLFLRMRPYAPGRRIRDAGLNVALGTNVNPGSAMSENTALALGLACLENGLTAAEAYWGATRGAAMSLGLQQHGRLTVGDAGDLVVFSCASYRHLPYHLGVAHARVVVKAGRIAVRQQMEGCA

SEQ ID NO: 10885 - protein, 90 aa, Myxococcus xanthus
MNFLVSDGELMVASRRNRTLFVSTGPSRDDVSTLPAPGTKLEQLVVASESLCGGPYWAPVAEEDVIGVDANLVFHHWRVPELAGPDLFPA

SEQ ID NO: 10886 - protein, 140 aa, Myxococcus xanthus
LGAMVGGTAALHYQWTAPWANLLTAGVDVRHGRHPSGNLRQNDHTLRLGVGHDARVWRNLRLHGAVEVGATLSQQWQPSNGEKALALQPTVGAVGGAWLPVYGAFGMSLLVNAGHTWVREEAGTASALSLGGSLGIGFMR

SEQ ID NO: 10887 - protein, 293 aa, Myxococcus xanthus
MDLNELLVFARVVQAGSFTAAARGLRMPKSTVSRKVSELETRVGAQLLQRTTRKLRLTDVGRTYYEHCARIVAEAEQAELAVTRMQAAPHGLLRVTTPLTFSFIGPLVSTFIKQYPEVQLEMVCTDRNVDLVAEGFDLAIRAGRLADSSLMARRLGIVERVVIAAPSYLKARGTPKAPKDLEKHDCLLFGAGLENNVWTLHSGNRSVDIKVPARIVVNEPDMLYAVARAGSGIALLPNLHFTSELAAGRLQRILPDWSSTGAPVHAVYPSTRHHSPKVMAFVECLREHWPIPG

SEQ ID NO: 10888 - protein, 170 aa, Myxococcus xanthus
MEIITYPLSGAIAHRDSTGGEGLLRAGEIQRMTAGTGVLHSEMNGADENLHFLQIWIIPDRKGLTPGYEQKAFPEAERQGRWRVVASPDARDGSLTVHQDVVLHATLLGTGEQATYTLAPGRHAWLQLARGKATLNGVELKAGDGAAVADESQLVLSATEPVEALLFDLA

SEQ ID NO: 10889 - protein, 294 aa, Myxococcus xanthus
METLIVAPSRDLGDGFEVRRALPSARRRMVGPFIFLDQMGPAGFQPGHGLDVRPHPHIGLATVTYLFDGEVMHRDSLGTVQPIRPGAVNWMTAGNGIVHSERTGPGPRAAGSKLFGMQAWVALPKRHEETAPAFVHHPEDQMPCHEGEGARMRVITGTVHGQRSPVQTLSDMFYADVALEAGARFVVPAEHEERAMYLVQGTVEVDGMAFEPGELLVFRPGGAVTLHATAAARLLVLGGEPMDGPRYIFWNFVSSSKERLEQAKEDWKAGRFAAVPDETEFIPLPEAPLPVRYP

SEQ ID NO: 10890 - protein, 67 aa, Myxococcus xanthus
MAGTDKRKQSLYFPEEMLKEIQEEATRQDRSLSWVVQQAWKIARERIKSFPAVNDVTGDERQDPREE

SEQ ID NO: 10891 - protein, 70 aa, Myxococcus xanthus
MLEEIQREATRQDRSLSWIVQQAWKVARGDIRKMPSVNDVLSPPPRPAAPAPAPAQPVTAVAVAPSEEPK

SEQ ID NO: 10892 - protein, 161 aa, Myxococcus xanthus
MSTEASAARVRTVRLESPEETHRLGVRLGELLEPGDFVGLIGDLGAGKTHLVRGVADGANVPRSEVASPTFAIVYPYSGRIPLYHADLYRLTDYDDLYATGFLDLEGTESAMLVEWLDKIPQAAPRDYLRVTLKHAGGEARVLMAEAFGVRPAALLDAWMG

SEQ ID NO: 10893 - protein, 511 aa, Myxococcus xanthus
MLRVLTAAQMRQAEQAAEARHGMPSALLMENAGRGLAEVARGLIGSGGRFVVVCGPGNNGGDGLVAARFLREGGACVSVVMVGDAAKLTPEARRNVEAVKGFGVTPRTLEAVEPARRGDVVVDALFGTGLSRAPAGAFADAVSAIRGWRAAGAKVVAADVPSGLQSDTGAPFSPCVEADATVAFGFLKPGQVLEPGASLCGRVHRVDIGMGGESSKEVSGPEFFVVEESDARRTLPVRKADSHKGTFGHVLVVAGSRGKTGAAALVAKAALRSGAGLVTVAARADALDTIQAHSAEIMGIPLEASGPLGMGDLDALVAAAEGKDALVIGPGIPRGPETGALIGELLSRVEAPAVLDADALNAVATDLSVLRRAKGPVVMTPHPGEMARLTGKSTKEVQAHRLDVARQFSVGLKVTLVLKGDRTLTSDADGRVYLNTTGNPGMATGGSGDVLSGICGAFLAQSLPVPSAVWTAVYAHGLAGDLAAAKRGQLGLVAGDIVEQGLCEVWLRWER

SEQ ID NO: 10894 - protein, 126 aa, Myxococcus xanthus
MGIRGLGLDICSISRIQRILDGPRAEPFLNRVYTEAERALCGRRSDAASAYAARFAAKEALVKALGAPPGIRWKDMEVRRQGGAPYFALSGVALEVMEARGLEAFLALTHDADVAAATVVLQSKGD

SEQ ID NO: 10895 - protein, 241 aa, Myxococcus xanthus
MGQRLGVNVDHVATLRQARRTTYPDPVTAAALAELAGAQQITIHLREDRRHIQDRDLRILRETVQTLLNLEMAATAEMVKLAYEHKPDVVTLVPERREELTTEGGLEVANQREHIAKIIKNLKDGEIAVSLFIDPDLDQVRAAHKVNADRIELHTGRYCEARNEKERARELARIIDAAKAGTKLGLGVAAGHGLNYDNVHPIARISEIDELNIGHAIVGRAVLVGFERAVREMLEIMRNPG

SEQ ID NO: 10896 - protein, 458 aa, Myxococcus xanthus
MPPKEAQASQKLFGTDGVRGKANVYPMTAEVAMQLGRALAFLIRNGPHRHRVIVGKDTRLSGYMLEQALASGLTSMGVDVELVGPLPTPGISNITTSMRADAGAVISASHNPYEDNGIKFFWRDGFKLPDETEGKIEELVSSGSIDSIRPTATKIGRAFRMEDARGRYIVFLKATFPRELTLEGMTIVVDCANGAAYKTAPAVLEELGAKVIALGVSPDGKNINHKCGALYPENLAKTVVKHGAHLGIALDGDADRLIVVDEKGKVVDGDAIMAICTGELVARKQLKKKMLVSTVMSNIGLERAVARWGVKVARTRVGDRYVVDEMRRNGYNLGGEQSGHLIFLDHTTTGDGTLAALQLLAVMCRAGKPLSELASIFEPVPQTLVNVVVKQKKELGELPTVMKVIKSVEQRLGNTGRVLVRFSGTEPKARVLIEGEDAARNQAYAKEIADALSKALSV

SEQ ID NO: 10897 - protein, 318 aa, Myxococcus xanthus
LELVEGTTLAEWMKERRPWKEVLRVFLEAGKGLAAAHAAGLVHRDFKPANALIGKDGRVFVTDFGIARLLQQEEGASHQEHIEAPVTPTGRLTRTGQLLGTPAYIAPELVRGQRADARSDEFSFCVALHEALFGARPFQGETLQEVVLAAQQGRMSPPKREVKVPTRVRRAVFRGLSAKPEDRFPTMQSLLAALAPPPHRRLVPLLVTTTVAGAMGILAAYGTTAQRRDASCAREAEKLAVAWSPARRERIRTAFLATGMTYAAQAWTQFAAVMDDHTAQWQALRTEACLAATGDTADQARQTAACLDARLWQIAAVT

SEQ ID NO: 10898 - protein, 134 aa, Myxococcus xanthus
MTTHSQTEKPGAFRQVLKTGTHTLHADVAPALGGEDSAPGPHDYFDAALAACKALTATWYAKRHGLALERVETHVERDDSRERQGTYTLKVKLAFHGALSPADKQRLYNAVAQCPIHKLMTTSTVDIVTEPLEA

SEQ ID NO: 10899 - protein, 161 aa, Myxococcus xanthus
MVIAKVRGSFRKYSGAISLDEQDITKSSVAVTIETASIDSGVEQRDTHLRSPDFFDVEKFPSITFKSTKVEKASGNGLKVTGNLTIRDITREVVLDAEQLGGAKDPWGNVKTAFEAKTSVDRRDFGLTWNQALEAGGVLVGEKIEIAIEVQAVKAQAEQAA

SEQ ID NO: 10900 - protein, 558 aa, Myxococcus xanthus
MLNQLRSNGVDVKYEREEQNSLWLTILGQWMPVVFLFLFFIFFMRQLQGGSGKAMTFGKSKAKLLSESHNKVTFADVAGADECKEELEEIVAFLKDPKKFTKLGGRIPKGVLMMGSPGTGKTLLARAVAGEAGVPFFSISGSDFVEMFVGVGASRVRDLFEQGKKNAPCIIFIDEIDAVGRHRGAGLGGGHDEREQTLNQLLVEMDGFESNDGVILIAATNRPDVLDPALQRPGRFDRRIVVPRPDVKGRLGVLKVHTRRVPLAPEVDLEVIARGTPGMTGADLENLVNESALMAARQNKERVDLSDFEAAKDKVFMGPERRSMIMTEKEKKNTAVHEAGHALLAKLLPGCDPLHKVTIIPRGQALGVTWSLPTEDKVNGYKKQMLDQISMAMGGRIAEELMFNEMSSGAANDIERATETARAMVCRWGMSEKMGPLAFGKSDGEVFLGRDFNSSKDYSEDSARQIDAEVRNIVVGCYERGKNLLTENIEALRRVSDALVEYETLDAEDVNILLQGGQLTRERPPPRVNAPPKATEKKDKRKILDALEGLPAMEPKKA

SEQ ID NO: 10901 - protein, 238 aa, Myxococcus xanthus
MGTVLVAERLRLRVEVASLDHGLRPEAAEEARQVSVLAAARGLPCHVQALRLHPGVGIEARAREARYAALEALRLERGLDVVATAHTATDQAETLLMRLARGTALRGAVGIHEARPGLVRPLLSCTREEVVPFLAEQGVAYVTDPMNTDPVHFRTRVRLGVLPALSRAAGFVVNVHLPRLRSGGPAGKVSAGVHAVRGLLSPAVAGWSPASGGRARAGARAAPAGARPAGGRHGGRGG

SEQ ID NO: 10902 - protein, 56 aa, Myxococcus xanthus
  unsure (1)..(56): unsure at all Xaa locations
QNPDRNPVQARKLXGTEANLASAYMKAKHPTPVQALREESRVVFQNCALPARPAGR

SEQ ID NO: 10903 - protein, 828 aa, Myxococcus xanthus
DPLLRKIGADVKLFPARLGEALQKLPRMQGGESAMLGQRLLKTFDKAEDEAKSLKDEFISSEHLLLALTHDKGAVGEVMKSSGVTRERVLSGLKEVRGSGRVTSQDAEATYQALEKYGRDLTEAARSGKLDPVIGRDEEIRRCVQVLSRRTKNNPVLIGEPGVGKTAIAEGLARRIVDGDVPEGLKNKRLVSLDLGAMVAGAKYRGEFEERLKAVLKEIADAAGEVILFIDELHTLVGAGKAEGAMDAGNMLKPALARGELHCIGATTLDEYRKHIEKDAALERRFQPVLVGEPSVHDTISILRGLKERYEVHHGVRIQDNALVAAATLSHRYIADRFLPDKAIDLVDEASSRLRIEIDSMPTELDDVRRKMTQLQIEREGLRKETDPHSQERLGQIEKELANLSEKFNALKVHWDAEKTAIGAIRSLKEKQEKAKNDQAAAERQGDLNRAAELKFGVIPSLDKELKAQNEKLAELQKNQKFLKEEVDAEDIAQVVAKWTGIPVSRLMEGEVQKLVHMEDRLANRVIGQRSAIEAVSNAVRRARSGLQDPNRPIGSFIFLGPTGVGKTETAKALAEFLFDDDSAMVRIDMSEYMEKHSVARLVGAPPGYVGYEEGGQLTEAVRRRPYTVVLFDEIEKAHHDVFNVLLQILDEGRLTDSQGRTVDFKNTVLILTSNIGSQDIQAGMAGKEELDERTRNEVMDALRAHFRPEFLNRVDEIVIFEPLRKKDIYRIVDLQLARLSKLLADKRLTLELTEKARELLAERGYDPTYGARPLKRAVQKNLLDPLALKVLGGEFVPGDHIQADAGPDGLTFAKVLVDTSKDVKRSA

SEQ ID NO: 10904 - protein, 227 aa, Myxococcus xanthus
MKPWETLERAEVPDVGEVTLARRGDEYVFRVRGQTLMSSRQHGSEEALAEAGCEGLAGRSGVRVLVGGLGFGYTTRAVLDRLGPDARVTVAELLPVVVTWNRGLLAPLAGAPLEDPRVTVVELDVGKHMARQSGTYDAILLDVDNGPTALTHPDNHGLYGRVGLAHAVQALRPGGVLGVWSAGPSPAFERRMEQAGFTVQVLHPAAHGTKGTRHTLFMGKRRPQGRR

SEQ ID NO: 10905 - protein, 338 aa, Myxococcus xanthus
MIPFSVLDLSPVTQGSTAADALRNTLDLARHAEDWGFKRFWLAEHHNMTGIASAATSVVIGYVAGGTKRIRVGSGGVMLPNHAPLIIAEQFGTLETLYPGRIDLGLGRAPGTDMLTARALRRDLAASADTFPQDVVELKSYFEPTEPGQLIQAVPGAGLKVPIWLLGSSLFSAQLAAMLGMPFAFASHFAPDALLQALDIYRERFKPSESLERPYAMACVNVFAADTDAEAQRLFTSVQQQFIRLRRGTPGQLPPPVDDIDSVASPLDRASADHALKYSIIGAPDTVQQGLAAFIRLTGVDELMVTGMVYDHAARLRSFELTAQAHQRLAEAEAAQPA

SEQ ID NO: 10906 - protein, 111 aa, Myxococcus xanthus
ADSSLPQSERRADTVMVVEAGGARFAVDVEIQAQADPHFAARLLDYTVRIHHREKLPVLPVAIYLVPEAEGAPPPYGFECSGLRVLTFDFQVVRLWEVDYLQPALRAGTLS

SEQ ID NO: 10907 - protein, 207 aa, Myxococcus xanthus
MGRFGWKANQPTLHQQVAHALVTDMGLTTELYPREQGREAGEAAPPEVSPKELDALLIYARLVAVPKRRDWEAADVLPGKAVFGTIGCAGCHVGTVFETEDVPGFPELSGQHIRPYTDLLLHDMGEGLADDRPDGLATGTEWRTPPLWGVGLVKAVNGHTRFLHDGRARDLEEAVLWHGGEAAPAQERYTRLPLADRQALLAFLNSL

SEQ ID NO: 10908 - protein, 434 aa, Myxococcus xanthus
MVAVGTAGLIASSMDGQRWTDESINSAYDVVTLVPGQSSFLAVANPMAGAPSQHPVLVRPQGAGAAWEVFQPATLSGLTIARLIAGNGRFLAFARPNQPSPLAPQAVEPTSGFFLSEDLGGTWTRVESLRLPADAPLPTPLMTFVDQSFVVSWTAVDPQVVGVLPSFELQVSADGKEWTAHPTGAGGNYASTAFATGDTSVVAVSQRRLLVASRRPWPLPELLTETLPPFRLGTAANVELSTRGSGTLTFELEGTLPSGLTFAPTTGTFTGTPAQSGSTAVTVRVRDARGGVAARTYSVDVVGTLSISSGAIASATQGTAYEARFTVQGGRAPYTWSLDGGTVPGGLTIQQRDGAYVLSGIPTASGTFPLTVRVTDSANQTAARSVSLQIAPTPPPIDDKGDAPSGCGCSGSGAGVQALGLAALALMGRARRKR

SEQ ID NO: 10909 - protein, 284 aa, Myxococcus xanthus
MILVTAATGKLGRLVVAGLLEKVPAKDIAIAVRDPSKASDLAAKGVQVRQADYSKPETLGPALAGADKVLLISSSEVGQRAAQHQAAVDAAKKAGVRLLAYTSILHADTSGLLLAGEHKATEEAIRASSIPFVFLRNGWYTENYTENLAPALAHGALIGSSGQGRSAAATRADYAAAAVAVLTGTGHENKIYELAGDTAFTAAELAAEVSRQVGTTVVYKDLSQADHAGALIGVGVPAPFAELLADSDAGVARGEMNDSSGDLRRLIGRPTTPLADAVAAAVKR

SEQ ID NO: 10910 - protein, 269 aa, Myxococcus xanthus
MKPLLSALLPLLCLASSASAAPQAPVAVQSDLAFLSGPPTLTFAADWSVTLSGQPEAGGALDIAYDTSRLPLCRGTGWTITGFAMSNRGPVQGFPVADATTVGAIAQTQLALAQGGTLELWFQNTDATGCSHWDSNLQYNFHTWVTQNPTISFHPAPAWTYTVHGTLQGGTTLMVDYDLGRIAQCRAQYLNYKAWGTTAHYRINGGPVTMLSLTASWGEWDAEFWRQIPAFIPLPPGPATLELWFSSQDRKGCQQWDSRHGQNYVFAIQ

SEQ ID NO: 10911 - protein, 335 aa, Myxococcus xanthus
MKHVTHIKDLGPEGVEAVLAQAAAWKQKGPEHALFANTLLGMVFFNPSLRTRTSFEAVMLRGGGNAIILDVGSGVWKLEHREGAVMNADRAEHLKEAAPVLSRFVDMLGVRTFSQGGGDEEDELDPVINAFRKWSTVPVVSMESAREHPCQGLADMLTLRETFGNTKKLPVTLTWAPHIKPLPKAVPNSFLLSAAAAGCEIRVAHPPGFDLHPAVRAEAEAYAKATGGSVTYTHDQDEALAGSRAVYAKSWGPTAAAAFSPNDVSALLASYSGWMPTRLTMSRAQKDAAFLHCLPVRRNVEVADEVLDHPSSRVVDEAGNRYHVQRALLHWMRSR

SEQ ID NO: 10912 - protein, 211 aa, Myxococcus xanthus
MVLAGKLHTDLLADLQAAGVPAVGLSGVDAGLIKARKRPPVMVTEAGATEGKLVDYGLVGDIEQVDTRVVEHLRSADYVPVIAPLSGGTDGAVYNTNADTVAAALAVALSAEKLFFLVQVPGLLKNVSDPSSLVTLANLTDLATMESTGAIAGGMKPKAHAIRHALVGGVGSVHLVSGVQPNALLEEVFTNEGSGTMVVRENAQKPAGAVG

SEQ ID NO: 10913 - protein, 353 aa, Myxococcus xanthus
MTAAELLQALVAIPSVSGDEGRIADTVSGWAEGWGARVQRQGHNVWFSVGSGPRRLLINSHLDTVKPCAGWTYEPHAPVWREDRLYGLGSNDAKGCVTGMLLAARTLLTEGAPTGAEVVFAFTAEEETGGQGLGTLLPKLGPLDAAIVGEPTSLKPCTAQRGMLLLRCTAHGKSAHVAHAHATEAVNAIHLAATDIAVLAELRFPSHPLLGEARAQVTQVSGGLARNQVPDRCEFFVDLRTTPGMEHAMVARQVAGALKSEVKVHSERYLPKATSAEQPIVRAAVAASGAQPVGSSTASDWAFLGDIPAVKVGPGDTLRSHLADEFITRAELEAGAGFYTQLVRGYFEEAARG

SEQ ID NO: 10914 - protein, 405 aa, Myxococcus xanthus
MLARVGLLKDAEAKSLVTALKALHDEARAGTFVIRPEQEDGHTALEAALVERVGDPGKRIHLGRSRNDQVQLALRLLLREEVLTLGARAAELAGAFLDFAQAHKDVALPGYTHLRRAMPSTFGLWGMAFAEGLLEELEALRGVWARLDRCPLGAAAGFGVPLPIDREYVAALLGFSRVQRSPIDVQNGRGRHESAVLGWACSVAGTLEKWLWDVQLYSMDEFGFLGLPDAYTTGSSIMPQKKNPDVVELARGRCRELRGLAHQVEAVAGGLPSSYHRDFQLLKSPTLTALGSTRELLDVLTRLVPALQVKADAAARASDDTLYAAHHAYALVAQGQAFRDAYKQVGRELVEGTFRPDRGALTATHLGGAGNLGLPQAREELAASRAWLDETHRLVADAAGRVWTV

SEQ ID NO: 10915 - protein, 43 aa, Myxococcus xanthus
VLLPMERASPRAIQGEGEGVMKSLQVWQNVTEALELLRSMLRR

SEQ ID NO: 10916 - protein, 249 aa, Myxococcus xanthus
SNKKNVVLAFSGGLDTAFCAVYLREQGYDVTTVTVDTGGFPPEQLERIAALSKQLGAVEHVTVDARETLFQGYLRYLIAGNVLRGQVYPLSVSAERACQAAEVVRVAREKGTQALAHGSTGAGNDQVRFDVAFRSLAPELELLTPIRTLSLSRQQELTYLAERGVHMPPKLGSYSVNEGMWGTSVGGAETLDSWKALPEAAFPGGELSQDLKPRPLTVSFEKGVPVALDGEKLGPVKLVEALNALGRTY

SEQ ID NO: 10917 - protein, 442 aa, Myxococcus xanthus
MSQSGSPVADDLPVARPVDASERVVLLDALRGFALWGVFVSNSLMWLSGRAFMPREAASALDAPLLEQVIGSIYQLFVTQKFISIFSFLFGLGFALQFSRAESRGVSAAPLYRRRLLMLFGIGLAHALLLWTGDILHTYAMVGFLLMAFRARSNRTVLFWALGLVTVMPFLVPAAIRYTPILLHGAEAAAEAAKASHARDMALRADTLVALSSESFWTAQVGNARFFLENLGGGFRRVLWMSLILGRFLLGLLAGRLLLLQDVERHRALLRRILGWGLSVGLVLNGGGLLLFRLRKAGVLEWDPKGPWMMIVNGFQEPGYIAMGAAYVAAFALLFQRERWSRWLGVLTPVGRMALTNYLMQSAVSIWIYSGWGLGFIGKLPASRIVVICCVIFAAQVVFSRLWLARFRFGPAEWLWRSLTYGRVQPMRRLAGDGGVPGVSAS

SEQ ID NO: 10918 - protein, 125 aa, Myxococcus xanthus
MAKLAVERGNLYVPSCPSRGVLDHVTSRWGVLVLIALLEGTRRFSELRRRVAGVSEKMLSQTLQALEQDGFVLREVHPVIPPHVDYSLTPLGEEVAARVEALADWIEDSMPRIAAARAVYTPRKG

SEQ ID NO: 10919 - protein, 183 aa, Myxococcus xanthus
MSELTELLDHARKGEQGARDALMAAAYQELRDMVQRAMSDAASTPSLQPAVLVKEAWLRLFSAGAPVEARRHFFSAAAQAMRRVMVDRVRLRRAQVREARLERVSLGDVEADVPAGLSLEVLELDRALSELDTFQPRLARMLELRYFVGLDLLDTAAVLSVSPVTVKRDWAYVREWLLTRLGN

SEQ ID NO: 10920 - protein, 140 aa, Myxococcus xanthus
MNLDEAILRLIAEREIGDQTVLQQLLEAEGQSPSQSTLSRRLKKLGILKVGGRYQRAPATPAVMPERPRVTILEAPPNLLVIRTAPGFAPVLALALDKERELPGLAGTVAGDDTIFVAVTDPALLRDVRAAVERLLSLGA

SEQ ID NO: 10921 - protein, 193 aa, Myxococcus xanthus
MSDGNQKTVRPSHVRRTYILDRPFQLKYILLLAGIGAGSILVFGLLAHRVHVSSTALGLDGGQTLLWLTAVGALGTAVAMGLFGLVFTHRVAGPVHVMSLYVAALAAGRYPRMRPLRRGDELKQFFDRFTEAVTRIREREADEAYALETVLEALRPVATTPEALEALGTLSALHTRKRQAVDTPTGSTFKSVA

SEQ ID NO: 10922 - protein, 304 aa, Myxococcus xanthus
MGTPEFAVSSLAACFELGDVVAVVTQPDKPKGRGNTVTAPPVKELALSRGVPVLQPTKLRTPPFAEELRQYAPDVCVVTAYGRILPKDLLELPTHGCVNVHGSLLPRFRGAAPIQWAIAHGDTETGVSLMVMDEGLDTGPVLAMKRMAIAPDETSASLYPKLAALGGEVLREFLPAYLSGELKPVPQPSEGMVLAPIIEKDQGRLDFTKPAVELERRLRAFTPWPGAFTTLGGKLLKVHRAQARGGSGAPGTVLASGPDGIEVACGEGSLVLLDLQPEGKRVMRAADFLQGHKLAPGSQPFVAG

SEQ ID NO: 10923 - protein, 307 aa, Myxococcus xanthus
MRLLVLHGPNLNLLGVRDGSSGGRLEDLDAALHARAEELGQALTVVQSNHEGDLLDTLGAELEELDGIIINPAGLFGSYCLKEGLEAAGLPAIEVLFKPPARESVVGEACVLQIHGGPGFEPYLQALETFGSGVFTTEKPESKKALGKKKGSSSKGAKVTPITVLERAARKEGSSETARSLSRAAKTAGPTKTLGRKLAPVEDLRAARQAKTLGRGGGKGLTPAADLLTRALVRQKISDRLSGRLSASELAAWARSQYQAVQRGAPAENGHRELLEESLQSLTLSNLPATRLSDEQLVDLLTRLDEG

SEQ ID NO: 10924 - protein, 438 aa, Myxococcus xanthus
MNARALAIQVLARVRATDAYLNVVLDTQLSESPPKDPRDAALVTELTYGATRRQLALDYAITRFADRKLDALEDKVLAALRIGAYQIFHTRVPARAAVAETVQALKEVGLTRAAGFTNAILRKLAALPAPPLPPASDVALHLSVRESHPQWLVERWLRQFGRERAEAMLVADNQAPAVVVRANTAKVTRDALLAQLQEMGVDAKATTVSPVGITLPSVGRVEDVYGYAEGLWQVQDEAAQLVGVYGAIPETARVLDACAAPGGKSCHQAQSHDVVAVDLHAHKLRKIEAEARRLGLQPRLKAYAHDAAEPFPEEWGEFHAFLVDAPCSGLGTLRRHPELRYRRKEEDISRLATLQRRILENCQDAVPPGGLLVYAVCTMEPQEGQDQVEMFLRSHPEWTAEPPVLPGLKLPMSQAYLRTLPGPEGFDGFFAARLRKLY

SEQ ID NO: 10925 - protein, 369 aa, Myxococcus xanthus
MLPGMRILYGVVGEGMGHATRSRVLLEELTKEHEVHIVVSGRAQDYLAKRFQNVHGIWGLTLAYEGNSVKKWQTVLQNLTGAVKGWPQNIRQYFELVDGFRPDVVVSDFESFSYMFARNHRLPVISVDNMQVINRCKHEPALLAGHEDSFETSRAIVKAKLPGAFHYLVTTFFYPELRKRRTTLAPSILRPEILEAKSEPGEHLLVYQTSTTNTALPDILKAAGIPCRVYGLRRDITEDLVDGNLTYRPFSEKGFIDDLRTARGVVASGGFTLMSEAVYLRKPVLSVPLEGQFEQVINALYLEQLGYGMYVKALTVDAVKEFLTRVPRCQQALQGYEQDGNTRMLAALREQLALAYEHRGHWAMERAQD

SEQ ID NO: 10926 - protein, 145 aa, Myxococcus xanthus
ADFLPRFYRLAVRVDAHYDALSRKLRQKLGIAPPLRILPYRGYGTPERAVIKARVLEDRHVRPPQERYTLVGSAVASYKRYMTREVPGAHVAVRWGDKRWEGTTDEEGFLELWVPPPDGVRSGWHMVELELLSPDAEGVSRLEST

SEQ ID NO: 10927 - protein, 221 aa, Myxococcus xanthus
MELLIFGHSGEPVLLLPTSKGRFFQAEDFGLIGAIADRVQSGRYIVVCPDSVDEESWFNTAIHPADRVRRHQQWEEYLLHEVVPLLKSRSTGGRLTLAGCSFGGFHAYNVGLRHPHVFRRLLSMGGKFETNEFLDGHHDADVYFHSCTEWLPNLTDPAQLSALQRVEMVLAVGEHDFCRPSNEHLSNLLWKKDIGNHLAVWQGGTHDWPVWRQMIQQYLPW

SEQ ID NO: 10928 - protein, 96 aa, Myxococcus xanthus
MQPVDPEKKPRVHETPLNHVGLWVDDLPVAVQWLESQGLRFAPGGIRKGAAGFDICFIHPKGSEQFPFGGEGVLIELVQAPKEVIAAFESLSTAGH

SEQ ID NO: 10929 - protein, 373 aa, Myxococcus xanthus
MRIPDFKLERYFARWEFAAPYLLCSSDIEGWRMADLLALAGPDERARWEGLTLGYTESTGLPALREEIAALYPGLSPEQVLTFAGAEEALFVLVNVLLGPGDHAVVTWPGYQSLHEVARATGADVTLLRLREEDGWALDLDALRRALTPRTRLLLVNFPHNPTGALLDRAAFDALCELSRERGIHLLSDEVYRLLEYDTRDTLPPAASHTPHGISLGVMSKAFGLAGLRVGWLACRDVELLRRCAAYKDYTTICNSAPSEVLSLIALRAKARVLARSRELLAANLSLLDGFFARHPDTFQWVRPRAGSVAFPRLLRETPVARFTEELREREGVLLLPGDVYDFPGNHFRLGLGRTNLPDALERLERYVVDTSR

SEQ ID NO: 10930 - protein, 295 aa, Myxococcus xanthus
MKKFFGTVIVAATMLAGTEAAAANYTLWIHGRNGGTTQPGNYNDFSYWGSASVEAGVNKKAVNWDGRQRIGSQNYRIRDALDCFCTGDNWCYVAAHSAGNLQIGYALSMYGGSQREVKNASPSASGVCGNVSSGAKQTGWNIRWVNVASGAGGGSELADIGEWAMNEPLVSDLVTTTARAMYNHNTTRNVWFYMFAGAKGTLYSGVLPGQDDEAVSYHSTGGVSGSAGSSQCNPGDWFCGGTLNLGTAATSDGRAKWSYHTVELRDDREAYNHYAGGNWGGIIAPVRQDVVNYAY

SEQ ID NO: 10931 - protein, 417 aa, Myxococcus xanthus
MRRALWAIPLIPLVLGGVGWWWMEAGAGPESSGEDGAWEASSPSGMPNPAPRKSGGGMGRPTGSVPRVAVQDPARSPEEAERDARRQLWEQRLARAKQMLESYMKATRYPPESRPASEHPDQMEMAEPERTRPLNKDGSDIQLRLKQDRVFVVGDEVVHFFVGCEDARRMPRPCQVVSASAHEAEHMPGAGGMPAVPLHFSDDGAAGDALSGDGTFTGRFQPSKQGFPIYSGTLRVDVQVRSGGEEGTAFFDIMYTPSPPALFTGRVREVLEQGSLQLYLGIQVQKAGRYVVAGRVDDESGMPFAHVSFNEELKRGEQEVKLTIAGNLVLDEVPTFPLKLRDVEGFLLKERGDPDRELMTSLRGYVHTTSDYPPTSFSAAEWQSPERRRYLDELNREVIEAQTYLDGIDQEEAPPRP

SEQ ID NO: 10932 - protein, 245 aa, Myxococcus xanthus
MDSAGQTHIGRRPHNEDAFCVAPELGLFVVADGLGGQEGGEVASRCVVDTFVGFGLRLGQDRDSTWPTVPDPRRSREENLLAACSALAQRNLQAQRVGRLREMASTVVALAVSEHGAAVAHVGDSRLYRLRGGKLESLTRDHSLIEELRDAGMEPPGGSGNLRHLITRALGTENAEPTVQRLQTEPGDVFLLCSDGLYEPLGVEGLMKRLTMSSAREVCDALVADAYEAGGKDNITAVVLRVAEA

SEQ ID NO: 10933 - protein, 506 aa, Myxococcus xanthus
MEALVKEGGARIILVDEVPHQAVAQPVMTAEGRTVGYVVLGRVLGEVELQALRDERGVEGVLTVGGKPVAHALSVVPDDALLAALEGKGRPDEVSVNGVSLRLRRVEMGPGVELLLTRDGGKEAEQFRASMLLVVLLGLIVTAAAGTAIFLLVRRMMEPLRELTVATTRMVSEGDFRGALAVRSKDEIGQLASSFSELMSQLRELLMALRHSAEQLETASTHLTESASVQNEAVSQQAVALHETQVAAQQLQEASRAAARRVEVILREADKASGFGEAGEAAVSGSVGGLTHIRSHVEQIGRTVAELHQRTRQVGDITRTVKDLADQSNVLALNASIEAARAGVHGKGFAVVATEMRRLAQQSVRAAGQVSGILDTAHQSIQHVVELSLVGAERMARDIEVVRASGERLRGLSTVLRTSTEGVQQISVAVARQAAGVARISGAVDELSAMMKQTLGRVEQTTTAAQTLRVVTGRVHGVIDTYQGTRTDEVPPANDAGRVIAFRRDA

SEQ ID NO: 10934 - protein, 423 aa, Myxococcus xanthus
DERFLPMLHGQLGTERKPEVRAALARALGDLKHASSVEPLTKALDPAAGDMPAQLANKAIVATLGAIGDRRAIPALVPLLRAKDNYTRIEAVQVLGDMKAKEAVEPLITLATDDTVEPFLNKKAIEALGDIGDGRAAPALVRMLTKERKGKSFYVESSFALYQLGAPAADALLQALEGQDADLLKWARSNGVNPASYAMKAATVLGDLREKRAVATLLKQLAFTNTDPQIQALVRMQAADALARMRAQEAVKPLAGLVSETDATVRDSYVSALVRLGGRDALPALEKAAGTGDWYARELAVKGIAMLGDARELPLLQKLAAAEPARTAADCKQAEDEGCDDAAALGKQRADQIAGQSKLLEAAQACGGNAGCWVQRMEKAEPRMLERAALEVGRSGAAEHAGALASRLGERDTEARLALVLPV

SEQ ID NO: 10935 - protein, 295 aa, Myxococcus xanthus
MFCDVVETGSFSRAAQLNHVTQSAVSQQIRALENRYEQKLLSRSARQVTPTPAGERLFRGCKEILARFAEVEQEIREQATEVAGTTTVSTIYSVGLHELNSVQKQLLKSHPKVNMRLNYRRNDQVYDDVILGAAEIGIVAYPQPRAGVDILPFRDDKLSVVCAPDHPFATKQKVSLTALSGVPFIAFDREAPTRKALDRLFREKSIDINPVMEMDNVETIKRAVEMGLGVAILPMSTAQGEVKGGSLVAKPFAEGPVSRPIGLLIRKGKYLDRASAAVLEAFKAASNVPPPTENA

SEQ ID NO: 10936 - protein, 102 aa, Myxococcus xanthus
MPSSPEPSSPQRPSLGRSAATGLLGGFLLGGLGLLAVGLSNSFAAPSCDGLTGPECQLLTDATREVGRTQLLAGGALTALAASLFVLFRPRPPAPPEGPEQS

SEQ ID NO: 10937 - protein, 348 aa, Myxococcus xanthus
MPAHRKDSDSSRISLGTVAAAGIGAALGLRRILRSRFQFKDSTVLITGGSRGLGLVLARQLLKEEARVAICGRDEQTLERAREELERTGGEVYAIPCDVRDPVQVEAMVSAIHERWGTVDVLINNAGVIQVGPLESMTLEDFQEAIDTHLWAPLYTTLAVLPEMKRRGKGRIVNIASVGGKVSIPHLVPYSASKFALVGLSDGLRAELRQDGIVVTTVCPGLMRTGSPRNAYFKGNHEAEYAWFATGDSLPLTSLSAEQAARKILDACRRGDAEALLGAPAKLAAVGRTLAPNLTATLTSWANRFMPQDSSQDRYSGSQSETPLTQSWLTELTRRAAERNNEAEVPLH

SEQ ID NO: 10938 - protein, 55 aa, Myxococcus xanthus
MARAYDVADTPAWLVFDADSGRLRHHFSGKNASPHVRQVLERFIQASAAAPSPAP

SEQ ID NO: 10939 - protein, 590 aa, Myxococcus xanthus
VLPAFLGCAQDSQVTREAPTPAESPAAASQPSPAEAKAFAEKVNADLKSLWTKQATAEWIKSTYITDDTEQNAAFVNEEVLAYVNGAIKEARRFEGLTLDADTARMLHLLKVSQALPAPSDAERRSELAATAAKLEGLYGKGKYCGPDGKGKCRDLEVLSDVIAESRNFDELLDAWQGWHSVARPMRPLYERLVSISNEGAKDIGFNDLGTLWRSAYDMSPGEFEVEAQRLWGQVKPLYDDLHCYVRGRLAKQYGADKVPDGKPIPAHLLGNMWAQEWNNIYPLVEPFPGQASLDVDAALKQQKYDAMRMVKLGEKFFTSLGLKELPPSFFERSQFTKPEGRDVVCHASAWDVNFSNDLRIKMCIKPTEEDLVTIHHELGHNYYYTYYYQLPVLYQAGANDGFHEAIGDALTLSITPGYLQQAGLLKAVPKNEKNLINLQMKDALEKIAFLPFGLLVDQWRWEVFSGRVQPADYNKSWWTLREKYQGVAAPVARSEQDFDPGAKYHVPANVPYTRYFLARILQFQFHKALCEASGYKGALHECSIYGNKDAGKRLQAMLELGASKPWPDALQAMTGTRQMDATPLLDYFS

SEQ ID NO: 10940 - protein, 246 aa, Myxococcus xanthus
MGSDLLSPEAAAWELQNRDTSTAPTPMEAEDVLFMLNGPGAAADLEPPLELGLEDIFEEAPRLHAAEDALFMAGADDASAASSDTTEIQQPSLAAARSGAPVNFATEAAGIDAVPADMMTAAAGDARVDDAPAGYALGSAYAATYGQQFAVRQALDPAVSPAGPDEFLADPNDLNMLLPEEPSLDDAAVAGVLGSISANPAAASAPVAAAFASQGVEVVAEALEPELRPEANPSITEAPAPENPRA

SEQ ID NO: 10941 - protein, 199 aa, Myxococcus xanthus
MRSTSIPAALTLLALTPSGLRAEEAAGEARAKAEPPRTTRNFGNLRVGGSTANGNGRPDLCLELSPVAFLSVESCGTGSGFLHSDPEPEVAHFRAKLRLASFDVERWGTFQPFLAGGFAEAQVGRDDPGFQFKGTDRRRVATAGPEAGLGLRFLRPLAAGFELVGDFNFSLAWMPHAPELIQPGNTWLPSASLSFGVGF

SEQ ID NO: 10942 - protein, 220 aa, Myxococcus xanthus
RSLPTVPQRYIFTLTRKHGAQTNTANGMSTNRCPQCNAPLTNSAATDCEYCGTPLATGERDWVLAAARTFEAWNAAEDARFRALPPRQSAPQQRMGGHDHTPQPEDAVMDVQERQRLLYMMAAIAAADGEVTSAERKLLKLCSERWGVVWDNVELALSMGPQLFDRLVEKGSPEAEVFLRNIVEMALVDGRIDRKERRMLVSAAAHLGLQDRLESMLDGH

SEQ ID NO: 10943 - protein, 121 aa, Myxococcus xanthus
TAMAIGQLVPLLNTLAHGTTRWQFAGMASATLRLERLQHKEYMAALNRFPATVKQGLARLEADPRLLSVPMTTLAASYRMPDIGAYVMTLTAAAYATFVTELKKLLDEGVSLDEAFLALRS

SEQ ID NO: 10944 - protein, 1506 aa, Myxococcus xanthus
MITKPIADPLANEHVLRVEPRMAPFGVDAEWRRRAHFFTGRAVSADALALEQEHRAGRLALLGQHLTPGIVAGLEVHLERAGTQTFIHVRPGSGIAVTGEDVIVRRQLRAPLGAIPLFPGHRDPSTFSLEALANEEPPVDPLPFPKAAVLVLVPTTSVLTPPASQTDACEVDPESHAFEDAVRTEGAALVLWGWPEGWYMPQDYSLRWRSRLVYSLFERERRRRGGLLAPWEHAGVPLGLLGFGQGPDGPEALFVDRHAVARAGGLPRARTPLLKSRGSPVLWQARILQFNDHLAELPPERLAQDKAILYFRRLPPVGVLPPDAVDYRAWTRRFFPDRFELEAVPIPLEQLDTVAMASAALEPLDITREERVRILVPVPGAVYEPGLLHDAPLDPAFLAAIEEGLQRLGGWLKRRIVVRARMSTLKDNLYGATGKHYPLVDPEADPDEARYIPAADPMNPTEEDYGTSGETVPSAEAYLQNHFEPSWGLAVDARSDLLPRPQGDPTPRLEFAGQLTSAPVVISTEDRAHVLFRGPFWTLGYRTFDGRAWSKVTPVLQGKVRSRSVPVAAMWPRGRLDVYFRDDQGNLHNTYLDTRVSNQPWSSPRILASDVMGDAAAVSPSEGRTDVFYQALRGQVLSLWWMTVTASRVIRPKPFETPLAFKGEPISAVVSRGQLMAFLLDAQRNIQQVTVSPDPTHGAVVWTNHSLGREVRWLKACASPDDGTVDLVVLTGSSLLHRRFNGLVWSEWKDLGNSHSLTAALSAPGKGVLDVLSRAVNGRIRYARFDGTTWTPWKTLGTEVARSAPAAIRRGDQLDVIVRARENLLWHRPVRSPLHTTQRTLGLRGLMRDLSNRIQQVDEAVDAAFLQVQSEIHRVRQLMLGSTTSAVMTASPVLTDVAQAETRVATLTDVEKFIGVLNAKRKVSWSTVRYLDQTNLRDRLLKVSPVIGTLHSAMAIKREVLGKLFTLLSGMEFNLEAVQVPNVKVPPWRRSRVPPVDGQPPPIPTPEPGIDIPLSELRALTAEDWNQVFTGYVAPKVPTRAEEATYFSMSVAQLEDVLAVLRNLEDRVMQYREALEEGGRLVSVLRAHEARGGERLTVIGTEVSESRQDVMVARALLAEEQTRLQRINERRALVLREHVRFLVYHRPREQVLDRATPVRALDTGIYESELPAALAETRAAPPELWALIQLLRDAPLDWFAQGPSLFQRLDRLDLVHRTLEGARQRATVRVPPALPQITRAPSRSGEGVNRVFTAQSQVVSQARVVTATLELASLVHRGWAELVKIALPITSFGDLMDTAHGRPDVARAAARELENTAKVATYLYFLFGEVPPRVRMEWASMLSEYDAPWDLRDLARLPQWNTLEVTSRRQLQELVDWLFAQMNPSRTQAVALMNDLVRSALLLASHAPVGEIVAGHLPKPAPARVGTVLDLQVDPSRIRVGTHVLLASGVHTVQAVVEDLGTGTARARVFSTSAASVNLAEKTVAKFSEPEQRGGLLPTPRRTLLR

SEQ ID NO: 10945 - protein, 81 aa, Myxococcus xanthus
MLRAALLAVGRVTRRLAHMGLRALVLRPGCLVATRTHLDIVFAASLADIRIRRAGLDINPGWVPWLARVIQYHYQYDETGE

SEQ ID NO: 10946 - protein, 474 aa, Myxococcus xanthus
MDAPLPPSIMDGVRRHARFLAGSPRSMLVLRGTSVSETRTVAAAVAMTLGRAPLFLGAELQRGLGPFLIQRGLLPIHVHDLAPGERKVLPNVPYYDGPVLAITGPEGTLDATDRTVLRWSVPRPPSEERRALWESSLGAPNLAEELARRHRQGAGRIAQLGRLARQKAELDGRPAPELQDVLAAAWEAESEGMGTLAEPLMDAIGDDAIVLVPQVKRELELLLARCRARDDLVHGLGPSATVRYRAGVRALFMGASGTGKTLAAGWLATKLGLPLYRVDLASVTSKYIGETEKNLSQLFARAEHADLVLLFDEADSLFAKRTDVKDSNDRFANAQTNYLLQRIEAFDGVAILTSNSKSRFDSAFTRRLDAIIDFTLPGPAERRALWTTHLGMAHELPAKELNRLAATADLAGGQIRNVVLTAALIAREAGRSIQPPDIIEALVHEYRKQGREPPSELRTTPLGSADGARDTWRR

SEQ ID NO: 10947 - protein, 223 aa, Myxococcus xanthus
MVPSIDGRIVTRNWKLSSRALSEYERTAETFDADGWMIGRISMEPYAGKAKVPVRKSGQPIPRTDFIARRDAESYAIALDPTGKLTWKFGSIDDEHVITILTEQVSDDYLAFLQSKGVSYLFGGKTELNLTRVLEKLRKDFGIKRLLLEGGGKINGSFLAEDLIDELSVLVAPIADGSIGTPSLFDAGEGRGPARHLKLVSCEPRKSDMLWLKYKVRKSESKR

SEQ ID NO: 10948 - protein, 676 aa, Myxococcus xanthus
MDLGQKQLSLAEERRTYEQRLASLQERIAEEEKLEQQAALREKDVERQRKEWQALDQKQRELLALQQKVVQQEDLLARNEPALQEAQGLVRRAEDGAREARERHKAQQGEVELAEQRVERGRLLEDARASLAEQRKLDGLVKQGTRVETAVENARRKTAALKALPDAEVKRAEEVQRKLNQALDRLDAQGVEVSFTAESPQRIEWEAQGHTTPHKLTREEQKVFSGVRAGALRIKGVGEVRVRTAAEEIGKLEAEVEKHRKDLARRLHEHGVDDVVGLRAEWASQQVVLQELSKYEEARSQFLEDNKVESVEVLKEQQREQARKTGALSAQLNLSREELQTHPFPELKALTEELKARRQEVKARDKAREEVEGALRKAEQHLKVVTQGRSSAQAAAQALGLELKTQLNTLGLSLEGLGAEVERAEAELSRLENMVRGLRAQLPRLEARATVERKKLQDTLERIGDEEKKNQEKRIRAQALLEQAAADGLYSRLCEAEEKLALAEAAYQRLETRARAAESLRTMSQAWQDQVNQTFLAPIEQELHSRLAYIRGGGRLEQLLLDAEFSEARLQTAGGPWPLEGFSWGMREQTLFALRLALGELLAKKGPRPEPQLVVLDDALVNTDAARHQRALEVIESAGDTLQILILTAFPERYRTLRGVKEFDLRALAQASSPSS

SEQ ID NO: 10949 - protein, 230 aa, Myxococcus xanthus
MASGLDVIRIGVAHGSLRIEGKHAADDFPIALDAAVRAGLDYLALGHWHGQYVHDGRTAYSGAHETTKFGEVGSGQALLVELSSRGAVPRLEPIATGALTWRTVELDLSQGHEPEVARARELVAQLARPERALLRIHTTGFSSEDASSGLEAFREELQGGGLLHVCIEREDIPRAKAEGRLADIAGSSSLVSSLLDGLNKPAAVGPGATPEPVRTAARQLLSELVMEVWK

SEQ ID NO: 10950 - protein, 168 aa, Myxococcus xanthus
MVAAMNTPQYANSAACGQCVDITGPKGSVRVRIVDRCPECESGHLDLSREAFARIAEMQQGRVNITWTPVSCDVAGNIEYHFKNGSNPWWTAIQVRNHRLPIQKLEWRRGTGGWQDVPRESYNYFVNLSGMGDGPFSVRVTAVDGQQLEDTLDRVLDNRSAEGSGQFR

SEQ ID NO: 10951 - protein, 33 aa, Myxococcus xanthus
MSARFISKLNYGADFRRATSPLIAMLDEVPAST

SEQ ID NO: 10952 - protein, 136 aa, Myxococcus xanthus
MAGQEFPTQREVNGFDKLSSTVHLVVYVEHGPVATVRILLPNPEVASATGGVLGVEMEHRLDLTGLVEPGQVVAEAARFCVHRQWRHSDAVVLLQAAFYAESRRRGVTTGLPGRIWRRTRRWMRASSSRPLPTTAG

SEQ ID NO: 10953 - protein, 345 aa, Myxococcus xanthus
FEREHSDIDVDIVFDAKLDLYDLDDGGTLNQLLGPGAGAAQVVEIDTLIMGELVSKGWVQPVALEAGAAHPAAEEAVSIAGQSYGVPTYLCSYVVYSNSPYLSSATDGDSLVQILTDVAPGMRPLAANYSGSWTLPSSYLDAWADTNPTGVLSQALSLPLDASALASFEDVVKSCELEAGVNPCLDGTYADSSLAEEAFALGQANGFMGYTERLFFVRKASPGMALPEVISVPLGTGSAPAVFVDALVVSAECTGTCAEDAHAFTDFMKDPDVRSLIAFSGDAPQGTTPRYLLQATQAFYQQEPARSDPMYQKYVQFLSGARPYPNQGFPQNRKTLQSALMDALQ

SEQ ID NO: 10954 - protein, 309 aa, Myxococcus xanthus
MEALGRGCVDTGLVFSVGAHLFACVMPILESGDDAQKSRYLPRLCSGEWVGANAISEPEAGSDVFALKTRAVRDGDSYVLDGGKSYVTNGPSADVFLVYAATQPAHGYMGLSAFLVEKDTPGLSVGRAFEKMGLSTSPIAPIYLEGCRVPESARLGAEGQGAAMFKRSMQWERACLFAAYVGVMERVLEQTADFARTRKQFKKALGKNQAISHKLADMKQRLEASRLLLYQACWKMDRGQDAVMEVSLAKLAISEAAIQSGLDAIQIHGGMGYVAETGIERVLRDAIPSAIFSGTSEIQRDIIANQLGL

SEQ ID NO: 10955 - protein, 504 aa, Myxococcus xanthus
MTLDQIVIRAAAKAPESIAIKGPDGTLTYGQLDALANRIARALQELGVKQGDRVGLWTEKSVRAVAAMQGIARLGAAYVPLDPLNPATRTRLILDDCGIDVMVTTTTRASELHNAGVSRLRYLLVDDKGPEICWNRLSGFSSEPLPPHGAGDHDLAYILYTSGSTGTPKGVCISQRNAMAFIEWCHALLGTTPEDRFSNHAPFFFDLSVLDLYAAFMGGASVTLIPEALAFAPEKLVELVLRERFTCWYSVPSALMLMMQEGGLLKHGALPFRAVLFAGEPFPIRHLRPLREHLPQARFFNLYGPTETNVCTFHEVTDISPHRTEPVPIGRASCGNRVWLARPPPGSEEAREEGDGVGELMVEGPTVMLGYWGQPRHGSGPYATGDRCREVPDGTFEYLGRRDNMLKVRGRRIEAGEIEAALLTHPDIREAGVIATGSGLEARLVAFVVSGASKPPSLLKVKKHCAERLPRYMIVDEVRVLPELPRTPNGKLNRRALRELTQAP

SEQ ID NO: 10956 - protein, 941 aa, Myxococcus xanthus
TEIQQAYSVGRQAELEMNAAMHAYNEIDCHALDLARFEDAWNLLIARHEMLRVVALPGFQQRILPDVPRYVLPVEDLRGREQEETEARFQAIRERLSQQVLALDQWPLFELRVCQLDGGRSRLFMSIDGTFIDGYSFQILYRELVHLYKHLGGAPALPQLDLSFRDYALAVQHARGARHARSLEYWRSRLPNLPPAPDLPLDKDPGSLRRPRFGRVFERLGPDIWQPLKQRARARKLTEPELLLAAYAEVMARWSRSPRFTLNVPHFNRLPLHPQVNEIVGTFASFTLIEVDHRPERTFTERALAIRDQLFLALEHREVSGVELLRELFRAQGRIAGAIMPVVMTSFASHSKSKDSHWVDFLAEEFGELIEALTQTPQVWIDLQIVYQRGGVFLNWDVAEELFPSGMIEDMFSSFCALLRRLAEDDAAWDQQGLDTRPVRQVELLARVNDTARPRSGELLHTGFYRHAAARPDALALASSSVRLSYGELARRSSRLGHALRERGAAPNRIVAIVMEKGWEQVVAALGVLSSGAAYLPIDAGLPHERRVFMMRNGGAELAVTQPKFAQESWPEGVQVLVVTPDAFSEYSEAPLAPVQKPEDLAHILYTSGSTGQPNGAMLTHAGMVNGVEWTNRKFGVGPEDRVIALSALHHDFSVYDVFGTLSAGAALVMPDASSRRDPSHWAELMSRHGVSIWSTVPAMMEMLLTYLEGSNARLTCPLRLVMLGGDWLPVTMPARLRAKFGDVKLMSVGGPTETSLWNISHPVVEADERRRSIPYGKPISNTKYYVLDEHLDERPIWVPGELCCAGVGVALGYVGAGAGSKKFTVHPRTGERLYRTGDQARFLPDGTLEFLGRRDGQVKLRGYRIELGEIEATLRQHASVRDAVVIVREDFPGDQRLAAYVIPHADTAADTAGVRAFLQQRLPEHMVPAALVALETLPLT

SEQ ID NO: 10957 - protein, 1414 aa, Myxococcus xanthus
MAELSPLQQALLTIEKLQKKLATASNGEREPIAIIGMACRFPGGATSPAKFRDLLWGAREALTEIPSDRQALQGLYDPDPSRPGKLAMRRAGFVDEVDRFDAEFFHISRREAEGMDPQQRFFLEVSWEALEDAGIPPHQLQGTRTGVFAGVHAKDYAFVTGGGLEKVSAHYSTGVDASYVAGRLSYLLGLEGPSMAVDTACSSSLSAVHLACQSLRTEESTLAIAGGVKLILAPQLSVFLSKAGALSPSGHCRTFDRDADGMVQGEGCGVVVLKRLRDAVRDGDRILATLRGTGMNHDGASGGLTVPNVGAQEALYRRVLQRAGIEPGQVDYLEAHGTGTRLGDPIELDGVSRVYGAARTSERPLWIGSVKPNIGHTEAAAGIAGLIKAVLVLQAGEVPPSINFEHPTPEFAWEGSGLAVPRARTALAEKDGPHRVAVSSFGMSGVNAHALVEAYAEAAHAAVDAGPYVLPLSARSEPALRTLAASWLQYVSEAGPGARLQDACFMAGAGRSHHAHRAVLVARTPEALRAALHAVTEGRDAPGVNRGSGEGEPVFLFGGTEPEASRLMRELLGRDVFRAHAEKVDAVFRQVAGGSVIEQVAGAQAGEGHPVGTLLVLQLALAELWRACGLTPAAVSGFGVGALSAGVVAGALSVEDAVRLALQLTPAQPVRPQPVKYPFFSTVDGAWVEAGATVPGAYWERQRAAVIDPASSVANLCARNASAFIQVSCEASVGAALEATARSRGSKAVILRASRPGDDAWTGVLGVIAGGYSSGGSIRFEGLFTGARKTVVPTYPWQRERYWWDGAVAPAPSSVQPVRDASPRDLFCELTWHARTVGQGPVDAEGRWLIVSTQPAASESLRQSLSTAGGTVRVAIVGSEQASVLREWLSESPAPRGVIYLSGSEHPESLEGLHTSVQREVHAAASLVQTLARHSAPTLPRLFLVTQGSQAADGAAGPTAIAGAPLWGLGRVVAYEHPELACKRIDIEPAAFGALVTELARKVSASADDDEVVLRGEQRLVPSLTQTQTIPEGTGAFRPRQDRTYLITGGLGGIGLRLASWLVERGARHLALCGRKGETDEARQALAPLRAAGARVETFRVDVSRPESVAEMLAAVRRGGAPLGGIFHSAGVLADSSLLQWEPQGFETVMGPKVDGAWNLHALATDTTLEHFVLFSSTASLIGSPGQASYAAANAFLDALAHFRRARGLPAISLNWGSWGEVGMAVADARRGDRLAERGMSPMSVDEALAAMALVLAENRVTRGIARFDVTRWTASHPSIVASSLFRTESVTDAVPDVMEAPRKLREVLLALEGSARRGVLEARLKEMISEVGKIPTTKLSSTDSFDALGFDSIMALELRDMVLGELDVSMPLKSFVDESSIEQVTAELLGKLAVASVLGAASSERDDSKRVLL

SEQ ID NO: 10958 - protein, 736 aa, Myxococcus xanthus
MLCEPIAVIGLGLRLPMSDCPRTLWQMLCDGIDATGDIPAGRWPLSSLFDAAPDRPGTIRNRKAGLIEGVELADPAAFRLTKRELRQMDPQHRLLFECAWHALEDAGLPFDAVRGSRTGVFMGVNFSDFQRMLARDWSSLDGYSVLGTTASFAANRLSYAFDFRGPSTVSSVGCASSTVALHEACRSLTLGEVEMALAGGVELMLSPDSSIMLSQAGVFSERGQCRTLDAQADGYVRGEGAGVVVLKRLSKVEPGDRVYAVIRGSAVNHNGRNEWIMAPSASAQADVIRQACEQGGVAPASIDYIEMHGSSFLKGDAAEAEAIGEALGTQRPVPCRLGAISNNVGYLGAAAGIAQFIKVCLSLHHRTLAPTIHVDAPNPLVSFDALGLSIQTELEPWAAREPGVPLRAGIVSTSLGGANGFVVLEAAPAAVLERTPAPVHFLALSALSQDALRQRALQLRDFLATTPDSVATLEDVCFTAALKRQHHRHRAVVIAGDRAGLVALLDSLATSSGTALLVQEGMPLEQVEAGRVFVADGTVPPEVFPVRAGRCVSLPVYPFQRQRLWPEWLSPDEVCRSPKDARPDAATLLQAAAVAAGDASRVPDVHGEAQMRAFLRGHLADVLEVEPATLDVQGRTFFELGLNSIGATLLKERISRALELPLSTTLFFELPRLESLAKRLLSLLEARRGRLPSDPGEVSTPEQEEQGLMERIAGLSEDEAREQIARTLAELSLEVA

SEQ ID NO: 10959 - protein, 268 aa, Myxococcus xanthus
MELAYRHAVKKASGSVVSRVVVLTDGDANIGRNVSANAMLDSIHKYTAEGVTLTTVGFGMGNYRDDLMEKLADKGNGNCFYVDSLREAKKVFETQLTGTLEVIAKDVKFQVEFNPAAVRRYRLVGYENRDVADHDFRNDKVDAGEIGAGHNVTAVYEVELTGEATEALATVRVRAKAPNGTEASEREFRFERTKLRDTLAQASPDFRFAVAVAATADVLRDSPSAEGWSLATAEKLAEGATEGDADRKEFVRLVTQARALKGASVRGR

SEQ ID NO: 10960 - protein, 611 aa, Myxococcus xanthus
MLGVEGNRWIVSLFGYEGHHPPRDEDGFVEFARSLREPDIYEAIKDAKPVSDVGVYRVPDVRWRHFERIRDFPAGLLVLGDAWCYFDPVFGQGMSVAMLEANLLNEALHQLDSLEAVTQAWTASYLRTGAQWLQGLWFFVTAEAMRHPHVPGERTRLIKLAQWYVEELYALNHEHPEIYQEFLKLMHVQAGPEFLLRPDIALRLAKRAWQQKSEKGLGTEALWPASRVALGARYAGRMLANLVVPQRVGPRDRICHFDTEVLWKPDKTLGWFVRDALRAQGLLSEASEVRRFLEYWLPVQGLGIAKKALIEFSYNADEPGLGFMLYGDNGTVTRAFREYTRQLGITNEGVERSVAICETFRPSDLGLVRAEFKPGGPTRYSIAASWHFDPMRGHSGFDEAMSRLPERFRAGPFAERVKTHASALRTEYYPLFLGLSFLEDGTLESKMYLVRFDANRPPFQPGSELWRFLQEMGVSAPELERVRQLNALLWEHSADKMTQVAIEASEFQSQPKRVNLIYCGIQTSVVLEAISRFGYPVSSKQSVRDFERMMQTDRAKFVAVRVGPEGLSPRLKLYKHALFDFGDLSVVEDGGLGPRDATPAAVKDVSDVCLY

SEQ ID NO: 10961 - protein, 352 aa, Myxococcus xanthus
MNMYSKADYAITPQPSFTADGRVVPDVFTEPLHLRKPLVEALGNFPAYDYWGPRYSIRSSEWIADVAMWLEQRHSPTLSLVFLPHLDYTPHTFGPNAKEIHKSLREIDDVVGKLIGFYESRGVRVIILSEFGAVPVSRAVHLNRLFRRRGWLAIREEGGRDVVYPSGSEAFAVADMQIAHIYVRNPALLDEVKALVEAEPGVAQVLDAEGKRAHHLDHPRSGELVALAEPDAWFTYFYWLDDARAPDYARTVDIYRKPGYDPLEMFVDPKLGLRMLELGGSVVKEKLGVRSRLEVVSMDGSLLKGAHGLPTGPEDGPVLMTRHGELIEAETLHATQVHDLILAHLTGQQAAA

SEQ ID NO: 10962 - protein, 536 aa, Myxococcus xanthus
GTHVGTTQGYLHALGTGSFRTGDDPCTPGRVEYQGYFGRAGNCASGQDYGAGNELFAYLPFKMLPYYVENYRRANDAYSTERATMDATPSVADVDLRSDDYRPDTGHDPRETDEAWRPRPPRNEGAKTVLASATGPKQSIFFALDVTNPTDSSYPTPLWEFDMKRDRFTSAGIPCTSSGNGCNPLPALFTGATPKPDTRGSRHAPSLVRMDFGQAGGKKWVSMFGTDYSPESGTVGTVYLMDLKTGLPAQVTGNSAKARLAGVVTLGTTADANEGIGGEPIPLDVNGDGNVDVIYVPSTSGKIYRINPTYSNTGTNTPLGKVLASCVVADAQAVPGIRNPTSQRIYSTISASVVPDSGSRRVRLYFGTANNPDIANEPDDTANPRPRYHLMAFEDRDPVPATRPGANCPAHLEWTRELGEGQVVWGGVSTTQDGVFTTSAVGRAASACDLDSTTSGRVYAYSTSGNALAGNDTPIDGHGTHAPVLYDNHLLIVKNGQVRALGNGTYNNPTAESPRSSSRVLIWDVQSGSRVQEVVP

SEQ ID NO: 10963 - protein, 178 aa, Myxococcus xanthus
MNRRRFHTHPRGLSILETIATAAVLMLGILGIMLTLGAASRHNRRNNNLSQASLIAEQELERVVNLRCVGEPLNDPCVNIKQLDNTRRDVWWSANGRMTETPPLPGATPQMAYTLTLDVDPPFEGAETGEPALNRAIPLPHASNLALHQVVNVRVTVSWMEEPGAPRRAVALQTRMAP

SEQ ID NO: 10964 - protein, 401 aa, Myxococcus xanthus
MKQLRSTTPRGFTLIELMVAASMSMVVLATAIGVSVHLQRRGLLEERIMETQNKGRAARDLMAFGVQRAGAGIGSVSLTGGRTPAGEADLFYAVWARPQATFPDDATFVPPTNAALLSDALEVWETDPARMVLLEQCPLPATASWFEDTLCVGGLPPAFLDNAVIAVVFPGTKDERGWACVGQVTNLVAEGVEWTPAIPGRPAPADGNCHPDAVTLPESPWLGTREPREGGMYLLPLTSRSYRVNWPGGTPVLEMDADGPMGPAGYTAVSQDIEQLQVRLGVNAPNALPGAPVRFFPDAETGRPSLATCTQATCAAHISWAWDAGVPVPPDRGPGSAGDELMRHMRVVELSITARSQRAELTGNEAPGARDDEGNLRDGYKRRHSVIRLAPRNFAFVGTGG

SEQ ID NO: 10965 - protein, 207 aa, Myxococcus xanthus
MTLLEVMVVVALVGLFATLSVSSFQGMTERQRLSAAQRELVLMMQEARQKARATHQPVRLGTRVMDEQGVQVTRMRWEALACSDAWGTVCPMPACQENACGVGGCECAELGPELVIPPKLDVELLVGLCWLGNPSAGAPVVAPPAPGGRVCEQNAPLPPTERLILLRNRGTLEAPDWKPELVFQADGLTAAIRPLDCDKHASTPGCQ

SEQ ID NO: 10966 - protein, 106 aa, Myxococcus xanthus
MKRLVLSLGGATGAHADAVADVWKAKCTVCHGGDGKAQTKMGQKESIGDMSRPAWQQSRTDADIRKVIADGDPRNSKMKPFKDKLTPAQIDALVGYIRTMKAPTAP

SEQ ID NO: 10967 - protein, 105 aa, Myxococcus xanthus
MKNLTVAVVFCLSMASLFTSLRADALSSVHIEKGLSPAQSLSLRPDDGKGGGDDKGDKGGGEEDEEEYRKRRYAGLSQKAAMELVDPGALTDVIRLQAAVKFGQR

SEQ ID NO: 10968 - protein, 1188 aa, Myxococcus xanthus
MDTPFIQTQDGGAAGDPFAQVVDELRAGQRVRTQGLKGAARGHVLARLHGALRAPLVCVAVDEEAADALAADLSFFLGGQGSLLAPRVLRLPADEVLPYDEVSPDAAAVTERLGALFHLGQGTRFPALVLSVRALHRKVLPLAVMRALAARVAVGQDFDRDSLARRLVRMGYQNSPLVEDVGTFSVRGDLLDVFSPLYDKPVRLEFFGDTIESIRAFDPQSQRTVDALKEVDLVPAREVLLTDETRPRAESAARAVADRINLPTIKLREQLDALREGLPGFGMEGLLPGFFEDGLSTVFDFLRDWSPEAPVIYLDDPLGQDRAADTLWEELERSHGAAEARQELICPPLEHFLSREDVNQRMQSFRVLEGGGLSLAQTERPPVHFSFGGTQDLREAILAHHGEEGALSPLVERLERWRELRVACVVACGTLSQADRLKRLLMDRNVMVKVHTEPLEDAVALYEPSIRAHLFTGEVSHGFVDGPGGLAVLADEEIFGARARRRPKRSKKLDAFGSGFGDLKEGDLIVHTDFGIGRYAGLTKMEVNGVPGDFLVLEYAGRDKIYLPVGRMRLIQKFSGGDPTQVQLDKLGTTSWEKTKKRVKEQLLKMAAELLQIAAARKAHPGHAFSAPDRYFAQFEADFEFEETPDQAKAIEDVLADMQKPEPMDRLVCGDVGYGKTEVAMRAAFKAALDRKQVAVLVPTTVLAQQHFFSFKKRFADYPVTVEVISGLKKAPEVREILKRAKKGKVDIFIGTHKLLGGEVTFKELGLMIVDEEQRFGVKQKESLKKWRSQIDVLTLTATPIPRTLHMSMSGVRDMSIIATPPQDRRAIRTFVMKYEDTVVKEAIEREVARGGQVFFVHNRVESLPSIETQLRALVPQVSIGVAHGQMGEGQLEKVMLAFTEKKYQVLLCTSIIESGIDISSANTMIVNRADQFGLAQLYQLRGRVGRSKERAYAYLLVPSRRAVTKDAQRRLEVLQNFTELGAGFSIASHDLEIRGAGNLLGDKQSGAIAEIGFDMYAQLLEEAVAEMQGQPPKVQIEPDVTLPMPALIPDDYVSDVHQRLVFYKRFSQASHPDEVTDLRAELVDRYGEAPDEVDHLSELTLLKIDMRDLRLRGLEVGTTRLVVTLGADALLDGPKVAGLVQRSKGVYRLTPDMKLIARAPQGASGQDLISEAKKVLRDLSHCALPQA

SEQ ID NO: 10969 - protein, 299 aa, Myxococcus xanthus
MVRSAASGVLRERVHRNLRRAGEVLAVATLVNWAWFPLLREPQWLFRMDILQCVGLCLLIVLPVAALLSARPKVLSVGAFMLAMATFAVSPLGEQVDGPWATLTEKSSFAPFPLLPWLGYAWLGVFAGTVAGAWGRAGLIKALLVLMGLGFTGAVLGDFLYDLYPPHRFFVANPSNAAARFGWVSTVLLVLTWLEARVPVNAAPSRLRRFVEVFGTSSLSAYFFHEMLLFYRLGGVFSFQRFWGDRSGWLQYWVLTAVIIGLTFVLCVALDRLERVLRPALRNLSGRLFRQGQHAPAGR

SEQ ID NO: 10970 - protein, 380 aa, Myxococcus xanthus
MSDTLPALRATLTELVAMDTTSFRPNVPLIDYAQARLEAAGFSAERQKFLDDAGVEKVNLVAVKGGSGSGRAALALVGHSDCVPYDAAWTDALRLTEKDGRLYARGACDTKGFIACALHAALNAEQLKAPLMVVLTADEEVGLTGAKKLVEAGLGRARHAIVGEPTRLIPVRANKGYCLTEVEVRGKEGHSAYPDSGASAIFRAGRFLQRLEHLALTVLREDLDEGFQPPFTTVNVGVIQGGKAKNVIPGACRFVVEWRPIPGQPPERVSQLLETIRQELVRDEPAFEAQIRVVRTDRGVNTRAYAEVVRFLAEASGNAPETVSFGTEAPQITELGPEAVVFGPGDIRVAHQTGEYVPVEDLVRCEAVLARAVAHFCGGR

SEQ ID NO: 10971 - protein, 421 aa, Myxococcus xanthus
MVLGKRETPTKSKLWIIRITKSASTALSPPGREIDWGSSRVVGGRLGHGDRVKDVNAGSGAVSSDPILSAEDWEARIAAPRGENSFYAGSGQGSRDLVMEWRVFRSIAPKLMKEENAPKPVQVATTPSANAGAEAMAFECGLPILGLGKQVKPGGTLLLGEMHGTQEVPRFVAQASCQVAVAGMPVTVGLELPLESQTRVGAFLESAGAEDDWLKLMEAPFWRSPYPDGRSSEAVANMLEQLRQLRSRGLDVDVFVFDHPTMQGQARETAMAATVRHHVESGPGRFHIVLSGNIHSRTKKGLPWDKSFRPMGLVLKDELDSVVALDMAYNSGSAWICAVDRNGVKDRLDCGVRDAKGRDNGDRFFVHTWGGTNDDGYHGVFYVGAVNAAAPAVHKGLGRPGAGDNSLSPLEEAAPQVASVR

SEQ ID NO: 10972 - protein, 225 aa, Myxococcus xanthus
MHVAEQPKEIEACLAEHGRRPVELLADLGLLGPGFTAVHGVHLTDEEVSLLGRAEATVCACPSTERNLGDGIVPADALVTAGARISLGSDSQATVDLLDEARQLEGHLRLSRLRRAVLDPGGGAMDGLAARLLDMATVDGARSLGLATGALEAGAPADFFTVDLHHPSLVGALPASLLPAIVLGAEKAAVRDVVVGGREVVREGRHALAEESGRAFQVLSRALYA

SEQ ID NO: 10973 - protein, 481 aa, Myxococcus xanthus
MTGCAHQAGTYSDLFIPDGEAIYERPVEEMWPEVRQYFTEANLPFREDRGSMVLETEWRQEFGGSKVSGFFHRYMVMGKRESPTQSKLWIIRITKSRNKALAPAGRELDWGVARVIGDQGGGGSAAPGLSVEDWEDRLDAPVGENSFFAESGQGSRDLVMEWRVFRTISPKLMKEENAPKPVKVAMAPDAEGSAAAMDFECGLPILGLGKQVKPGGVLLLGEMHGTQEVPRFIAQASCQTAVAGTPVTVGLELPLESQTRVDTFLDSAGTEDDWLKLMEAPFWRSPYPDGRSSEAVANMLEQLRQLRSRGMDVDVFVFDHPKAQGQAREDAMAATVRHQVESGPGRFHVILSGNIHSRTKKGLPWDKSFKPMGLVLKDELDSVVALDMAYNSGSAWICAVDSKGVKDQLACGIREAKGRDNGDRFFLHTWGGTNGDGYHGVFYVGAVNASAPAVHKGLGRPGGGDNSGVPTEDRTPTLALH

SEQ ID NO: 10974 - protein, 161 aa, Myxococcus xanthus
MADKSEVARLRSLAQLDADAVGAYDAALARIPEQLVRERLNGFRIDHVRHVQDLNALIHEAGGTPLELRLDLKGTAMVGLTAMSSMMGTEAALVAMLGNEEFSNRAYDVALRFDWRPEVRELIEKHREDERRHVMWIRDAVRTRPWERARAIAEEGSEAPA

SEQ ID NO: 10975 - protein, 61 aa, Myxococcus xanthus
MTASVGFTLYSWKVGNWVFVVTNALMLLSAVLGAVIVLKHRRVARRKHATQPRAPSDAVHA

SEQ ID NO: 10976 - protein, 92 aa, Myxococcus xanthus
MADAQRFYLAADITDSHLSPESRRYLVDHAQAGWFLGVVYIGAAMEQKATTKSLMVGAMLSGGMRLDTAYVDSAEEARAWIARHREAAARTG

SEQ ID NO: 10977 - protein, 285 aa, Myxococcus xanthus
MEVFLGRAPEDASLAKLSMMCEPIYTMPSMDIQTFAPVSLGDLNGDGCDELAWRYAEGSRSGVAILLGFDAGGARCGGRSTATLWRIAGDSEVQLTNMGLGLSMTRAGRFLGDTRDFVAISATSVPFNGVTQPVVLLFDKTVLVNRMQALQSAGSPLVVGALGDGLNPIVLVHRHRAVNFGARLVGGTDLTGDNIPDLLVSAPGASEASDGGGAVFLYAGGVGQQGALSPFFMVVGDGSERSALGQAMSMMPGSGSSPPMLVIGAPRSYRTGTQNGTAFVLPLGF

SEQ ID NO: 10978 - protein, 426 aa, Myxococcus xanthus
MAISVFLARAQGARFRASPDVYVLPANTADSNEGTWRLGVIPAEGTRPPLLLAVADRADSPDLRSSGGLQSGSDSGGALLFDLTGYSATGEPANRPPQVTREAAFARIYGEASGINAGRSWAVMDVDGEPGLELLLGAPYASAPSGVGSGTLRWSGKILVYPLATLTQGSILNRPLTVINGTAVSDTLGSGLATWGPAANPSLVAFAGRSSSAQGAFTGSVELYHRQGASVTEWTRTSVRVPAKPSVERFGEAVAIAQGPQGRPLVLTGTPGWSSPSTSYDRNSLTIGRAYVHDVSAPAQATVVEEGLPSSKHAVRNLSVDVAILEFTATGVQTWWWARPTSTCRARAPRAPTTSSTTRTRRCPPRVSPVAPSRWAVPWCHWDSRTAASSRRTGCSRRTSSRTARWSRRPSAGVPASGAAWWAGLI

SEQ ID NO: 10979 - protein, 365 aa, Myxococcus xanthus
MQNGGYTTDENVGFYASKTAASCLVPVYRFSNTTLRKHRFAITEAQRDALASTGWVNQGIKFYAAPESAPPVDTKFTFAVIPDTQNEVLTTPPTRLTHRLQWLVDNRSSLDLRFVLHTGDVVNWDTPDHIQYVRASEATEILDAAGLPYVYAIGNHDTAAVCPGGSACPGNVNANLRDTTTFNAHFPLTRFTALGGVYEPGKIDNSYHTFSAGDLDWLVLNLELWARTGAVDWAKTVLAQHPRHNVIINTHSHLNGSGAIEQSNGGYGNNSPQYVFDQLIKQYANVRFVFSGHTGNAAYRTSTGVHGNTIHQILTSYHENTSNLTRLVEVDTAANTFSTRVYSPMTNAEKQDGSKFAISNVSWVR

SEQ ID NO: 10980 - protein, 391 aa, Myxococcus xanthus
MAESGWLIAPPWRDALGQGVIATAQSADGAVWLAHTRGLFRLQEGTLAELKVDGASVKAITSLAAAPSPENLPGVWFLHEGGLSVAVALSTAHYRVHTTSAPLAEGESLQALAGIGPAVGTSGELWALTNQALLRRGKDGWRRVELPQQPQKLIGSGRFLWAKTGGSLLQYDADANVWRAATDAGAGDFHFLAADESGSVWVQQGGVSVALSHVLVPRLRGLYQGMQLVNDGLVVRAVMPPGGAPESVVYKLGNSEIPTEGPDYSLGGLEADGTHRAYSFASLEAGRYVLSVVARYADGSEAQRSVPFDYAPLASGPLSWDKDIRPIHEARCRNCHNSSSAARSLDSYELWRANAPIITGAVRDQRMPADGPMDPELISRIQRWASSGARP

SEQ ID NO: 10981 - protein, 346 aa, Myxococcus xanthus
HYDLMAVVRGINMNTLGHEVGYRYFLTGKMPIGSAARGSSTATEIVGQMKPRVPIASISYNVESYNDRYGGYANALRVSRRDDLILTLKGSADALDSELEKQLLDFRGQPVNCEQAAYGARGVGTTYSNSQEQMRLIQSKGLDKSFDFLVGANQPHSAEMAVIRTKYNLTSANDVNGERGRAATVATALKKGIAQCVTINLTGGLDTHFGSQLTQANNQRRGFDALAMLVKDLRESDHPAGGTFMDHTTIMVFSEFSRTPLINSSGGRDHHLSNSALLMGAGIKHNFVFGRSGDIGMAPGTFDLRNGASDPNGENILPEHVIATVLASAGLDYSITRVEPLRPILA

SEQ ID NO: 10982 - protein, 386 aa, Myxococcus xanthus
MGLLADAVKSGEPVDFEGQRWDVLSHLRERLVAPTPFATPAHEDFFDRFTRSGLRTQVLLAAGQSGLLAALAEDVRTEQALGESTSTRAPGVLLEALAVLGMTRRQEDGWALTPEAKTLLEGKALAYLVRSLSVSARYWEALGRLDETVRHERYVLDLKDPEVSGRFYADNSQQITAVFATHFQLSRRAAATLAGVRPLEGAAVLDIGTGSGVWGAAFARTSSSTHVTYFDQAIVLEQVRRNVAKLEVADRARFWPGNLFTQDFGAADFDVIILPQVLNVLSPKDVPDIFARVARALRPDGILVIAEYVLNERRDGPLDHLYFGFRRFMTNEGDLLSASEYAKLLADVGLTTSVCIPLPTQELVFAARDGVALPTALAPPPRPPSV

SEQ ID NO: 10983 - protein, 215 aa, Myxococcus xanthus
MLVRGKRHNRNLGHLLAVLDLTALDPYRRDHFSHHLHLGDAEKDLDFQPRRRFGFADPDQPFVKSHLLRPLLLIHLPAFIRPVLFHREDPVWVTLLRWSFIGGLLAVAHFVVGWDVFLRAYVIPYFVAYQVIRYWSDAVDHAGIISSADEFHRSRNHVFAWGWLNRLVFPRNDEYHLTHHLFPAVPTPFQGRVHQLLLRDADYAAREHAFASLTR

SEQ ID NO: 10984 - protein, 209 aa, Myxococcus xanthus
MLVGNHSGGVAVDGAMVLTSTMLEMDPPRLAQGMVERFLHNFPVSSLWASRTGQFIGLPEHAKRLLEDDRLLMIFPEGARGTAKLYNERYSLVDFGTGFVRLALQTRSPIIPFAFLGGGSAVPTVFNAYTLGKLLGVPYVPLTPYLLPLPLPVQLEIHYGEPLVFHGTGDEEDHVIEGYVEKVKQRIAGLIERGRAQRHSRRIGRNLLP

SEQ ID NO: 10985 - protein, 315 aa, Myxococcus xanthus
MRVLIPGISGGIARQLALHLHARGHQVAGIDTRPWAEAKEAGIQVYRGDVRKRAAEDVFRRWRPEAVVHMATVTAFTVPGKERGRINLDGTKAVFDHCAAHGVKQMLFVGRHTFYGAAPDSPLYHSEDEPPRALEAIPELADLVAADLYAATALWRLPKMTTAVLRLPYTLGAPGTGTLSSFLKGRRVPLVLGYDPLFHVLQEEDVVTALTLALEKQVRGLFNVAGPPPIPLSVIVRETGRRAVPLPAPLLSMLLGRAGLPRLSMGALDHLRFPIVVDNRRFLDATGFEYRHSVADSLRIFRESSPILPAGGQGR

SEQ ID NO: 10986 - protein, 525 aa, Myxococcus xanthus
MSADIEEVDVVIAGGGPVGVLTANLLGLQGVRVLVLEREAAPHGQPRAFSCDDEALRIYQAAGLLDVLKPDLRQGRHVTFTGVGGQPIAQVQLGQVDFGYGHAPIWFFHQPLLEKALREGLSRFPAAELRTGTEVESLEQDGAGVTVRYLTSGVRHGVRARYLVACDGGRSTVRALLGIPMEGRGGQEPWIAISGTVAEEDAPAECHVVCDPVRPGFVGRGPVGRFRWEFRLRLGETGEEMTQPGTIRRLIGPYVNPDRVTVERAQLYSFHSVVAQRWRVGRTFLAGDAAHLLPPFLGQGLVSGLRDAANLAWKLAWVLQGRAPEALLDTYAVERRPHVRALLEATARLGSVFTARSTPMAWVRDTVLRGLQAVPAARRFVEGFRFKPAPAIEEGWMLGGRRSGRKAAEGSYLPQPRVRRASGEEHLLDDSLGSGFAVLSRGGSPGTEVARELAESLGARAVTVRSAGVPGLGDNSVEDHTGRLSEWFREHGADVAVVRPDRFVFGAVPLARMPELRAALGVEEA

SEQ ID NO: 10987 - protein, 330 aa, Myxococcus xanthus
MGDAEVFVVRSQPQNQARTLQFQGKTAHQRRVLLEGLTPPQGQSATWELCRALLESPAPPPSGVLPDAVSQAIARAPLPALQTLMALVPAGSTPALRVRAGPSDFRALRTAAALCTAAPALTTGCVLTAEGLAEHLRREESHILAMLREGRLDLAEPELDEDTREFPEAAVASTRARLRQEGSSEQVVALYDSAVRTIASAYRDANGRARSEAEKFLHARLQDHASTRGLFVLNGHVDPVGGGRRLEVDLLCTELKLAVEIDGYFHFRSPDGFRRDRRKDVALQCSGYWVVRFLADDVVTRLEEILETLDTLIATRRGELSGKEASNGKR

SEQ ID NO: 10988 - protein, 317 aa, Myxococcus xanthus
MTRSERRGTRKELEDALRPFVEHQLSRAEWKLRFEALMEALLGGGTVAVRGRSGLELTPKGRTEVLRFLQLDQPPRGLTWKRLKATHLVARSLDLRPSKAVLARMKGADGVRAAALQRQHGLDTEEGLTLAQTRDRLLWRQLGVETDRPFTLGAVQAHLLGKMLDAKTMDPRKGVEQLAARAAGAPRVDAEAVRLSLMRRWAVAQDADASEDAPADRASTSPDAPPSPAAFAERVLSVARALPTGRFGENKVFISHVWKALQPEWSTREAFDAALLEANRTRLLSLTRADLVSAMDPNDVADSEVRSFGASFHFVVV

SEQ ID NO: 10989 - protein, 897 aa, Myxococcus xanthus
LAMERPGDFVRGFWACTLGGVVPVPLALPASLERSQPGVARLISVSERLGTPWLLTEARATAPLSEAGLRALSLQSLSGAEPGPLAAVDPEAPAILSFTSGSTGRPKGVVLKHANLMAMGEGMVAGGWYLPGDVGVSWMPLDHVAGTSYPHLLALRTRTPHVLVARDYVLADVLRWLDLLSEFGGTMSWAPNFAYGLVADRLEREERRAWRLEQVRVLASGGESVLPATLRRFSEPLRDSGLREDAVCPAWGMAETSSFFSMTRGVRTHPVEAATELGPPPVGAALRVVDDTDAVVPEGQVGHLQARGEQVLSGYLDDAELNARSFTADGWFRTGDMAVIQDGQMSIAGRQKEVLILHGNNVYPQDIEEVVESVPGVLPSYTVACPTRSGAAQTDELAVCFVPTPDAPPLAELLRSIREKVGRVLGFHVAHLLPLAREQVPRTELGKRGRTELRRRFEAGELGAEYHRSLSVLGGPATMPPCLAVSRWVPRPLATRVGTRGAVVVIADEAFAGALREQADGYQVVRVAPEANGELVRAIEALAERSVPCGDVVVLLPEAQEVPAVRESVLRGEMTAADGRFQDAAARAPGGGVSGGVSAPDQGTTSDGAMQAAPVAHLAVPVQGTASDAVPQAAVASRMAPLLHALQSLARRGEGAPVVRVLAVLPESGGDDAASLAALLTPGLLWTAAAEVPGLEARVAWTPPDASATAHAVARELASQDAAREVAWREGTRWERVFTPWTPPPLAAPQRLKRGGLYLVTGALGGLGREWARQLRQGLDARLLLVGRRPHGPEARALESELGTAKYVSVDVTNEVALRNAVRDAEAHFGQSLDGAFHFAGTLTPVALEHETPETLVQGAAAHALGARAIATVLKDRPQAVCVFAGSVMGTPGRGPP

SEQ ID NO: 10990 - protein, 304 aa, Myxococcus xanthus
MKDSLKGRVALVAGGTRGAGRGIAVQLGAAGATVYVTGRTTRAQRSEQNRPETIEETAEQVTAAGGLGVAVQTDHLVPEQVQALVERIDGEQGRLDVLVNDIWGGESIFEWNKSVWEHSLDKGLRLLRLGVDTHLITSHFALPLLIRRPGGLVVEVTDGTADYNATNYRISTFYDLAKASVLRLAWSQARELRPHGATAVALTPGWMRSEGMLEHFGVTEANWRDATVKEPHFVISETPAYVGRAVAALASDADKARWNGQSLSSGQLARVYGFADLDGSQPDAWRYVVEVQDAGKPADATGYR

SEQ ID NO: 10991 - protein, 431 aa, Myxococcus xanthus
MEPLRTFFMEDYLEGSRFTARFNLGESGGRPVTVGELLLGSGVSAERAAEVFLSTPLNDSPNWGRADLRDAVAAMHPGATRDNVLITTGTSEALLLLFRQLRPRKVALAWPAFQLLYELPQRQGAEVVRLPVKWDANGVPSVDADLWLERLEREQPDTVIINNPHNPSGLVLTAELLSAVERWAERTGATVVGDEHYRFLSSETSVLGASVYRPGSRHFVTGSFIKCLGCPGLRIGWTVGDTAMLSRMQNEKNYTTHTVNPVTEWVAREVLRDLDSPALRRARGGLAAQSRHALCFPGALARCLWRRAPGRARHLHRPAGGSGRRQRGDAAQGPVGCGRVRPAAERHGGGLAGRSTSAGARARFPVGTGHRAGAFLRGAGRHRARHRALSARATASGTRRHARARHSPRRAAAVGARAPGRAWAPRGRGGA

SEQ ID NO: 10992 - protein, 245 aa, Myxococcus xanthus
MAYWEALGHLDEAVREQRFRLDLRDPETARRIYQENASRISSIFASHLRLSRQAATLVRSMRPLAQARVLDVGTGSGVWGAAFGLADPTTHVTYLDSPHVLDAVRPHLAKLKLEARSELWAGDCLSVDYGESRYDVILLPQIIPALPPSELPSFFARLARALRPGGLLLISGYLLTDRRDGPLDALYFALRRYVTNEGDVLSLPEFRALLGPVGLTDARGFDMPIQQVVIAHRGDVAWPDVAPSA

SEQ ID NO: 10993 - protein, 332 aa, Myxococcus xanthus
MRLRMLMRQPEVLFWTFIFPVVTSLFLGLAFRNDSLGPVRVAVAEGAGAPALMAKLEGVPELSAEVVDEASARRRLARGQLSLVLLPGAVPEALVDPSQAEGRTARLLVEQALAAPEDAARPAVVKATPVSEPGNRYVDFLIPGLLGLSLMSSSLWVVAGSLVAMRGGKLLKRLAATPMRRSQFFLSYMLARAGFALAEILFFCAFARWLFGVPMFGSYFTLTLVGLAGALCFAALGVLVASRARTEEAVGGLVNLVSLPMMFVSGVFFAAGNFPSWLQPVIRALPLTAINDSLRAVMLEGAGLASLGAPMLVLAAWTVVPLLLALRWFRWT

SEQ ID NO: 10994 - protein, 316 aa, Myxococcus xanthus
MTHQDELAIEVKGLVKRFGDVTAVDGIDLDIRRGECVGLLGPNGAGKTTTVEILEGLQTATSGEVRLLGLRWETDAPVLRERIGMTLQETRLVDQLTVEEMVRLFTSFYPRPLEVEALIGLVQLGEKRHARVGKLSGGQKQRLALALGLAGDPDVLFLDEPTTGLDPQSRRALWDVVAQLKARGRTVVLTTHYMDEAEVLCDRLVIIDRGRVIARGTPRDIITSLGAEQVIELEAEPSPDLERLRPLPSVVAAQRHAGRITLRVRELHLALPEVLREVAAGGGQLLHLSTRRPTLDDVFIDMTGRSLRESAEEKAA

SEQ ID NO: 10995 - protein, 57 aa, Myxococcus xanthus
QHTLEALLLGAGLPQDSALKSLAVARTLGLVSMEPATDEDAGDLPPELDVRRLEAKF

SEQ ID NO: 10996 - protein, 177 aa, Myxococcus xanthus
MVREILIWPDPVLKQKAKPVAKVDDSTRTLVKDMFETMYSAEGVGLAAPQIGVLQRVIVLDTTHSQPELKPVAMINPEIIAMEGDTTYNEGCLSIPGEAADVDRAAVVTVKFLDPDGQEQTLRCDGLLSIAVQHETDHLNGTVFVDHISSLKREFIRKRMKRLKTSREREASAPASP

SEQ ID NO: 10997 - protein, 341 aa, Myxococcus xanthus
MKRIDFRSDTVTQPTAAMRRAIAEAEVGDDVYGEDPTVLRLEARVAERLGLEAAVFVPSGTQANQLAIGAHCRAGDEVLTEAGSHILHYEGGAVPALWGVQPQPLPGQRGLLSPEDVSAAVREDNIHNPRTRLLSLENTHNRGGGSVWPVERFRAVVEAARKAGLAVHLDGARLFNAGVALGVPVSAWAALTDTTSVCFSKGLGAPVGSALAGRADVIREARRLRKRLGGGMRQAGILAAAALHALEHHVERLADDHANARRLAAGLAELPGVEVDASRVETNMVFAEFSRSALEMVARLEQHGVLTNPAGAPRTLRLVTHLDVSAADIDEALQRIRRAVG

SEQ ID NO: 10998 - protein, 237 aa, Myxococcus xanthus
MPAAQVENWEQVTFALDGFLSRPAAPRVGSGDLLQAQSVLEAELERDGFTYGDMPAPLAEAVVLRVGRLALRTAELRRLEQPPEPAEDALPRFSWPVDPVSVTSLFGYRWHPVTGVHRRHLGVDLAATQGQPIYTADKGVVLRAGHNGDHGLQVEVQHEGRWVTRYSHLSRVLVDPGEVLERGNAVGLAGETGLATGVHLHFELWRDGQPMDPLEALGDAEPPPEPMPSVARGPVSR

SEQ ID NO: 10999 - protein, 238 aa, Myxococcus xanthus
MDGTLILDEVSVTGHEYGVSSMQARRLDVHRFTSVRAIRAGMGLLMSCVRLRDIVVRDSGAYGGLQFSGGDLDVQGVRVDGAAEYGVMALRGKLRLRDVDIRRVRTADGVTGDGLHLRQVEADVEGVVVRDAQGACVLAAQNARVSLRGAKLETCGYVGLLTDTLARMNAVNVDIQGAATALGALGNGELRVESLSASGLETGFVHAECEGATQVHLKEFRSEDTRGLSARCVHASPK

SEQ ID NO: 11000 - protein, 328 aa, Myxococcus xanthus
MTLKDRHVVVAPHPSVDGLAAGALMLRALQAMGARVKAQVPAKGEHALSPTFQQRLRAAQPDAWVVLEMSSDAMDDSVAPPGLPTLIVAPQAAPAGKAGTTVLSARGLEPAVSCSLLTYALVSPCVVPGPLEWLAVLGTVADQGVDAPIPFLKDALRRAGRTAVTESVALLNAARKSSRYAAPLALGVLLRAGSATDITRGNVPGVDTLHDCRLEVQREVLRCSKTPPRIASPVALLLFSSEAQVHPQVAVRWAQRLPEHIIIAANAGYLPGRVDFAVRSRTPMELGGLPFNATGGSLSREDFLRFAAGLGFKGLRDIDVERRGAFPG

SEQ ID NO: 11001 - protein, 287 aa, Myxococcus xanthus
MKLRKLMFVLPNLFTVTSIFCGFYAITLCTGDAEPVQLYQAALAIFFAMFFDGFDGRVARLTKTQSDFGVQLDSLADVISFGAAPSLLVYKWALEPLGFMGLFIAFSFAACGALRLARFNVLAARNPHGGGGSFFVGLPIPVAAGMLVSVIISHHAATQGQPLAESAVVPMAVAVAGLALLMVSTVRYRTFKDTRPNRKSALAFMLVVVGGTVIATQLHPAWVLVACCGAYLALGLVESAVLVRSRLVARKGAAPCAVAAVAVATVIDDEEEEDAESNQGNDGPAYL

SEQ ID NO: 11002 - protein, 407 aa, Myxococcus xanthus
MRVELLCTGDELVTGLITDTNSTYLEARLFDLGVKVERVVLVGDVRPDIIQSLKEAASRADVVVVSGGLGPTADDFTLECAAEAAGVPLEEDAQVLDWLHQRYAARGLSPNPSALRMARVPQGSEPVKNPEGSAPLVVMKLGGAQLFFLPGVPREFKALLEGEVLPRIRATLDARPERTYRAFRLLRTVGIPESELDIAVAPMGPRHPRIVFGFRTHAPENHLKLMAEAPSQSEADAALAAVEVECRQMLGTKLFGVDSEAYAAVVLETLRRAGATLAVAESCTGGLIAQQLTAVPGSSEVFIGGAVVYSEKMKSAWVGVPPDVLARHTAVSRETAEAMAEGVRDACGTTYGLSVTGYAGPGGGTPEDPVGTVYCALSAPGVPTRCERISVTGDRDRVRLFAAFPHA

SEQ ID NO: 11003 - protein, 386 aa, Myxococcus xanthus
MEGRLDVDPQVLPNMEDWACVRMVNGDKVRCTGRPLPTDRWFVSFPSFPAEAMLPFVALHGYQFNDTSFGVIVGALAVALFFSLLRFLAKEGETERNRNENVALALILAFGTLFFYCAIRGEVWFSAEVMGVALTCLYVRNAVRAHRPLLAGLFFSMATLTRTPLLFTGLFFVLEALCPGPEPRLAQLKALAQNWTPAAKKLGLFTLGAAPLAGLAAAYNVYRYGRLSEFGHAYLFNNRVNADIDRTGLFNWEYLPRNLEAAFFKLPSVSLSPLKLGYDPHGLTLLLTLPLLVFLLVPKTRPRLHWPVWLTVAVCALPGLFYQNTGYMQFGFRFSLDYTPYLLLLFALGGWSLRNRAVMAAVALGVLVNFWGAVAFRGYTELVRNW

SEQ ID NO: 11004 - protein, 142 aa, Myxococcus xanthus
MRWWHDDEPILHPKIIELFNASLVLDDADRYQLRIGNDWCFIQVEGAAYEVRTVDVTPDERVSVRLSDRTAEALDVASLHLDADGVLSCRVKQGRAQARLSRDAQYQLGQLLEEGPDGGLVLNVGQRKLAVPVKLDVLASSV

SEQ ID NO: 11005 - protein, 424 aa, Myxococcus xanthus
MVDRQNHHLFQPLLYQVATATLSPSEIAAPLRAVLGHHQVAVVLAEVTGVDTAGKRVLLSDGELNYDYLVIATGATHSYFGNDAWAQFAPGLKSIEDALAIRRRILVAFELAERETDPEIRRSLLNFVIIGAGPTGVELAGSLAEISRHSLHGDFRNFDPRDARIILIEGMDKVLPVYPDDLSQKACRTLEKLGVEVRTGARVTNITEQGVFIGQEFIPARTVLWAAGVAASPVAKSLGVELDRSGRVLVTPELTIPGHDDVFVVGDLSLLKDAEGKPVPGLAPVAMQEGKHAAHNIRRQLQGKPMVPFSYWDRGSYAVIGRGHAVGIAFRRFKQAGFGAWMAWLLIHITFLIGFRSRLAVLLNWAFSYLTFGKSARIITGPSPRLDRLQPTHALPEGGQTPSIAEPRFQTTTSHAESATTGTH

SEQ ID NO: 11006 - protein, 190 aa, Myxococcus xanthus
MKVAFAVFRFCLYGMVGLSAEIFFYNLVRIAQHVPLLEALFRFQWRVDDRLGLNAIWDTPISTAYGQCSLWMFVIYGVACFFFIEPLYRWMLYQHTGLRAAVYGVVILLFEGFSGVMLERLTGYRIWYYADAGAILWQMTSLYILPIWMVTGLLAEFIYRELMDPDLLAALESPLPATPEETEASFQLIR

SEQ ID NO: 11007 - protein, 221 aa, Myxococcus xanthus
MDRLAADMPDARIELDYRTPLELLVAVILSAQCTDKRVNMVTPALFQRFSDAQAYAEAEPSDVEPFIRTCGLYRAKAKNIVAAARSLVQEHAGQVPLKRDALEKLPGVGRKTAGVVCIHLGGDVAFPVDTHVKRLAYRLGFTTKADPDKVEADMQAVLPSERWALGHQLLVWHGRRTCFARSPACERCVVADLCPKKGVKVQKDAGATETPARSPRARAKS

SEQ ID NO: 11008 - protein, 22 aa, Myxococcus xanthus
MMKLKASKTIGFRPAKELKNSL

SEQ ID NO: 11009 - protein, 176 aa, Myxococcus xanthus
MSASLAPFLGYITLPLSDLLVNPEHIPPRIQRQVYANMMSSMSRKVLLQFQDWIEHDMFRSFDRTKDWRAGIAQLQLPLLVMGGSSDRLATPGNVESQFALATAPDRTLHIFGTDHGDKMNYGHGDLIFGTGAPSEVYPVIREWLERHASALPAAITDPAPAPVEEEPREPERSVP

SEQ ID NO: 11010 - protein, 342 aa, Myxococcus xanthus
MSKLAEKLKAVAAAVASIEKQFGRGSVMTLGGEAREQKVAVIPSGSVGVDRALGVGGYPRGRVVEVFGNESSGKTTLTLHAIAQVQAAGGVAAFIDAEHALDVSYARKLGVRVEELLVSQPDTGEQALEITEHLVRSGAVDLIVVDSVAALVPRAEIEGEMGDAHMGVQARLMSQALRKLTGAVSRSGTCIIFINQIRMKIGVMFGNPETTTGGNALKFYASVRMEIRRTGNIKDGDAVVGSKARVKVVKNKVAPPFQEAEFDLMYGSGIHRVGEVLDLGVATGLIEKSGSYFSLRGERIGQGRERAAEWLREHPDVLEALGKEITGTSALPSSPAPVEVAA

SEQ ID NO: 11011 - protein, 528 aa, Myxococcus xanthus
MDYGKHLNLHTIIMLRDVIRKWWQVELAFADRHGMVHEWQRGEISPPPNAFCRASLTSKEGLRRCGQSVRVLNEKFKANKKVRRSLIHDCHLNFSIVGAPLYIANEYEGFLFVEGFARQPLDAREADVLKSKVRQFAPQHATLDGRSEQVPVLDGAELSKLSDLLECAANEIANHEAAEASRQEDGAPGSSRELSDRYRFEKIIGRSGPMMEVFRLMEKVANSDSTVLINGESGTGKELVARAIHLSGPRAQQPFVVQNCSAFNDNLLESALFGHTRGAFTGALRDKKGLFEVADSGTFFLDEVGDMSAALQVKLLRVLQEGTFLPVGGTQLKEVNVRVIAATHKDLSELVKRGEFREDLYYRINVIRVQLPPLRERRDDMPVLIDHFLRKHHREGQRARGLDAEALAILGAYAWPGNIRELENEIERLLVLGGDLESIPAELISSRIRDAVLPGGGPFISPRAHGKLHEAVEALEREMIQQGLMRTRYNKSRLARELGISRSNLILKISRYGLDKGLPEDESEMGDA

SEQ ID NO: 11012 - protein, 537 aa, Myxococcus xanthus
MGIDVVVVECEVDMALGLPYFNVVGQAEGAVRESKVRVISALKNTGFELPQKRITVNLAPADLKKEGAAFELPIALGVLAAAKLMDEAPLERLLFGGELSLDGTLRPIKGVLPLAVAALNGGFEGVMVPWANAAEAALVEELRVIPVKTLREAVDHLTGARSIPPYTRQREPRLLAPTGQAPDMSDVRGQADLKLALEIAAAGGHNVLMSGPPGSGKTMLARRLPGILPEMTFTEAMEVTKVYSVLGLLGEGHALMRERPFRAPHHTLSDAGLVGGGLSARPGELSLAHNGVLFLDELPEFRRNVLEVLRQPMEEGVIHLARANQNITYPCRVMLVAAMNPCPCGYYNVPSRSCTCGEQRVFDYMTRVSGPLLDRIDISLQTRPVEYHHMARSTVQEPSSRYYRERAQVARERQRARYRDEPGIHCNAQLPAHLLRRYCAMSERAEHMLQQAVRMFGLSARAHDRIMKLALTRADLEGRDRIEQTDMQLAINCRMLDRRGAMQGKLHGARPAPPPEDAAWRNTGPSGRASPLEDLDG

SEQ ID NO: 11013 - protein, 101 aa, Myxococcus xanthus
MRATQNFRAGNNYTESKLRELGPTQFELWMNEVGPYPAFTAGIIHAGLRVAGAQDIVIEMSGYDGHACVYRINWNEASVSSGVAGSGDSKAARRSGSISSL

SEQ ID NO: 11014 - protein, 54 aa, Myxococcus xanthus
MADDATNYGRLITALDGANTAGAKVLGMATELPQNAIIQGTSVDTPTPPPAPTP

SEQ ID NO: 11015 - protein, 80 aa, Myxococcus xanthus
YGDLDTLVGSSGAGVLNQQGHLLGVHTDGDCEVNGRGSNRGAPAEVIVEASAYLQIEDIAVPSTATRTKGADAPSARLAP

SEQ ID NO: 11016 - protein, 750 aa, Myxococcus xanthus
MARSAAKTNPNAACNVLVRDAALNAVASLPERTVLVPITRNASGQEIAPDAATKSVAFVEENPNARYMSGLSSFMLGTAHRDRTYFPASTKTATLMRFARLSQRNAWNNSGNTVDSCREYVHEKYYDYSVFEDAISSAGTDYRKIFDIAYAQAPSGGSVPASAIGTRSIADPVQRGKDGTPIQPAIQFPAGAPKNEFFTVPPPVQGKVTISASNVDRVVVVPGGRGVAFIELKDLDRPLNLYGTILPEATLSTLANGASYYNESWAWHRSMSTIRNANVLDERMYELDRLQEEFAALVQQRKDLVSSIQVELARRYQPIQGFLKAEPETSSNLTDDDEPQDPVVTQLYQLASLDAVIEAALQQAQAKGCLNFQIGKAAAPCDWSPKRFARRVMNLYQGAREQDFQKCSTYTRDDFADLKARPLQIGTVNYPAQDYTTSPSRLETYFTRRDQYMRALSSTVGPMLDPKTAQPRLRWESGDSYSLGNDTFGATANYQVAVAINNVKNTPDCGLSPEVTGSFTATGSALGISANLINAQVNVTQKRADIDLDVLDNTVPLVDIHKNLTLGQFNIVSGKQEKKATLVSAQATFVIVVVPVTIGAKVAGVVGLEYGLSADHKVTGTTACSVTSVGITGHVQPYAQVDGELYASVDLFVIEAGVKGRLQLVHAAVPLNANVWLSPVGGRVKLRMEGNSDLRFTFLSGSISAYVEVGIWPFETEFEETLVSWNGITENVKLFDHSFNVDLLDLRSLL

SEQ ID NO: 11017 - protein, 622 aa, Myxococcus xanthus
MNARKVITGGALLALLLLGAAWLFHTQAPVTGAPPAATPLRVHFPVGERRTYRMDYTARTEVRLAGSQQKPTAMGGRAHFVGDLVLRGHPAQGTALRVGLSLENLHEHTLELFGHALLPDAAAVAATFTGREALLDLDADGTLRAVSFQEEDPSLFKNTVQTLAGELQWVLRDGATWQVEELTSRGTALTEYARLDEGALPARILKRRLAYPEPRGMGTGSGAVEVDSRFEMTLDADGVLERLSGEERVLRRPTGGGEPTATSHIQLRLEPGKRDRFVVAQASAAPAAPLQKLAPGELVTDAHARERMLEQQVDGLTPERFFELMEKYANGGTFPEHNHFLLQATGLLEQQPELCARLADFFQQSTLKPRGRALVLDLLAGTGTPEAQTALVRALSSPQALAEPGYGMLLSRLSLLTSPTPDTVRFIERTHRTARDDTRVATAYALGATAGALYRQQQDAESLAAVQQLGAELRAARTPEDKAHLLLALGNAGLEEQVDVIAHYAQDADAQVRRASARALRKIQTPQAMRTLLSMTEDTDAPVQSSALTALGRRDLDESALRQLRDLALSGRVPVENHHTLVTVVEPYLQRAPEVRQLLQHLLTQDVPDAQLHTRIRGLLGT

SEQ ID NO: 11018 - protein, 430 aa, Myxococcus xanthus
MLDAIRQEKFDYALRWLERMRPLEVRDGALVMGVPDRFFRDWVDDHYRPMLDVQLARMGEGLTSIAYEVVEGLEPDPHFPPTPSVKASATRPGRLNARFTFDTFVVADSNQLPAAAAQAVADKPGHHYNPLYIYGGTGLGKTHLLQAVGNLIWERDPSQRVVFLSSEQFTNEYVESVREHRMGDFRRKFREECDVLLLDDIQFLGKREETQKEFFYTFNTLYEMNKAIVLTSDTVPAEIPGLEDRLRSRFAMGLMTDIREPTYETRVAILQKKAVAEGLDLPDSVAHFIAKHIQKNVRELEGALVKLSAVHSLTRQPVTEDFASQVLRDILPAHSAVDVEAIQREVARFYKVTVESLKEDRRHKALAHARQVAMYLSRKLTKSSFPEIAARFSKDHSTVISAVRKVEGLRVTDATVQRELAELELKLGNP

SEQ ID NO: 11019 - protein, 485 aa, Myxococcus xanthus
MQALRGMFERPVYVGQDVRGRVMAVHFDAAQDATARRLVRLLLASTQFVAEDGPRWSTEEPDSRGDLEAVYRAGGSANTYVKTKRRYLRAGSAVLPRLQGHLDFTLFADGHVKEATGSDVVELGGGSTGLPRIREEARVALTNVGVDYRLSSLRPFEATRTTLRSERLTDSADMEGASLEARDRQLVKGVKLDDLLRALAKREDLDTARLRLTALFRQNLAEVERAVALIRQGSADAVRSEQILEALASAGTPEAQRALVSVLEGERVRPKTRAHAARAAGRMERPSLLLGDALERVMDGTRDAGVRNAAALSMGALSKTLEVAEPGRSQALVEGIVRRCRTGALEPEVCLDALARAGAPVGLAYVKSALVHPEADVRGAATKALSAIPGAAVDALLDQVMLDDPSPRVRALAVKAVSQRVTGAHLEVLARVLRSERSERVRIEVVRLLGHLQAVEAPAAALLRDVAANDGSANVRALAASLLGE

SEQ ID NO: 11020 - protein, 281 aa, Myxococcus xanthus
MVFCDGLGCDGFAWKYLAPYLVRNHRVLRWHYRGHGRSTVPEDRSRIGMLYTCDDLRRMLDAVGMERVVLFGHSMGVQVALEFQRRYAQRVCGLVLVCGSYGNPLDTFHDSTALKRAFPLIRRVVERYPEQSARIIHTVLRTELAVQLAITLEMNRERIARNDLAPYFDHLARMDPVVFVRTLESMAEHNAWDHLPHVDVPTLVVAGGQDKFTPGWISEEMADRIPGAELELIPEGTHTTPLEAPGRVEARVERFLRERLNVRTGAPSPTPTPVVSPPAGP

SEQ ID NO: 11021 - protein, 345 aa, Myxococcus xanthus
TIAALATAPAAGAVGILRLSGPEALDVGRLLAPGVPAQPTPRHAYLASFVDAEGRSLDEGLFLYFRGPQSFTGEDVVELQAHGSPRLLRLLLTRALEDARVRHAAPGEFTRRAFLNGRLDLTRAEAVADLVAADSEAAVRAAAAGLSGALASRVQALEEPLRALHADMEGVLSFPDEAEGADEDVGERVTALRAQAETLLAEVGRGRLVRRGARVALFGPVNAGKSTLFNRLVGEARALVDDEPGTTRDALEARVEWDGLAVTLFDTAGLRETPGRVEALGIARTRALLTGVDLAVLVLPPGVTQAEVEAWTRDVGGTPVLVVDGKCDVAEVSSSPRQRVSGLTG

SEQ ID NO: 11022 - protein, 75 aa, Myxococcus xanthus
MGKAKALKDKLYGAAVLKMSFRLRGDEESPAFRFVYPGVLRDLELEDEAVERDIEENREDEENADRGSTPPIGTR

SEQ ID NO: 11023 - protein, 225 aa, Myxococcus xanthus
MGFPARLDMKDAADGSLSVALHFEPAPPPGVEVGRRSQVVDSLQFLLNKMLHRPGADRRWVMLGAGVHPEPRPRREPQAAAAQAAAPAAPAPAPAAPRAAAAQAPAPAPAKGGQRGAQAPAAKAAPASKGEGDERSVTVEEDAALKAAIRQLAEKSGSLGRFYAIAAMKLEDRARVLTSVEGVGGVKVSAEGEGRNRRVVFTPDKPAPLPKRSMLPDDDEDDFDA

SEQ ID NO: 11024 - protein, 402 aa, Myxococcus xanthus
MDGFELSYTLQVRNTSGQPQSGELQVHHNRAIDPNFEHAPSFFGGVGNLSRSACWVGDKLQKMSPGDDHPDAEDTRGQIQFFGIDQQYFLSALYPLEGPRAGSCSFEATPTLRKVTASFPITAAPGETVTLRFGGYFGPKDTDLLAQVPGASLRAATGQTDATFHPPLAETVDFGIWAVICKVLLWVMKFFYGVTGNWGVAIILLTVVVKLVLLPLTYRSMVSMEEVKKLQPRMEEIRKKHADNREQQNLEIMKLYQEAKVNPLGGCLPLLIQMPVWIALFTALRNSFDIYGEPFIGPIWRDLTYKDPTYLLPLALGVSMVITQKMQPQMMDATQAKIMTWFLPIIFTLTLLQYPAGLSLYIFTNNILSIAQQYGLRKWLDRNKPQTGGGTPAVAGAGGRRK

SEQ ID NO: 11025 - protein, 72 aa, Myxococcus xanthus
MSPLAFVISLPIRFYRKFLGPLLPKVCRFHPSCSTYAMEALEKHGGLKGSWLTLWRLVRCQPFHPGGIDPVP

SEQ ID NO: 11026 - protein, 137 aa, Myxococcus xanthus
MTKDVTVINAKDSLKDAALKMRELSVGPLPVCDGDRLMGIITDRDIVVRAVSQGKDPNSTTVAEAMTGQLEYAFDDEDISVVAEKMKEKKVRRILALDRDKKLVGIVAMGDLLEALAEEDVGETLESISEAPPPAAH

SEQ ID NO: 11027 - protein, 75 aa, Myxococcus xanthus
MLKRCPRHEGKVARKYKLEQFLAMVAEELDTTPNEAERLARAVFVTVRNHISEGEADDVMGQLPADLRSLWVPEA

SEQ ID NO: 11028 - protein, 240 aa, Myxococcus xanthus
MYCPACAVRPEVNYLEAFRLKLWGRRDASAWLVVGVTVVLVGLALVALMAGDVGTTLACLGSSGVGVAFFLGMRWARMGLLAVPLLAMLLTAQSLGAPALLFFIPLMVAVNVFRDTRSRLFFRLDVPERELRQLWDLRVNNPLARHALSLSVGSLFLPVFAPLLSYFGVWSALTFVFAGLSMLALILGLVALRRVDPEARPPIGRRWEALGAVCLALVALALWGVLHRTRMVELLGGAVD

SEQ ID NO: 11029 - protein, 168 aa, Myxococcus xanthus
MEALGEGPAVLRELVHAPERTVEALRQGCHALVRRERELRALAPPAETQRLDAERDALAARVASEEDAVVRERLAGALAALESQRRQRAELAIAAARLEAEHMRLYYTLESLYAQVLRVRSADTVGEDIAGLGLRQSVEQLGAEVEAVAQALEEVHAAPGGGGRTRTR

SEQ ID NO: 11030 - protein, 391 aa, Myxococcus xanthus
LYSGGGMRLVRTWSTGLAVLLLAGCRSQGDPGPQGGQAATNQPMPVEVERLAPAEVRESNEYLGALISRSSITVYPQVAGYVKSIPLKPGARVEQGEVLLVVDPRRESAGLRATQAQQAAAMAQREYAQQTRKRSAQLLKEGLQSRQDHDQAVAQAVQAEASARAIEAQVQAQEVQLGFYEVSAPFAGIVGDYPVNVGDFVTQQTALTTLDQSNTLELSVQIPVERAGTVRVGTTPVEVLDPEGRLVVSAPVFFVAPTPNATTQLVEIRGAFENTVGLRAGQFVRARVVYATREALRVPTSAVTRISSQSFVFVVRDSDAGTVAQRAPVSLGLVSGNDYEVTGGLDAGTPVVLSGIQMLRDGQPIQPKAPSRKPPPGVGGSGTDGGTPPEQ

SEQ ID NO: 11031 - protein, 79 aa, Myxococcus xanthus
MADIIRERRFNFLIAGVLSLVIPGLGQLYKGQFLRAVLWFLMVGAGYWFFFIPGFVLHFFCVLGAAFGSAGSDRIRLPG

SEQ ID NO: 11032 - protein, 234 aa, Myxococcus xanthus
MSGWDVAVTRPLGLLLLVLVCCLGFIALSDEVAEGETQQLDERMLLALRNPEDPAQPRGPWWLRRTAEDVTALGGIPVLTLATLAVCGFLLLVRRYRTLLLVLGATLGGAGLNVLLKQFFARPRPSVVPHLTEVVSQSFPSGHAMLSATVYLTLGALLAQLAERKRLKLYVLTVALLLSFLVGLTRVYLGVHYPTDVLGGWVAGLAWALLMAVCARTLRRRSPALRAEARRPVE

SEQ ID NO: 11033 - protein, 586 aa, Myxococcus xanthus
MSLRDWLSRWRWGGAPVPAFYDESYRLPLTGIESSAGIEPRGVDFTTWYLLEARALRTQDVHHPQPVSLAELSRVHDAAYLESLGQPETLARIFATDPADVPVDALLSNLRRVCGGTLGAARLAVARKGPVVNMAGGFHHAGPARGGGFCAVNDIAIALAALHADGFDGQAVVLDLDAHPPDGTAECLAGQKRAWIGSLSGSDWGALSPEVDETRVPEDTDDRTYLALLDGLLERMPRPDVAFVIAGSDVLAGDRFGRVGLSLDGARRRDRALARALRGIPSVWLPGGGYHRDAWKVFAGTVLVLAGQGRRRIKARYDPLSARYRRIARSLTREGATPLDEPITQEDLEGALGLSGGPRQPRILGYYTAQALEYAFFRYGILSYVERLGYSRLRVEVGSVGEGDRMEVHGCAAGQEHQLVDCVVERRVLAGEPFLFVNWLSLRHPRARFSEGRSRLPGQDVPGLGLAREATEMLLVMARRLVLAGVAFRPMWFHLAVLARSRFRFLDPARQGRFEALLRDLGQLPLLEVSQAVVDGHVLLNGQPYAWEANDMVSRLEPEAGDLEAIARERERCRFTWEPARLATGA

SEQ ID NO: 11034 - protein, 202 aa, Myxococcus xanthus
MPWLYFVLKPRHREWADAWQREVQALLRELETVEIAEGCFIAPEARIFAEPGRTVSIGPGCSIAADVFLHGPVTLGPRVSINARASLDGGSAGIRIGEGTRIATGATLYAFDHGIAPDRPVREQPVTSRGLVIGADVWVGANAGITDGVSVGDHAVVAMGAVVTRDVPAWAIVAGVPARVVGDRRQRPRSGAPGGWEPEDGA

SEQ ID NO: 11035 - protein, 691 aa, Myxococcus xanthus
MKSQASHAGSQVESERFRHLSELLHEVVFQLDAQGRLAVLGGAWERLTGTPVSAWRGRALLEAIHPEDRERAQALLAYTPGIPVSRQEVRVDTGGGHGVRWVELSARALATVPGEVMGTLLDVTSRRTAEEAVTTRERYLDAMVQVQRRMMGHDLPDDLYGAVVEPLGHVSAASRVYVFEMHFAEDGTLLASQRAEWCAPGIPPNLEDPNMHGLPFDAALRPHQSEQLQRGEPVQGQPRDFSELLAPMLEAQGVRSVLLLPMHVHGQLFGVIGFDNCREPESWGPIEVNLLSGAAGALSLALEQRTANALRMRTETTLRRTEAGVHLLIEAFPDPVLVHVGDGVLLSVNPALVQYLGFRDASELVGRHMLDLVRPEDRGAAQLHLSQALEGKSAARVVEMPLVRSDGEVVVADLVTLAVVLDGSPARITVARDFTERKRTQAQLMLTDRMASMGLLAAGIAHELNNPLAYVLSNLDFLHSAVGGVRPRMLSPEDMVELRQVLDDAREGAERMRQIVRQLRVFSRVEDGKEESVDVHAVLESVTQMAASVVRARARLVKDYGEVPFVRGNEGKLFQVFLNLLINAAHAIEEGDSEANEIRLTTRTEVGGRVMVVVSDTGQGIPPEHLRRIFDPFFTTKSSGLGTGLGLSICDTIVTALGGHISVESSIGAGTTFRVALSAAPPKAPANRPGA

SEQ ID NO: 11036 - protein, 686 aa, Myxococcus xanthus
MRTHFVRHLLALSLVLATGAQAASQPWRTSPHPESSASGLTGACEDARDFLLGAGSADITGPAAEVGMMGYGMLEQQTTGIHQRLHSRAFVIASPCNGKRVAFVSADLGMVFQAVKQQVVERLRARYGDLYTDDNVLLSATHTHSGPGGYSHYTLYNLTTLGFSPQNFEAIVSGIVASIVRAHERLAEGTLRLSSGELFGASRNRSPNAYLLNPAEERARYAHDVDTRMTLLRLTRADGTDMGLINWFAVHATSMGNGNTLISGDNKGLASYLAEQAQGAGDTFVAAFANANEGDVTPNILGGTHGGGANDFEDTDLSGRKQYDFAAKLWAEAKTPLTGGVDYRHVYVKMDAVDVAPAFADGAPRTTCPAAIGVSMLAGAEDGPGVGVEGVTCAAGQNAWGQFSCSLATTPCQAEKPIVLEMGSMRPFPWTPEVLPLQLVTIGNLALVAVPFELTTMAGRRLRDTVETALAPAGVTDVVIAGLSNAYSGYVATREEYARQDYEGASTHFGPWTLAALQQNFHLLATSLRDGAGVPPGPTPRDLRKEQLSLQPGVVFDDKLLWVDFGEVVTDARPTYSRGDTASATFWGGHPKNDLRLEGTFLRVQRREPDGTWTDVATDADPATRYQWRRENCVPTLACSHVTVTWGIPDDTVPGTYRLVHEGNWKSGWDGNVRPYSGASRTFTVK

SEQ ID NO: 11037 - protein, 1232 aa, Myxococcus xanthus
MTALSQGLHRALRRMHQFAQHRGPLAQGLHQPGAEGVHLRHPGVRLPLRDTHGLPLRHSSVARAALVTPRTLQVLQRGQEEAQGHEDQPPQPAGLCQGNQHARYRRGDVGGAPRGVARAVGQHLPFGAACGALRLPPPLLLPLPANLPGRHLPGAAHPGLHRRVLTRTALRKRVFQPEQAFMLDAGRWGNRRLGTSTRHEVTITTTRPLREGKRTIRRLLHMHGATSGNAQPFAFALGNSVENVRWRGAKKGAGAVELPEAKGESAGWEPETIRALRGEQSRAAFARLLGVTPLTVYRWELPSEAPQARRPRGRVAVALRQLAARGGAPTPVVSAPRRQELHPEELARILPSVTHLTRAEWRAAEEELLSLLASGLLRTPGARAMAAVGLAYLQRWGREDSRGAFTTLLPHLAFADAGIFPEEVELRVLAMAANLYASPDGKLFDANKSAAYVARAEALLANHDDPEVRCQLRMAEVACGFYLGEAERITHGSGRLEDALVRVKDPALRLLAEDASAHEAALRGEATLATRRFREVAQGAARMGYAFLEARNLAFLAQRRLDEACEPSEALQMVRRAREAAYGGRMVRGFSFIFAARAEAEALLRLARFAEAEAVLDEADAVVEELRWTPLYLTVTRARLYLLSGRYPGLRKLARQLTAYDGTIQRALTGAYAQFAESLADLAEGNTHRAAEGFAAAGQRTMELGGWPYLRRECLLYETYARVYACQRDEGLVLLRLTGAFLERMPSAWHSALLHRFEALLHVLDGRTAEARSLLEAALGTFSLTGDLCMAVYTRHLLALLARMEGDPAAGELLAASEAELHRVGMVVHPQHFVHYVAREPHATAREAEGAPRLGAEALVVPFERLSVRGMGAPLIQRELLAVVEGLFPHCAPRLEELDSQGRATPLGGDTTVPATEAVEFGDGCGRRLRLGVAGHLPPDGRALLTALSRLGGFALEVATLRGFAQVDVSALASDDTDVRDADVPGFIAASSAMRRLRSELASLSSSRATVIVTGESGSGKEVVARALHALSARSQRPYVAFNCAAVPRDLFEGQLFGYRRGAYTGAATDHPGVIRAAHGGTLFLDEIGELPLEVQPKLLRFLENGEVFPLGEMRPVEVDVRVVAATHRDLGQLVREGRFREDLYYRLQVVPVRVPPLRERREDVVALARHFVRQLTPEGMEPPQLGPDAIAALMSHPWPGNVRELRNVIERSMAYGPFPAVLGAEQMRIAG

SEQ ID NO: 11038 - protein, 96 aa, Myxococcus xanthus
MKKAFLIALSLSLPAFASSDFDSEDLSVDVDPEELVSQEAADASRPPLLQFCWNLHYTSCSGPGTTQQCTDGIWSDYVCTCRTLGTRNVWVCPEVR

SEQ ID NO: 11039 - protein, 400 aa, Myxococcus xanthus
MEQGPGFIKLLLAYFAVGLALASLQLPAVLDWLIGTTLFVLLAISGGRLAVSLLHLASERLVGTWAAKSTATKYEEYFLALGRLLPVGQKSLEAIVYISVATLVIRRFQGLEFFAPYGPVLIRVIALFFAASVVVEFVRLLIARAFKVDGSNLDDAARRRNTFVSLIQSASKYLVYFLVGMMVLSDLGVDPTPILAGAGIVGLTVGLGSQAIVTDMVNGVFLLFEDQILNGDYIRINDTEGVVEEITPRITRIRDRFGRLHILRNGEVKNVINYSRGWTLAIVDMAVAYESDLKKVMDVIRQVCEQVPMLSQGKVSEIPKLLGIESMDESWMTMRIEAKVQPGTHFDVKRLLNRLLIEAFTANGLEFPYPKGVEYEGGPLLPATSEAPQEEPQALAASHR

SEQ ID NO: 11040 - protein, 469 aa, Myxococcus xanthus
MHCELCLTEHPYDVACGGEPWTQVYLSTGDAEAPPADLTGQTLGSYRLVRRLGAGGMGTVYLGEQTRIGARVAVKVLHPHLGRDESLRARFYAEARTVNVVGHPNIVHIFDINEAPGGIHYFVMEYLEGVPMSHLPRPMVPATLVSLLAQACDALDAAHRCGVVHRDLKPDNLFVVRHAGEPPSLRVLDFGVAKARRPHPGEDETAAGIVLGTPAYMAPEQSAGQPVDGRADIYALAVTAYYLSTGQLPFERGQMVELALGTGPVGAPPPHLLVPGVPPALSEVLLRALSRRCEDRYATALEFKEALLLAAAQPLADALSPQTPPPRSHTPVPSLAWLDTEDPATEPNALTPPLTWVARVRRRSGAGDVEVLCTELSRGGLFMCCADPFPRLFNRLEFTLLLAGELVECAGEVVRHVDAAQAQTWGMLSTGVGVQFINPSARLCELIRRVQPHRLTTPASTLMRAEVVL

SEQ ID NO: 11041 - protein, 350 aa, Myxococcus xanthus
MADIADGEQVSVQGSGSKPYILKNTGGVYSCSCPAWRNQSVAIERRTCKHLRRVRGDAAEDARIGGDGSGAPAVPARPTRSTSASDDTKAPPLLLAQSWENDVDLTGWWMSEKLDGVRAYWDGKQFWSRLGNAFLAPEWFTAGLPDFPLDGELFGGRKRFQRTVSIVRRQDRSDDWKELAFVAFDAPGVEGTFEARLERCRQWMEEAKPAYAQWHAHARCDGTPHLRTELARVESLGGEGLMLRQPGSRYEAGRSHTLLKVKSFKDDEARVVGHVAGAGRHKGRLGALEVELRNGTRFSVGTGLSDAERASPPPVGAIITFRYQELSNDGVPRFPSYVGVRVDAAPFAAS

SEQ ID NO: 11042 - protein, 85 aa, Myxococcus xanthus
ALQALLLAMGSNALARLRNKPSITTLVPGLMLLVPGSVGFRSLSSLLERDVVAGVDTAFSMLMVAVALVAGLLSANALVPTRKVL

SEQ ID NO: 11043 - protein, 267 aa, Myxococcus xanthus
MATEQTARRVFTGLIILSIILLALVVRPFAKAFFLAAVLAGTFYGLYSRLSRKLRGHNNLAAGVIVSGVILALLLPLGGLTAFIVTEVSDGVKFVSDTVQREGVEGLIGKIPSPVRGPVERLLERIPLEQAQLDETLQQQVSTQGGTAARAVTGAVAATGSIAFQTVMMLIALFFLLTEGARLVSWVESVSPLRRGQTREILREFRSVSVAVLVSSVATAGVQAAAGARRFPHRPRPRGRSSSRAWRSSWRSSPPWAPPSWCWSPRR

SEQ ID NO: 11044 - protein, 147 aa, Myxococcus xanthus
MALIPAVGAAIVVLVAAALMFFSGHPWAALFLAIWGTVVVGLVDNIVKPLLARRGMHQHAAIVFFALLGGLAAFGTVGLLLGPLIVAFFLALLRIYERDYGRPTPRPGDPATPGGPSGDESLIIRPSVLSAETRERVPLSPTPPENH

SEQ ID NO: 11045 - protein, 324 aa, Myxococcus xanthus
MSSTIAPVPSPSQSSDLRLVPVEIAPETFWVGKREPGNIFYANPYLLRFRGTDKKTQRPTEFNLLIDPGSSSDFSTIHTKVTSLIGGMERLSAMFINHQDPDVGSSASIISARYAPRAGLLCSEDTWRLIVHQNLPRHRFIPTEKFAQGLSVPTGHRLLPVPSPFCHFRGAVMLYDPQTRVLFTGDLFGGLTDSNAKGIWADESDWAGIRAFHQIYMPVNSALQRTVAAIRKLEPGVEMIAPQHGRIIRGPPGAAVPGPDGEASRWGPGPSWTRPRPHALQAGMPCWTGWCRWRPATWVTPWRPSWPRARSCRTQRSTTARGWW

SEQ ID NO: 11046 - protein, 115 aa, Myxococcus xanthus
MDEAQAARTAGWNAVLDRVVSLAPGYLGDSVEAQLAASPELSDTAQYDGTRLVVSRLGKWTLEHVVDLLCHGEPPEIAGPIIVEATSAAAEYNLPTPHLDIEGVGAPSHVSLLDP

SEQ ID NO: 11047 - protein, 324 aa, Myxococcus xanthus
MSPHGTMLQGIVVPAPSSVVRGLVPGQTVAQRYRVERWLGAGGSSTVYEATDLHQDMRVALKVLAVPHADAAMVARFRQEVEHARALEHVNILRVFDAGVDGERHFLTVELLDGVDLRQRLLERRATLAEALRWLTHATVALEHAHGRGVLHRDVKPANLFITRTGVLKLMDFGLAKSTHVMGTTAQGAVLGTPEYMAPEQVTGNPAVSPATDLYALGVVAYELFTGQLPFRHPEPVPLMFLHVQERPVPPRTLRPALPEPFERVVLRLLEKRPDDRYRSAAELRTALAKLWPHALNGDASVAARAPAPPLARARAPGPGGGTG

SEQ ID NO: 11048 - protein, 247 aa, Myxococcus xanthus
KLAHRLQAIKPSPTLALNSRAKALVAKGVDVVVLAAGEPDFDTPDYVKQAAVDALRAGFTKYTPTNGIPELREAICAKLERDNGLRYTPDQVLVTSGGKQGLYNFCQAALEEGDEVIIFAPFWVSYPDMVRLAGATPVIVPTREEDGFAPDPDAIRRALTPRTRAVIINSPGNPTGAVYSRAALERIAEVLRPHDCLIVTDDIYEKLLYTDERLGISDVAPDLVPRLVVVNGMSKAYSMTGWRMGYV

SEQ ID NO: 11049 - protein, 128 aa, Myxococcus xanthus
MDEAVEEPWVVIPGMSGTRAMEAACEARGVTPRLAVETDNAEAMRRMVERGLGVAMVPQLMARDHHAQGFDVVPLARAGVKRQVALIHRGEGYLTAAARALKSFIVESVRAMPEPWGTRKAAPGARVR

SEQ ID NO: 11050 - protein, 133 aa, Myxococcus xanthus
MARTDSFVEYTVELLEKLGPVKSRSMFGGWGLYLGGRMFGLIGGGQLFLKVDDVTKPDFQAAGCRPFIYEGMKTPVEMGYWTPPADAADDAYALLPWARKAVDAANRAALKKAQKTARKKAPAKKRTSRVKPS

SEQ ID NO: 11051 - protein, 281 aa, Myxococcus xanthus
MDDSNARLVAALLEARQRHCFPADVRRAAPEFVGQVLGLLFPHFAERLECTAAAVHRDVTTVEASLHRIRDTLAPLYPGIERDLPARFMERLPGLYDWLRQDADAIFEADPAARTVDEVILTYPGFTAIAIYRVANALHALGFPLLPRLLTEYAHQRTGVDIHPGATIGRRFVIDHGTGVVIGETTLIGDNVKIYQGVTLGALVVEKGLTDKKRHPTIEDDVVVYANATILGGETVVGRGSIIAGNAWLTQSIPSQSVVTRRSEVRQRGENGSLDALEFHI

SEQ ID NO: 11052 - protein, 306 aa, Myxococcus xanthus
MKVNNILETIGNTPHVRINRLFPSRVTVHMKLERANPGGSIKDRIALSMIEDAEQRGLLKKDSVIIEPTSGNTGIGLAMVAAVKGYKLVLVMPESMSVERRRLMAAYGATFELTPRAQGMKGAIARANELLSQVPNSWMPQQFENEANIEVHRRTTVQEILKDFPEGLDYLITGVGTGGHITACAEELKKVWPKLKVFAVEPTKSPVISGGQPGPHPIQGIGAGFIPKNLHKDALDGAIQVTEEDAFEFTRRAAREEGIFVGISTGAALSAVNQKLGEMTDGSRVLAFNYDTGERYLSIEPLFPAQ

SEQ ID NO: 11053 - protein, 533 aa, Myxococcus xanthus
MRRTILDAMRNTLFVGAALLAGCAGTVHAPYPPIRADMSPAALERGAAIFHASCESCHRGGDAETASGAPLRELPSYMGRFYAANLTSHAEAGIGAMTDEALARAIRYAVSRDGRLMVMPSYGMGDADLAAVLGFMRSGHPLFTPDSVPAPLSKFSFFGGIGFRFITGNEPVERPASGIPVPPKAATREYGHYMAHDVYDCASCHTDGFSPRKTEGDDVFAGGMAFVDPEGRNVHSSNITFHETGLAHWTLEDFTRAVRDGLAPDGSVLRSPMPRFRGMDEVEARALYDYLRSVPHRKNAVKGARPRLTAESVRPDWGAEEMEEQSAEALPDAVQASAPDETRTGAVPNASSSVKGAGEETSGPLVSPAQPPANHEGTRGEDAHAAVTSSASATASGSAMHTAPGATDKSAASAPSAKHDAANTAAAGPSTLASKPTPTRKPRPAAPKVDAPALFVKLGCASCHAPGARYHDRLAKVSSRSEAELVRWVRNPEQFLPGTPMPTYAELIDEKTARALVRWVKAGGLATLPSTSR

SEQ ID NO: 11054 - protein, 369 aa, Myxococcus xanthus
  unsure (1)..(369): unsure at all Xaa locations
RRALERCERHGTRVGAHPSYEDREGFGRRALDVTPEHLRAQVAAQCGRLAKLAADRHLPVAYAKPHGALYHAANATPALARAVVAGIVEALGTAVTFIGPGTGALHDAALAAGLAYAREGFADRGTRPDGSLIPRGQPGAVLTDHAQARANTVRLATSGSVDTVCVHGDTPGAVELAREVRATLDALALRAEPLGEGALRLVLPEGLERRATREALCAMPGVLDAVITEEHACVYFAPDAPPEEPRLALARLLRIPAPVAGRPLTTISVRYDGQDLHAVAERAGLTEDEVARRHTAREYTVRCVGFLPGFAYLGEVDPSIAVPRLATPRTRVPALAVGIAGGRTXVYPFASPGGWNLIGTALDFTASHL

SEQ ID NO: 11055 - protein, 79 aa, Myxococcus xanthus
MLATVTVLELAAGALSAAGLVSLVATGSATLAFWGALLSAVSLVALFFGQRLAKDYAGAGGLVHYFLLTLVAVYVTRLG

SEQ ID NO: 11056 - protein, 272 aa, Myxococcus xanthus
MAVIKDFLIPGDSSPGNNASVTVTSPNGGESWAGGSVRDITWTSTSVTNVKLEYTLNGSTWSTLAASTAASAGSYAWTVPSSATTTAQVRISDASNASVSDLSNAAFTITTVPTGGTGKVIINEVMVNEPGSNVAGEFVELVNTGTGAVDLSGWTVSDAASLRHTFPGGTSLAAGGVIVVFGGAAGIPAGTPNAVSASTGTLGLSNSGDTVTVKTATGTVVESAVLSSGVSGTDGVSANRSPDLGATATFVLHTSLSSLQSSPGRRVNGSAF

SEQ ID NO: 11057 - protein, 48 aa, Myxococcus xanthus
MSWMPVVGDAFVIAGGMLGVRPLPFVFFVTLGKGLRYLAVALSAAATL

SEQ ID NO: 11058 - protein, 288 aa, Myxococcus xanthus
MHASWRWVFLVNVPVGLFAAALLYLSYRDPPRRPEVRMDRWGPVLAGSSAALLLFSLEPGAASLRWACALAAVGAGWLLVWQQRTTVSPLLPAELLRDRAVLSGIVGGIAGGSLLYSMAAWVPLWMTEQGGHTPLAAGLALLPMLLGWSVGSTFGVKLLVRGGMRLSAGVGFAVAALGAGWLSLAAARGWGVPAALMGLAVLGLGLGPAASTSLIGPQSRAPWHHRGIVTSALYATRLLGGSLAVALLALASGHFALQFGIAAGLTAVAALGLALLAPGRTEPAASGA

SEQ ID NO: 11059 - protein, 160 aa, Myxococcus xanthus
MLVAIYPGSFDPLTNGHLSLIQRSLKMFDRLIVAIAVNPKKTPLFSEEERLTLIREAVQDDRVEVDAFHGLLVDYVRRRNAGVIVRGLRAVSDFEYEFQLANMNRKLAPDVETVFMMTGEDYFYISSNLVREVASFGGDVTGLVPPNVHEGLKAKFAGRK

SEQ ID NO: 11060 - protein, 484 aa, Myxococcus xanthus
MALGVQKGDRVGLWSPNRFEWVAVQYATARIGAILVNINPAYRSSEVEYALNQSGTKVLLHARGFRQTDYRGMVKEVRPRCAGLAAALVLEDDWQRLLDGAEDVSEDALAAREASLQFDDAINIQYTSGTTGFPKGATLSHHNVLNNGFFIGEALRYGPEDRVCIPVPFYHCFGMVIGNLACTSHGATMVIPAEAFDPLTVLQTVQAERCTSLYGVPTMFIAELDHPRFGEFDLSTLRTGVMAGSPCPVEVMKQVQSRMHMREVTICYGMTETSPVSTQSALDEPLDKRVSTVGRVHPHLEVKVIDAGSGEVVPRGSPGELCTRGYSVMLGYWANPEATAAAVDAAGWMHTGDLAVMDDEGYVKVVGRIKDTIIRGGENISPREVEEFLHAHPGVSETQVIGVPSKRYGEEVMAWVRVKPGATLTAEELTRFCAGRIASFKIPRYFKFVDAFPMTVTGKVQKFKMREASVVELGLEDAAAIKTA

SEQ ID NO: 11061 - protein, 378 aa, Myxococcus xanthus
MTRSLESYRDLFPVLKEQLYLNHAGVAPTSLRAAEAVRGWMEDIVHHGIKHERGWEAHCERVRGLAARLINAEPGEIAFVRNTSHGLGLVAEGLDWTPGDEVVVASSLEYPSNVYPWLHLKDRGVTVREIQTPEGGVTPEAVAAALTPSTRLVAVSSVQFATGYRTDLDAVGALCERAGVLFCVDGIQSVGCIPVDVKKSRIHFLSADSHKWMLGIAGIGFLYVAKDVLPRLRPVLVGWRSTTDAWNFNRSHFELRPDAGKLEEGSAAYTGIYALGAALELLHEVGVDAISARIRELLGQLETGLRGLGCDVGPAPEHRAGILTFLPPEGEARALGAWLAGREVALSVRRGRVRLSPHFYNLPEEMDRLVELVRTHRG

SEQ ID NO: 11062 - protein, 187 aa, Myxococcus xanthus
MKAMTRYLVLFSMLAVGCGDSSDGDGDSALKCDAIGWCTSWESDQAPVTDAPALKGGSVPEGLYRLERGSEDARALLFKGKSVLKVGGSWGNILGTWKVDGNHLVITTASSCYGTREDAFNETFRYAFAVKGDTLYLHEDEFEDMPIMAWRKVDSLCQENASFNCKVSNCTCKYVANSSFDTSERCF

SEQ ID NO: 11063 - protein, 167 aa, Myxococcus xanthus
MSMVVNHFDTFVYSLEPAASERANLIRSFGATYVSGQDVLLGELGKKVGTFDIIYEAVGMSKVAFAALDALGPNGLFIFTGIPAHGGPNPVDTDTLMRNIVLRNQLLLGTVNASRSAYELALRELEQAMFLFPQSVRALITHRVPIQEAPALLTESGGIKQVVQLAS

SEQ ID NO: 11064 - protein, 586 aa, Myxococcus xanthus
MCLPRIDSDACFAKLLGTNEHGYWSLRPAVEVRAVQQRYRPETLVLETEVTCDGGRARIIDFMPPGETEHDIIRIVEGLEGEVPMHSDLRVRFGYGKLTPWIQCNSHRATLTSGPDALAYISPVPLVPDWDASRLEADFVVRAGERLPCSLTFYASHLAAPGHPVDAERDLVRTEQYWREWASRCRYEGSFRDAVVRSLITLKALTYEPTGGIVAAPTTSLPEELGGVRNWDYRYCWLRDASLTLEALMRGGYLDEARAWRDWLLRAVAGAPDEAQIMYGVAGEHRLPEVELPWLPGYEESRPVRIGNGAYGQFQLDVYGETLNAMYEARVYGVQEAGSLPWDTLKVLVDFVEKSWQRPDEGIWEIRSKRQLHFTHSKLMAWVAVDRGVRFVEQFGANAPEKLKKRLPRWRALREEIRADILARAYNSRVGAFTQSYGSDALDASVLLIPHMGFLPADDPRMLGTVAAIEKGLTKAGFVERYLAETGVDGLAGHEATFLICSFWLVDNYTMVGRLDEAGALFQRLVSIRNDLGLLAEEYHPGLHRQLGNFPQAFSHVGLINSAVLLEAKRAGRDVSFTAMAAASMH

SEQ ID NO: 11065 - protein, 173 aa, Myxococcus xanthus
MGVPEVTALAASLPAGAWVLDVGCGTGLPLTRVLLEHGCHVMGVDSSRELLARFQVNFPHVPVSCAPIQSCELHERTFDAAIAWGVLFHLRHEEQEQAIANIARALKPGAAFLFTSGDAHGSIDGEPMNGVPFRYHSYSVDGYRDLLRAHRLALEATHTDPGANVYYLSRKTG

SEQ ID NO: 11066 - protein, 651 aa, Myxococcus xanthus
VFFGVRAAGDIKVDVLPEMNLPVVYIAHTFNGYTPAQMEGYFTKMYVNMMLFTNGIKNIETKNSQGLTLMKLSFYEGTDMGQAVAEINALSNRSQVFLPPGAPPPFIIRFDASSHPVGHLVFRSESKTTNQLQDIANFTARPFLISIPGLTTAPPFGGSPRTIEINIEPEKLRVHNLTPEQVVEAIARQNVTAPSGNVHVGDVTYITPTNSTLRAVEDFGNIPLLKGSVANVYVRDVATVKDGADIATGYALVNGKRSVYLNVAKAGNASTVHVVQQLKESIPRIQSNLPDDVHISYEFDQSVYVVGALKGLIAEGVLGAVLTGLMVLLFLRDVRSAIIVIITIPIAIISGVLFLKLFGQTINIMTLAGLALAVGILVDESTVTIENIHQHLQRGKTVAVAVWDACLEIAFSKLLILLCILSVFAPALTMGGIPGALFRPLALAIGCSMVVSFLLSQSLVPVMANWMLKQHGPPPGGEGASPSPGRVRRVIEGMLPHRKLLVSAGVGGLIVLAVVSLQRIGKDVLPRVNSSQLQLRLRAAEGTRIEKTEQVVHQAMGLVEEVVGAGKVRISSAYVGQHPSSFAISPIYLYNAGPHEALLQVAFEGGVGDIDALKERIRQRVREAMPDVQVAFEPVEITEKILGQGRAVSPS

SEQ ID NO: 11067 - protein, 236 aa, Myxococcus xanthus
MGVPFREFQLEPTFHQSTPESGEPAHVAPGHPVLAEHEGKVRRSEQEKKVAAAEGLPTLFAFGMLQGRGSGFRSNYAQDPGAFSSGYLGGVGIDRGNTLVGLGLSWNLASVLRSFSSEAARDARTRALHQEQELVTQELVAQARFAEHKFDLAREVTHHAVLQRDAATEGFRQSKARYDSGLGTIVELTQATFSATRADVDLELAQNGIWQALLLKSAAAGDLNEFLQQVRGVKKQ

SEQ ID NO: 11068 - protein, 60 aa, Myxococcus xanthus
MCKDRLANDATFRTATDPVSQRPVDKATAVIGITQDNSALYFENDQTFAAYSRQAAGAPR

SEQ ID NO: 11069 - protein, 165 aa, Myxococcus xanthus
MARLAEGDRVAFTRVFELLWGPIQKLCLSLLRNEADAADAGQEAMHKILERASDFDKTRPAMPWALAIAGWECRTLARRRDRRRESQADAMPSCAGPHAEEEFLQRDLTAAAMAALGELSELDREVLIATFWDEAASVSGATLRKRRERALDRLRKTFRRLYGLD

SEQ ID NO: 11070 - protein, 185 aa, Myxococcus xanthus
MRIVAGTAKGRALAGPKSSSLHIRPTADRVRETLFNVLGQFLDGQRVLDLYAGTGALGLEAVSRGAGQAVLVDQDREALTLCRENAQAVGLAGQVEVLAAPVARALETLKRRGDRFELIFADPPYTARVVETVLDGIVAAGLLTPSGMVVVEHDKREAAPDTHAGLDREDQRRFGDTLVSFYRAP

SEQ ID NO: 11071 - protein, 319 aa, Myxococcus xanthus
MGGSQWGGTNDDESVRTIHAALDLGITLIDTAPAYGFGHSEKVVGRALAERGGREKVVVATKVGLERRGDGVIRNSSRQQVIQELEVSLRHLRTDYVDLYQVHWPDFSTPYEETAQALLDLQRAGKIRAIGVSNYSIEAMERFRSVAPLASAQPPLNLFEREALEDIIPWCRTNGVATLTYGALCRGLLTGTMNKDTRFEGDDLRQTDPKFLPPRYAQYLQAVQRLAQFARERYDKGVLPFAVRWVLDQPGVTVALWGARHPGELEPLRDVIGWRLDDEALTYTDSVVNESVPEPVGPEFMAPPEQRPEESGERPGAPA

SEQ ID NO: 11072 - protein, 58 aa, Myxococcus xanthus
MGYAFVPESISPTCPRTVRLVPIDELDGRFDVEFVYDGQANSPVVQQFLAALRTTANT

SEQ ID NO: 11073 - protein, 32 aa, Myxococcus xanthus
MLVMSLRERDYIYTAISVFVLAVIAAGVMVEL

SEQ ID NO: 11074 - protein, 107 aa, Myxococcus xanthus
MSFDETYLPRELGEKIVTHDLETEPIFALLEERYHLPLIEAEYRLEAITATPTVAQALAVEPGNPVFLIERTSYTEGSRPIDYERLHYRGDLIRFITRLSRRPRARS

SEQ ID NO: 11075 - protein, 307 aa, Myxococcus xanthus
MLTEGSVVERLRRHPAGLLDPHVANASLLLEPEGREALAAIYRDYRDIGLGHGLATLLLTPTWRANAERLARAGLAGRDVFTEAGRLLAGLRDEPRERETRVFVGGLIGCRGDAYQPAEALPRREAAALHAPHVEALSRAGVDFLVAQALPALSEAEGLALAMARTGAPFLLSFVLRPTGTLLDGTPLAEAVARIDALPDARPTAYMVNCVHPSVFREGLSHQLAASPSLGARVVGLQANTSRLSPEELDGRAELDCAPPDAFAREMARVHAELGTRVLGGCCGTDERHIAALAGILTEGTPGALPP

SEQ ID NO: 11076 - protein, 318 aa, Myxococcus xanthus
MCMSSGSPGRIRLWKPCREGAPSCFTSRPGASRGRCCSPSCGWMGPTFPQDQQRSTFSMSARFANQKLIVVGGTSGMGKAVARILLEEGGRAVVIGHRDDKLQAAVAELAASGPVEGLRADIASGTERQALVAQLQKDHADATLLVNAAGVFLPKAFLEHEERDYDLYLDINKALFFITQAVARSMVALRKGGAIVNIGSMWAKQAIQATPSSAYSMAKAGLHSLTQHLAMELAGHGIRVNAVSPAVVETPIYEGFIPKEQVHGALQGFNGFHPLGRVGRAEDVAQTIVHLLSDETSWVTGAIWDVDGGVMAGRNKYS

SEQ ID NO: 11077 - protein, 267 aa, Myxococcus xanthus
MAFSEFECWSESGQLECVAVFRPAALDVTSAEEAAAVGFMRPVTRSEAEDAFGRLRDTLTRLGCQTIDLWELLPERERAVSDTTVNRVFVRDTAAVLGRQLVTGTAAFPVRLAEFDVAHRALSQLQPELSSDEVPTSARIEFGDVFVLDAERLLVNVGLRSDARALQPFLELAWRSGFREAAVVRIPESLGIIHLDLAFNVLGPRAVVARAFLRHTPIQVFAQGVAPHWEPFDGYFAQRGCRVIPFEPKGESGFMSNFIYVGPNLVL

SEQ ID NO: 11078 - protein, 476 aa, Myxococcus xanthus
ADDNAAQPGKDNADTPAARERRTDAVLLKMPNHNMDYPHLAVPTLTAALRKNFFKVKQQDVNVLLRDFLLTEEMLKDLAYRFLPELAKAHIDIPADFDRIRNALVYLHYIDNQIGFARVEQVKQKLQARKYEEVFCDEQESSLASLIFVLTGMLHIVIDLALTYDEAGGEIDNPVTNFLHQKVREVAALNPRVVGFSVIQIQRKATLWFARRLKPLIQGKIAVGGPDASTFKEEYLKNNDCIDYAFLKEAETTFLELLRGKPVEQLDGVVFRDAEGNIQVNEPRHDIQLSIFRPDFDGYDLDKFLLPTLPLSTSRGCAFAKCTFCNHYKTYSGYYSNDAVKTVDIIELLAKRYNTRFFHFVDDMLEVKEGTAIAEELIRRDLDVNILTYARFEPQFTDEKILELWHKAGIRVIEWGLESASQEVLKKMIKGVSIRQVQNILDISSQKGIVNKLMLFHNYPGETVDQLKMTVDFLRK

SEQ ID NO: 11079 - protein, 224 aa, Myxococcus xanthus
MLLPHLTDHDNFSGLADSLRSTAALLRRYIIDFRFCITAERLPQTLPALLSELRKLSESPEDRALLSRFPVIEVPFTAGGDDSAQLANALAELWSRWPQLNDSVNLSRGGFVKHFYALKELWHLARIMNQEQSVEADIAKLRTGYGVEAAVEARIAAFDQAFLERYASLGQYNEWRHSSNSVVLEFDLDSIADTYECQSPVFVDNRWILERNSLELATDKGRKS

SEQ ID NO: 11080 - protein, 228 aa, Myxococcus xanthus
MTALAAFYTLLHRLTGSEDVVVGVPLANRAHPLTEDLIGFFVNTLALRCQVQGALSFQELLQRVRTLTLEAYEHQDVPFERVVDELGIERSLSYNPLFQILFVLQNTPLPPLRLGNLSLSQVTPNFDAVKFDLVVILTEHDGGLEASWSYDADIFDEATIARMHRQYELLLRQLASGADRSLARLELQTETERKQEGVLKDTRRASDFDRLRRIKPKPVTPQRTGEEG

SEQ ID NO: 11081 - protein, 344 aa, Myxococcus xanthus
MNVLDKVLTLRPGNTVARVGAGSRVPLLNPRELLRALAEAPVALPCLPVQAKGALPGLLRAARSEDAVLGLACPHPLSDRGAPERFVVAAHQAAAEAEHARPLFLQAGPIRVARADADTLDALKDGIYRVVDAGFSLVSLDLSRLDSYEAVEAVNALVAPVTERELALELTGPAASGGFVDAYRTLLEGLRQWKVPVDFVRVPESALGEGEPDVRLVRSLVQLPAEYDAVLSVGEAGAALAGGLPTYVAAGVRKVACVGGFDRLALGAWPPQVRASVAKKATAAGLPSDQLLSVLEEQLPPLNDTAREKLQALSFMEATEVLSALGATRTGQASLRFLAEKRGD

SEQ ID NO: 11082 - protein, 957 aa, Myxococcus xanthus
MLVEWNDTAAALPTEPTFLSRFEARAAATPDALAVVDGERTLTYRELDTRANQLAHHLVSLGASPERVVALGLDRSVELVTSLLATLKAGAAYLPLDPSYPQERLAYMLSDSRAVVLLTTQTQEATFTGASVPRLLVEQEAVRLATLPTEAPASTAAGDSLAYVIYTSGTTGQPKGVMLTQRGLLNYLTWAQDAYAVKPGQGSLVHTSIAFDATITSLLTPLLAGGAVHLVPSGREVEALALALQQPRGHDLVKLTPAHLQVLSGLMTPEALSKLTGTFVVGGEALPPSTVAFWRKHAPQIRLINEYGPTENTTFTCCHPMEALDEGTAPVPIGAPVTGTRVHLLDAGLEPVPLGAPGELYCAGDGLARGYMGHADLTAERFLPDPFSRKPGSRMYRTGDLACWRADGSIEFLGRVDNQVKVRGFRIEPGEVEATLLRHPAVRDAAVVAAGERADTKRLVAHVVLRDASAITSGDLRDYLEPQLPEHMIPSAVVFHHALPLSPNGKVDRRVLAQAPLDSPEAGGPLSAPRTAAELTLVSLWRELLGRTHVGIHENFFELGGHSLLATRLLSRVRETTGIELPLKSLFEGGTVATLAERIEAASRSRQAAARPLSPVDRGAPLPLSYSQQRLWFLAQLEPHASTYNIPGALRLTGALDVAVLERCVETLLERHEVLRTAFESQEGRPVQRIVPSLTLKMPVEDLRALPAGEREARAPGDQKDGGGPPVRTRRAPVAARPPAAAGRTGARLAGDAPPHRLGRLVTGSALPRDDSALRGVQRRQAEPAAAPANPICRLRVLATALAPGRAPRPPAPVLAPAAGRSPRAARVTLRAPTARSSEPPRQARCWTAQPPGHRSAPEARKTGGDDALHDRAGGLLHAASPADGQRGRRGGGSPGQPGPPAHRGFDRVLRQHPRAPVPGSRRPLLPGTPSARQDADARGLRAPGRALRARRGRARD

SEQ ID NO: 11083 - protein, 1571 aa, Myxococcus xanthus
MTAESFVFPVSFAQQRLWFLHLMQPENPSYHIAGAVRLGGTLDTAALRRAFDVLVERHESLRTTFAQEEGQPVQVVAPEGTASFAVTDLSSLPRDEREAEARRLATEEIRQPFDLMKGPLLRTRLLRLADTDHVLVLTMHHIISDGASLGILIHEMTQLYGAFIAQREPELPELPIQYADYAEWQREWMATEGALDAHVAYWKQQLAGAPVLQLPTDRPRPAVQTQRGDALPLHLPTALVQALQQVGQRENATLFMTVLAAFQALLSRYTHQTDILVGAPQNSRNRVQTESLIGFFVNTLVLRADLSGNPSFRELLQRVREATLGAYAHQDIPFEKLVEAVQPARNLAYTPLFQAAFNFQGMAGQVLALPGVTLQQLDLQPGTSKFDVTLDLQETPDGLRGFVEYNSDLFDRATMERFAGHFQTLLAGVAANAELRLDALPLLTSPERHQLLDVWPTLKSFPGADTLHGRFEAQVRQRPDAIAVVADGERLTYAELDRRANQLAHALITRGVQPEGLVGLCVERSLATVVGILGILKAGAAYVPLDPTYPADRLAFMVSDSRMSLVVAQRPLIDRLPADGTALLILDEATEELARQPAHAPGLATTREQLAYVIYTSGSTGLPKGSLLPHGNVMRLFEATEHWFHFNENDAWTLFHSYAFDFSVWELWGALLYGGRVVVVPYLVSRSPDAFFRLLSDERVTVLNQTPAAFRQLIQAEERLGAEAPPLSLRYVVFGGEALEPATLVPWFRKHGDTQPRLINMYGITETTVHVTYRPMDAAEAERTQQSPIGVAIPDLQLYVLDARLEPAPIGVAGEIFVGGAGLARGYLGRPQLTAERFVPHPFSREPGARLYRTGDLARFTADGQLEYLGRIDHQVKIRGFRIELGEIQTVLSLHPAVREALVLVRESSPGNKSLVAYVASSEQPPPSVNELRQHLLGKLPDYMVPSAFVMMERFPLTANGKVDRKALPEPEGARADLADPYVAPRTKEEEALCAIWAQVLEVPRVGIHDNFFALGGDSILSIQVLTLAQKQDIRFSLQQLFQHQTVAELAAAAAKAEPAREVFPRTEPFGLISAEDRAKVPESVEDAYPLARIQAGMLFHMELAPTSNIYHNTDSFHLRLKAPFDPARFVEAVQVVTARQPVLRTAFDMTSYSEPLQLVHREAQLSVEITDVRHLSTEAQDAEVRKLLEDEKQQHFDLACPPLLRFFIHIRGERDFQFTLTECHAIIDGWSLHSTLVEMFNHYYALVNHQEPPRFEPLSITYRDFVAMERQALASEDHQRYWRELLEDGQVMRVPRWRRPLAEGEPRIATVKVPISPEVSEGLNALTRTAGVPFKSILLASHLKVMSVLSGQEDVITGTGVNSRPEEGDGSKLRGIFLNTVPFRLKLAPGSWLSLVRAAFDAERALYPYRRYPMAEIQRQWGRETLYEVMFNYMHFHVLHDIAGTLAELEALSTIPLRGNQRHPRRPLPDRAPHAGAHAGAGLQRRRAGPTPRWSKLARASRASSTRWPWRLRPRTTPPAHCPPTCSAGCWWSGTTPPPRCPRSPRSSPASRPAPPPRRMRSPWSMANGR

SEQ ID NO: 11084 - protein, 1127 aa, Myxococcus xanthus
MEGERLRFNAPPGVMTPDLLGEMKSRKEELVSFLQQVGQSLQGAADLIPAGPRDGALPLSSGQQRMWFLEQFQGPSGAYNMPAALRLEGALDIAALQRSLDEIVRRHEVLRTSYGQHQGKPFQRVLPPASVTMPEVDLQHLPADARQAEVRRRATEEASRPFDLSRDLPLRLSLLRLDPREHVLLLTLHHVACDGWSLGVLIRELAALYRAFSTGEPSPLPEPTLQYGDFARWQQERTTRGDLQPHLSWWRDHLAGAPALLELPTDRPRPANQRFHGATHRFTVPAELTARLKQRSREAEATLFMTLLSAFGVLLSRGSRQEDLVIGTPIANRVPQTEPLIGLFVNSLPLRLQVDGARPFSELLARVRQDTLSAYAHQTLPFEQLVEALQPARDPSYSPLFQVLFTLQNTPSEVLSLSGLTLEQLEFESGTTQFDLSLSMAETAQGLVSELNYNTDLFDAATVERMSGYFLTLLAAIAEDPTRSVSDLPLLTGPERLRLLREWNDTALDLPLPGSLHGLFERQAARRPDATAVRFESRALTYRELDEQANRVANHLRQLGVEPGHRVGIFLERSVELLVGLLGILKAGAAYVPLDPLYPPDRLVHILDDSGVSLLLTEPELAAQVPAYRGKRMVLAEATGAPTTPPQVMLAGTNLAYVLYTSGSTGRPKGVAVPHAAVVNFMASMQRAPGMTDQDTLFAVTTVAFDISVLELFLPLSVGGSVVIASSETAVDGTRLMRALVESGATVMQATPSTWRMLLTLGWKGSPTLKLLCGGEAIPSELVEPLCSRGASLWNMYGPTETTIWSTTTRMEPGRRITLGRPIGNTQVYVLDAAMQPVPMGVTGALYIGGHGVAQGYLHRPDLTAERFVPDPFGQEPGGRLYATGDLIRALPDGTLEYLGRGDGQVKLRGYRIELGEIEARLAQVPGVLEAAVKLWDVSGHAELVAYVRPGTKPAPEALTIRQHLASHLPAYMLPSHFVTLESFPRTANGKLDRKSLPAPSANQRASAAYEAPRTPMEVQLAAIWRDVLAVEQVGARDNFFDLGGQSMKAVQVVARIQESCKVDVSLRVLFEHPTLDALAKHLETLQQPGAPAAPPPLVARPRQARRVQAATRAELNLPDSTSSKKE

SEQ ID NO: 11085 - protein, 630 aa, Myxococcus xanthus
MLKVDKDGSVTAIDLGSEGGTEVRGQRLVLPTALNPGDVLMVGGSQVEVLFGATQPERPLPAGARVAGPVFQGPVATPPPPRGMQMQTQTRADLPNLVPTPPPPMRQVSTALGNRVERVASPGVIPVEPPRQVPPGLQPRTTPSSARTSTPNVANTATPRRTVAPHLQEPLPPEAMPTPEARVLQVALLWGDTLLEVQHFKDGVPVTIGEAKQNFFNVFAPSVGKSHVLAVSKKDVLEVRAPAGSRAFVTNQGNVRTKDALRAAGALSGQAGDDAEQRFTLGLHDRVEVSLGTVSFVARYVKPSPVITAASLKDSDFTFFKITSICMLAGLAVVLKMVQSPRPELPHSADILESHQRVAKFLIAPEKRLEAKKLQLSAPEEGAKAKHEEGKFGKEEAKQQEAAPSKPGTPVVDKSKKEKDRQAVGKAGLLGAFKGMKGGASDVFGPGGFGTGINDALGGLKGGAAMGDAQGVGGVGSRGTGKGGGGTALGIGGLGTQGTGRGTGGSGGIDLGGRGKSITKVIPGKTTVVGGLDKDVIAKVIRRHQGEIKYCYESELNKDPSLAGKVAVSFVIDPAGAVSDASVSETTLNNAAAERCMLSRIRRWKFPEPKGGGVVSVTYPWLFAPAGAGG

SEQ ID NO: 11086 - protein, 87 aa, Myxococcus xanthus
MHRGVDGRLLTGVCAALGRELGVDAALIRVGFVVALAVSGGTALMVYLLLWAFTPPSATGTAPLRRTYNWLSGLGNSERTPRVERRV

SEQ ID NO: 11087 - protein, 80 aa, Myxococcus xanthus
MDPKDYLKRSAGIPLDPKKQKDPEEDGERVPAEGRAEFLNDVSEHNGGQRTDVDVPWRKGPELQRGQRDAYNAESDKKKG

SEQ ID NO: 11088 - protein, 112 aa, Myxococcus xanthus
MSTDQAPPYWLLISVLFSNQPLSPSLAMTLHQVAYELHQRGEGAKEVAGDMVSGRVVNLRKDVSFGGIAGPAFEAEIETERGSGVVRFVLTRQGLEMMKQQPAEPPRPKYLN

SEQ ID NO: 11089 - protein, 27 aa, Myxococcus xanthus
MVGTERFKEAVQRLELEGITFRELPTR

SEQ ID NO: 11090 - protein, 206 aa, Myxococcus xanthus
MSYGTADESVNLDAVEALLAAVKEAMAPDGRVYYGTFPSEVRPEHVTPEALELLKRYVHNDNLIIGGQSGSERILQSTRRGHDVETVVRATRIAVECGFVPNVDFILGLPGEEPEDVDATVALMEKLAGLGARVHGHTFMPLPGTPFRDAPPGSVDEAHTAQAGPAGLAGAPCMGTGSSRSRSPRALPHAVARARGKGSAERARQT

SEQ ID NO: 11091 - protein, 466 aa, Myxococcus xanthus
MQRLWEGGRQTDEVAWLAAYASLGVGDDAAAFQWLERAVERGMGSPGDLLHDKSLEPLRRMPGYDALVARARENALKARAEGNVGAGLEKATPAEAGLSEPALAAFVKAAEESGSSALVVLRHGKLVGEWYFGGETQRIESMSATKGVVALAIGLLIDEGRIPSVDAPVSTFFPEWKDGLKGKVTLRHLLSHTSGLAANAHAMDIYESRDFVRYALDSHVVDVPGSQFFYNNKATNLLAGVVERASGEKLDAYLMRRLFEPLGIRDVFWQKDPSGNPLGMSGLRLHPVDFAKVGQLMLQRGVWQGQRILSEAWIQECTAAASQAHTPTAGLLWWLVYDKAFRVLGQDMVNEARRNGMPEASLSRLRDVVDKPIPAGDFMQVLSERLGGMKGVMAFMEKSARIPLRTHVEGAPRGYSARGSFGQLLLVVPEQDLVVVRMAVPDGRVPPDVMEFPAFNTLALSLVPSP

SEQ ID NO: 11092 - protein, 198 aa, Myxococcus xanthus
MVKISFLIDSTKLPTGGSSVSTAVAVSHQTFLVNDNPHPNQNDPDYAVPVPSGESVRIYIQEANYASTVGLAPNGIIVHAFNGAPVSDAIMNDATKRPIDIPNFDLDLGPIPDFIGFVGDSPKWTQTPPSWSNWPNEPLIDQQLRAGWTPTFVPYITFNASKLVSGLLEYGVVFALTKDGANVQYFYFDPFLKIGSSS

SEQ ID NO: 11093 - protein, 305 aa, Myxococcus xanthus
MVNADRLQVVTSPVAEGKYALKATVHQGDDPINASGNRNELVYISNEPVGSEYYYRWKVMFANDFPSVDTWQLFTQWHHDGCCGSPPVEFYVKGEEIRLSLPGTSEIPWRTKLTRGVWHEFILHAKWSSDPKVGFVELWHNKELVLPKRGAMTMYSGQRNYLKLGLYRSDTVKPVGVVYHDGFIQATALSDVLEQKPEPPPVDAGTPMDAGSPMDAGSPEDAGRVDPDPVDAGGAEEPGPQPEADAGTPAWDAGTEPGPNVPPPGGISSDEGAAAQSGCSSTGGSAAAFALLGLMGLAGYRRRKG

SEQ ID NO: 11094 - protein, 210 aa, Myxococcus xanthus
MVQKGQFLERATLVPVGSEVMEGTTHRGSRAPPLLVIPPRPDEGGGMDHVIAAELVWAAANAGFPTLRFNHRGVGASQGKRGRDLELLADAEAAMQMLLENAGANALAVASLHGGAQVALALQAKHPAVGGLCLVAPALVAPEVLSRVTCPLLVVQGEEDTRLPRAAVSAAIARTGGDLEVIDDAGPTFQRNLPQVGRAVAAWLRRLSGG

SEQ ID NO: 11095 - protein, 597 aa, Myxococcus xanthus
MRKVRWTLGGAALALTLSAACASASREQDTPPPANLRALDARDVVAGAIVVDFKDGTTKAEFDAWEADWGVDLELNSVESADEALTVAVGVDDVDGVLERIRQHPAVEAAEPLMEVRASFTPNDPHFAQQWNLRMIDMPKAWERNRGKGVVVAVLDTGIAYEDHGDFKQAPDLKGVKFVKGFDFVNDDEHANDDHGHGTHVAGTIAQATNNGEGVAGVAFEATLMPVKVLNHFGGGNTADIADAIRFAADKGANVINLSLGGGAYSQVMASAVEYARKKGVTVVAAAGNGGRATVEFPAAYPGAVAVSAVGPDGVLAPYSSYGKELDIAAPGGDKRRGDQGGILQNTLDPRDVSRFVYASYQGTSMATPHVAAVAAMLYAAGAKGPDEVEQALYAGAKKSADQAWSEQYGHGLLNAEASLASLRGGGLAQWPPLYWALALLAFVLLTLRGRARPGYLNVLVRPAFLIPLLLSTVGAFFLRGWFGGAEGAAGDVVQVASLPLPDWERIIFGRGRTVNPLFYSALIPLLLSLPAIKWRGLRSAMGGLALGFAGFLAYTAWAGAPALAWLPFAFLAKPWLGFNTVICLVIARAMLQKEDA

SEQ ID NO: 11096 - protein, 94 aa, Myxococcus xanthus
MRRLVSAVVVLGLWAAPSVAMSQEPRDTVKIVQEEDRTVVRKKTVIDFTDVAVEGELTKPEGSYVLHRKKTDFQSLIKVRDNFDPELQKSVDNL

SEQ ID NO: 11097 - protein, 71 aa, Myxococcus xanthus
MKLTGRVVFRDIETGVWVLEGDDGTTYQLAGGDRKLKKDGQRIEAEGRVDGDTLTSAMVGPIFHVSTYRFV

SEQ ID NO: 11098 - protein, 236 aa, Myxococcus xanthus
MREPMSPPRWLGADTLWLAGWLSLAPAVGAAATPPATVEGRVADQVVAIIEGQVLTLSELRFEARVALLQRGGVQALELPLDEDTLRGALELIINQRVQVLNADRLQAFPAEPAEVQARVDAFQAVLGGEAALKRFLSRHDVDVQGLERVLARGLRAERILDSRIRLRAQVGETEVRRHFEQNADEYPEGYEAARAAIREKLVRGRYGALAAEELAQVRASAQVRRVAPFAREASR

SEQ ID NO: 11099 - protein, 161 aa, Myxococcus xanthus
MREESAPEARHGYTIRQMAAEDLSAVMLLEQASFKNPWSQDLLKRELQHEWSTILLVEEEREADGPELLGLAIFWIVHDEVHVLNVATAPKHRRRGVARAVMDEVLARGRAKRCTLATLEVRKSNEAALQLYRAFGFRPVGIRPNYYVDEGEDAVVMVLDF

SEQ ID NO: 11100 - protein, 43 aa, Myxococcus xanthus
MIRGGRVKDLPGVRYHIVRGTLDSVGVAGRKQSRSKYGAKRPS

SEQ ID NO: 11101 - protein, 156 aa, Myxococcus xanthus
MPRRRVVAKRKILPDPKFQDRLVTKFVNDLMRKGKKSIAEGVCYGAFALIEERAKEDPLKTFKKALDNVKPVLEVKSRRVGGATYQVPVEVRQDRRVALGMRWIITYSKARGEKTMQEKLAGEIMDAANNRGNAVKKREDTHKMAEANKAFAHYRW

SEQ ID NO: 11102 - protein, 90 aa, Myxococcus xanthus
LADVIQAAKDKLNKGKNPAVDSLSDIVYSELKAGRDIHLMGYSRGGLITSRALKDVGSGLRIEDGMSKAQVDHLLSRVNVETFGAAATTY

SEQ ID NO: 11103 - protein, 128 aa, Myxococcus xanthus
MSALLAYARRQPGVWGPGARASDEEAQEPGPTPSLVRLMLPWVVGATVSLGLLVAVDSRGLALNFYDAQHPLPTLESPQAPALHAERKALSALRASARRGELPMEAYYEERERQIRAHRIQTGPGLKP

SEQ ID NO: 11104 - protein, 829 aa, Myxococcus xanthus
MGRALGTRYLESVHFPPEAETELRNLHAKGFVVHVMRTTAWVNFLYLTWAMVRRALPPVRAVVNLRPWFTRPWRQAKQSGDFTQRFEHARQTGGSGLVFLRRTALLRPSGKETREDPFPALVAMARQSDKPVYLVPELFVWEKRPARLKPNWVDVVFGSPEAPGFLHSMLAFFRNYKRAQFRVGEPIDLQRFVAENPRDSDELLARKARSSLHVHLARETRAVFGPPVKPASRVIEETLRDRSLRKVVEECAAESGRKPESVLREARRNLEAIAAKPSPTALAFTSPVLEWVFNRIYDGMHVDEAGLHRALKAASHAPIVLCPSHKSHVDYLVMSWVLWNRGYAVPLVAAGANLSFWPLGTFFRRCGAFFLRRSFKGDKVYAASFKAYVRKLVHDGIHQEFFPEGGRSRTGKLLLPKLGMFTWQVESVLEGARDDLIFVPVAIDYEKVVESSSYSKELAGGEKKPEDLKALLSTPKVLAARYGRIHLGFDEPISLRAFMQARGINPDEPVSDEQKKGLVRALGNRVMYGISKVSTVTPHALVSTALLSHRRRGLTQREMADRINILRRIAVEEGSPQSVEMRNAPSNPETMGPIQDAMRTFISDEMVRTQEARGEVIYQVEEARRPELSFYKNTLMNLVASRSLVANAMLASGSPAPYDTVKERALFLSRLFKVEFIYRVGTTFDSIFAETVERLERMGLVLEENETLRVAPEAHARPDLEFLADMLRDYLEAYLLAALTLQDVATGAAEDRKSFVKMALETGRAEYHAGRITASESLAKVTLENAVAFLLDQKLLIEADKKLTLGPAATEQQARTQLVDDIRGYLKRG

SEQ ID NO: 11105 - protein, 1040 aa, Myxococcus xanthus
MFTDFFIRRPVFASVVSIIITLVGAISIPILPIEQYPDLSLPVVQVTATYIGASAETVESAVTTVLERQLNGVEGMRYISSTSSNTGVSTITVTFDPGRDLDIAAVDVQNRVATASAQLPAAVNALGVTITKAQTQLLMAFGLFDEENRYETGFLSNYADVFIRDALLRVTGVGDVRIFGERRFAMRLWLDPSELARRGLAATDVVNALRAQNVQIGAGQVGQPPAPPGQTYQFTVRVLGQLTSAEEFGNIVVQQGPDGSLVRLKDVGRAELGAENYGQLLRFNGREAVGLGIFQLPGSNALDVRDGIVAELKRLKGNFPPGMRYQRAFDTTAAVQASIEEVLVTLGEAIFLVVLVIFIFLHGWRSVLVVATTLPVSLVGTFLFVNAFGFSINTLTLFGLTLATGLVVDDAIIVIENVERTMEQDDVGPREATHRGMKQVAGALVAIALVLSAVFVPVSFFPGTTGIIYRQFALTLAFSISLSALVALTLSPALCAILLRPHEGQKWKVFRMFDRGLDAFRDAYGRMLAKLIGPLRWPVVIAFVVCLAGTILVYRLTPTGFIPGEDQGYLIIAVQGPEGTSLDYTRNVLLQAEDVLRQQPEVADIFTVGGFSLLGTGVNYGTLFVNLHPWDERKRPDQSVAGLVERLRHPLMAIGGARVLPFEPPAIRGVGSVGGFEFVLEDQQGGRTLAQLAQTTDMLVGAASQDPGLRGVFSSYTANTPLLDVQVDREKALAMGVPLDGVFSTLQVYLGSQYVNDFTFASRVYRVYVQAAVPFRNEPRDIDALYVRSAKGEMVPLESLVQVRPITSAQNIQHYNLYRSATINGQAAPGSSSGQALDTMEAVARKTLPVGYTFEWTGLSQEQKEAGRSVLLIFGLGVVFVFLVLSAQYESFALPLVILLGVPVAMLGALGLQNLRGLQNDVFCQVGLVMLVGLASKNAILIVEFAEQLRHEGRSVEDAAIHAAQTRLRPILMTSFAFLMGVVPLMLASGAGASARKSLGTTVFGGMLLSTFVNLIFIPVLYVVLEAARLRVRPPKPHAP

SEQ ID NO: 11106 - protein, 332 aa, Myxococcus xanthus
MSARIRERQESWGTIIYDNLRDEFSAKVFEGCVPVPRSPIGCGWLVTAPCNLVCIHCYGNVEDLPSKRLSTPQQLKVADEVIRAGIMRQILSGGEPLMRRDTLNVIDKLTDHGVATILGTNGTFLTQQMMKTVSRCTRVEISLDSMDERVNNEIRPSRNAKGNTYQETLRAMGLCVDHGVAPRILTCLNRHNSQHVEELAQFIYERGIRDWAISWTLSAGRAYHIYGELMPEETSHVTAAVERLRVRYPDMQIRLSDRTVNYSRYYFLIWPDGIMGTEEIVTGKKLFFASLVTGSVQDGWKQENYDLDAHFRKWVGDRIEVIPAEGRKPLVA

SEQ ID NO: 11107 - protein, 573 aa, Myxococcus xanthus
MSTSVYSRYRAAFAQALANALGVPAADIEAQVKPAEPAHGDLSFATFPLAKAQKKAPPAIAAGLAQSLSVPGLEIKAVGPYVNARFPTLPFTAEVIDAARSAGIRYGGDEDAGRGKTVAIDYSSPNIAKPIGFHHIRTTFLGHCIANIYRALGWRVEGINYLGDWGKQFGLVAVGFQEYGDPARIDDMGHLVEVYVKANKRAEAEPEFDEKARAFFRRMEAGDAEALKLWNQFRDTSIKGFKKIYARMGIEFEHIEGESRYQGKMDAVIDQIAKKPGVKESQGALIVDLTYAENEPPILLKKNDGSTLYATRDLAAAQDRYERFQFDKSLYVVAQDQALHFRQVFRALKEMDLPWADRTVHVAFGRIHGMSTRKGQVVQLNDVLDEARERVSVKVRENVEAGRIQTDDADALSEQIALGAIAFGDLKHKRASDYTFDWDEVLSFEGHTGPYLQYAHARAVNVLRKDGGAPASYDAALLTLPEEQALLREIMRLPEVVRDAAEQYEPSLVARLLLDVASALSRYYTLGNQERDKRINVEGNDALRSARLALIDAARVTLAAGLTLLGIPTPDNM

SEQ ID NO: 11108 - protein, 518 aa, Myxococcus xanthus
MSRHLTDNAGPTEALRAHLQTIHTLLKPKVCYVARYFPSREQLHVEHVRGRYDDRVTAAVPGEGVVGRAFSQKALLRDGDTVAVPLEGPQGVGGVLVVLGSRREPSDTLLQSLAAQLTAAYEVARLRDDSARRNKDLQTAIAGLKSLEQNREELLGNVSHDLKNPLTTIKSYLAMMGREKLGPLTDAQRRAVQICDRNSDRMLRMVNDLLLMSRLQSGKMQLNQRPFGLKAVAEEVVRSLGALAEHCKVRVVIPPCPEVFVRGDRERIAEAIHNLVENGIHHSEADDTVEVRVSAEDGLAMLTVKDSGPGMSSEALEHVFDAFYRATPGMPRPPGAGLGLPLVGKIVALHGGRMESASVLGEGSTFQMVLPMFAGAVSAPEMAQAAPKSGGILLVEDDADCREVLQQVLEQEGYRVMATSGASEARSILSHIRPAMVLLDLRLSEEDGQSVLRYIRGNESLADIVVYIISGATEVASLTSGQGLERIDGFFEKPLNLPKLLDTVSAVVRPSRRAPAVP

SEQ ID NO: 11109 - protein, 243 aa, Myxococcus xanthus
MGLLDIFTGGSGPEKALKLKPKVTQKYGDPATRQKAIQQLGEMKVPEAVSVLLSRFTLTVDPLTTDADEKEHTFELVKSFGKDVAVPPILEFLRTSEQAASWALRLLGELTSEEETITACVSALQHLSAHYTRNPEKKVVLLHHVAGSQDPRIPPTVVPFLEDMSDDVKIAALKALGVFKYEPAREPMLKLLTADETARRVQTSVLSALAEGGFSVEGYREKVEPLLVEPYALGNDQRIQRRA

SEQ ID NO: 11110 - protein, 391 aa, Myxococcus xanthus
MADDYYQTLGVDRSASAEDVKKAYRKLARKYHPDVNPGNKAAEEKFKQVSAAFEVLSDTRKRKLYDEFGPDAEKIGFDEKKAEAYRAYKASAGSAGAGGIPYGAEGFDLGDLFGDLFGGRGGGAAGGAPGGFDIGEMFGRRGRNAGPERGEDLTVRVQLTLAEAVSGTERPLAFNRPGRCSTCSGRGTSGPVSTCNVCNGTGRARRSGSLFGGAGACPNCHGTGKAAPPCPQCGGAGVKEELARLTVKIPAGVHTGSKVRLSGQGAAGTRGGPPGDLYIETEVAEHPLVRREGDDLHLDLPVTVSEALLGADVRVPTFQGEVTVKVLPHSQSGRRMRLKGRGVPSLKGGAQGDLYLHLQVKVPEETTAEARAAAEALARAYQGDVRRELTL

SEQ ID NO: 11111 - protein, 65 aa, Myxococcus xanthus
YGRTLESEMAPYLAHGLLHLLGHDHERPRDAKRMAALEEQLLGERGMVADSLQVDAKARRARSLM

SEQ ID NO: 11112 - protein, 440 aa, Myxococcus xanthus
MLRPSLIASCLLGLLLLAAPARAASMPPWGTGESQGEDLAILLVTFSPGDDVPSWWGHGSLVVEDRRRQMSRLYNYGMFSFDEAMLARFAMGRLEFWVGQSSVGGTFRFYQAEDRDVRVQELNLTPEQRVVVAKRLAENVLPENREYLYHHYNDNCVTRLRDMIDVATGGQLREADRAPGRMTLREHTRRYTSVNAPMSVLLDFMMNDEIDRPITKWEEAFLPDELETQVAALQVKGADGQTASLAAKSWNYYESSRRQRPPAAPPPWGPWILALGLALGGLAVGLAVWERQRGSRVARLLLGLENAVVGLALGLPGTALFIMGLVTDHTVTHRNENLFLANPLTLLALPFGVALTWGSQKARMRLFKVWTLLAALGVLGVVLKVLPPFDQDNWRLIALILPISLGMAGAFGLDRVLARLPRADRASAGRRDAVASLKTP

SEQ ID NO: 11113 - protein, 246 aa, Myxococcus xanthus
MDINAGAGGTDSMDWAAMLLRMYTRYCENKGWKVEINDEVPGEEAGFKNVSLRIEGDFAYGYLKAEVGVHRLVRISPFDANARRQTAFASVDVYPEVDDTIQIDIPEKDIDLKFIPAAGAGGQKVNKTSSTAQLRHLPTGIIITCQTERSQSANKDMAFKILRGRLYELEMKKREAARDAAEAQKKDISFGSQIRSYVLAPYRMVKDLRTGIETGNVDAVLDGDLEEFVTSQLLGVKNPNRSAGAD

SEQ ID NO: 11114 - protein, 47 aa, Myxococcus xanthus
MLVALRDIEGLSYDEIIDITELPEGTVKSRLHRAREKLADLLGRLEP

SEQ ID NO: 11115 - protein, 113 aa, Myxococcus xanthus
MNHREARALFLALADDELPAPKAQEVRTHLDGCDDCRQGWQRYSSTVQRLQRVEREKAPPALASLVMNRVRRKRRFGLRGLHTLHMNYRLPVEVLIPLLLAAAVAAFLVMVDP

SEQ ID NO: 11116 - protein, 517 aa, Myxococcus xanthus
MAETENKSEKSAGEGDLGTKEQEIYDQRLEKAAKWREAGFNPYGNGYRPQHQAAEIHEKHAAQSAEEIEQAAPPPYDVAGRVVAMRSFGKAAFIKLRDRSGEIQVHMKKDALGDSYETFKLCDLGDFLAATGPVFRSKTGELTLSATKFTPLTKSLRPLPEKWHGLTDVEVRYRQRYLDLVSNPDVKQTFLRRNKLIRFIRNFLDTRDFVEVETPMMHPLVSGAAARPFTTHHNALDIDLYMRIAPELYLKRLVVGGLERVYEVNRNFRNEGISTRHNPEFTMLEFYQAYATYEDLMDLSEEMISEAAKAVTGDTKVKYGDHVLDFGKGWKRISMTEAIREVVSGLSDKDMADADRLRHELLKTSHSEAERRAIDTMNHGELVGALFEHHVEHTLIHPTFITHFPTAVSPLARRNDQNPDVTDRFELYVAGREIANAFSELNDPLDQKGRFQAQLDAKQRGQQETMDYDEDYIRALEHGMPPTAGEGIGIDRLAMLFTDSQSIRDVILFPLLKPLAK

SEQ ID NO: 11117 - protein, 172 aa, Myxococcus xanthus
MELIDVIDTQGQVVGSAPRDQIYGQKLPHRIVHVMVERDGKVFLQRRSRHMTFMPGHLCTSAGGHVSAGEAPLEAAQRELQEELGLEGSLVPVAEFVFDDGHHRRIFLYRARMEGPLRFSEREVDGGLFLAPEELGRLLDEPCHPQLWPCLERLFPGPSADARTRWKQSSTR

SEQ ID NO: 11118 - protein, 601 aa, Myxococcus xanthus
MVAFISGFIGASRAQRLSLPEATIGVLYLGLPIPIILTLMERLPGLQLALGYRLREVTYVAGLIGRPELGYWLVFTFLVLALVLGINTGFIAAGSGRVDLKLGFELFVARRHVAVFRPSLLLGTLAVLMLGIIPPLLIYFIIRSAEAAVERTRIRELGLKDPLAAASDLNRLKLREQSPTMMMTALSVGGVGVGVMALIIVLSVMSGFEADLQQKILGTNAHAVVSKYAGDLPEYAKVMESVRKVPGVVGQTPFIINQVMIASEGNVDGVIIKGIDPGTVGEVTDLPKNILGGGSLDILYTPEKIVHRGLPDEEPAEESGVEEDDIIRRSGTPKKAPVLPGIVIGRELAASLRVVVGDRVNVVSPLGTELGPSGPIPKSRAFRVAAIFYSGMYEYDSKFVYILLNEAQDFFDVKGATGIELKVADIDDARRIASQVVKVLGGYPYRARDWGEMNKNLFSALRLEKLVMGIILSIIIIVAAGLIVATVIMLVLEKRKEISVLKALGVPDGGIVKIFLAEGLQIGVAGGFLGLISGLSWCVFIEKVGIKLDPDVYYIPAVPVRVEPVQTVLAVVIAVLVTYLASIYPALKASSVEPVEGLKAE

SEQ ID NO: 11119 - protein, 224 aa, Myxococcus xanthus
MALLSIRNVFKSYFLHGKRIDILRGVSLDIQRGELVSLVGASGAGKSTFLHVLGTLDAPAAGEVMFEDRSVFSMNDAEIAEFRNQTIGFVFQSHFLLPEFTALENVAMPALIRRQDRTAAYAYARELLERVGLGHRVDHRPGELSGGEAQRVALARALVLKPAVLLADEPTGNLDPATGEGIHQLLREVNREQGITAVVVTHNETLARSMPRRLRLAGGEVSEA

SEQ ID NO: 11120 - protein, 184 aa, Myxococcus xanthus
MSLRTTIAATAAALSLALPVAASAAELKVAYVDLQKVMLEVDDGKAAKSRLQKWLDDRQKEIDKEQNALRAEKETLDKQASAMSAESKAQKEAELQRKVMLLAQKWEKSRAEAANKEQQEMKPIIDKIDSIINTIAERDDLGFVLERRDSGIVYARSQHDISNEVIRAYNSSKKTAAKDAPTKK

SEQ ID NO: 11121 - protein, 406 aa, Myxococcus xanthus
MTWASSSSAATPASSTPARSTTSPTRSSGRTTARRRRRRRTPRRRSSRHSQLVQTAPMPRQLGELAAHVGGELLGDPSQLIHGLNGLEEAGPGDVSFYGNPRYRRQFEATRASAVLVGADVPPREGVALVRVANPHLAYAKLLRLFHAPERPAAGVRPGAWVHPEATVHPEAVLLPGASVDRGGRVGARTVLYPGAYVGEQAEVGEDCVLYPNVTVRERCIVGARVILHASSVVGADGFGFAFNPEGEAGPEHFKIPQVGIVRIEDDVEVGACTCIDRATVGETVVGRGAKLDNLVQIAHNVRVGPLSLICAQAGVSGSAEVGTGVVLAGQVGVVGHIRVGDLAKVGAQSGVAHDVPDGQVVSGSPAVPHREWLRASAAAGQMADLLKEVRALRRRVETLEKEKGP

SEQ ID NO: 11122 - protein, 153 aa, Myxococcus xanthus
MDIGEILNLLPHRYPFLLVDRVVEIIPGQKLTAYKNVTINEPFFNGHFPGHPVMPGVLILEALAQATAILAYKSENMDPSRKLTYLMGVDGARFRKPVLPGDRLQLEIEVVRHKGAVWKTKGLATVDGARVAEGEFLATVVDKDADAAESAAS

SEQ ID NO: 11123 - protein, 109 aa, Myxococcus xanthus
MLLGQADVGHTVVVHNGHVLALEAVEGTDEAILRGGRLGGNSGTVVVKRCKPQQDRRFDLPAVGPHTLEVMQQVGARVLALEVGRTVLLDAPVLFAGAESRGITIVGVP

SEQ ID NO: 11124 - protein, 294 aa, Myxococcus xanthus
METVLYSLTSVLLRSGNSVFDRLSYGLRRQSILVLNFANNFVPFLLLAALTPLLPMTDRAGWALYGNARLALFAVSVQGVAFAFSYGFRHLTVARVNIASRIGDVLIPLALMLSGRTVHWTEYLFALAVSGCSLLAAGGGSDSRRALWLPAFFITVAVLVQSLCGELFFQGQPSGVASNLEVSTALMFWRSAACLVLLLLFGARGTLGAQLSELVVDGRARTNLLVRALFTVGNQVAFVMALAAGNRVVAWPILNSVTLFSLVFANAFIQEAPARREVFAVVAIVALAVLKAAL

SEQ ID NO: 11125 - protein, 340 aa, Myxococcus xanthus
MNARLLLLAFVLSSPMPVLADAVRVSLEGRAVLGEKLPALLVHIEEPIAGFEVKLKRSDGQDVEVKGGGSPGLTRRIELNQPEGRFRYEGALTVRFPDAESGVMPLSFDTELYGTLKLDVRKEDVDVAARRLRFVLSRPAKRAELTVLMDTGKKAFEGEVPFKGEAGGTPLELTWPAAEGRVMKISLRAFDTAEFYTGVDLYPWQVDIPHEEVNFASGQADIPATERGKLDKSHALIVDALTKYGRFASLRLYVMGHTDTVGAAAENLDLSVRRAKSLAAYFRKKGLRVPVYYEGLGEEAPAVATPDETAEAGNRRAEYIIAVEEPVLQHAPRPPRWRKL

SEQ ID NO: 11126 - protein, 155 aa, Myxococcus xanthus
MDRFHQKAWALLGLGVLGSTGCAHQARLAERQGVEAEKCELVHRLLREPVPSQVVREVVAAGRDEPAPVVVYVRRPEEAMLERFFSGDAPSCGDATFKVVQENVLDAVVVYLQEIQDGYAYDAHRASHDELSLEGKPQGLLKRKGPEWVAIPGPT

SEQ ID NO: 11127 - protein, 220 aa, Myxococcus xanthus
MAGALRAHMGDYPVRSQEFGRDLQAMGLDTDDLKIAMQVNGRIALKDLLAHGRGELRMAYSLLWFLKLTGGVTFSSTPVATGTDVLSAAVLPDRIAPRKRKALPPETAASLREEALRIITRSYFGGLGLDIAADAEAVERAYHETAMRFHPDTYAEFDISDLKDLLELVQDPLSASYRVLSVEEKRKAYLQYLFSRMERGGGTRRWSWMRKSRCAGASPP

SEQ ID NO: 11128 - protein, 208 aa, Myxococcus xanthus
MPEYASLFLVSLSAIFFVVDPIGVVPLFLAMTAGDSQEKVRRTAMRACLVACGMMLFFALFGGVIFKVFGVSLGAFRVAGGILLLITALDMLRARPAETRTTPSEEQEGVVKEDVAIVPLAIPLLAGPGAIATAMVLMAKGDTLVSAIPVLAAVVLTFVASYFILRASGLIQRVLRQSGVAIVERVMGLILAAIAVQFIADGGKELFK

SEQ ID NO: 11129 - protein, 234 aa, Myxococcus xanthus
MNPALVCIPTYNERENIEAIVQAVLETDPRVDILIVDDNSPDGTGQLADGLAAQDSRVRVLHREKKEGLGRAYLAAFRWALAEQYTYILEMDADFSHDPRYLPGILDAAEAGADLVLGSRYVTGGGTVNWGVGRQLISRGGSLYARSILGVGIQDLTGGFKCFHRRVLEAIDLDSVKSTGYAFQIELTYRTLRKGFTVREVPIVFEDRRVGHSKMSKKIFAEALTMVWKLRLTV

SEQ ID NO: 11130 - protein, 383 aa, Myxococcus xanthus
MTNPPRILVVAGEASGDTHAAELVAALRARRPDLTFFGMGGARLAAQGVELLFDAREVSVMGITEVLPRIPRILQILKGLAEAAAERKPDVAILVDIPDFNLRLAKKLKALGVPVAYYVSPMIWAWRRGRVRTIKRLVDRMLCILPFEEDFYREAGVSARYVGSPVVEQVPSPDTATAFRERLGLSKDAPTLALLPGSRMGEIRRLLPDMVEAAKRLSAERPGLQVVVPLAPTIDREEITSRFEGSGVTPILVEGRAPEVVGASDAAVVASGTAVLEAGLMQRPLVVVYRVSLITYWVGRLMLKVAFVSLINLLAGRRVVPELLQGEMTPERIAEEVRRVWIPGAPREEMLQGLAEMRGRLGETGAATRAAESVLELLPPGRV

SEQ ID NO: 11131 - protein, 488 aa, Myxococcus xanthus
TTALETSPRTAAPSFRAAGQDSYARIRGLSGAEGGTCLSGGRKCPPDAHQEATVMDPTRNAFPEKNRNLAVGSARLQEVQKAVHYYVDNHHCDVIGRVFHGMPGREARVSFSPTRRDVRLNAEGPRDVLHFGSYNYSGLNGHPRVVAAAEAALRRYGTTVSGVRLLNGTCELHLELERALAEFLGFEDCVTYSSGYAANLSVLSALCAEGDVVLSDMLNHQSIIDGLKLSGADIRTYRHKSLRSIESTLKKLPYEQRKFIITDGVFSMDGDVADLPGIVALAESYNAFILVDDAHATAAMGPNGRGTPAYFGLQSQVDVLTGSLSKGLPGIGGFAAGSKATIDLLRFGSNGYIFSASLPPPIAAGLLEGIRILQEQPELQERLHHNENYLRAGIRSMGLDCMNSESPIIPILMPAYEKTFELTRLLHLEGIYVNPVGYPAVSKNRTRLRINVSANLTQADLDRFLDALDRCSRKLNLQDAPPLQQTGT

SEQ ID NO: 11132 - protein, 426 aa, Myxococcus xanthus
MDLKEQLLYGLPVFLAPILIELVVGLLRRKPAYRLNDLLTNVTMSLLTVLGSVVIAGATFVFYGYVYKHHALFSLAKDSAWTWVVAFFAYDFFYYWAHRMHHTMAWMWGVHVAHHSGEDMNFGLAVRQSALGELTTWPFFVPMALLGIAPEVFLGITGIQLIFQYAIHNTYVPPLGWLEYVLVTPSQHRVHHSRNTPYIDKNYGNILVVWDLLFRTYQPELKDQPPVYGLRSSLRSWNPFTAHFHYFVELFQKSAACARLADKVLCFIKGPDWNPPSLRQERFTGPPDGGPSATFQKYDPRLPLPVTAYCVTQFFSLAASILLLAWYLDTLSPGARAVTLGLVLFGTWSLGALMDSRAFAWRQEFARLAGIALLGPALALMEGVPLVSALPILLHPALSAAWLLRFRAAFHEGADTSTRGSSALAA

SEQ ID NO: 11133 - protein, 376 aa, Myxococcus xanthus
MQSFELHQATEAASIEDVRFHYLVLRNEGAVVAIVPCFRFRMSLTVIAPENVNKVVSQVRRAFPDFLFLNAFVIGTPIAICKDLLGVRADLPKARRDDVLRAISREVIARARHLKLGLVFMKEFTSQKLPEVKDVLSPRFNFVESAATTYLYLGEPGKSTFKERLRKKYRSLMNNRMARVQEAGMRWETVSDFSRYAAQMHPLYLQVLNRSKIRFETLSVDFFAQLPQRLGDRVFALLCFKGEQLVSFELFLKDAEWVHPIYLGLDYSLRDEGALYFNSIYKIVEVLESQGKSVVQLGQTSYAVKASIGAVVDRLYLAVHHTNPVLDQLLKRFGAELFPPTPLPRSQRVFRDMKENDDGLARHGIHFERLDAEGDE

SEQ ID NO: 11134 - protein, 397 aa, Myxococcus xanthus
MTAQAGITTKVVPRIQDVPQALWDDKVARGHPFKSAAFLSCLEDSFPERKFGYLIVSQGADVVGLAVITEERLDLSLLLPEQVGTLTKGVRKVLPGFLSLGLGMVGTFETAERHWWYDAQRVSEHDFARALLAACDEVCGDAALLLVRDFMEALPEDVRLESWFLQRGFKQVANHPMAMVALDGLSSEAHFQRLKKKSRQNLRKKLKDAEALGFQVERVRDFRPLIDECYPLYLQVHEGASEFKRNPFPRAFFETIAERMPTTSSFLTLRDSAGHLIAFILTGTGGGINNPFCIGMDYARTEGTPAYYLMMWKEIEHAARTGCRVVVLGLTSYFVKHTVGAELEGMTMAARIQSAWLRPLLNPLLPALLSEKQPQERRKFRVSTFDDDSQPPTDQAA

SEQ ID NO: 11135 - protein, 1055 aa, Myxococcus xanthus
MWIVRLALRRPYTFVVAALLLVFVSVQVIHESPTDILPEVDIPVISVVWSYDGLPAQQIERQITQYSEYSLANNVANLARQESQSFDGVSVARLYLHPGADVAEAMAQVTASSQSITRRMPPGTQPPIILRYSASSVPILQVSFSSETLTESQIYDHVNQRVRPLLGTVRGARIPQLMGGKVRQMTVDLDLEALEAHGLAPHDVASAVSAQNLVLPTGNIKMGAHEYRVTLNSSPETLAALNDIPVRRSDGRVVFLRDVAHVHDGFAVQTNIAREEGRRSVILSVMKTGDASTLEVARRVRELLPTIQAAAPEGLSVRLLADQSSFVTTAIHGLLVEGVIAALLTATMILLFLGSWRSTLIIAISIPLSVLAAILVLRGLGYTLDSMTLGGLALAVGILVDDATVEIENIHRNLAMGKPLTQAILDGAEQIAVPAFVASLSIGIVFVSVLFLEGPARYLFLPMGLAVGLSVMASYLLSRTLVPTLVQFLLRAEVQRHGQPQTGWLARLHHRFEEGFDRFRARYVRALQGALARPRRVLVFFLLAVLAAVGLMPFVGRDFFPTVDAGQLRLHVVAPPGTRIEETERYLSLVEDAVRELIPAEDRVSLIDMMGMPGGYNLALTDTSNVSSADGEVLVTLAPKRRVRTDAYVRLLREELPRRFPELTFYFQPADIVTQILNFGLPSPIDVQVSGSQREATYAIARKLEVELGQVRGAVDVRLSQVVNAPRLHFEVDRVRSSAVGLTQRDVANNVLLTVSSSSQVSPSFWIDPKTGNSYPVSVRVPETRVSSVEDLTRMALPTREGPQLLGDLTRVQREWTPVFVTHVDIQPTFNVRADVQDTDLGSVASRLERIVDRYREELPPGSRIQVRGQVESMRTSFDRLLLGLLFAAVLVYALMVVNFQSWLDPFIIITALPGAVVGMVVSLFATQTPFSIPSLMGAIMSVGVATANSVLVVSFANEQLALGASAAEAALEAGRVRVRPVLMTALAMGLGMLPMSLNLGEGGEQNAALGCAVIGGLVGATVATLFFVPVVYSLMQARRAVRAAAPELEPSVTA

SEQ ID NO: 11136 - protein, 280 aa, Myxococcus xanthus
MLRFAYGCIPSVMSLYFANTLVRRAGLAPACILLSAGGLRFQKKRYTPAQVLPVFLKQFGPRFTGYNVLAGLSGSLPFSIPASGLMSFQALSQAYGIPLVISDDFSGAATVSELERHGVELFLTSMCDQIIREPLLSLPRHGCLNIHPSLLPEFRGVDSVFQAMLNGVSEIGTTLHRTTGRMDAGDVLAQSAFTRTAADSHLALTAKATAAGIALLKRHMETLERGETPDARPIDVSRARYPYRSWPEREELRRFHAQGNTFWRASDFRRLLAFEDVLAT

SEQ ID NO: 11137 - protein, 44 aa, Myxococcus xanthus
MRKLPKDAVAPFEVGLAFTDVPPLAMDKLKSVLVVDDEGGPADS

SEQ ID NO: 11138 - protein, 257 aa, Myxococcus xanthus
MVLESFLVGEGDVPTVMLHGFLGTGRNLRSLAAAWSAADPSRRILLPDLTGHGTSPALPANSDLYSMARYVVDTARAQGFQGPFDWVGHSLGGRVTLAASLNVPEAVRSVSLLDIAPGPVPGDLSESGKVLGILLQAPAQAENRRAMRAELTGRGLSEPLADWLLMNLVTEESGVRWRFDRQGLAGLHSRVNDTDLWTAVERKDRPPMRCLRGGRSKYVSDADVERLVAAGCPVETLPEAGHFVHVDAPQAVLAWLR

SEQ ID NO: 11139 - protein, 272 aa, Myxococcus xanthus
MSIKLTGRLMAAALLSLTAAGCQGEESQPAEADALSAQEAPVKAQCVETFAGITNCATGNAKLERTEKGLNVTGLEKAANDGVSSNFAAATQWEQKAVFQDLAKAGQGFALAARDGDQVVSTVQVGIGREPGQVTFQPQFTGTPGGSTYSVYVYNGGQFQGRHINRGLWFPMDASWYDIHIRFTPIHIGFRNHMTFGFNDTIPTGACVWSFRSATPGAFTFDFDGREVSGDHVEFVEELGDGHYPYTSFSAIDLTAAASALTIHSESISRGK

SEQ ID NO: 11140 - protein, 120 aa, Myxococcus xanthus
MERLRRAVEALLEDQESPRHCQLFAELWALAARDEMVADALAVFYAGFRAGVVALLRELAPGLSPSRLERRAALVVAFLEGLSLFRGGGALRRASVPGLEQELRAVLEEVLAGVPAAGKL

SEQ ID NO: 11141 - protein, 363 aa, Myxococcus xanthus
MVAEDSVVLVGGYGVVGTWLAQLLRERHPDLPLVIAGRRREPAEALARRLGNAEAVVLDVTAPDPLACLSGRPRAVVSLVNDPDDAVLRSAVREGVAVLDITRWTSRVKSAVLRLSGTPPRAPVLLSSAWMAGLVPRLVAGASERVGGVERVDVGIRFALADQAGPDSVEYMDRLGMAFDITEGGKERQVLPLTDGRRVMFPDGRPTRVFRLDTPEQATLPLVLGARTVSTRLGFDSGTVTWMLAALQQVGLLRLLQHPRLTSVRRALMASSGTGGEAAWVADVEGPRGALRIEVVDPKGQAHLTAVGAVLGTERLLGWDGAPPPAAGVWFPEHDARPEQALAALRGCGVQVRFEEQSRREAA

SEQ ID NO: 11142 - protein, 558 aa, Myxococcus xanthus
MTEFPGMARPGLTPQAVHDVFFSTTRRSLADYWSEVSEGRTTTTGDVVSGYTLDRAYSCSEGAAMREAAVRAADADVDFTQYDRIFIVHPRPQAGCSYAGQATVSCGQVQTADGTVMASTSWLVAESMMVHDSAVELVTHEAGHNLTLGHASSRDFGAEALGLPGATGVIDEYGDVFSTMGRWNLGHYAAPQKARIGWLDASAVAEVDGVDGVDGTFTLAPVVASGGLKALKVRRRPGSNDWLWLEYRQPVGGYEATLAPQVFGGALVHYADATTLSGSHLLDFTPQTASWTDPALLPGTTWDDPYSTLSVTVNAATSAGLVVSIAHRQSACVRAPHEVQVTSFAPTSWPGGRPEFEVVLVNHDSPTCSPSTFQVSALLPQGWGSDRLPAQVTVAASASLSWGLQAYAPYSAAPGTYAVGLAATRDGHTVQGTADIDIVERCVTASPTVTLSPQTVTAAPGTDVTWTVNVTNNDSASCDWVWYDFYSNLPSAWDTAFSDWGVNLPPGGAFTFTMTKSIPREARGGSHTVDLDIYKDEYGLVWHGTTTVDVAEPLTRSR

SEQ ID NO: 11143 - protein, 106 aa, Myxococcus xanthus
MALVIVPVRLARRKRRSIWTHGLRARARLVKAEAGVLDRNRQRTTVMTFQVDGVDGGAPWMLVQQRTLGAEHGHLLAPGTELEVIYLPEAQYSAVVIPRFDGEDWD

SEQ ID NO: 11144 - protein, 169 aa, Myxococcus xanthus
MTSLFELAQTHTLKVYVDVPQSLAHDIRPGLEARIFTLDAPARALPGRVVRTAGVLDPGTRTLLTEVQLANTEALFAGSFVRVRLLIEREAPPMLIPASALAVRREGPTVLVVGEANAVQQRVVVLGRDLGAHVEVMDGLSAEDRVVLSPPDTLGDGRVVRVAEGRAAR

SEQ ID NO: 11145 - protein, 543 aa, Myxococcus xanthus
MDAASQVRGHAYLASSSADEVAQESDTIGASFFTHFLVTGLRGAADASGDGRVTLHEAYQFAFHETLARTERSQGGPQHAAYDIQLAGSGDLVLTDLRTSRVRLTVAEDVQGRLFVRDWGNQLVAELQKPAGRRLALGLEAGRYQVVLERPSQRFEAELTVSPKGGSELRAEHFVPMTLTRTAARGGTDMRAEALSTGEPVVLGDMPSVPFNLSLVPPLATTSLWGGVGRNHLALGVLGVRSMQLQGLGVSAGVGWVDGTVEGFQVSGVANVAGGEIFGLQTAFGGNLAFGGGTGGQVSAVFNMAERDFTGFQVSTTANRAAARLRGVQAAVGINLAERLAGAQVGLINISGDVAGAQVGLINVAAEVRGVQLGFINIADDVSVPIGFLSIVRKGRFVLELSADDVMPLSVGIKYGSRTVYVLATTGVGIGKDSLRTFLNMGLGVHVPLDAADRYSLDVDLSYGSWQPNFYGSGPKNTLFRMRATLGWELKRRFALFGGVSLNAYDPSSQDEYRDVSWLPQWKLGRGPGGVRMWPGLLLGVRI

SEQ ID NO: 11146 - protein, 306 aa, Myxococcus xanthus
MKTLLEYGGLLLLLGATACVDVEDQPSRVHDFRVLGLATEPPEFMASACELNPATLDELSEPVTYRALLVDPAGEGRPIQYTLWACADPEDRTCANEANRVLLAEGTTAPGELTLSIQPGAATLADDTPLLVRVQALDPYLGLGGLRMPLVLFTQAGEERVYAQKLMVFWCPAVEGMRANVQPVIPGLRVDDVAWAAEAPLELRGAGPFVVTSEDVVALQETYVVPGLRLEAVTLRESWEISWHATLGEFSPQETGGSSFGGQEGRHRTEWEPPEGAQAQEVTFWAVVRDGRGGSSWLVRRALWSP

SEQ ID NO: 11147 - protein, 632 aa, Myxococcus xanthus
RAPFISGELLVRGSNPGQTSTMMDGVEIPLLFHLLGGPSVVNAEFIDQLDFFPGGYGSQYGRAVGGIVEVGTRKGASDTLHGSVKVDLLDAGFFLESPITDGISVAAAARRSYIDAILPAVLPKTEGGTLSVVPRYWDYQLRVDFGAKRGTPNDDTTVTAGGARSSGYIMAFGSDDQLRVVSTGPETERDLELDTRMNFHRVKGDWTYRKGAMWSVFTPFVGMDRNNIDFGLARQEGKTYTLGAREVLGIELSSALTLRTGLDLVFEHERYDVSFPAPGGIEYVPFPGAEPVGQQLEEQIALSAFDGALFLEADLLVGRFTFTPGVRGNLQTVGNTRNLALDPRLWVRYAATSRTNLKGSLGLYSQPPETFRFITAPYGNPDLAYQRAFQSSLGVEHRITDVLNVDVTGFFNRRFNNIVSPGQLVANEGGGVFTLPYSNDGIGRAYGVEVMLKKERASATDKWSGWLSYTFSRAEDGRVGPPPQGGGAFGGGSVPDDSTYGLSPWDQTHILTMVAGYVLGNGWELGGRFRYTSGRPMTPLASGHDVYDADRNRYNATFGPYFSDRTGGFHQLDVRVDKSWRFQSWTLTAYLDVQNLYNAKNVEFVFNDYRFRREYEVPGIPILPVVGVKGSF

SEQ ID NO: 11148 - protein, 65 aa, Myxococcus xanthus
MNQCPRGKVTVLVSSDSGRGGALVTVDPRLHREELVQLVERHARGEPTREAPVPGDVEAEREGAT

SEQ ID NO: 11149 - protein, 338 aa, Myxococcus xanthus
MAMVIGHTLDAVLSPVVRADVWVQHYWTCRGITAPLFLMVAGWAVVAALGSKPTAARDTYGKRVRRALLLIFLGYLVHWPGWSTVIQMGLTERMLTKVLVFDALQCIGFALLVGATLLAVTPGRWGRTVMLAVVAVGLPLVSATLWTLGEGLPGPLTQFIGSGGASRFPFFPWASYFFAGALAASLLGTLRPGVPQGLALLILGGGLFWFMRGQNQDWGTASAWLVAYRVGQGMMVLGVVNMLPRKVSGLLAPLGRLSLWVYVLHLPIVYGWSSYAGLSSRVGPTLTLPEGLGIGVSLLVGCALVARIGTWLRDQARPWRTGSTTLEASVGSLGSRGN

SEQ ID NO: 11150 - protein, 201 aa, Myxococcus xanthus
MRADLLEGQKTGAFLDQRENHVMAAHYAHGEALDCFSYVGGFALQLATRARHVTAIEISEAASAQLRENAAANKLNNLDVVVANAFDFLRDAVDEGKRFDTIVLDPPSFAKNKDAIPAAVRGYKEINLRALQLLRPGGILITASCTYHVDEQAFEDMLASAAADARRRVQIIERRGAGRDHPVLLNLRETRYLKCFVLRVL

SEQ ID NO: 11151 - protein, 162 aa, Myxococcus xanthus
MRTRDWDDEADDAPLGGTRERERALKEVRAVYRQADAAYAPYSCPASGECCQLAVTKRQPWLWQPEWELLSRGRPLPPPRADGGCPYLDATGLRCSVYADRPFGCRTFFCQRIQGPSRQPAETVATLLERLERVSQRVAPSLKAPRPLLDWHAEAWRAATKA

SEQ ID NO: 11152 - protein, 346 aa, Myxococcus xanthus
MARGLRESSPEVVLDVAPLADGGPGTVEALLTGLRGERRQQVVRGPLGAPVEAHWALVEDGRTAVVEMASASGLSLLAPEARDALKASTYGTGELMHAALESGCERLIVCLGGSATTDAGTGALSALGFRFLDARGQPLPPGGAALAQLARVGASGRHPRLGAVELLGATDVTSPLLGPDGAARLFGPQKGADEAGVEALEAALAHAATVLGDTSAGWPGAGAAGGFGFGLLALAGARLVPGYELVSRALGLERRVLMADVVLTGEGRFDRQTALGKGPGGIARLAREHGTPVVLFAGQVQRDEGLALDLFHEVVELSANAQPGEAASKVLCEAAARWAAQRLKGR

SEQ ID NO: 11153 - protein, 431 aa, Myxococcus xanthus
MGVHGLLWLTLEREEPVARPPPASSPPALEWVDVEVAEARVSRDTLMPDKGPVAGAAQPVPPKRSDSVHAPPAPRTAAKHRAPSGKPAPERDAAPAQAESRSERHTEPTHASSQPAHDTQVAQADARPERHAEAQDSAPALLRFADAPLTGTPPTDMPRAEPGTNAVPGSRLLLAARQVTALSGTHRDVAAELDGGVDPHAPPSAQGLVEELVSESVGRGRVERGLVHPYYGQLGKALMKAWDADRSVKAHGLQGYFDMGMERGRAYSRIWAERAADYGASGSFAAKNGPGEDRRRPLSTAGDPTLNARRELRQQMRQEFRTTRRALIRVVQDATGQLVDVHLLEPSHQPEVDKEALKDVRATAEKLPPPPDEAVGGRSRLTSVWEFELLISISPPIPTFSFEFDEALGFIDTRLPLDRRIYKRVRLVEVR

SEQ ID NO: 11154 - protein, 463 aa, Myxococcus xanthus
SSKAETLLEAQSRLVWDFWTEGRHVDVAATYAGQEALFTIENIRRIDRLRQLTDDAREVRALTALHSHFAGEYLSHALAEFNDAAANLEASLTFPVDGKDVRYRDLERLLANERTVARRRALYAAATPAIERLNQTLRRREERADELVRELGFASYEAFGSELRQSDLGRLSVLAEEILQATQAPYRVVMERLSQRELGMAFKDITRADIPRLFRSREVEDAFPKGESLLKAHGTLAGMGLDLGELPHVTIDARDVKGKSSRPLALAVRVPSDVRISFKPGTGVLHQARVLHEFGHALHAAFTTETRFELARLGNPTVGEAYSALFEDLAEDPVWLEEHAGVSGEQRAQYLAASSAHKLFLIRHAAGRLLYQLELHRRVEADPKALYREIMSRTDDIPMTDEDTERYLVDQEDFFQSADSFRAWFLAGQLQAQLKARFGPAWWRTSQAGEFLKTLWAKGNAMF

SEQ ID NO: 11155 - protein, 102 aa, Myxococcus xanthus
MKRFLWLSVFAVASVSNVASASEELSKAKNCSTCHSATARLVGPSFKEIAARYAKQEGVEDKLAQRVRKGSSGVWGAIPMPANAQVSEAEARALVKWIMTQK

SEQ ID NO: 11156 - protein, 129 aa, Myxococcus xanthus
MLFYAHSGLRYLVLLAGILALAYFAYGLATRKPFDKLGRILGSAYSGLLQLQVLLGVGVLVTRFYYPALIGHIVMMVLAAGVAQATLSINRRKPQPAFVLPLVGVVVSIIFIIGGIMAIGRGVFTTTAM

SEQ ID NO: 11157 - protein, 369 aa, Myxococcus xanthus
MIQNRWVSLLSLSALGVSALTGCERTPPSAEAPVAAPEAQKLPAPKPMTAEQLAHFFKPLPQRKDAPPPPEDTDAQVALGRMLYFEPRLSKNHDVSCNTCHGLTTFGVDNKALSDGHKGLKGARNSPTVYNAAGHIAQFWDGRADTLEAQATGPILNPVEMAMPDEKRVLATLTSIPEYTKRFREAFPGDKKPVTMANTARAIAAFERKLVTTSRFDAFVGGKHDALTEQEQRGLQLFATTGCTTCHNGPAVGGTSFQKLGLIEDYPGLKDAGRFDATKNEDDRGKFRVPTLLNVDKTGPYLHDGSVVELPQMVRLMAKHQLARTLTDPEVDDLVAFLKSLTGELPPAEFIAPPELPPSTAKTPKPDPS

SEQ ID NO: 11158 - protein, 163 aa, Myxococcus xanthus
MPTIAWVLVSGLVGTALSRREGRRVLRHWRESMARGQVPEEGILSGVLVLAGGVLLVIPGIITDVVGLLLLLPPVRRLISARVRRTLERKVREGSMHVTTFGGGAFGGGFHASMGSPFPGGPVPRSPRTGALEPDAGGTVARRPQGPQQEVDAEFTEEEPRRS

SEQ ID NO: 11159 - protein, 167 aa, Myxococcus xanthus
MTPGSPYEAARVDALLSERGVVARPDGVRRWSFKNGDVDIGELREGGQVVATELRVPLSDRPDLMREAVEAAAALASEAGVRLVDPQLGRSLTGNDDAGVLEQYVRTARYAGEVAGVPEAMGAGSYALETEGSRGFQLSTRMVLIAIGIFVVLYLVVDTLVGQLGGR

SEQ ID NO: 11160 - protein, 383 aa, Myxococcus xanthus
MEPNKDPFLLTPQLPAAAAPVRHPSPFPWNQVALVFPSPAPDSVSVLTLNDKLWRLELSGSEVRRVEVDDEYLEQVSGGELQGMQPPSPTHLAYLQSRSLVMYDLKWQLAKTWFMVERLEEVAIRGAWISHAPLVVAAELEDTTNYARTSRISFRLRTWRLEGEKRAKLGSLELGSVVGAVKWDAGAGLVAVQKPGVPLELYGPDLARPQPEHPLALALRKLTVDGLTLQSLRLHPSLPVALVALGRDVTPKREEGKEKPEDPGIWRVSWEGAPAVTVRLARYASGESVTLGSLSPEGDWLYYRVLNSAGRNPQLYVQQVGAAFKPPLALGAVPEKGAALLWTGGAPSLVMYDGTKDALVHWKLAGAAAPEKPPAAPPKPDGK

SEQ ID NO: 11161 - protein, 582 aa, Myxococcus xanthus
MHIMSGNCTPMPALVQMMKDKGLGFLIGTGTSRTKINRLGFWAAKIPFAPDIGDVSHRDTHRIGEEAVRSNDSLAQDRTGYTSDGMGNVEEYTIPAPLRAYASTQGHAEASASYMGMSIVLTMDMDYCHLAGYQGDPIYSSDFDGAEPRFTYRWRTKSDDPGELIEAKSDEIRLHETWDRQLRHTEQVVAENPFRLLPMFHFEPRRFIKNEDKSFPFEKVVTASKAAPYIGFKMYTPQGYMPKERHAPVKDILSWFFSECASNDIPLMTHCTPSGFYTHERRFYLDHEPDEAIRNDPKYWPSKDAIATADANITKARDYVTELEASWKSHIPLVLRRARNGVEDAIEAKEKLLNPGRMRYFYENYVHPEAWRPVLNDNPKLRLCLAHFASDGTFWDIRKGLTVKQDGQKVQYDKSWIGSIVELCNEFPNFYTDISYLDLMEKQKWKLLADILKSSPWMLKKIMFGTDWYMITAEPVAYAAWYSRTIRGLEFIQKELPTQVNLFTQFAIVNPMRYYRMMEVAPKMKEGLKKLQTDLNVTGAAVDKLEDNFTTLMRLQHPLEQIDKAGGLASGPMLFTATTKAK

SEQ ID NO: 11162 - protein, 833 aa, Myxococcus xanthus
MAAQFNPPAFTVQVGSHGADALSVSSISGTEALSHLFDFRVDFFAKDGNPIATSELLEQDALLTLSIRDSAPRYVHGWVREVESLGMKTGRRRYRAHVVPRLWRLTQHHRSRIFQQKSVPDILKDVLDAAGVKTRLALSGSYAPREYCVQYRESDFAFLSRLMEWEGIFYFFEHTEEGHTLVLGDKPSAHAPLPQGQQLPLRPSLGKEVVEGEYLSALEVVHRLRPGAVHLKDFDFEKPGLDISGKAQAPEGVTELELYDYPAGYVAPGVGKAATNVRTEAASMGGRTLMGQGVAPRLTPGYLLEVQSPEDGTFAGEYLVTEVVHSGTQPDVSAGSEAIQGLYRNQYQLLPKAVPFRPRRLTPLPQLAGPQTATVVGPAGEEIHTDEHGRIKVQFHWDREGKRDEKASCWVRVGQPWGGPAWGDVWLPRIGQEVVVRFLEGDPDRPLVAGAVYNGTNTVPYGLPGEKTKSTRKSASSLGSDGFNEVRVEDAVGQEEVFTHAQKDEDLLTENDKDQQVTGFEDLLVKKDRKRTVEGNQELRVGVDDVGVVEQNQTLLVQGNRSTRTTLSHDEEVEGNQTMTVGGNLTGLVLQGAMENVGAAKATTIGGVYSVNVALAYNEATGGARGLQVAAAHTEHVLGSRQETVGKDKTVDVGMDWDLRTKGQLTLTIGKDWEEDIGKTTSLYITEAMAGLAKKFELKADTFSLLVGDNLILKMEKSGKVTFTLKTLTVDGKEVKIKGGKVKMEAAGSLKSDSRKAKELEHFKEPDPVNVEFNLKGMDGKPIKDQPFELHMPDGTIKKGRVDGSGKGVVEKVPPGDYRVVFPEMSGRINKGS

SEQ ID NO: 11163 - protein, 90 aa, Myxococcus xanthus
MSFDRVYVFGQASSHCVLNTLLDLRRHIERTDPSKMGRIHILEDAMSPVPAPPLEPLPASLDFPRLAKEALRDFQAAGMRVVRTSDPLEG

SEQ ID NO: 11164 - protein, 443 aa, Myxococcus xanthus
MPLDVAAFVKSLIPEPKPEDYDYLSRYDYEMGVGFKAAILRREKLSIRAIPKGALFYPREPILTLTGPSALVSWVEPLLLQLNFRIQVATLALSDRDALARALATVTCDEQKAIALETLDSVGVKAVPITVDTEGYAKRVFATVKELVDIVEDPSRIFEVGLRAATCLEQHEVALRSCKDAGVTRTSNVDGAAKLGMVPVGTMGHEHIQRYGSDEAAFRAMRERRPQRSSYLLDTFDTLTSGIPAAFQLIQEEPGNNDSIRFDSGNKKLQYLYAVTRARDLGIRPVNILEDGLDAEATREFEELRRQVGWEPSAQFYGYGGHIIARTMDCPLTRDKVAAIYKLSRTGNTPVMKFGNELAEGKKSIPGEPVLFRRRHGSGPIGLVGQVGEPVPDGYFPLMESAPETPSLVGAQETAAEARVAYTAATQALVDALHRRHFPQQHR

SEQ ID NO: 11165 - protein, 245 aa, Myxococcus xanthus
MKKPIQTTSQAHPWHGITPGEDAPEIVTAYIEIVPTDAVKYELDKESGILKLDRPQRFSSQCPTLYGFIPQTYCDELVAKRCAERTGLKDIKGDGDPIDICVLTEKVISSGNLLVRAIPIGGFRMVDGDEADDKIIAVLESDLVYGELQHLAQLPRALLDRLKHYFLTYKQIPGEGKRSVEIAEVYDQPEALEVIKRSMKDYERIYGPQVTTKARAVRTRGAAVEAKIAKPAKAKTKAARKSRAS

SEQ ID NO: 11166 - protein, 253 aa, Myxococcus xanthus
MAFIAFSTIKGGVGKTTLCSHVAAALADAGRQVLLLDLDPQAHASLVLGLESREGPCVGDALGPRPKHTLAQVVVASPKRPGLFIAPAAPRMAAQERELFQWGHRLQAIPRALKTLGWTPDIILADTPPSIGAYTEAVLASADLVVAPVPTGAFALQGLGEIETAWRDVREQGGELVAVVNLWDRRTTATNEAMEGALSESTVPVLRARIPRSESINQAGLGYEVVFDTSPQAAGVEELRALAQELAKRVGLR

SEQ ID NO: 11167 - protein, 226 aa, Myxococcus xanthus
MLEFYRPHADYHAIMDDLEGALAEAGRGATEGEPGADPLFFTRTPYERLTVRDAVLRATGVDIRQHSDGPSLKRAAEAAGVRTGNAETFDDVFFHLFLQKVETGLGHERPTFLIEYPASMAALSRLKPGDAVVAERVELYAKGLELANGFSELTDPVEQRARLTEEQELRRQLGRAVYPLDERFLDAVGRMPPSAGIAVGLDRILMLLLGVQRISDVLLFPAHEFV

SEQ ID NO: 11168 - protein, 76 aa, Myxococcus xanthus
MDFREGPMMLHGEVVWTSTVPRKNSGTVAPGFGATFGRLRPDMQQRLEGLLSLATLPPVPWKARVSFGMEAVARMP

SEQ ID NO: 11169 - protein, 755 aa, Myxococcus xanthus
MAEIYRARMTAAAGVTKPVVIKKILPGYAGNSAFLSMFVNEARIAAGLSHGNIAQVFDFGEVDGEYFIAMEWVDGRTLSSVMRRAREKGMYTLPQPLALLIAVEMLEGLGYAHTRLDERGRPLHIVHRDVSPQNVLLSYEGQVKLVDFGIARARLAGSAEPVEYDLKGKYTYFAPEQVRGREPDARSDIFAAGIVIYEMLCGRLPFEGKMPDVLRKLALGDFPRPRDLNPGIPTALERILLTALAVEREQRYATAEAFAEALTRHLHTAGPDVSSSARAHFMGYLFEAELVGEGRPVLLPREFLAQMARWTQSPLERRALREMAPPVREPPDDEEERTPIAEFELPPSQAAAPVEGRMERTTLTLPALPGPGAPPEPGVPPLDAAASRTMGMPRAVTLGAPIIVALTATLALLVSNSTGTFSVELSSSPPGAAIRVNGQPQTARTPALLTQLPADAEHLLEVQVPGMVAWSQTVRAERGTTLAVHARLLPKRIQGPAQQPHRAPPPHEVRMPAERMSLSSVVHAFRVPYLSTAQMRLDPSRTYSVRVEGSASLGHANTVEHAGYFLEGDARLAARESFGVLDGEERLVRHASRLHVFLLDANRTDNHGTLMVRVREWDNDGAVTTLRVDARTHAVKLSRVDRFLLRGLEPDTHYDVVLRDTAESARTRGFDGGPVGRVLGLYGAGEGPETVSGLLTLLEVGRPLRLRGATWLQLAFPDDHLADNTGSLVLEVSPVTAPGTSPAPPPGPPAPAPNR

SEQ ID NO: 11170 - protein, 68 aa, Myxococcus xanthus
MKKLVAVAVFGLMGTLGMAARVDARPGVDGMEPTDAQVEAALDARQKLVLGNLLRVQQTDARTAAIHR

SEQ ID NO: 11171 - protein, 263 aa, Myxococcus xanthus
MVPEGKVLAIGVRKVASAEDVEAIFTFLRSDSDKADLDWKQRARTNLDRMTQGGIMGLAEVVKGLQVLSELRPLPTKERELYDNARHLLVTEVAAALGTAEVNAEDAIDIVLFPPGRERPKRTAAEFQREEGDLDLDSDLLGLDSDLDLPSDEEPSEPSEEESSEEGESEEAASSEESAPKKRGRPPKAKTEAPEGAEPPAPKKRGRPPKPKPEATAEGAEPPAPKKRGRPPKPKPPEVEGAAPAAPKKRGRPPKVKPPEGES

SEQ ID NO: 11172 - protein, 129 aa, Myxococcus xanthus
MSEPLDAEKLIDEVKGIRSYKDDKVLLLTTRKLKDRELPSGVAPTAGFARQGKDRAILTIAPHKDLESAFKAVSRHALHQLGHLWELHHCLDPRCSMYPPWTPSFAQGEAIFCTFCREKSEQKIRLAKS

SEQ ID NO: 11173 - protein, 113 aa, Myxococcus xanthus
MHAPGGKQRLVAELDGVPGGLGLRLEGGIIFEHAFPKDSRFSTTHLGVDDAANGARLLSLAIPPGLEGVQKAEVRLPEGAPHTVKVWVQADNADRRQVCLDVLAVEPEVGVQG

SEQ ID NO: 11174 - protein, 503 aa, Myxococcus xanthus
MAALIPALSFLLGSAMYGRLAGLFAAFAFMLVPRQYFNAEMACFDVPVAAMWLLVVYCFWRAMEDVRWGLWCGVAFGLTLATKHNALFLPFVLTPFALWRAYSASEGQPEARAWLGRFVGVFTAVAVFYGLLVLSLGGGEGFQRKFLLLSPHTLLFAGLAVGGAWVLKGVDKVNAQVARALVPIAAMAVLGPVIFYLHWPYLWHQPVDRTAWYLAFHAKHNHYAWFYLNQLLREPPFPLAYVVVKTALTVPTSIFVPMVTGLAALVARMVLGAFTRTRAWVERPVTMTEALVCVNAVASILIISHPQVPHFGGVKHWFPSMVFLGILAGAAVARGCTALWERLKMKWPSLPQAVVAVPVFAMLLAPALVYSVRVFPYGTAAYSELAGGLPGAATLGMQRQFWSSHVTGVLPWINANAKQGARLFLHEVHGGSFRDYQRNGMLRKDLRAVGSPADADIVAYQYHQEFREHEFLTWQAFGTRTPVTGLYLDETPQVVVYVRPETR

SEQ ID NO: 11175 - protein, 32 aa, Myxococcus xanthus
MKFLYGYVIAATGTKRNGWMAYDALQVSSGCP

SEQ ID NO: 11176 - protein, 139 aa, Myxococcus xanthus
MLYTVSEKGVIRQLTLTRENRSIRCDANKPVAHTSFRIPVQEGKVRMYIFFSDDRIPAGPVAQQLYELRSQERINAMDLRLPGRVFVETLEFTPEEGGTPVTGTVVGAGGDTEPEGTGAPVLSDGGTEGSGMGAMDEAP

SEQ ID NO: 11177 - protein, 124 aa, Myxococcus xanthus
TPERRKYLVVGGLATLLLILDQWTKVLVREHVKPLGYTGMSVFGDVIRFQYVENTGITFGMFRSLPYAQLILSAVAIPVFLLVIHLVRQTPADHYRLHVALGLVGAGVGNLIDRVRLGRVRNRR

SEQ ID NO: 11178 - protein, 415 aa, Myxococcus xanthus
KLTDVLAGCGAEQTSGGRSAVDVTGVTHDLRRVKPGDLFVAIPGTKEDGAQFIGEAVSRGAVAVVSEKPVPSSQVPFFKVSSARKALALIAANFYGRPADQLTLLGITGTNGKTTTSYLLEAMSTAAYASTGVIGTLGYKFAGRTVECANTTPDPLELHRILREMVEAGVETVIMEVSSHALAQERVHGLTFKAAGFSNLSRDHLDYHKDMEDYFQSKRKLFAENLSATGVAVVNGDDTYASRIYNEQRGQKRMAWKFSRQGSGEISAADVSFSLQGIKGVLKTPAGDIPLKSKLLGPHNLENILLAVGIGLGAGFARRDVQEGIERMMPVAGRMERVENYGPSGAPAVLVDYAHTDDALKRSIEAARSLAKGRVIAVFGCGGDRDKGKRPLMGAVAGEGADLAVVTSDNPRTED

SEQ ID NO: 11179 - protein, 620 aa, Myxococcus xanthus
MAQDQYVRHIEIPARRGDIFDRRGTPLAQSVEVDSIWVDPSMLPDVKAASRALAKALKLDPDELGARLARAKRFAWVKRQAKPAEVAAVKALALPGMGFSKEPKRFYPQRELGAHVVGTVGMDGRGLEGLELAFQDELSGQNSSTSGFRDAKGRKLLVQGALDPLQRQGAAVTLTLDRHLQYVAEKALSRAVEDAKAVAGMAVVLDPRTGELLAVANHPRFNPNTPESSSRSGMRNRAALDTFEPGSTLKAFVVAAAMEEKAITADSLFFCENGAWRVGRHTINDTHSYGWLTPQGILQKSSNICMAKIAQAMGREKFVKGYQSFGFAERTGLSLPGEGRGVLPFPKAEVSLATQSFGQGMTATAVQIAAAYGALANDGVLMRPYLVSKVVDPDGVVLLENRPTELRRAVSAKVARQVVGMLESVVVKGGTATKAAMEDYRVAGKTGTAQKADPVARGYSDKRIASFVGVVPAESPRAVILVVVDEPKTDVYGGTVAAPAFKEIATAAMAHLAVPPSRTVAPEVAVAAESPAPAAAKPGANASGAARTALADAVTETPEPGTVRVPDLQGEVGREAVVKLLAAALEPQVLGSGRVVSQTPAAGSLVEKGARVTLELAARQ

SEQ ID NO: 11180 - protein, 139 aa, Myxococcus xanthus
MSKVHSRVSALRSSVTVGGVLLHLLPAVCLFALFVAVGILHVTSRVLVVDMGYRLSREEAESRILTRENDRLKLELATLKAPGRLERVAREQLNMAMPRGGAVVSLSAEKPARDSGARAEVPDATQPTVRVAGRAGASR

SEQ ID NO: 11181 - protein, 101 aa, Myxococcus xanthus
MAVNGELEALDALLAAIPGLLKVGGRAAVIAFHSLEDRKVKKAFRALAGRCTCPPGLPVCVCSGVGDFALVTKKAVPASEAEVEANPRSRSAHLRVVEKLR

SEQ ID NO: 11182 - protein, 104 aa, Myxococcus xanthus
MLEGELSEQDLLELCDDLGRKLQRGTRQVVLDFGDVGHLNYRGVKPLMARTDAFRRAGGDVKLSGLSPYLAAIFRAAGAHDCFEIYPHMNDARAAFALARAPFV

SEQ ID NO: 11183 - protein, 39 aa, Myxococcus xanthus
MVKVIELWSREGWAKAQEEARQEATSADVMKVLAELRQA

SEQ ID NO: 11184 - protein, 601 aa, Myxococcus xanthus
  unsure (1)..(601): unsure at all Xaa locations
MDAASKATSQQGLALGGAFLFEEVGSARILTPETFTEEQRLFFKTALQFSREQVLPLSERIEAKDNALLRQLLRQAGELGLLSVDIPEAYGGTGLDKTTSLLLAEAMSLNGSWSVTFGAHTGIGTLPIVWFGNAEQKAKYLPKLATGEWVAAYALTEQGSGSDALGAKTKAVLSPDGKHWILNGSKLYITNAAFADVFVVFAKVDGDKFTGFIVEKDTPGLTVGPEEHKMGIRGSSTCPLYFEDARVPVENQLGEVGKGHKIAFNILNYGRLKLGAGVLGGMKLQLQNALRFTQERKQFNAPIVQFPLSREKLARMAALVYAVESMTYRTAGLVDARLGQGDKDAPDYEARLLEAVEEYAIESSIMKVHGSESFGHLVDDAVQLHGGAGYIEEYPVERSYRDARINRIFEGTNEINRMLITGMLLKRAVRGDLPLFAMAGNVAEELSRGERPRARVQDALAPQEVAAEAAKHLALHGLRVAAETFGPELEQHQEVLAALSDVVMDAFALDSMVTRTRQAATSGALDPVRVAMTQLYALDAIPRAYDRTRRALCATLKGGALDQELERLGTLDVFTPYDXAALRETVVAALESAGGYPLGAV

SEQ ID NO: 11185 - protein, 117 aa, Myxococcus xanthus
MHAFDVLGEPVRRRILELLAEGERPSGEVTESIQAEFGISQPAVSQHLKVLRDSGFAEVRAEGTRRLYRVDPAPLQQVDAWLEQFRVFWTPRLEALATEVARGKRARAKADNEGGGP

SEQ ID NO: 11186 - protein, 219 aa, Myxococcus xanthus
MIDVKRYLGAVVREVESREHEGKPARVVVATRDYDTTVEDLWDALTNPERIPRWFLPVSGDLKLGGRYELKGNASGSVTRCEAPRHLGLTWEFGGSVSWLEVILANAPGGGTRLRLEHMAHVSPFWDDYGPGATGVGWELGLMGLGMHLESGGAAVDSAAVESWTTSDEGKAFITASSEGWGQADVTRGEDAAAAKARAARTTAFYTGAPPPDVRHPGT

SEQ ID NO: 11187 - protein, 274 aa, Myxococcus xanthus
MYAATQALAVVLLVVVGAGCREEKQAEPLKSLKPEPLPSLTVPGEAAPEAPRPASPSEVEVAGPIHGEPLPASALRVALAGERVRVGEEAFEPARPDDAARLARRVKGHTVLVVPDADTFLVQTSELFTVLRDSAESVWLAHPDGPVAYPVVLRDEAGFRAWLEEVAPGKLRIIMRADGFELTTSVGKLPGPDPNGPSVPVRAGRQDIVTLRRGLGLLKGRFKTSEDICLVPSFGTEVAQAARALGGNFTAPGEPLFDTLCFVYPTPHKAPDGG

SEQ ID NO: 11188 - protein, 439 aa, Myxococcus xanthus
MAVGGSTLHWSGWTPRLQPEDLELRKRTGKGNDWPFSYTQLEPYYSQAESLLNVTGPNAPVDGHPTPWRSQPYKWNSPPYPIESEPVRHALKALGITYDHIPMSRRGPGGEGVGGPCMTFGTCRYCPMGARFDPTLLLADMESHPGFRLLASSPVLAVRMAGAVAQGVTYRTPEGETATLDADAVLVAAGALETPKLLWHSGFDEQRLPALGRYLVTHPMLKLEGKLAKPPREFNGREVPMPALFSRHFDTPEQQAAGKMIFSEYPEEPDLQSWVRQEQLAPEYIASFARESRLNLHGFIEEFPQAENRLRFTGKPGERQVEIHYAVDAGFAARWQWMTDTLMQVMKTAGCRESEVWVSGVIRRADHSVGTARFGQGPDSGVVDGRHLVFGTKNLFALTNGNFPNNGAINPTLTLTALSLRFADQVLPDLAPTRTTARP

SEQ ID NO: 11189 - protein, 219 aa, Myxococcus xanthus
MEALRTEKDGPNDNLNMLAHYGSQAASKKGIFASGPLDPRGLGPQQVQTAVPDRDKGEHTKVFGKMTGGETSSTKYQQKLGTAEPRTDYEILHGMGHGEGGKKTQSPNNLASASHGANTAMIPPDKAISGNPDVIVDTKFAMRPGTQRAEYVDQRFFHKDFPDQPFFQQRIDGDRPKVTQSEYKQLKEQVAPLSDAELLRGAAHLMNFRKKAGSSGGDT

SEQ ID NO: 11190 - protein, 94 aa, Myxococcus xanthus
MEFNRAVCTARLARVAVALGDTTQAREEVLAGNAIDRVRKLNAAVGIPSRLRDAGVQEKDLERIAEKAFQDASHLSNPRKVSQADLLALAREAY

SEQ ID NO: 11191 - protein, 201 aa, Myxococcus xanthus
MQVLLPPLVLDIANPAVLGGLLSTGGLGLLMGSVVMTAWGGPKNRIHGVLGVGVGLGTVMVLAGLFPTLRMLGYCTFMAGFCIPIMDASSQAIWQGQVPAALRGRVFAMRGMIAWSVQPLAYLAAGVIADHLDGVSFSIPALFGPLEQLDARSRGIALCFIAAGLLALIAAVRGYTARHVREVEEMPPGPPFTGAVSPPSR

SEQ ID NO: 11192 - protein, 482 aa, Myxococcus xanthus
MRDSAREADRDAVLLVHHSFESRMVPRIAKSPGRKVLVYHNVTPARLFEGFERKVAAACDAARDELLALRPHVEAAFAYSRFSAEELVAAGYPNVAVLPFAIDWAAFDTAPDPALQAELDDGMSNILFVGRAVPSKKVDDVLRVFTAYQRLYQPRSRLVVAGYLHRDGAYGAYLHGLKDVLGAEQVRFLGRVSAAQLSACFATASAYLSMSRHEGFGVPLLEAMYRGVPVVAYGAAALPETMGGAGLATRSDEPREVAKLLAVLDRNAGLRAQVITAQRERIAELSQEAVAEQVRVAFEDICSSTAPRPPVATTTTATVELVCPGFTVRPEEPASRLARRVAERLPGARVLALRPWGEDASLTLEPISDDGVAVTHFTPDQPVDSNPRTALPGSSAMETAVRASSAPVVLLSADTVSAQTLLPHVSARAWGVCAPASQSALLASAQEHLGDRLVVEEPAQVETALQALLTTLASTGVLPRAT

SEQ ID NO: 11193 - protein, 113 aa, Myxococcus xanthus
MDSRYAEPATSHRGGFTGTALVLAKRAFRLTFQPFINEVLRKQVEFNESILDALATLHDVQREQARAQAAWRKELERRLAKLEATGTRTEPVKTEQQVPTPAASSKRTRKRGR

SEQ ID NO: 11194 - protein, 703 aa, Myxococcus xanthus
MSRALAEAGHEVHVLTAAHADWQRAVSYLPGVHLHAVDEREVDFKGAFPHAPLRHAWAAYRSLLELNARHPFDVIEFPDDAGEGYFAMRARRTLGHFEPAVLAVRLHDSTHDRLLLNRVATLDMDIAQREHMEDTSIREADLVLSPSGPAMERVRIRLELKRTGVVIPPPFASRREHRSSPRSHEGLPQVLYVGDLEYRKGVHLLVEAMQVLFEQGVVAEVRLIGADTRTGPFGRSLRQWLDQRIAPAWRNRFHFAPPLEGADLASALAEATVCCIPSRWEHFSHVCMEAMSAGALVVGSDGGGNAELIEDGQSGLLFRSDDASRLARALERALSTPALQEAVRQTAPARIAAYCAPASIVRQFEAAVADARRHRHVGPISAATRKKDSATPYVSILVPYYNMGRYLPETLRSIRAQTFTDYEIILVDDGSTDSESRAVLETLHEPDLHILRKPNGGLSSARNAGLRAARGRYVLPLDPDDLIQPTFLEKAVAVMDSTPGLAYVTSLVSYFVESPDQPVGGWIPWGTERDALLAENVASTCTALMERQRIEEIGGYDEWLTAYEDWDVFCSLAERGLAGSVIPEPLFLYRLRPDSMTRSMRVNDRHAQMAYLCQKHPALPLHPERALRMQLGRAHRQELHLRATGSASPPLLNRFADKMNATLKRFDFAHATLRRAALWVAGADDDSRPLRHQVMERFFRRRN

SEQ ID NO: 11195 - protein, 501 aa, Myxococcus xanthus
MLAAHALVLGTLLLLMGLWLTGRPPPPLKPMPRRWVGLLTAIPTVVVAGIWLLTVYPGMLSPDSTSQWRDALSGSMDDAHPLFHTASIRFLQKLWESPAAVALAQIAGLGVLVGWGCAALARAGVSRGIIALTATVFALAPVNGTMAVTLWKDVPFSLCILALCIWVFRSATDTTTRWDVPFWVSMVVLGAMAMLFRHNGLPAVVGTFLALGLLRRERYKAVALALVATFVVASGTRWVLSQTYTIKPFPKGMTLIGFLGAHVAAGTHLEPGERALLEELHPLDDKWNYRCFSNVFTIWDGRFDMNALTRHNKALLPLLVRLTQRDAAPVLSHVLCSSSVLWKLSQGSDHINGPPIWRGPHGELDTLEPGARHLRSDSLLPVLREPLLRWTVRTLEPDLAWLLWRPALPLYLLLLACAVACIRHRTWRLAAVALPVVLHTAALAALIPSPDVRYQYPVFLVALMFVPAWLAGMRLNAAPATEAPRRAPSVSQDAPTLRSAG

SEQ ID NO: 11196 - protein, 656 aa, Myxococcus xanthus
MKRMTTWKRTFLLHATWALLWGTPAAAVTPSNVTKVSRVTGATPAGELLPNPNQTHTNHDVHGTDLGIVWDKGGGEVFVLFGDTFGAGWCGNGGCGGGWRSNVLARSSDTNLANGLSFSSMIQDGPRHAKEILASRKVNFDEITVIPTAGVTIGSRHYIHYMSIHHWGEAGMWFTNHAGIAYSDDQGQNWVKHPTARWQNTPAWTNNFQMAAFVRNGGFVYMYATPNGRFGNVHLARVPETALLDINGYRYWDGNGWSVSQAAARPVAIGIAGELSVSYHAPLGRFLMTYLNEHRQAVVMRDAATPTGPWSGEKVLASGAVYPGLYNAFIHPWGNTGNSLYFVMSQWTPYNTFLMRATLAHDAHSDNLLSEPGFETQAATPVMAPWYLQGSGGVDRALGNARSGQDNGFVNASSGWNALKQSVVVQPYTDYTLRGWVRSSANNTAGYFGARGPGNGPILGEVPFGALGAYTERVVHFNSGPNALIEVYGGLWADNVDTWMQLDDVSLTRGSNLIHQAGFEQQSTNNATSPWYTEGRAGIDRGLGYARTGANNAWARNDTGWNAVKQEVAVTPNTQYTLTGWVKTSTNHADGYFGARLLRSGPILNEVRFAQPLGNYTQLSVSFNSGAQHSVEVFAGMWANTGDTWIQVDDLTLTRN

SEQ ID NO: 11197 - protein, 119 aa, Myxococcus xanthus
MVGQWMTGPTVRDEEVLRLAIDPRVGGKFSFFVRRAGEEIDHVGTYLEIDRPRRLVFTWHIDKEGDELSRVTVEITPRDTGCELTLTHEMDAKWADYASRTEQGWATMIDVLVRVLAQG

SEQ ID NO: 11198 - protein, 387 aa, Myxococcus xanthus
MLAMSVFLLGSVLCGFSQSLTQLVIFRTLQGLGGALMTPVGRIIVVSSAPRERLVAALSWFTMPALVGPLVGPPLAGLILGVADWPWIFFINVPVGILGMLAVARFVPPLHQPDPGPFDTRGFVLVAVAITTLIGAAETVGIGLMPLSLQLGLAAVAFLSLGAYVWHALRVERPVLNLRLLRIDTFRASMIGGTLTRMGLGASPFLLPLLFQVGLGWTPVEAGLVTIGGGVGALACKSVAPYIIRRFGFRQTLIFANLTSAVLTAMPAFFRNSTPIPLIVGVLMVSGFMRSMQFTAINTVAYADIPPDTVSNASTLSVVTMQMALGLGISFGGLMLHLARGAGEAPLTPDRFVLPFIAVGIMSSLAGPLYRRLSPNAGAHIGGRRVG

SEQ ID NO: 11199 - protein, 102 aa, Myxococcus xanthus
MDGQLNEALLEGYLRLKCEERPSYLATYTRFAAEVKRPEKLSAEWLLELPELHRVKVVGELAIMSLVGGGFRTFGFGNMNGHMGGLWHEPHESGSYHASDEL

SEQ ID NO: 11200 - protein, 293 aa, Myxococcus xanthus
MKGIILAGGSGTRLYPLTRVVSKQLLPVHDKPMIYYPLSTLMLAGIRDVLVISTPQDLPRFQELLGSGDQWGMRFSYAEQPKPDGLAQAFVIGRDFVGADSVSLVLGDNIFYGHGLSELVKRAASRTSGATVFGYYVKDPERYGVVELDAKNRAVSLEEKPLKPKSNYAVTGLYFYDNQVLDIAAGLKPSKRGELEITDVNAEYLRRGQLDVELMGRGYAWLDTGTHESLMQASNFIEIIERRQGLKVSCPEEIAFRMGYIGAQQLLTLAEPMLKNDYGQYLRALAENRGAVS

SEQ ID NO: 11201 - protein, 153 aa, Myxococcus xanthus
MLAPGCAIARTAVVYGWPPVEGRLNFGAWLVTALEKGQQVRLFEDQIVSPSFADNVAAMLVELGTRRLGGVWNTCGGTVIDRVGFGRALCEVFGFDAKLIVPTRMAELKLASPRPLKSGLRTDKVRAELSVPPLALAESLSRFHATWLAARGH

SEQ ID NO: 11202 - protein, 220 aa, Myxococcus xanthus
MVSTDEVYGSLGPTGAFTESSPLQPSSPYSASKTSSDLVALAYHHTFNLDVVVTRCSNNYGRYQFPEKLIPLMVVNALHDKPLPVYGDGGNVRDWLHVEDHCHALLLALEKGRAGEVYNIGGGAERRNIDIVKAILGLVGKPESLIQYVKDRPGHDRRYAIDPSKIRAELGWTPAHTFEQGLAETVRWFVDHPAWWQRVTSGAYRQYFETQYRTRLQGRA

SEQ ID NO: 11203 - protein, 135 aa, Myxococcus xanthus
MLLGMFGQRAQVTDPTSGFRVYSPRAVATLLRLMPDEYPEPESVALVALAGLRIGEVSVAMRPRTTGTSSLTGLKGFQFMTKVASALFGLRLRSLIRKEPSALVPAAEGVAPPVVSLTPREPASLPPAEEGRLGG

SEQ ID NO: 11204 - protein, 487 aa, Myxococcus xanthus
SDLTDRFVFIKPGPDREAHMRAGVVVITSSYESLNLTAYEASVAGTRLVLNSACLAFGDDSPFVDGVHCHKYDGSLDALVVAMRKALEGPELAPVRWTVDRPYWERHAREALPTRSPRSPLVSVVIINQDQGIFLPIALQGVAASTYPEVEVVIVDDGSTSAFDMQVLQRLERSAAEGEGLRVVRSPIRRGFAGARNLGVRAARGEYVVFLESDDSLSPDFIQHAVAALEARQEFSGVVPTGGRFHSSEELANRQFKGFMTYLGDCPTYALAANQVSAPTALLRRTVLEQHAYNETLSGYADWDFFLRLAQGGHRFLVTNQVHFFSRRGHAITPSASQQRQHFRWLVRLFEGVPAPLHPSTRLFALLAHSREAMVDPYGALDTHERRPSSAASASLESAQALAEAARPLRYDVVDLMNAALKRLPLVHPLLKQAVAGKPAPASGAVGSVNPGDAPPLRYVLVDRANTLFKRMPVIHRAIRSTVSRLT

SEQ ID NO: 11205 - protein, 73 aa, Myxococcus xanthus
MSGGGGSFDFDDDEKESTRGGGKAHKDFDCPSCNANNPVDEALAQGDEVRCNYCGSEFKVSVNSEGRVKFKEI

SEQ ID NO: 11206 - protein, 364 aa, Myxococcus xanthus
MNPADLLSAMKRTVEQLAAFNEMAKALTSTLELREVLALVMQKVSSLLLPRNWSLILQDERTGKLYFEIAVGDGADVLKGLQLNPGEGIAGAVFTSGAARLVHDVGGDPSFSPRFDEASAFHTRSILAVPLLARGRVLGIIELVNGPMDPPFTNEDLTILTAIADYAAIAIENARNFRRVQELTITDEHTGCYNARHLRALLDQEVKRSERFSHPLSLVFLDLDHFKSINDTHGHLVGSATLKEVGDLLMTLGRQNLDAVFRYGGDEFAMLLVETDPEGAAVIGQRVCEAFRGRGFLLEQGLDVRLTASVGVATYPDHASSALDLIRAADFAMYAAKARGRDALCIAEPIAPNGGTGSHEFPER

SEQ ID NO: 11207 - protein, 80 aa, Myxococcus xanthus
MLRTEDVEDGDLIITAGTDGIYPPGVVVGRVTNLEKKEHGMFQGADIVPAVDTSKLEEVLVVGSPYSAMAPGSAAEGASK

SEQ ID NO: 11208 - protein, 166 aa, Myxococcus xanthus
MKFLVSVALALALLTLESVLVKQAGLELGRIDVTVVLVAFLALRASLLEGTFSAFSVGYLLDLMSGQPTWLYTFLAVFIFLVGRLVPTFVEVRGPLAFALFAMGADVGHSLLATFFTWLTVKEDGPGSQLAEMPLQVALTGIAALALYPLLRRFEASQERPTGLLR

SEQ ID NO: 11209 - protein, 653 aa, Myxococcus xanthus
MAGLGLISIQLYRLQITRGEEYAAKSVANFVKEVRLRADRGVIKDARGTILVDSRPSFDAFITPAFCTDCYEQVIPRLAELLQWDPDQRKKVEDMVRMGRRNAPFQPVPVRVDLSRDEYDRLAARRDILDGVEVAPVPHRHYRTNSVLSHVLGYMNEITQEELERLNGDGARYALGDYIGRRGLERYFEQRLRGTDGVRKEVVNARGQTIEELNDKLGDNAVVSPRPGNNLVLSIDMRLQEEAERAFPGVTGAVVAIDANTGFIRALVSRPGFDPNLLTGRVTPAQMALLSRDPLDPMINRVAAEHYSPGSTFKVVTALAAFKSGAFRPETVVNCPGGYRLGARTWRCHRDAGHGLVDGFTAMKSSCDTWYYKVADTIGLDPIGEMGKALGLGSPTGVNVVAEVPGIMPTSAYHDKASPGGYTKGMALNSSIGQGDNNVTPLQLALVYAAIANGGTLYKPQMVNRLENLDGQTIESFQPEVVRKVDLPPAHLKAVVDSLVMVAHEPGGTAYRARMNHMRDKDILVASKTGTAQVARLGAIRLRTHQMSYFERDHAWYAGFAPADKPELVIVVLNEHGGHGGSDAAPTAMAVFQKYFDLKKLDATAPPPRPNQPYTPSSVTRAPSADEAALTRRVRPPARLPGDEEDRTRATAD

SEQ ID NO: 11210 - protein, 495 aa, Myxococcus xanthus
MQEQPRPPAEVIAFESDVRGAPLSSLIELVAKVIHRDFGDRVLLLRSAPGGHDAPVTKGADGVLRATLPPAEAGGPGLLTPSVLQRLTAEHGLHYVLLDGCRVADIGMPGKTARLVTTLDARKASAPRVLPTVVVEPGRASRASELSGKSLHPQWLPPCPLRLSLDRMARVLVDDRPLDATVLSPAERDALSRWARALTHRRVGLALSGGGVWGFYHVHILRWLVSQGVPIDIVSGASMGSLVGAYFCGSALDGHDGLEGLRRLEERAMSRQLTLAATAAIVTTYSLERFVEQDLGRLCLEELAIRFLPVTTDLTSGDCVALEQGPVALAVRASGSAPGIWGPTVVPPARYVDGAFTSMVPAHVLLNAGADVIFSSNIFPFGVRHASPRRQSGLGRFLAGLNPVARALDLAASGVLLLHRSGDVESLLADVRYDIQSAEAPLLTAMEFTKARDILGRAAADASLAKRLEEMKQHWLQVKARGVRAHAHPGGQQAA

SEQ ID NO: 11211 - protein, 138 aa, Myxococcus xanthus
MRSEQTLIVTEADLERLRQVVDHNGGGRTAEFAEMLDAELTRARVVASEEVPPDVVTINSKVVFEDEQSGERREVTLVYPRDASSDDGRISVLAPIGSALIGLTVGQTITWPLPGGRSKRLRIVAVPYQPEASGHYNL

SEQ ID NO: 11212 - protein, 336 aa, Myxococcus xanthus
MGYLGISMVAVLVVCLVDYRWIQRMALPIYVGNILLLIALRFFGHTAKGAESWFVIGPFRMQPAEFMKIGVVLMLAKVYHDDFQPNAPSYNLTRLWKPVLVVFVPFALVLVQPDLGTALMIGLSSLTIVLFGKVRWYLVATLVAGVFAAGIVIWNDYIRDVPEPRPTIVRHHLKKHQSQRISGWLDPEADLRGSGYHAAQSKIAVGSGGVSGKGWREGTQTGLRFLPEQHTDFIFSVWAEEHGFVMCIVLLVLYGAIFIFGLGVGFNARDRFGAFVAVGVVAMLFWQVFENIGMVIGLLPVTGITLPLMSYGGSSLLSVMLSIGLLVNISMRRHMF

SEQ ID NO: 11213 - protein, 164 aa, Myxococcus xanthus
MNQGEAEHRHFPRAQLATRFEVWVDDEAGERRFEASLVSVNVSVSGAFLESTFYLPLGPVLGVRFALEPGAAPVQARAEIVREERGDGPEGRSGFGVRFLDFSGQTEVALARLFVGMRLRAFAEDYLKSQRARSLPNEVERVVDVLAAWELLKATSSVSDPWQG

SEQ ID NO: 11214 - protein, 94 aa, Myxococcus xanthus
MLTADGVRMVKFFIHIDKKTQLLRFREREADPAKRYKLGPEDWRNRAKWKKYEAAIQEMLDRTHRPDAPWHVVPGNDKRYSRLEVLRRCVELLG

SEQ ID NO: 11215 - protein, 97 aa, Myxococcus xanthus
MAEGGVAFPLMPAVHFVQLVSGEDTQGLVARVKTEEQLARLGAEQMADSVLVGDNAYEVVPGYVAEVAAGAPRPEGADKKPDSEADLLAAFILNKMG

SEQ ID NO: 11216 - protein, 271 aa, Myxococcus xanthus
MSHTLVSLACHAYGIAAVVYLAYLVRQSEALATAGRVLVGGGLALHGVALFELLGVQSGRPVGLAQGFSALAFLLLAIFLFLDVRYRRPVIGAFLTPLALAALLPGLLLQGGQAPLPPGVRQPLLPLHITLALMGLAAFAVAAGVGVMYVLMERQVKAKRFGLLFSRLPSLEFLDTLNRRLVVWGFLALSITLATGAFFVGTAPGPWTVDGKTLATLVAWAVFAALLVARSVAGWRGRRVAFLTMAGFCLVMVSFLSSYDVSSPSAAMRMP

SEQ ID NO: 11217 - protein, 441 aa, Myxococcus xanthus
MELICIGLSHRTAPLTVRERLALPESRQVDVLQRLAQAPVEALWVSTCNRVEVYLFAPDAAMARQRALMELQVLGGVEALEHLYEHQGEAALVHLFRVACSLDSMVLGEAQILGQVKEAFERGQGAGAVRGELMRACAAAFSCAKRVRTETAIGRAATSMAAAAVQLASKVFDGLAGKTVLVVGAGEMGELAARHLKQAGASKLYVTNRTLSRAEALAAEVGGQARPFEELLGLVAAADVVVCSTASQAPLFTRDNVGALGRGRRGRPLFMVDLAVPRDIDPAVGTLDWVHAYDVDDIQKFVADNAAARAEEAQKAGVLVAQEVARFVKERALREGTPVLARLRQRAEAIARSEVERTLGALGDGLNEKQRKSIEAMGRAIVNKLLHEPTARLRAVGPEGEGNRLAGAAAELFGLLEEEVGTAAAAPSVMAAPVQVATGGK

SEQ ID NO: 11218 - protein, 313 aa, Myxococcus xanthus
MTHVRIATRQSPLALWQARHVGALLTSRHPGLEVTLVEMTTEGDRFLSAPLSAVGGKGLFVKEIEQALLDGRADIAVHSLKDMTSVFPEGLILAAVPEREDPRDVFCGLGGLTLDTLPQGARVGTSSLRRSCILRSRRPDVDIVSVRGNVQTRLARTREQGLAGALLAYAGLKRLGLEDVITQVLPPEVSLPAVGQGVLAIQCRTDDARVRALLVPLEHATTRIAVTAERALLAKLEGGCTVPLAGYATVSGDTVFLRGLVGRPDGTHVVRGEVRGPVSQAHALGESLADDLLSRGAADILRDFARRFEARES

SEQ ID NO: 11219 - protein, 182 aa, Myxococcus xanthus
MEALREAGTQDRIQRVKVATVGPRTTRAAEGYGLVVVAEPSEGTGAALLNLIKDALQPGDEVLLPAAEEGRRELEDGLREYGLLVTRVTAYRATPAPLPPESLALLDASPPDVVLFASPRTAEAFVEEAGRERLATARVVAIGPTTASALERLGVPAAAVAERPTPESLVDAAVLAVTSTVH

SEQ ID NO: 11220 - protein, 326 aa, Myxococcus xanthus
MLARIDISERRKPQDGRIKTERDGREVELRVSTLPTAFGEKVVIRIFDPETLVQDIAQLGFEPDEKSAFESWIDQPHGLILVTGPTGSGKTTTLYSALKALAGPDVNVTTIEDPIEMVWDAFNQVQVQPKVGLDFAGALRHILRQDPDVIMVGEIRDPETAENAIQSALTGHLVLSTLHTNDALGAVARMRDLGVPSFLLAQSLLGVMAQRLLRRVCSHCAQETTLTPDELLALQAPLPLLPGGVRLLKGAGCVRCRGTGFVGRTGVFEIVTSAGELRDLIAREAPYSQMVDAARRSGMRTLREAAVRKLAQGFTAFDEVVRMTTV

SEQ ID NO: 11221 - protein, 125 aa, Myxococcus xanthus
SPLRTLFAALLSLSSVSAWAQLPDAEADAPEAESAKAEEPEAPLTVAPCNAALPALRTPLAFMPGEVLEFDLDAMGAQAGTMTMRVHKQKDGHLPIQVEAQTNTFFSKVRRVRGSATAYLHPRTL

SEQ ID NO: 11222 - protein, 270 aa, Myxococcus xanthus
GGALSYRELRAKHDALVLAMGARRPRELEVPGRELSGVVQAMEYLEHQNRLVSGHGQKDPRLDAAGRHVVVLGGGDTGSDCLGTALRQGAASVRQVELLPAPPPVRAEGNPWPRWPVIFRTSTSQEEGGERRFALMTKRLTGSDGRLQTLHAVEIEFQPGPGALPRLIERPGTEVTFETDLLVLAMGFTGPEAGNLSEELGVKLSPRGTVQVDARFATSADGVFCAGDASRGASLIVWALSDGREAAKACDAYLSGGRSALPTRGTDCAF

SEQ ID NO: 11223 - protein, 549 aa, Myxococcus xanthus
MSSTQEPQVVSPLVKVRPGEAVKGRKEARLSLARGECEAVQVVLPGRVERPPVESLTLKGPGAALKASVWREAFIDVKTPSNGQGHKGPWPDALVPVDAPGHDSKLPTVFYVEVCAPEKQEPGTYRGQLLVKAGGAKFRPVPFTAEVQPFALPATSSLPNSFGVSMYSIARGHGVAPESAESRKLLRDYGRALLEHRVSAHGMSMTPPPVRFEKGRAVLDWREYDAEMAPFLDGSLLPSGARFTSTDVRDSKQAKTDAEKTAYYRAFAEHFREKGWPAQLFFYAKDEPKPEDVPLVKAQSTRVRAAGKIPVLVTSPLDDALNGSADILTPTLNCFYPRPGPQTCRSVVEARALRKRLAGDTRVWWYQSCNSHGCNGGPPADKAVDAAYSGWASYMVDHPAPLNRAMGVLAFSSGVDGELYFDTVFAYNTKKDPWKDVFEFGGNGDGTLFYPGTPARVGPSGHQPILTLRLKHIRDGLEDYEYLRLLAELGDATFARTAARKLARTGWDINADAGEWEAVREEVTTRLRKRWAESEYAKRTDRQTPQSTP

SEQ ID NO: 11224 - protein, 245 aa, Myxococcus xanthus
MAQESVNPAFGPGEQSSYRVRYLGITAGTAQVTVGAHMKQWGQDVWPIVAVARSNDMLGVWPIKDKFVSYWQPESQRVVGSDLHADENGSRRRQRIKMEPDGKTAFVVKQKEGESPRESTREVMEGTLDVTGATFALRNRELVVGQEYAYPVFTGSKQFTLRAKVEGREVLGTAMGDKEVFKLSVKTEFGGNLASKRDMFVYFTTDSSHVPVRVEAEFALGTIVAEITDYKPGRSMTVARAENGG

SEQ ID NO: 11225 - protein, 66 aa, Myxococcus xanthus
MALPPPTEDEARARADFQALRELARVHGLPGLSMGTTHDFEWAIEEGATVVRVGTAIFGERALKSP

SEQ ID NO: 11226 - protein, 61 aa, Myxococcus xanthus
MSWYANSGEPLDKAGAYAIQGKGGFLVAGVEGSTSNVVGLPLGETVALLERAGLPLPWRAS

SEQ ID NO: 11227 - protein, 456 aa, Myxococcus xanthus
MSFLRSQGSPVPESLARQFGMHNQVLDRLVNTELLAQAAERHGIAASDDELRKLIHQNTDFQKDGQFDFERYQQVLRDFYRKSPQDFEAELRRQLAAQKMMDVVRGNAVVSDDEVRARFEKEGNQAKVVFARFLPAMYADKVPSPTAAQLAEWKKAHEKDIKEYFEANRFVYQQPERIRARQVLVKLPPEATADQKKAALEKAQALRKEIEGGKDFAQVARDSSEDPGSKARGGDLGWVERGSWEPALADAAFALKQGEVTQPVETKFGVHLVKVDEKQAAQDKKLEDVQDEIATTLYKQDRAKQQARAEAEKALASAKAGQDLKTLFPPEKEQPALLRFETETRPEAVETDSFTAEGEAVPHLGPAPELVKAAFAVSAPQPLDSVFPLGEGFVVAQVVERQKPDAEGFDKRKEELRAQARQAKQIELTESFLKALREQGSVVTNTAAIDSVVGTG

SEQ ID NO: 11228 - protein, 110 aa, Myxococcus xanthus
MAGADVTNIGDGDFKQQVLDSQEPVLVDFWATWCAPCRAIAPSIEALASQYKGQVKFAKLNIDENQDTPQEYGIRSIPTLLLFKGGRVVEQIVGAVPKARIEEAVKKALT

SEQ ID NO: 11229 - protein, 862 aa, Myxococcus xanthus
MVKPHQVGVVQRVLSASRPRFVLADEVGLGKTIEAGMVFSALRLSGLARRCLVVAPSHLTVQWLVELFHKFNQLFTLMDSDRYAQSLKEAPEVSPWARFPLVVTSLEMLQRSEEHRRALAGEDAFWDLVIIDEAHHLKGERAFEAAQVLAKNTWGLLLLTATPMQLDPAEYHGLLTLIDAATAPSVAGFEERLKRQEELSAAVRALMEGGKPSAAVQALAKRFPEDAKLSSLKDRDALLQHLSETYSLSDRLVRNRRAVVGGFSTRRLHRHPVTLPAEELTVRDAALAVLAGASLRGAPLGNVLRRLESSPAAFAGAVRANPVFKGHADALRLPSRDAKFGAFLGVLRGVWKTEPAAKVLVFTESRDTLDALQSELGREGVEALGYHGDLPLVERDRQVARFRDPEGPKVLLCTEVGGEGRNFQFAHHLVHYDLPWSPATVEQRIGRLDRIGQTHPVEIHVFDPAGTLASDVLMLLADAVGVFGETVGGLDAVLEEVEARLAELALMPREARMAYAQELKARVEAARAQVKRAYDPLLDVRSFDRPAVERLVKRAQERMGIEADEEDEDGEAEASGVEDGLWGIARDLDERLEETVTELARRVGIGVDTDEQVEAFQVAFQFGHALKVDGLPGIDVMEDRTQLGTFWRDTAVEAEELEYFATGHPLVEALFGFLRDGPYGRSAFRFIERRGPQKGRGVELLFHAQLPEPEDTSPGARVPSRQLARFLERTLLHVAVVDGAGGPKSDPTLLPALEKEGKSLKGDEVSLAFPGFADFVDAAVPVGQKAAESELAKLATRARKAIEAERDAAVARLRLSLGHQGLSTEAVEAQLDAERTHYARLLDALAGAKVVLDSACGFVLNR

SEQ ID NO: 11230 - protein, 226 aa, Myxococcus xanthus
MMLQARILAQVAAYRAVRAGSINHGNCLPMMHAALVTMLPTVARTDSSETLAAAFSPRRHNQFRVRSSYGRDFNEPLIEIVRESPDAGWAQELTGGEDLLFDQPTDNAAALRARTLEIRMVAWYYMRVPFANWVMSRMLLAHFRLRRYTAANPLMPVQRRSAWWGETSATLGRDGWPGGDLGTRMVRWSDQGHFVFPIQVNAAMRMMTPVMSEYFMGGPACNLHGS

SEQ ID NO: 11231 - protein, 484 aa, Myxococcus xanthus
MVLMTLGFGMRAKERVEIQMAADAAAYSQAVATARAFNAISVMNRAQVAHMVAMAGTQSLISHSSQEYAAHDVACPGSIPPPVWFAADAAAATQVRQLQGRAGNMFQAGLNIYGKLLSEHIAEQELTRRVAQAVNPELRAPSAGAAKSFSELNGGNDVPERDAVIQSIKAGTYGCGVGDGALCPSGGGTPALNATMGSMGWTWVHNRPGGTAGFGTGGAAISTSFRRYGSVSQMDPSTYHTVSGRNSTAHDHGRVVIPTRCTRAPTLPPIATDAWVMSDEEQTHEDQHVYGARMPPGQAPEDGKPTYETHTLGACVVCPGIWPYSVGYNVDELHAGASNHYGQPKLYSMLYRDYASAERRARPDPWNLFFRFRFAGTETEFDNSSPLGRIRPTGREDVHRNQVALSAGMVYYHRPQPAVQGGGWREPPNFLNPFWRATLVSAEGARDDRPADSLSAAGFSGHARALRELHSVGYRGGGPGDRGY

SEQ ID NO: 11232 - protein, 316 aa, Myxococcus xanthus
MRVRHARGQSLVETALGVMVFVTILLFGIYFAEVGALTLKVQEAANFAMWNATGRVMHDPQDNEWGRRGTVLAAEAEANGRYADFDGRQRMGRTGVAVQQAIARAQPIQVDCRPELPGTVRGLSMADADPDLAGTIAMGTQGMGCTASSSIRGVRIGRYLENGREGFFKVSQRRAADAFTVCAAGRASGGRCTARFGMLLDDWGLGGVEEGRACALNINGARRCANPDYYEWAQRVYRANGAGGNAGSALAAITGAAGVNEDQFFMSFRGEEDNYEENLGSTHAGGQTRWEVTPFDAPNIRSYKVGRASHWLGVPR

SEQ ID NO: 11233 - protein, 193 aa, Myxococcus xanthus
MIAALRGRTAEAKLDVDILEGDGMALPFEANAFDAAFSMFGLMFFPDRARGFQELHRVLKPGGRAVVSSWTPFERSKELRAVYTRLWEQMGAKPSQPGAIPLSDPDTCQREMSSAGFTHVTVNEVEGSIDYPSTAAMVDATTRSSAPVVLARRALGPQWEPLLWSMHEYAQAELGPGPQRVTLTAYLTTGTRP

SEQ ID NO: 11234 - protein, 144 aa, Myxococcus xanthus
MLTAIDGHRGITYTVIFQPQPDRTTLMYLGEANHALRRDPAAAGDFAPMPPQASQVLRVNSESSRTLAFHVPLSGEAVDAFYAQALTRAGWRLEEGETSFYVRTGEELRVVHEPGEGNQRAVVLVYRGGRSVPPPPPGPAAVVR

SEQ ID NO: 11235 - protein, 211 aa, Myxococcus xanthus
MAETSVETLKTAVQALYRVHAVEGPPGENGLRTVWHLCPDGAELMSLVDSEGRVRRQELTLLEDHYVWASGEGVRTGYLERGGGKPTAAAVVQTDPELVPQRLMRAALAMGTYTGQDRYLLHMQRVLALAREGLEMKGGLTRPSEPTLPAVEAPVVSTAQAAVFDVPPAAVAVVEDVTPPVVRRGEGVTMLLVLALGLLVGFGMLAFILMG

SEQ ID NO: 11236 - protein, 120 aa, Myxococcus xanthus
MSATKNFSLARAWLDAFNAYDVDALVALYAEDATHTSPKIRVLHPETGGRLVGRQALSAWWKAANARLPGLRYELVALTADEDRVFMEYLRHAPGEAPMPVAEVFEVRDGRIVASRVYHG

SEQ ID NO: 11237 - protein, 109 aa, Myxococcus xanthus
MAKNSNPSAFDRDFGYLMPFLDRVAAAASDLEDASARAELTRLMVEEKARWQRIQELLGGAGGRGAAAPTPAREAPAEAPRLARGSADELHEAAPFATGLTVGSLRGSR

SEQ ID NO: 11238 - protein, 390 aa, Myxococcus xanthus
MGDALFGYDMVLQVTQNEINSQFSRLMQQGYIRSLLKTNGLATAGGAFGGGEMTLTSYMRGYIAAPSVAQPMVILASGDNPQQCLFQFALQSQPLTQTVMEQLGFTQAQVDAAFASPQPGPDNSQYGLLVNHEDIAFGSNGEAQTLPNQTVYYWLKRTSVTVGTTTTYSNYLVPALFYMSGGLYPTLVDLSGLPLRFTVNLDSIPTTPQGIAELVDKGIMPPQVLDTINGSGFNSAYFSLKQLFLNFDTTDFTQWSTTAPPTSTAVTGASINTASNTFSVSTTTLAQLVADPGFLTEVSVALQYAFGVGATYDGNPASTPYIIGVSVTSSNPAQTDPDSTPLLVPTSVGFSSLRNNADSGLSVLNYQVMGRRQRQSHPAGAQRGHELRRL

SEQ ID NO: 11239 - protein, 215 aa, Myxococcus xanthus
MTFTYQTSYEWLVRSTPPPDNRLKTGTYMKVTQKESPNYTIAVSGNTVNVSGSLSITQKLAATLEVLSIEIPLVWSVTCQTSFSQALTLAVGGNGYDLVVNHSQATFSKPVNGPLESNNWEAGLSSFVVQTAWAIIDQLFPTSKLIQELNPARYTVDVVHAQINNTFNKLNSQLNKGLTGGATGNFISPTGAVFLLNAPRFNDALALQMDVTYGV

SEQ ID NO: 11240 - protein, 338 aa, Myxococcus xanthus
KNYLPALPIAPGGQVTAACDSNGYPIVFSFGADSGDFYAIVNTRNDSTGWSQIDLLPGVSALGKPVYFASGQLSNGNLCLFLACQDAASGAVNTYVAGPLSNNLEVTDLSQLAALWTPTGNPLSGASVSRASISPLDDGKGFGIPMIAVGLVAPGATDVLTYLMQATVNTTTGAITWNWTSFPSPTDARTVLDSAPGAVSDLGQGLYMLYAGQDGSTHLVFKTLLNEFGRDYVRALPVPAGQNSLQTTAGSGGTSYLYAGGAAGIVFWSASAQLESNAPGWTAAQTVATGEQLPGMAAGGLVVPQSFSKSNALSAWALSGSNLYLLSQFEYQGALHWT

SEQ ID NO: 11241 - protein, 56 aa, Myxococcus xanthus
DGVTDYALCFLDRHGRVTAWNAGAERLTGWSEVELAGRDADRIYPVDEVAAGVPRA

SEQ ID NO: 11242 - protein, 186 aa, Myxococcus xanthus
MAKDKDDNGGGFSGKRNKSWREIDAGRGKGSKYASRQDDPAQQKLERSASYQKYKAAADALFTGGELPEGLAKTFDPEGKRKAQKQAMQKVTESETRADWVKAVVDYLEKYPELPEDAYFLDSLLDHPRERIVDKALAKLEVLGDEGKLKTKVPQSLDQRLKSVELTSMDPDMQGRAKALREKLRA

SEQ ID NO: 11243 - protein, 76 aa, Myxococcus xanthus
MLELGWPPGLTSVKPAVLEADTDAPPVPQPLKDYADEALFEAEQDEEQPLSSQELEAVRRLVHRGLAALWGARKER

SEQ ID NO: 11244 - protein, 260 aa, Myxococcus xanthus
MAGLLVGSPWAIVLLLIAGGFAGRYYDAQHALPPEDPEALSGFSHAPYASAHDATSEAALVPREEEPYEQFASDLCAVFVEVAHADGEVRRDEVRVVRRYFQTTLGYGPEALEVVRSHLKVFLAHPPDLDAAVSACHAQLPSAERHRLLDTLYELALADGGMQRSEREVLRRVAEGLGISEADEQAIIALHLGAGDEHYAALGLMPDATDVEVKRAFRQLAAEHHPDKSAHLGRQAAEQAARRFQQIRDAYEEIRRLRGL

SEQ ID NO: 11245 - protein, 74 aa, Myxococcus xanthus
MAITLPDEPIETPFEVPANRPEVTDEPTDAFMKAQVSWDGWAAHGGGHVPEDYAWTSNPKERQDELMGEWPGES

SEQ ID NO: 11246 - protein, 309 aa, Myxococcus xanthus
MALALEVPLLSLALVGSGMDRRVPLSAMLGLATLPWMLGLMGTEVLMDRVLASLPRLDTVEAGLVLATSTGEAMAPRLLGAWTSTALLLGLALGLALAHFGPTGFREPAGSRNRGLLLASGVSASLASVAMVGALEARHLLSFLTSLARMPDAERSELIATGLAATANLRALRWTCTGVLAVLGLTLMARRAGEDSHSPLGWSARLVPATAVAVLLVLDAHPVSSATEHAPVAIPAEHGESPSGSMPQPPSGDVSPAQPIKMNASIPNPTSNPRASTSSIVTPSPRRTTGGVTSSTTATAAGGTSKTAA

SEQ ID NO: 11247 - protein, 55 aa, Myxococcus xanthus
MGMHVPLLLAGVLAYGRIGCNGGGCPKLYLLGVLVSPIAGVLASVIYWLVGRPPV

SEQ ID NO: 11248 - protein, 501 aa, Myxococcus xanthus
MKILAGAARADTGELQLRRGARVTYLPQEPEFPEGATVASELSVSQGPLKEALAAHAELAKRMESAPAEEQEKLMAQFSALSDRIEQMGGWDTEHHAKTLLDRLGVKDWDRPVAQLSGGLRKRVAIARALLTRPDLLLLDEPTNHLDADTVDWLEEELDKLPGALLLVTHDRYFLDGLVDRIVEIQPGAGVTSYPGNYQAYVEQKLVAQENAALAQHKRERWIAQEVAWLRKGPEARRTKSKARIERAQKLMAEKGFERPKVADLRVAAAPRLGHTVIEAEGVNKAFGDRKVLDGVDFRLQRGARVGLVGPNGVGKTTFLRVLLGEVEPDGGKLVIGKNTKVAYYDQSRAQLDLEATVYEAASQGEDWVELGDQKIALRDYLDDLLFPVPMQRMKVKALSGGERNRLLLARLFLEGANGLLLDEPTSALDAASEAAVGEGLVALMKGRTVLVIAHRLSTVRDADLIAVVEAGRVVEAGTHAELLALRGRYTQLLGEGAVAA

SEQ ID NO: 11249 - protein, 662 aa, Myxococcus xanthus
MDNMDLEREKGITIQSAATFAMWGEYNINLIDTPGHVDFTIEVERSLRVLDGAILVLCSVAGVQSQSITVDRQMKRYRVPRIAFVNKMDRSGANYDRVAAQLKEKLNHHPVQMQMPIGAEDRLKGLINLIEMKAYYFDGESGEDIREEEIPAELLEEAKTRRQQMIEGVAEVDDQLGELFLADQPISNEALIAAVRRATIGLKMTPVMCGSAYKNKGVQLLLNAVCAFLPNPKEATNEALDQKNNEAKVILDSDPEKPFVGLAFKLEDGRYGQLTYMRIYQGRVTKGDFIINQSNQKKVKVPRIVRMHSSQMNDINEATAGDIVALFGIECASGDTFTDGVVNYTMTSMHVPDAVISLAVAPKDRSNLTNFSKALNRFTKEDPTFRVHRDEESGQTIIRGMGELHLEIYIERMKREYNCEVQAGKPQVAYRETISQKGEFAYTHKKQTGGSGQFARVCGYIEPLPSDAVQQYEFVDDIVGGSIPREFIPACDKGFTEAVKKGSLIGFPVVGVRVVINDGAFHAVDSSEMAFKTAAIMGFREGYAAAKPIILEPMMKVEVQAPEDFQGSVVGQLNQRRGTILSTETAEGYVTAVAEVPLNTMFGYSTDLRSATQGKGEYTMEFSRYTPVPGNESEALKGGVQEEAGRRAGRAQVVRASAALWR

SEQ ID NO: 11250 - protein, 467 aa, Myxococcus xanthus
MADFDLVVIGSGPAGEWGAVQAALAGKRVAVVEREPVLGGTAANTGTLPSKTLRETALHLSGFRARGLYSVETTLRHEATVSDFLFRERRVKDIERERIARNLQRHKVEIIQGTGALVDANTVVVRRQDAPERRLTGGTILVATGSSPYRPPLYPFEDPRIHDSDEVLELERLPRSLVVVGAGVIGCEYACMFAAMDIPVTLVEARAELLPFLDDEFSALLGQRMEALGIQLRFGQVVEQVDVPRDADTPIRMMLSSGAVLETDQVLVASGRTANTAGLGLEALGVQVGPRGQVEVGPTYQTALPHIYAVGDVIGFPALASTSMDQARIAVEHAFDLGGVRTMAPVLPYGIYTIPEVSMAGETEEALRTLNVPYVAGRAAFATNPRGQILGDTHGLLKLLFHRESLKLLGVHVMGPQASELVHVGLTALLTGSTARLFVETCFNYPTLSEAYKAATFDALDQLSGCP

SEQ ID NO: 11251 - protein, 1990 aa, Myxococcus xanthus
YRKRGVDTRHVREFLSRKLPEHLVPATYVVLEALPLTRNAKVDRKALPHPDHVARPTQREESKPAAAARPGREAQALQQSIAKAVAEVLGVPEVHPDRNFFELGANSVHLIKLHLELKEKLGLSVPVTDLFGRPTVKVLAARLAAAGGEEKPEVALAPREETPRTQDARDIAIIGLSCRFPGASTPEQFWQNLMQGVESVGTFTDDELLAAGVSPEAFRNPGYVRSSAVMDDFDAFDAEFFSLTPREARALDPQQRVFLECAWEALEHAGYPPSGRNGLVGVYAGKSVSHYRYPYPDLTRPIGFFQDLMAQDKDFLATQVSYKLDLRGPSINVQTACSTSLVAVSAACAALNEGSCDLALAGGVAIKVPHRVGYLYEEGSVFSRDGHCRPFDAGANGTIPGSGAGIVVLKRLSQALADGDRVLAVIKGSAINNDGHRKVGFMAPGVEGQTDVVRRAHQHAKVDPRTISYVEAHGTGTAIGDPIEVSALTEAFGGQVQAQSCGLGSVKGNIGHLDSAAGIAGLIKVVLALQHRTLPPTLHYQSPNPRLELDKTPFYVVDKARPWTATQGVLRAGLSSFGIGGTNVHVVVEEAPPQATPAPDVQPLDRSRHLLALSARSPEALRQLAGRYRAALEAPGASLADVCFSANTGRVAFDHRLAVVGEDAAQVAAVLGAAERKDEHPGVVQGEADTKQAVKVAFLFSGQGSQYVGAARELYQTHPGFRRRIDSFDQMLREYWDRSLISVLYAEPGTPSPIDQLDYAQPVVFVLEYALAELWMSWGIQPDVLLGHSTGELAAACIAGVFSVEDGLKLAVHRGRLIQQLPEGGNIAVSAAEPELRQFLAQGGWASSIAAVNGPDNVVISGIPAEIVEIGQALDAKGYKVKRLNIPRAAHSVMMEAILPEFRAVAASLRYSPPSIPMVSGMTGELITDGLCTPDYWCSQLRNPVQFGRGVEALYRDGMSVFVEVGPKATLLGMAARSVPEGAGTWLPSLRADDGGWRQMLESLAALYVRGVAVDWAAVDAGYPRRKVEVPTYAFQRQRYWEEGAGLQRPNGRSVSRAEHPLIGERVPLAVLEAGELLFEATLGPASQAFLGQHRVFGTPTLPATGYVEMALAAGTRLLGTTALELTDLAILNAMTFPKDAERKVQCAVRRDGEGRAAVRIFSRTGEGSERAWSLHATGTLAVLGDDATATEAHDLDSVLRDLQTPLPVEDYYQRARNAGVDFGPEFQGITELRREGEQVLARIERPAGLGSGGGYLAHPALMDACLQVVGGAYPDMDGTELYVPVHIERLHVLGSIEDGVWSHAVVRPVDEAGKRLRADVRIFGRDGALRAWVRGLELQRTSQEALRAALSTSLDEWLYERRWEPLALEGTRPETLVPASGACLILSERDGAGQQLAQVLKRDGRACFVAIRGTRSHRIDETTFEVPDAPDALVEALRELPLPAALSDVILMWGSHTEEAETLDADALGQAARVTGGGALGLLQFLLDRGYSGTVWLVSRGAQPVKPGVPLTGIAQSLLWGMARPLTIEASELDCRCVDLDAQGEPSAQVELLAQEIRRRAEVAEDQVAYRDGRYVARLRRVESRKLVEASAERVEAFRADRSYLVAGGLGRLGLLTAELLASRGARNLVLTGRGAPGPQTAERLEHLRQQGVRVEYRQVDIADAEPLAALLNEVARDMAPLGGVFHSAGVLDDGVLRQQRWERFETVLRPKLRGAWNLHRLTAGLPLDYFVMFSSVASLVGSAGQSNHCAANAFEDALAHHRRALGLPALSINWGIWAGDAGAQVSVSEEARTPGFGVIPKAQGLRALELLLTSRVPQVGVAAIDWAVFGSGRSTPYAAELRERAGGERTVERASFLDTLTAAPIEMRRQLLMDYVREQVAWMRGVGSSESIDPARGFHELGIDSLAALQLKNRLQSGLGVSLPATLVFNYPTAEKLATQLMDAFIPLEFTEEARVTSKSDAPVESPLEGLAEANLAHLLSEQLSKMN

SEQ ID NO: 11252 - protein, 1840 aa, Myxococcus xanthus
MKRALLKLQETQSKLDAHEQEKHGAIAIVGIGCRFPGGVTSPGEYWRLLSEGVDTVTEIPSDRWNADSFFHPDPDHPGGIYTRHGSFLRDIDQFEPRFFGISPREAARMDPQHRLLLEVAWEAVERGGRNPTSLSGTRTGVFVGLMGQDYTQIATQSPELIDAHTGAGNGASVAAGRLSYSFGLEGPSLTVDTACSSSLVAVHLAIRSLRQRESDFALAGGVNLVLSPVATLIESRTHMLSADGRCKTFDASANGIGRGEGCGLVFLRRLSDAIADGDPIVAVIRGSAVNQDGRTSGLTVPNGLAQQRVIRDALRDGQVEPAKVGYVEAHGTGTSLGDPIELEALASVYCARTGRQQPLMAGSVKTNMGHLEGASGIAGLIKSALCLANEEVPPHLHLRTPTSHVDWKQLAIEVPTARRPWQGTESRFAAVSSFGFSGTNAHVVLESAPRPKSPVRDVERSRHVLALSARSNASLRRLAGSIAEELSLGPAEGLADICHTANTGRSAMEERVAFTASTSEELTEALRAFSRGAPTVRETCVEGRRDAEAPRVAFIFTGQGSQYAGMGRELFDTQPEFRRELLRFEGILKPHLERPLTEVLFQDTEGALDETRYTQPALVALELALAHLLRAWGLRADAVLGHSVGEYAAAMFAGVLEPEAGLPLVAERARLMQALPERGAMLAVFAESARVLPLIAGHPRVTVAAINGPRNTVISGDSAAIEAVVQALVEAGIESRRLKVSHAFHSPLMQPMLAEFERAASRASFQKPRLPLISNLDGREAGEAITQPAYWSRHVLQPVRFEDGIRTLLQRGVRVFLEVGPKPSLSNLARDVVAGEEALWLETLHPRRSDWAGLLRAMSELYVRGARLDWERFDAGYARTRKALPTYPFERQRYWLDVPAPWTRTSRRASTHPLLGTRLESAALKEGTTVFSSELSAGTVPFVADHRVYGKAVVPAAAYVEMLASAAAQVLGTESLRLEDISLLQPLVLPEQQTRVVQTLLEDQGEAGLACKVVSRGDERSEEGGGGSRAAWVTHVTCRVSALSTVAPSVDREAWGRDCATPVSIDELSAVFTHHGLDYGPSLRVLTSLHRGTGAALSLGQVEDRSGHYRVHPALFDGCLRTAAAVSRLTEEDALHLPVALQTLDLYRPLPERVWTYAAQPPREGQEGFSATDLTLCDDDGAVVAVVSGFSVRKAERDVLLRGLENDFQDWLYRLNWVSRAVTEEAHSANQHWAVFASEDDFASDLVQVLSQRGERCTLVRKGESFSSTPEGFRINPANPEDHARLVKAWANQPPTGLLYLWGLDEGGHAGDAGARLDAAQELGCLGALRLTQALAHGQGASPRLVLVTRGTQSLPSDTHGARVAQAPLWGFGQAVATELPELRCLRIDLPAEPRSEDLGTFVRALALPDGESGAAIRGGGLYTPRLERARSRSVAAKKVSIIGEATYLVAGGLGGLGLRAANWLAAQGARHLVLMGRSAPSPEARAQLDALESQGVKVRVARVDIASHDAMADLFASLREAPPVRGIIHSAGVLRDGTLANQTSEQFREVLAPKLQGAWNLHALSQGMALDFFVCFSSAASLIGSPGQSNYVAANAFLDALVHLRHAEGLPALTLNWGSWAETGMAARLERAASARPGAQGFGAIPVQQGFSVLERLIGSAQVQWGVFPVDWTRLAEQLPGLARQALVQGLLGSVPQRAQAPAFRAQLDAAPPNRKAELLRQHVAGQVSATLGMPESERLSGNERLFELGVDSLLAIEIKNRLASSLGRSLRSTLIFDFPTVNGLVAHLAEELELGTEVQKKQEASREAQGALSAEIQGLSEQELTSLIDQELESALTR

SEQ ID NO: 11253 - protein, 1741 aa, Myxococcus xanthus
MYTRRGAFIDGVDLFDPGFFGITPRDAKGMDPQQRLLLEECWRALERAGIPPAGLTGSRTGIFLGLMHNDYNLLGIAENMEFHSASLNYPSVAAGRISHTLGLQGPAVSVDTACSSSAVAIHLACQSLRNDESDLALAAGANLNLSPVTVMVECQNRMLAADGRCKTFDASADGFGRGEGCGVVVLKRLSDALAHGDAILGVIRGSAVTHDGRSSGMMVPNGRSQERVIRAALDSCGVEPDQVGYIEAHGTGTLLGDPIEMEALRSVFGRKGARGEPLYVGSVKTNIGHLEAAAGIAGLIKVLLALQNEAIPAHLNFERPNPNIRWDDLPVTIPTATRPWLRGDKRRIAGVSSFGFSGTNVHMVVEEAPVLARPRVDAERPAHVLTLSAKSEAALEALMEAQERALPEDPAALGDWCYTANTGRSQFEHRAAVSGATAAELRANLTRLREEKLRPAREPLRGTESPRPVFLFTGQGALRPGVGRELFETQPVFRAAVERCSKALEGLLDCSLEALLFGESSAMLLEDTRHAQPALVALEYALAELWGAWGVTPAALIGHSLGEYAAAAVAGVFSIEEALRLVVTRARLIGELLGPGAMLAVSAPLDTVNRAIAPHAGSVSLAAVNGPDDVVISGTPDAITEVEQALSSQGIQTKRLRMSYAFHSTQMEPVLKPFAEAFQGLTLSAPRIPLVSTLEGRRVGDEVSRPEYWCRQILEPVAFAKALEASREDGHRTYLELGPAPILAGIGRRTFQSEELCWLPSLRPSTGETAQLLSSVAELYMRGFDVDWAAFDAPFERRPRCLPTHPFQRERYWMDLQSPENRRGYAARDDAARGDAHSLPGTPLSLAGAKETRFAARLSRHEPAFIEEHRVLGNPVLPAACYVEMALGAAHHATSGGKPLELTAIELERALVFAEGQSQDVQTVLTPEEQGSRFEIFGQATGTADRNWARLAQGRITEGRMNPEHVALESELLQAFPRQGSVSAHYDMMARGGLEYGPSFRGIDALRFGGEGCLAHVRLPDALVIGLGDYWLHPLLLDACFQTAAAAFTDGGAQVAGEGQGRIPVAIERLRWFKRPGSSIWVHARTGARTSLSEGLASADLRILDEDGTVVAEVEGLLLKQVDRRAFQAAFSGAMQELLFELAWREQPAPSARDQVASQSGPWLLLVDSDRVADEVRTLARQRAWICVVATPGASYERVDANHYRLNPHDAAGFDRLLQDVSAPAAVAYLWGLGDRSPEALSGAVTSSTLGALHLVKAMARAGWAQPPALWMVTESAVAATPTDAVEGFAQASLWGFGRAVAIEHTEFMCRMVDLEPGSESLERLFLLMAQPPQENVLALRGGRILGARLVRPGKPPERAAPVRIRPDGVYLVTGGLGALGLETAEWLVGAGARHLLLVGRSEPTDAANARLAALTARGVGVTVARADVSRQEDVQRLVASVSERGLSLRGIIHTAGVLEDGVILHQDAERFSRVFAPKVQGALNLHRATAGMPLDLFVMYSSAASLVGVAGQSNYVAANSVLDALAHHRNRLGLPALSINWGRWAGAGMAAKSADRPEASDAASLSPEVALQVFEQLLEQGAVQVGVVPFSVSSLEAGPSPGHGPLFSELMLREQARSAAASRMHELMEELKRADGERRRALLTRYVQSRLGPLLGFAPDHEVLQKRISLNEMGLDSLRAVELKNRIGRELGVDLLMARFIDGTTLDGIVDALSTQLELKELLARAPAAEAAADIEELTV

SEQ ID NO: 11254 - protein, 651 aa, Myxococcus xanthus
MLSAFFVLLHRLTGREDLVLGANSINRTRTELEPLVGFFVDNLVMRVDLGGGPGFATVLERVRETVLDAFAHQDLPFDLLVEELRPARSLGFNPLFQVVFAWVRASGEAQDETGLRMRPLEFEAESSRFDLNLFVDDHGDRLSARMVFNRDLFEQGTIQHYVDCFQVLLEGLVAEPQRPVGELPVLPADVRERVLRQWNDTGTPEAEGACLHALIEAQALRTPDAVAIVVDDWELTYGELDQLSDRVAASLQDLDVGPEVVVGVYLDRSAELIVSLLAVMKAGGAFLALDADEPVDRLRHIVADARPRVVISSAKLSERLWGMGGFVTLHVDEGYRDMPAAPGQQLRRDVLPDHLAYILYTSGSTGRPKGTEITHRSIVNYLRWSVDAYRLREGTGSPVIGSVSFDGTLTSLFAPLLAGRALFLVPRGHEIDQLTSRDYPEQGFSFIKMTPSHLRAFNGLGRTREVLGRTHAVVLGGEGLHGVDLAPWREQGLPTRVINEYGPTEAAVACCFETLLPDGTPPPERVPIGRPISHMRLYILDRYLQPVPVGVPGELYIGGVGLARGYLRRPDLTAERFVPNPFDGGLEGSRLYRTGDHARYLSDGSHRIPGPPGRPAQGAWSPRRDGRGGGGACGAPGRPRRRGGVAEGRFE

SEQ ID NO: 11255 - protein, 237 aa, Myxococcus xanthus
MSQQRNGPKKKEAAFSNNPFKSAIQVMKDQEKKEAQEKAAAEVAKRKAAAPPPRATKAPKVREEDDASLFFSAMDGVQQLTHRGEAPAPNPRLPAIIDENAEALAQLSELVAGQGDFDFTGTDECIEGASPGIDRNLMRALRRGDFAIQGQLDLHGKTQSEARDALERFLGDSRRAKKRCVLVVHGRGLNSKDQIPVLKERLKGWLSEKRIGRMVLAFATARPQDGGTGAVYVLLRR

SEQ ID NO: 11256 - protein, 700 aa, Myxococcus xanthus
VPSWFVVLESLPLLPSGKVDRKALPAPDVDVSERQYVAPRTPTEELLCGFFSRVLGVERVGIHDGFFELGGHSLLATQLVSRVRSAFRVELALRELFEAPTVAELARRIDQAKRSGAEMPMLRSPAVPRARELPLSFAQQRLWFLDQLQPGSAFYNVSAVVKLTGPLDPIALEWSFEELVRRHESLRTTFRAKDGTPVQVISAEPTLAFAVVSLEALDDTERDAAAKRLAEEEAQRPFDLKKGPLLRATLLQLREREHVLVLVMHHIVSDEWSMGILVREVSALYEPLSQGQRSSLPDLPLQYGDYAVWQHEWLADDVLEAQLGYWRQQLAGSPSALALPTDKPRPVMQTFRGSMQEALWPSELWAAVKALGQREGATPFMVLLAAFQTVLSRYSDQDDVSVGSPIAGRTREETEGLIGFFVNTLVLRTKVSPVSSFRELLAQVREVTLGAYAHQDVPFEKLVEELQPERDLSRSPLFQVTLTLQNTPFSEVQLRELTLTGVDAEEKTSKFDLSLLAEEVPHGLSVAVNYNSDLFKAATMERLLGHLRVFLDAAVSAPETRLLDLPLMGSEERERLVKEWSGTASEYPRDASLSVLFEQQVQRTPDAVAVEYEDQRLTYAELNRRANQLAHHLRGMGVGPEVRVGLCVERSLELVVSLLGILKAGGVYVPLDASYPLERLAWMKQESGVAVLVAQEKLAF

SEQ ID NO: 11257 - protein, 213 aa, Myxococcus xanthus
GPFSSIGTLPANLRVELDALDVRGRQLQDALKGDSHTLATRALALYRQCKDVVTKMPPSTGRTELLGVLEKMTGDSFSLAEVHFGLEAQLGSVVANDVDAQVRELRERAAATQDAVARRQLELAASSLGEELNHLDVLARRKERLLAQLHAQVALLERARVSFIGVQGNELGAKGAQAADLARKLKQLGEPSSSGGPDDVASVAAPNPTRVAP

SEQ ID NO: 11258 - protein, 252 aa, Myxococcus xanthus
MTLGDLIYSFFTYYAVVAYITVGIISLVFAVKWFENPLRMLLAMLAASVAFPFGWYLVHKHILHSRFLYKSPLTAATWKRIHFDHHQDPHDLRVLFGALANVLPTVGGVIAPIGYLIGGKAGAAAALGWAMVITCFYEFCHCIQHLNYTPKSQFLKDIKRLHLSHHFHNEQGNYGITNYFWDRLFGTFYEKSGDKPKSPTVFNLGYTAEEAQRYPWVDRLSGGTRGDGHPRRFWENQADAKTPPEPATRQES

SEQ ID NO: 11259 - protein, 131 aa, Myxococcus xanthus
MSETKLPRPTDGELAILRVLWARGDSTVREVHEALTRDEPEGTGYTTVLKLMQIMTEKGLVERDESQRAHVYRPRATEQRTQRQLVTDLVDRAFGGSPARLAMQALSSKKTRPEELAELRRLLDTLEGGEE

SEQ ID NO: 11260 - protein, 705 aa, Myxococcus xanthus
MESLGWALLHSLWQGTLVALTLAVALITVGRRAAHARYALACGALVLALALPVASGWKHFHGAPARVAMDTSVPRAQSLTSALGTRGLEETVTQAARPAWRVAPVAASPAWIDADMAEDGAANGFESTLLTGLGSFLVMAGLLLQRALSQVEAHLHWLVLAWVAGVGLCSGRMAAEWMKLRRLADRALPAPAAWQERLDALSRRLGLRRAVRLLQSSDVDVPAAVGWLSPVVLLPVSTLAGLPARQLEMVLAHELAHIRRHDFAVNLAQVLVETLLFFHPAVRWISHVIRVEREHCCDDVAVAASGNSVSYARALTALETLRVLPGAPSPAMSALGGSLPERVRRLITLPTSRCASRWAAGASVLTLVSSLAVAAPLTSLLLGQTDAAPQPGDEPVLIQPPPIPALSLAPPVPPAPTPVPPPAPPAPPAPPASVAAVAVQSAPGPTPPPAPPARSLGSRAQRESDQQTRVGAGQQLSVAQLIALKNAGITPERVQQLTAMGYTPTVSNLVRMSHAGITPDYIQDMNTRFGRKLEAKELTRLRNLGVTPEYVQSLKSAGFNVDDPKALSHARAVGVDEDFVRGIKDAGYAGMSLEELAHLRAVGVSPEYIREMNKHGLSKLKARELMQLRAVGVDPGWLASIRKAGVQTMDTKVLQRLRATGVDAHFLGELHDAGLKDLSVDELVRLRTGGVDADFIRKMRGTGSK

SEQ ID NO: 11261 - protein, 269 aa, Myxococcus xanthus
MGFTEPLASFQGLSTTGGATTFTLPREAGTFHFEGQFQDSQGAGHFRFDASSDFLKKLATLGYSDITPEVQFQLAATNVTTARIQGLAALGYKQLSTEELIQAGIFDVTPEYVRGLSDAGYPGLSFKELVESRIHRVTPQRVKEFSGVGFAKLPWNQLTAMSIHGVTPDFVKQMRELGFQGTDADDVIAFRIHRVTPDFVKQMRELGFKDLTQDQILAFRIHGVTPDFVKQMREAGYPNVTPDELVTLRIHGIDRIFIRDMSGTAPKKK

SEQ ID NO: 11262 - protein, 86 aa, Myxococcus xanthus
MAFLELLRGPQGQRIAWRRVGPCCGTGAPTELEVFEVTYDGLAAPVSLYLDPNTAGAVHAPNGFNLQGLASRSQVEQEETPRVIEL

SEQ ID NO: 11263 - protein, 154 aa, Myxococcus xanthus
MRVKDIYPGRVPSQPTNLTVVKDRLFFVADDGVHGRELWSSDGTSAGTRLHADIAVGALGSEPAELTAVEEYLFFSAHTEAGGREAWVSDTREPGVFEVQGIAPGSMHSDPSNFVRSGWDLYFVASDSTDYGRELRALRIRPAGMCDMSGNDGL

SEQ ID NO: 11264 - protein, 66 aa, Myxococcus xanthus
MAANQLYFLKIQFDSACQIQKIIPYLDRPDAPGEVYSRRGKRWVLIGIIKPSNKAAGIVTPVGGLD

SEQ ID NO: 11265 - protein, 86 aa, Myxococcus xanthus
MARAIQLAMEDFYPWDKKAPTPSHPGRECLYRRESYDVYAAPYQEGVVLVGIVLSPQACGAQAVPNDMGALYAVDTRGWRILAVQH

SEQ ID NO: 11266 - protein, 331 aa, Myxococcus xanthus
MARDLIDLHIHVGGAVAPHILWSIAHQQGFKLPVKNYFDFVELITSRPGKVGSLDDYLKILHTWTEKIQSSPSAIERSVYEVIGKEYRGSRVTQMELRFNPMKRNLNSELDLDHIIHAALRGMDRAVLEYGVKMGLIFCLAREFDHRLNSIIVDKAIKYRTRGVYGIDLAGTETNAMELKPEVVTQYEELFSRARRAGLKCTVHTGETRGTGAEGVMAVVEKLQPHRIGHGIRAAYDEHAMKVLRERDLVLELCPTSNLHTKAVEGVEELRHIVRTFWDRKVKFTINTDGPYLLETDMRREIDIIEQNGILTPEQVDQTLAWAREASFIPA

SEQ ID NO: 11267 - protein, 740 aa, Myxococcus xanthus
MDLSGVHVERAALTDGAIRFVDRGAGEQARELGVKDLDIEVKDLRVGKPLVVNLAAAVLADTQNLQVSLHAAPLPATLVPTPERVTLKAQKIDLAPLGPFLPPDIGLRAGTLDADWQADLGGAVPGGQGPTKLVGIIKALGLSFTGSEGGKALDVVMDTDVAGDINTGDLALNKLKVDLGPASLTGKGSVKGLLTDKPAVEGFELTGRNLDPAVLAEYYPPLRKQLNGMIAGPIGLDVRGSGTQDAQAIDVNVDLTPVRLRVPAQLTKDAGGAMKLSARVSGAAATGGALRFDAKADLGGIDLRPGLLVDKAPGQRMDLSAAGTYAPGKGSGMKVDIPKLTANVLEDTMTGSASFALAGTGKKQTTTFSADLKSQKLDADALMMSEEEVQARGGPPPEEPPSDDPTRFNGYRGDIRFAVGTLRYMEMNMTQVTGVVKMTDDLITVEKFSTGVYGGRIVADGTTMRLGPLPEQRPFEAKVKVEGVAVEQALTQFTPQKAVTGKFNGNVDVKGVGYTPDQLKQTLLGGINGDLLDGELLGKDLVASVSEPLAKALPIAAKGLKNEQVTKLGGDLPFSVQIKDGVAQLSKPLTWARPEAELSFDGGIRLDGSLDLTGSVSLTPSTVKTLTLGKVTPPAAIPVGLKLTGPAWKPEVTSLDVKPAVAQIAKLAASSLAGNLIGGERGQQVQSIIEGGEDKLRAEAEAKRKELEAKAAEEKARLEAEAKKRAEEEAKKRLRGLFGK

SEQ ID NO: 11268 - protein, 233 aa, Myxococcus xanthus
MYLAADHFRRTGVMERTSVVFGSGAKTIFGVKPFASVLDGVVHRYGITPRFQHNLIAVDGERREATFEATRDGQTERITLAYDMMHVTPPQSAPDFIKRSPLSWREGPNAGWVKADKYTLQHPDHPNVFALGDASDLPTSRTGAAIRKQAPVLVENLLAYMKDLPLPARYDGYASCPLTTGYGRLLLAEFDYDGKPAPTIPFIDTMQERRDMWLLKKYGLPRLYWAFMMRGLA

SEQ ID NO: 11269 - protein, 149 aa, Myxococcus xanthus
MYRLRVVPLFLPTLRERRGDILPLALRFLEELHQRGARRVERFSPGARRLLEEHPWPGNVRELRNVMEYAYVIGEGPVVREADLPPEFSEQRQAAPAKLPPPDASLEPERIRAALAQAGGNRSEAARLLGVSRVTLWRRLRDLGATAER

SEQ ID NO: 11270 - protein, 234 aa, Myxococcus xanthus
MLFRQLFDADTSTYTYLLADEATGAAALIDPVLEQTERDLKLLRELGLTLSVVLETHVHADHVTGAGVLRERTGATVVASSRGAPCVDRTVNHGDIVRVGGLEVRVLETPGHTDDSLSFLCERRLFTGDALLIRGTGRTDFQNGDPGQLYDAITRVLFTLPDDTAVYPGHDYAGHAMSTVGEEKQHNPRLAGRTRADFIVLMNALQLPPPRKLDVAVPANRACGHTPPSPSLQA

SEQ ID NO: 11271 - protein, 51 aa, Myxococcus xanthus
MHPLCDNAAPHPAGYRDVEVGQLAAFLPSELTLVDVREAAELDGIWATSRA

SEQ ID NO: 11272 - protein, 526 aa, Myxococcus xanthus
MHDAHLPDVSSGALKRKAEALRGWLTRLEQVVARGGLSGDAAVDVRVLENAMRADLLELEEVRPWERDPGFYVGIISSGLDGLSSREFAPVAERMRAMRSRMARIPGVLDAAQFNLSGVPKLWAEYALRDARGTAAYLRTDLPRALAAQGYAQVPLSERAAFSAAREEAARQMEAFAVWLERELLPKADGDFRLGRERFEKKLALEEHVTLDADALRDINERAIRDYKAWVAREAARLDATKTPEQVMAELVKDHPKAEELVASARAQLVELQRFVRERNILTLPSDRLPVVRETPPYARLGFASMDTPGPFETKATEAFYNITNVEPGWTPEQKAQHLTYFNRAGLLGITVHEAMPGHFVQLLYGARIPTDVRKVFTPASLVEGWAHYSEQMMVDEGLGNGDPAVRLGQLRRALQRHARWYAALALHVYGEPVEAVAKRYAEIAYFEPFPALREVERGTLDPTYLYYAVGRMQIFKLRDDYRRHLESRGKTLVLKDFHDRLLQIGLPVSLAREVFLPGDTAPSLE

SEQ ID NO: 11273 - protein, 176 aa, Myxococcus xanthus
MNNALTKIATAQAAAGGRYPRFGRYLLEVEVIRTKEGFKGDSAIAELKVRESEPLAGGETPSRPGETVDYVENLSDQKKGGGGRFKSFLMTLVGADEYEFANPAALKKFFDERQAGTHLLIRCEVFPKQLPVKEGHAGKVISGYRWSHVEMNDEQLAQAEHARKASKLPALTDALA

SEQ ID NO: 11274 - protein, 600 aa, Myxococcus xanthus
MAADDPSLVAPIFAALEAGRLHCVQIREALIDIARGLYGVDPSTGRKLDDDEGARYPLALLVQRYLGLDISEDKKNPKAWRLRYAELDGVPVERWPTEAAAYPKRDARYTLDVFFRQEAVARETPNGGNLHAEAEQMRAAFALHLASIWGLRTNGDSVAVLRERVEREWGENRAKFQAAGIYRADGTKDSKRLAALVTAAYDGQPPITAPSDRFPDGQVATDRDTLLGSGDALLEDLGKSGRVDKYKSTYLDVVEAGTSLPINPRFNVLVSTTRVSSDYQQLPQKGGIREVHEARPGFAYCSVDYGGLELRTMAQRAIWELGYSKMAEALNSGLDVHTLAAAEFLGASYDELLPKVKAKDPLAVAFRQLAKILNFGKGGGMTGGSLVYNARAKDRVSFCLLAKRADVCGIERIVITVQRKPKMVCRACVEVAKELDTKWLNAWPEQRELQQRAKSSTYGGGFADVMIPGANILRGGCGYTQILNTPFQGLGAVGCKLAMWRVSREMYVDRRSPLYGSRLVLMVHDELISELPANSAQRMHDAAERKAYLMREAMKETTPDLAPAIEAEPALSRIMSKDVATVRDSSGRLLVWEPPTKRAA

SEQ ID NO: 11275 - protein, 57 aa, Myxococcus xanthus
MAKTTDALEQLPPALCPYLDADLDDAVAFDVADFHELSLLPTLGGEATSRHLLVAAP

SEQ ID NO: 11276 - protein, 186 aa, Myxococcus xanthus
MPTTRNLLVALDPGLRECGVAVFDLDSGELLAAGMPTNPERKARGLATWSRMAGGVAEFVSTFLEPLRAAGVAVSVTVACECPQVYTAGKSKGDPNDLIELAGVVGRVAGELRATSERSFLPREWKGTLDGDVMVERIKARLGERPHEHLRVQLPRAQDKHHNVWDAVGIGLHVVGRLAPRKVFPR

SEQ ID NO: 11277 - protein, 363 aa, Myxococcus xanthus
MYGLTRSLLFQLSAERAHRLGMAGLHYLGRSRDLCESLREKALEGAPPGLAVEVAGLRFAHPVALAPRLDKDAEAVDGLFACGFSAVEIGTLTPRPQPGNPSPRLFRLPEHRALINRMGFNNHGATQAAARLRMQTWRPGPLGVNIGKNKDTPLEQAVDDYVACVDALAPLGDYVVVNASSPNTPGLRKLQEPEQLGQLLGAVQERLATVAPGKPLFLKIAPDLSPEAVDEVVDVARAQKLAGLIATNTTVARPFEHPLAKEAGGLSGAPVREPANAVIRRAWLRSGGALPIIGVGGVFTAQDVYEKLRAGASVVQVYTGFIYEGPGMVGNILPTLATLLARDGYKQVRDVIGAEHRKPGAPN

SEQ ID NO: 11278 - protein, 680 aa, Myxococcus xanthus
  unsure (1)..(680): unsure at all Xaa locations
MPSYLVAFVVGPFDVVDAGTAGRNAAPLRFIVPRGRGAETAYAASVTPRIVTLIEDYFDMPYPYEKLDVAVVPRYWGTMEHPGLVALGQPLTLIRPGEETLARRKWYVNIANHELGHYWFGNIVTCQWWDDIWLNESLTSWLDRKTVDPFDTSWGFGLEQSTQSTLFALDTDALAATPPVRKPANTHDEVLGSFDNGTTYAKGSAIIDMFEAWLGEERMRDLLRGHIKKHEWGVATSEDFAATLSAAAGPDVARAFRSFIDQPGAPRIAAELQCQPGAPAKLTFTQERYVPAGSTASKDQTWSVPVCVRAGSGKTSERTCTMLTGATGELALPGKSCPSWFVLNAGGTGYYRSGYTREQLTRVLAAPTEALTVRERLTLLADMEAGVRRGDLPLSDVLRYVPTTAKGDHRLIMQRGARLLTFVHVDRLSNDESARYRNWVAAMYGPRARALGWEPKPGDDDAVKSLRPNLLGLAALRGEDPALVRDENPLVKXRLXEXKSVHPEAVPLALMVAARNGDKAFFDTLVARARATEDRTERSRVFTTLGSFRDPALMREALALVAGSEFDVRDTQSILTGAFSMPQTRALAWAFYQEHFDALASRMRSDEVAGLIGLVGMLCDEKTAAEAEAFLTPRAAKLENASLTLTRTMESIRLCAASSTLNAQSVRDFLKGQPIPAKSR

SEQ ID NO: 11279 - protein, 205 aa, Myxococcus xanthus
MPRTYTAQAGDCVSSISHAHNLSPQRVWEAPENESLRRERTSPHVLKPGDTVTLPDKEIRQVPCATGRTHTFRLKGIPERFRLRLHEDGAPRTKVPYRLVIGDVTHEGETNEQGLIECGIPPGAREATLEVGGEEYTLSLGTLQPVSTEEGLRARLVNLGFLADEASEEDALSEAVARFQAEYGLMPNGTVDERTRHKLREAHGA

SEQ ID NO: 11280 - protein, 1627 aa, Myxococcus xanthus
MDASDPNRLFAPFVGLFNVGQGACSVLYDNQGRAIVYYDFGSPANGQQGTFPIIPLGHCVGPCMCNGPLIILSHWDMDHCDLGRYYPESFRCRWLAPQQHMGTVVCRDTVARVVHDGGEFYIWAASGRPGTAASPRGTPSSWNRPGGSHMRFPWGFVERNYREGAQNPLASGSDPRNNSGLALYVCVRDAAGAAAVAAGPVATDANNLGGNGRGLVTIGGGAPPGWVAAAFAGPNLPGIGGGLAAFLAAMGPAGGNPNPAAILARRQSAAATAAVGAGGPGAGLTARQRLVIATLAVAHPALAAATAVALGRAAEVAADAVVVAGGNLPQMAAAAGAAVIVASGAPGTAVATFTAMGTAAAGGAPLMPGSAGALALAHVQGAIVGAPAASPVTTAANTAAGVVPQGGEAVRAAVEAVVRTHAPAPLPGLSLEGAVARAAGVSNPAAVCKALAPPLPPTLQGEAPFHANERFVLLTGDVNYQYIPAQRRPFAAPGGGAPGGAVALPYAPTGHPPVVVGLTATHHGSNKVGANDLNPDRIPWAPNTLPTRAAAVAHAASALPNPNIRRAATAAAAAAALPLPLPANLANLAAAAERAAYAASAGAFTPLVVARAAAAAVVLENAVPNTPQAQFVQLGAVSAGAPLPVPVLVGGTAAAWATVTAALGGGAAAAVPGLGPVVAVPGGPQVVRAATAAVLMARDLPNAHRTASARRAVEQAHVSARPGAPQPVLQAVAAAVAVRRSIAQGGTISVPTATAIVQASRLSITTGAGGTVAALAGAGIANLPAVTHPYFATAAAAIPNPPLAAVQAALGLARSAPIDPANAPFAVANAFAPSPVLPEIILDALVSRGQSLPKFPLALVEIAAALAAIGPAASLSEVAAVVEAARAAQNGQAAGAPPAAGLAHAAADRIGYSYGVATQTGGAAAAPPFAHRYLSQGVGHPAHLAIDKYQRRGWAVRRNTSMHADQSTQPDHSPRGHHALGWELAPFYEGPLRPASAVTGTLSRTCHGCKEVAAVRAAAAVGAGTAPATAVATAIGVVPAAAAATAPAAGPVNAAQLGRHGVPATRAARRSLEPAIAARAAVPFARAAVTGVAAAHATSACILVTQAVLAAWWPAAMARGDVVRGGPLSPAAAMLGGVPPSAAEAVTAARAAVLAAPLVLPPVDLAAVVAALAVSLGEPPLTAVAATVALPFLGGTGAAALSAAQAAAAGVGIDNFAAAIVGSTHACALGANLPAPVAARVAAISAMVGGAPLPARLDAVANAISAGPPVAAHHALLLRTAGITLPAIAAVVAAAAGMAHAGVTPPVAADASTCHAAAAATVPGIAQAAVNVCAATLAGGAIHPNPAAVAGLVAASTPTAAAAVTAASAVLTATGAAPPALGDAAVCYASATAAVTAAMGGAAAAAEAAAATLTGVPVPAVGNTAVTAATVANSSEEAAAAVAAADALVTADALTLPTAAQSAACYAAAAAAAGVPALAANAAAGTIALAGVTAATDANTALVAGAAPLACATVAAAMVVTQLAVGGAANHRAVAAAASASAIGVPAGPVDQAAQSLSVGMAHPISVAIAESASMRASGASEEAAAAMATVRALEPRSAPLAATAAASAGVPAADAAATAAIRLFNV

SEQ ID NO: 11281 - protein, 251 aa, Myxococcus xanthus
MFDVARYLERIGVGAEQSLTRLHRAHLEAVPFENLDIHLKRPIRLDMNALFEKVVVQRRGGFCYELNGLFARLLTALGHRVTLLSAGVATAPDGSAYGPEFDHLALQVEDEQGRWLADVGFGECFTEPLRLDTHDVQVRSGRAYRLSPEGNNLILWSEKPSGWEAEYRLSLVPRQLADFEGMCRYHQTSPDSIFTQRRLCTRATPEGRITAKEGTLVLTRSGVRTEQPLPVEDALRRALVEHFGVILPSLE

SEQ ID NO: 11282 - protein, 649 aa, Myxococcus xanthus
MHALVDEVEDLTPLLSTYAYVASRRTSDPNTRATAQMLLLDTERARGRLVRANEVKQWLGYVGDYYVTGGFENEGKAGCDTDFGPEAANLDLSATYPAAKGGNTTWRKLTANTADGYIDLATAIRPNREAVAYAVTWLESSQESRVSLGVGTSGAFRLWVNGQLAAKEDRYNLPRPDQSRVSVKLRKGLNRVLVKVCQESGPLGFYLRQESPTVRATLPAKAPALEKLTAPQPQPLPTLTSALRAMVEKNPDDAALRGDYARVLGFFRAYDEREHTASAEAARAAEAAPKDARLQLLAAHAQRDDLNERRRFLEAAIAADPAMPEARVALADHELDRGHPERVQPLVAPVLEKTPDDVNARLVLARAHEALGERPKAHALVEETFRLQPRVPRAVRAAAQVSRQLDRGREAMDRMRVVLALRFDDTTTRHMLATMLAEAGQVESAQREYAQLVKLNPFDNGSRVRLAELKASNGAVEEAVALFAEARALSPDEPEVYEREGRALLAAGRREPALASFERSLALRPQNPGLKEALRTLKGESTGTGMQYLVDAQPLAKESEAYVHEDALYLVDNTYVRVQQSGLSSRLHQTVVKVFNSRGVDAFRTIPVTYSPDRQEVRVLRARVIKADGSVVESYGENERNINEPWTGM

SEQ ID NO: 11283 - protein, 143 aa, Myxococcus xanthus
MEVHVGGDRKKDAEFNVRRYARLGIPEYFIYDRSRERLEAYTLESPGAGVYVRMEPTQGRYVSRVLGLELELVGERLRFWAGNALLMESDELIVRMRERINWLEQRADEAAHLREDEIRRREDAERRVAELQAELERVRAAQK

SEQ ID NO: 11284 - protein, 28 aa, Myxococcus xanthus
MAVGPQDRIGMAYFVRNGTMRENVENMD

SEQ ID NO: 11285 - protein, 218 aa, Myxococcus xanthus
MTRAHSNRGRLSRRSLIQRLTFLGGGVVLLGPACKRSSESQEKTPPADTGPLAAKQDGQAPRTFSSFEYAVVAAATERILPRDEDPGALDANVPVYIDRILQTPELEPVREDFLSGVAALERRAQRMHQKGFAALTAEQQDELLTLFKDSPPRSGEAHFFELLTVMTLEGFLGDPSYGGNQGKVGWRLMGFDTVGTVASAPPEGYDGPKCLRECGVHR

SEQ ID NO: 11286 - protein, 550 aa, Myxococcus xanthus
MSLPEVDVCIIGSGAGGAPMALELGRAGFKVVVLEKGPHYQPKDFIHDEILNSRRNFFMPVPWEEPHLVRQGAKGRYEKTSAAWTANCVGGGTVHMSGFFYRLKPVDFRLRSTLGAVPGSTVADWPISYEELAPFYDKAEAELGVSGESVPHPFAEPRSGPYPLPPLDVHPVAKEIDKACGAMGWHSLPTARGIISKPYRGRAPCSYCALCGSYGCETGAKSGTNASLIPAAVATGNVDLRPGCMARTVEVDKQGRARGVVYLDADGVTREQPAKVIVVSCTAVESARLLLNSTSSRFPKGLANGNGLVGRNLTFSSFGESHATFRLSKQSAARPWLKDPSPFVNRSLQDFYLMPDAQFGFRKGGTLGFMWAHPNPIHAAVGLAGKGEKALFGKALKDKMREYRDSRILQFEVYAEFLPTAGTYVSVEDSVKDRYGIPVAAITVDRHPMDLAATRFLVERGEEVLLRLDPDDVRRGTTTGETSILQHGTCRFGDDAATSVLDRDCRAHEVPNLYVVDGSFMPTGGSVPSTLTISANSFRVADHLVRKLKG

SEQ ID NO: 11287 - protein, 43 aa, Myxococcus xanthus
MERQGSFTEEAELTGVGDHLIEFESDMQARYIIKVDVTPLRNR

SEQ ID NO: 11288 - protein, 192 aa, Myxococcus xanthus
MAGPKDERDNGNGSLMRVLPLALWHSGNDAKLASDAMTQSRVTHGHMRSQVCCALYCLWARRILQGARASEAWTDAVETFRNLYPEGFEARTELDTHVLPPGWEEIRGTGTGYVVDCLRSARQCVVEHDTYEQGVKAAVRLGRDTDTTAAVAGGIAGLIHGVNGIPARWRESLRGGELLHPMLQKLLKCTVS

SEQ ID NO: 11289 - protein, 145 aa, Myxococcus xanthus
MSMRLRTRWLPIIFFALAGCGEETELPQAPTLFIDRAALTFNREFNHGTYVGQTAYNSLAIQNRGLDPLDITAITLSAPSVFTLQLPEGFTPGTPLRLETYDRAYLTVAFMPTDDVEYNGTITIESNAANAAQQVITLNGLGVAP

SEQ ID NO: 11290 - protein, 792 aa, Myxococcus xanthus
MPTSVRLLPFALLVLAACSSGGGETPDAGTPVVEDLCNSREEALTRPECELKPGEPLERFLALDSEPRAGDQDWYRIVLPPGTNARTLLNVNGTYLASSTAVNLSVTILGPLPDGKEGSLARKEDKHAQGAPRPVDIVLPLRDGLENQTLLVLVQDAPDVPSRPNFDARNKYRLTVRIDQNPDAQEPNDTHETATPLVLTQSGEMLMGASTGYLATDNDVDHYAFDLAEGKIAYVHVTAPDLDAVPNWRLSYELWRPGFTEKEDEGVVLPQVRGGELATARKIKKAELPGHWTLVVKGYRGTNDRDTAQGDLTQPYEVEVRVLEEEDAQDRTAPGNDRAQEATTRNLVSATPGGAGSSVSFTGRLGYIPDRDWYSVRLPAFSTPTLLRYRLVPLETGGRFPAMPVTASRVVHVFTLIATGGPLSESRESCATDAAVCPRDFSENPDARGLVDRFCRRTDLPAPMCLHSSREEAVGNSRFTALSNFRGVIPVPAHDAALMYYFLVQDNGSWVDDKDYRLEVSWDVEDADELSRYVNGAEAPLARTLASTTGFPSPPDTAEFSVTGQLSHGHGRLRSGTDRINGLGVRGPLDYDAVPSDVDSYVFDLPSVPPPEDRTWLLQWEVAKLADGGTPHGLALDLTFCDGDATDAGVGTCTPVRTGNRGPLTLGYRSDALRAWHTPSNAGTSSLQSLYQLEDRPNSTVVTLAPYACGCLERRFIRGGTLRVDVTASERLDYERVNYTLRTGHGDYPQSYPVDGGTTVSCPVVTDGGTTPDGDGGVIQNYAGGCNFTYQP

SEQ ID NO: 11291 - protein, 481 aa, Myxococcus xanthus
MLFAGSTTAFLTQQPGNPPQDGFVQVSSMDDAMLRRLTEQLLTFRNPDTSPNRDSTDFVKPLSDIYSLINTDIARSRLDPGGAQALAQARYSVIFLSDGKPTNDQDDELLRGDAVVRIRQLRDLVEDVRVNTVHVFNPTQAGSSVCDLSGDGGCPLLIINQNADRLEQMATLGGGNFRDFRNNEPINFLDFTFGQVRRAFIEKEMGDFNFSAPTGNPVGEADSDGDRLTDAHQLGLGTDPHKVNTDGDGFSDGVEVYFRDRGVDFNPTQEALPDGGGLDRGCPPALRGVDSDCDGLLDCDEQFVGTNATLADSDRDGVPDGMEWLGGTQGASNDLDEDPDNDGLTNRVELRMHTRPLVVDTADLSVNGYRYAFEADGPPDNLGRQCYRFRVENVLLAPTIASADDAGVVQRGAGFNDNALSVALVPGDDPTARTLVRTFRVNDVRYPVGGIKSPADGVIRVEPEQLVDGCPGRPDDVPPTP

SEQ ID NO: 11292 - protein, 82 aa, Myxococcus xanthus
MACTDSYLYDPRRDTEVPVDRAVTLEGRFCTVGSNEVVRPIKLVVAMDASQSMRVSDPDGARATALVELIQNLPRDPRCTWR

SEQ ID NO: 11293 - protein, 659 aa, Myxococcus xanthus
MRRFVRTSLLAAGLLASGLWSCSDAMLESRVDALSNLDDRLTLQGRVCTRPPSPSGFPVKVVVVIDESGSMCVSDPPGAQLDNGFCQRREILDIIPEGVTEPARVRALKRLVQQFREVNAQGGNVQVSVAPFETNVRNVWPPTTTGDRFARPDNNIDSYIEGLQSQLGKGTDYQGALSYAYSLISSDINAVAQSNPELLPRTRYVVVFLTDGTPYPRCSATDNLSVYADPDNPDLTWADSLRDFCNLTNTTDQIDGFEVGTDRNQNYQLFSYVRRLMELKDQYNVGDLRMHTVLLFNQEAVRACGPICQDIYGVYPGVEPARYPEAAKKIAAWLLRRFADIGNGVYQEFNDTGEISNLGLGALDYSSFASRNVMKTLMVESLSSAPGDTGRVLDSDGDGVPDSIDNSFTLKTNTFVADSDGDCLDDGFEYRREDQGFRAANDLDARGCNPASPLTPNCVCRDTDGDGLSQFAEDYLRTRTGIVDSDGDGVPDGLEARWGLNPLENSVSGLDTDGDGIPDAQELRAGSDPTRRDKAFHERFGYQYETRIAEVRPDGSLCYDFTVSNLQLVTPPDRAGVKQGYNLFKVWFAEAPESGVSTDYGVWRTACAWAQYAPPSVRVPVGPELVFEDADFRRPDTLSNPWNNQNDCVGIPPSGSANP

SEQ ID NO: 11294 - protein, 85 aa, Myxococcus xanthus
MYVDGSVPTFVPDKKGEYQLQLTARLAFSDRVFPDQRVSTSTLTVLVGDESEKGNNCSSVPAGFSATALGAALLSVLMRRRRPQQ

SEQ ID NO: 11295 - protein, 219 aa, Myxococcus xanthus
MGTDPLRQDTDQDGLMDGVEVRMGLDPLQPDVINGCNVSLDEDGDRLNTCEERVLGTNACIGDTDGDALPDLVEALVMTNPLIPEDLLDTDRDGITNVSEVEAHGDPLSADLDFHRERGYGYELVETTPTADGRSCYQVRVENVTVVPTRERPHPFIPGEVIKAGTNEVYLYLQAGRDNDPRGAGIGSLLIQEIQYSEEGGRLPAGIIPLDPDTFIPGT

SEQ ID NO: 11296 - protein, 476 aa, Myxococcus xanthus
MELLRQEDGTLVSTVAPGPGVSIVGGNTERFREQVMGGKAPRFLVASERLGHVFMSSLGPNVGPNPQRMEVSANSGVSVVEPSRGGYVRHRGFGAGGTEGLALDDGAGLLYAADVGLGLVRVLDARALVSGDAPARRAVLQEVAVAPPDGTPRIRPPEDFGVRGRAGEELHSGPSALALSPDARTLYVLNRFTRTVAVVDVHDANAANALVVRQLPVETSRAQAKRRLGQVLYYADLGRTGITCDGCHIEGHTGGIFYEKTQPNRIYRSTTLRGSRDTPPYFTPASHVSLVDTVRFVGARNRFRNPDLSPSEVEALALFNALIVTPPNPHRGEDGAPLETVALPDGRVGRPARGRALFEGKGACATCHPAPLYTLDQDLATRGRYLEVGTPVALPLRLEQQDLVPGAATPSLVGAWDVWPLLTSATAGYGVKDNRLVVETRFALRALLETSGPQHGHASALTSEERDDLLAFLLTL

SEQ ID NO: 11297 - protein, 125 aa, Myxococcus xanthus
MAVAQLLGVGTLVAPAEAWAQSRGRTSRQAKSKAAKKAASKTPPKIETKGSSVVDPVTGDAATASSNALPQRGPARIDFDDRLIQGQTNKSGAVYLYDRKELKTRSMIRERESFRSETLSTVYDP

SEQ ID NO: 11298 - protein, 467 aa, Myxococcus xanthus
MQFADELMADLALDPLPEPTGPLLQEQRTLARPTHAPRIAPGKGTAQLYLELYWGAIRRDARRFAPDKKKPVQASLDLEGAMPLWGFTLPEGAPFTLAEPLNNAFRLFVPPGTDVEKSGGDGRFTPVTGAALESDGSRRFLTLREGTAARLTQGQMSLVAYAAPKPARVFVNPLKGLPWLTLTCLGLFASAMAAFLVMKPDQPEVADFQHKSLPPVALRLIAPEPKKKEEVKKKLEALQEKVKKPTKEKVAEKAPPKPVEKAPPPPKQPEKAVAAATPPQNKALKALAKLSAAGPATNDLLAAVDKLGSGPGSKNAKNSNYKLSGLIGKAPIANAGLGTFGLGGGGKGGGATLGAELLRGKGGGGIGALGAGGVGKGKVGGTVTRATARSIASTQGTVDREAVARVINSNLHEVHGCYERALLKDPGLAGQGGAGVDHRRERPRGGRQDEVLHAAQCLRRVLHPFPS

SEQ ID NO: 11299 - protein, 142 aa, Myxococcus xanthus
MRLLEEIGCDPAGKRAVVVGRSNIVGKPMALMLLQKNATVTICHSKSDLRREVEGADILVVAVGAAELVKGAWIKPGAVVIDVGMNRKPDGKLVGDVEFAAAAERASFITPVPGGVGPMTIAMLMRNTLDAAVRYGLVPVVR

SEQ ID NO: 11300 - protein, 173 aa, Myxococcus xanthus
MHHELLLGVGVLPANAYYKGLVGTVGYTYHFTDTFAWQVGRGTYSYNLQTSLRTQLERDFNTSPNAAAFQDQVQWMVGSDLVWSPLYGKMAFLNQSVLHIEAFLLGGGTVVKLDRDGGFRPAVNVGLGLRLFTGKTLSLRLDVTNNTVFTGATRVIQVPLIQLGTAFNFGATE

SEQ ID NO: 11301 - protein, 246 aa, Myxococcus xanthus
TSRSLIAALTSAALLVSPAPADAQSPAAAQPTSTAPAAAPTQGTPPAGAKAPGDAKADAPDAARPAANAPTAGAEAPPSAPQKVDPGVFDKALKDYFDGKPRDAAGPLHAWLQAAPKTDENYAWGQYFLARSLIDLGLTHAGASYLARIARERSNPNVLPRALDTLKALTDRPHDEVMIDEQVFGALDLGFLPEDTGAYAHYQQGLVDLRVGNERWANTHFAKLSETSPEASRAKFALLVTRLEQV

SEQ ID NO: 11302 - protein, 82 aa, Myxococcus xanthus
RKLKALQRELDAVDIPYHLVMESGGSRSIVLEFVDDQGADLLALGTRARSGVAFALLGSVATDLIREAKCDVLVVREAEPHE

SEQ ID NO: 11303 - protein, 276 aa, Myxococcus xanthus
MLAVGTVLFFTFYAERTAHTYGVAVIFNVFGTHHTLSQHRGIWSLHGLRAGKAGLPGASALERKLQQMYVPLLLSLLLVRIFFVPEAPGPDAPAYLDIGQGAVLPHGTLGVLLAVWLGYFMLLFRTVLRAEAVSGPKVLYLLAMATATGLVLVAPTWGYVMLPGMHGLEYYMLTARMLEPREGDTPRLPRKFIVPAMIASMLPLLALGAVHGLLQQGVVRGALGSNMGVAETHPLLRAMTSLGFAVVLAHYFADALIYRFRIPSIRAVMLKRLGFS

SEQ ID NO: 11304 - protein, 193 aa, Myxococcus xanthus
MAVQTLARNTGLNDRDKRRLTIANREIRTMERMLWLLSEYGRDTTPKLDAHPLRGVVQEATEMVAPELAERRVEVRVDEEPDLPRVRVDPTRLRPVLAQVLLNVAMGQAEGSPMEVALRRGGPHQVMMVLHDPAAALPPEENGSLFEPFGSRLARGAGLSLAALRRVMTGVGGDVAARGSAEPGVVLTLTFAT

SEQ ID NO: 11305 - protein, 488 aa, Myxococcus xanthus
METLLIVDDDVSLLETLKMHFEEIEQDGQPRYQVATATSAAAGLRAAQEAMPSVVILDMMLPDRTGLEIIEEMKGLCGDARIILVTAYHDMETTIRAMKAGAFDYIHKPFPDPAALDLVVERALEYRQLSRRADEVHRENAAARLGDIVGTSPLMQQLVKEIGKVTGSHATVLITGESGTGKELIARVIHNYSYDEPRPFIGINCSAIVDTLLESELFGHEKGAFTGATAGKPGKFELAEDGTVFLDEIGDMSLMLQAKLLRVLQEREFERVGGVKRIKLRARVIAATHRALVEEVEAGRFREDLYQRLKVITLQIPPLRERREDIPPLVKHLLERINEKVHKRVTRVPGEVMERLTRLPWRGNVRELENVLTRAVVLAPGDVLRGDDLPALESPLPSPEPGRATSAHHTASAMFAAPAEDDASLIPTLEEAERQLIARAMTVTKGHKGRTCQILGISRPTLERKLQKYGLAQSQSPQVHTFPVKDAL

SEQ ID NO: 11306 - protein, 222 aa, Myxococcus xanthus
MVTANKLVPGQEAIDFKGYFKVESFPHNSTIYRPGDNTDRVYLLKSGRVRLMRIGKNSTRSVVSILRPGDLFGELFRPEGTPIEEMAIAAGEAEVWSIEGRDFRAQLEARPALAVDVVRAYAERVRALRKRVLGLTFKEVPARLADTLLTLVEAHGERCPHGGETDLRGITQQDLADLVGASRSFVSTLINEMKREGVLGNVGRILCVRDQKALRKIAGKEK

SEQ ID NO: 11307 - protein, 119 aa, Myxococcus xanthus
MLSPTEVLETLQWSKEYVEEGAFGDNEDELEAAILEKKLRERLIPFQYSAYSSVSDYYYFDTGMRRDTGLLIFPARHDDFDLSTWLLDGAPDVSGCTFDFDEHLRWVLREGLEEKDWGR

SEQ ID NO: 11308 - protein, 414 aa, Myxococcus xanthus
MNTLLSRITGNAPASGLRLGVSPEAGVPAASIDPAAVRFTRRPDIVVVLVESLRDDFFTADVMPNMWRRAQSGTRFLHHHSAASSTDYSLFSMFFGLEAQRRNAVVGAGRTPLLFPALAHNGYQQFFFAASSVDWMGLKDTVFRDVTGGLRTDYTGRSHLRDEAMVRDALAAVEATPQDKPLFLFVFFAGTHFDYDYPPRSEVFSPAWNGKGGLSTARVPPEHLKARAWNAAYEVDTKVEELLARIESLRGARPMTLVTGDHGEEFREYGRVGHGSDVTASQLHVPMLVFDDQLPVGQVDAVTGHIDVVSTIFDLLGDTHSPAMLGDGIPMSRPDPQRYLLTTVGWEARYALIGQELKVHFGAGRPGTVITDLRDRPLADGKERLAAEAPRILRRLRGTSESTLPDAATATDVP

SEQ ID NO: 11309 - protein, 39 aa, Myxococcus xanthus
MPRRFRLELARDVLSSTDTPRTLHFIEPVPADPEPVDSH

SEQ ID NO: 11310 - protein, 239 aa, Myxococcus xanthus
MADHVIGNAEAIRHQLITEEGLPASRVSVIHNGLDLPRFESRRREGLRGPLPDTGAAPVVVHVANMNHPVKRQEDLLLALAQLRHSGITLHAFLVGDGPRRPGLEKLAGELGVSDTVHFLRHRTDVPAIYARATFGVLCSTAEGMSNAVMEGMAAGLPMVVTRVGGNTDLVRDGERGLVVDPERPAQLAQAFRQLLANPEKARSMGHAARDFVARELSLEKMVRRHDALYQRIARGADA

SEQ ID NO: 11311 - protein, 179 aa, Myxococcus xanthus
MSGKTTLMRAVGANVVLALAGAPVSAKHFRLTPLQTLTSMRVKDSLERGVSYFYAEVQRIKAVLDAAQAARGQVLFLLDEILLGTNTRERQIASREVLRLLLGTGAIGAVTTHDLSLAVLADEPGAHVVNVHFRDHLEAGKMMFDYKLRQGVVDTTNALRVLRLAGVPVDDPDEATAAR

SEQ ID NO: 11312 - protein, 231 aa, Myxococcus xanthus
MGLGFIALIAGSILSVALTLRLSVRIQAVPVGVLRVALAVLLENLWVLGMLPVLCYGAARVMELRPWTTAGGAALTGAAFLNAMAFIQSGVYGLWAGDIGSVFSLAAFAGGVVLSARAVMMGRHAAAQQSVKTQAKAAERKSEYDEFLRAAEQGGARLEQREAQSTAVAGDALTAAALSATVASAQAQAPASDANAAASQAQDSGGVEPAATEEAGASPATDTQAGKAPEA

SEQ ID NO: 11313 - protein, 189 aa, Myxococcus xanthus
MGLNGLLPPDVAVVDAVEVAEDFDPRRWSRGKRYRYRVSNRRTRSPLRRMTHWEVFAPLDVEAMRQAAAHLLGRHDFSAFRAADCQAKHAVREIRSLAVEGTSGDAVSFVVEGTAFLKHMVRNLAGTLVEVGKGRRPASWVAEVLASQERKRAGPTAPPQGLVLEEVFYRDGPPARTPGGTTDAEEDEG

SEQ ID NO: 11314 - protein, 408 aa, Myxococcus xanthus
MPPAAPQRDTGRFGKYRLIDRIAVGGMAEIFLAHQQQEDGRESPVVIKRIRPHLSKHTAFVKMFLNEARLAAQLNHPNVVQIHDLGKIADSYFIAMEYVSGRDMRRVVPKAEALGIPFPLVYAVKIASCVCAGLHHAHTKGDLYGNPLNIVHRDVSPENIVVAFDGSVKILDFGIAKAANQMEQTRNGEIKGKLSYMSPEQCLGKPLDCRSDVFSLGVVLYEWLTGFKLFTGESEAAVMRSITDGKIYAPSYFREDLPERLETILMRALERDRDKRYQTAAQMQKDLDAFLDAYDFTPTALHLSNFIKQLFEEELAAEQRRLAVRAAAAPTSEEALELSDVADALDTAKAMPAPEPEPPAHDDRTEPRTLAVPLSPAVSEALEAVARRNNVPAGRMVAELLESWLKYR

SEQ ID NO: 11315 - protein, 328 aa, Myxococcus xanthus
MGTLASSLVETLRASRGRRGPLLGDARTTAWRVVNAEADGVPDVTADVFGDVYVISLYRDFTPDEEETLLDAAVAAWAPRSLYLKRRPREARVLANVAKESLAPEAPARGEAVESFTALENGLTFLIRPAQGLSVGLYLDMRDTRAWLLSQARGLTVLNLFSYTCAFGVVAMAGGAKRALNLDASRRVLEWGEENARLNGQTVDRYDYVAGDVFDWLKRLAKKGESFDIVISDPPSFSTTRSGRFSAARDYARLAEAAARVVSPGGQLVACCNHAGLAARRFEAMVLEGVSQAGRQGKSLGSLAPSALDFPPPPGQEPALKVHRVQVR

SEQ ID NO: 11316 - protein, 419 aa, Myxococcus xanthus
MAVVVEGNTIRRMAPDAQVPVLPGDWEVACHGRLVAPGLVDCHTHLVNGQLLPPTGHFLMLPPRERLDRLRHVARLLTNEDVEALTRYAAARALRHGVTLAVEHLSCQDVAGGLAAQARAAEAVGLRLVTSHSTHGLDGAAQAQAWLDANADFTRAHRDHPLVRGALGFHASFTCDDALLRRIAELSRVLDAPTVFHLAESEDDLSSTYSQHGKRVVPRLDALGLLGPRAIAGYARVLDSAEAELLEQSGAFVALAARGVRALERGADPMDAVLSRVHLLGLGTGGHGSLQDELLAALVGVLRISRSGRLPDVDGALAHLLVNGPAELCTRLFGLPSGSVEEGSIADLVVYDVVPTADPETGYSPYLLGQLAHSPVGWTIVNGRVCVREGQLLGLDYVALSRAATEALERVWTRARLGS

SEQ ID NO: 11317 - protein, 259 aa, Myxococcus xanthus
MALTVSQVARLAKISIRALHHYDELGLLCPSDRSEAGYRLYSQADLQKLQQVLFFKELGFPLEDIRRILGDPTFDLRTALRMQRQLLTERAARLDALVHAVDAALDALEKGTHVDKEAMFEAFGDFDPSKYEEEAKQRWGNTEAYKESARRTARYKKEDWKRIKEEGDVLFQALADLLAAGTSAASAAAMDLAEAHRQYLGRWFYACPPAMHRGLGEMYVADTRFTENIDKARPGLSLFLRDAFAANAERQGAADVPCG

SEQ ID NO: 11318 - protein, 85 aa, Myxococcus xanthus
MKAISKKQQLRKARGQGMTEYIIIVALIAIAAIGVVTLFGDNIRKLFGASADALAGNASVDSEATERQRQLEKKTIKTFGQNNAY

SEQ ID NO: 11319 - protein, 826 aa, Myxococcus xanthus
MGGTLPALVRHFASSLSGVRYELARLYAVNSLGAAVGVFIAGTKLVPAIGLSSSAGLAAGLNILVALASLGLARRFPPALVPGQTPPAEAGDAEVSYPRIAVRAALIGVLLSGFTSMLYQVTWIRLLSIVLGASTYAFTLILTAFIMGIGLGSFWLMTRKGQVDSLRLFGRLQVALVASICVALPLYVRLPHLFRKAQWMMTRSLDTWPLFQVLTFGFCCLVLLVPTFFMGAAFPAAARVATAKVSEVGRQLGGVYLWNTVGTITGSALGVLVLMPWWGMEGNFIAGVAANLLGAGLAFHPAPGRPAQHARALWPVAATAVLALVVLGGMSGWAVRLSGIASIRSHEKPPESYAKLVADTEAIIRPIFYQDDTFATVMVADVPVDNLRFMKLNGKVDASNGSDVETQVVAGHLGALLHPREPKSVLLVGAGAAITAGSVLVHPVEHLDMVEIAPAVIDAARLFKADNRNAVDDPRTHVHVDDAKTFMALSPRKYDLVVSVPSNPWVSGVSGLFTRDFFQTVDRHLADDGVLVQWIHTYESNEDLIKLVVRTLRDTFPHATTWLGPHDLVMVASRKPLAFDAARLAERMGHPEVRKDLSRVGINDVFALLSKQVHSEAGQLEFAGEGPINTDDHNLLEYASPIAFFVSNLDVRVKDERRAPEGADRLFLHDYVQQHPPTAEQAAGLYRNIERYHAPNDPMVRGAAAQWRRLAPDSPESALALGKAALAQQDLTLAASLLEPEVARGGRAPALVTAYLRLVTAQTWASRTMWTPVGALHDTVALGREVASRHPDDEHLARALRSLCEALPRSSCEGTAQTPVAAPGGP

SEQ ID NO: 11320 - protein, 240 aa, Myxococcus xanthus
MGGDVTTPATANRVAAALGLSGSCDAMDLSNACMGFLSAFDLAARSVATGLGPVGIVSVELLSRTTTPEEPRPYLVLGDAAAAAVMGAGRSGEGVLGVALGNDGTLPTDVVLENPTATGKLERMRFLTPSQEMTRVALDALVRAARAALDEAGVTLHDVEWVLTHQPNGSMLEAILQALEVSPERSVRVVDTVGSVGSASLGTSLDRLLRTRPVKPGHRILLVGVGAGVAHGAVLYQVGG

SEQ ID NO: 11321 - protein, 426 aa, Myxococcus xanthus
MVLGEQGQRRDVWAFYALTAFAAVMYSVPGEWIPALAPLRLALVTSGLAAGLMVIRRLGRAEPLYLDGSRGLALIAFSTLAVASVGWSVIPEVTTATGVELLKLTAIYITFINVITTGRRLAVVCGAMVLASVVTSIGAINWYLVGEDLVEGFRARWVGVYADPNHMAMNLALVVPLAVAFVARKSSGWLWRLACLTAAILAVAAIVVSHSRGGFIGLSAAMAVWAIREKRRIQAIVVGSLFVMGLLVFAPQSFWQRNETVAEFHEDASAMGRVYAWQVASRISLDKPLLGVGAGGFRYAWPMYAPPEARRAYVAHNIFLDVIGELGWVGLLFFMVFTGGAAGGAFEASRDKEVGWLARALSASVVGYLVCDLFSGYILSAHLYVLFGLAAAAHRVARASEALDRQWGPAPSEPVVATWEGSGHAA

SEQ ID NO: 11322 - protein, 303 aa, Myxococcus xanthus
MPPRKLVRHLVWLESFAAAVEAGSIEAAAEHLGVARSVVSEHVRSLELALADGAPLLERGPGRRLQLTARGERLFAGTQTPLHQLDMKRLRDLASAEPVVRLGLNPTLSLSLVGAVARDAAAADLKLVLSFGGPHELTRQVQTRQLDLALDFTPLPTHEGVESESLLRMPFVVLAGPDNALARQAASRKSLHVKDLEGQRFVDWLRDDPYGGANSARFAAHGVTVDEVGRAESFLLLYELLRAFRACAITPDLRPMHPFPPDLHAWPLLEEEPQAVEVVALWPSGALSPGARLVLDGLRRKPG

SEQ ID NO: 11323 - protein, 93 aa, Myxococcus xanthus
MVGAMLSYTVGDDYFAGLPSRYDRGYYWFRTAVRPALLLGASAGRPVEALNLRFVEGYFELVATDYRLVQFIRNPTTVNVELFTLALGVKLRF

SEQ ID NO: 11324 - protein, 176 aa, Myxococcus xanthus
MGDLTEFGSTQEYEWGVELLSRLKVPFFVVMGNHDALGMGQKLYRRTFGPESFSFTYSGTRFVFFDSNSREYGFPGDIPNLQWLKTALAPEPAVLNTFTFSHVPPGNGDFDDALVAPLVKLQQKQGVAISFHGHVHQYHDVHAHDVRYVTTDSMKGRSYLWVDVDGSSVQVQRATF

SEQ ID NO: 11325 - protein, 324 aa, Myxococcus xanthus
MKEIPGIRIGIIAHGDYCDAGSTYVTKMLDLTDDEGAVVRFVDRVEHTGGGDAPECYEFVLRQAQSLSWTVGYTRALVLIGDDVPHGPAQNPHKLDWRKEVAALGKMGIPVYGVQALARRHATAFYKELAEKSGGFHLSLDQFAHVTDLLLAVCYKQSSDVQLQSFEQEVVREGRMSRGLNVMFSTMLQRTAPPLYGEADLRAVPPGRFQVLDVDRTQPIKDFVQENGLRFKTGRGFYEFTKTETIQGRKEVVLMDRKTGDLFSGDRAREMLGLPPGETVRIRPASLEKYVVFVQSTSANRKLMGDSKFLYEVEDWEGASSAAA

SEQ ID NO: 11326 - protein, 84 aa, Myxococcus xanthus
IDVFELNEAFGAQALYCVRELGIPADKVNPNGGAIALGHPLGVSGARMVATILRELKRRNGRYGVVSMCIGGGMGFAALIEAPK

SEQ ID NO: 11327 - protein, 307 aa, Myxococcus xanthus
MPSAPRVGTPAPQRAVPTASPTNTTSAAPTLPPMPGSLQDTEEDGLAQVDASGHLVVSADLRRLFDYYLSAMGEEGLPVIRERILASLRAKNLPAAAMEETVRVLDDYLAYRDAARTFAANQRGAELDVGARLQSLRELRREHLGPWAEGLFGDEERVDAVSVERMKLQQDTTLSPEARERRIAALDEQLPAEYRASRDEALRPLRQQAVERELVESGASAEDLRQHRLATVGAEATERLEAMDREEAEWKRRLAEFRSRREALGQSEPNPAARQAAVQRLLFDSFTPEERLREEALNAIDAAAGAP

SEQ ID NO: 11328 - protein, 196 aa, Myxococcus xanthus
LYDGSPAWSITGHYRINGSAPASFDVAGAPVTGNGPTLDLQEQGLLELWFLVSSPGCEHYDSNYGGNFQFNVLEASATPMATLVFQQGWVEHVVGTPRQGQPFIVDYDIARLPECRLLYNGAPTWDVGVRWRFNNGVMGEKSVTTTSGYTRTGTPVTIIPPVGATSVQIWFENWDRGTCRRWDSDYGANYTFTLQP

SEQ ID NO: 11329 - protein, 343 aa, Myxococcus xanthus
MALTLARPEGNGPGGKGLALFYVETRDAAGRLNGIQINRLKDKLGTRKVPTAELTLDGALAIPVAGLTDGIRNMAWMLNVTRTWNAVGSAWAMRRALALARDYAQRRVQFGAKLADKPLHMDTLAGLEAEFQAGFLLAFRAVELLGRMEAKAATEQELLLQRLVTPLAKLTTGRQVVHVTSEVTEAFGGAGYVEDTGIPRIQADAQVLSIWEGTTNVLSLDTLRALAKEGALEAFFHEVEGRLGQTRDAGLRPCVDAAQGALEHARAWVAGAMEDPATLEAGARRFSLTLGRTLELALLCAHAQWCLDHGHGPRSKAAARRFASHGVDLIQPAASLEDVRLLA

SEQ ID NO: 11330 - protein, 238 aa, Myxococcus xanthus
MMVGLRPPENCCLEQLSRDSVVQVTALLGKWYPDIRVGTESRHLEPAFYDQCVCIQGESPDRPVYAILGRDRDTQEVIGLLTLEKNARGLQLSAAMGAVEPSQRGLGLGQFGISLLEQVGRNIGAEVVLYYSTLKMARAQRNAEHRGFKLVGLVPAFDVDAIAPNTVKRVYEAIYAKVLVGPEKIHLPDWNALIPTTRALYTHLFGQHPAAAILENRNGVSIPASAPVPISAPEAHHG

SEQ ID NO: 11331 - protein, 425 aa, Myxococcus xanthus
MAAHPTAGHTNALRAIGGRLRELGHDLAIATVVAPARFPGLMPEPLRFASQLPEALRQDGLRLVPLRPAPAALWYGARITRARGLDELGWALRLFTTGMEGHARRIAEEIEASGTDVVLADYLMPAALLAARRTRRPYVALYHSALPFPVEGAAPFGSGLEDDAPRDATWTQAEQRGLALLRWFDARVARAAKRLRVPLKTNGLLAAPISDDLNLMATTPALEPGLEPLPGPVEMTGPCLPRPVPSSMDDPALTAIRPGRTHVYVSLGTVFNDQPHVFHAILDGLARHDVDVVVSAGASFERLQARAGPRTQVFRRVPQVPLLQKVDLVVTHGGNNTVQESLAAGRPMVVVPFGGDQLANARRVERLGVGRAVPPSALSADAIAHAFTQVSQPEVATKARALAATLEGVDGTERAAQAVLRLLTT

SEQ ID NO: 11332 - protein, 349 aa, Myxococcus xanthus
MVEVRAFEGGAKEASQFINSVWQRTYGAKMGLTIWDERFFDWLLFSNPLADRDYLLGAYSKGKLVGAFLAEPAKIQLGQRQVDGTYGSWVSVAPESRGQGIGIKLSDTMQARHRERGAALTLSCVADGTLGQGFWSRRSHTRYLNNLGMWLHIFNTEKAVRWSLSAAERAFLTFTRPLHRRDFLAARTDNIRAYQPRDLPQCMALVQKMMRPVNLGYAYTSERLAHQLQFRDIPHTFVLERDGVIQGMVNYYTLQMTARGLLTTGLVDLLAFQDGLPFSEQRRLLWVAMQDMVAQGADCAAMLRSPCTPTHLMLRSGWLPFPGGSRVTCLLTTPDVELPASPRVFMHLR

SEQ ID NO: 11333 - protein, 71 aa, Myxococcus xanthus
MLGQEAVVVESLGDPLGGTVRINGELWTARSLSGPVPEGELVTVEQVEGLKLWVRRPTASLPVPSGDPRKE

SEQ ID NO: 11334 - protein, 368 aa, Myxococcus xanthus
MEIVTIFGIFAVILVGIAATGIRIVPQAKVMVVERLGKFYKTASSGLNYLIPFVDAPRAIEMRTGNRFMRSNLVDLREQVMGFDTVQVITHDNVNMEVGSVIYYQIVEPAKALYQVENLALAIEQLTMTNLRNIMGGLTLDQTLTSRETVNTKLRIVLDEATEKWGVKVTRVELREIEPPQAIKAAMAKQMTAERERRAEVTKAEGDKAAAILQAEGEKISRILRAEAERDAEIARAEGHKRATMLQAEGKAEATRLVFEAIHNGRATPEVLALRYMETLQELGKGDNKIFVPYEATATLGAVATLKEVFAQTGDAAKPAPAPARSAASLSGQAIARNTVVPEHATLPGGTPAVAPRRPRPALDTQDD

SEQ ID NO: 11335 - protein, 500 aa, Myxococcus xanthus
MSSVRAHRVSFAFSDAVPVLSEVDFHLSPGWTGLVGANGAGKSTLLRLLAGELTPTEGHLQFEPSTPTLRLCRQEVEALTPDISAFAESWDSVARRLHGQLGLDVTALERWPTLSPGERKRWQVGAALAAEPHLLLLDEPTNHLDAEARTWLISALRRFRGLGIVVSHDRDLLESLTTSTLRVHHGSARLWPGAYTAARAHWEAEREAEIATHQQARAEQRRAAHLLDQARREQQSADAARHTRKRLKNKHDNDARSMGAKVVAGWAEAGAGRRVGIARRELERVSEAVGEFTADKTVGRSVFLDYVRAPNPWLFTLDVPGLRAGDVELLGPVNLSVSREARVRVEGPNGAGKSTLVRALLENARIPLERVLYLPQDVSADEARATLDAVRALPPEERGRVLSLVAALGVDPERLLASEQPSPGEVRKLLIARGLGQHAWALVLDEPTNHLDLPSIERLEAALREYPGALMLVTHDTSFAQACTSEVWRVEHGQVTVTSG

SEQ ID NO: 11336 - protein, 176 aa, Myxococcus xanthus
MVSVNQLRPFAGASLDAFRAASGPVALIQQPVELVGQHSRGLAARTVGMAHRAYMDERLLAMLRDFDNLEVHFLQPSVDGEELTVGRTEACDLVVPDPSVSQHHATMRWSAARGGFSVRDAESMNGTFINGAPLGYRAQVLLHDGDTLAFGDAQFLYLRAETVYEHLRLASPKKAR

SEQ ID NO: 11337 - protein, 810 aa, Myxococcus xanthus
MAPPGLINKEDIPQVLPILPLRNSVFFPGGVLPLAVGRQKTIALIKDAVRDDQVIGVVTQRRAEEEDPGAADLYTMGTVARIVKLLKMGEDNYSLVVQGLARFRVVELVQEAPYLKARVDAVEDKTSSENVEVEALGINLKKLAREVIELMPELPAAATELVESITHPGHLADLIAANVDVPIEEKQAVLETVDLKARMKLVLELLNRKREILKLSNKIDSAVKGEMSKTQREYYLRQQLKAIKEELGEMGEEEEELDELQERLKKAGLPPDVEKVANKELNRLKTIPAASSEYTVARTYLDWIADLPWAKISEDNLDIENARQQLDKDHFGIKKVKKRILEYLAVRKLKNDMRGPILCLVGPPGVGKTSLGQSVAKATGRKFVRLSLGGVRDEAEIRGHRRTYVGALPGRFIQSMKKAGTKNPVMMLDEIDKLGADFRGDPSAALLEVLDPEQNNTFSDHYLDVPFDLSKVMFVATANQLDPIPGPLRDRMEIIELTGYTFEEKQSIARIHLVPKQLKEHGLSPDHIDITDEALLTLTTAYTREAGVRNLERRIADICRAVAVEVAGGKTEKQTINADRVKEILGPEMFYSEVAERTEVPGVATGLAWTAAGGDLLFIEATKMAGKGGMTLTGQLGDVMKESATAALSYLRSKAEQLGISPNFLEKTDLHLHFPAGSIPKDGPSAGVTILTALTSLLTGIRVRHDTAMTGEATLRGLVLPVGGIKEKVLAAHRAGIKRVILPERCRKDLIDVPDQARNELEFIFVTHMDDVLKAALETPPVGVAGTPGGEPGKEAPLPKPAESAPEVRA

SEQ ID NO: 11338 - protein, 254 aa, Myxococcus xanthus
MTADLEWNDGVRPYVPLSTLKPVADGVWWVDGPVARMRVGPVSLPFPTRMVIVRLGTGGLWLWSPTAPTPELFEQVDALGTVEHLVSPNRFHYAGIPAWKARYPRATAWASPGVRERARSQQMDVPFDADLDDAAPSAWSTELGQLIFRGSRFVEEVVFFHGESSTLILADLVMALEPERLRPRLRWLLTLGGTMWPGQTPREVRVTTWGRTAQARACYQQMMAWQPRRVLLAHGRCYLDEGVAPLERAFSWLR

SEQ ID NO: 11339 - protein, 792 aa, Myxococcus xanthus
MARLFADRPEALARAAELASRCHASLDDLHYRFPEEGLPEGRTADAHLRVLTYEGLRFRYPEGVPPAVVKQIEHELKLIAALDFAGYFLALWDIVRFARARGILCQGRGSAANSAVCYALQITAIDPVRMGLLFERFLSMERKEPPDIDVDFEHERREEVLQYVYEKHGRRHAGMVCEVICYRGRLALRETGKALGLSLDQVDRLSKVSASNGFDVTPDVLREAGLSAEDGRVQKTLALAMELEGFPRHLSIHVGGFVMTREPLTELVPVENAAMPGRTVIQWEKDDINAVGLLKVDLLALGMLTALSKCFALIREHHGRELSLATVPAEDPKVYDMLCEADTVGVFQIESRAQMNMLPRLRPRTFYDLVVEIALIRPGPIVGNMVHPFLRRRNGQEQVEYPSEAVKEILGKTLGVPLFQEQAMKLAMVAAGFTAGEADGLRRVLSHKRAESMLLQYRGRFVEGCVSRGYTRKQAEEWFDNFRGFAHYGFPESHSASFALIAYASSWLKCHYPAAFTAALLNSQPMGFYAPHTLVADAHGHGVVVRPVDVRHSSWDCTLEEGGAALRLGLRMVKGLGESAGRRVATAKREGFRDVGDLARWSRAPRHELTRLALAGALSSLCGSRRQALWELQALGPLDSDDLFFGMAMDGTAVELPSMDVLERVCADYDTVGLSLEKHPLELLRPVLKQQGAVTAEGLKKVAHGRRVAVGGMLICRQRPPTAKGLCFISLEDETGIANLVVPPDVYERCRKDIHGALFLVGEGVLERSGKVTNVKSSRVASLHGQRGTLPG

SEQ ID NO: 11340 - protein, 131 aa, Myxococcus xanthus
MAPLRFLQAIRDGTELSLHGEGRMQRDFTYVEDVAEAVVRVLDRPLPGAPRHRVLNVGRGEPVSVRAFLSVLERILGARARVKSTPAQPGEMDATWADPSALERETGFRPRVSVEEGLTRLVAWFHEQSGT

SEQ ID NO: 11341 - protein, 81 aa, Myxococcus xanthus
MIQDNEAEAGVVVVLNWVDVTSAQLMGRAEVLLETGVVGPNGKLRWSNPTRTVSTIGMYQAQTDFRSYLRKAVVEAIQAIP

SEQ ID NO: 11342 - protein, 48 aa, Myxococcus xanthus
RALMLDPDVLLLDEPLGALDPLVRHELQGDLRGIFARLRKTVVLVTQD

SEQ ID NO: 11343 - protein, 503 aa, Myxococcus xanthus
MRRAYLHLTRFPVQRRVVESPELAGRPFALVEAVRGQRRVAFASTSALKAGVRPGMTLTAATALEPGLRHFDYRPEDELRALTALGEALLPLAPGFQLCAPDGLWLDAGAAHLCDGEEGLGTRMLSLCAELGYRAHVVVASEAFTSRAVARHGARRVEVVAPGDSARALAPLPLSALEGREGAAFSALGLTTLGEVAALPVGAVAARGGAAGARVHARCRGEDDTPFVPAALEEVLEERVVLDFPAESFEPLRFALKTLTDRLGARLSGRCRAAVRLTFTLKLDPSGQRQVTLTLARPTARAKLLHELARHRLEELRLENPVAEVSARVDEHSEDGGQQLALGDAPEGDAALEVVLSRLASTLGEASLFAAGLEAVHRPEAAHGIRAFRPPEARRGLSAELLEPGARRASVSAASRERPSRLLAEPACLEAEVAESGRLLAARMEGRRHRVTALTGPERLGGEWWSETPFQRDYYRVHFEGLGPAWVFRDGRDGRFYLQGLFD

SEQ ID NO: 11344 - protein, 290 aa, Myxococcus xanthus
MSAAEQRVGAGQGTGSVVEQLRERIRQLQAAPRRYLAVLRTGLSAVDALLPTGGLPLGQVVELCGEAASGRTSLALHAVAAAHQEARLCAWVDGPRELYSPSAAALGVDLERLLIVRPQASEQRIWAAVQLARSGAFACVVLDLTRGMNPGGRACRVALAEARKLADAAARGGGLLLLLTSPESPADGVVRLRTEARDGDGWSVEVVRSRQGGTGARAELPWSALYPALGLEGGGRLLDVAEDTEDGTPDFLRDQSGALRNGLGILGQRPGRDAPMPPMRQGLDAALPAH

SEQ ID NO: 11345 - protein, 105 aa, Myxococcus xanthus
MAEAFDQGLDNLDSICRDNYRDTLLRIAELATVAQSIEVVNLPDPRLVQVELTRANDEVERCSVAAGDLRYEASTEAYPARLFFQSSCLRRADDKKVEVKVLCAG

SEQ ID NO: 11346 - protein, 255 aa, Myxococcus xanthus
MRAPLPVDEVVRQAALLLDSGVLRLAQAPPREAAVSPSFSVPQPGGVPVPVEEPVWLRLQVVDDTTDVPIAGIQLRIQLDDRSEHQARTDSEGRIDLKGVPKGGAHVLSDLEGATLDNTLALVRTGGPWSQQKPAKRGQRARGASGPRFLARVTQHRVIDGETLESVAEMYGLTVEELTRFNWNTTDAADIERHLILDVGCTRKGSRGQYVFTREDDPGILYVPRPEAIPRLPVEHSHILRVKRVPEPRHFLFSL

SEQ ID NO: 11347 - protein, 859 aa, Myxococcus xanthus
GSRAHEGGRVMADTAVASQSHAGGERFELRREPGAEGVFYLVAVAPTELKLSLKSHRAAQDRIAFILEGTHKNLPADTVCSVLIKTHARGMPAREYTLVNVPLRVNGRSCTLEFEADIYEASFFGRGHAEMTVIPDFPFAQECCLEKPFEFDIPLGLRGLDLSVPVLFGRRFRLKPDMDARFTGATLRLSIYHSVEPKRGVAPRMAPEAQRYAALEWGASDLGAKDWRVGCAWSGDGLRLPWREPIQGEYAFDLRLEVLRDIEGETRPYVVWDQPRACVCPKPNLTGLEFKHHAVTATVEHLDPDFELPLELTHWRYEAQTRGEALSFTLMDPVSRPVLVNANERGLFLRQFLDAEDWLRRKSFALLRIPRSLTGSDEYVPIRSVLDFDETQFLAFEDEDLWLEAPASARAPSRQKQDRVRQELVTALASKELAVRPSRMPRFGDVWLGARDNHLLITVKVIGDLDYWREASPVFSLCDDQRPVEPTVSREAEVLRLDARPLDGNPRYYEALVRFDDPRIRQKVFIQGRVSKPDARLWDELVAAPPAFFVEYPGVPQLQGLRAEFVQLTDDTSILEVRCQALHVPNGKEGDVIEFRLYEFFADVAEPVVFGAVPFRYEVAKGAAGQCDARGRVVARLREPALVERMRRKGQFRIEARLVERANANHSSALPAIHLDLEGTPRRIEGTLIYGSHPNVTEAFRRKVLIIAEQLEMNADDLMACMAFETGNAFRADTPNRAGHQAFGLIQFTAINEGKDALDIKLSALVRMSAVEQLDYVAKYFRMWKARSKLPLDNLGDVYACILCPEALGKDASFVCYAKGSRGYEPNKGLDRGGKGFITKADILVPVERHLREGQKFRK

SEQ ID NO: 11348 - protein, 233 aa, Myxococcus xanthus
MIFRQLFDSESSTYTYLIGDEATRQAVLIDPVLEQVDRDLQMVAELDLTLTHVFDTHVHADHITASGALRERTQATVVGSVNGASCANVQVRHGDEVRVGQLVFQVLATPGHTDDSISYLLGDRVFTGDALLVRGNGRTDFQNGNASQLYDSLTRVLFTLPDETLVYPGHDYKGRTVTSIAEEKRHNPRVAGKSREEFIHIMENLNLPRPKLIDAAVPANRACGHTAPSPQGA

SEQ ID NO: 11349 - protein, 108 aa, Myxococcus xanthus
MTLRPYQDITPSQLDTLGPEVRRIDVREPDEYTGPLGHLPGAELIPLATLEAAASAWPREAPLLLICRSGGRSAQAARLLAHGGFKHLFNLAGGMLAVREPLAPRPQG

SEQ ID NO: 11350 - protein, 253 aa, Myxococcus xanthus
MGLSLGLLGGGGSIITVPILVYVMGFGAKESIAMGLAVVGITSLFGAASHWRRGNVQWKAALVFGAVAMAGTYAGARLSALISGTTQLLLFATVMLVSAVFMFRNGRKDSVQAPEPKKASFPLMALAALGVGGLTGLVGVGGGFLIVPALVLLVGLPMKQAVGTSLLVIALNSLVGFAGYLGHVEVPWVSLGIFTAIAVVGILLGTWASHFVSQATLKAAFSGFLVVMGVFIFFKNREALGLGGGAATTQNAH

SEQ ID NO: 11351 - protein, 220 aa, Myxococcus xanthus
MPTDVTQNSRRSTMAEQPPDAAAQWDARFSHPAYVYGTQPNDFLVEMASRLPPGGRVLSLGEGEGRNAVYLASLGHAVTAVDASSVGLQKAKQLADERGVNIETRVSDLAHFTFAPEAWDAAIVIFCHLPPALRRRVHGALVKSLRPGGLVLLEAYTPAQLGFRTGGPPVEELLYTAEALREDFAGLELPVLRELTREVREGTLHTGRAAVVQLVGRKAT

SEQ ID NO: 11352 - protein, 509 aa, Myxococcus xanthus
MRAPAPTPKRTVYTEAMEIFHRAADLIALDKRVRLELEEPDYEHIFYVTAKLKDRLVPLSEEKARTFSNLPETQVRNKEGLELLANGNIILNGRALLGSDVDIRQGHLRLPDGKVYQLVPGESQRFKAYRVQHNQARGPYKGGLRYHREVSLDLFKALAAEMTWKTAIAEVPFGGGKGGIQIDPREYGREEIEAITLRFMYRLKSMIGPDIDIPAPDVGTNPGIMALLYRQYSDGERERHNLRGIVTGKDVRIGGSEGRHKATGQGVAFCIEDYYADRGESVKGKTFIIQGFGNVGSHAANILSQMGARLLAVNDADGTIFNGDGIDVTALSAYVQDPKNLKRSVLGFPGAQRIEKKDLWDVQADILVPAALGGEITADVAERLRVKLVAEGANGPTTPEADRILEKRGIELIPDIIANAGGVTVSYYEWIQNKRMERWSEAEVDQRLERAMKRNYRIIRDISRNQPRKTEMHDSRQYCIGETVDTRCAAMILALKRIEAHYLLEGFSQ

SEQ ID NO: 11353 - protein, 317 aa, Myxococcus xanthus
MRTAARLLWVYLAGALCSCAAPAPRVSPVAPEGATPVGPFLPEARALFEGCTPVPDRADSRLYRCDGVTVWLTEREDLTPEQALKDAQARITERLGPGATVVEEALPLAGSPWPSVRVEACEAEDCRAAGYASAITGTLGRVRQLGCVVQAPVRPLLARCLELLESLASNGSPEGETLGREALLVPPRLPWRALAVPDGCLLAASTARAGRIRCEGASLLWSLYEPAQSQVTERWRSQSVAELVDALPGAGPVEEVPCRLENLDTRCARFTVPSSEGPLLVWAAAVTWEGRALFAACSHRASEPPYPAVCNGAFTLP

SEQ ID NO: 11354 - protein, 127 aa, Myxococcus xanthus
MLTPGPYSLGTGEYSINITPFFPGGSSALTHGAPKKTDGNGNPILPYLTVTGDMPAGWNLQMFNRLFSTRSVRAQIVFTPQSVWTLPKKGGGKSHGVTARIEAIFITEGRSGQAMGLWLHGKDAKKR

SEQ ID NO: 11355 - protein, 52 aa, Myxococcus xanthus
MEEVAEQLEIPVEVLARVERGVMVPTIPTLTRLCVILKLDPDVLPELPEMSD

SEQ ID NO: 11356 - protein, 356 aa, Myxococcus xanthus
SPEQCRDARYIDARADLYGLGVMFFELLCGRPPFVGEAAAVLQAHVSRRPPAIRTLAPWPVPPAVETLVQRLLAKVPEDRGDSARSLAEELRELQGAGDALGTHAVSGALAENPRHATGASWTDTGPSTAPTPGSSRATREVAVLGVKSSLDAPALQASLTGSGVILARVEPGLCLFAFPHEAAVEAGLRAALRAAEVLKAALPPNATLALHCAPLRIRERAGRLTVGGAAVERPERWWPSLESVSTPETVALTASARAHLGDLPYSTPHGDALTSPDVLLGRDTERQWLREALSRVQAHGAPVLRTLLAEEGQGKTRLLTTWRTELEGTPGVSVRFVEALPDEGSASESGLRSLI

SEQ ID NO: 11357 - protein, 146 aa, Myxococcus xanthus
MNEALAMDLERHHLKAFSRIAPCEFESSDPAEVKAWVEREVGYPVDVPVVPGATLLGARRCRLHGKLSASLLYRHEEGKAMTLFLPLPGSAAAQEAARFAGDGPRCTQGPVGERICVLPGGGERAALAVSEMEPAVLLAALARLSP

SEQ ID NO: 11358 - protein, 175 aa, Myxococcus xanthus
MPVSARAFIERALEHLPVLRRVGRRLTGSAAEADDLVQETLTRALEQRGALRETERLKAWLLAVQRTVFLNSRRGLRPHLEVLEGGLGRALPPEPSADLEAELHARTLSAGMQAALDSLAPEWRDTLWLREVEELSYEEIAQVQGCPVGTVRSRLARARLAMLDFLEKEKVHGSL

SEQ ID NO: 11359 - protein, 156 aa, Myxococcus xanthus
MRSSLSAFLSGLIFAIGLGLAGMTDPANVLGFLDIAGDWDYRLAFVMGGAIAVHAALRPLIHRRAQPLFATRFPAFAASKPDAKLLVGSALFGVGWGLAGYCPGPALTSLATGAFPLLVFVPAMFAGFYLAQVLQARSGVGAPRPGAPHVGATPAQ

SEQ ID NO: 11360 - protein, 141 aa, Myxococcus xanthus
MTSSILLPLLGGALIGLSASLLLLANGRVAGISGVVGSLLAPVRGDVAWRVLFFAGLLAGGLLLAWLRPGSFPAPSTPGAGGLWLLVGAGLLVGFGSRLGNGCTSGHGVCGISRGSVRSISATLTFMATGVLTVFLVRHVL

SEQ ID NO: 11361 - protein, 79 aa, Myxococcus xanthus
MFVEVRDQVGLGEKLKVTFAGEDGTEMTCLCEVRYQVALAFGRKDGREGSSRGVGLRIVAYETQDDAPLLLVDRERVMH

SEQ ID NO: 11362 - protein, 276 aa, Myxococcus xanthus
MISAKERVLGVGQFDDFIQTDALINPGNSGGPLFNMKGEVVGVNTAIISQGQGIGFAVPSNLVKELLPNLRENGKLARGWLGVVINDDGSNGGGERQAPLVKDVYKGSPAAAVGIRPGDRLVAVNGRPIGSYLQLLRKVALLAPGTEARLSLTRGTETQEVTVRLVARPAQEATEGLIQRTASEEEMGLVIRDLTPEVAAPLGETAWSGVLVSGVTPRSPADSAGLRAGDVVTEVNRRRVKDVAGVRAALGKGSAGVSILLRVKRGEALQYIAIAR

SEQ ID NO: 11363 - protein, 156 aa, Myxococcus xanthus
MVAELETLRKKFDIAVRAVQAAEKDREEFKQRVTRERERMLDVERGNVAVTLLEAIDELDRCLSVSAQDTSPLAEGVRMIRDELLRKAQSTGIERLQVVGQTFDPNTADAVDMEVTATPDDDHRIVAELRAGYRLKDRVIRPARVKVAKYVAPVQA

SEQ ID NO: 11364 - protein, 122 aa, Myxococcus xanthus
MDIVVADLTQPRTTAGIGGSGSKDGGLIPGPSLPMQRADARLEQAVAHAQQHLDVLRKAQGPDFDEAFLKRVIEDQEEALRLVKQAQATYKNDGAFTLMLDRTGNLADRHLQRAQGLKESFE

SEQ ID NO: 11365 - protein, 520 aa, Myxococcus xanthus
MRRVAGGMGQGPQSVMSFGKTRAKVQAEADTGVGFKDVAGVDEAVDELREIVEFLKTPEKFRRLGGRIPKGVLLVGPPGTGKTLLARAVAGEAGVPFFSLSGSEFVEMFVGVGAARVRDLFAQATSKAPCIIFIDELDAIGKSRNSGVAGGHDEREQTLNQLLAEMDGFDSRAGLIILAATNRPEILDSALMRPGRFDRQVLVDRPDKRGRERVLEIHAKGVKLGPDVDLKAIASRTPGFAGADLANVVNEAALLAARRNRDAVMRADFEEAIERVVAGLEKKNRRMNEREKEIVAHHEAGHAVVGWMLPHAERVTKVSIIPRGLAALGYTMSLPLEDRYLMSLDELRDKMAGMMGGRAAEEIFIGEISTGASNDIRQATEMARMMVRDYGMSTLGPVALSADHGPGFLRSAGVPETRSYSEQTARMIDEEVRKLVSEALDRARQVLTTHKDRAQALAARLLAVEVVEEDTMVTILGPKVLAQRGLLHPEARQVISAHPVDVGGGDDQTPPTQHSDALDS

SEQ ID NO: 11366 - protein, 143 aa, Myxococcus xanthus
MYPGGPRDAESVIIDARSGRLAVITKTLDSLGDVFALDGLSAETPIQARKLGTLTAPLGMDRATTAASLHPSGERLLLRTYSRAYELRRPGAARLEDLLQGELVEVPSGSQAQAEAITFVQDGNGYLLGTEFTGQPLWLIGCR

SEQ ID NO: 11367 - protein, 76 aa, Myxococcus xanthus
MGVEVDVLGQAMHTHHEYPNYDIDFRVFHCRLSRPTEEVQHLRVHDHRWVTLEEMSAYRFPDADAKTLAKLLDLDN

SEQ ID NO: 11368 - protein, 60 aa, Myxococcus xanthus
MSDGPKKSPKVFGVPVKIDPYTSVRPEHPTGEFGMPSAKKKDDKPFDPFAVVIESPKGGG

SEQ ID NO: 11369 - protein, 128 aa, Myxococcus xanthus
MRQRIIAAAVACDYTALNTLADENGKAVRFTFGDGTDAGEYWRAAEKLGNPELARIVKVLNLPYAKQDNLYFWPAVHVTGATSDKDWGALKGVYPDEEIAGMKDQGSYLGLRVGITPEGDWQIAVAGD

SEQ ID NO: 11370 - protein, 171 aa, Myxococcus xanthus
MKLKALCITVSLLTLPGVAFAQGGFGALTKAAGDAGKSAVEKRVNTKLMDEGRQNQCSFKTGTAQLDAGCEAKLKKLTNALVDAKKQLVAAGVKSYKFEVSGHTDSTGDAAKNKKLSEQRAETIVKELIARGIPRGEIIAVGYGSEKPLVKPDDTAAKKAKNRRYELQVRL

SEQ ID NO: 11371 - protein, 508 aa, Myxococcus xanthus
MSQSQSMAILPPDGHHATQVTHQRMTAAPLYDKGMHQPGAEIQAVRGTKRLPAQPDFTLSTSSFSHSDQATESLYFSKSGGSSPQHVPRAATQRRLPGGAMRMKTWMPVSLLLLNAPLALAEPLKAKPTDKTVWIAIGTDAITPMQETFAAEGCNVPTALKQQKHAGVFQLKESQLSRLALMMHEKFDRCAGFITYETQEEALASLAPVAPNAAQKAVSYTLTNAATVNTLVGELSAANIRTTIADLSAFPTRSQSSQGGVDAAAMLLAKWQGYVTGAGRTDVTVAYYPHTGWRQPSVILTIPGTDLSGEVVVVGGHLDSISSTSAAPGADDDASGIATFTEVIRAAMARNYRPQRTVKFMAYAAEETGLRGSREIALSHKNNNINVVGVMQLDMTNYKHPNATSDVGIVTDNTNATQNQFIRDLITTYVGVPFTNTTCGYGCSDHASWHSQGYAASIPFEGTVVQKNPNIHTPRDTLANSDSSAAHALKFSKIAAAYVAELAKGTAQ

SEQ ID NO: 11372 - protein, 439 aa, Myxococcus xanthus
MLRNATTLIGGLALLLYTSPRLTLVMLAVVPPVTLGALFYGRKARQLARDAQAAVAEANEVAAESLYGIQTVQAFVAEDAERRSYGRAIGKALALARTRIVSSGFFMGGTGFTGLASTLLVFWYGTHMVVSGDITVGGLTSFLMYTLMVVMAVGALSELWAEFMKAGGATERVFELIDRTPAISVSGGERPANMEGNLRFRDVNFSYPTRRDVPVLQGLDMDVAPGEVVALVGHSGAGKSTVASMLMRFYDPDRGAILVDETDLRTLDVRWLRQNIGIVSQEPTLFSGSIADNIRYGRTDATDAEVEAAARVANAHDFVSRFPEGYRTRVGERGIQLSGGQKQRVAIARAVLKDPRLLILDEATSALDSESEHLVKEALDRLMVGRTTLIIAHRLSTVAGVDRIFVLDQGRVVQHGNHEALITQDGLYKRLVERQFIAA

SEQ ID NO: 11373 - protein, 66 aa, Myxococcus xanthus
MVESNIVLKPEVVTFKQLDPAKVDALRGQLSMILGRGEFPTMSARAGAVVVKEPQDHTSHTSDGWF

SEQ ID NO: 11374 - protein, 67 aa, Myxococcus xanthus
MVESNIVLKPEVVTFKQLDPAKVDALRGQLSMILGRGDFAQISARAVGPVKDQEPQDHTSHTSDGWF

SEQ ID NO: 11375 - protein, 68 aa, Myxococcus xanthus
MLAADETVYEISNTPITDYELCLESQSQGRRTTSVQAFEDYNALRCARWTRCGASDPCTSVTHGACTP

SEQ ID NO: 11376 - protein, 266 aa, Myxococcus xanthus
MKIHEVRATTQGTERSIDAEMLRQAVGACDLFVCFNTWHATGVSELLEGFPAATETVGLYRRYKQWVRSEELQHSADRLFSLAQQVDPSLRLEDFAQAPVLTAEATEGGRHFRDSVPDGAKVLALHTETGARKQWPVARYRAVLDAFLTAHPEWLVLNVDYSATELAPMVHEGRVLSVPGAPLDVAMALLGACDGFLGIDSCMLHAADFFRLPSVGLFGTTSPQQWGFRFTPAFREPTGNGSMDDITEEEVLGALTDLAAGRLRPA

SEQ ID NO: 11377 - protein, 129 aa, Myxococcus xanthus
PVVTNDGARMLDAFRWGLVPSWAKDPAIGNKLINARGETVAEKPSFRSALKRRRCLVVVDGWYEWKQSTKPKTPYYFHRKDGQLLTLAGLWEEWTAPDTGEVLNTCTLITIGPNALMAPIHDRMPVILE

SEQ ID NO: 11378 - protein, 382 aa, Myxococcus xanthus
MVNPSHLGTIVAAACLAHDIGNPPFGHSGEAAIQHWVSQRLARPGAEVDGRKSPFETVEQWQDLEAFEGNAQGFRILNRLQSRERRGGLRYTAATLGAMSKYPRASVLPGGRERDKGRVSEKKFGYFQDDEALALEAYRAVGLVEREAGVFSRHPLAFLVEAADDICYAVIDLEDSAKLGLIPIKDACELLDAVLPKLVKGPVRPPPSHPETRLAQARARAIGELIQASVKVFLENVEAMEDGKWETPLASARDDVAKPLKAIRNLTRRYGYESERVLQIESAGFKTLGGLLDMFAMAVVTDTPNREEKKLRQLLPLDLFQRPEHVRDMAEEPASRDEAITEAVARLSKYQRLLCVTDYISGMTDGFAVELFQRLSGIKLPT

SEQ ID NO: 11379 - protein, 540 aa, Myxococcus xanthus
MAMDCDWLIIGSGFGGSVSALRLTEKGYRVMVLEKGRRFRAPDFPKTNWALKRWLWMPTLGWRGLFEMSFFRHVTVLSGVGVGGGSLVYANTLPIPRDDFFQASTWGHLAAWKEELAPHYTTARRMLGATPNPLRTVPDQVLQDVGTDLGRTDFQPTTVAVYFGEPGVTVKDPYFNGEGPDRTGCTACGGCMLGCRFDAKNTLDKNYLHLAERRGLALHADTEVTWVRPLPDGGYEVEALQGARRFFRKKVRFTAKHVVFAGGVLGTLDLLLKLKASPDGLPRLSDRLGDGVRTNSEALVGVVNGRKGQDLSRGIAIGSILHTDAQSHLEPVRYSAGSGFFRLLMAPQVSGATMLQRFVRLVGLLVRHPLRFLKAWFVPDFARRTMILLYMRTLEGHLRMTRSRRLGLSTALQEGPAPSANMPEAFDLARRVADKLDGYPMTIVSETLLGIPTTAHILGGCCMGDSAETGVIDSRHRVFGHEGLYVVDGSAISANPGVNPSLTITALAERAMTFIPAARTAPRDEVAVPAGPMSSGARTS

SEQ ID NO: 11380 - protein, 757 aa, Myxococcus xanthus
MRFPHEERLVMVWDSLPKAGVERSETSLATLEDWTAQAGGFEHVAGIVPRSLNMGGALQPERLQAFRVGAALFPALEARPSLGRAFSAEEDRVGGEAVVVLSDALWRRRFGGAPSVLGESVTLDGEPYTVVGVMPKSFDFPPGAEAWVPLAPTQAELDARGDRKVRVVGRLKPGFSVSMAEDALRVLAGQLAERYPDTDSERTVRLTSVREAYLGPLRPLLITLAGAVGFVLLIGCANVASLLLARAAARRRELAIRGALGASPTRLMVQALTESVLLSLLGGGLGILGALWGTHMIATMLPPGLAERLPGWQSIQVDGGALLFCVGLSAITGVLFGLAPAFQMSRQNPLEAMREGAGATAGRKSIRSALVTAEVALALMLVVGASLMLRSLYQLQGTSPGFAAERVFYFDVTLPETRYPTDAERVRFFHALQERLSSIPGAQAVSAASLPPISRRSQSSNIYPDGQPKPLPGQLPEASQRVISPGYFRTMGIPLHEGRDFNALDVEDSPRVAMINSALARRFWPGESPLGKRFFTGGTEPWEVIGVVGDVRTLWRGQVRSSVPEFYLPLAQAPRDAMVMMVTVGGTGAAASSLALSLREGMASLDPEQPPPSPRPLEELIAESFGSRHLLAALLGFFACVALLLAAGGVYGIMAYSVTQRRTEIGVRMALGAREGSIFWLILSQALRLAGLGVIIGSVLALVLARGLSKLLFEVSPADPLVFLGTACVLLFVALVAGYVPAWRAARVPPSMAMREE

SEQ ID NO: 11381 - protein, 501 aa, Myxococcus xanthus
MRVPGLRYRDEWLPNFFPAKQVGPDHFVRLSRTGAMQLLSGAENAQLDEISMDEALFERLEQTSHLITAQNSSRVLEDLKRWHDRTYAGPGLHIVVLSKRCNLNCTYCHMNPENISADSKRFDMQPDVADAIIRFALGSPAPFLGFEFQGGEPFLNFEGMKYFVEEARRQNEAVGKRLRFSVVSNLMVATDEHIAYCKENRINVSYSLNGPEDIHDSFRVTRSGAGSFRKVMERLSHFRDRFPGVLSASPLCVVGASNAKELKRTIDFYHAEGFKDLAILKLKALGNARKEKLPFDIQDFLHYYLDALDYIYEKNRQENENYSERVVRVVLAKILQSTDTGFVDWRNPVGDFGSAITYDHDGEILPSDEARSMRSEFGLGNVKGTTYDALIRNKATFRSMNLSLRDRDPQCRECAFNPYCGVLPVLDYARTGDATPRPHASEECLQTLAVVEWVLRKLVEDPIPLLRMMPGMDAALVEMANGLPTEPSSQAMPPMLSVQSG

SEQ ID NO: 11382 - protein, 369 aa, Myxococcus xanthus
MGNLASLLIVQRLRGEVTHGEAFFVTPRTLYCLPRGERLDVRGPGEGRVVWHFSGAECLLSVEGHSGPGLRIPLPLMGDAPVSIQPLPWSETWNVPVLDDSEMLGITGRRDQAGIPDDGSTGTWRPMPLLQSTEEAFHILGKLWPEVLDWARVLLPALVDMGGPENRSVRCSSSYGAGTPVFLTRVANGLEHAEDLVHELQHERMYLLLDSRAFGRWDDSRPEFVSAYRTDPRPLRGVHLGLHSFLAVNRLRLLALDRPEFKQREWRFQLLKSHRCNLLSFRTLLDFERPTPEGRVLLAQMAQALSEQHPLIERVADADMDQAFDTWMKQHFSRVAASGPVVNDAETYMGWREAAVLAARYTQHAGGAA

SEQ ID NO: 11383 - protein, 348 aa, Myxococcus xanthus
MAGRPREDRLERYPVDRAHWMAAAVTRAHDSALVPWKPPYRLVYGEHVLERCALLQPGRRFEPARGQRRPQALLTTFFTGYHPSKPIQRWGWGDNNDLVRWLEPFEAIREVVRASTRDLRYLLERCQVSVNKTPAAVLAPRTLRCLVEGKAFELAARLVSLLPSKVSEPTDMDAGYFAAVEAALLSEPALEEPQREDLAACLWMDRGLFHIQCMSRRMKELARRDERTEALRASHQSVLRDSLLQRRPVLGPYHLRVTRDLARLLDARPLSPETSEVLCYASPAGIRYQPLSTLEALLLDQCDGRTVAEMVGDVSAALSLPHDDVRSAIFTFLSHLSHESPLVLDWSH

SEQ ID NO: 11384 - protein, 445 aa, Myxococcus xanthus
MNLGRPTDVNLFERTLDSMASLLLSGQSEEGLWPVAPLYEAGDVVYGSLEASAALCIEALVRYVRIARIAAERTDNFLPGALPPRSGTWKETLAAFDNDYPPALFSPESRARLLALGEWLPAALEGDGGFEVRLLEGTPRVDFILGIKHDGQALLAGRHPHSELPAPLFAAPEWRRIRDFARAWAEPGGLLDREVDAFWLEFDLDAPVASPPLPIVFLCTRDQPVAVNEALHQQKSDTYRATLHAGLPLLRGDEAPLTPELQRGMDVCIEALPPGAHLYAACVMMSRRSKNLRFTLKNVPPERVVAYLEAVAWPGDFQQLRDTLAWVLPLGVNRFMLNLDLAPQLLPTLGLECSFQGRAQPAEEPRWQRLLDELVTRGLCAPSRRDALLAWPGRTQVNLPAGSATRESVFDKRLAHVKLGLTGAPVIEAKAYLATHRTSELLRPR

SEQ ID NO: 11385 - protein, 718 aa, Myxococcus xanthus
MDREHTVPPARAARLVLALCEGLAAAHAAGVVHRDLKPANVLVEARGRVVLTDFGIARALAGEGASRTQGLVGTPMYMAPEQLESGEVDARADLYATGLVLYQLLTGAPPFAGDSPMAVAVARLRQPPPDPRLLAAVPDALAELVLACLSREPSGRPRDAACVADALRQWLGSVGEAIEPKHAHGVHLGTRGHALGGDSVSSVVGTHGTSTPRSSGASQVSAATHGASTPQPSGFGHASMSSGGLVARTPLRPDEQSLAVLPLRFLGASDQAFLGDGVTEALIDVLSRTRGLRVQSSGATERFRQERDPRVAARELGVELLVDGTLQAAGKTVRVTLRVVEGASGTQLWSGRFDDADDDPFQLQDRLGQRLAEALRGELTILAYRSTVPAEALALYRQALSRMLAHSMTGELKDEVITPLEQLHASVPGFPHAAAQHAVATLRAGFISTLADEVDWDALARTSLERARQVAPELVETKLAQAILATREGRWRDAVVALRTALDTAPTFAPALQLLGNLQCEAGRADEGLPRLKLAYSLEPGMTICLVEVARCSALRGDDATYQWCMARLNSQPLLGMPVLILRMRVAAWRGDMDDVRQCRDALNEDPSHMASYVATYCSAALGEVSVEAAMATLDDMLTRQQVSSRFASMVCQLAAELMCIRGAPAEALRYLQQAANLALIDLEWMDRCPALTPLRAQPGFAEARRKVRSRVEAIWSA

SEQ ID NO: 11386 - protein, 590 aa, Myxococcus xanthus
MKRSLNGLLPLALLGFFLAQAAHADVVDDVWRGTNIRLNAARIRVKGNDYATGYWLLPKAANTLNLNVPARQFGLNSDLVLHMYGSRSGNVITWTFDDTLPSRYNLGDSTYVTRVRGTLKAYARQVRGSDDPFCNSAACPHNVELTLAPGSSAKVSGYKTFIFDIDFTEDVQVKQFVAYGGVPRPRLSSMAVVTPSSRCPSSGPSELSGDVVLSSPAPTGGILVDLMSVDASVGVLPVRVPEGQRSARFTLRLPPYWTGPTVVYGASGGVRKSVKVGVRPCLVHVFPFVRWYLIDSLYAPAHLLNGGAVIARYKEAESDVLLTGKGEAYWLNEVLGAEQVRVTGVNSTGDIFGTAYTAKGPNAFLLRSEDVKAGAEQWLEGWEAVTANAHGTLLVRDPNDGKGIYLVDEVGPARHPGLSELLPSRVLFNALGEVAVTLETEKGLRAARVYGKDVQVLLDNESEVTALNDVGVFVGTALDSDKRPRPFVWSRQEEARWLPMPKGAVSAKAVAINDGGWVLGTATAEDGKTQVPFLASPDGKTATRLDEVLPEELKKAGYRVLRALALADDFSVLVQALDGQGQRVHLVLSP

SEQ ID NO: 11387 - protein, 256 aa, Myxococcus xanthus
MKIATWNVNSVRARQERLLAWLKKAQPDVLCLQELKCVDDDFPMEAVRELGYHAAVHGQKTYNGVAILAKEEPKDVVKGLSDGVDDSHARLIAATVGGIRVVSAYAPNGQSVDSPQYQYKLEWYGRLRRYLDTRDKPDEPLVLGGDWNVAPEDIDTYDPKLWEGQTLFTLKERDALQRLGAFGLSDAFRRLHPGVQKFTWWDYRMLGFPKNLGLRIDHLYVTAPVAERLTVVDVDREERKGKQPSDHAPVWLELRD

SEQ ID NO: 11388 - protein, 57 aa, Myxococcus xanthus
RRNHTKPTSHSSFRPPASVRRALVLASLVVLGLALAWADAPLPRALRAWLAAEEPLE

SEQ ID NO: 11389 - protein, 422 aa, Myxococcus xanthus
MIANLHNADIPQPVLDVIARLRDLGHAVYLVGGCVRDMVRLVHPKDFDVATSALPQEVQGAFRKVIPTGIQHGTVTVLQNGTHVEVTTFRSEGDYLDGRRPSSVAFERDIVKDLSRRDFTINAMAYNPLDRELVDPFGGQSDLRSQLIRCVGSAQERFSEDGLRPLRAVRFAAVLGFALDSATRAAIPATLGVFRKVALERVREELVKLLLSPRAESGLLLLADTGLLDVFLPELARAEASAAASVRAAVQASPLEVEVRVAVLLADLVDRAQARDIGLRLKFPNKVADLVALLVEHAKAETRVGEPDAALRRLLARLGPPQLPLWAAVVRARVGVRQPDALPAVEALIARVEALAAAKPPLTAKDLSLTGGDIMAALGVGPSPIVGEATRFLVESVLDDPSLNTADALRQRLQAWQAQVAR

SEQ ID NO: 11390 - protein, 342 aa, Myxococcus xanthus
MSGGVDSSAAAALLKEQGHEVIGITLRVWSYEGKATCGSCCSPDDIDDARAVAQTLGIPFYVANAEEIFQDRVINPFVQSYLGGRTPIPCVACNRDVKFNFLLKRARALGARLATGHYARVEEVDGRFVLRRAVDAAKDQSYFLFTLGQDELRDILFPVGGMTKAEVRAVAERHGLVTSQKPESMEICFVPDGDYAGFVEKVAGPQPAGDIVDTEGNVLGTHQGIHRYTVGQRKGLNLGGGEIRYVHRLEPETQRVVVGPAEGTGRDNFGLLQPHWVDGPPPASQPVEVRIRHRHSGAQGRVHVSPHGLVSVKLDAPARAVTPGQAAVVYDQDRVLGGGWIV

SEQ ID NO: 11391 - protein, 260 aa, Myxococcus xanthus
MAQRLVGCLIAVVTVFAAAGCKERSDKPVAGLLAAGAPVLRAEGKQWRPIAVGSQLLGHDELKATGPAVLEFFGGGLRFLEKGDTLEVGEADEAKLHGVNLPSRHIVEGKLQEAPRPLRIIAARYTQVQVTPASAQQEDPYSSNGYFVAFFTPNGLSPNKTSDEPSRDGPRKPLPPPPHRPRVPHIHAGNLGEGGLVATVEDGFIVAETDDLATAVLLEGGDVPLGRTVRLMVPAGTEVVLRTQQGRKIEVEGPADVRLR

SEQ ID NO: 11392 - protein, 127 aa, Myxococcus xanthus
MTRSELIERIVERATHVPRREVEAIVHAVFEEMSQALIAGRRIELRGFGVFCVRTRRARTGRNPKTGQRVSVPARRTLSFAAGKDLRERLNAPPAMAASPVPDTPPGEALSPLPLAAGASFSVPVTG

SEQ ID NO: 11393 - protein, 286 aa, Myxococcus xanthus
MKEKFDVSLDNRQIVSLLIAGIVVMGAVFVLGVVVGKKLAGNADAVAAPDLLSALDANAQALQNVQQEQPLTFPDELTRKAAAEPVAPPQPKPVVAKAPPPTEKPAAAKPPEPKPAAAQRAALAPTPDPDTGELPPEEPKAEPERVVVAEAPTAPTPAKAVPVSGKVEASAVPTRTTTTEGGGLKEAIARATQQPAQPASPPAQAVKGGAFTLQLSAFQDKQEADRFAARLRDRGYAPYILTAEVAGKGTWYRVRMGSFASRDAATRYLSDFKRETSLDAFVAGTN

SEQ ID NO: 11394 - protein, 120 aa, Myxococcus xanthus
MTTTKRVEKPWGYELIWAHTERYVGKLLHVKQGHKLSLQFHNRKDETIHVQSGKLLFVVDEGQGLIEKEMNPGESYHIKPLTKHRMVALTDCDILEVSTPELDDVVRLEDAYGRTGTSNP

SEQ ID NO: 11395 - protein, 59 aa, Myxococcus xanthus
MARKKVSTTIYITPEQNELLKALNQKTKVPVAEYIRQGIDLVLEKYKAQLPGQSTFDEL

SEQ ID NO: 11396 - protein, 556 aa, Myxococcus xanthus
MDGTLSLEGELTLQALEVRANGARVRLAVKRLDRHDATLSGQALFPDAAAVQAHLPQTASAWLELDARGALVAVRFSDAEPPLFRQVAQTLAAELFPTELRDAAEWSAVESTQTGEVEARFQFDGEDARLTRRRARYQSLRAAATAPAFRQTLSSLTHFDRDPEGFLAGVSHDEILDATHTDGRSLMSRRVRLRLAFSTRQQKPLPPATEDKPIVRAPSQVAFEGDEALALTTSQADGMTVDAALQVLASATDPGAIPELGTFARRAIAALKLEPHRAGELGQLFLQKGRSPAMRELMLDLLAGAGHAEAQATLRELIVSTEAREHAGAHGLMVQRAGLLREPEPETGRLLARMNTEARTAGDVGAERASAYALGAVVSRLPAGSPEVAEFLRPLEDALARADNAESLEHSLRALGNSGTERVMDLASPHLRDEAPEVRSAAAGALRTAPQEAATRMLLDALMSEPARAVQGALLDALNARTLGAPELERLSGWVVAGQLAPGAEAALLNVLTPRMDDSAAVLRMLQALSVRPGQQPATRARVMALMAQASASRGG

SEQ ID NO: 11397 - protein, 603 aa, Myxococcus xanthus
MPAENAHIRNFCIIAHIDHGKSTLADRLLDKTGTLTKREAQAQFLDNMAIERERGITIKAQSVRMNYTAKDGKQYVLNLIDTPGHVDFAYEVSRSLAACEGALLVVDATQGVEAQTLSNVYMALDHNLEIIPVINKIDLPSADVDRTRAEIEDVIGIDASVAVPCSAKEGIGIQDILESVVQNVPPPSGSADAPLKALIFDSWYDNYRGVVTLVRVLEGTLKLKQKIKLFSNNKVFEVQELGVFSPFSRPVPQLIAGEVGVLVANVKELQDAKVGDTVTEESRPTAEPFPGFQEVKPMVFSGIFPVDSADYENLRDALAKLVLNDSAFTYEPESSTALGFGFRCGYLGLLHMEIVQERLEREYNLNLITTAPSVVYRITTSKGETLLVDNPAKLPPVQHIEKFEEPILTCHIHVPNDHLGAILKLCQERRGVQKDMKYLGSSGQRVQVTYEMPLAEVVFDFFDKLKSVSRGYASLDYELAGYIESDLARLDILINGDPVDALSVIVHRERAYLRGREVCQKLKEVIPKQMYEVAIQAAIGAKIISRETISAIRKNVLAKCYGGDISRKRKLLEKQKEGKKRMKQVGTVEIPQEAFLAVLKSEQ

SEQ ID NO: 11398 - protein, 401 aa, Myxococcus xanthus
MAARRTPEMLRARNVLVWRERLTSLWAPLIILALLYVPYTVIIEYSRASAVWAQPVMKGLGLLLVLYFVALLVWRNVSPKKKALRGVRHDANELLEENERILRKPGVSAKVAGPVLDRIAEQALRVEQASAAGDAEQLRTEVKGLEALTAQHLGAFRKQSAMDFLGGFGKALLVALVFRTFIVEPYRIPSGSMLPTLEIGDQVFVNKFIYGVRVPFLNFVPFVIVRPPERGDVIVFNNPVNESVDYIKRVVGVPGDVVEFINGVVHINGQPQKRELVSNEFTVHNITDDGRWYDQQETLYEENLSGVAHAALQTLPRMPRREGPYEVPPGHVFAVGDNRDNSADSRHGLGVTGYGKAEYVPYGHIKGKAMVVWLSLGYHGLLHGLFGGTGLRVDRFFEPVR

SEQ ID NO: 11399 - protein, 734 aa, Myxococcus xanthus
MRHLLGIEGWRRDELESLLDRAKAHLPGGPDTTHLLRGKVVANLFFEDSTRTRTSFHMAAKGLGASVLNWTHTGSSVSKGETLLDTARNIEATGPVAIVMRHRSSGAPHLVAKHVKCAVINAGDGTHEHPSQALLDAFTLRQRWGSLDGRTVLIVGDVLHSRVARSNLHCLKALGAQVVMCGPPTLLPPGLESLGAEVTHNLDAALPRADAVMCLRVQLERQEQAFLPSTREYARLFGLNAAREERMKAGAVSDASGPHQPGRGAGAGGGGWRPQRHPRAGVQRRRRAAGHPGGVYGMSSTVLFRRGRVIDPRNGVDGVRDVLVRDGKVVEVSVTLLPVPSSAEVVDATGKWVLPGFIDLHVHLREPGEEGKETVLTGCRAAVAGGFTAVVAMPNTKVVNDNAMVTELVLNRARAAGLCHVYPAGAITKGLKGEELAEMGELVSAGCVAITDDGRPVMNASLMRRTLQYATQFDVPVMVHEEDLTLSAGGAMHEGTTSTRLGLRGIPASAEVAMVARDLVLLEETKGRLHVAHVSCEGSVRLIREAKRSGLRVTCEVAPHHFILDDRAVGDYDTHAKMAPPLRADTDVQALREALVDGTVDAIATDHAPHGVLDKQVEFEKGINGIVGLETALGLTLELVHAGVLTANRAVELLTHGPAKAFGLPGGHLAPGAPAHVTVVDPHAECTVDAHQFHSRSRNTPFHGRKQKGRVIQTWVAGHKVFDKGQVGQSKESR

SEQ ID NO: 11400 - protein, 374 aa, Myxococcus xanthus
MTKRAVLALADGTTFEGRAFGAVGETVGEVVFNTTMYGYQEVLTDPSYVGQIVTMSYPEIGNVGANPEDEEGSRVHAVGMVVRALSEQPSNWRAKESLDAYLKRNGVAGIEGIDTRRLVRHLRTHGAQMGVISSEGLSPLALVERARSARGMEGLDLATGVSTKEAYTFTQPSPDVFTGLGEVRVPAEPRFDVVAYDYGLKKSMLHFLVDVGCRVTVVPANTSAEEVLARKPNGVFLANGPGDPAAVKGADRTVAALLGKVPVFGICLGHQIMALALGGRTYKMKFGHRGGNQPVKDLTTGKVEITAQNHGFAVDDASLKGLAVVTHINLNDGTVEGLAVPDARAFSVQYHPEASPGPHDARYLFDRFAKLMAG

SEQ ID NO: 11401 - protein, 221 aa, Myxococcus xanthus
MTSSLSPLSYQPYLDLLIAFGSAEPRKEDLLQAKAEYFRLTGEVFEDDKLFELRMASFLDFYLYDRVSPLTNKTPATEFYEQRLAGSAPEEANAFRSFTETVHGLFEVRKLGKGEVRLRELYSGKDFDVTERRHVAGLETGDIIEARLIPFGGHLLFSSAFCYHPRMAVKAIKAEVKRRKKKEPDRTPNELVWECARRSLNMERYRQLAVEKIYDFEQKVL

SEQ ID NO: 11402 - protein, 74 aa, Myxococcus xanthus
MAWFTGNIGYHHVHHLNPRIPFYRLPEAMAAIPELQNPRTTTLHPRDVLACLRLNVWDGKRGRMVRFRDVPASR

SEQ ID NO: 11403 - protein, 112 aa, Myxococcus xanthus
MVASGRLHHAWTEDAAPNSIPDVILGRKRRESSEAPETAVTPEPVRPSEGPRVWVRKKGASPVVPTPSGDSAPILQLAQASVIPTAQRSEREQVASIVEQWASEFRANKHRS

SEQ ID NO: 11404 - protein, 710 aa, Myxococcus xanthus
MDRRAATLLAYLGMEGPASKAAVSHLLWPDSPPAAVRNNMRQLLRRLRLSCGGTDLVDGDSQRLGLSPDVTLDLARLKCAAGKPLSPDVLQALLQGTGVGLLTGVSFDDCDELSRWLDGARAAVEGWVRNAREAEVQRRMDARDWPTALALAQAWVQQEPESEQAGRHLIRLHYLRGDRGAALAAFERLRSTLSHDLGVAPMPETLTLVRTIEKDAAWTASPQPTRAPLPMSVMRPPVLAGRQHALRQLQEGLEAGQLLFVAGDAGSGKTRLAEEFAASVGTWFRLEARPGDQEVPYASQTRAVRAHLARRPGIVMPDWVRTELSRIVPELGNGTALPPLASEADELRFYEAHAEAMALLHEGDQVIVVDDVQYWDQASAKLFMYSLARMMERKYEAPARAPAFIDCFRKGELPPYSEANVRKLVDTGLARVIEVGPLALEEVRQLLAGLELPGAEPHAEALTRYTGGNPLYIVETLKHLIETDALHRDWPRRLPPPGRVGPLIQRRLERLTPLARLTAQLAARADLHFRAALAPEALQVSVAELHAALSELESAQILVAERFTHDTGAGKRSHAQRVRLRRPLPARPACTRLRTGWRARHHPGPPLDGSGAGGPRPALPARRRARGRTVAAQGTGRRTLRSRGGAARSRGSRLRGRERSRGRIAMPPVGKRIYAGCLQRGALRRHVRGSRCATTDTATVEMFRTGNSSQ

SEQ ID NO: 11405 - protein, 783 aa, Myxococcus xanthus
APVASQTTPRIPLLPACPRVPRGLPLERGWSASGTRRALGHRRAEPGAGPSTRTTRYMNQRKHTKQLRRQLRWAGLSATVLAAPASFAQDCPKPTSQQCVDADYRAGSCGSVHDAYCQGVVESEWKAGWEAAPKRVALLPEELGGGVDTVAYAPHIPKHTRFQGMDQSIMGQVLKGQILYRKSLENLTKEEQVYLSRIRSWEKDGTQVTSCQEFVDEKYLDFSRFERQAGRYGDDYRAFFNGAFGKDGIAHRVLYSGDQEKLAPIWDGQRAAKNAYFHFTPGRYPKGIDGYVFKSEAAKLANNVEARNWVAPSDEWHQKQAEQFSYIADDVLNHYQVEQESFTALLRQRDAVYAEWAQASKVLRSRDHETVELDKLTAERLYGLDQAIEESLVKAQKDGCLDTQGPTVCDWSPRRYKTMLEAAMAPRREADLQACLFLTGNDFGPESFVRNADKLEVKGLDRKDYTLSSSLLAQYLALYGAHIHGLNTPTNPSTGAVRHGGEASDSGYAGGDTFGGGYNYVAGWEYVQPGSGLRNKALGAWCDSDVRLYGEFNAYANVFGPTRHEMAHVSGEAGTEGNGIRLKLDARVLGTSLYSHDKHYPLRFTFYEGKPVFDSDAAKASTTFVVVFVPVTVQGGLSAEAGVKMNIGGAVTRNCSEDLLGVDLYGTITPFASVKGFASVGIGVPGLQVGVRGELVIARVNVPLYGDIGLYLSSPSHPTNPNTLFLRASSKLDIELRFLDGSIKLFGELLFLKGETTIVSWSGFGNTWNIYNESKSLPLVRVY

SEQ ID NO: 11406 - protein, 199 aa, Myxococcus xanthus
MPRYKQLIFLGLMTSGALAGCASSKSAEQDGAGTARGRQAGEAIRPERGANEEVTQQDANGDGRPDVWTYTVDGRKVRQELDLNWDGRVDLTRYFDANGDKARESLDLDFDGRVDATYFHEKGVNTRRERDTNGDGRPDSFTYYEGGKLVRKERDTRGTGRIDYWEYWEGGQVDRIGEDLDGDGTVDKWTRNPNNAARE

SEQ ID NO: 11407 - protein, 466 aa, Myxococcus xanthus
MRKAKIICTLGPASDTPEVIEGLIRAGMNMARLNFSHGTHEEHRRRVETIRKVAKRLGTPVAILQDIQGPKIRLGRFDGGQLLVKQGQSVTVTTRNVLGQDGVIPTPIKSLVKDVAKGHEILLDDGRVRLRVLRVHGQDVQCRVEVGGVLKNHKGLNLPGSPMSVPTITRKDAVDLAFGQEVGVDYVALSFVRTPEDIKKARAHVAKLKTPLIAKIEKPQAVERVEEIAAVADGIMVARGDLGVEMPLERLPAIQKHMVSAVNRMGGLVIVATEMLESMVANARPTRAEVSDVANAILDGADAVMLSGETAAGKYPVEAASTMACIVEETERGVVKHQHHSPFERSEDLGTGVAAAAVAAATQLGIGTIVAYTESGHTARLISEFRPHARIIALTPSETAVNRMALYWGVTGMQVARVSTTDAMLTQVRQLCRKEKLCAPGTPVVVVAGVPLNVPGNTNLMSIHRI

SEQ ID NO: 11408 - protein, 25 aa, Myxococcus xanthus
MDMEGLPPGHSMPKTPLGTGKEIEL

SEQ ID NO: 11409 - protein, 103 aa, Myxococcus xanthus
MNRRKPSLSSTLVEFCRGAAEAAPVLRALMAEAQFDEDLHRRLIAQLVRPRGDELRACLADRRPADRELVVNVLSGLVWQRLMLNEPLDARFVRFALRVVQRI

SEQ ID NO: 11410 - protein, 340 aa, Myxococcus xanthus
MSSSELPVLKFVLTNYKNFNARATRDALLSYWEHVSNGGRMFWSVAGAMSSAQLGITLAPAIRAGLIHGLSVTGANIEESLFRLVAHTGYKDFPEYRYFTKQDDTRILEQRMRRVTDTSIPEDEAFRAVEKIAVPMWKGATEKGERRFWHEYFYAFIQALDPSVYEGDPEACWLLEAARLRLPIVVPGYEDSTFGNIFASYVKAGDFNASIVKSGIEYMADFYDRYEEMSEGRGVGFFQIGGGIAGDFPICVVPSIKYDLQKPVKPWAYFCQISDSTTSYGSYSGATPNEKITWDKLTETTPMFVIESDATIVAPLILSALLECKSNPEAANALIAKHQG

SEQ ID NO: 11411 - protein, 110 aa, Myxococcus xanthus
MGAQVGILLAAREPRMTHLVTMVPPNIDPSMEEGAPSRHMASVHQDWLLLTANKDDFAPVADSRALFDAASSRRKTHKTFDSGHVLPREYLEEVRRWLHADRRAPGRKDP

SEQ ID NO: 11412 - protein, 301 aa, Myxococcus xanthus
MEFRQLQLFVAVAEELHFGRAAARIGMAQPPFSQQIRRLESELGVELLTRTSRRVALTAAGSRLLEDARALLARRADVIHSVQQAASGETGTLRVGFAASSAFGVLPDIVLRFRTRFPKVKLELDDSETLDVGAALVSGELDIAIIRAPFRHEGLTVERLLQERFVLALPARHPRARQQVVALSSLANEPFVLFPRHSAPGLHDLVTSMCLGAGFSPNILQEASSWPSVVGMVEAGLGLTIAPASSQALCPKGVVFRPLSGAPGHAELVVAFPGTRPAPAAQHFRVLAHEAVSRSGRRASD

SEQ ID NO: 11413 - protein, 155 aa, Myxococcus xanthus
MVRFDPATGEFDAWSTTLDSFINPGTEGDIAAMLLPGAPGKGYLRVMNKAAAQSAWDAAVTAERTFNGQSAAVGAWWSLWEVTLGDAPTATPVVRDDLVPTNGRTIPQNPGELLVLPEFINDNAQTRFRLMSPETGLGDAKTVVEGQVRGLLRIR

SEQ ID NO: 11414 - protein, 477 aa, Myxococcus xanthus
VGDPAGLRGVSLGPIGMPAGSAVRAEPGLSAYFIEQRWIPVMEYSPHFVDGLASFRAQFEIDYMWGRSANALQQNEGGGFNADQVNIQTKNVNVALYPTRKPRELTLLVGTQPVYDNVYDPTRTPLSDITRTGYKMSFLGSDATGISIFSGYKGLAKLSLMPLGTAQADKGTRNDPRLKYIWLITGDYVYPVRPNTNVGLSLWFLNDQTKGDAYAFEGLVKSGPSSTGLNTFTGTARFDIARPTGNVFWAGANFNHNIDFRTGRFGASGFVMYNGGKYVSDDPERSALAELNISGLSANLELMYQWGRGPADMLTLEGMYTTGDDDLSDSRYTGAFTLNQYGLPGAVWFNHKMLILFPFTSTVNNYTGAVTDISNQGYGMRAAIATAAWDMVPNKLNLKLGVGTATSDATPVRWTPEVERGRYIGTEVNAELRYHIRYLMTAGLHAGYLFRGSFYDGSPTIRTNPFSVFTTFTWYAF

SEQ ID NO: 11415 - protein, 141 aa, Myxococcus xanthus
MGHSYGGLLVLHAFFTRPTSFDTFIAGSPSIWWNDRYVLTEKKAFLERFARTPVKTRVLLTVGGLEQKPRQSEGTRGMFAAERRMVDNARALAVELEAMGGGDFAVQYLEFPGDDHYSAWLPMLSRGLLFFSAPSLLPGAD

SEQ ID NO: 11416 - protein, 66 aa, Myxococcus xanthus
  unsure (1)..(66): unsure at all Xaa locations
MTRFLFAWKEDWWESLPEQRPGAVLGLRALSASEDGRVKSWRKRARDGTLPXVLLLFVDILANXVG

SEQ ID NO: 11417 - protein, 133 aa, Myxococcus xanthus
SRHVFLTGVTGFVGKVVLEALLAQGVERVTVLVRESKDRQGRVHSAAERFAKVAQAECFSRLQPGWTERVAVVSGDLEQPACDLSPADADAVRQHVTHVVHCAASVEFDLPLAQATSANIRSALSVLELARTC

SEQ ID NO: 11418 - protein, 545 aa, Myxococcus xanthus
MQWFAGKLASPLGYDNRNEPHYPPEIPAAKKNDKLVAALREFLKEEQLTDDPKQRLRRGHGHTGGEIWAIRYGKLDRVPDLVVFPRGHDEVVRLVEVATQHGACVIPFGGGTNVTEALRIPLSEERLVIAVDMRQMNRILWVDPVNRMACIEAGATGRHLMEELAKFGFTMGHEPDSLEFSTLGGWIATNASGMKKNRYGNIEDLVLDMQVVTPQGIVERPRQAPRESVGVNPRQYMFGSEGNFGIVTTAVVKLFPLPEVQRYGSVIFPDLETGLSFLYALQQSGAVPASVRVMDNTQFHFGQALKPAKHGLAAKVKSEVEKAVVTKLKGFDPYKLAVATLVFEGSREEVAFQEKTVYRIASEHGGMKGGGANGERGYQLTFGIAYIRDLTFEHWAIAESFETSVPWSRAMDLYERVQRRVEKEHAALGLPGKVFFTGRFTQVYQTGVAIYFYLGFYARGVSDPVGAYAALEHAAREEILAAGGSLSHHHGVGKIRRDFLPEVYSEAALALNRKVKAAIDPDNVFGASNCGINGPVALTPDEEAH

SEQ ID NO: 11419 - protein, 86 aa, Myxococcus xanthus
MLGNLIKNALAYTHQGRIVIHIAPEGWSISDTGVGFGQVEPGHSGFGIGLSLVERLARRFNCDVAFSAVEPHGTRVRLTWPSVEPG

SEQ ID NO: 11420 - protein, 224 aa, Myxococcus xanthus
MRVLVVEDNLDLQANIERFLGKDFQLDFAATGPQGLTLSLGQEYDVIVLDLMLPGMSGIELCQRYRQLAPRLVPILMLTARDTLDDKEEGFRAGADDYLVKPFSLRELRLRLEALARRPVPPSGRRLTVGPLTLEPDTGQARRGVRTVHLNKTETLLLRLLMEAAPEPVSPATLAHHLWGDDAPESSALRTHVYALRGALSELGMSDCITTLRNKGYRLDARED

SEQ ID NO: 11421 - protein, 737 aa, Myxococcus xanthus
MLTALTGAPGLALDDAPPPLAPSGTTPDAQVQAKLDLADRFVRRAELLRDSLVPPRWLREGDRLVFWSREGKDGGTWVLAHAKTGELKPLLSGEQLRQQLSTLLGKPITAPRFFDVALAPDERGIVFRLEGKTFGLGLSGGHVTLLSPEDRAALTLSPQHFLAPKGGALAVQRQGGFAVLNAEGATVVERTGEANLDWRIPERPWSPDGRFLVVWRDDLRAVHQVPVVDYSSALEKVTTVPYTKSGTPLPRAELHVVEVATGRVTRVPPVEGETYDWFAGWNPEGTEALCLHLSRDAKRLDLSVVEPASGQRRHVLREERPETFVTGLDFAVGGWAKQVTALPGGRGYLWMSERDGWRHVYAYDRSGKRVRQLTRGAFPVHEVVGVAPTGDALYVLASADSGAPYEHLFYRGSLKGGALKRLSSASGMHRITPSPSGQYYVDTWSSRTQPRLRELVSVEGGKRVRLTTSDASEFESLGDTRPEALLVKAADGVTPLHGVLYKPRDFDASKRYPVLASIYAGPFTTVVPWSFLGTSDSLTASGLAQLGFIVVLLDPRGGPGRSKSFQDANYGRVGQTEIPDYVAGLKQAASTRPWMDLERVGIHGGSWGGYFTLRGMLTAPDFFKAGYAGAPGALEEEAIINEPYLNLPSVNPQGYAAGDNLAIADRLRGHLKLMHGTSDVNATLSVTMRMADALIRAGKRFELLIMPGQPHSPRGAASRYYRDDVGLFFLRTLGGPR

SEQ ID NO: 11422 - protein, 195 aa, Myxococcus xanthus
MAVKSSKVAKKATARPSTSKAARPSKAVAKSAAPKSKKATAKKSAAAPKATAARRKSPAAAAEPVLLSGGNPQIAKGYGDAPIRAYIKAMPGWKRDVGHRLDELIERTVPGVSKAVKWNSPMYGVEGQGWFLSVHCFTKYIKVAFFRGTSLRPIPPGASKSRDTRYLDIREDEPLDEAQFAAWVKQASRLPGERM

SEQ ID NO: 11423 - protein, 43 aa, Myxococcus xanthus
MHTLGAKQAIVYAFADNPASLALYQSAGFTVVDRNLGHTLASP

SEQ ID NO: 11424 - protein, 344 aa, Myxococcus xanthus
MRFRVVSSAVLLAFVALWTSITLAADYFTVSNMVLQMQTESWPSVQGTITRSEVDAVRSNKATTYGLKVAYTYSVDGQQYEGSKARPSMWRSGDRGFAEELVARYPLGATLPVYYRPGQPSEAVLQTGMDGSQLFTLMLLMPFNLVMLWLGTLVVGAWKPEPPLLSTFFREDGSECVTLEGPWTATLVSLVLVGASLACVALAGLTVGLHAPLPVAVGAWGVVIVSGVLVGRWSHTRVKAGYYDLRLHPQERSLSLPPFSGRKHGLDVRWRDVRSLRVEPQAPTQKGGQVSRYHLTLELSTADGGVRQEAIAGFPRQEQAESLARWLRTRLEVGEVASEEQRSA

SEQ ID NO: 11425 - protein, 175 aa, Myxococcus xanthus
MRAVADGLGFVTGDDPRLAEAVARGEHVLLQPGGTREGCRDFRHRYRVDWGERMGYLRLAVRYRLPIVPVGGCGMDDAYVGLNDGYALGRRVGMPARLPLWLGVGATGLWPLSLPFPVKMTQWVGEPLTRHLEPGFDAGNRDAMRAVHQEVADAVQRLLDKARDVDKGSRRKAVQ

SEQ ID NO: 11426 - protein, 334 aa, Myxococcus xanthus
MAVVPQIAYVDMPGSGPDAKAVVFIHGLGSYLKFWRAQLDAFQKQGYRVIAVDLPGYGKSDKPGTFPYTMEAMADAVLELVDGLGLDKPVLAGHSMGGQTSLSFAIRYPESLSGLVLASPAGFEKFSWREKEWFARAMSSEFIKSAPEASIWGSVRQANFMHWRPELEWLIEERVRLAKSPEFDAYAYANVRTVRGLSHNDFVRDNLHRVTVPTVIIYGTDDRLIPSPFLHGGETRGIMEYGASHIPGAKLVALEGCGHTVQLDCAERFNEAAFAFVRDAAAGRIEVPSAPAKEEAPRPESPPAPASEPLTPESLPPPTPGQEGEPTPGVLPQP

SEQ ID NO: 11427 - protein, 286 aa, Myxococcus xanthus
MTGDSLRWHFFDQRGCGASSRPFTHAPPGGTWQTLQTVEARLGLAAQLADLERIRRLLGKERLTLVGHSFGALVAALYAAEWPERVEALVLVAPAPLVTMPAGDGDLFTQVRARLDEAGQRELAAWMKHTFDFPARLKDDEARLAEHFAAFGPLYVQAMRREHPDAKLPGSGAAGGFLSLGLYLSLGRHHDWSDWLRRVRARTLVIHGAQDLQPRSATARVVEALPHARLVELAGSGHFPFEEQPELFAATVRAFLSEELPGPDSSPTSMRRSAPHPSPCARRTCA

SEQ ID NO: 11428 - protein, 144 aa, Myxococcus xanthus
MGQTADPSKTSPLVLTNPKGLFDPAPYGFSHVAQVAPGTRLIYLAGQGGENETGALQPDFRLQVRQAFQNIRTALESVGAGVGDVAKLTMLVVDHTEEKLRIIGPELDAAWNGGMKPTCTLIPVPRLALDGMLFEVEAVAVLRA

SEQ ID NO: 11429 - protein, 321 aa, Myxococcus xanthus
MVGVRFPLPEDGGAVPSNIPGLVTVPPLLESVDSSTVRLLLPDGTQVPATVTPGAHQTQVLVPDAPLVPGTTYRIEAKGVCQFQPTQTESVTFTAGPALPLPTTTGTLTADTPSQGIFNVYGDSSCGDRQVEGNFTTLRFTPSPELVPFLPWVHWTVEVDGEPWSYAKHSGLTSTGEESPEPRRYEYNRQLLFLYTFCDYVGCADSYQRPTIESLPPGRHRATLKATLEHANITLPPVSVDFELSCAARVANAGMSQMSGCSDGGTEMDGGIVDGGIVDEDPLPEPVDTKKGCTQAGGGLTVLGLLSTLWLLGGRNSRRAK

SEQ ID NO: 11430 - protein, 311 aa, Myxococcus xanthus
MPLWHDGRLAVLHGVGLPEPVRSHFDAQDFVESGTPGRKSTPDGWLNRALDEEAGAALRAVALQPTLPRALFGDAGAVAMGRLEEFRLRGGRRGEEATRGFSALYAGAVDEALRTTGQGAFEAMSLLDEDRLAKLPSHAAVAYPKGPLGQRLRDIARLIHGEVGLEVAATESGGWDTHAAQGSATGAFANRCQELGSALSAFAADLGPRLEQVTVVVLTEFGRTVRENGSRGTDHGVGSAMLVLGGGVKGGKVYGRFDSLEPDHLQDGRDVPAWTDIRAPLAEVLLACRPGVELARVFPGFTPPPSLGLFG

SEQ ID NO: 11431 - protein, 305 aa, Myxococcus xanthus
EVEFGGVLATNVVVASATELRARTPAHAAGSGVAAADFWNHGRAAGTRAAFRYCTPLVTGATPNSARPGGGEDIVLRGKFFDAAATVSFGGTPSPHVVFRSSTELVAQTPAHAVGAANVVVTNGDGVAGTLPQGLTFIGAEVTSIQPARGPSVGGTDVTIRGARIAAGATVSIGGTNVVPTIHPPDSLTARTPAHAAGAVDIVVQNGGEAASTLVGAFTYIAAPAITRVEPPRGTTAGGTAVTVTGTDFAEGARVLMGGRPATQVTIVSPTTLTATTPAHAAGTVDIEVQNADGAPTTLVGAFTY

SEQ ID NO: 11432 - protein, 262 aa, Myxococcus xanthus
MGKYQLHPRELDHEAWELESSEKLPPERDRCDTNAAWQAPSGPDTREAITHVVQAGECISTLAYRHGHLPETLWNAEENAALKELRGDKNILNPGDSVVIPAPRRGTEGVDAGNAYLLRGKGFTETLRVRFLDAEGQPRVKLPYVVSLESDVRTEERAGATNSEGFLVEPASASVHTLKVTFGSGSKREAYAFQVARLAPLDTLAGAQARLCHLGYSCGEEDGVMGPWTRRALRDFQRDHDLPVTCELDDATRTRLRAEYLA

SEQ ID NO: 11433 - protein, 110 aa, Myxococcus xanthus
MVTHLRSHFPREVDGLGDGELRIHIEESLTRARGYGLTSTQDTIRFLNLCASFGWHFDQEPSRPWVGEYLHDAEIALPSERLSRVSRRCLRDLKTESNNRKARAALGGAA

SEQ ID NO: 11434 - protein, 75 aa, Myxococcus xanthus
MQVQNNPTDTGPTWQLRYSLNLVDGSGQASAYAEWNVWSRVALFALGVIHHGGPRTEFHSLLSQSILVGARGYVL

SEQ ID NO: 11435 - protein, 247 aa, Myxococcus xanthus
MKHILALILGLLLLHTGTARAAEPDAAEILKASDRSRGGGLPGIRWTVRITPESGVDKEPERLLTLKANATASLAETREPVRFKGSKLLQVDRNMWMSRPGLRKPIPISPRQKLSGQASQGDIASTNYAVDYQGKLLREEDVNGEASYVLELKAINTFCTYDRITYWVSKERQVGVKAEFFSLSGKLLKSATFEYGNQLTHEGKTFPFVSKMTIQDALTPARTTLEYADVQVTELARGTFDVNRLGN

SEQ ID NO: 11436 - protein, 408 aa, Myxococcus xanthus
MNYFSIGFRNILKNHRRSLVTLLSVGFGFASISLFAGYIKYVYSGLAKQAIHGELLGHLTVMKQGLRTEGRLHPAQYMFSKEELDRVMPILRKYPHTRLVTPRMSLSGMVSNGTASTVFVGEGMVPEDVKKLQGDFQRKLSGDLKADNPIGVATAEDLGRILNLKPGDSAALLVSTVTGQANALDVDIVDDFNTGNVGTNDKFLYLPFDLAKSLYDFDGAERLIVLLDDKAFTEQARTELTAQLKQAGFDVELKTWLELSSFYSQVKRLFDMIFAFIFSNVFIVVVMSIVNSMSMTVVERTREIGTLRSMGLRRSGILRLFTTEAFMLVVLGCAGGLLFTLLVRLAVNSAGITYTPPNSSNVVSLMVDLDVPRMARTFVMLSLLGIAAAFFPARTAARKCITDSLGHV

SEQ ID NO: 11437 - protein, 227 aa, Myxococcus xanthus
MEQAAGFPTVFLTAYYALFELAHPRPGANVLVHSAAGGVGGALLQLGRIAGCRMVGVVGGTHKVETARAQGAEVVIDKSREDLWSVAKKAAPRGYDVVLDANGPSTLRDSYKHLASPGKLVIYGFHSMLPRTGGRPNYAKLAWDWLRTPRFDPLTLTNDNTSVLAFNLSYLFEQRAVLEESMAQLLGWLEEGKLVPPPVKSFPLDAVADAHRALESGGTVGKLVLVP

SEQ ID NO: 11438 - protein, 242 aa, Myxococcus xanthus
MANLEGTAASTANEDVLLSLNDIRRDYVLGETRVEALKGVSLRIHRGEFVAIWGPSGSGKSSLMNILGLVDAPTSGEVSLEGTPIAKLTDNALSDLRSRKVGFVFQSFNLIPVLSALENVMVPLQIQGVGAAEVRERASQALKDVGLENQASARPDKMSGGQRQRVAIARALVTSPSIVVADEPTANLDSENSYMVVKLMRELNRSKRVTFIFTTHDPRLMDLVDRKLLLKDGLLQADEAVR

SEQ ID NO: 11439 - protein, 401 aa, Myxococcus xanthus
MRVVITGMGAVSPYGAGVPPLLDALAEGRSAIRPIDDFDVSGCGCKHGARVPRGSLSALTGSNNLRRAPRGTQYTMLATEEALQMAGHGPSTWNPERVGVFLGTYRAMAEVSQDIWHRIITSEPRFVQPLLFQETVTNAVASALSIRWGWRGTNYAISAGNACGFQVLALAAQALRSGRADALIAGTFDLFTTATHFDMDDIGVLSDANVSRPFDTRRDGYIMGEGAAVVVLETLASARARGATPLAEIAGLGVAHDGHAFGIHHPEGRGLASAMSQALRDAEASPEAVDYIAAASNSTQSLDRAEVAALKTVMGAAASTVPLSSVKGLMGEAESASDMFNLLACVGAVRGGGLPVQAGIEQPEFELNLVRQPRPHRPVRTALAHSYSFGGNAGAALVRAL

SEQ ID NO: 11440 - protein, 336 aa, Myxococcus xanthus
MIRVAAAQGLAASGMDLDVEDRSRIGVVLGTNLGGMPARKEGYAALHYPYRRGRAGPKEPWRALVLDSFICAMSDHVASQYQLGGLSLVMSTACSAGLHALGVAMDVIRSGRSEVMFAGGVDPLSEMPQAGFGVLRSLASDKLRPFSKDRDGTLLGESASLWVLESEAHAKRRGANILAELAGYGGSTDAYHMTRPDETGRGPARAMQAALASAGMKPEQIGYIKAHGTGTPANDVIETRAIKHVFGEQTRVPVSSIKAMVGHSLGSSGAMEAAAAVVALNDGFLPPTLHLDTPDPECDLDYVPHHSRPTKLEAVLSNAFGFGGNNAAMVFRRWEG

SEQ ID NO: 11441 - protein, 121 aa, Myxococcus xanthus
MMQQGRGAIINMSSSAGIRGRAGQVPYAATKGALIGLTQALAGELGPHGIRVNCVAPGFVETEMVAGLMNRPGVREGFIQATPIRRLGTVEDVANATLFLASPESAYVVGDVLRVNGGLVL

SEQ ID NO: 11442 - protein, 111 aa, Myxococcus xanthus
MRKRSGRIVNLLDAASGGASRVAAEGITAMTRALANEVARQGISVNTLAVQLLEEETAHLTPAQRERLDGELGPLGRLGSAEEVAEAVLFLGSSAANLTTGQRLSATGGLW

SEQ ID NO: 11443 - protein, 149 aa, Myxococcus xanthus
MTEHPMARIYGGTPHRFPMLLVDTVETLSPGFGRTFKQVSGNEMMFERFGDAPPALPSCLLVDALGQVAIMLLREPDEVTPSVWYLGGIETMTFHTPIPAGSVLRMEANILKRWRTTVRVEVKAWADAVPAASGVMVLSQRGSKSHESP

SEQ ID NO: 11444 - protein, 340 aa, Myxococcus xanthus
MSRRIVISGLGAVCPQATGPTALWERFSQGDAGPPSSLAERIPDAAFAKQSAQLRHMDRLGRIALTATTLAIEDAGPGNPLQTGIAFGSSYGCLPTNAEYLEAILERGGRYGNPVVFQNTVTNAATGYISMVHDLRGPTATLCSGHAAGLEALRFGCQQIEEGQAERMVVVGADTLSPMLLAGIALPEGMRVSEAACALVLEEHTHALTRGAHRHAEVLGTGHRGGSLTNQAHTLARAVRDAMHLARIEPEQLSAVFSCASGRGDFDGWEQRGLHEALGAHAAKVPVSCPKDVLGETFSTAGMLAVVLATRALDKGCALVTALGGEGSALAVVLRGGAHD

SEQ ID NO: 11445 - protein, 403 aa, Myxococcus xanthus
MSPHRVVITGLGVTAANALSADKLAQALLNRRSGIRRAAPFDIEGRTYSAGVVDLPGETPDNGLDRVSKLALHAAEQALRDSGLEAQGNWREVAGVMLGTSRGPALSLEQVIRSGGDEDARRRHFGEVPFSSIARNVADRFGLGGILSTVTMACVSSSLAMGRALDEIRQGRASVMLAGGADALTLLSFSGFSVLRAMTPTVCRPFDHRRNGMVLGEGAGILVLEELNHARQRGARIHAELCGWGTAGDAHHPTSPHPEGRGLQQAMTLALRQAGLTTEQIDFVNLHGTGTPANDPAECQALRGVFGARAAALPVNSLKPYFGHTLGASGALELIGSVLGMARDFLPPTLNCEELDPKCDVDVVRGEGRAQRIDTLMSTKSAFGGANVALVTRRFPETGRAAR

SEQ ID NO: 11446 - protein, 144 aa, Myxococcus xanthus
MFLNVLLQGSGFPRLRSTVTLVQSQQRNILVDSGLCDDAGRLVLALKERGLTPDDVDVVVATHLHYDHCGNHLLFRNAQYVVGAKDFVENAHFIEAYHQDHTPGKAATSELLREHYQTVKEFYVRSIVREVTREHRVLQPRART

SEQ ID NO: 11447 - protein, 132 aa, Myxococcus xanthus
MVDRIDSLEPGVFAEGIKCVTANEPFFQGHFPEHPIMPGVLIVESMAQVAGVMLRTRSRPDLAPVEPATQKPARPGVMANIHRMRFRRPVVPGDQLRVRATHLKSLGTIHHVKVEARVGEELVADGELMLGA

SEQ ID NO: 11448 - protein, 505 aa, Myxococcus xanthus
MPIVHDWLARRAALAPERTALIDADHGERRISFREWNDSASRTAAFLHHALGVGRGDRVAVLAYNCVEFLDLFFACAKLGAVLQPLNWRLSATELGGLLADAEPSVFVFGPEFRTQVEAVRSGASFVRHWLSLAAPGPSERAFSERDTQTDVALPPLELEEDAPWVLCYTGGSTGLPKAAVLTHRSITANAVNTVMGWGLTADDVAILNAPLFHAGGLSVFTAPLAYAGGASVVCRSFHVEGVFDLVRRGVVSLFFGVPTMFIEMQRHPRFDAVDLSRLKLVISGGAPCPAPVFERFFARGVDFKTGYGLTEAGPNNFWLPPEDVRRKPGAVGVPLFHVEARIDGETQPGDVGELLLRGPHLCAGYWRRPGDTARTFADGWLHTGDLATRDAEGCFRIVGRSKDLIISGGENIYPSEVESVLAGHPDVAEVAVIGVADPKWGETPRALVVARPGTSPSAEALLRFCDGRLARYKTPKSIRFVDALPRTSAGKVDRRTLGAAHGAP

SEQ ID NO: 11449 - protein, 103 aa, Myxococcus xanthus
MHLDNTEVKSGLKAMIVDRLRLDIDPASIPDGAPLFGGDSQEGEAGGLGLDSVEALEIVVGIEEKWGVVIADDSVAKEFHSIDTLAALVNRLIAEGGKKAACA

SEQ ID NO: 11450 - protein, 43 aa, Myxococcus xanthus
MELEDATLAFITGGDAEATCPATPTPNELTCLYTNCGRIACCR

SEQ ID NO: 11451 - protein, 325 aa, Myxococcus xanthus
ALRHLTWRLEAAPMQVRGVGILNGWGGILYALTHLGALWGERALFETAESFVDAMAPRVEQDEHLDLGSGCAGALLGLLTLVGRHPSERASRLARVCGEKLLQTATPQSHGMGWLSPATGGQALCGLAHGGAGIALALLQLASATGESRFHTTALEALAYERGRFSPEAGDWPDLRADAGVHGGDGPAFMCGWCNGAPGIGLARISGLPVLDDHQVREEIAAAVRATLAGGLGYNHGLCHGDLGNVLFLLEAARALHDDTLLRRTYQLAGGILQGIESHGYLHGLPDSIETPGLMVGLAGIAHGLLRLAAPERVADLLSVAPPVS

SEQ ID NO: 11452 - protein, 63 aa, Myxococcus xanthus
MLWLTCEGDAKDYVLHPGDTLRMERSGHVVVQALKPSRFCLMQRTPVHTPCTPPARKHEAPVR

SEQ ID NO: 11453 - protein, 43 aa, Myxococcus xanthus
MQAVGDIAGHDVPGAISIYELSMEESLATTIPCPKLRAWVKEG

SEQ ID NO: 11454 - protein, 93 aa, Myxococcus xanthus
MEDCSLDTLADIAGLTSFHFLRMFRAVTGQTPRQLVIATRLGMAASALRGSRARITDVALDAGFGDLSHFTTSFTRAFGLSPRAYRARARQHA

SEQ ID NO: 11455 - protein, 72 aa, Myxococcus xanthus
MDPELLNVELRRWRAYGTPREELERRRERFMTLRPIESDAALFAMLANAGLVAPKPIFVSLQFKVFLARYAP

SEQ ID NO: 11456 - protein, 183 aa, Myxococcus xanthus
MSQNLYDIPLKSIDGAPQSLGQFKGKVLLVVNVASKCGLTPQYEGLEKLYERKRAEGFEVLGFPANNFLGQEPGSESEIKAFCTLTYDVKFPLFSKISVVGADKHPLYHALTGAIPDAVGEGPMRSRLQGYGITANPVPEVQWNFEKFLVGRDGRVAARFAPDVAADDARLLSAIDAELAKQA

SEQ ID NO: 11457 - protein, 502 aa, Myxococcus xanthus
MSTFIPGPPPERGLFCNRTLNLRAIKAVGYDMDYTLIHYHVEAWERRAYEHIRDRLVEQGWPVADLSFDPELSMRGLIIDTEKGNLLKANRFGFVKKALHGTQAMSFEAQRDEYARTIIDLHEQRWVFLNTLFSLSEACIYAQLVDRLDAGQLPGPMGYSDLYEHVRKNLDATHMQGRLKAEIIADPERYVIDDPETPLALLDQRNAGKKLLLITNSEWAYTEPMMHFAFDRHLPEGMTWRQLFDVVIVSARKPEFFTTRSSLFEVVESSGEALLRPHTGPFKPGTPYFGGSAVELERHLGMSGDQILYVGDHMFGDVHVTKNVLRWRTALILRELEDEVRSIASFRATETRLAERMVVKERLEAESCQIRLELQRRRFQYGPRTDTPSETELVARLATLRTELEALDAELGPLARAATELSNPIWGLLTRAGNDKSHLARQVERYADIYTSRVSNFLFATPFVYLRSPRGSLPHDPSLPGGTPVFGASEAGGGMSGTDGGE

SEQ ID NO: 11458 - protein, 74 aa, Myxococcus xanthus
MGPTAQDFGYRTMRGERRPQSWCRGCRGLHLEPTETARTSNTAPRGADGWLFPPESTTSTRPPRRGKGSSTQSR

SEQ ID NO: 11459 - protein, 159 aa, Myxococcus xanthus
MGVTLARKAILGGTAHDAADGGTYNVGVPLTSSVDTFVGIAGANLGLTSCYMSGPSTPTCGSTNGLYPGYLFWGSVTGRSTYLNDLRSTSGYEGAFRYTIYSTADEIIGYDGIVYGEYTSRIPGQTGEKRYTGYPYGHFNSKDLTAEVQYDMVVNHTIP

SEQ ID NO: 11460 - protein, 478 aa, Myxococcus xanthus
MGAVAHKAKLYEQVAERLADAISAGTLQPGDRLPSVRQLSLRERVSISTVLQAYLHLESLGLIETRPQSGHYVRRRERPRLAEPQVSRPASSATAVTVSGLVASVYRSMGDARMVKLGAASPAPELLPVRRLYRELNALSRESRDRSIQYDALPGCPELRQQLARRSMDWGCSLAADDFITTFGASEAIHLCLLAVARPGDTIAIESPAYYGTLQSIEALGLRALEIPCCPRNGMQMEALEAALTRRRIAAVLAVPSFSNPVGSCMPDVRRQRLVNLLDAHDVPLIEDDIYGDLHFGAERPRSCKAFDTRGNVLLCSSFSKTLAPGFRVGYVAPGRFRERVELLKFSTSVTTATVPQYAIARFLQNGGYDRHLRSLRRRLAAQVERMAEAVAEFFPEGTRVTRPSGGALLWVELPRQVDSLALSAKALEAGISIAPGPIFSARMDSYRHCFRLNCGHPWTPRIEAAMSTLGALARSLT

SEQ ID NO: 11461 - protein, 33 aa, Myxococcus xanthus
MTKPERIQPFGFWLHKRVTQLTRIVEGNLREVL

SEQ ID NO: 11462 - protein, 108 aa, Myxococcus xanthus
MSDWKRLQKLNGGDAIWYSEPQLDVKDEVWLYSAGGELRVWSAGTLYKPEPKTLKVSAPVKERFTLFKLLSQLFVDVEVRGEKAVVRRGTLNGAHLISLCDASDVGMA

SEQ ID NO: 11463 - protein, 316 aa, Myxococcus xanthus
MTLWELGCGAHGGRPATALENHGGTCTPELYGAGLFTTGAWDFFMAFSPDQRRVLFGRADDRFQQYTLYETQLTEEGHWSRPVLPRFATEWSNADPHFSPDGRTVYFISNRPELGEQGPRSSYDIWAASLDADGAWEDARRLPAPVNDKHRDEWSPAVAANGNLYFGGERDGTLGGSDLWVSRWVDGAYQPPENLGPGINSSVHELEPWIAPDESYLIFSALRREDGLGGYDLFLSRKVDGAWTPARRLCEGINTPASDYNHSVSPDGKWLYFSSTRPFTGDVGARFDAPRDDSAVQGIGRGTGDMYRIPMSALGL

SEQ ID NO: 11464 - protein, 202 aa, Myxococcus xanthus
MKNLTRALVLSLSLLAVSCGDSKEDDKDGEGGGGGGGGGNALQCSAVGWCTTWSADPNEVTNAPPLTGGTLREGTYRVEQGNGYDAAMVLRGSSVILLGGSWNNYLGTWKVSNGKLELTRASSCDDYSEGPLDNLVTEVHAFAVRGDELFTQDQDDSRGTILRWKRVSDLCEESASFKCRGGLCSCATTTNRPMTGQQSCSG

SEQ ID NO: 11465 - protein, 876 aa, Myxococcus xanthus
MEFLEGGTLRRWLTEQPRPLREVLERFRQAADGLAASHALGIVHRDFKPDNVLLTKGGLVRITDFGLANATLVPGTAAPGTVSPASLTVTGTLLGTLAYGAPEQLRGEHGDARSDQFSFCVALYEALNGQRPFEGKTREALLEQVARKAVRPERAGVPAWLRAVVRRGLSADPAERFSSMEVLRARLSRDPGARWRTVALVMLGAVLTGLAVFGLLSRQAPQALCQGSERHFAGVWDAETREATRRAFLATGALDAEASFSAVAAALERWKLDWTRAHQEACEATRVWGEQPEQVLGLRMACLDERLEEVTRVVAALQGADARTVARGFGLGGSLASLRRCSDARTLLEAVAPPEDPAVLLEVTAVRAELARANAGLFAGHTPEALKVALAARERAVRTRYRPLEAEAHLLCATLQEDASAFEDARASLVQAGLAAEAGRHHAVLARVLYAQAWLSGHDLERTQEAWAYLNRAQAVAEPLRDPEFDALLNYVRAELFEQEGRFSEAEPLLREALDRVTAKGVSHAAARAELNGRLGLLARHQGRLLEAKRWQEEALRLQEDLHGPDHRDTARALVNLGGTLAHAGELARAEAVVQRALANLRRSLGEEHLVVARTLSNLAVIYFEWGRGPEALRAAEQSLAVARKSVPPEGADAVLMGMTSNRTGVLGELGAREAELEQARRSLAHRERVYGATHPEVALDLHEVGRLLRLLGRAKEARGFHARGVALQESLVARGELEGEGLRWLADALLFLGRVEEARGHAERALARLERDWGPVAPERIKALVLMGDIHLARRAPAEAVAPLRTALAALASEQVASARVPLARRRLAQALRQSGASDEACQEARRAWLEWEPWRKAYPGEVAEARAEKDRCPR

SEQ ID NO: 11466 - protein, 120 aa, Myxococcus xanthus
MLAADPAQGGLELGLVREEARSHVRAAFVQAVASLDDEDRELLRLHFVEHLSLARMGELYGVHKSTLSRRLSGVKALLETRTHEGLTERLSLSQEELDSMMRAVHGRLDVSLSGLLAAKE

SEQ ID NO: 11467 - protein, 90 aa, Myxococcus xanthus
MSVVRAYCGHGIGETFHTSLQVPHYYEAEADTVMQPGMIFTVEPMINLGGWGHRTWDDEWTAVTADGTRSAQFEHTLLVTEQGAEILTVA

SEQ ID NO: 11468 - protein, 225 aa, Myxococcus xanthus
ITAQNTQGVTRVDVMAPEAVAAQIDAVASDIGAGAVKTGMLVNPAIITTVAQRLRALGLGPLVVDPVMVSRAGARLIDDAAVGALKELLLPLATVATPNRHEAELLAGMKLETLEDMREAARRIHRLGPKAVLVKGGGMTGALRGTDVWFDGERLETLHLRAVDTRNTHGTGCTLSAAIAAHLALGQPPLEATRRAKDYVTAALEHPLPLGKGPGPFSHFFPLEG

SEQ ID NO: 11469 - protein, 509 aa, Myxococcus xanthus
MTVTSTLKDRIENTELLAKVVPVEEAVKHVVHGNTVAISGFTKSGEPKTFLPALAWHFSQTAPDARITLLSGASLSEDVEGPMAPFIAKRGPYMSSPASRRRIHAGEMDFTDVHLSAFARNLMYGFYGDIDVAVVEVSRIRKNGSVVLTSSVGISAEALARAKKIVLEVNTSGPDYTGFHDIVLPAVHPHVGWPLPLVNVRDRIGNPYVELDLSKVVAVVESRTPDHPVPFKAADDTAKRIAEHVIDFLMRCREQYQWGKRLPPIQSGVGNVANAIISQLYDPPFQKIRFWTEVFQDGMLRYVEDDAKFEYASATAVSFSSEGRQRFLDMFERSKDRLVLRPMWLSNSPEIISRLFVIAMNTPIEVDIYGHVNSTHIDGSRIVNGLGGSGDFFRNAYLSIVHTPSTRKLRDGRTVSCVMPYVRHIDHTEHDIKCVVTEQGYALNMDIRSPKRRAQDIIDRCAHPYFRPLLHAYLDMAGPGDEPRATDMKVLQGWWADYDAATRAFPQNG

SEQ ID NO: 11470 - protein, 118 aa, Myxococcus xanthus
MKRAEALEALGRDEAAERDWTLAIEEALGNPWLLQQRAAARARLGRLDDAAQDLTEALASQTGDEVDPELLHARGVLRERQGDVDGARADFEAGLSAFREGDPPALLDALREGTMRKP

SEQ ID NO: 11471 - protein, 336 aa, Myxococcus xanthus
MKAYELKQTGSADAWVQVERPEPTPGHGQALVRIRAVSLNYRDLYIALGRYPGPRPASLIPVSDGAGEVVAVGPGVSRVTPGDRVAPTFFQTWTDGPASPEKTRNALGGSVNGVLAEYVVVDAEGLVLLPDHLSFEEGATLPCAAVTAWNALVAEGRLQPGQTVLAQGTGGVSIFALQLAKALGARVLITSSQDAKLKHARTLGADGTINYKTHPDWEEQVLALTGGQGVDHVLEVAGEETFPHSVRATKPGGHISLIGMLSGGFAKPDPALVEPKKLDVQRTYVGSRAMFEDMNRLLIQHRLEPVIDRSFPFEQAREALRYMESGAHFGKIVIAV

SEQ ID NO: 11472 - protein, 208 aa, Myxococcus xanthus
MLEKLMPKSDEFFDDFDAQCAVTVEGAKMLYELLSDYRDVGPRVQALKDAEHRGDEVTHTAFNRLHKQFITPFDRGQIHTLLSRIDDVLDLTNAAAARLHYYEIPASLPDATELARLLVLSTQKVQEVVAALRLIKKPEQILAGCKEIKRLETQADEALRSGVGRLFKSGADTLLIIKWKEIYDFIETATDKCQSVANVIEGVVLEHS

SEQ ID NO: 11473 - protein, 341 aa, Myxococcus xanthus
MLLAAVILIVAVALIFDFINGFHDAANSIATVVSTRVLSPNLAVAWAAFFNFVAAFGGNVHVANTMGKGIINFEMLRAQGPSAVLAVIFSALMGAIVWNLLTWWWGLPSSSSHALAGGMIGATLPVLGFAGLVGSGIAKIAAFIVLSPLIGMTLGIGLMVLSTWAVHRQTPLKVDSWFRRLQLVSSAIFSYSHGTNDAQKVMGIIAVVLFGTIWQDRPFHIDWWMIISCHAAIALGTFFGGWRIVRTMGHSLTKLAPIGGFAAETGGGVTIIALAQLGIPVSTTHTITGAIVGVGATRGWRAVKWGVSVRIIWAWVVTIPAAALTAVVFYGLTQVVMRLAS

SEQ ID NO: 11474 - protein, 448 aa, Myxococcus xanthus
MWICGGASGAPIGADLATCSTYNRSTNAWASAPSLPAVRRGGLMAYRPGAGMYLFGGTSNGAARNDLLRFSAGAWTTVTAQGAAGSPPSSGGVKLETDPTTGDLVLLTGTGAVWTFDGTAWQRATSSSAAETVTLSGTISGGVTSGFSGATIWVVAPTGFSATTFYVGLTGGVASYKLTGVPAGVPLSVYAYYESGGLYSHKDVGEVGPLVADTTLDIALEPGPLATTTTTGTLVPPADWPAFINARYARGVRLQSGLPAQPNGPPESTGGTSRTFSATYIPASAPATQAVSLEATVVGASLCETLTTWVYNPPAGAVGAVALPDGIRGVAPGLSECGTGTVPTVAEGAYQLTAPAGTELISVRRGARGMSWDWVHLSQAQAGAQAFDFPQPSTLAPSRPAPSGQGTAWEVTANVFEPGSGFRYEQFESANLRPTSTARSHPRGFVRQ

SEQ ID NO: 11475 - protein, 803 aa, Myxococcus xanthus
MRGVADLAAAARKQTRVMMVASAVSGITNLLLEAARAAQEGQPVESLHGRFEDVHRGIIRELAPELGEARQRSLEEGLSTLASELRGLLQGVGLLRECSPSVLAHLSGLGERAACLILGALMHARGLEPHAVEPRDVILCAGDPLQATPLQEETRARFTPLREAGGPGLMLMPGFFGGDTRGKTMCLGRGGSDYSAALAAAALDAELLEIWTDVDGIFSADPRLVPEAFPLPEVSFEEAMELAYFGAKVLHPKTIAPARERGIPVRVCNSFRPDHPGTRVTDDAAPPEHPVRGLSFLPGIALVNLGGAGLKGVPGTAARVFESMALANISVVLITQGSSECSISFCVQQADAERAVQALEVAFEMERAAGKVDTIEQQRGLAVLSIVGDGMRHRVGVAGTFFSALADVGCSIAAIAQGSSERSISAVIAETDGPRALAHVHGRCFGTTEVVELLLAGVGSVGGELLKQVHQQAPKLRAHGVDLRVCVIANSKRVATASEGIPLEDWKQRLAASSDGAPLDAFRDWARAKRPGRPVFVDCTSSEDIALAYPSLMEAGLHVVTANKKANAGQWSHYRKLRETASRHQRRFLYETNVGAALPVIDTLKNMLRTGDRVLRVEGILSGSLSFILGLTEEGVPLSQAVGTAMEKRFTEPDPRDDLHGTDVARKVLILARELGRQVELEQVTLDSLLPSDFDATGPLDDFLARLPQVDAAFQRRVETLRAEGKVLRYVGSVTEDGCFVGLVPVPLTHPLAAVKGGENALSFTSERYSPTPLVIRGYGAGAAVTAAGVLADVLRLVDGPLP

SEQ ID NO: 11476 - protein, 346 aa, Myxococcus xanthus
MDVTRKPTRDLTCKVLALAFTLALTTACPGDDDDDDGGNGPPGDPVTLSGTVTYDFVPAVYSPSTRRGTLEFNQAQKRPVRNAVVQVRQGTRVLVDGTTNQEGRYTLTYRPSGSGALTVVALAKTTQPEIQIEDNTDNNAIWALGGDITTTVTTKDLHATHGWAGTSYTASRRIAAPFAILDSMYTASRAFMDVRPVNFPLLKVNWSPNNVPQSGSKPQGRIGTSHFSFSENEIYVLGRDGVDTDEFDAHVIVPEWGHYLEAHLSRSYSPGGRHSSGDILDPRLAFGEGYANALASILLREPINDDTMWNGSTLAALGFNAEREPPSTDDPEKGAFSEMSVFRAAL

SEQ ID NO: 11477 - protein, 71 aa, Myxococcus xanthus
MTLSASHASQDVGIEVFGQGRSLAESDISYTGTETVSIPTQADARYVVVVYGFKETTGNYSPFPTLSITSQ

SEQ ID NO: 11478 - protein, 166 aa, Myxococcus xanthus
MNLKAIAALSSLLALTAQVACTSPSKSNPTPSDSSDTTKAGAPVKVDAKLGEDQARVSLRFDAPATDVKVSLSGVDGLEVKSSATPVSGGSFTPDAVSEFDVSFTPGEGQSHLVVTVTGDFRGAHLSRVFSFAVGTPTAAQQKTEGTTVTGDDGQPIKVMPSSDAE

SEQ ID NO: 11479 - protein, 699 aa, Myxococcus xanthus
MTTDLPAPKPSTHGLTGTLFHLWVFLGSFLLFQVELILARLLLPSYGSSAAIWTTCLVFYQAVLLLGYFYSSRVAVAAHQGRYRWAHLGFVLLAVVVFPFRLHLFELHPVAAILLTLTLSLGLPFLALSTTSVVAQGWFTRTEHPSRGDPFFLYGTSNAGALTALLTFPFLVEPALDIQEQLAVWYVGYGAFVVFALLCIQRVRPALAGGSTTSEPAARTEPVPRAPRASRITWLLLSASANALLLAVTNVLTLDASIPLLWILPLSLYLLTLIVCFSKRPPTPTGLNRLALGSLAVAAGAALFSLARAQTSLPSLVLHSAVLWVGCLLMHGNLVWCRPSDPRLLGSFYLHVSLGGLVGTLLLALLVPLTLGSLALPYLDHGITGLLLLGGLAARDMMRRGQGLPVPKLAPYVSSGAALFVVAVLVLSGWMLARGRIEGSRTFYGLYTVKDAEGLRLFQHGSTVHGVENLHPDERGEPLSYYHRGSAVGRVLASERIPRERVAVVGLGIGSLAAYGRTGEHWDFYELDPEVERLARQHFSMLGSSQAELRVLAGDARLRMEEAKDGGYDVIVLDAFSSDFVPTHLLTREALSLYLRKLAPEGLLLFHVSSRLFDLVPVLTRLSTELRVQGLVNRTERLTAEELASGRSPSVWFAMSANSDVVARLTQELPFQPVDTPPELKDRRVWSDSYVNLLHALAH

SEQ ID NO: 11480 - protein, 133 aa, Myxococcus xanthus
MPPGITFPLFVRDYLAWTETSGARVYLIFSAPGSRKPIGIIFRRDALGGEPVTRMCEWCHSYGSAHEVCLLTTAVDNKRRVGVNLCADLRCREKMEDAADRSGRHPLEFLGKLNERMFRFAHEALGIEAQPAA

SEQ ID NO: 11481 - protein, 41 aa, Myxococcus xanthus
ASNAGLGRFVLEPLPGAYRVTTRESVTLIQGEAAPGACRGV

SEQ ID NO: 11482 - protein, 318 aa, Myxococcus xanthus
MDWTDRNCRYFHRQLSRHTLLYTEMVTTGAILHGDRERLLGYDAAEHPVALQLGGSEPAALAESARIGEQWGYDEINLNVGCPSDRVQSGRFGACLMAEPDLVARLVGAMREAVSIPVTVKSRIAIDELEEWPTLEGFIRKVSAAGCTRFIVHARKAWLQGLSPKENRDVPPLRYDLVHRLKVEFPHLDISINGGIKTLDAAAEQLRHVDGVMMGRAPYENPYLLAEADRRFFGATTPVPQRHEVVEAMLPYIEKAMLRGAPLGAITRHMLGLFQGLPGARAWRRHLSENAHKQGAGPEVVVAALAKVRREPEAEVAA

SEQ ID NO: 11483 - protein, 99 aa, Myxococcus xanthus
MRIQFNPGELIPLAEHGTVYPGARIVDAWGSLTATSDVLLSSDWKTATVNAPPSGPRDARWEGEGWVLELAPGWRANKGPRPGDLVLQAPEARSPAPQP

SEQ ID NO: 11484 - protein, 455 aa, Myxococcus xanthus
MKKDSLKARLRRTLRWDLWMTLGPALVIVSIAFAVTFYFVKPAPPKKVVIAAAGDEGGFRYFARKYQEILAKHGVTVEIRPTDGSLTSIKLLEDERSGVDVAFVQSGTSDATKAPHVVSLGSLSYVPLWVFYRGPTIDDLNALQGKRIVVGPEESGTRALSMKLLEANGVGAAPTELLNLGRDEAIEQLKQGKVDAVFIVSPAESPPVQRLARVPDIHLLSFSRGEAYVRRYPYLSRHVLPRGVLDLAADVPGHDVVMLAPTANLVATDALHPALAYLLMRAASEVHGKAGILDRTGEFPAALEAGFPFSSEARRYYESGVPLLHRYLPFWAANLVDRLWVMLVPFIAVLVPLGRVAPALYQWRVRSRIFRWYARLKEIELQLEEGPGREMLEEMLRRLDEAEREVNRIPMPLAYAENLYFFREHVDVVRRRLTRRIAESGEPSSEVLTAREKTA

SEQ ID NO: 11485 - protein, 103 aa, Myxococcus xanthus
MRELGLWGEDDGIGQTFTDILELAAGCRFTDCQHQREPGCAVRAAVSSGALPEARLASYERLRREQAYQVRQRSASAERDHRRHERGRTLMGWEASRSKRRRD

SEQ ID NO: 11486 - protein, 27 aa, Myxococcus xanthus
FEPPQEVMLGFGVMDPFSSFLTFVVCV

SEQ ID NO: 11487 - protein, 177 aa, Myxococcus xanthus
MPVFTAAFVIITFSSIAVPGTNGFIGEFLVLLGTFKSDLGEAAGNPHLTAVFGAFATLGVILGAAYMLWMVQKVFFGGITHRENQHLTDMNLREGLTVLPFIVLVAVMGLQPQPFLDRLAPSTDRFLARARVGTPGAELQEDRLRVEVMSLPSRQVVAAPSAPVPLAAAPAVPSPRQ

SEQ ID NO: 11488 - protein, 400 aa, Myxococcus xanthus
  unsure (1)..(400): unsure at all Xaa locations
MSFFDNHLLNLVVFLPLVFAALVALLPAGESGQIRTVTFIAMVLDLAFGVWAYMAYVPGGPEFQLEYRARWFDLFGTSYHIGVDGLAVSLLLLTVFLGPLVVLASTTYIKFRIKEFHLALLVLQTTMLGALVSLDVLLFYIFFEAMLIPMYLLVGVWGXEDRQMAAVKFFLYTLAGSLLMLVAIIAVYFISSPVGARSFDYASIYNGLLDANRQLSACTAGPAGACDSLTGLAATLHTWGPWLFAAFAIAFAVKVPMWPLHTWLPDAHVQAPVAGSMILAGVTLKMGTFGFWRYAIPFFPVATQQARPFLATLAVIGIVYGALMCLAQRDIKKLIAYSSVSHLGYCMLGILAITAEGATGSAYQMLNHGVSTGALFLLFGYLYERRHSRLMGGLRRASRR

SEQ ID NO: 11489 - protein, 742 aa, Myxococcus xanthus
MTLVEFFRAAPVAPDILAPSLWLIIALPLLGAFICGVFGKMMGRANVQLVACAAVAGSFVLSLLAFWATSHHNPETGRLAAIFPNPFGIERDFVRYALAYDYGTWFSVGDFRVNFGLMVDHLSGILLLIITGVGFLIHLYSTSYMEHDAAYWRFFAYLNLFVAAMLTLVLADNLILLFVGWEGVGMASYLLIGFWYDDPAKAWAGRKAFVTNRIGDFAFLVGTFLLVLLVSAFTQQSNAADYNNAGTTAQHYTAALEKKGPVTFKGLEKMAEGLVDGSADKVDLSTPIEAGPLEGYTFGGVMTVAMLLFLLGAAGKSAQLPLYVWLPDAMAGPTPVSALIHAATMVTAGVYLFSRMSALLVLSPTAMATIAIIGALTSLLAALIAFAQDDIKKVLAYSTVSQLGIMFMGVGMGIFWAAVFHLMTHAFFKACLFLGAGSVMHGNGDETDIKKLGGLRKEMPWTWATFLVATLAITGIIPLSGFFSKDAILHGVHHNHLQGLEWVSSLVYYLGLLIAASTAFYMTRVYLLTFEGPRSKEARVAHAHESAWQMTLPLVVLAVLSVVAARYAFGIDFLNMTAQPVLDNFLSPVFSATKRITDASTLVALDTSRPQLVPDYLKAWAVALAGGGAAAFLYLRYFPSRVGLPDPAFIRAVRPLALNKFYVDELYELIVIRPVKFMSFLLFRVVDALVIDTVAVRGTAWVTARVGSALRYVQSGDAQAYAAVMAIALLGGMAYALIQVMQ

SEQ ID NO: 11490 - protein, 100 aa, Myxococcus xanthus
MVPITYYLLLAAALFCMGMFGVLVRRNALVVFMSVELMLNAANLTFVAFARMRGDNLGHVSAFFVIAVAAAEAAIGLAIVIAVFRSRGSILLEDLRTMKH

SEQ ID NO: 11491 - protein, 127 aa, Myxococcus xanthus
MAGIYVLLWAHTVAVMQVLVYAGAIMVLFLFVIMLLNLGESPTRGKPTVARVAGGAATVGLFAVLAIILLKLPAEPATLSTGAQASFGTIATMGQVIFTQWLFPFEAVSLLLLVAMVGAVVVAKSRI

SEQ ID NO: 11492 - protein, 446 aa, Myxococcus xanthus
MASTAKTIEPIISAAWGKPQSWTLDSYRKRGGYEALKKALQMEPAAIIDEVKKSNLRGRGGAGFPTGLKWSFVPKDSPKPKYLAVNGDESEPGTFKDRYILEDDPHMMLEGIAIASYALGVHTCYVYLRGEFKFPAERTQAAIDEAYKAGIFGKKVLGKDYELNCYLVRGAGAYICGEETALLESLEGKKGWPRLKPPFPAVVGLFGCPTVVNNVETLASVPAIFQQGAEAYAKLGTDKSGGTRLVCLSGTVNRPGVYEVSMFTTLSELIFDDKYGRGMPAGRKVKAVIPGGSSAPVLGADELDVAMEFEALKVKQTMAGSGGVIVMDDTTCMVRSLWRVARFYAEESCGQCTPCREGTPWQTRLLRKIEEGRGEPGDIDMLSNVASSIAPYPPIGLGNTICALGDAAALPTHSFLMRFRDEFEAHIREHRCPFGDKPWGSFGDWS

SEQ ID NO: 11493 - protein, 162 aa, Myxococcus xanthus
MAEPLFTSEEQKKFDAGIAEIISHYPPDRKSAGMLPALRLLQEIKGWLPPEGLRLVAKHLEVTPERAMEVASFYVMYHLKKPGKYVIDVCTNLSCSLWGAEKMLAYLEEKLGLKAGEANEKFTLRETECLASCGTAPCLQINEDHHESLTQAKLDAILAKLS

SEQ ID NO: 11494 - protein, 101 aa, Myxococcus xanthus
MGVYAVRCLANGKVLVGASANVQGMLNRIRFELSTGMDRLPTLLEDWKRYGAEQFTFEVLDVLKPSDEPVVAPEEELKVLEALWLDRLKPYGDAGYNVQGG

SEQ ID NO: 11495 - protein, 249 aa, Myxococcus xanthus
MNPGPEDKRQHPRVPAVLRVDYTDGRQARDVTENLSHEGLFVQTDQSFVMGDEVRLALSFPGLLDPVEVSGTVAWMRPAGPDQPAGVGVRVEREQDRRKLGDILSAAGADSHASHAEHEGYRVLIVEDNPHIIEMYSYVLKKLASGELHGKVPLEVHFAPDGHHALLMLREDRFNLVMTDLYMPVMDGFALVERMREEDALRTIPIIAISAGGKEAQDRAMQLGVDIYLRKPVRFVEVLETVKQLLRIK

SEQ ID NO: 11496 - protein, 516 aa, Myxococcus xanthus
MQKPALNRDTVSGEALFILRNLRENGRLGRSNKLADVKAALEPSVSLEFDNYFFFLRKFHYIAMDREAQLKLTDQGEQVAGGELNERFSLEVGEFFADQLVAAADAPLEGAGGHESLMVPPPPPELLLDEAEVDGAPHVPSGPPAPPPMPPVRSSRSAMPALDLGMPSAAIPMPPPSAEPRREATVIVQGPFTASNTPAPSPTPPAPAAAPMSPPPASTAAAAAPAAPAPKGAELDLRYQKFDPIGTGPLGTVFKGRVTALGLDICLKELKDIFGYFSFLQRGEVLKRLKKELCAQAQVRHPGVVQVVDQNVDAARPYFVLELMQGSLRERLDAGGGNGVPVPFALRAFLQMAYGLRAAHAGGLTHHNIKPENVLFDVYGNAKLADFRLGRVVEVDATKGMPQVFVGTGGMAYMAPELMNRGGKEPGASADVYALGILLYEMLTGQIPGRRSPLPSEVNPEAPSGLDQLFDKATQDKREQRYPDVDAMLEDFYKAFPDKEFLAKGDLVISSDTPKE

SEQ ID NO: 11497 - protein, 399 aa, Myxococcus xanthus
MTPPLSESVLITVTGKDHPGIVSRLTGLLAEAGAELLDVEQVVVQGRLTLCLLVRLPPASGTLETLLSALKTLGVAMPFQVVEAPATPAASAHHVVTAVGRALGARELHALTQVLAGHGANVERITRLSEPHLGSVDIHISLPPGQPPDALKHALLELSMQSGGFDVALQRESLFRRGKRMVVMDMDSTLIRIEVIDELARAHGVGEQVSRITERAMHGEMDYDESLRQRVALLQGLDASVVHQLAANLPLTEGAETLVRVLKRLGYRTAVISGGFSVAAEALKARLGIDFAYSNELEIQDGKLTGRTVGRIVNAQRKAELLESLAQAEGILLDQVVAVGDGANDLLMLERAGLGIAFRAKPKLRAAADTSIAAGGLDSILYLLGLTGRELLEAGSGAG

SEQ ID NO: 11498 - protein, 280 aa, Myxococcus xanthus
MASPSRNRIGDILVKARVIDDLQLRSALATHDQWGGRLSRIIADLGLATDDVITEAICQGLGMQRIQLGNVTRDAGALSRVDVSLAEQKAVFPVSLKDNGKTLVLAMADPTDLVTLDQVAAKSRARVVVMVAGEREIEHAILRHYRGQEPVVSTRFGGNKRPSSSDAPEDEDEFKVVDMSGNTVVKRIADITPPAPAAAPPPRAPERAPAPGAGASAADILDEILAGGAPANEWTDEDLKRLQTVQQNQEKSSKILRALLELLLEKNQLQQRELAARMRL

SEQ ID NO: 11499 - protein, 64 aa, Myxococcus xanthus
MQPFAESAAQLCPYCGEEVEVAVDPIGVASETYIEDCPVCCRPWTVQVSRDEESFAVHLGRDDD

SEQ ID NO: 11500 - protein, 131 aa, Myxococcus xanthus
MRDVDALFRELTQPMWRQAPRERTPAADITESESGLTLHLDMPGLEAKAIQVTVEKDILTVQSERKAEPRAEGVNVRRQERAFGTFARSFALPDTVDASRVEARYEQGVLTLTLPRREESKPRVIEVKVQG

SEQ ID NO: 11501 - protein, 201 aa, Myxococcus xanthus
MQQEGSTAMTDQLYTTHDISRLLQVDPSTVSKWIDRGILMAFRTPGGHRRVRSADLRTFLITHQMPVPEELGSGTVRLLAVDDERPVLDAIKRAFKPFAAQVELQTTTSGVEALLLVSEQKPHGMIIDLNMPDIDGLEVCRRIRARKQMEGVRLITMTSAHTPEVVEQSKQAGALACMAKPLDVQQVLELFRVPLALSAKR

SEQ ID NO: 11502 - protein, 177 aa, Myxococcus xanthus
MSRAARVRLLVFDVDGVLTDGGLYYGQDGELMKRFDVKDGHALVMARLSGLPAAILTARTSGIVEKRGRELGLAAVFQGRRDKSAALKELVTQLDVPLDACAYMGDDHNDLGPLSMVALSACPADAVPEVRREAHFVTQSPGGRGAARELVELCLKASGRWDDAVGLMRGTDRRGTQ

SEQ ID NO: 11503 - protein, 278 aa, Myxococcus xanthus
MSAPNPIELCGFKVGQGQKLFVIAGPDSIESEDMALRHAWMLKEITGRLGVPYAFKCSYDKANRTSGKSFRGPGLKEGLRILKRIRDEVGVPVLTDVHETSHVGPASEVVDIIQIPAFLCRQTDLVEAVARTGKGVNLKKGQFVAPKDIVHSARKAFEAGNPNVLVTERGSTFGYNNLVVDMRGFAQMRDAGLAVCFDATHSVQLPSAGNGETAGERRFVSLLARSAAAAGIDALFTEVHEDPDRALCDGPCSLNPQMFEDVVRNVLSIRRVLGHEPG

SEQ ID NO: 11504 - protein, 546 aa, Myxococcus xanthus
MRSKKTKFIFVTGGVVSSLGKGLASASIGALLENRGLAVTLIKLDPYINVDPGTMSPFQHGEVFVTEDGGETDMDLGHYERFTNARMSRLNNFTSGRIYHAVIMKERRGEYLGKTVQVIPHVTDEIKSSIRQAAQDADVVIVEVGGTVGDIESLPFLEAIRQMRYDVGNENVVYVHLTLLPYIGAAGEVKTKPTQHSVMKLREIGIQPDFLVCRTDREVPRELKDKIAMFCNVDTRSVFTSPDVRSTYELPLELHRQGLDERLAEVLNIWSRAPHLERWENIIRKVYEPARGQVRIAIVGKYVNLTESYKSLNEALLHGGIANDVKVNLHFVDSQEVEEQGAEKLLAGVDAILVPGGFGVRGTEGKIAAVRYAREKKVPFFGICLGLQMAVVEFSRGVLGLSSANSLEFNEHTPHPVVTLMESQVKVQDKGGTMRLGSYACALKPGSLAHQLYGQDTIQERHRHRYEVNNAYRSKLQEAGLVISGSNPELNLVEMIELADHPYFIGCQFHPEFKSKPFAPHPLFSGFIRAALAQRDANAAAGKVTE

SEQ ID NO: 11505 - protein, 275 aa, Myxococcus xanthus
MREGEGSEAREWALILGASSGTGAAIAEAVTRKPGLNVFGVHRGRYAEGAVQLEQRIRDAGGRGVLWQADASSPEAAEAGVAALREVAGPRSVKLFVHSIAGASVGRFLSEGEDRLHARRIRRTFDTMAHSFVFWVQALVNEDMLAPEARLLGLQNPLDETHLGNTGLISASKAALEMYVRYLAMELGPRGHRVNLLKFGTVMTPALKHVYSPGALARLEAAHARMNPAGRMGTVEDVARFVTVLAGEEAGWFNGATIDFTGGMTLRLLDLVLNP

SEQ ID NO: 11506 - protein, 275 aa, Myxococcus xanthus
MLPFALLGVLGCGDGMEVAIPFEARVGSEPFACGRIYTGVGTTGTTYEPMDLRVYLHDVRLVTADGIEVPLKLEQDGRWQTRGTALLDFADKAGLCTNGTQATNLRITGTAPEGTYTGLRFKLGVPETQNHLDVSTAPSPLNDTSLYWGWRSGYLFTRIEGRTKGLPEGHVMHLGSTDCAPPPEGQTNGTAGCTFGNRPEVALDSFDLASGKVVLDLGALFSGSNLDENAEVPNTSVGCMSQQADPDCAPVFSRMGLTHRSQELAPGPQAFIKAE

SEQ ID NO: 11507 - protein, 513 aa, Myxococcus xanthus
MLAVFTVQGIAMALRIYLFTNAGERVVSRLRKDLFRALLSQEVGFFDSRRTGELTSRLSSDTTVLQTTVTANVSMMLRYVVTALGGVGLLLYTSVQLTLVMLAVIPPVAIGGVFYGRRVRVISRQAQDALAASGEVAEEDLSGIRTVRSFAAERHEVERYSVAVERSFTLAKKRALQTSVFMGVASIAGYGSIAAVLWYGGRLVVEGGLSVGELTSFLIYTMLVAFSFSGIAELWADFMRASGAAERVFELLDRKPAIGAGGEQLTDLRGHVQFRGVHFAYPSRPDVPVLQGLDLELRPGEVVAVVGPSGAGKSTLASLLSRFYDPQNGEVLLDGHPLTALEPEWLRRNIGMVAQEPQLFSCSIADNIRYGRPGATDAQVEEAARAANAHAYIERFPEGYGTQVGERGVQLSGGQKQRVAIARAVLKDPRLLILDEATSALDAESEHLVKDALERLMKGRTTLIIAHRLSTVANADRVLVLDGGVVIQSGTHASLMSQEGLYRRLVERQFVAA

SEQ ID NO: 11508 - protein, 240 aa, Myxococcus xanthus
MTHVDTAELYGYGKVEESIVSEAIAGRRGDVFLVSKVMPSNASYAGTLAACERSLKRLRTDHLDCYLLHWPGSHPLEETVRAFEKLVVDGKIRAWGVSNFGVEDLEEALALAGPGRIACNQVLYHLEERAIEHAVLPWCEAHGVAVVGYSPFGNGRFPRPDSRGGKVLGGIARAHGVTPYQVALRFLVRGPSLFAIPKASREAHARDNAAAASLTLTADELAHLDAAFPLGPEPASLPVI

SEQ ID NO: 11509 - protein, 318 aa, Myxococcus xanthus
MGFLKNVFGGGAAKADAESPAPDAAPAAAPATSALPGAGTTVPAAEPAGAPHAAEAREHAPAEAPRAEAAPKPPAPPKPQRAQETRKQQQEDEDMEGVQRLLSRKVERVLEQLGTLATRARSGEEVPTITVTLHLSHGHSMTGEVVDYVPRESVLMALGKEGLRRSESVAYVDLSTVVAVAVGNAEKLLELTQLVRPNPTRQDVVTLLEKLPHALTEQFWPGEASLGGKPLRFEVDWVGLDDEPGRRALESAVNVASHALRALAQEQGREVLRRITTVRFLKGRDTRAAVEGETGTVTVGPGEPTVSAFRKAFAAGIR

SEQ ID NO: 11510 - protein, 222 aa, Myxococcus xanthus
AIIAGRTMIEHVWRRCQEAQAFDEVWVATDDDRIRAAVEGFGGKAVMTSPACATGTDRVAEVALGRPDIDIWVNVQGDEPLVDPATLQRLAGLFQDASVRMGTLVRPLEADEAASPHVVKAVLALNGDALYFSRSLVPHVREPGTPVQRWGHIGLYGYRREVLLSLAKLAPTPLEDAEKLEQLRALEHGIPIRCAKVTSHTVAVDLPGDVEKVEALMRARGG

SEQ ID NO: 11511 - protein, 82 aa, Myxococcus xanthus
FTKCLGLELAPHGIRCNVVSPGSTDTAMQRALWADDSGAQAVIAGSPEAYRLGIPLQRIATPEDIANAVRFLVSDAARHITL

SEQ ID NO: 11512 - protein, 109 aa, Myxococcus xanthus
RPALDCAAESVRIRPDGVATCGDGAVPTGAQALALGRPLDLNSATEEELALLPGVGRALARSLVEAREEQGGFKSWDDVDAVRGVGSAKLQTLRAATALGAPPDAGPVW

SEQ ID NO: 11513 - protein, 157 aa, Myxococcus xanthus
MASLRDTVDTLRKELDVQLAQLSKAPESEPPSAATARLKARALHASVLAAPDSLALAERLRNVESAPYPWSTLARAEYALIAGSPPESLEAVARDLEALRQADSTLLRAYLLGARVALKLKDTAAARSLLDDAVALNPDHQAAARLIAQIDADAASP

SEQ ID NO: 11514 - protein, 393 aa, Myxococcus xanthus
MSEVFFWCAVLLLAHTYFLYPLSLFLLEGAAQVLKNARDGRRAETVNPGSGGQRALPSVSLVVAAYNEASCIQQKLENSLALAYPAERFEVLIGSDGSSDGTDEIVRACSDARVRLSPAPRAGKTTVLNRCIPMAQGDIVVLSDANTMIEPEAIERLVRHFEDPEVGAVCGKLRLYNPTKQDYEESAYWSYESLIKMYEGRRGAVVGANGGLYAIRRSLFTLLPPSTIVDDFVIPLRILDQGYKVVYEEHAVAHEETTEDYGKEFGRRARIAAGNFQSIRMVPGLLLPTAGFPAFAFWSHKLLRWCAPALMGMALVANLFLLDRLFYQFTLFSQVLFYALAYLGKTGVLKRGTAKKAASVAYYFVTMNLAIVVGFWRFLRNSQRAAWDRTARA

SEQ ID NO: 11515 - protein, 563 aa, Myxococcus xanthus
MASFRRALAVLLLATGCIPSPYDRAAKKDTIDGYRAFLREYPTHADTDAAEARLEELEFEEAKRLHTVIAYKRFLEAYPDAAQARTAKTLLEGLRFNGAKETDTVAGWRQFLQEHPDGVQRDEAKRLLAEAEARELATTEDPRKLAEYLRASPDDPRRQDVEARLDAQAFAQAKASGATKLFAYLKEHPAGAHREEARVLLLQLEVEGLLVSGLVDEAEARVKAHPLGPKLTGFPERLAHARAERAALARPEPLAQAAHVGHYLRGAEDLSRALVAPDALDRWQAAEELGQHVSVRVLDPLLESLRAARNPLIRQHALESLRTVLAALPKPVAEYEVASRLDALRERATSAEMYLTVAVLLDLSGQLAQASTEYQRAAESGVPDPVILRRWVQIREERRQHFSAAVAARQLALWSLEVAQEEPVTPEGRVPLASARQLCAAAVNANFAVAAIARARSASTEFPEDLAEFERKAADAKRLADARLADAELLLREQTPGVKTCADRGVRDRLENAVKERTAALDSVATKLPQVGRLLLEVARERDPSPQVRAAASARLTALKPVP

SEQ ID NO: 11516 - protein, 607 aa, Myxococcus xanthus
MASRTDTLQAPAVTPSLRIDYAALLNEEQLRAVEAGEGPVLVIAGAGSGKTRTLTFRVARMLERGVPPAGILLLTFTNKAAREMTRRVEELAGAFVDVRRILGGTFHHAAHVLLRQYAGVLGFSTNFTVLDREDARDLMVTCIAERRLKSDKRFPRPDLVLDLVSLAANLQQPVSHVLMDRRPQMLPLAPEVLAAAARFQQRKAQMHLMDFDDLLVHLKRLLTHHPDVKAQLTERFRCVLVDEYQDTNRLQGDLVDLFAGERKDLTVVGDDCQSIYSFRGADFTNIIGFPERYPGCSVHALTRNYRSTPEILRLANTSIALNTNQFPKVLTAARSPGVKPLIVPARDAGEQAAYVAQRIGELRDQGLSLEAMAVLYRAHNHSLELQLELTRRGIPFRVRSGVRFFEQSHIKDVLAHLRLVNNPGDELAFKRVIRRVPGVGPATAEHLWTALRASPEGTPLAEGLAHADVRAHLPRKAQKGFQAFSDLMGRLTQPEASPSPGRLIEDVLAGGYADFLRAEFSEEEHREDDVRQLAEFAGRFEDVARFLSEIALVSEFPAGQALRQQGPEACLTLSTVHQAKGLEWRAVFVLWLADGRFPLSLATRLPE

SEQ ID NO: 11517 - protein, 329 aa, Myxococcus xanthus
MTEEKVQLGRRLFFDVRLSRNETQSCASCHDPARAFTEPLMTSQGSTGETHRRNSQGLANVAYATSLTWANPSLTTLEAQALVPLFGKEPVELGFGDREEELLGRLRAVPELEAEFQRAFPEAVEPVSVATLTRALASFQRTLISGNSAYDRYVYGNDVEAMTRQQKRGMELFFSERLECDHCHSGFNFQDATVHETTSEPIFPYHNTGLYNVDGQGAYPAKDPGLIELTGRPEDMGRFRAPSLRNVAVTGPYMHDGSLATLSDVLDHYAAGGHARRVRGGEASPLQSGFVRGFTLTAEEKEDVLAFLESLTDTEFLTDPRFSDPSSVP

SEQ ID NO: 11518 - protein, 89 aa, Myxococcus xanthus
MGIKDDLKKQALNVSGKAMEKLMADDRRAMAIANAIGKAQRGKQALDRGQEELMKALNFAPRSEFKALGKQLSGLKRRLRELDEKLGAL

SEQ ID NO: 11519 - protein, 205 aa, Myxococcus xanthus
MNVFTSTGYKPKEIATYDRDVLASRGYMQSPNDWKNIEMTGFVKLNSASDESDNFDMYARGGKHNDDHEGCEGSSYKGALHFNGQARFQKEAWHVSYEQAPYKKVTEPLTGRWVGFKTVMRNTQVNGKEAVHLEMYLNENADKVSWEKVYDFVDAGDWGGDAEHCGGADGAIPLTWGGPIATFRWDSTDDVDFKWLSVREIAPEQ

SEQ ID NO: 11520 - protein, 446 aa, Myxococcus xanthus
MQLPCNHHLAPRVREKLETPGKARYLYVSHEHKDHFDPEFLATLRQRDFTVLVPRFHRSELQDVFARYGCKQVIACEDGHEVPIKGGYVKLFVSEQGTNRDSAVMVRGDGQCFLNINDCKLHDRMGRIVAEEGPIDVFSAQFSGAIWHPTCYEYPAETYAAISLKKRESKFEAVARTLEVIQPRAYIAAAGPAAFLDPAQFHLNFEKVNIFPNATQLFAFLRQRLPQGKTRYLEPMPGDVLDAKSLEFVSQVAERVTPENMKAYLHAYAKRQESVFRERRRNLLVAEVAEIHERLRVELQRKLDLLDLHERVGMPLYVELTELPDRLLRVDFKSRRVHVVADIQEEVRYTLKTSAADVGRVLDRKLTWEDFLLSFRLRLSRNPDVYEPVLHGFLGVEIEDMREFCDGIRSTESQRERTVVEAGGRRFSIQRFCPHQGADLSEGWVE

SEQ ID NO: 11521 - protein, 54 aa, Myxococcus xanthus
MQDVPEAWQFVQLRPSERHQAAVAVNRPRGQPLSVRWQFTVPLAGDTPPRFQAA

SEQ ID NO: 11522 - protein, 152 aa, Myxococcus xanthus
MPVEVLDGDEVRTWLSRGLGFTREDREENVRRIGHVARLLAKHGVGVIAAAISPYASSRAEVRRLAEEAGIPFVEIYVQAPLDVLIARDVKGLYKKALAGELAHFTGVSDPYEAPDAPDVTVHSDVDTVEAGLWRVLETLRKRGLLDAAAAA

SEQ ID NO: 11523 - protein, 276 aa, Myxococcus xanthus
MGILATLATGCATTGAPLEPWLDSYSLRYRSASPPAFPRESLSKQVATANREAPAARPDTVAARPAKASGGKSRATPARATRPTPVASDARAKVVTTARSLVGKTQVALNGRKYPSDCTGLIEGVYAQAGVTFRGTVQPGDNGVTAMYRFARSRGRVYQEERPTPGDLVFFNETYDQNRDGRRNDGLTHVGIVENVSASGTVTVIHRVRRGVVRYRMNLERPHLRRDPKTGEVLNDMLRHPGPNREPVLTGQLFGGYGSVLPKSPKAQKPVPVALR

SEQ ID NO: 11524 - protein, 197 aa, Myxococcus xanthus
MIFAGVAMLARFHWLIYVFGGFLIITGVKLFLQRNKEDNPEEGALMRLARRTIPSTPNFDGHHFFTVENGRKLATPLLMALLLVEASDILFALDSIPAIFAVTTDPFIVFTSNIFAILGLRSMFFMLAGAVEKFSYLKVGLSAVLVFVGTKMAIIDFVKMPPEVSLSVIAGLLGASIVASLIKSRHAPTSDADAPKV

SEQ ID NO: 11525 - protein, 158 aa, Myxococcus xanthus
MRAIVPESTTSDVALRFTLLGPTERQVALASGEQRQQVGLKLFAVDACNVLYAMWRLAPKPGIVVNFKRNPGQHTSRECGNRGYTLLHPEQHVRLEAPSTGEPHTLRAQFDGKVLRVWADDTLAWTGEVPEEALAPDAPVGLRSDNVRLSLQLSTPPP

SEQ ID NO: 11526 - protein, 719 aa, Myxococcus xanthus
MALEPETLPVQESRVEYVCPMHPEVVKDGPGTCPKCGMALEPRTVLAEEPPDPELQSMRLRFRVGLALTAPLLVLAMSDMLPGQPVQRAVSAGVLAWAQLVLATPVVLWVGWPFFQRGWASVRNRHLNMFTLIALGTGAAYLFSVFATLLPRALPQGLRTGHGGSAPLYFEAAAVIVTLVALGQVLELRARHATSGALRALLSLAPPVARRMGEDGHEEDVPLASVQSGDTLRVRPGEKVPVDGVVLQGASAVDESMVTGESLPVEKAPGAQVTGGTVNGTGSLVMRAERVGQDTLLSRIVQRVSEAQRTRAPIQRLADKVAGVFVPVVIAVAVVTAGVWAIWGPEPRLVHAVVNAVAVLIIACPCALGLATPMSVMVGTGRGAQAGVLIRDAAALERLEAVDTLVVDKTGTLTEGKPRLVTVVPAPGFEEARLLRLAASLERGSEHPLAAAIVAGAKARGVTLAPVEDFRSLTGKGVVARVEGASVAWGNAALTEALQVHGGELTSRAEALRAEGETVVLVAVEGKAAGLLGVEDPVKSSTPEALALLREEGLRVVMLTGDSQTTADAVARRLGITEVIAGVLPEAKGDAVRKLQQEGRVVAMAGDGVNDAPALAQADVGIAMGTGTDIAMESAAVTLVKGDLRAIARARRLSQGTLRNIRQNLFFAFIYNAVGVPVAAGVLYPVFGLLLSPIFASAAMSLSSVSVIGNALRLRKLKL

SEQ ID NO: 11527 - protein, 285 aa, Myxococcus xanthus
MYDLVGIYRGRAIHKRAEADCRRQRAMVVLESAIRQGSGLGEQAALEARARVLEEALPHAEALLTSLRNDMKQGLVTLEELNAVQVRLDGLRQLSSNTQIARERLAARPRVQEGQRLESVLNELRAADDQLEAYHGALRSSRAWRVSVRGGYDKLIDVDQDLPLFGQLTLSYNLGHLWLGSANARAREGRRRATLDDVSGVPQRVNELVAELRTVHRTEEGRLREVSTLVSDLEAQLQSMDALQTREIRRFRGYLMMELTRLRAEQAYLRAHVESLQSFLGARSP

SEQ ID NO: 11528 - protein, 366 aa, Myxococcus xanthus
MNQRVANRVNSIAVSAYKFIGSLLLALIMLGLVSFLSVQGFFLVSRSWVTPTVISPTDPQILTLNTQVAAQTSARDHVLSDRRSVENRISDAERTVAAERAFQQRFLVALRGERDARDRVARRLALLRREYSSARAEILQSNRAFAGLARTRTDALYDARMMEQEEKLTINHHLAQLAQSNLALAQSSADLETRLDSLQREIAGLSAVQSGMGKNETPQGMTSDVLLLEREYTHSVLEQARAEATLKSLQTDLAALDEVALRYDTLIASLRASPYLKAIERDLTVAFVPYENIPNAEQGTPLYSCAAKVLWCHEVGVIGRVLEGEVSLKHPIRQYMLRGVMVEVQLTDAPSAREDLLHLGRPPLLL

SEQ ID NO: 11529 - protein, 403 aa, Myxococcus xanthus
MNRYVLGPLLRRLKGRKFDRVDDTYLPRVAIVIPLFNEGEGIYHGVRSLLEQDYPSHLLQIVVVDDCSKDDSYAWALKAAEGNPNVIVMRNPENMGKRKGINRAVKAATDAEIIVSVDSDVIVDKAAVRQLVRRFVSPRIAAVGGRTYVTNRHQNWMTRMIEIKFHFAQEWLKDLERSFRQVMCLSGCLTAYRRHVLLELEPILEARAIAGIPIKYGEDRFLTRQIVKHDYETVYTLDAFCFTAAPSTLAGYFSQQLRWRRSNLVDLLGGLSHAWRLHPVVAVHYVSQLALLLSYPLVIVHNVLTGEFWDILAFHFLVIGLLGVIYRIETRHLPADRRVHGASFLPMALLMPVTYALFTPLALLTLDSGSWETRGSANTAPETSPVDSGGRFPPTHAGEGTTP

SEQ ID NO: 11530 - protein, 87 aa, Myxococcus xanthus
MLRADFGIAFTEDGPQPAKLEVPISVVGSPEDKHVPTANLERWRDETRSEDVRVRLFPGGHFFIKSQRDALLAHISEDLNRWMGRAP

SEQ ID NO: 11531 - protein, 529 aa, Myxococcus xanthus
MLDRPMYLKPNVAIEPLYNQWYAWWYLLSPATAPLFVTNLHQKLMQSFVANPDVHVAALKNPMLMGGPFINHPAAKASRVKELLERTQKEQANMLAYTKAVAELEQLMAPNNGGSLEGLYAKVPDILRGYVELTYDLSNRASARYIEPLLYRSPFHKESSQSVTLMQVDGDWRPYIFSTPRLEEDTPLWLRVPYKHEGLDALFRMRHTPGSPGQVAEMLGVPASAADAFAALFTDVEPRRTERYTGEGVRVRYFGHACVLLETKDVSILTDPVISYEFPTDLPRFTHSDLPERIDYVVLTHGHADHLMMETLIQLRHRVGCIIVPRNNGNSLADPSLRLMLHHNGFKNVVEIDDLQEIPVPGGSITGLPFLGEHSDLAIQAKTAHLVRLGGKSMLMAADSNAIEPRMYQHLRDIVGTIDVLFLGMECEGGPMSWMYGPLLCNPLPRKMDQARRLNGSDSARAIEITNYLSPKEVYVYAMGQEPWLRHVMILVYDDKAPQIVESNKFLEHCRTKGIQAERPYVKMERILA

SEQ ID NO: 11532 - protein, 91 aa, Myxococcus xanthus
MRTGIMVGLLAVGLMTGCGGIEEEAAAGLETEAQAIPCRDITGRDYVITYYAEPAKVTKVGELLCGCSTPETVLNGTKTSYYEKVYGCFAM

SEQ ID NO: 11533 - protein, 495 aa, Myxococcus xanthus
ALERLAARDAGTLPSGTPLRPTDEEVAAHAEEVRQQARVEKARLESFFDFCCFDSSFVELRRRTRHDLEVTGNAYWEVLRDGKGDIARFVYVPSYTVRLLPLDKEAVEVRERVRISAVSFDTVTTRRRLRRYIQVQGNERVYFKSFGDSRVISRLTGRAFQDVAALKAADSSDGPATELIHFAIHSPRSPYGIPRWVGTLLSVLGSRQMEEVNYLYFNNKSVPPLALLVSGGRLSDASVPRIERFIEENIKGKANFHKILILEADGTGTGDGGRAKIELRPLTDAQQQDALFQAYDARNIDKVGSAFRLPPLLRGDGRDFNRSVAEAQLRFAEDQVFQPERDEFDFLLNRKVLADMGVRFWRFRSQTTATRDPERMTEMVERLVRVGVLTPEEGRQLAGDIFHREFRKIGDDWVRRPLTLTLAGIQTGVEDLKPRKDKDSLLSEAKRLVGLREELRAEEERLAQGRLALARRYMDTEHVPVPREEFDTWFSARES

SEQ ID NO: 11534 - protein, 348 aa, Myxococcus xanthus
MHEARAVADALLGDVLRLPVAKALDVGTAAGMDRAVALLAARLRRAVGRADVDAMREAVAVLDVDWRTTTAAQRRRLVAQALEAAGRQTAVIPARIQAPLGDAAEEVVASTRSHARREQGLALAARFNAVDRRVAQHIVRTQGNFVRDEYGRRLDAFGEEVRRLVAEGLEAGLGRSDIAESLERAARGALIERAPFYWEVVASHFIGQGRSFAQVSSYAEAGIRRYRIEAVLDEATTQVCRFLHGRTFAVADALQRFERVESLERPEDVKQELPWVRERLDADTGRALLYVNRGGQETRLAEVLRSAASTRDDVGEFRALASDRQLADAGVGFPPFHGLCRTTTLAVT

SEQ ID NO: 11535 - protein, 35 aa, Myxococcus xanthus
MAKAEATPVVWPRDLNLPTSGELTWGFDPEGLCDG

SEQ ID NO: 11536 - protein, 450 aa, Myxococcus xanthus
MGDTLAKALARARHVLKSLQGEPVEKTIWGSPAGKKRLAKRLVAMLPAHKTYVEPFAGSAAVLFEKAASDVEAINDADTAIADAYRLIQKLTPAGMAKLKKLPWVGDEKTFKSLFDAKPKGDVERLHRFLYLTHFSYGKLRGRSFSPNGMGVEAKTLARIEQFAPRLKRVKVYSGDYEKVVRKYDGKDTVFFLDPPYPGYNVDVGEGDFDEERFYGVLKSLKGRWLMTYGIRGKLPGMLKGSGFLVKRIRTPRTIAAMRGVGGSSVLTQLLVSNYQPAAKALEGGSDFAVDDWQPEESPDTASFLATMPLLKGVEPDDERYVLGIVLEPETVDAQGDVYSAAEIRQAAHRFMAEFGGLGLMHQMRVNGHVKVLESYLAPVDFNLGEVPVRKGTWLLAVRVLSDELWGRVKDGQLTGFSIGGTARRLPEASPTTEPPPSDTPAADSQPEAA

SEQ ID NO: 11537 - protein, 64 aa, Myxococcus xanthus
PSIAQVEYRIGDTSHIMVTSAMTPVSDWDTLVYAVVTFRLPLPRWLVRAALPLLMPVALHCRAL

SEQ ID NO: 11538 - protein, 205 aa, Myxococcus xanthus
MVVEEVSLVDRAANKHRFLLVKRDDMHDAPQDSAQAEDTSKAEDALLAAAQKALEAVTALVEALASTDGIDGVRVVEVAQHLRALADALEDEDEDEEDVEAREKTASSEPPPAQPAPPAPTPGADASGLQESLTKLTDAVRALEGSVKEQHQRLGRVEKQFGLPNSSAPAERPPKPTVEDVGWPLDLNKPLNRESVDKALSFHDV

SEQ ID NO: 11539 - protein, 286 aa, Myxococcus xanthus
MSRLDNSTLLAKADLALADLTAGGGILQPAQAQKFMRLLIKQSVLLQQCTVVPMAAPKQQFSKLKFGSRILRPGQEATAVPAAQRVKPDLSQVELDAKLFKGEVRLSDEVLEDSIERGELRQTLMEMMADAISRDMEEILVNGDTASADPFLATMDGVLKQATSNVVDAAGAPISKDVLGDLLKSLPSEHLRDKSSMGFLLPASTRTWTTAARWRRGPRLSATSSSRATRLSSTRASRCGRFLSGRRTSARRMTARPSSCATPRISTSASGGRFGSSRRATSPRAR

SEQ ID NO: 11540 - protein, 125 aa, Myxococcus xanthus
MDNTYLVRLKAYDARRGHVLRRYTYAGIKFQEERGWYRVEKPVADYLRTVHQLPGDTYSPLAFDVSSEAEAKALDAAEADEARVKRSASDELKLSAARPVGTLTTEDLPKASEEKDSRRGKREKD

SEQ ID NO: 11541 - protein, 205 aa, Myxococcus xanthus
MRAEGVTPAMAGDTRLAVLLDEATRTIDKVTGWYFEPRSATLHLDGRGTPSLWLPVPPIRLYRLALYGADVSFSKEHLVVVGAPVGPGFDGPRLTFRHGRVFPRGEGNVTVGARWGYTEADGTPEGRTPAAVRRACMLLVLRSLSPLADEASLEERTRWRVVEERTREQSYRLDTVRPAVRPLTGEPEVDTLLAPYVKPSLPGAA

SEQ ID NO: 11542 - protein, 174 aa, Myxococcus xanthus
MRGRLIFPFLAELHRLDTAAMAGPGPGPHASGYDADFHEPVLVDADDDGLAEAFRREFPPVRVPCQVEPDAFESLRMTPSGNSPRTSFELVFHFRDLERLGLVDAATGDALIRPSDRLGALYDVAGALVQAVRTPPGLYVTEARPTGFGLHRRRPSRNLLLVTFNDRPQARGLA

SEQ ID NO: 11543 - protein, 97 aa, Myxococcus xanthus
MKALLLTPLLAAALLTRCRAPDGCAPVSTRCAGNVAQICNGDGNWQPLADCDAVSEHSGAAFTCAYVNEEGVAGHTCLPTTVDAGTVDAGTEEGGVL

SEQ ID NO: 11544 - protein, 183 aa, Myxococcus xanthus
MQERLRTKTANKADSLEMQLAAEALQRMGILDRQRFLEKYATTVGRTLYVPFEVGVPKGGWDLWAQVVVCVHEHQHVVQHDEEGPSYELAYLTSSAARARYEAEAYTCNLELHYWRYGTLPAVRPMAEGLKHYGCQPEDVEVAAHTLALTSVSVRHGAVVSEATHVALEWLNSHVPHLRAKKG

SEQ ID NO: 11545 - protein, 175 aa, Myxococcus xanthus
MQAALRQEAHALRKEVVQGLTQQAPGGEPLRPPSPLTLAARQLAGFSGTKALLVSGALRNSISVVVEGDEAFIGVSRTAKGPDGEALVDVAQLQEYGGPPVVIPMTPKMRRFLFALLRQAGLAGQSRNGGGGRGVIVTQTPARPFLRPAFARFRQGASRRFLARVAKELGLGGPG

SEQ ID NO: 11546 - protein, 300 aa, Myxococcus xanthus
MAIPTLTSVTPSSGPTSGGDILRLAGTGFAARVAVSLGGLRAEVLSVRQQSGTSHVDVRTPPHAVALVDVELLNLSADGRPIPGEAALLPGAYRYLRPRVAKEADLTRLVRTLLRELKRQVVANVSASVSVDYDDTVADGLNVIAMASLPSVVLSGPTLRESRRYSTNVLHEDVVQGPSGSELVRRRPTYTVDLAFTLTVASERTAELFNLMAAVATFLNRNRWLSMARDAEDASRGTVRWEMDADGEVRTQLGSRDDVRAFTWGLLVRGFDVDEGLPLDIGKAVAGTHLETDSLSGGTS

SEQ ID NO: 11547 - protein, 280 aa, Myxococcus xanthus
GDTTDWLLDAAHLATEGDLEGALAVATRIADLAKANAAALAPGQATALAERVDGLLAPLRQLLHGVSLTRECSAPTRDRVLSFGELVSATLLAELLTAHRTPATFRDARQLLVTDDRFGAARVDLVRTRERLQAARETWGVEVPVLPGFIAATPDGRTTTLGRNGSDYTAALVAQGLGASEVTVWTDVLGLHTADPELVTDAYPVAHLTHGEGLELAAVGARMLHPRTMIPLIESGISLRIRNTMEPEHPGTLIDAIGSRDGQRPACIATREDLALLGIE

SEQ ID NO: 11548 - protein, 153 aa, Myxococcus xanthus
MAIIGQPRSFHKRFKFLCEADGLGHSGFQKCSELSVEVANVQYFEGGSLIPNKSPGRLTFSDVTLERGATQDHQLFDWFQDVVHTTSGLGLPDSLYKRNLDIVQQDRDGTTLRRWSLSRAWPVKFVAGEWDNESDENVIESVTLTYDSFELAK

SEQ ID NO: 11549 - protein, 257 aa, Myxococcus xanthus
MADIISCPSGLTGRIRGMRVREERVLADRKLAKSGGQVDELLSACWEEMQEAGPYAFADGKVDWGQVLQGDRFYALLQVRVLTYGPEYAFAVPCQSAACRARIDWELDLTQLPVRVLSDASRASFVAGNRFETTLPDAGTRVRFKLLTGEDERRLPQLQRAAPEKLLSSVLAYRILDVDGVDARDKRRFLEDLSLRDADFLVDEFDAVDCGVDTTLEVECAQCFMRQEVELPFDRGFFLPGTQRTARRRERTTSSRE

SEQ ID NO: 11550 - protein, 19 aa, Myxococcus xanthus
MGQQRAQEAKALEKAAKRR

SEQ ID NO: 11551 - protein, 897 aa, Myxococcus xanthus
MLNNLGLGFVFTARDLASGTFQGVERNFMSLDRRVGLGTARIEGAFERLGVAMALFSAGAVTLGASLSLANTAGQFEQAVAGVGAVSGASAEVLGQLRDAAIKASLATQFTPTESVLGLRELTQAGFTAAESMDLLLPVLDLAGGSLGELTPQGAAGLASQAMKAFGISTDKAAISVDQMLQAVNVFALSANELPLALGTAARGAQALNQSLPETLIALGLVKNVVPGVERASTAVAVAMERMADPQVQEHLRGLGVAVTDSKGNFLSFLGILDELAPALERMTAAQRSAFLLKAFGREALGGVNAILTQFTNGIRKDTGEIVRGADALKHLRDEFENAGGTATKFREQMLDTFQGQKTLLAGNLETLAIVLGEPFGQVLKPFVTLVASAVQQVLGVFQSLPGPVKRAFAAFALGAGGLLTLVGAVISAKVGLALLVVGLKVLGLTLGSLLATVLPAVAAVVLLGVAVAGLAYAFRHNLGGLGDFVRRVQEQVTLAFRGLVQLFEDGGFSGAVREELGRAENSGLKDFLINLYLWAHRVHSFFSGLADGFSSGLEAARPTLDAFQATLGRVGEALGFLSERDDAATAAAKFAAFGDAGATVGRALARVFDFVVRGLTAAAEVVEGLAGQWGYMKAGVDVLLGSLAHLGRVLAGALSGLLGTNSALQQGSSGWALMGQAIGFAIGNITTVVGVLVSAVSLAVSVVGGILNAALAAFSGIVDVFWGVVLTLSGILTGDWAEAWTGMKLVVFGVVDAISGVLLELVGAILGVVDAVASLFGTDTGLQQALRSARLGLHRDLSVAFGLEDATGSAATPVTAVSAASPTSPVDWPLESSSMPAVAALQASLPQSEVLSSQPASTPAAPVLVSLQVDGEVLAQATARAERDAASRSFSPMPAY

SEQ ID NO: 11552 - protein, 147 aa, Myxococcus xanthus
MECLFNPTQLVEKLQVNWNRLAVPGLSHQVLQFQGTSNRQLAGVEFYLDAFFATQQADASNIMAFRGFLRALTVPPAGTEGVLATAPPRVLVLWPGLLTVECVVASVEFHYRQLAVDGRVLVYTATVTFEEVLDTRVTSEQLRQEVP

SEQ ID NO: 11553 - protein, 427 aa, Myxococcus xanthus
MTRPLDRSAPGVRLTLLAHEKARGGEPLSLEGRVLGLTFEDSATKADKLSLQLDNFDLSLFDRAELVGGAVLEVSWGYPGLMAPPRRVVVKRLKGFQVLTIEGQALSVLMHREAKTRTWKGKTRAQVVREVAAEYGYEEDSIHVEDTGESFDTIHQAGETDARLLRRLAAREEFEFHVDDRGLTFGPRNQAAAPTQVLWWYADAGRGDILSVNVESELGRRVGQVGVRGRDAMAKATIEVQASSATVERTTLADFLEVVEKRTGTTSLQLRNSTTNVQPTSASTPAQAQRESEARFRRAEAGTVKLSLQVVGNPSLRAKSVVEVRGISSFLSGRYYVTEAKHVLSSSGYTTDLKLSRDGTGRRQQASPEKQGQPQGGQPNTSAPETTGALKEVEAFERDTGTRYIEYRRDGQPIGVEDPEAGMSLPR

SEQ ID NO: 11554 - protein, 192 aa, Myxococcus xanthus
MSSFDDDLLAHDTRLLGMYVGYVTQREDEAQLGRVRVCIPGVLEPESAWAWPLGTSGGGAKDTGFFAVPEVGAEVAVFFNQGDVDAPYYLSAHWGRPGGQSEVPEEAQVSPPDNRVLATPTFRVELDESAGHRKLKLTNRKTGDCLTFDAEENTVTLEATTALTLRAVGAISLEAAQVTIAGRVVRPIAEPI

SEQ ID NO: 11555 - protein, 224 aa, Myxococcus xanthus
MALPICIHIPPLPQAPTLTLPGGATLQHHQLLQAVQPALAPLTPLFDIIGAVLALVEVVKAIPDALGPPPDPTAIAAALPKLAEKVSKLLRLVPQLSVPYTVVGVIDIVLGELGHARGQLLHLQLRLSSVAQARQRAAQLRDAGLLAVAGCAEANVAQEAANVGKALAALSQLMALLNVFLGLVGGPQVPDFSSLEGSPLEEAIAPLDAIVRTLQQVRAAIPIP

SEQ ID NO: 11556 - protein, 147 aa, Myxococcus xanthus
MPSSARCSRCARPSPFREEDVVSRAPQNLLIPFRRDRKRDFAAGAGAELLASKVRQVLLTEGATPHSTGELPWRTSFGAGLSRLRHQRNDTVLAELARVYVRDALARWLPGVQFVQVRVEQHAAVLTLRVRVRDGDATAALDVPIPG

SEQ ID NO: 11557 - protein, 179 aa, Myxococcus xanthus
MGALCTILVAGGLYYGAGMDFRHVLGMGEYTIAQLLADTPGPLSLWWYLLLIVGGKLLTTGFTVQSGGSAGMLIPSMVLGGVSGAATAQMLASVTGTGPADVTVFVVVGIASALVAVVGVPLAAIALVLEVFGSAYGPPAVLACCVTYVLTLRLSVYNEQRREQAVEAEPVASACSTRS

SEQ ID NO: 11558 - protein, 420 aa, Myxococcus xanthus
MLGYRLHGAQAATAEVELRLAQPPAAHVTFPAGTVVRTQEVTEAVRFQLLSSVTIPAGANPPRVVAVVEHSKTHTQLFDARGLADFEAHLDFAPYLDGSARVSTAQGAFTEVDTFLNSRASDAHFLISVDQGDKATVRFGNGVNGLPPAGTVAVVYKTGGGSAGNVDAERLVVVEGSFRDAHGHAVQVAVHNPASASGGADRQTVASAKLLAPESLRALTRTVSREDFEINARRLPGVARALMLTSNEDATIGENAGILYVVPQGGGVPTPALKAQVLRQVTEVYPCTLTFQVSVQEPVYRRVDVSTRLFLRQGASAQDVASRIRQALAAHFRISEPDGTPNPRIDFGFNLKDAQGFPAGEVAWSDVFNVIRDVPGVRKLGDARMDLTLNGLPADVKLTVRELPVLGSVTLQDGDTGGLL

SEQ ID NO: 11559 - protein, 176 aa, Myxococcus xanthus
MALLNPSFEDAGARPGEAAHWTLTAVTRIEVLAGFGVPEEACEDFERWYVWHAALSDVPVALAFFSGQRDGFEAFSRGWDNDGFLFELPPAQLVPHRFEGNVAETWGHGPFLADWADATSVEGLFSDSPREDFEQRWHTNEAYAWRWEDVATRAALFNTTQPSEDFDTGWPVAATQ

SEQ ID NO: 11560 - protein, 189 aa, Myxococcus xanthus
DIATVDRGVTAGIARPLGGGNFLFAFNSLTAAQGAVALFANLPDFAPMAKGGSIRGCLQRGPGGGPTGFSPFLYLCGQGTSVNDSAYLLGLSDDEPHRVVLRKGAVATGLPDADGPGVLLKSSASFTQGTWLHLRLDVIVNANGDVVLKAFHNDLAIHPLGTPPEWQPVPGMADFIDDARGINCDSQPL

SEQ ID NO: 11561 - protein, 898 aa, Myxococcus xanthus
MPSALTASEIREAFLKFFEERGHRRVASSSLVPANDPTLMFTNAGMVQFKDVFTGRETRDYRRATTSQKCVRAGGKHNDLDNVGFTARHHTFFEMLGNFSFGDYFKADAIAYGWEFVTRTLGLSTDRLAVTVFNGEGGTPWDEEAYELWKKQGVPAERLYKLGLKDNFWAMGDTGPCGPCSEIHYHQGDDIPCVEEAEGKKCQGVACDCDRWLEIWNLVFMQFERKEKDGPLIPLPKPSIDTGAGLERIASVVQGKRSNYETDLFQNILATVSELCGKPYSQESGASQRVVADHSRAAAFLISDGVQPSNEGRGYVLRRIMRRAIRHGTQQLGLEDVFFFKVVDRVIELMGDAYPELRESRTFVLEVCRHEETSFRQTLSRGLKLIEEELSELQKAGGKQLSGDVVFLLHGTYGFPWDLTQIIARERGLDVDLVRFEERLKEEADKNKFAGSGDKATGEVYLKLAERLGTTEFLGYEGEGHEGEGSIRAIVKDGAEVTQATQGDTVELVLDRTPFYGESGGQMGDTGRIVGHGGKAVAKVTDAQRPVPGLVVHSVEVSEGTFKVGDMVQAGVDSERRKSIRANHSATHLLHKALKLVLGEHVKQAGSVVAPDYLRFDFAHFSPATSAQLEQVEDLVNGWIRDNAGAETRVMSLEDAKKSGAVAMFGEKYGETVRVVTVHPESTELCGGTHVRRSGDIGLFKIASESGVASGVRRIVALTGIGALQHVREQEHELRKVAELLKSNPKEVSKRVEATQKRVKELERKVEEVAVKAQTASSKDLLEQARDVNGMKVLATQVDAADDNVLRGMADQLRDRIRSGVVAIGGEKDGRAIILVAATKDVVAKGINAGALVREMAKEVGGKGGGKAEMAQAGGPDASKLPAALEKLYELVKGVGTA

SEQ ID NO: 11562 - protein, 216 aa, Myxococcus xanthus
MNHRASASVALLAATLVLGGCKEESVPDYTGTGDDRTLQKLRQEVDRVNQGGRPSQGPEATRGDPNANLAGLAAGINVPTERAWELPAPNDAVHLETLSVKLTGLDASHSVKGSGKVSLTSEDLFFRVQLMTQNVGGASLTLDLDGAKLFGAEGQSYTVARDAQVVGGTRPLRRTWAPDERTDVVLLFELPPEALRDDGLHLLLQGSGGDVRIPLK

SEQ ID NO: 11563 - protein, 49 aa, Myxococcus xanthus
MKRHAVSLATEHLDDATFDALIARSPLAAEPERRPGGVLSGLKKLFGRR

SEQ ID NO: 11564 - protein, 193 aa, Myxococcus xanthus
MAGPAFAIEAQQVGERLRVKERPLVGVDVRLGLGNFTGDLGSNTKVGPLLGINASAYPWQYGGVEVGYEGQRFPIDDSRLRNNGDGEGVWRHNATLLAKAGPLIDEKWRPFVGAGVGLSYLNPSDGADRFYNNDWQTELPLAAGLDYRFGNLVAGARATYRFVGGEGLLRNPITNADEKGSLLNGNVMIGGQF

SEQ ID NO: 11565 - protein, 250 aa, Myxococcus xanthus
MGLLGRAFSLILRDRRLFLLSALCAAVTAAALVGLAWLLWRYAPGALESVWTRPESWYGQAAWTAVLVLSGLVLWVVGANVLPPLLLAPLQDPLSELTEEACGGGPGASFTVAGFVRGLVTGIAHTLARLFFLLAGLAVLLPLHLIPGVGSVLWTVLASLYTMTWMAGEYLAAPMTRHLYPFAEVRRMLRERRALCLGLGAGIYVLLWVPILNAFFLPVAIVAGTLLYGGLREARLLAPPPGESTTAALK

SEQ ID NO: 11566 - protein, 1069 aa, Myxococcus xanthus
MPRFLRRITAVAVLLGAWALVGSNRAPLPLTMGAAEAGQGSWDGSLPTVKGEKAPHDLNSLRVLTKVILYVKENYVDPKRVKPKEMMIASLEYVEKSVPDVLVDGNAETGKLNVNVNGKQREFDIAHVDSLWKMSFALKDVFDFLSKNMRPIEDTRDVEYAAVNGMLSTLDPHSVLLRPELYREMKLSTKGEFGGLGFVIQMREGNLTVVKVIPKTPAHRSGIQKDDRIKKIGEESTVNMDLNEAVSKLRGPVDSRITITVERDGWDKPRIMTLSRAMISIESVQHKMLSNNVGYIRLKNFQGNTTRDLEAALTQLRKQADAKGGFKGLVLDMRGNPGGLLEQAIQVSDTFLSSGTIVATVGLSDKLREEKRARATDGEDSYPIAVLVNAGSASASEIVAGALKNLDRATIIGRQTFGKGSVQVLYDFPDDSALKLTIAKYLTPGDVSIQEVGIVPDIQLVPTRATDERVDVFAPRRSMGEADLDQHFGNPDSSTVAKKREDVLNREKPLESLKYLKVDEKQAQATAKKEEGKAPPKTAANAKKHGDKDPLLDVDVAGMGEDLDDQLDAEAQEEIKEDFEVQFARDFVLRAPATTRKEQLKQGKAFIDQKRAEEESRINAAIAALGVDWSAGPTPKNVQMAVSLTPGPDAKILAGEVMEMALTAENRGTEPLKRVRAWTESDNAFLDRREFLFGALAPGEKKTWKVKVRLPKDLTSRRDDVTVRFFDDHGALPETRVAELNFVELPRPAFAFNWQVIDDCATCNGDGTVQRGETVSVLLDVTNAGTGTALDSFTQIKNGGDANIFIEKGRFKLGELKPGETKTARFQLEVKKGFKGNTFPLKLAIIDEPLEEFVMEKLELPVTDAAIATMEPKKGLIRVGDKVDLYGAPAQGARAVAKLSGTTVLPAEAVTKGYYRVELEKDRFAFVRSQDAKELKTGKATTPKATLVTNHRPPDIRLDVDPAAGGMVANGDKFTLSGVVTDPHGLLDVYVLVNDQKVYFKGVDPKGAEPNTLKFSTEFALKEGNNNVLVVAREDNDFASRRTLVIRRRPAEVAQKMASPAGSPANKPQ

SEQ ID NO: 11567 - protein, 235 aa, Myxococcus xanthus
MPPETTGHSAWAINAELSVVSLPGSVNIPTQNEQPSTVLIPSFHARKGLPFSLELGGRVGWVEKSSQVVATGELKWAANEGFTYLPDFGVRGHVTKLFGARDLGLTVMGLDFGVGKQFPLGGMVTLTPYGGLDLGFVGATSSRIDFNPDRSFDDTTGDDSRAALTDTAAYRKVSFGSNINQRIYGGVRFIGGVLQLGAELSLTRTGSVSYEENGSTVERGLPAVFAFNTTLGLDF

SEQ ID NO: 11568 - protein, 152 aa, Myxococcus xanthus
  unsure (1)..(152): unsure at all Xaa locations
EPEPAPEPTVAKAEPASASSEASPVAGVVGGVVXGVVGGTQGGIVGSTGIGGTGDALTLKQVMRPPTVLKQVRPDYPRLAKQRNIQGVVVVRVIVGTDGRVEQEHTQVMRSVPALDAAAIAAVNQWHFTPALGRSGRLARVMIDIPVNFSLK

SEQ ID NO: 11569 - protein, 75 aa, Myxococcus xanthus
MLGLGLGEIIVLGFILLVVFSAARMGQLGNAVGKFVYSFRKASRGEDLVDAKPLPPGRRSTTDAEFTEPEQPRRR

SEQ ID NO: 11570 - protein, 464 aa, Myxococcus xanthus
MATRDTVYTLVVRLSGTTTGFNASFALVRAVRGMLEKDGVSATFTGQVGQNGIYEFSGMMGARLGLGVTSVSTTPAGGGAVIRLLKPDGTLLVDCSNFYVPGNCDVPVLPMTGTYSLTVNPSGTVTATVGLLLSTSLGDVLTVDGPAHTFSTARVGQDGFYTFSANANSNLTLLITGNNFGSNTLVRILRPDGTQLTSQTTGSATGYTVDFTPPTTGTYGITVDPYQASIGQMTLQLVEEASGSAGTVDGVETTVVLNAGQNGRYTFSGTMGARLGLGVTSVSTTPAGGSAVIKLLKPDGTLLVDCSNFYVPGNCDVPVLPMTGTYSLTVNPSGTVTATVGLLLSTSLGDVLTVDGPAHTFSTARVGQDGFYTFSANANSNLTLLITGNSFGSNTLVRILRPDGAQLTSQTTGSATGYTVNFTPPTTGTYGITVDPYQASIGQLSLGIKTAGAPSAPAQADVRK

SEQ ID NO: 11571 - protein, 296 aa, Myxococcus xanthus
MPWMPKTRYLIMRRTLPERGRLALNMMLMTSTGQVSLDWADQSDCVRKTVVVARLAPLMNALYANSPIVEGKPSGYLSFRNRVWDEVDPTRCGYLPAFFDGSFSYRAYVEWALDAPLLFLRRNNEYLYPKLTFRQLMKEGFEGKPPDLNDWTDHLSTLFPEVRLKTVIEVRGADCVNPAMTGALAALWRGILYDATALEEAERLLPKLTYAEHLAFHDTARREGLGGRLGSQELHRLAAEMLAISRRGLMRLDAQDAPLLDALDAVAASGRSPAVAVLEAWEKNPRPEALLDGFSL

SEQ ID NO: 11572 - protein, 253 aa, Myxococcus xanthus
MHGGGHPRRLEGMLLLAHRGASADAPENTLEAFAEAVRQGADGVELDAMLCGSGEVVVCHDERLERLARLPWEVRLTPWWKLQRADVGSPLGFAPARIPLLEEVLEALPPQFLVNIELKCERADDGGLAEQVARLVRRRGLAGRVVISSFNPLCLFRLAAAAPELRRGLLIDPDKSWALQAYGVSPLVSSHSVHPFHEACTPERVAAWRAAGMSVAAWTVDDPQRAHVLERMGVSYLITNRPGAVRQALHPAA

SEQ ID NO: 11573 - protein, 199 aa, Myxococcus xanthus
MAALEQEAEHIPHVASLRRLAHVQSLDTVADLFAQGPAKLEMDPDAAARADANAFSQSLGHLKQQARLTRDPDTLSRLATVSNPTVLRNVLINPRLTEELVVRIAARRPARPEPLIEIWKSPRWSVRHAIRRALVFNPYLPPETGAKIVPLLNTADLRELVSNAALHPALRAQATRLLAEGNGTGPAAASLIPGRRGHD

SEQ ID NO: 11574 - protein, 560 aa, Myxococcus xanthus
MHELAWRLQCAAERHVEREEQARSQEDLALLLELTADYAETSDVEALLHGVTRRLAEKLDIARATLVMLGRSADEGIIVAASDDPTLKDLRIDLSRYPEIREVMRTGKPVVMQEASTHPLLGDVERRAVAARGIHAIAALPLPIRGQVRGVLLLRAAGRRRTFTPREIDFLTTVAHATAVALRNASVLQSVRGQTEAEKTARLAAEEQAASFKPYQLFFAHVSEGVAILDDKACVLSLNPSGAAMLDVDAPDARGRHLHQVTQPVDENVLMELVTTAARGEARSGADVQVCTRTGRRLTLSMSAAPLRDEEAATILSFRDVTDARRLEDELLQTKDFLERLIDSSVDAIIATDLKGRIILFNKGAEALCGYTAQEALGGGLTVHQLYPPGVAKRVMAMIRAPEHGGKGRLSLIREELVHRSGERVPVNMTASIVYEGGREVFSVGIFTDMRARMQLERKLSDVETRLEESEKSAVIVALAGTAAHELNQPLTSVMGYAELLKRKLKEDDFAWKPVDIIYREAERMAEIVRKIGKITRYETKSYMGAQQILDLDKATSHED

SEQ ID NO: 11575 - protein, 638 aa, Myxococcus xanthus
MKTETRAVRIAGGPAPEFFQALFEALDAPAAMCDPALRLVAVNDAFRRFCADQHVSVEEVARTLSGASVPADGASCDVELLPDLPGVVLTLSRRGDVVAVRARNEPELSRNRLVVAERALLEQARTEGVLLDLGRSVAEAGGEEELVAAVARGVKELFPGRSFCIRITDSRTGGLTSLYAEGRLKEGAHEPLVLMERAVEKTSLDRASLPVDRVAVLGEVPLLFQDSTHGVSAPLVASGQLFGAINMEYPADFVSDVPHDERVLLQLANQVAVAVKNAKLIDELTFVRKYLEDLLEKANALILVANRDKQVVVFNQALSALTGFGKEEVLGRDFFWLIPESEHLRLNQLIAAAIRGEPVNSFETRLLTSSGAEVRVSFATSSKLSQHGEVEGVIAIGQDITVVKELEKRIIHAEKLASIGQLAASVVHEINNPMTAVATYADALLQRSRMTPGANPADQEKLRKILESSHRILRFTRDLVSYARPAQDRPERVQLNAIVDMAVGFCEHVVAQARVTIQREYIELPPLSAVRANLVQVFVNLITNACHAMPPGGSVILATGRDGQDAVVKVRDTGTGIEPKHLQRIFEPFFTTKPEGRGTGLGLSICQGIVENHGGRLTVESTMGEGTTFIVRLPLQQG

SEQ ID NO: 11576 - protein, 245 aa, Myxococcus xanthus
MDLASVTNLTVLANVGGPQRGFFEEIAMRWEAGQWGMYPIAACLIVALAIMVERSIILFGKASINKEAFLRGLKKHIYAGDLDKAINYVAGQKSTPLTNVIKAGLMNVPKGNDEVQAALDEASLRETPKIEARTGYLAMLGNAAMLAGLLGTVSGLIACFEAVANVNPADKAAILAIGISEAMNCTGFGLLTAIPALISFSVLTGRTQSLINDINETSVSVLNLIVANKDKFKNLNVPTAARDEE

SEQ ID NO: 11577 - protein, 158 aa, Myxococcus xanthus
MDTGGGKGGKKSLDTSINLTAFIDLMAVTISFLILTAVWTQIGRLQVSQAGGPSTEEEQQQEEQTKTVQLNLLITPTELRLTADQSAFDPIPLTKDAKGKTDLTKLVARFKELKAQLPDQSAITLQPEDKVRYEDLVRIIDECIGAGLPQVSVSAAMG

SEQ ID NO: 11578 - protein, 194 aa, Myxococcus xanthus
MAIQVPGKRYGKRLQHSKVFGHGGTAKKSGYSDLLITPLVDMFIIIVLFLIANFSATGEVLMMTKDIELPEAVNVKEVEMHPVVMVSGEQISVSGTIIGRVEDFTKDEYLNIPSLEEKLRDMKKQYEDLHSMAQDTANTFKGDINIQAHKDVEYSIIKRVMFSCATAGYNNINFAVITAGDAEAVKAASAKATP

SEQ ID NO: 11579 - protein, 442 aa, Myxococcus xanthus
MRTFRNILFWIHLIVGIATGLVIAIMSFTGVVIAFEKQLIEWAERDVRTVQSPSPGAPRLPVEELVERVRAARTDGQPSGVTVYPEPTSSVLVSIGRGSVTYVNPYTGEVLGNGATGLRGFLQWNVELHRWLAAGGDNRAVGKAITGASNAVFLFLAISGLYLWWPRKWTLRAMRPSLWFRRGLKGKARDWNWHNVIGFWSLPVLIVLTASGMVISYKWASDLVYTVMGHEAPARQGPPGSATMKVPAPGVETPRKPMDVVIAEAQKTSPTWSSATLRLGSGARPGGAPAQGGRGPDAKGERGEKGGAAPAQGGRGPEAKGERGGKGGADGVDAVTVTLREADAWPLFSSKQVSLNPFSGEVAKQETYADYNSGRKLRTWLRFLHTGEALGLMGQLVAAIASLGGVFLVYTGFALSWRRFFSRRRTNTEPREEAAAQSEPVA

SEQ ID NO: 11580 - protein, 219 aa, Myxococcus xanthus
MLLRAVIFDLDGTLVDSLGDIADATNHALAHHGLPTHPESAYLRFVGSGVRELIRRAVPSGQDALIEPVLASYKAYYDDHLFDRTAHYPGIPEMLTALAAQGTKLAVLSNKSDDFVKRLVARLLPQASFAAVYGERPELPRKPDPTAALALASELGVPPAACGFVGDTSIDMDTARAAGMYGVGVAWGFREVDELKAHGARAVAATAAELLAALRDARP

SEQ ID NO: 11581 - protein, 329 aa, Myxococcus xanthus
MALRLARLEVEASRVLGEPRYLGRAQAVLRPWWELATPPLGVRLVRATFHHARRDFPAALEDLDAVVKEDPGNVDAWLLRAEVLGIRGEHAEAAHSCARLTALTSSLTVAVCEARVRSLAGHSRKAHALLSEALRRSERSQESRTRALATLAEAAALAGDAGLAERYFLRAISLDSKDYAARAAYADLLLDAGRAREAAVVVMDHTQDDRLLLRHALAENALRSSRAPEVAHALSRRFEESRLRGDSLLAREEARFALQVEKAPEKALRLAQAVWASQREPWDVRLLIEAALAAGRPEAARPALDFLQASGCEDPGLVFLAERVRSLLP

SEQ ID NO: 11582 - protein, 373 aa, Myxococcus xanthus
MSRVALLSLLLVSLSAQAQKPSDSYLRLTEADGQGVSGRWDVSLQDLDDVLGLDAGGDGAITWGEVLAREADIRSYVLGRLVLGSEGAPCALVSQGGLHIRQHSDGAYAVVDFDARCTGSAARLDVDYTLLFDHDPLHRGIVRVGAREPLIFSVSQHFARVHLRDESPWRTAERMTVEGALHVVTRPDHLLFLFALLLPSVLRRDVDGRWVAVSGFGTALWDVVKVVSAFTVAHALTLVAATLGWASLPPRFVSIAFALGILVAALDNVRPLGWGTRWTVAFVLGLLHGFGFASVLAGMGLSAGSLALALLGFNLGVELGQVAFVAALLPLAFVLRKAPLYRRAVVVGGSVAIALLACLWLAERALGLGVSVT

SEQ ID NO: 11583 - protein, 805 aa, Myxococcus xanthus
MLGLVVVYLLAGALGLQVAIVGNISPAWPPAGVSLAALLVLGVSRWPGVFVGASVISVLGDVPVVASLGVGVGSTLAAVLGVGLLRWLGFDKGLERIRDVVALCAGAGALCLGVSAWAGVASLVLGGRLPSTSLAAGLRVWWVGDLMGVLVVAPPLMLFKRWSWPRRGGEAVVLAGLTTVLGGAIFFVPDLPHSAAHAAAFLLFPMSAWAALRFGPRGAAAATLCIAAASIVGTARGQGPFATDDLTQDLLVLQLFIAANAVTGLLLRRRSTERQRAIGQLQLLGTSVRSVHEGVLIAQVRAGGALRTVFANQALCSLLGYRLEELVGQDPCSLYGAQEPEFRQRTRQSLFAGEPVFAEVKLAHKQGDLVWSEVLLSPVRATGEDITHFVATHRDISATKELQARLVAAERVAAVGTLAAGVGHEINNPLAYLVLNLEAAERGLSQGGMSGMRDAMANMRGALEGAERIRLIVRDLQVFSRQGNQDPGLVDLNALVPPAVRIISHALRHRARLVEEFGPVPRVSGSEARLGQVLLNLLVNAMQAIPEGNPSMNEVRVRTSTDASGRARVDVVDSGAGIPAHVLPRIFEAFYTTKSSGEGTGLGLAICQQIVRAHGGELEVRSEPGRGSVFSVLLPPARVQASTPPRPLPRASLPQPSAARRGRVLVVDDEPRLAQSMRLLLEPFHDVVTTTRGSEALALVDAGHRFDVILCDLQMPETDGAAVYQHLCAHAPDQAARVVFISGGAYTPESRAFIDTVPTRVLEKPVRPDLLMTTVAAALTAVDAMGPEPRVDEASPVAAVGGVRH

SEQ ID NO: 11584 - protein, 218 aa, Myxococcus xanthus
MTAQERIERAASALKVFPLPSAVLFPHTVIPLHIFEPRYRALVRDALAGDRVLALSQLEPGWEGNYGGRPPMLPMMCAGVIVWDEQVEEGRYNILLQGVSRIRMTSELTTEKAYREVLAEVLPDVPYEGPEEEQLRQAVFELAGRVPPSFAENLLPVAARAQGGMLADVVASAVIPEPERRQELLAELDVRKRLEGVLEDVGALIGRLQPLRPTGPLN

SEQ ID NO: 11585 - protein, 630 aa, Myxococcus xanthus
MRLVKLGLASVNTTVGSFTRNTDKALALAGKMAAEGVTLGVFQEQLIAGYPAEDMVQWQGFMDRQWPELERFARETAPLPTVFVVGVGVAHQGLRLNCAAVVAGGRILGLVPKEKLPTYSVFYEARTFGRGQPGMAEVHRGVPLGDYLFHFDFGVVAPEVCEDIWSADGPMRRRTYSGAELVVNLSASPFRLGFVETRRELIATRAADHQCTIAYSNAVGSNDGLIFDGGGFLNQNGRHVMETPRFQEGYTAAVVDLDRTLRLRAEATTWRVDRESWLAQGGQAVPVLDCTQVVHTKRDALTFPVPPHRSFFLPSPDTRRTARDALCEDILDALSLGVGDYFEKTRAFKVLGIALSGGRDSLLTLLIAHRYAKRARPENPGSLIQAFYMPSRYSSDATRDAAETIARELGVAFQVVSIDEAFERERAVAKTMLGGKDVTPITEQNIQARLRAQRMWNWSNSCGGLFLQTGNMSEKSVGYTTIGGDLMGALAVIANVPKTVVMYLLDYLQDTTGYEGIRKVLAKPAGPELAHDQVGEEELMPFPILDACFYLYGSEKLTPAEILQALTAMFPEVPSSRLSGYVEKFVRLFQQSIYKWVQSPLSLHIGNLDLDRERALQLPVVTGTEWMRQG

SEQ ID NO: 11586 - protein, 310 aa, Myxococcus xanthus
KAKILAGAVAALMYGGVAVADDGDCPPPQASTSQSQQGTMVAQAQQEDPGGDDLLQEDDTIILETEPVPGVSGQQSQDSMGMGGSGQEGMDDAALGGSGQQPSNAQGEVYMNVPVRCEPVGQQGMGGSGRESMTPPPAAPQGTHDSEQLVVPPAPPLGTGGSGQPSSEPVYPEPESAYPPPKGGTGGSGIATTPPPSNFQPSAERAEPMKVEKHEDKNKIKGLSVMLGGGVEGYTGALAPQLSPGATAGVRASIKPSKVLGLELGYTGALNNIRRGETGASGPDLVRNGGQAVLTLGITPTAWQPYLLGV

SEQ ID NO: 11587 - protein, 357 aa, Myxococcus xanthus
MPLALAALAVLSACTEARGAAPAAPGPTIQDTRRYEKPSDADLRRTLSPLAYEVTQKGATEPAFRNPLWNHHEEGLYVDVVSGEPLFSSRDKFDSGTGWPSFTRPVDSARIVEKRDSTQGMERVEVRSKAAGSHLGHLFGDGPAPAKTRYCINSAALRFVAVNDLAKEGYGAWLPLFGRPAPAAATKRQDTSPFTETALLAGGCFWGMEDLLRKIPGVVQTEVGYTGGSSAFRNPTYHDVSSDKTGHAEAVRVVFDPTRLTYETLLEQWFFRMHDPTTLNRQGNDVGTQYRSAIFYLSDAQKRVAEEVKARVDASRKWPRPVVTQIVSAGAFTPAEDYHQDYLVKNPGGYTCHYMRD

SEQ ID NO: 11588 - protein, 296 aa, Myxococcus xanthus
MARKRIGELLLEQRAISVAQLEAGLAAHRKSGQRLGATLIAQGAITEATLADALSQALGLPRVDLAATTPEWAAVHMLRARFCEQHDLFPVALESTGGRKQLVVAMSDPLNVTAVEEIEFTTGLKVSPRVAPLSTVRGAILRYYHKVPVASPSASRPAPARPAAKPVKAAPPVTRPTAPPSEEDDDEEVIIGEELPPGEATQRTSLAELIRAREEQSKQKRGQGGAAKPKAPVANAGGVLDDLDYLFGQAREDPDRVEELERKFWALMRIMARKGLLTNEEFTRELDDEDKASGES

SEQ ID NO: 11589 - protein, 73 aa, Myxococcus xanthus
MSRPAIAALLSFLIPGVGQIYNGDLLRGLFWLIITPGFWIGTGGCLGWVCHIVAAVTAHNRAEDKDKYRVTVV

SEQ ID NO: 11590 - protein, 235 aa, Myxococcus xanthus
MSNARNAAQTTRLELGFLLVSSVKGTLASPDVLLSDASRPLQAHASLADGALDRRPDILAARLRVDALEESAKEPLARLLPTLGASATYRLTNEAGLAGRTGDGFLGVNLIWNFFDGGERYAERRERVALARAAELQVQATTRRVDVDIEQARVALENAQAALAQSDLAVRTARQNAEEQGILYRQGLSTALTVADASLRQFEAEVAYAQSRFALGVALLGLRAAVGLDPLGKEP

SEQ ID NO: 11591 - protein, 172 aa, Myxococcus xanthus
MNLGMVDEARALLAWLRSEGHARLGVAGYSMGGYMAALTAAVVPEPLAVAALAAGASPVPVFTQGLLSWSIAFALLDGPRRDAEQARSRLGRIFDLANLARFPPPRQPEAAVLVACRRDGFVPGDETLALHAHWPRSELRWVDAGHVTALFTERAALCAAIRDALSRVEATT

SEQ ID NO: 11592 - protein, 138 aa, Myxococcus xanthus
MPWWVYALLSAGFAALTAVLAKMGVEGIPSTLATAIRTVVILVFAWSISLARGEHHALPAISRKTLLFLVLSGVATGLSWLAYFRALQLGPASRVAPLDKLSLPLTLVVEFLILHEPLTWRMGVGVTLMAVGALLTLK

SEQ ID NO: 11593 - protein, 231 aa, Myxococcus xanthus
MDAFKVLVVDDEQPIARALQRLLKREGFEVQIAFNGNEALERLEGFSPDIVLTDFRMPGMTGSELLQRLKRSHPLALRLIISGYADFKSVVASVNEGEICRFISKPWDDAELVTYLKGLLRHRETMACLYAPFRQAPDGVNAEVGMSAASMVLKVQVADPSFPADQAVALIERFAGLLADDRLKVVGGLLERYGGRLSFMADVGGPQRLRLEVPMPTLETVNALRPGASDA

SEQ ID NO: 11594 - protein, 115 aa, Myxococcus xanthus
MSNRFLDHCRRRRTEVMGAPMLRLVQDLDAEGETAPQERWERVSRDEFQRAIDQLRPPHLRDAYRLHVAGLRYRAIAQQLRSTEGTVGRWLTEARQALRELLGGKDASHEGMAES

SEQ ID NO: 11595 - protein, 903 aa, Myxococcus xanthus
MVVPLALAAGLAALVLVPRTQPTDSAPELWLAEAATRPLEVRLTHPGADGHRPYQVMRSGAGARPQALALRELARLEEAADHRGIASAFLLRGDMAQASAFLDKLPASADLDTDRAALALQQDEPEKALVLLERALKRKPRHAQALWNQALALQRLGLSLRAAESFEQVARLGERGWSDEAAQRAQALRNAAEQERQDWKGMRQDCQRMVDGGAPLSTAQAEALPGMARVCLYNALRAAASPERVESLHPLAVVLDRKEDGTHLEDALRRTARRDFSARVPLASEYARLTRGELKGPALESFLSRLREARQEDLLLGALAYADPRQFPDEYRALALDTKDPWFALLAEERQARTDALADAPQRARERLQAAVKTCTASGKQLYRCMLMQRELGLVMARLHRPVDARARFVGALRAARDSREWGSQRNLLQDLGQVARTQGDLVLARAYVEELLLQTPEGCADSEVALTSLALAHHRALDVAGARELLDRAIQCSQKPSMARLALLADLARTPFRKPEDARLLEQGLGALRDSGAQDAGDLALLRHIEGRFYLEQDAHKGQALLRQALADASRLPAANVSARKARVYSYTSLILDAGRTGELAQGLALFAEEHAMPAPERCVLGVTVDDERTFVVARDAEGRLLGHHDTGRTAPLEGVEGLVPGAVMKALRACPSVDILARPPVQGRAGLLPSDIAWSYRVGGLPDTPPSQAKAQRLIVTDVLAPASLHLPTLRAWNPASDAGEGLTLLRGAEATPPRVLAAMRDATEVQVHAHGIIDPSVADASVLVLSPEATGGRFALTTGDLKGQRLRGRPVVLLAACYAGHTSAYLHENFGLPLAFIESGARAVLAATQEIPDDEAHAFFEPVLARIRDGVPAAVALRDERQAWLRRNASAWVQQVLLFE

SEQ ID NO: 11596 - protein, 178 aa, Myxococcus xanthus
MKKYLLPLACLFLASACRHLGNTPDWPPSEDIPPGTYVLITLQDAHSPQRRSTYVVDPRTGTVVERRDGKRAYAVADPQSLDTESTGEAAQAALAPTSRVTVAMSVNCRDTLTLPDGCVDLAIDPKHETSGDPNPIKDEKQRIAITERYVKQLAVNVLQTARRTGVQVHVPALKRPAK

SEQ ID NO: 11597 - protein, 671 aa, Myxococcus xanthus
MAHSTRYAHPFLPTTRADMQARGWEQCDIIIVTGDAYVDHPAFGPVLIARFLEGRGFKVGLLPQPDWHSAEPFKALGPPRLFFGVAAGNLDSMLNRLTAQKKNRSEDQYSPGGQTNCRPDRATIVYAQRCREAYPDVPIILGGIEASLRRIAHFDYWSEKVRRSILFDAKADLLVFGMGERPIMEVADRMRQGERIQDIRDVRGTAYTINDEEMRALEADPARRAADRKTVVLPSYEQVIEDKHAFAVMSRDFQMETNPGNARPLAQRHGNRAIYMNSPALPLEDGVGTAGAEGKSVAMDELYDLPFNRVPHPMYRERIPAYETVKHSIVLMRGCFGGCTFCSITEHEGRVIQSRSAESVLREVRALRRMGDFRGTITDLGGPTANMYKLKCKSEDIEKRCRKLSCVHPGVCENLQTDHGPLISLMQDVRKEDGVKHVFIASGVRYDLAERSPEYVKELAAHHVGGQLSVAPEHVSPRVLEKMKKPGIESFERFQQMFACASEEAGKEQYDIPYFISGHPGSTLEDMVELALWLKQNGKRPRQVQDFIPTPMAMATAMYFTGLDPLKMEPVYTAQGLREKRLQKALLLYWNPEQWPLAREALKLAGREDLIGRGPHALVPPESPGEAARRQRTERDTGAGASAPRHEAAPRLGPHGTARPRARRPGGPRAR

SEQ ID NO: 11598 - protein, 206 aa, Myxococcus xanthus
MLSLLSALWLATAPVTTSEQPVVRPPPPQCVFSQGRSVCGYQCKTTGTQTACARTPYGICEVLVGGVHCWDPPLVAIQHPPTTSAKPECKESRGQVACGYNCRQFNGEVACNRTPYGVCSTNFNKLTCWDPPDAVIHQYGAETPAPRCLNASEDMACGYDCKATRTEVQCANTPDGVCRLDNQRFTCFDPPSLLHCDHSAPPPPRH

SEQ ID NO: 11599 - protein, 171 aa, Myxococcus xanthus
MARTTQEQTQERHAFLLELFRQQPDISSKEALESFKDKFGGTINMKTFNQLREQAEDEAASAAAAAPAPAPEVEPEPEPEPEPEETEATVDDAASRLKAAAAPEAINGAAGAPAKKAKAKGNGPKNIFVDAPKEHLTFLEGIIQQFQEAGAANIRIDHATDRWMVVVVDSK

SEQ ID NO: 11600 - protein, 340 aa, Myxococcus xanthus
MARVMRTLLIASVLLVATACSRASTTRPDSAVEQPGVQAPLPNEWSSPLHREHPLTGRIWDVKAARFVDADTMRRSLAQARFVVLGERHDQPDHHQLQAWLVQALTEGGRKPALAFEMLDVGQQAAVDASLAQAPRDAEALALAVNWAGSGWPDWALYRPVFAAGLEAGLPIVAANLPRSQVRDLVMRGPEALAPELRQRLSLDTPLPEPVEQAMRLEQDEVHCGHLPKEMLGPMVQAQRARDAHLADRLSNADTGQGGVLITGNGHARTDRGVPAQLAARVPGKDVRSVGLLEVAPALRAPADYAASFGTQSLPFDYVWFTPAMPMEDPCAALLKRPKK

SEQ ID NO: 11601 - protein, 130 aa, Myxococcus xanthus
MVPVTAEVTGEDAERLRPGAFATVAVPVDTRGGSPVIPQTAVRASERGFLAYVVEGNKARERVLELGLRTADGRVEVRDGVKPGELLVVRGGEALRDGANVRVAEGPKPTFTGEPRLEPEAASGGGGARQ

SEQ ID NO: 11602 - protein, 117 aa, Myxococcus xanthus
MLTNFGLSLVPPGAHGYQAPEQRQWGRAVPQSDLHALGRVLHEALTGGMPETQPLPQGVPRHLRRLLKSLLSEAIQDRPDSAISARRLLTQRAPLGPLAVGIAALLAMLMFLLLRAA

SEQ ID NO: 11603 - protein, 235 aa, Myxococcus xanthus
MPHLPPNLEQDTQTMEDPFGHYDARHFGEFLQTYQPEWPPPRRYAPSILGMGVLGHALSRRAGLNYGHALRDLLFKPLGMADTTLRVSEEQEPRLTPGHTARGKPIPQWTFPALPGAGAAYSTAPDLLRFLDANLGRGDAGIVRALQLTHVPRAEANPGKMGLGWSVTQVRGQPVVWRSSVIRGYTSFMGFAAGADAGVVLLANHGWSFFSALRGRIPLQAPGLELLSRLLPTEA

SEQ ID NO: 11604 - protein, 220 aa, Myxococcus xanthus
MAIMGGRSMTLLNELRQRIDSRFPLTAYADPAPRAFQPAALLAFATRVTDAYAADARHLDEGCSGSWRALLAHAFDVYEAVRPCLSIRYSTRTVYSGPEDIAADLERGQLEINTEHCEHPLWTPEENCVFRIVHDVIPHAMYARPFSLEGEVLAFHDHIRRAPAEAKLALFTEIFGYAAIRYSTGVYPETQKCIVFPELLADYEAGFLSPASSPPTQPGA

SEQ ID NO: 11605 - protein, 193 aa, Myxococcus xanthus
AGFDSLFGVYDYFYGIGSDLRSGGATVYVTSVPQFNTTEQRGEALLAQVKDIVARSGKGKVNLIGHSHGGLDVRYVAAVRPDLVASVTTVGSPHKGADLADYLRANLRGGSFTESVLAYFANNLGTVLGLLSGKTNPQDAIGALAALSKSGTAAFNQKYPAGIPSSSCGQGAATGTQGQRYYSWSGTDPLRAL

SEQ ID NO: 11606 - protein, 235 aa, Myxococcus xanthus
RGFEVELAEALARELGVRARFVQNDWSSLVPSLERGSFDVALNGLEVTPSRSGRILFTRPYYVFHLRLLARRDDAAITGLDALKGQRVGTLANSLAWDLLQRSGVEAVPYEGVEEPYIDLEQGRVRAVLMDDIIAQRYGQPRPGLRVVGDVGEGYYAIAVRPGEEDLREALDTALGNIARSGELRAIFQRWGIDNAEQQRMVDWTDAQSREVLAPTQTARMGWGQLVLFLQAAGV

SEQ ID NO: 11607 - protein, 821 aa, Myxococcus xanthus
MLEDTKGGKLRASIEERERELILQRVRGGPAHELAKLQAELRGLRGKVKDPTLKEVEKGDCPLVVVTVHRALRLVSELEGKRHFARLVVDEAGMVTRAATALMGPLAERVTLAGDPKQIGPVSRAAEGAGKGTQKWLRGSGLSHLEDAVKDAARADVLLLRTQHRMHPDIAKVVSHFCYGGALEDGDVVKQRAERPAPVAAFPSVRAGWVVLDGLTRDSKRLTHGRGETGSGYQRELSANLAVSLAREAVRSGLSVLCVTPYRAQAALLRRLGNAAGLRGDVFSASTIHRQQGTQYDVVLVDTVAGGRPFPPHTLVPMLNVAASRAKDYLLVLASRDEARAATIPQRFLSLLPRLRVHPGEPLRLEPLPMPQRAPPPPPPPVPVDLGAEISGARPGKPLFTHEQVSLFERRFDDGHHLVRGVAGSGKTYVLAHWVARYLLEHSEAQVLVSFFNRALAPLVDKLLVEALAQRAGRLRVRELRARVTVRHVGALRRHAPESFDGVFVDEAQDMDAKALAMLHALVRPDTLPDGREVRCFQLFMDDSQNVYGQVPIDALKEQLPEGLSFRGRTRVLKETFRATRDILDVAFNVVLDPMRQHAAAEPGMREYMKVGELAREGLVWLPEETLEGLFRVQSTERGGVLPQVRGFASSASEARQVAREVARLIREEGVHPSDILVVAPVMPSQYTEALQRAGVPAEAYGGKGGRNVTDFRVSGVDHVRATTVFSCKGHECPIVFFAGLDALDTAEQWMAGARERSTRENERIRRAMFYVGATRAMKRQYLTGVKGARFLRVAATYVETLSGLVPAAPSPEGASGADAR

SEQ ID NO: 11608 - protein, 330 aa, Myxococcus xanthus
MAIKPAVAFDGKQFLVVWSDQRGGVLTPDIFGNRVTKDGIRLDGAGGVPLVVREGAQTVPDVTWTGNHFFVVWQDDKNDTADIYGARFRKNLALDGPAAFGIATGADEQTAPRVAPSGNKSLVVWDATRQGIHRVRGVRVGDNGSILGSKSGFTISTGDFQQEIAPAVAAGDHKFLVTYAGTTTGTDEFGPHEILATRVTHDDVVKDRPALRLTRPWGHKPPVAAARGTDGYLAVWSENLSGTPGMLAARVSLDGQLLDVPVVLPAGATSRAPVVVWDGTAWFVAWEEGAADATGFQGARVSGAGPALEVSRLSRSALLPLEMLAPSAER

SEQ ID NO: 11609 - protein, 306 aa, Myxococcus xanthus
MAQQKVQVPREAAGERLDRFLSKQVPGINLERARALIDSGAVRIRGKRCQPTRKLWGGEEIELERPEPRAASVAASEGPVLPVLHDDSALVIVNKPPGIVVEPEGRAASVVGLLAAQRPPFDVEGLAQPGVVHRLDRETSGCLAFARTDTAAAALLRSFQEKRVDKRYWTLVLGQPPAQGRLEGPYARDPADPRRFTTRVPSARRAALSFEVRERFADAALLEVDLDTGRTHQVRVQLSEAGFPVLADSLYGPPEARAHAAARALGRQALHAFTLELPSPATGQPVRVEAPLPEDFQRALTVLRGG

SEQ ID NO: 11610 - protein, 66 aa, Myxococcus xanthus
MTHVTVLERELPWAWRSLDVARQARGWIVLLNDEERLITCYRRGDANRFIRRKPKHRMSGVQLQGL

SEQ ID NO: 11611 - protein, 99 aa, Myxococcus xanthus
MKLGQSPEAIQGIEKSGYPGSVLLAIGITELICMVLYAVPRTAVLGAILVTGYLGGATSTHVRLSEPFIAPILVGVFAWAGLFLRDARLRALLPLRRAP

SEQ ID NO: 11612 - protein, 281 aa, Myxococcus xanthus
RTCLLLPLLFISGCALEPGESFAVLEPAVRADYTPVAGRDEGNGFQRLASDFELRLDGAALGVDHIDLVGGGGTRGPTTFDPANPPPGYTNCHNGHCHHDDGALVDYEDIQAELDGGGGGAEATVASLHVDADLDLLADQTLSPDCEPSCELGRTHVSRYQWDVSSVMLEGAVRDSRATPRFNDERRFRLALAAAEEATPLMVLRGTVDIPADRENKPRVKLALRLALTPTLFDSLDWAATTPGPDGVVDLNAPENAAIRTAMVEALATLEPQAEVRREDR

SEQ ID NO: 11613 - protein, 402 aa, Myxococcus xanthus
MLDMGFAEDLEAILSGTPEDRQTALFSATLPPRIASIAERHLHEPVRVKIAREKVEQGEIPRVRQTAYVVPRAFKIATLGRLLDVESPTAAIIFCRTRTEVDDLTVSLNGRGWRAHALHGGMTQEQRDRVIKQLKSQGTDLLVATDVAARGLDIPRLSHVVNFDVPNAPEAYVHRIGRTGRAGREGVAITLVEPREHRLLRNIERVTGQRIEVATVPTVADMREKRQEMLRASLRETLVTGEYDSLRNVVESLASEFDAMDIAAAAVKLLHEAQDEGRDTEETEIPVVAPPQERRERTGKFGAPTGRPGRPERGPKARGGPPTWDVTRLWIGAGRHAGVRPADLVGAIAGEAGVESSKIGAIQIGDAFSLVEVPESDANRIIAALKNATLRGKKVLVRKDRS

SEQ ID NO: 11614 - protein, 412 aa, Myxococcus xanthus
MATGKVLRRAVKAAAAGMIHYSGMRRAMAAYRRSQSGGRRILIVSYHRVVSDFTGELQRSIPGLLISQETFRRHLEEAHAAGFELASIGDAVDVMNGRRVAKKDLCVVTFDDGYRDVYRYAYPVLKEMGVPAITYLPTAFISTDKRFNHDRLFHLLRRVQERRFRPFYDSLPAPALQLLGPILSGQKTVSASLDDFIGEHPTRVLTEIIDALEQQLGGGADLVPEQGDVMNWDEVRRMARDGFEFGAHTLGHTVLTLEPQEVVEREILESKRAIEREVGITVRDFAYCNGWYSDEVIRVLSANGFRSGVTTEDMPNRIGGDPFTLKRKVLWENFSLGMLGDYSSALTGCQLDDCFGVLGMSSPVPGKRPHFISAPTVGNQLSSAPVRVGPKPATSNEIVVGPESATTIQEAP

SEQ ID NO: 11615 - protein, 338 aa, Myxococcus xanthus
MVVPPLLGASLYGMMMAVAAFAGLRYLATWVVSLRGATGPWVDGQRFREQLTYAAPFGAAMLLAIPQQNAHLYAVAGAVAPALYALYRVGCFQLPVVDLLYTPTSEVLMVRLGELEREGRLEEGVEAFREAAGKLAYFFLPFAAFLFSAAPEFIGAMFGEKFLPAVPVFRISVLGVVLSILPMDGTLRARGQTRAIFASYAVKAAVTVPLVWLGVKHFGLMGGIGSWAVAEVVGKAMLLARVPAALSTPERKLGVADVIPWQSLGKATLAACAAAAAVFVLRAGAHGAWAHLPTGFLWRVLPLAVAGALFFIGYLVVLHFTGVRPLSLIAGLRARRAG

SEQ ID NO: 11616 - protein, 167 aa, Myxococcus xanthus
MTFYRLARRLKKRGVPLLPAVLRKAIYYLHSSYIPEDAEIGEGTQLGYGGIGVVIHKAARIGRNCLISQQVTIGGRSGMEGAPVIGDYVRMGAGAKILGNIHIGDFAVIGANAVVVKDVAPGTVVAGVPARVIRQDPDPLGTYQREMGELPPRVSLVSVPSSSRLRQ

SEQ ID NO: 11617 - protein, 320 aa, Myxococcus xanthus
MVGSLPGPKSPRVITLHSGLLPDYLAASDTRRSFVRVALAGYARVVAVSDAVKSALVGCGVPAEKIDVLPAFCASQVRPGPVPSAAEAARSRRRVLLSMAHHPSPVYGRALMFRALRELAQTWPDVGLALFGPGLESEAFIRDVREARVAGHLEVLGELEHSAALGLIARSDAFVRPTTHDGDSISVREALTLGVPCVASDVCVRPQPARVFAAGNARELARVIREAVAAGLMHVPQVDAGPELLSLYGELSSSNGLKSSHEQGSGLGHTETSVSVMSWTSRAGHCADVTWWCSPPTGMGTRCRRSTSCGFSPGRTASCG

SEQ ID NO: 11618 - protein, 120 aa, Myxococcus xanthus
MLGRKRYADLPGYSKAFDVALMPFKVSELTLNANPLKVREYLASGLPVVSTDLPEVRKVGLCKIAKDTEDFVRKVDECLADKPGPNRERAERIFGESWDARVDEIRHHVGAALMADGKAL

SEQ ID NO: 11619 - protein, 164 aa, Myxococcus xanthus
MACTPDAIDFTGKTCEDAQDCPPPYVCVAARPGEGRTCEVLGLPGVPDGGDAGPVPTWCEDIQPIMAASCVSSCHGADTSDSGVKSFRLDYYAPEDGGIPGAHAMAARIQARAYVFKDMPPPWRPVPMPTAQERERIARWAREGAPLCADAGSEEVPGGVDGGL

SEQ ID NO: 11620 - protein, 188 aa, Myxococcus xanthus
MSLVVTGCSKRDNVESQRQDVAEAQVEAQQKTAEVRQDAREDIARTQIEAQEDIAGTQREAAEEVASAQQDVQDERQDLAEAEADRRTDLNGDMALGGSGAAGATAAASSVSGRVLSTGNDELTVVDTSNNKQLELKTNDQTRILHNNQPLKLDDIEEGAQVRASYVRDGEDMVVRELTVTQPVLKKK

SEQ ID NO: 11621 - protein, 300 aa, Myxococcus xanthus
MRLSHPAIVQVFLVRVHEGLPHLVMEHVDGKSLETLISYAALRRRPFSEAFAAYVGVEVADALHHAHTLEDARGRPLGIVHRDVSPRSLRLDARGHVKLSDFAMAWAKLPGRIVTETHVVRGDLAYASPEALERKPLDGRADLFSLGVVLLEVLTGLHLLDLEDVERAALAAGPLPDAEVLLAEVPSWLPAPLMAARMACLAPAHVERATQGLSPAMRAILGRLLRREPSERFQSGQELADALRAVLAGQGYAYGPTEAMREATQVRRDARCRRQMADVLRWEDSVRPEAPPRTTSGSEP

SEQ ID NO: 11622 - protein, 224 aa, Myxococcus xanthus
MLEDNLAQGRLSAVLGVEGGHAIEGQVARLSELHQRGVRFMGLTHLSNNDLGGSSFPMMGNRGLTPLGRDVMEEMARLGMSVDVAHASESTLKDLFTHPSVRFFCSHTGVRAAGGGWRNLSDESLRFIADRGGVVGIIFAPVYLGGDTVDDVVRHIEHAVDVMGEGGVGLGSDYDGMVPLPRGMKDVTGLPLLTEALLRRHPPSWVERVMGGNFRRFFQETLGG

SEQ ID NO: 11623 - protein, 125 aa, Myxococcus xanthus
MNRSLLALVPLVGSLLLAGCGPSAGGDCDGGGFVCQERVLALECRGGKWRELPCRGPLGCRETSEAVRCDTSNNVAGDACASSAEGTGLCRADGQAVLECRQGVLTETATCSACTVENSQVTCQP

SEQ ID NO: 11624 - protein, 336 aa, Myxococcus xanthus
MDERRLELKVGALVLAAIVGVLLLLWLMGELKLGSETGLAVDFGHTGNVVKGAPVKLGGVQVGRVQDIQLQPERRDAQGRPLPVRMELAVAPEAVGALRKDARVTVATVGILGEPYLELNPGSAPERLPAGTAVRGTDAPRLDVLAEQLTRFVDLLSQMLEEDPEAIRGLAANVSRLARTLDQLLTENRGDVKVLASELAAASKDLRQLAGLAREAFQPGGKGARLLDDASAAAAVVRRDLPGLTKSAGTTLDGLAAVTGALGPEDGARVKVALERLTSASGQLESIAARADRVLAKLEAGEGTAGAVLQDGTLYEELRMLVTDLRKHPWKVLWKD

SEQ ID NO: 11625 - protein, 481 aa, Myxococcus xanthus
MFVNACFSCTGQREFYGDARGQSVSIEFLHQYILGNYRRLYARTLAAGINHFNQAQIILNLLASGSPADARDKAEEGALIAAALRALPPQRAFRVLESLRGRRINNRRARAIARDYVHGRANLAFDAVKYRSKLRAAVSHGHLKLEGELGPFLFRGWKKRFFTQPLLETFRRAHYTHEALYELPYTVAEGLAVKHGISREVFLRRIEPRLTAAERLRLQESAARERGTPPPVDLGRASLTKLALYVLALSLEVRRERHAELHAALEQAAARVLRRAPSPLQRVAAILDNSYSSSGSLEKRRRPLGVALATHYLLSAAAREYRAWWTCPVEEPLLVSARGQTDIATPLLDALAWGADLVVIVSDGYDNDPPKAVAELTRVFRSKLDPERHTALVHVNPVFDSEGYAPRSFGAAVPTVGVRDAEDVPTVLGFARFAEGVASLSELEAYLASRVGAMLQRDAGDRRGDDEGRRQEAPSAEEGES

SEQ ID NO: 11626 - protein, 389 aa, Myxococcus xanthus
MTDARLIQRLEPAGLRLAPSQVWGGIRLVPVLRDEVRGDLRMSLRTYDDVAAVVSVKGGLKEPGLKYISYVPHGLVMTWGNRQAEAVYGTQLQPEDGKRLKAGPFSIRLLHRMVHREDRRQLRMLPLHLAMEGFLSLQFGGPEIAWAEYSREGLSRGLAPRSEGSVPGWASPMLDGALRTFEIHPQQVGLLLFNADVLLSAFVVAHPDDYRALHRTLVEDFYGDLLLQYGFLGDAPELGLTLDDARVSSLEDLRNEVHRMRQDWADFHGFMAGSLFGASMSSTGVYKAGGFLLQRFHTSLDPAEENHIGEAIVGTDGTLEYLKTYRLSAAQTRRAYLLSQLAQCDWHLEDTAERLRTTVSDLSLRLRNAGFGYLLKDSVLEAVQRKHRR

SEQ ID NO: 11627 - protein, 263 aa, Myxococcus xanthus
MSQIAQGITQLGEAMRNPSVMSDRWTLLAEVQRIRARFREQMSNLVFESASLLGEATRAQVVPGYAVEVKAAVTVRAITADLGRILTARLKKVREAEAQDVQWNAQQLQTEMDAFGRTAAYRNLRAQDKRHIVEMRAEVGRLAILPNPSRAELVTVVEALDTFVQGLSAVNQRQLLIIHDREVWASCGVRLERAMSLVGSDPAGAARALAEAAGSGQSLYGRATELDAFLRKARKLQVGQLSPDELRSTIVAFQGLLAGLDVM

SEQ ID NO: 11628 - protein, 56 aa, Myxococcus xanthus
MFAAFGLGVGVANVRAVLDRIEAPPAFITRAPEGRGFEELARAILARRGRGAAREE

SEQ ID NO: 11629 - protein, 209 aa, Myxococcus xanthus
GKFIKWGLPALALVVLAAGWWLGLEWAPPDREMGDVQRIMYVHVPLQWVGMVAMVINFVAAISYLMKASWKLDAADEASAEIGLVLGTAGMITGAIWGRPTWGVYWSWDPRLTSQAIMLVTYTGYLVLRRFVEDPEKRATWSSVVAIIGAINLPIVWFSVRWWRSLHQVQSTPKTVDPEMTLALRVSAFGMLFLTLWFLVLRYRQALAE

SEQ ID NO: 11630 - protein, 233 aa, Myxococcus xanthus
MSTSRPRPIGLLTATLALLRKDLLIEWRTRARLNAIIFFALATLLMFSFALGPDTKLLEKNAGGYFWLAILFASVLALGESFRVESENACMDGIRLAPADARAIFLSKALGNTLLLTALGVLLVPVMVALYGVRIVTSMVDLGLILLLGSLALSAPGTVYAAISSNARARDVLLPLLLFPLVIPALLSAAKATTLVLQGDPMNQFGSWVGLLGGFNLIYWGIGFLLFPRIIED

SEQ ID NO: 11631 - protein, 77 aa, Myxococcus xanthus
MRKRLAIARLLLKAPSIALLDEPFGELDPAGIRDMEAIIAELKASGVTVILATHLIEQGLTLCEERLHLQEGRAVAA

SEQ ID NO: 11632 - protein, 197 aa, Myxococcus xanthus
MGKGEVYVLAGSDLLENRRLELLDNLRFWEALAARGPLLFDEYHHQLAPPPPFSRGIWVFTAQVLAVGLLYVVSRGTRFGAPRPLRVERHRSALEYVRSMGWLMRRAKVEKELLPELDQALRQQMQERLGIPMGLSDEDAARLMEQDGGVSATEYLEAKADLTRTHAQPTVAPADYARVARRYAHLERALAGREARA

SEQ ID NO: 11633 - protein, 56 aa, Myxococcus xanthus
MVVSHDYRQLKALADRVLVVANKQCAYLGTPKGFLESSAPELRVLTAPFMEGATDG

SEQ ID NO: 11634 - protein, 149 aa, Myxococcus xanthus
MLGLALALILWSVLRLRARRGRKAAHVSASSAANAEPLVLDSPAEHLRRARAALSTDAREAIREGLLSLLSSLEERRLARPDRVRTNRELAAELPGRGASAALVREVERLMGWYDRTFYSLAPVAPEEAARFVTEVESLNGTLATEGAR

SEQ ID NO: 11635 - protein, 323 aa, Myxococcus xanthus
MIDRAATFWRSHLKPLFLLSFGFTLVNYIATKATLVIGQRLAPLLYTGDAESRAQLDPAVMLPQASITIALWMSLFLFLVWMYWLATLAASRYVLTSQLGEPVRPADALRRSFSRLGTLTGVYLLSLGWSALVTMALMLPGLILAIIGIAVGVASGSNTLAVVLGVVGTLLASLGLLAAALWYMLRFLLVPPVLAMEDLGAWETFRRSGQLLSGRVEPGFMGRVMVRAMILFTVVSLILISVQLVSGLPSWLVMMPYGSPFDPGTMARTPQLLLVPVELLQTVAQSFFTPINFVFCALFYLDMRVRREALDLEHQLNTMTPAN

SEQ ID NO: 11636 - protein, 41 aa, Myxococcus xanthus
MTLPDAAGFAVISSVLEADDPTAAARSLLAARAGRAMLRTP

SEQ ID NO: 11637 - protein, 261 aa, Myxococcus xanthus
MSIQDKPFTIAGVTFSSRLILGTGKYPSHDIMKRCHESSGTEMVTVAVRRLDLKATGEASLMNWIDRNRLRLLPNTALCYTADDAVRTCRLAEELGMSKWVKLEVLGDEKTLYPDVEETVKAARILVKEGFTVLPYTSDDPITARKLEDAGCAAVMPLAAPIGSGLGIRNPHNIRLILETVKVPVIVDAGVGTASDAAIAMELGVEAVLMNTAIAGAQDPVRMAVAMKKAVEAGRDAYLAGRIPRKAYGSASSPIDGLVHH

SEQ ID NO: 11638 - protein, 80 aa, Myxococcus xanthus
MHLKDVEDRESDGHYGRLIRMAREVGSPVPQIWHLFAYKPRLGEALSRFTHEVMRGPSPLSPGLRELIAAYTSRGNQCLF

SEQ ID NO: 11639 - protein, 265 aa, Myxococcus xanthus
MLTVTVDGVPLHYRDEGKGPPVLLLHAFPLNGSTFDKQVKALSGRYRFIIPDIRGFGESALGDGPTEMFRIARDALSLLDALNLDTVVVGGVSMGGYAAMALLREDAGRVSGLVLMDTQATADDAEGKARRETSAIQALEVGVEPIIQAMLPKMVAAGPDSPVAQEVAALMRAASPASVAAALRGMALRPDSKDMLARYAGPALVIVGEHDALTPPAKAKEIAGLISGAKLEVIPDAGHLANQEQPDRVNAVLDAFLTSLQGRGA

SEQ ID NO: 11640 - protein, 326 aa, Myxococcus xanthus
MRAMPLAWERYGMIQVCLVKDGQLLTGGEELLGEEGRKWIDVLHPTEEVLARLAAQFGLHKLAVEDCLHLDQRPKLEEYPNHQFVVLQGFTVTGKDICELTLHEHHFFLAKDWLISVHELPFAGHDTVMRRVKEDPQATLIRGTDFVFYMLADALVDAQFPILDTFSDEIEDLEAAIFDKPEKSHLQRIFAMKRMLVTFRRVLSPQRDVVGLLSRRGISHVHEKTTLYFRDVYDHLVRLYEQIDAGRDIIGNVIDGYLSMVANKTNDISKQLTIFATIFLPLSCIVGFFGQNFDRLYTNNAWYLMWASILGLPVGMVFWFKHKEWF

SEQ ID NO: 11641 - protein, 221 aa, Myxococcus xanthus
MGIRELLFESLRWVDEQPDVDKALPIDALSVRALAPPSPSQPLMHRIILGLCTSPQNLGRLRLSMGVSRSSVTRRVHELLRSKLVEVDGAPQVEADPVAEMLEKGAVLMREGQYDAAGIVCASLLASDPADRRVREFARLVQREHVAALYSDMPPLMVPLMIHDPQGQALLKPEERQIAGLVNGTWDVSTLVLASPARELETLKTLAKLQRMGLLQLVFPR

SEQ ID NO: 11642 - protein, 360 aa, Myxococcus xanthus
MTDDLLLETRGAVGVVTLNRPKALNALNLGMCRKLHPALDAWAADPSIQAVVIRGAGGRAFCAGGDVRAVALSVGDASAEAKERVSREFFRAEYGLNHRIHYFGKPFIALVDGVCMGGGLGLSIHGTHRVVTEKLVLAMPETAIGLFPDVGGGWFLPRFPGESGTYLGLTGARCGAADAMWLGYATHHVESARLEAVLDALVGAPWGTGAASTVVDTVLAGFHADAGTSPLGVQRAAIDRCFAAERVDDIQQALELEGTPWAQETWATLLHMCPASLKVTLRQLRMGRTRDYDEMANVEYRLSQSMTARPDFREGIRAVLVDKDNKPHWRPSTLAEVTEGMVEALFAPLLHDTWKVPARG

SEQ ID NO: 11643 - protein, 216 aa, Myxococcus xanthus
MGAEETLFQRFGKEFPQGTELFREGEAGKEMFVIQAGRVAISKRVRDVEKVLAVLGPGEFFGEMAIISNKPRNASATVNEDARLLVIDPKTFEGMIRGNAEIAVRMIKKLAERLSEADAQIENLLHNDPASRVVHQIIQACQSRGRPLDEGVEIDFAMRELPRQIGVGEPAVRAVVDRLERSGLVERNGDRMTVPDTARLHDFLQYLEMKWKFGDL

SEQ ID NO: 11644 - protein, 248 aa, Myxococcus xanthus
MNGVLSFFGAPVVMLARTVRASTRDGVPWRESLAQLHELGGRSVWLVMSGMAFFGAVLVTIANSQARRFVGNVAVLGPAYFELLIRELGPAVSALLTASRAGAAHAAELSTMSVNEQVEALEMSAGDPYADLVAPRVFAGVMGVPLLCILGTIAATLSAAAVAQFAFGVDGRAFMDPRYVDGWDLLAALLKAAGCGLYIPLAAAVAGLKARGGAEAVGEATTDGVVAASLGCLLIDLAVSLAFQLLRL

SEQ ID NO: 11645 - protein, 96 aa, Myxococcus xanthus
MSGDTGPTDKLWKALNETKNLKALLLETSFPNKLQSLADISGHLTPHTLSLELQKFERNGASVLLYHLKPAFVSQLKKELAELPVEVLELGDTFEL

SEQ ID NO: 11646 - protein, 259 aa, Myxococcus xanthus
MEGLWAKCETCDEIIYRQELEKNWMVCPHCEHHHYWAARARLAALLDPDSFEEFDKELEPQDPLGFSDSKKYKDRLKSTRKNLGEPDAFISGVGRIQGHQVSVGCFVFEFMGGSMGSVVGEKVARVFERAHELKCSAIVFSASGGARMQEGIFSLMQMAKTSAAIARFRTGTRPYISVLLNPTTGGVAASFSWLGDVILAEPKALIGFAGPRVIEQTIRQKLPEGFQRSEFLLDHGMIDAIIHRKDLRAKLGQILGLLG

SEQ ID NO: 11647 - protein, 376 aa, Myxococcus xanthus
MTAASLHAAGHRVGLYTSPHLVRVNERIRVDSEDISDADFGLRILEVLERYPSAVSSPMTYFEFGTVVALWHFAQVRVDVAVLETGLGGRLDATTAASPVVTAITPVSFDHMEYLGDTLAAIAGEKAGILKPGVPCVVARQAPEALEAILRKAEQVGAPVRLEGRDFTGERQPDGGLSYRGATWSLDGLSVALRGPHQRQNAAVALACLEALQERGVTAPPEAARAGLASACWPGRLEEVGQQPILLLDGAHNPAGVEVLLASLKDLYPGRRLHLVFGVVGDKDRGPMMRALLPECASVQLTPLETPRSLAPEAYLAEARALCADVTAWPDADAALAAARKRAAANDLVLCTGSLFLVGMMKARMYRNLGAMHQPP

SEQ ID NO: 11648 - protein, 261 aa, Myxococcus xanthus
MLGYGYAGIHNDFEGLITIGSPADLGRGFMLLRLLAHGAPMLAGMIDLTLASLNVGGKVEGAGRSLLARGVGVLNKGLGRRLSPRARRTLRFDAVPVDIILKTLERQLAKAEDSPLYQQLTTRLNRLINPERVSADDIRWLLREGGEREPRRVLEQFARWIRRGEMVCYRTGFDFKRGFGRIEVPMAIIFGDLDPLASLESTRSVYRAAKSEYLLWRPVKGNSHIELTMGHDIRQICYDIKNLIEYARTHRYRSPSLPRLR

SEQ ID NO: 11649 - protein, 477 aa, Myxococcus xanthus
MKPFAAWLLGVVLVPFVALAQAPATNLNTITAVQVNGGTVTISGSQKANFTTFTMTDPPRLVIDISEAVFSEVPEEIQVGNGTVTAIRTASYGSEASSIARVLIGYEREVEADIQAQGNQLVVRVAGGGGQAVAQAPGTEKPQAGSSAADAAAAAAAERQAQEKAAADAAAAARAEREAQERASAEAAAAAKRDAEAEARRQEEARAASQRQQEEQARAEAERKRQEEASRASAQAAADEKRRQEESAKASAQSAAEEKRRQEEAARASAQAAADERRAQQQAAAEEQERRKAAARAEAEQRKAAQQSAAEERRAAAQAAAEERRAQQEAAAEERRQRQAEARASRESRQNQAVEPSRPSSSGSEASVSSRRKTLTLVGFQQQSGASRVFIRTNEPVSYSVSERGRSVVLELENTRVDASNNTLPLDTSYFATPVLRVDPSASGRDVRITIQLRQSAPFQARQEGNVISLDFQRTGR

SEQ ID NO: 11650 - protein, 878 aa, Myxococcus xanthus
MSFFVPLAAALLVSTSQVPLATPLALPNGETAQLAADLVVYEADTKVVTARGNAVLRTETMQLRADEVTYDEVNQLVTASGGVMFVGPSGLAAVADTAKMDVRTYEANLEGGLFMQKQGVTQEALFTAKTPQELRAMGETPLLMSGSRIRRTGENTFLVEDLAFTPCNCSPGEPGWRMEASSATVVLGERATMTLPVVYVKSVPVFALPWLYMPLSQRRTGLLLPKPTFSSLNGFSLEQPLFITLGQSYDVTLTPGYFSGGYELHTVPGATEQVREPRYLGVKGPRLLTEFRYAPSERTRGRATLGFLYDLRPIRDPRSFMFYRRTEDGVASPEFVDERRGLRGEASWQHTQDMGGGWHNRVDASFVSDGNYTRDLTADLITREFTYLRSTGTVFQRQDDLYAGLDVALRQDIRWGYRFFQDNRIPAATDPARPDLKGPNTFQRLPAITLALPERPVLGGIMGGLSVQYLRLAPLRGGYGDEGIDGIFRADGFHVPFGSAGWPFPADTTQSDGIFNSNDREARDRVDFFPRLSTSFGLGSLMRVSPSLGMRQDVWLGEVSGRTWQRGYPIAGLLLESQVARVFEGRETSFRHAITPSLELRYVPGGWGRLPSAGASGENLARPYDEVDAAVPFQSDGRTRGFLHAVLAVDQTLRFKRGNDIREPLRLRIGQGFDLTRHVPAAGKVDDPGPVLRDTFARLSATAGIFTAAGTVRYDPNAGRISGLSAEVNVDNGKGHAVYARFDDLLWTGGDALNRGADPRSVGPDVLRRSLDTLVGGLSRVEPGFPPAERAQALIAGTRLKLGFGLGVRYEAIVHPLYQDPITRENRPLAQQTFGLSYGPACDCWRVEGVVTSRRDLGLEFSGINLIVADFGSFGSGG

SEQ ID NO: 11651 - protein, 76 aa, Myxococcus xanthus
MIERGERVPHVETLAALANALGVSLGELFTGTEQTLAQTEDLLRPLSDFARARGLTARDVDRLLGVARVMFSGTAA

SEQ ID NO: 11652 - protein, 512 aa, Myxococcus xanthus
MRPGLAPWVAFASLLFVACSPSAPATLEFVDQSPAQPRLGEITTLRFRAVDSRGQPQAGTPVSFTLESPVPGVELSPTEGVTNTGDGIVSVQMTARGGRVASAVVIATAGTGAEMKRAVSPVVSFAGTNSNSRQFTFQCGSFSGDGSGLHHAVGAWDETRALIAGVKVRCIAHVGDRNGDGVVGAQVSFLTEAGTIGPSAVSVTDVVGNAEVLYKTSLPLPQDVEPGIFTWSPQKDATHTGEYLAPLWMHPFLWDENPIAAYGNAPQPQQDRPEPRRPDPIRPGIVLNPRDNLVSLIAITSGEEAFDDLNNNGVWDTGEPFEDLTEPFVDNNDNGTWDPGERYVDTNGDGRWTGKNGQHDASTLIWVQERILWTGMPHGLDKDQTQRQLDPPPNAPPPLINHFGGISISFIVSDPWYNRMAQNSGNDGCSGGASGPVTVSPANTGIALTYPSFNFETYLVSDAHEPPAEGPPPPVFNPPVDWRVTPICKYTAAQLEGHEAIVQGPVVRGTVE

SEQ ID NO: 11653 - protein, 61 aa, Myxococcus xanthus
MALTAFVVGLADARDPDALERAKSQIADSFLYGVLTGAQAAEVSEWKPEKSATKSKAPKRS

SEQ ID NO: 11654 - protein, 260 aa, Myxococcus xanthus
MEAGEVRYEVQGTQALLTIDRPKARNALSPAVVRELMAALERAESDTSVRVVVLTGAGEKVFCAGGDLGTLAGDEGFLSTHEGRRSYGRLLARFQELRKPTVARVNGHALAGGLGLVLACDLAVAVEGADLGTPEIDVGLFPMMMMALLQRHLGRKRALELVLTGDRLPAREALTLGLLNRVVPAAELDAAVGTLAGKLAGKSQAVLALGRRAFFTAEDLPLPAALEYLASQLSLNVLADDAGEGISAFLEKRPPKWNDR

SEQ ID NO: 11655 - protein, 257 aa, Myxococcus xanthus
MALLTRLGRTALDALRGTGALGLVVGRTVLALPKLERRELGRALVQFGYGSLPLALATAALAGIIVVLQSGIYVQRFGARAFLGWAAGYGVLWEFGPLLLGLIMSARLGARNAAELALMQVGGQIEGLRGIGLDPFAILVAPRVVAMEVSMLALSGVTFAVAILFESVAALLALGLPVRVFFGTFSQLLGPLDLLGGVVKTGIFGLAIALLSTTVGLSARGGAHAVGQAAANAVVRSCAPIFVLDFALTSLLAGWMG

SEQ ID NO: 11656 - protein, 217 aa, Myxococcus xanthus
MADRSIIRWVGATGRTSTFANAYPAPYLDALEVPRRPSTSPPEFVLTRKSRRKVKPSASKLAFAAGGIPLRTLDDARAGDGLTHDITGASARAYGLPAPARTPEEAAAVFWDIASGADFTFFEHYLADEAGHAQDWTAALAALDAFDAFTRALVATRPVEARVLVCSDHGNVEDLSTRGHTLHPVPVLYFGPPAPEVESFSTVADVGRAVVRWLGAE

SEQ ID NO: 11657 - protein, 329 aa, Myxococcus xanthus
MMSIATEGDRTLFFDFLPVKVERVGDCSVRLALYTVPGQVFYNATRKLVLQGADGVVFVADSQPEAMDANRESLANLEENLFEHGIRLDRFPLVMQWNKRDLDGVLPVEVLRKELNPRGVPELETSAANGRGVLDTLKAITRLVIKDLRAKRIVPPPRPTASAQPAGLEAQLTQHLQHRQQPGAVASQPVQAGGPVPRVAPVAVMPPPRVEPTPIPAPQPGPKLLGAASALAPGDMFDHARAAEAAFMTGDYATCVTACTDAIRRALAFAGEGSLGQQAFLLRVDGADLLRLQGLGTQQHLRVDDAAFSLYVMMQVFIRLNAVGLPNGE

SEQ ID NO: 11658 - protein, 63 aa, Myxococcus xanthus
MAWKCDLCGKRPLVGNNVSHANNKTKKRTLPNLQKIRASVQGSTQRVLACTRCIKAGKVTKAA

SEQ ID NO: 11659 - protein, 509 aa, Myxococcus xanthus
MATSSAKLKLPAGPSRHVYDVIVLGSQLGGALAAALLAKRNHRVLLVEHDGMGPGYEHGGYVLPYAPFVAPPLKAMPAVEEALTELGLNANVQRALRPHAPELQLLMPRSRLDLHGDAARRKAEVTRELGEEGESLLGALAGAAAQHEASDAFFKAGPALPPDGFFEGWGLKKLIRAHPGLATPPRLTGDSASVSLVRGLRPFVTHLDRPEAPLALTRAMSQVLSAPSYFPGGHEGLRELLARRVAELGGDVLGRDNPTGFIVEELAFDGSKFAGMKLMRSDTMYRASCLVAATDAGALRRLVTDKKHHRGLLEHLDQSNTKALLFTVNWVVPESALPRGLGELALLDTGDAELGPVLIQVHPARAAPAHGGKEAKATEGLRVVCAGAFVPASARDLGEEHLQGLATRIDEHLDALMPFTAQHRVLRSAPYLDAGGVRGSRLMPHPLFSFESEAVLGVTGLTQRTPAKNILLANREVLPGLGLEGELLAGIRAARLVQDMLKKKDPLKG

SEQ ID NO: 11660 - protein, 215 aa, Myxococcus xanthus
MDGTLVDNMQFHNEAWVSFAQKLGLPLTANDFQSRFAGRKNEEIIPELLGRPVAPDEVERIAEEKENHYRTLYRPHLKLHRGAEAFIQRLKEAHVPAAIATAAPQGNRELVLDGLGIRPLFASIVGAEQVTRGKPAPDIFLAAAKALGVAPTECLAFEDAVLGIISAREAGMTVVGLTTAAPEADLRKAGAHWVVQDFTQLPPALEQRLFSAQAR

SEQ ID NO: 11661 - protein, 216 aa, Myxococcus xanthus
MGPVTPGAPQVELTGTLDVVESGYPSRELRVAGKYVKPPASVRKRMAADRRAFAEAFAQDFSAPHFAQNFVWPRADRITAPFGDRRTFNGKLSSQHFGVDIDGDPGTPVQAANDGTVVMARDNYAAGNTVLVHHGAGLYTAYFHLSRIDVKTGTQVKQGQLLGTVGSTGRVTGPHLHWGVKVDGLWVDGERLLKLDFFPHLPPSVARGGNTELGTP

SEQ ID NO: 11662 - protein, 230 aa, Myxococcus xanthus
LKRALLEGFVYRFNVGTDVAVLLLGMGRVLREQGSLEALFLQGLQSRDTLHGALDHFTTGLRAIPMDALRKALGPERGLHHLLPSPLGGGAAKRLNLYLRWMVRGPDTVDFGIWKRVPPSALLIPLDTHIGRISRHLGLTFRNDLTWRTAEEVTAALRVLDPADPVRYDFALCHYGMSGACPAQPIAENCGRCPLLPACAVGPQVVATATRRVQGTTARKRRELSATRRR

SEQ ID NO: 11663 - protein, 326 aa, Myxococcus xanthus
MELREVVAEAQEGAGRVSAIVRDLRTFSRADEELHGPVDMVHVVDGALRLLRNQIGLVARLTCTLEPVLPVHGNEGRLTQIVVNLLLNALQALPDRAPEENRVRVSLRASSSRHVELEVSDNGHGMAPDVQRRIFDPFFSTRPVGEGTGLGLSISLTLVQAMGGRIEVSSAPGWGSTFRIVLPAQAAGWTDGAEQTQVVEPAPARIRRRLLLIDDEPSVGNSVSRLVRDVYEIHVVQDAREALRLLTMGERFDAILCDVMMPGMSGLDFVVELERLAPELALRTGLMTGGAFTAQAREFVGRRTRGLLEKPFERERLCTFVEHLIQ

SEQ ID NO: 11664 - protein, 232 aa, Myxococcus xanthus
MDLRADGLTVRYGARQVLSGVSCALPPGTQALVLGRSGAGKTTLVKALAGLVRPTEGRVLWDGQDAARLTAAERREQQASFGMVFQTDALFDSMTVLENVMAPLTRRHVPEAEARARASDVLRAVGLADAAGTLPERLSGGMKKRAGIARALAARPSVVLADDPFAGLDPGTARQVARVLLDVSQGGTLLVVATEAPMDLPLPRWLYLRNGRLVHDGPPAPEWEDAPDEVPA

SEQ ID NO: 11665 - protein, 384 aa, Myxococcus xanthus
MIRAARRSLAASLVALLAAGLFVVPGWLQGLSLVVRAAGMQGRVETALADWRTGPFDVSDVQVPTRHGPVRARLYRPVTQRGRTVVLTSGVHADGIDEPRLVKLAEDLAMGGQAVLTPEPPDLLRYEITPRLPDIIEDAAVWAASQADLAPDGKVNLFGISFSGGLSVVAAGRPALQDRVAATLSFGGHGDLPRVLTFLCSGDLPDGSHLAPHDYGVVIILLNVAEMLVPPEQVEPLRAGIRTFLRASHQAMVDGRLAAETFAKARDLQAELPEPAATLMGYVNTRDVAALGPRLLPFVKTFAADPALSPERSPPPTAPVFLLHGAGDTVIPAMESSRLAAALRPHTEVNALATPLITHAEMDGPQALMDVLRLVHFWADLLDA

SEQ ID NO: 11666 - protein, 92 aa, Myxococcus xanthus
MGAFPVRLPEKLAKTHGTQSGLKVASVEPDGPAEEAGLHPGDTLLTLEGQPLREVDDLVAQLPPERVGQTVHAKVLRAGAAKVIDLTVGAHP

SEQ ID NO: 11667 - protein, 266 aa, Myxococcus xanthus
MKALLDEAEPHFQAKRYDEAAKLYAQATDLCPECYVAWVFRGDADYFAGDAATALEHYGRATTLNPYDHRAWFFQGNALAKLGRFEEALDAWAQCLALSPRYPIIRQFFRTNAHLGLVIRGDTIVPRGYAERDAEGVSIQFDPNHDPAWLAFANCKALWLGEPSHRAKMTGSTEEQFTSVEEMECLASALAVHESQKAEGKTDALDPTLDRLFAIAQEGLLLEAVLFEVGARVHPQIALTLEDELRRRLKKYVLTHVLVPAGGHGG

SEQ ID NO: 11668 - protein, 66 aa, Myxococcus xanthus
MPGWRRWAEQSLGSKDLFYPYREDVPLETADAKAVDALAALLAWARSERRPEEVLVISHNARPPFE

SEQ ID NO: 11669 - protein, 354 aa, Myxococcus xanthus
MADTAENPLGLNGFEFVEFTSPQPEVMEHLFERLGFTAYSKHPSKELVRYKQGGINLLINREASGQAAEFRAEHGPSASGMAFRVANARTAYEMALERGAKAADPERGSLGEGSYVLEGIGGSLLYLVDRHGEKGTLYDSWQEIPGAEAAEAKNSVGLETLDHLTHNVRRGQMRTWSSFYNRIFGFTEQKYFDIKGQATGLFSQAMIAPDKAIRIPLNESQDDKSQIEEFIRQYKGEGIQHLALTTPDIYDTVERLRARGVVLQDTLETYYDLVDKRVPKHGEDLARMRKNRILIDGSEEEGLLLQIFTENLFGPIFFEIIQRKGNEGFGNGNFQALFESIELDQIRRGVIKVD

SEQ ID NO: 11670 - protein, 112 aa, Myxococcus xanthus
MVAEHTFRPPWFHRNVMSEFMGLVHGVYDAKAGGFAPGGGSLHNCMSGHGPDRTSYEQAIQADLKPHKIKDTLAFMFESRWVIRPTRFAMETPALQQDYDACWAGFQKAKLP

SEQ ID NO: 11671 - protein, 128 aa, Myxococcus xanthus
MAQIDDRVTPPPQRHYPPTSTRSSSVADILERVLDKGIVITGDIKINLTNVELLTIQIRLIICSVERAQEMGLDWWTTNPNFSSRARQQLSAAQAPVAAPARGASAEPAAPAPRAAPKPRRAPKAKKV

SEQ ID NO: 11672 - protein, 108 aa, Myxococcus xanthus
MAVEGAPQAVEELARALEPTKPPKLELDEENVQAGLVRLVLAVVELIRQLLERQALRRIDAGSLSEEQIERLGVTFLRLQEQMDVLKKQFDLTDEDLNLDLGPLGTTL

SEQ ID NO: 11673 - protein, 73 aa, Myxococcus xanthus
MNGQATTPEAQQERASVLELLDRVLNKGVVISGDLVISVADVDLIYLGLRLLLTSVETALEVGTLPEHPQRLQ

SEQ ID NO: 11674 - protein, 85 aa, Myxococcus xanthus
MSPVRSIAWIFRSVHKAVQDEQAQEQTDLRTRLSDLYQELERGEITEEQFDEQESQLLDRLDALKAAQEGAGPAPPETGPGGENR

SEQ ID NO: 11675 - protein, 206 aa, Myxococcus xanthus
MVGFESGNSVALYAVDSQGRILRWNYEEGAPTQAAPEELTRLNDNLKSIDGTSPRTLFAAGAEAQGGTNHPVVWRGPTEDGGTWQKEALGNVGSTEFLFGIQVLSPSHVYAVGDKGLFLERAGTTWSVKPAITLPTSAPADIRGLVAFGSKAIYAVSSGTNNIHFFNGTAWSTAFAPSSPMNALSGTGPADVWVAGHSGALVRWRP

SEQ ID NO: 11676 - protein, 190 aa, Myxococcus xanthus
MDQAPMLPVAFGIIAGSEREVRNLLAEHANDFLTQLRAVRGNVEMGLRIRLSDPDAFGYYVNAFPELKAMRDDLYREGEPSREEKIELGKYFVDLLNGFREATADKVLDGIESVARQTVVNEPRNESEVVNLAALVPQKKVDAFNATVEKLGATLPENFQVNVTGPWPPYNFTHLRIHFEEVEEAAQGAP

SEQ ID NO: 11677 - protein, 251 aa, Myxococcus xanthus
MYGILDARQAAKESLPPGLNQAPLMAVKHGNLAAAISPVEEELASSAGIEQALEYARVVEQLHRRLSVLPMRYGCFVHHPEQVVEFLHRYERQFSDALAQVEGCDEMGLRILFQESDVAEPPEQAGAPTGADAQTRGRAYLDNRRRFYAQQTRVDRAARRMAERAQAAFSGQFVRCTWDHAARPDGQLLSMAFLVERPKLAEFRRAFLRFQKDGPGNVMCSGPWPPYGFVADLAKPAVAALAELEHLQEKG

SEQ ID NO: 11678 - protein, 101 aa, Myxococcus xanthus
MQRELDVRSRNEGQSLAAHIREELAPAALSVKPLRLADRGISGRQDDMVLNSAFLVHSGQVQRFAQRVQQLAARYQPQGLTVETTGPWPPYSFCPSLEERP

SEQ ID NO: 11679 - protein, 174 aa, Myxococcus xanthus
MAEKTGISGGGFLEGITTLVTKLAELAEKSEQLQRSGEFGASDKGLRGVYGFNVRIGGGAPGQPSGIPRVEPFGNIRQDHQTGKAVVHPIREPLVDVFEEGPDVLVVAELPGVDRKDITLELREDILTLHAEHEALKYHKEVLLPRRFTRRQMHTNCRNGVLEIRLTAQEERRS

SEQ ID NO: 11680 - protein, 82 aa, Myxococcus xanthus
MGNPGIEYTHQALAARVEGTMIAKCVITVRGDVTDCRIIKGLPHMNEAVLDALHARRYTPVQFQGRTVSVSYVFTLRLKLPR

SEQ ID NO: 11681 - protein, 151 aa, Myxococcus xanthus
MLTARSLEDDILRGFEVGAQDYLTKPYRLRELLARVRALVRRSGTAPPEQMGFSSFTLDLGRRQVSRADGSVVELTRTEFDLLAFLLRHQDRALPRGEILDAVWGRDVVVDPRTVDNFVSSLKKKLGWTSTSGFSIHTIRGVGYRMEVASS

SEQ ID NO: 11682 - protein, 222 aa, Myxococcus xanthus
MKAKIASRVGVTPQWVKPPAKFQLLYKNGHQFFGRAASLRCGYFSADSGGCTIWPYREAVCSTFFCKYVAGADGRKFWMSLKTYLTLAEIQLSRWTALQLLPDYVLTGRDRAETQPGPLTVEDLDDTAPPAKAYAALWQGYEGLELDYFRECYRMVKALPPDGVEKLLGLDGTIELKTLEKLHHTAVAPQLPRTLKLNPDATVQWMQDGSVAWARTANTTRG

SEQ ID NO: 11683 - protein, 188 aa, Myxococcus xanthus
MEVERRPTLTADGKVVASPPPAALAAEVEQLRAEVRGMVAGEALNSEGGRDYLKDAVRNVQNEMRNEQRAERQQQWQQAQVQQQAQQQERVRKFITDARLNYTQEQTLSRRLEAESTKRQALMEEVRAGTKTVRDMRQALRTESQQTDQEMNAILDEGQRSQYQSLRREDRPVGGPPGGQRGGQGRGR

SEQ ID NO: 11684 - protein, 800 aa, Myxococcus xanthus
MDSLLQDLRYAIRTLTRTPGFTLAAGLTLALVIGANAVLFSAIHAMLLRPLPFPLPESLVRIWCVQESVSHASVAAPELLGWREHSKGFSQLAGFGRTSLNRTGTDEPERVRAARITPNFFSVLGVQPAQGRDLREEDAPPGGDTSVVLVSHGYWQRALGGVPDVVGQTLVLNGRSHAVVGVLPEDFSFPEFAEDTDVWVPEWQDPQRHGNHYQSVLGRLAPGVSLEAARADLERAAQGIGHPEPGQKRHTVRVTGWQDHLTTNTRDVLWMLWVAVGFVLLIACANVANLMLVRTLSRQRDGAIRAALGASQGRRLQQSLVESVLLSLFGGVLGLLLMLWGMELVRTLLPASMLRVAPLELNGTVLGFSVLLSVGTGLLFGLAPAMHASGMNVLPLLRQSGSAVGARSGHPLRSALVMVQLALALVLMVGTGLIVRSLQNIQAVDPGFDAEGVVGAQLTLAPDAYQEDARKRAFFEGVAERLMARPGMEAVGFVNDAPLGGSSSNGDFILEGMSASPGDRHITAYRVASPGYFSALRIGVRQGRDFGPEDTEKSAPVIIVNEAFVQRYLGGGDALGRRVRLTWNDLQPFREIIGVVEDVRHESLTQPATPESYLPYAQFPLRAMTMLVRTQGPPASALAALREEVKAVDAQQPVYDLLPFTDRVEKLLLRPRATTRLLAAFAGLAVILAGVGVYGVLAYSVGQRTRELGIRMALGAHPLQVLRLVLSQGLWLTALGVGVGLIAAYGATRFMAATLYGVEPFAPDIFLGVAVALAALSLLACLVPALRASRVSPSESLRAD

SEQ ID NO: 11685 - protein, 85 aa, Myxococcus xanthus
MRSGLLKLYFSKHTPLDERSGQYIATVLQRYAEERLEQRGPVDPRLVGVFDVFAGRLFQAPKAQQRRMNDVRLACEEIAARWDVH

SEQ ID NO: 11686 - protein, 23 aa, Myxococcus xanthus
MTVTRESPRVSVNKLGQYLTATS

SEQ ID NO: 11687 - protein, 960 aa, Myxococcus xanthus
MPAPAIIFWGHELIQVYNDGYAVIMGPRHPRYLGATYRECWPDTYPVISPWMRKLLATGEVTQVAKTYFMLTRYGFNEEAYFTFDFSPLRDDAGTIAGILQVVFEVTDVVLSERRLATIRALAPRVNGPSESATTDAIRALADNPKDIPFALIYHWDEGEQRLELAESTGLDGLAQHAVVDLGRITEATKQAVAANVPVLLESVPSLLGARQFGPWPEPTEKALVLPLRRTRTDSLRGVVVLGISPRLRFDDTYRQFFEDLARELATHLAVEQEKRAEREAYTHAKQARAQAEAEVARRAQAEAALRASEERLRMALAAGQLGVVELQYERGVLSWDERALQHLGLPPGKSPTLKEAAARIHPDDVNRARRTIEQALRPGAEAIRLECRVQGWDGVQRFLLAMVKTHFDAQGQPDRVVGALQDVTEQRSAERERERLATIVEQSPDFIGVGDPSGRAVWVNDAGRRLLGLGLDEDITRYHLRDFFLAEDQTYVDEHIAAAILQGGRREGAFRFRHFPTGEPIAAQYHTFALVEHDTQRQMGIATVGRDIRAQKRLEAERERLLARERVAREEAEEANRLKDEFLATVSHELRTPLTAVLGWVQMLRTGTLPPEKRERALATVERNARAQGQLVEDLLDVSRIMTGKLKLDVSSVDVSQVVEAVLESLRPAAEAKGIRIQAALDSGGTIMGDVSRLQQVVWNLLSNAVKFTPKGGRVQVLVERRNSSVEITVADTGQGISPQFLPHVFERFRQADGSTTRKAGGLGLGLAIVRHLVELHGGTVMATSEGEGRGATFIVSLPQAVALRREVLVPPTLRGPLQEQDIPCPPQLASLRVLVVDDEEDTRELLRSIIEACGGIVTTASSSEDALAELREASFDVLVSDVGMPEEDGYRFIARVRALPEEQGGGIPAVALTAYTRMEDRTRALLAGFTTHVPKPIEPVELMAVIASMSNRGPPRRA

SEQ ID NO: 11688 - protein, 374 aa, Myxococcus xanthus
AIAVTLNLALGITVSAGLLLSGDAILGGMNLQGHMLAYAKTYLHIVGGFLFIQALINVFAGLLRTYGFTRASMFVSLGMNVLHVGGNYVLIAGHFGFPAMGVAGAAISTVVSRAIALGVFVYVLYRVMPVKMAPRDYVTFSKDYVRKILKVGLPSAFEQATYQGCQTVFLYYVTFLGAVALASRQYAHAISQYVFLCSLAIGMGTSIIVGRLVGANRADDAYQQALRSLKWGLAITLVVDVAVVLLRVPIVSLFTENADIVRLTAQVIVIGLALETGRCFNLVLINALRAAGDATFTVYMGIASMVCMSLPLGYYLVFHMGLGLAGVWMAVAADEWVRGITMWLRWKSRAWEKQVLVSLDAETEAEAAPVAAHA

SEQ ID NO: 11689 - protein, 172 aa, Myxococcus xanthus
MHVQAHSEPAVACSVTEGINLLREARKRRLEVRMLLLSAVSTPEIISQCFDEGASGYLFRAGLGTTAVASAINSLVRGERLFPVQLLRNDFEHPPVTSPTASVLLALTQREREVLAYVAGGADNLKIAAHLQIAERTVKSHVTQLYRKLGAENRTQLALRACHLGVRPPPDL

SEQ ID NO: 11690 - protein, 336 aa, Myxococcus xanthus
MQRVFRVITALLLALGVTWAALALALTGAGPEGAHVLRALGAGLLAAGAVVAWRRHSQGAALSVMGVGCVAIWGWTQTVRPATQADWAPDLARSARAVVEGSRVTLHDVRDFRYRTTSDWDASWYSATYDTRELTGAWFIVEPFSGVWGAAHTMVSFGFADGRYLVFSVEVRREKGETFSALGGLFRQFELTYVVGDERDLVQLRSNHRKDDVYLYPVDASKERIASFFLDMVARMNALHEKPEFYDTLTNNCTTNLVRHLEKVSQSRVPYDHRTLLPAYSDALAYELELIDRDAPLEQVRQRYHINARAQAADGRPDFSRRIREPLAAATADAVP

SEQ ID NO: 11691 - protein, 330 aa, Myxococcus xanthus
MAQFLDVALKVGDLTEFTADAVLFKYAQSLYGATGQAARRLEQAGVPLAQLELAPGATRLVETRGALTARRALFVGTVRLGEFGYHEIRQFAVRALAALENHSGLAHVAGTVHGPNYGLDEDEAVLAFVGGLVEAFQRGSGPQSLARFTVVERNASRAQRLAKAFARGLSATPGVETLPEGVFRVRRMSSVTQAPPLATAGTVSMAKPHAFVAMPFAPELEDTYHYGIQGPVKAARMLCERVDQELFDGPIIQRIRERIETAKVVIADLSLANPNVYLEVGYAWGRGRPTLLLVRDVKELRFDVASYRCIVYRNIRELEQSLTKELQRMD

SEQ ID NO: 11692 - protein, 346 aa, Myxococcus xanthus
MLLAREQTSVLGAVEKLLALQAQQAKPPFIGLWSRVAGFERDALQVLLQRKEVVRATLMRGTLHLASAEDYRHLRASFTPLLEASVASVLRERAKGLDVAPLVKEARAMFHEAPSTFEALRDHLVARHSQNDERAMGFAVRMFLPLIQVPTETEWGYPGTTDFAVAESWLDAPLRAEADLPTLVQRYLAAFGPASVTDAQTWSGLKGLKSTFEALRPSLRTFRDEKGRELFDLPKAPRPDKDTAAPARFLPEFDSLVLGHEDRARLVDDAYRSKLITKNLRVPATFLVDGFIAGTWTVERKRAAATLVVEPFAPIKKKDRDALVKEGEALLRFMEPEARTFEVRGH

SEQ ID NO: 11693 - protein, 671 aa, Myxococcus xanthus
MWTYDAFPSDTVNKAYGFTPTQAWLDHVRLGSVRLAGGCSASFVSPEGLVMTNHHCIRGCIEDLSSPKKDLLAKGFYASSAAQELRCPKVEANQLVEMTDVTAKMNAATKGLTGAAFNTALKKETAAVEAACATSGDVRCDVVTLFNGGKYHLYKYRRFQDVRLVFAPEFSMAAFGGDPDNFNFPRFGFDAAFLRVWQDNAPAKSPHFLPWAKQGAKEGDLVFVSGHPGGTERKATVAELEFQRDVNLPYTLLQLAELRGMLREYAGGSAERYRTTRSMLRGVENGLKALRGRHQSLADPALLAGKRQDEAALRQKVDANAQVKAATDGAWDEITQALDAYRRMLPDYRMKEAGDAYPSELFRMARHLVRVAEEKERPNAERLREYTQSQLPTLEQQLLRDAPVTPELDQALLTFGLTRVRETLGADDPFVQQVLGREAPADLARTLVRGTKLRDVKVRAALLKGGKAAVEASKDPMILFARKVDAEARAARKRYEDTVEAVLKRNGERIAKAHLAVYGTSGYPDATFTLRLNPGQVKGWDENGRPVAALTTFGGAYERHTGKEPYKLPDTWLKARGKVPPQTPFDVATTNDIIGGNSGSPLVDRDGRVVGLIFDGNLHSLGGRYAYVPETNRAVAVHGEGILAGLEHVYGARRVVDELRKASDAAVVPAK

SEQ ID NO: 11694 - protein, 214 aa, Myxococcus xanthus
MPVLRGAVTLSRFRVEPAKEAPSDVKRWLTRGLKAHAFEPIDRRSEEERAVGFVELENEESSEFSAGRLYYGEYALFAFRIDTIKVPAAALKAELAKWAAAFEKENGRPPSRGEKTQSRGEIRQMLRTRATPRTSTVDVSWNLKTQQVQIWSASRKVVDEITVALEGGLNVKFFGMTPSAMAQTAGIDESLLGPTTELIGMDLPATAEVAHGEA

SEQ ID NO: 11695 - protein, 216 aa, Myxococcus xanthus
MRGDVGVDGGATEETKDEAEVEKGKAQDQLLRGRAYLGREFLTWLLWRTEAGGPLVEVEGEGVSVLFMGRVVLRGVSGEVTEMSAKGTLAPYSEQVKHSLDRGLLVAQARLRFTQGEREFEATVDSEFLDIRAGKLPALMSEEEDDQLSERLLLMEQLAAMVDALVQDYLSVRASKGWSKTVVPAMKEWMRGDEQGADALAKAARARGRDARTARS

SEQ ID NO: 11696 - protein, 757 aa, Myxococcus xanthus
MLLGVVALAMSLLGISLACPGASGDGSGRPGDEVEITDPSPEGEPGTDGDGSAPTAPDGGGPDSLGLFGLDVRPANPTCVAPPRPPDPAGATISRAFPELSFTQPLFALQAPGDSRRIYVVERGGRVRVFDKDATPPVSSVFVDISGQVNVEHDETGLLGMAFHPAFATNGQVFLSYVGNNAMGSLRSSIVRYRSPDGGATLDPASAEVVLEQDQPFSFHNGGHLAFGPDGFLYFAFGDGGGRVDPNRTAQNPELLLGKMLRLDVDSARPYAIPPTNPYATAGGRKEIYATGFRNPWRWSFDRSTGALWLGDVGEKLLEEINRVELGGNYGWSILEGTECARGGGCRTTGLTPPVAVYGRAEGVSVTGGYVYRGTAVPSLAGKYIFGDFGSGRIWTLPGDALPGAAAAPQLLVTTALSISSFAELNDGELLVVDFAGGGLHSIHASLPPAPGGEAFPTLLSATGCADPTNPNLPSAGLIPYGVNAPLWSDGAGKERFIGVPDGAVMTVGPEGVLDAPPGTVTVKTFLLGGKRVETRLFMRHPDGIWAGYTYEWNDAGTDATLLETGKVKTVGTQTWTYPSRGECMQCHTAAAGFVLGLEVAQLNGDYTYPGGRIASQLQTLEHIGVLKLPAPVEQLPRMPAYAGPEPVETRARAYLHANCAVCHRPNGLGRGELDLRFSTPLAATKICGVAPDHGELGVPGAMVVAPGDPSKSVLSRRMHSLSTPRMPPLASAVKDKEGTGLVDAWITSLPACPTGP

SEQ ID NO: 11697 - protein, 60 aa, Myxococcus xanthus
ATPLPAYVAQRRADWDALQALLAKQRSGTLKLGELRTLDTLYRRASADLAHAQTFYAGTD

SEQ ID NO: 11698 - protein, 254 aa, Myxococcus xanthus
MRSAPTPHLDVATPERVALTLPIAGIGYRCLAWLVDASLLFFFWLVAYFVFTLLVSDVLGVFQALSGVGQTLLVVGVFATQWLYWTVSEVFFHGQTVGKRVLGIRVVRTDGSPVGVYESAVRNLCRAVDFLPMLYAAACVSMLLTRQHRRLGDLLAGTLLVREERIDLDKYTAAPAASVPLPQSTGARPLSPEDVELVLSFLSRAPGLAPEVRQRLGARLVERVGPDDAEARAAVLASEERTEAFLRARVQGER

SEQ ID NO: 11699 - protein, 71 aa, Myxococcus xanthus
MTDEREDTTVYKVVVNHEEQYSIWPADRENALGWKDAGKQGLKAECLEYIKEVWTDMRPLSLRKKMEELKS

SEQ ID NO: 11700 - protein, 156 aa, Myxococcus xanthus
MSYMKGLVLFPVRKVFRKIFFVLWVKDCVDVASSALHHGYLLNHAMDRGDLRPEDMEGPLPGKIHDAIVAACAELDPRPVNQALRRLFVGSRLLMAEATRAFFSSDALGPRTPEPGESAEVKTLTERLIAALWEERGYFAALQQHYDTHLKARHTP

SEQ ID NO: 11701 - protein, 281 aa, Myxococcus xanthus
MREHGLTIHGAEGDFTVAVKADDDVQRFGPVDVVVLAVKNYDVASVLPAVKTLLSARGAPAPGETPPFVLTLQNGVDSPSEVAAAVGEAAVLGGTTYISTAISEPGVITQTGTNHRIVLGEVFGDTSRISDRAQSLRDALAGAGITVEAVADARGALWDKLSFLACMSAFSTASRLPVGALRDNPAFREVFRQAAAEVLSVAAAEGITTTRTPDALVQYMDGLPAHMRPSMLGDLENGKPLEVEYLQGSVVRRGRARGVPTPVMSTLYVLLQPHAQGERKA

SEQ ID NO: 11702 - protein, 386 aa, Myxococcus xanthus
MRERILGVDHWSGPNADMFYIGIHVNGGPHPFSLRGRLDSPTIFVDYRQYQPRLAEDFVARGGKLEVLPVDLDVLERLAQQHALMVVATGRNGLTRLFPRVPALSPHTQPPRMLFAALLKGVRMQEPIGMNANLIPGQGEIFESQVVTADGRVPSVLIEALPGSELSRLSTQRYDEDPRAFEAMLMNFLRRFAPTTYERVDSASFGVRGPMDYLQGSFTPTVRQGWAPLSNGRFALAVGDTHVTNDPVAGQGANAGSASAFALAEHIVTALADNRPFDEVFCREAEAGSWAATAPATHWTNTLLQPPPPHVIDLLAAGSKDARVADAIATAFVTPELILSACASPENSAAFIARHRPMVREAAPPPSPLAWHPPPEEPKVTVSLTR

SEQ ID NO: 11703 - protein, 356 aa, Myxococcus xanthus
MMTTPAALVDLDRVDANLKRVAMYTRQHGLRWRPHTKTHKTPEFAALQLAAGAQGVTVATVREAEVMATVCDDILLAYPPVGDDRLTRLMALPPHVRLTVALDSGEALEMLSRAARRAGRTVGVLVELDLGMRRVGVQSPEDAVALARAVTSSSGLEYRGITFYAGHLRMPQAELGDAMREQSVRLATYVDTLADAGLRPKTVSGGSTPTLWRSHEVAGLTEIRPGINIFNDRNAVSVGACPWEECAYSVLATVVSTTVPGQAVIDAGSKALAKEEGFTDTGVYGALLDRPDVLVRGLSEEHGLLDLSSTDWRPRVGDRVRVVPNHACASVNLHDRLHLLRQSTWAGTHAITARGW

SEQ ID NO: 11704 - protein, 551 aa, Myxococcus xanthus
MGTVFLANHLRLRGRQVAIKVLRHDAGMGAEAFVRFRREAEIASKLGHPNIVEVLDFDSLEDGSPYMVMECLRGMPLSRRLRKGPMTLEEVFSCARQMGSALQAAHRAGIVHRDLKPGNVFLVPTEVGGVMMEHVKLLDFGISKVIDSQSVHTQGGILLGTPQYMAPEQATGKNGEVDPRTDIFAFGCLVYEMLARRLPFRDNGNLPELIYRIVYDPPEPLEALVPDLPDHVIAAVEKSLEKRPEDRFPDVASFIFALTGRALQTMGEVPMLTPLSTPRLAVELAPESKPETVPGRRSGRGTEDEDVDVNPPDANPPFRESETVSLAAPAPAVAPSHDAATIAEAMPLPEMEAPPPRPVVAPADVVPAPIARSPVGRPPSAAPPGPSARKPTPRDGAVAGAQVPDEGVSASRGPEKPLAPAPLPRGADAAPPVRPPAGGAQAGAASPKVVPAPIARAPVAGGPSAPVAARNGPPSPGEGAVGSTVLLRSKAGVAQSASPGVLAAQPKRKLTPLTVAMMVALVAAVAFAVWPRPDPRVEASGKHAVPAAGAE

SEQ ID NO: 11705 - protein, 107 aa, Myxococcus xanthus
MDASGAAYVVRRYLESPPTAAELEAVLGRLGMEPWELVRMGEAAATKATLEMLPRDATHRADWIAAMVQHPELIQRPIVTASDGTTVVGRSPEALERVLAAERSSGT

SEQ ID NO: 11706 - protein, 614 aa, Myxococcus xanthus
MKAQPPKQQSFLVVLDSVDDTSKERVLVDPMVVDASGHTTIDWYVPTLDGKKIAVSMSKNGTESGDVTVYDVATGKPLPNETVPRVNGGTAGGSLTWTADGKGYFYTRYPRGEERPEADRDFFQQVYFHQLGTPTEKDTYVLGKDFPRIAMTELDTSHDGQHISAVVANGDGGEYMLYLRDAAGKWSQVSKFEDKVIRARFGHDGAMYLLSRKDAPRGKVLRLPLATPTLDKATVVVPEGEASIQGFFPTKSRLYVSEQLGGPSQLRMVDLKGKALGMVPTLPVSSVGGLVSQGDDDVLFINTSFTQPMAWYRYSAKDNSVKKTALARTSPLDLSDVEVVRAFATSKDGTKVPVSILKKKGTRLNGNNPALLTGYGGFNISISPNYNTLAGFWLEQGGVFAVANLRGGSEFGEKWHAEGSLTNKQNVFDDFHAAAKLLVDQKYTQPKKLAIQGGSNGGLLMGAAVTQHPEMYGAVVARVGIYDMLRVELTPNGQFNITEYGTVKNPEQFKALHAYSPLHNVKDGTAYPSVLFTSGANDPRVDPFHSRKMVARMQEATKAKNPILLRANAETGHGAGTPLNARIEEEVDVYSFVFNALGMKYQPPAKKVAAPKPQ

SEQ ID NO: 11707 - protein, 494 aa, Myxococcus xanthus
MRRILSASLLLVAPLVLSGCFRETRPEGDTLPSLARALFETLEAEGALASAYVVDAQTGEPLFTHREHVRLLPASTLKVVSTASVLSALGADFRFQTPVALEGTLDGGLFLGDIVVEPTGDPSLGSWRFPETALACEQVADALQARGIRQWRGQVRVRGAKEAEFPFGPGWAWDDAAYAYSAAPTAFVFRENVVDVALSRAAGAACAQPPTIQVTPTFATLPAVVGVDTNAERPSLACVRQRGGPGVRCLWRSTADTCPRSAAVRLSVDEPEQLFSACVEAALLARGIPRLPMTLEAPTPRQPAVPAPLVTLVSPPLSELVKVTNKESLNLYAERLGLRFARELTGTESYGALRTALTEELTRRGIPSRDLRPVDGSGLSRYNLATARGLVRVIFTSLREAYGTALLDSLPVAGLDGTLAARPVTADTAGHIRAKTGTLSGQRCFVGVVDRPGDARHPRVVFALMLGNMDDGTALPANEAFDRFTAGLVTLPLR

SEQ ID NO: 11708 - protein, 129 aa, Myxococcus xanthus
MAGCVVGYCLGARAGTAALRRMAGDAELGRLTRAAERMGPWFLLAFRAVPVLAETSVLFAGTSRMRPRTFLTVSALANLGVSVTYAALGASAARMESFLLLFAGMVLLPGLALAWMRRRTPPHPDPATR

SEQ ID NO: 11709 - protein, 141 aa, Myxococcus xanthus
MNEKSASYQSWLESFASEHGATAGTVHLQRGDDLFLVAALNIPPPLMAAVQHVPHGKGMAGLAQVRKQPVQTCNLKEDTSSDIKPGAKAVDARAAVAIPVLDATGRVRAVVGIAFTEEGSLAAERETSLMAAASRLPIADG

SEQ ID NO: 11710 - protein, 286 aa, Myxococcus xanthus
MNGKAFLTRHPLVDAAHFTYATPDAERDAAIMRRGGDPCEIPEDRGALYVRLEVEGHPVVLYNVHHTLGDSGINARNLRQLNALLQHREVMHAVALGDFNANTAIKSGGSWLMAHLRTYDDTDTVEEYEVRYGEPHASVGDEGVGNIADPRLRHELHVLEQSLPETIAHATTAQVRLPDGSLMTPKQACAELRSGRVQRGSEQWLRLQDIADSATLTSLPDENGVVPATGKRFDNLYASPGLVPRLFEVDRSTESSDHQPVVAHYDVRTPGLKDGKPAPGTVQRPT

SEQ ID NO: 11711 - protein, 193 aa, Myxococcus xanthus
ALGPFTDIDRPLVHDTAMGMIDATFFTSTTGAPYLVWKADGNAVGRPTPIYGQALSADGLSLVGSRQTLISNNLSWEGGVVEAPWVVARGGYYYLFYSGNAYYNSTYAVGVARATSPLGPYTKLGSPILKTGGGWVGPGHNSVVTGPRGDMYMVYHAWNSAHTARVMLVDAITWPNGWPAVPSAPSASSRPMP

SEQ ID NO: 11712 - protein, 176 aa, Myxococcus xanthus
MERNDEKGFFSWVTSLVRDHRGALAAVARNEGLLADDALDAVQDAFATFLGLPHARKLAYEEDDSRNLLAILVRNHSRNRRRRHELARPHLSDSEVVESLPDDRESVDSLIAHAEAHVLAFQCVEKLAAVQRQVVTLRLLEDQPGVRVADLLGTTPGNVAVLLHRAKRELRACMEE

SEQ ID NO: 11713 - protein, 82 aa, Myxococcus xanthus
MVRIAEDETRHADLSWAIDRWAVERLPSAEQEAVRAARQRAVAALREEVSAPTDAALLRALGLPEPEVAVAMVDLLSRELWN

SEQ ID NO: 11714 - protein, 591 aa, Myxococcus xanthus
MGSRNAAVFPEPVFAEAQTSPPRRTTGMVARCTGVGSSYPSPATARVSASDRPSEANVMGWKPWVARGRGSLPCPGGPPPEFLPPSPSRQGVARTPRGAGGVDSPRRGTARRVTSMRMAISTFPERLRAVLVGVQLPGVSDEEHAADFAELRRLVHTLGYDTVATVSQKRTRLATGTVLGTGKLKELAALTGGSGVIASGASDRTSKAREKWEAAANTEPDSEDEVVEEEADGVETEDALLPPPSEEDDKAEPRPTVVVVDHELSPGQLRNLEKATGAMVLDRAGVIVDIFHRHAKSHEARMQVEIARLNYLAPRLRESTGGRERQQGRGAGDSALELDRRKIRDRLAELREGLAAIQKDQDHRRYARRDLLRVALVGYTNAGKSSLMRALTGSTVLVADQLFATLDTTVRAMQPETRPRILVSDTVGFIQKLPHDLVASFRSTLDEALEASLLLYVVDASDPTWAAQLEVTRTVLRDIGADAVPSKLLFNKADRLDAAAKEALLAKHPDALLLSAHLPDDVAMLRKNIIAFFESSMVEADLVIPYSRQGRISEVYEHTTVVSQAYDESGSRLRVRGLPGAIAKLTQSFQE

SEQ ID NO: 11715 - protein, 199 aa, Myxococcus xanthus
MQPPVSGTISRASAQVRSAYVPQTSAIDSLLPLRAGELTAWGRLRGWSFLWPFARKADRQAVQSALETAGAKAFASRPYRELSEGQKQRTLLARLVATEADLVLLDEPTAAMDAVAEHETMQRLCTLSRERGLGVVVVCHDLEVAAEHADVLVFVDRETSAFVVGDARTVFCHPAFRRQYGDEYCQRAPLGPHRGNDAR

SEQ ID NO: 11716 - protein, 39 aa, Myxococcus xanthus
MKNIRLPVAVYRIDPPEHRRRMPLLSRMRSFWGRRSAAN

SEQ ID NO: 11717 - protein, 258 aa, Myxococcus xanthus
MYERITGEHPYRAPMRIYPAVHYTMGGLWVDYDLRSTLPGLYVLGEANFSDHGANRLGASALMQGLADGYFIVPNTIAAELARFGPGSVDLDHPAFRDAERIVQAKLERLLASRGTRTVEDHFRALGSLLWEQCGMARSERGLSSALESIQALQGDFERDLRLPDTGIELNDSLERAGRLADYYELAELMCRDALERRESCGAHFREEFQTAEGEARRDDEHFCHVSVWEYRGQDRPPALHKEPLSFESVAAETRSYK

SEQ ID NO: 11718 - protein, 140 aa, Myxococcus xanthus
MLGLERFVRNCGLEHPLLDLVKTRASQLNGCAYCIDMHTKDARVAGETEQRLYGLSAWRETPFYTERERAALEWTEALTLISQNDVTDELYDRVRQHFSEEELVSLTMAVITINGWNRIAIPFRSVPGSYQPPARAAAHP

SEQ ID NO: 11719 - protein, 121 aa, Myxococcus xanthus
MAQQRAEYIVKALAPPKKIWRFRNRPVSGVLDSVRRAGEGLYVVGLDYHVGFLWNDSARVWMCHASYLREATVVCEDALTSPAMVSRYHVVGKLLENRMMDAWLEGQVLPVFIPSGQEPTD

SEQ ID NO: 11720 - protein, 184 aa, Myxococcus xanthus
MNVLRAGLIVVLVWIGSLKVAEYEADGIVPFVANSPVMSFVYAYDAPEYRQHMNAEGALVPANRAWHEANGTYGFSYLLGGVIVLFGLLIAAHWWRPELGAIGSALVIGMSVVTLSFLVTTPESWVPALGDAHHGFPWLSGRGRLVVKDAIMIGAAIVTMADSARVWLAQRKPQPAEQFHRAAA

SEQ ID NO: 11721 - protein, 203 aa, Myxococcus xanthus
MRFFKMSVYLCTAVLFPACGGEDGVTGQDDALAQQESAVSSVSLDGCIYSISAYPQPNVTPTVYDVKLFRQPIPTCVYGYGSVTLGTSIVYEPTRSVAGNALGIAASYTKKSSLSGSAPITLSVHHVDPATLTVIRSSGLGVFLGAGNIVSENVAIAADGTTVTVSGSKTGVISGESGSGSHYTARYPDFFTSTTPPTIMAFP

SEQ ID NO: 11722 - protein, 112 aa, Myxococcus xanthus
MGMGGYNSQGLCATGVSRAIRNSLGIGVSGNGNQIDNNLPRDKFKQVNMSLEEALKIPGLVLTWESTSTRLGSIYGHTAVTLGDGHSSASDFIERNTTNSGRTGFKVFMPIV

SEQ ID NO: 11723 - protein, 143 aa, Myxococcus xanthus
MGASAMQVEHVGSTAVPGLSAKPIIDIDLIVADPTREDDYVPALESLGYDLIIREPSWHQHRCLRLAAPRVNLHVFGPDCPEVIRHLMFRDWLREHDDDRQRYAAVKYTSAEGMDDVMEYNRRKEPVIRDLYARIFRAAGWIR

SEQ ID NO: 11724 - protein, 68 aa, Myxococcus xanthus
MEARTVRLYECEPCDRSLLFARAVKPARAPKTPARAFVEYRDAAALKKPFPKGFVPWRYERFLTRQHE

SEQ ID NO: 11725 - protein, 64 aa, Myxococcus xanthus
MYLLPVLVVLIGTVALICYDEFVFHRRRCDRWEALLHRTLLAGHAAAFLAWAHFCFVRENLRGG

SEQ ID NO: 11726 - protein, 113 aa, Myxococcus xanthus
MHSGFGALRQHMNMNLRARSPGKGRAPGVAEDIARVQALWNDCRGRFGQGGPFLFGRFSIADAFYAPVVTRFVTYDVALDAVSAAYRDAVLALPALQKWTEEGRSEPSIPKYD

SEQ ID NO: 11727 - protein, 176 aa, Myxococcus xanthus
MHRLGRATSGLVLFTRTRDAAARLASDWREGRVHKRYRALSQGLAAQESYDIRAPIGLVPHPRLGEVHGASARGKPSHSTARVLERRTEHTLFEVDIHTGRSEQIRIHLAFIGHPLVGDPLFAVGGLPLAENPGLPGDGGYLLHAESLTFQHPRSGEHVQLQAPAPLELRVQDSWR

SEQ ID NO: 11728 - protein, 201 aa, Myxococcus xanthus
MAPLCIRALGMILLVAVLVWRDRQGPAQVGLAREGWAKELLLGVPVLVATYAVHIAASVPMAAVAVALKLADKEMLARKGLATALIDTGLDVPAFAAIMVLVTGFEEFVFRGFLVPRLRVVMGRWVPAVLVAAVLFSVGHFYEGTLAVFQTFVMGAWFGFVFWFRGRLLPLVVAHAAFNTISFALVMWLSKSGYLDKLPPL

SEQ ID NO: 11729 - protein, 305 aa, Myxococcus xanthus
  unsure (1)..(305): unsure at all Xaa locations
MLALRGGADIVVXTPARALDLVHQNALRLDQVETLVLDEADRLFSLGFADELNSLLALLPTRRQNLLFSATFPPAVRKFAEQLLHEPTRIDVDDGELPSTEFILQRALQVDVPRRTMLLRHLLETHAWSHVLTFVASRYTADHVALKLNRAGIVATSLHGELSQGARTRALADFKAKRVRVLVATDVAARGLDIAQLPAVVNYDLPRSTADYVHRIGRTGRAGDKGVAISFVSAGTEAHFRLIEKRHQLDLPREQVPGFEPTEEVSTTTPPRDPNGGVKGRRKSKKDKLREAAAAAATRPPKQGP

SEQ ID NO: 11730 - protein, 247 aa, Myxococcus xanthus
MKRLIQGLSLTSLCLSLAACGANKYYTLPVDSHDASTTKTSIGVCALESGLESQSMDNTAIAVTYDATSTMYYRYNGKDAYTFQVSVDDKQVPPEELEAKLATVRKKGEELYLCAQDRINPRFVAAPTHAPAQTNVTINLNAPDANSRDSLSAGASVSTNTNTASASTTSSSASVDLGEGTCARAVDCYARLAKTVCEGAQDCSFKVEMSGNDEASCRDALLRVPDLIQPFKMIRPNLSAPAVCRAE

SEQ ID NO: 11731 - protein, 372 aa, Myxococcus xanthus
SKAAPVGVHNLYGPTEAAVDVTYWPCPRGEDFHRVPIGRPVANTVLYVLDVHGQPAPVGIPGELHIGGVQVGRGYWQRPQLTAERFIPDAFSGIPGARLYRTGDVARWLADGTLEYLGRADFQVKLRGFRIELGEVEAALRAHLDVFDAVAVVREDAPGDQRLVAYVTGEPALDVAALRARLVEQLPAHMVPTAIETLPSLPLSPNGKVDRKALPQPRATPAPGAAAPLPVQERMTPFQQRVAALFRELLRVERVGLHDDFFSLGGHSLLATQLISRLRTTFGVELSLNALFDAPSVASVTELVEEGMLVRVTAPQIPVLRPVARDGSLPLSFAQQRLWLIDQLQPGGSQYNLPGAVRLEGALDTEALRRAL

SEQ ID NO: 11732 - protein, 31 aa, Myxococcus xanthus
ATEGALYWLDIPGRKVHRLELQSGAQASWDT

SEQ ID NO: 11733 - protein, 197 aa, Myxococcus xanthus
MVSPRTAPIRTGNTSTFILKQRRLHLVLLDPQEVPYAETEYVLTVGRTEHCGRTAADGSLSHEVPGLAAGELLVKLSKPPAPPPRRSAPPAATKGAPPPYPPAVTDEDFPDATPTAASEPVTLRWALQLQSLPGFESDALRAAQERLHNLGYAIEGERGSPGASTKSAVRAFQRRHGLPETGQLADISRELIRLHDA

SEQ ID NO: 11734 - protein, 37 aa, Myxococcus xanthus
MGYDFTTERRFCGLCLLRLRGWNTHALDRDGARNARP

SEQ ID NO: 11735 - protein, 1102 aa, Myxococcus xanthus
MMKRSRSPIRDGESEELAWLDLLRLHAAEQDLANAPEVSVVVPCEQTVTNDVTANVAVAHVPGWFDDAGQGTRPAIVMLSIIETHPDLPYQGSGTVSVTGDADLFCDSNCTTPAAEAFTAEALRATLPLFVRGNSAGNVTVTLTITPDANPNVRVIVPSATEVVGIQAINVVNPTVTVGEAIAWHHEEQFAAAQITLGLAESTGQPPYAGRGRPTVVGGSLFTDANCETPVDAFDAGALRHGVTVYVKGANVGNASVQLALDAVDSPGIRVAPPQTGDIPVQAINVVSPTVTVGEAIAWHHEEQFAAAQITLGLAESTGQPPYAGRGRPTVVGGSLFTDANCETPVDAFDADALRHGVTVYVKGANVGNASVQLALDAVDSPGIRVAPPQTGDIPVQAINVVSPTVTVGEAIAWHHEEQFAAAQITLGLAESTGQPPYAGRGRPTVVGGSLFTDANCETPVDAFDADALRHGVTVYVKGANVGNASVQLALDAVDSPGIRVAPPQTGDIPVQAINVVSPTVTVGEAIAWHHEEQFAAAQITLGLAESTGQPPYAGRGRPTVVGGSLFTDANCETPVDAFDADALRHGVTVYVKGANVGNASVQLALDAVDSPGIRVAPPRTGDIPIQAINVVSPSIRCDELVLVHGNHDNRSTDPSRLILEIDQTDPTHTCGDLNLRLDYGAQIACFRDQLCTNAVASGTTFAANQLPVTLYMRGVTAGNCDVSAEARGTAGSAWRLAARASKTVCVEKIELQVPTFAGGLSLNPDPLLNAPKQRELHAKNNQAFTFAKMTVTAPSNAFWQKADQLSLEHANLEVFDDAAGALAGTALLNQAHFGGHPVVRYFATQGNNPAWDAIPTHGHGIPATRNPVKVVTARYVSCAARISAAASADGIPRTLNHGDVVCLDTFSFDQHLDRLTGNECRTRALAGPANTDVALALAAAHKYYGRRTAFWVNRNYRAIGGSPFGLFLNSMNNPHGNNNTWATAGANWIENFLLNDHGIVLNAQMKTRIRNHIFAVISGATVIPHGTNAAYGFAALYGVPGVHAECLATNQLLAAGVAATDVTVATYMLQEQHQRQGRPFVACPNCSGILVAPGQFRVITG

SEQ ID NO: 11736 - protein, 98 aa, Myxococcus xanthus
GLFGQRILKLLSLFTVYVLRFGRLPLRVVFRFGHLLARADDQLGWKPTLLDQLYDQLLGDFSSERRDAVSKFLSDVGNDTSLIPQLTPEGIDLFNAST

SEQ ID NO: 11737 - protein, 245 aa, Myxococcus xanthus
MAYIDGFVIAVPSANKEAYRQAAIAAAPLYKEFGATRFVENWGDDVPEGKVTDLRRAVKAEPDEVIVFSWIEYPSKAVRDEANAKAMRDPRMQAMGANISFDGKRMIFGGFVPSLHEGGAGRPGYVDGSLVPVPVGNKEAYHVIASRLAAVLLEHGATRVVDAWGDDVPDGKVTDFKGAVKATADEQVVFAWIEWPSKEARNAGWGKAMADPRMHPGSMPFDEGRRSHGGFVPMLVETAATDTGA

SEQ ID NO: 11738 - protein, 77 aa, Myxococcus xanthus
MDRTTLTANLKPLERRGLVKTTVDPADRRGRLLTLTDAGLQLLQSALPHWEKMNEETERLLAQTDVDALRAGLRALS

SEQ ID NO: 11739 - protein, 147 aa, Myxococcus xanthus
MAFIDFLESLTGVQGLIPDPHFRGAGLHLTLRGGHLALHADFNRDRFRALSRRLTVLYYLNPGWEPAWGGDLELWSSDLSRCETRIAPLLDRLVVMAHGDDHWHGHPTALECPEGRGRAAVAAYFYTAEEAPNAPEPHSAIWAPPRS

SEQ ID NO: 11740 - protein, 398 aa, Myxococcus xanthus
MKTGPSEPLHLPEYLPALDGLRGVAVLMVIAYHSLTGLRSASLGSLFQVGWAGVDLFFVLSGFLITRILVQTRERGGYFRTFYARRALRIWPLYFLVLAFSFGIMGRLLPALAFDTQRYSWVTYALYLQNLWMTDFGPAPINVTWSLAIEEQFYLVWPLLVFFLRNGQLRALLWACVLLSPVARLAALGEGAAPIQVYTFTLFRLDGLALGGLLALGVVDGRATADGLSRWGARLAVPALLVACGLSLVFFGQGAAIHMATALTGPGGPKVRVLLVAGLYTLWAVGFASLLGWVLSGRARVLQAVLQWRPLRFVGQVSYGLYLFHALVIPAGGIYTRPLFYRFIPSTFVATAVGILFEYAVLLALTLVSWRFFEKPLLRLKDRFTHPEAAGKAAAPAA

SEQ ID NO: 11741 - protein, 253 aa, Myxococcus xanthus
MKRALMLRFVAIIALLTTTPTLANEEAESPAPIAESGPPLSREEALEQYELRHIGFDEYIAVTLSYSPLAVRSPPSRWTVPYEGKYKKPLEGAAFYQKLGRDDLVAEYQSRSATKLTLKIVGGVVMVGGLVYGIASPGVRTEDCELGPDFSACIDRNFAAGDRKRNMFLVGMGVSLVGVGLLGWGIFYNPHPIASSEARELADGHNKRLRQELGLTDVPAPAPGPRKRPYVIQARLTPVFGPNSGGLLVDGRF

SEQ ID NO: 11742 - protein, 170 aa, Myxococcus xanthus
MHAIDVEDARRAGLIVETPDQVRANWASDIARIKQAFDVAPALLQRWERWLGDDSYWPRFVTLTHGEMYPAHVLLAPDDTITGVLDWTTAKVGDPARDFVFQKMLGVDAVFEATVDAYVKAGGQVPDRLGDHCEELLAASPAGYALFALLTGLPEHRAAAQAQLNPEAAM

SEQ ID NO: 11743 - protein, 174 aa, Myxococcus xanthus
MTAALLSLSLAFTLVTGQFAPQQAGSDPLAPELETRAQTLGKQLRCAVCQGLSVADSPSSMARAQLDMIRELVSEGKSDAEIVEYFVARYGEWVLLSPRAEGFNWFVWLGPVGLVAVGAFVIWRQLQRGAGTPEQTPPAATTSEETAAPAAPAGTPPVDEEDPYLQAVRRELER

SEQ ID NO: 11744 - protein, 322 aa, Myxococcus xanthus
MQPQTTNWLPGIIVLAVTFVLAAGWILFQRRKGSLASAEPRDGVLDDLTQRAQSLIDQLRALEAEKHNQSAEQYAAEKSRLEREAAAALRAKDEHLKRKASGEGVRARPQAPAPTGWASRNPQLVGALWGAGIMVFFGGLGYLLVSEQQTRTDGMEATGRMPPGGAAAQQQGAGMDDQMQEGPEMQEARARLNANAGDVDAAALLSHELIRRQQFDEAVKVTAKGLAADPFNVELKVHRGVLRATQGDMAGAEAELTELVDTWPDAQEALIFLGSLALRRGDKAAALAHFERFSVEVPRNMQPPQLGPAIAQLRAEVAGGMP

SEQ ID NO: 11745 - protein, 370 aa, Myxococcus xanthus
MREEWAALMDASDAGPFNAWEWVYPWCRRIATGRRPLVLTARDAVGTLVGLMPLGVEYLGVTGIPVRRLSFLGETHVGSDYLDVVARRGREREVAGAFARMLHALRDEWDVLDLSDLREDSPTVDVLRETFARQDVRVAPRYVCPYDTLTPGEPFDAFLKRTGRRDNFLRRRKWLAKQEGYRIERTDAPGELAAPLTDFFRLHSARWAADGGSQGIKGSGVEAFHRDATQFLAERGRLRLYTMKVGGHAVASVYGILHRDTFVYFQSGYDPAWRNRSVGLVLVGETFRDAMEAGLTEYDFLRGTETYKSDWVSKQRRTLSVRVHAGTWEGRWFSQSESLARLLRNGAKAAMPDTLVEKVRRFRRRRAAVH

SEQ ID NO: 11746 - protein, 389 aa, Myxococcus xanthus
MKHSGRLFVPSLPTLWPHMLLSRPKPGELPPFSSPNVRYFYFARNAIWLTVKMLGLDSGEVLMPAYHHGVEVEALVDAGATPRFYRVGSRWDVDLDDVARRIGPKARALYLTHYAGFPGPVGEMRKLADQHGLILIEDCALSLLSSDGAVPLGTTGYVGIFCLYKTLPVPNGGALVVNGPRQYSLPEPPAPPSVSTFSHTVSALLQNLELRGGLAGRALRSAVRTLGHGTVKAANIERVATGTQHFDRKHVDLGMSPLTKRIAQAQDLESIVEQRRRNYFFLLGRLRDISAPLFNQLPPGACPLFYPLVVQDKAEVLARLRVQGIDAIDFWKRFHPACDASAFPEVAQLRRSIVEIPCHQDLTPEVMADVAQAVREAVKSDHRSKKRAG

SEQ ID NO: 11747 - protein, 100 aa, Myxococcus xanthus
MAYAWAGDWRYVSGVRVVRIRAWFQTEEDRKVGPTLAVNLEGKGNGMTDDSAALPRDAREAILLARGLGWSPEGRGTFWIQPEHGLELEALSVIAPDAST

SEQ ID NO: 11748 - protein, 372 aa, Myxococcus xanthus
MEARDLSASPRVTEVTGRAAFISLESEWNALVEVTSNELFYRHEFIRIWMDNFVPGVIPRVLTLRDTDGSLGAVLPLWEERTTLLGVPARQLSVAANAHSCRFDLVAKEPEVAAAAFVSHLRSAGGWDVLRLTDVPDGGAAWRLHAVARESGLPVGEWESLRSPYVPLPATRDALQKTLQSKFKANCRRRRRKLEEKGQLTFERVDSGLGLEGALEEGFLLEQSGWKGARGTAMAQDARTRGFYTELARDSAYRQRLALYFLRLDGRPVAFQYGLEYGGRYFLLKPGYDESLRECSPGQLLVDEVIGNCIDRGLHEFDFLGPDMVWKRDWTNEVRRHTWLYVFNDSPFGQALCAAKFRWGPAVKEVVSRWRR

SEQ ID NO: 11749 - protein, 160 aa, Myxococcus xanthus
RVTVSPRSPPPTEGLLEAIYTADLIAIGPGSLYSSVLPNLLVDGVAQALKETRALKVMVANLMTQPGETDGMSCLDHVQAVTDHVGPVLDAVLVNGTLPTEEATRRYARRGSFVVSANPRDLIGAGVVPVHADLLKAGSRIRHDSRKVAACLLKMARSGL

SEQ ID NO: 11750 - protein, 1027 aa, Myxococcus xanthus
MGLQFEELDTASRALVEMMLMRKTVADSNAPAVQPLPAIAPSVAPAIAPSIAPSVAPAIAPSIAPAVAPMAQSRPAPPVQARPAPPVQARPAAAPADVGGIALDSLFDDLEPEGGSSAPIPDEPLDLVPSVVEEPRTPPPSRVPVSYSPPPPVAADDVDIPLDELIASTPPPPVAALDIDEPLPGFEFEIESPSGDAPVAMGAPLDEPPIEVGISLEVEPSSAPAGGGALEFELDLGDSVAEPPRAPAVPPVRVVPPPAPVSSDGGFEFDLDLSDAEAAPPPRAPVAPKAPPAPVTSPAGSGGIEFDFDLAEDVSPPPPVAPPPPRAPAAPPPAPVSAGGVFEFDFALSDDAGTVPPPPPRAPSPVSAGGGGIDFDLDLSEDVEEAPPVVPPPPPRAAMVPPPAPVQPPMAARPLPPPPPVPPLLLKGFPKCAVRRLGHRSRRRRPRCSRPPWRRPPRRRPGLDEHGLPKTVFLPPPVPLSGTGPVIGIDLGTTNSCVALLSNGRPLVLRSREGYNTIPSVISLNAQNKLLVSHRAKNQLVLRPQHTIYGAKRLVGRPYDSAVVNQVRERFHYDIVPDSAGRAAVRLADTALSLEEVQALILRECKEMAEAHLNQKVERAVVTVPAYYSEPQREAVRKSGILAGLKVERILNEPTSAALAYGLNRELNKKVLVYDLGGGTFDATILKIEKNVFEVLGTGGDVFLGGIDFDNLIVDYLLARFQEKEGIAFTGDGIALSRVSDAAERAKMGLSERSTFEVHIPMLMMDDSGRPRDLRVVLSRQELEKICEPLLSRTIDVVRDVLLDAKLKAAEVDDIILVGGMSRMPLVRDKLKGLFGKGAQASVNADEAVALGAALYSGSVDKVSSVVLIDVLPMTVGVAMPGGAFKRVIERNSPLPAQRSFAINTTKDNEVFLELSIFQGEDSHISANEYLGTVRIEGLPKGPKGSVRVAVTLKLDSECVLHVEAREYSTRKEVKATLATRYSPEELQKQLQVSKESVKAAEERRGADLKERAGGFWSFVKKALGRK

SEQ ID NO: 11751 - protein, 83 aa, Myxococcus xanthus
MALREAVLCWTLFGHPTVVALCAEVAADTAESRARLDAAAVECFQLIAKHVEQAPQLHALAQGLAGSGGDETLGRMLVLLKGL

SEQ ID NO: 11752 - protein, 651 aa, Myxococcus xanthus
MISLRRLSSPRVSPDGKQVAYVLRTTDMEANRGRTDLWLVGVDGNAAPRQLTSHPDADSEPTWAPDGKSLFFLSSRGGSSQVWRLPVDGGEAVQVTKLPLDVGAFRVSPDGTRLAVALEVFPDCPTLECTPQREEERSKRKATGRTYDKLFARHWDTWKDGRRSHVFVVPVAGGAPVDVMKGMDADSPSKPFGGAEEFTFTPDNKSIVFAARDVGRSEAWSTDLDLFVAPIDGKAKPRKLTEKNRATDTSPVFSPDGKTLAYLAMSRPGFEADRYRVILRTWPGGQERVLTQDWDRSVGSLAWSADGKTLFASAGHVGQQPIFALDVATGKPTQLTKDGAADAPQPAAGGRIVYVYDDLDSPADLHVMNVDGSESRQLTHVNQDALARIRFGDFEQFSFPGWNNETVHAYVVKPVNFDPKKKYPLAFLIHGGPQGSFGNHFHYRWNPQVYAGRGYVAVMVDFHGSTGYGQAFTDSISDDWGGKPFEDLQKGVAAALKRYSFINPDKMCALGASYGGYMINWIAGNWPDGFKCLVNHDGILDERMGYFDTEELWFPEWEHKGTPWENPEGYSKHNPIEHVAKWKTPMMVIHGGQDFRVVETQGLGTFTALQRKGIPSKLLYFPEENHWVLRPANSVQWHDEVLGWLDQWTRK

SEQ ID NO: 11753 - protein, 55 aa, Myxococcus xanthus
MAYNSGRISRLSPSQLSVSGAPTPDVVISSPDLGATHGVAVYPAPANLPLFHRLP

SEQ ID NO: 11754 - protein, 218 aa, Myxococcus xanthus
MASGTVLLRLGVLGGLLAGSAALAADTADVPRAEAAPVGPESSSVQWQLLAGGLASLDGYASTGYQGWLLGAGWEFPRLRFRFQFLAGLPSSMVETRTEVKLEQYVFGFWLDTPMLRSGAWRWSVGAGAGFLLFGRTAFARVGGLDTAGPRFVPALLTGPDTSLRWRFSKYFAVEGSLAMDIVFGRPLIGFQSAQGFEPLHEGWAVRPRLSVAMMVFP

SEQ ID NO: 11755 - protein, 93 aa, Myxococcus xanthus
MNRTDFASHAPHGTFRHLLVLALLAWSGGCAVEDPVARVRVADGGTGTFSTDDDEALLLGEDDLELALPDCAEVEPDAGSGVACEDSGTPDAP

SEQ ID NO: 11756 - protein, 118 aa, Myxococcus xanthus
MAPVVLEVRPRVRTADAEVTVGSGAECDIVLAEPTVSRLHARLRREPHTGLWCVTDLESERGTYQDGVLILPGRPAPLLCRSRLTLGNVELLFLQTYAFEQSVRVSSLTPPVSLTRRR

SEQ ID NO: 11757 - protein, 96 aa, Myxococcus xanthus
LGGQALLLVHAGRSDGDFAYDVDELPAVDGNPQVSERRARNNAQGGGALLRYRRRLVGGSRLDALAELSLENRAIPGTVQNPQSTGDQELGRTASV

SEQ ID NO: 11758 - protein, 86 aa, Myxococcus xanthus
MLDSIGINALCFDSEEGYEAMCMGLIQGKPNITFRHDWKERIVIGVEEGVASIVLHDAKGTPHLKLAVDKDGATRVEEVKPAPASK

SEQ ID NO: 11759 - protein, 128 aa, Myxococcus xanthus
MGAAMGLSAVVFWPPFAARMDFIMFAVAVTAFHNVQYHGVVWFYHRNRYHAAGVDPAPFGWAPKVSQRFVIYAVCGVIFTLLYRGLGCGFGAHPGCGGFDLKVPLGAGLTLRNLMECFIWGLALHHYY

SEQ ID NO: 11760 - protein, 206 aa, Myxococcus xanthus
MSEPITVRVWSDYVCPWCYVGYAEVQKLKKEYDVQVDWRPFYLRPETPPEGLPLPDYVREKMKDPNNPLKLRAQAAGLTLVMRELTPSTRRAHEATEYAREQGRLEPFHAALLRRYWSEGQDLWQWDTLRGAAQEAGLDPDAVQRVVEEGRYTKAVEDSIQEARTIGVNAVPTFVLGERFGLQGAQEYSVFQEAMRRLGATPRAQP

SEQ ID NO: 11761 - protein, 92 aa, Myxococcus xanthus
MMPRTLTLTFVITVSALLTGCFSDTDTICEKRKECFTDTLNVQSCEDDLKAWMERQDQDRRRDQLAACGDCVGSKTCSQIRTACIGACFGVP

SEQ ID NO: 11762 - protein, 182 aa, Myxococcus xanthus
MATYRGYTAPTDEKALLDRLHLANQHEIKSGQLAQQRSQNPDVKAFGTIMMKAHTALDQKLTSYARSKGLKLAESPKPMNDAEEASMAKDKATMEQLQVIRGAPFDSAYLASQVTGHDAVLGMVLTAQKAMPKATPELAALLEDLSKQVPAHRHQAWNMLGKLGGETGVGGSGPAHAPPPKP

SEQ ID NO: 11763 - protein, 130 aa, Myxococcus xanthus
MEWAGVGSMVLGAVLALVVLATRQQLPAGEAYRRFRLNLGRAILLGLEFLVAADIIRTVSQRPTLDGVLVLGLIVLIRTFLSFTLTVELEGRWPWQHRKDIAGPVHPPPTSSTPQHPVPPAPDAPRPVKH

SEQ ID NO: 11764 - protein, 575 aa, Myxococcus xanthus
MAVGLLCVPQAAWAQSSSLKDEVKERLGRVETELDDWDVPGARRELSEVEKLLPADVEPLKYFQGRVAFEEGRYDDAVVLLEGANIEDKPGSYLRLAKDTRAIVKDHERAESEHFIFQYPKGKEAVLVPYALETLEGIHRAMKEDLGWTPPGGKIRVEVVSNARELARVSTLTEKQIGTTGTIAICKFNKLMVTSPKAVARGYDWQDTLAHEYIHLVISQMSRNTVPIWLHEGLAKFLESRWRGKAGLAMTPSTQALLGKRVKADTLIPFEKMHPSIALLPTAEDAATAFAEVFYAIDYVHSVKGTAGLRAIIQELKAGQKDRKAVETAMGMPFALFEKSWLAHIKKQPFPTELLPREDRVVLKENAKGKVKDESEKKGREISFGDFQEVTEVPARKFAHLGELLRERNRVKAAAEEYAKAHKLVGDKYESVSNKYALALLELRRLDEAEGVLRGSLRVHPGSPSTNVHLGRILLYRKDYPKAKTAYLEALASDPFDPEIHLALTRIHGSMGETALADRARQASALLTGLKVEEVDRVAQQFLRDESGLSEMNVSGTPDAEAPKEAQPEKPDAGN

SEQ ID NO: 11765 - protein, 990 aa, Myxococcus xanthus
MLGVATVALLLVAGGFLALVAPRAGASLLWTALPVGVAVTCVFGLWLARRRVGDDVLTARMVGEKRPELSLDVLAAVELMREPDAPGSGSPALASAFLREMDARARTVDVRTVVDSRPVRHVALGAGGALLALLVLMVALGDRWSAGMARIREVAASPKAQAQVEPITGDIELTYRYPAYTGLAPRTVPGTNGEISAPAGTEILLKTRSDRPVERAELVVNGQALPLTVTGNRDLEGSFVTKQSGHYRFAFYGARDKALAVGPDIALTVEADKAPEVSLLTPTVELEIDPGDQVALKYEASDDYGLSGMALVFRAPGAQQETRVPLPREDGRRHRGTYSWSLDNLKLDPGDRITYYVEAQDNDAVEGPKKGVSRTQVLRVYSAAEHRRAALEKAEQLWGRMVDHLADRLEGPERAKQKDPQAITAGATVDTSGESLVADMKTLAQELARERDVPTELVSALSNISESLGSHIRGTAELRRLYLRTQRARGEDWGTGNRLTAVVNEEITELEKDILYLESLLDRQKLEALQEMARQLSNERRELANLIEQYKSNPDEAARQAVMEQIQQLKSRIQELMQRMAEMRKGIRDEHLNAEALSEMMKDQDLRSALDDVEKLMREGKADEALAKLQELGMQMDEMLENLDQASDEFGGEQHPELAEKFGKFMEELQGTVQEQQRVADQTKQLRDQARSQNRERLSEKGEAIKDSLMRKVQQAQEDYKALEPSQLNSRAARPLEEAQAELQNVENALKVNDYDLAAEAAARAEDAARQLAMMGEQQRHLDEMFGNPEEVVKQSTELAQRLNRDARNVSEVNRQLQSLFPPPGSQLSQQEKQQLQQLGEQQSQLEERAQGLRQQMDEMQQMAPIFGEEATQQMEGAGQRMGEAARRMQGKDPGRGYGEQQAALEGLRQFQQQMQEGQRGGKGGLPLPMGMGRRQQGNGRDPKQKVELPDEDAFQAPKEFRKDLLDAMKQGAPEKYREQVKRYYEELVK

SEQ ID NO: 11766 - protein, 135 aa, Myxococcus xanthus
MESTLGLTGPQRLVIRLVGRFPDITAGMLAQILHVHPSTLTGVLKRLEKRGLLERKSDPLDGRKALFSLTDEGRALDIPSEGTVESSVQRVLSRLSRSNIVATQEVLTALARELGGVPMPEVEYDEAGARKQVVR

SEQ ID NO: 11767 - protein, 567 aa, Myxococcus xanthus
MNRRLTNLLTALPVTAALVAPPVLACTSMLVSKGATADGATFITYAADAHELYGELYFTPARRHAPGAMRDIIEWDTGKFLGRIPQPAATYSVVGNMNEHQLSIGESTFGGREELEGPAGIIDYGSLMYIALERAKTAREAIQVMTTLVAEHGYASTGESFSIADPKEAWLLEMIGKGKGEKGAVWVARKLPDGYLSAHANQSRIGTFPQNEKQTTFYSPDVISFARAKGWFKGADKDFNFAETYNPIDFGGQRFSEARVWSIFRRAAPSMKLGAEYADGAAPQKRLPLWVKPDKKLSVQDTMALMRDHFTGTPLDMTKDVGAGPYAAPYRWRPMTWELDGKQYVHERAISTQQTGFSFVAQMRDWLPAPIGGVLWFGVDDTFTTVYTPMYAGIRQVPRNFAQGVASRGEFSWDSSFWVFNWVSNQAYGRWSDMVNDVQKEQGALEGQFLADQADIEKRAQEQFKRSPEEARQYLTDYSLQQGEKVHTRWRKLGETLLVKYIDGNVRDEMGKVNHPKFQEAWYRRIVQENGKALQMPAKPAEPAAAPAPAPAPAQKPAPKPTVAPAP

SEQ ID NO: 11768 - protein, 83 aa, Myxococcus xanthus
MLTAGKRLAVFSIREGKGGSIWVRAGSAFVNKDGSLNVLLDVLPLDGKLHVREAAEKRDTAGMSGGRYAGELGLDAAPVGGHS

SEQ ID NO: 11769 - protein, 274 aa, Myxococcus xanthus
MKLGGYVLHRNNRDTLEPCLRGLLALCDDVVALDSGATDGSAELVRSLGARSVPHAWRGYGAAREAAVNALAPCNYVFFLDSDELLGPEAVETLRAWKTSSPTEAVYRLPRRDWAELGTHRFRYRTQWRARLVRRDKAVWRPEQIVHEALPKLAGGRVRAFIEHRFATSVEYRAQKEDRYALLWALRAHAEQRGLKPVGVQRLASWARDCLLKGALWRGGAEASRLAWAVAGYHATKYAYLRELRQGRYPELVRLYAEGRYDALFARVRDGALS

SEQ ID NO: 11770 - protein, 864 aa, Myxococcus xanthus
MADPREDEDRKLTEERLALLSVLQELTVAALDLFDPSKPADAFMDRVAERLGCMVALWVQVNARGQVILQGASGLSAASRQLPIPARSEPGGKQGPAEVNLPFPELEMPGLVRWSIPIIGADAAHSASALLLYFDREPQLPRHYRGMMERLGGVLRTALMHRQLFTRILESERALHQKKTLLESLSEASDEGILISTQEGRTLTHNRRLVQMWGLEEALLSAPYGAWVRAAAELVEEPARFMARAAFFIEHRDASGHDELRLKDGRIFEQYDAPVVSADGVYYGRAAYFRDVTARRRTERDLQHERDFSSAVLDTARALFIVLDVEGRIVRFNRACQEMTGYSFEELRGARFWKQLQAPEEAARVERDFAQLSAGQGHEEYESCWLTRAGERRLIAWSSNILRSPSGAVEYIIGTGIDITEQRRAERERDQTFLREQQARTRAEEQEGRSAFLAEASGLLAGSLAPEDALRNVAALTVQRFADWCTVDLLDNDHSPQRIAVAQSQILRARWPAKDAHAPPDLNATHGPGRVLRRGEPEFCLEGCGSSALECGVLEFQSWLSVPLLARGRTLGALTLARLDDGSRYGLAELSVAQELAPRAPMAVDNARLYREAQQAIGLRDEFLSVASHELKTPVTSLQLSVQGLLRRARSGALCTASAETVTQSVEGIERQAMRMAKLVNTLLDVSRIHAGRLELELEEVDLAALVRDIAARFAPELALSGATLQVHADTPMPGIWDRSRLDQIVTNLLSNAIKYGEGKPIEIQVGGDARTALLEVRDQGIGIPTERQALIFRAFERAVSSRHYGGLGLGLHIVSQLVERLGGAVRVQSEAGRGATFTVALPRSGPAAPRPAPADMHLDANHA

SEQ ID NO: 11771 - protein, 268 aa, Myxococcus xanthus
MRPGRRRALLVFPDALSGNPTEVVRGAQQEAGAGVVWAGGGAGGDLRSAMTAQFTNGQAYRDRVVVIAFDAQAPIGVGIQHGWYPYGPPTQVTKAHGATAIELDYESAFEVYRRTAASRGDALDVQGFARFAMTHPLGIPQANGEFVIRELISIGPDGSVRCVAEIPDGSLVRVMEGARADLLDAAAGAATLARTGTPGALGGAVVFDCFSRYPILGEEIQDELSRVQGALGEATPLVGCLTLGEVGAMGGGVPQFHNKTVVVLALPG

SEQ ID NO: 11772 - protein, 145 aa, Myxococcus xanthus
MVLGAQFNSFLHPVTVLTILPLSVAGAAFALLATGSTLNIFSMIGLLLLMGIVKKNSSILVDYALQERERGADAFQAMLRAGPVRLRPILMTSTATMMAAVPAALALARARRRARPCPSPCSAACPCPPCSACWWCPPSTSSRTG

SEQ ID NO: 11773 - protein, 62 aa, Myxococcus xanthus
MSIAVLGGLSVSTVLSLLVVPAFYVIADRMKTRVGARLGKKPDAESGPHPPRTDEPRPATHD

SEQ ID NO: 11774 - protein, 104 aa, Myxococcus xanthus
MSTPVEKQEWFRVAEAFEGSGLTQKAFSQQRGVRLSTLQSWVYRRRRQQPEKAETVRLLPVEVAGMAQPGPALLEVVLASGACLRFASGTNVEYVARLVAALGR

SEQ ID NO: 11775 - protein, 95 aa, Myxococcus xanthus
MALVRAEWGEDVYSGHLFAFVSRRGDRVKVLTWSRGGFVLLYKRLETGRFWLPPVDAGAQVVHLDATQLAMLLDGIDVAQVRRQPAWTPPGRTGT

SEQ ID NO: 11776 - protein, 199 aa, Myxococcus xanthus
MAQVKAVLLDLGNVLVFHDNTLLFSRLGARAGLEAAEVARRLTGAGWTDANRGVLGAEGIRQDVCRALDVDLPMAEFAPLWSSHFTLHDAVLPRIESLVGRVRLGLVSNTNALHVAYLRPLLPVLQRFDSVVMSCEVGHVKPEPDIFRLALTGVGCAPEEAVFFDDLAEFVQAAEAVGIQGRLFTTADAFDAQLKALGL

SEQ ID NO: 11777 - protein, 88 aa, Myxococcus xanthus
MLCLHCHTVALGEKPSKRATLALIFATVGFIGFVPGLVGLVLGYQELAAIRRGAAPGSGEGWAVLARNVGWFHMAMLVIIGLGVALRG

SEQ ID NO: 11778 - protein, 119 aa, Myxococcus xanthus
MLYFLAGVNTLLGVIGLLVESEALEAAGMGLGSILFGVVVAVLGFFTYRGTRAAPILAGILYIADALTTVVDTVTEGGRVPVVALIIRAYIIITLFTAAKAAAELRRREQEGAGVSLQP

SEQ ID NO: 11779 - protein, 69 aa, Myxococcus xanthus
MTYEDRIEQQLLDARRELEQADKDLATGTEAARVRYARALHEADIAERRALRHAREARNHQKSWRLVAG

SEQ ID NO: 11780 - protein, 322 aa, Myxococcus xanthus
MAYPIHRPRRLRRNAVLRDMVRETRLDPGDFIYPLFVVEGRDVRRPIVSMPGIFNLSLEHVVAEARHARKLGVPAVLLFGIPNHKDARGTQAYADDGIVQRAIQEIKAAEPDLQVIVDVCLCEFTDHGHCGVLEGGHVVNDATLALLAKMSVSCAKAGADIIAPSDMMDGRVAAIRAALDETGFGELPIMAYSAKFASGYYGPFREAAQNTPTSGDRRGYQMDPGNVREALKEVALDVEEGADMIMVKPALAYLDVIRAVRERWELPVVSYNVSGEYSMLKAAGQNGWIDYERVMLETLTSMKRAGSDLIITYHALEAAKLL

SEQ ID NO: 11781 - protein, 60 aa, Myxococcus xanthus
MRMSETGSPTAALAAEYTREHVEWAAPMISPLSAHERLARLAGLDEPEPREEGLTLEPEE

SEQ ID NO: 11782 - protein, 206 aa, Myxococcus xanthus
MAASRQGGGRALRLVSGDAQPDSPYPKASLWLRGGARAVDVSVAWGLYVVGGAAGAVVALLFLLLADGMLQGQSVGKRIFGVKVMHLPTRSAARHRDSTLRNAPLALIVLLGMMPAPHGTVAAAAGLIVIGSVEAWCVLRDPLGWRLGDTWAQTQVVDGKVVAGVTVAARTPVAHERASGRLMSAAKVRRGRSSFRKRRGYPCASR

SEQ ID NO: 11783 - protein, 613 aa, Myxococcus xanthus
RIALTHNLRLSDLEEEAEFDTQETVNALAAAIESIGPRLERFEVSGPASRTVARMEAYSRDLIFNTAEGRRGRFREAFYPALFNDLGFPYKGSEAYAQPVTLDKQLTKVVLSKQGIRTPGWQYVEKLSELSAENLRFPVIVKPNCEGSSKGISQDSIAETLDEVRAKVAAALEKYPSGVLVEEYISGRDLAVPFLESVDNDYDGVLSPVEYVIDPAVTQGRKYAIYDYALKTSREGTVSVRAPAQIPPRTAEDVRRMAQKVYRALDCRDLGRIDVRLSDAGVPYFLEINALPSLEPGAGIYAAAELDGLHLDGVINSIITSAAKRYKIKDSSRRQGKPARKSGPLRVGFSFNVKRVKPTATAEAVEDSEAEYDSPNTLQAIREAIASWGHEVIDLEATAELPSVLSSTPLDVVFNIAEGFKGRNRESQVPALLELLDIPYTGSDPATLSIALDKGLAKKIVRQAGILTPNFQLMATGKERLNKEFTSFPLIVKPVAEGSSKGVVTKSVCHSEAELREVVREIAGKYQQPALIEEYIRGREFTVGLLGERRPRVLPPMEIVFLDREEKNPVYSFQHKLDWTDRIRYDAPAKLEPALLERLRTAARNSFMALGCL

SEQ ID NO: 11784 - protein, 58 aa, Myxococcus xanthus
MLAAGSRDPERFDDPDRFMPDRPNNSHLGFGSGIHYCFGAPLGAVGGTDRFDRIRLPP

SEQ ID NO: 11785 - protein, 288 aa, Myxococcus xanthus
MAQASIFEQILDPANRANPYPLYAELRKTPVAREADGTYIVSTYDEIVALLHDPRVSSDIRNLVRQAGATPSPQEGPPGLPEPFIRRDPPDHDRLRKLAMRPFGPPHTPGRIDALRPWLVETTTGLLDALAGKNQVDIVGDVAYPFPVTVICKLLGVPREDEARFHELADAGVETLDPTTGTIEQRKAKRDRTKAELGQYLAALADAHLRQPGGDLLSGFLTDNGPDGRMSREEVLSTAALLLVAGHETTVNLIANGMLTLLRHPGVFERLRREPRAEHPAGRGAAAL

SEQ ID NO: 11786 - protein, 136 aa, Myxococcus xanthus
MLSPEADRWPHLTIPTFWSTQFGVNIKSVGVPTFSDALVITQGSLAERRFVAVYGYKGRVTAAVAFDQPKWLEFYQGLIDAAAPFPPAFRTVHQPAEMRPVPPEFPKRAVSEHEATVMVTGREPYERRVRWVYRHL

SEQ ID NO: 11787 - protein, 559 aa, Myxococcus xanthus
LSGAEDPAVRAALRGDVSPADAMLGVLQSRYLTLNGIVVFDDTGRAISANTPALRDEYLRRQDEVRRSPWFAEAQQGRTSSEGITEEHPIFTGHVLSLAFPVLDPVSKHRLGVLLAAFDWAHVDQLVQPALARAHQRALKSFAITLQRPDGTPLYDSRGANAQGNDALLAVTAVNGTDVRDVADGWHFVARVDPAEAYAPVVRVNRVALLMALGFIVLAVGGAWLLSHRISGPVLALRAAVTRLVSEGDLTQTLDVKAGNDEVGELAGAFGLLVFQLRETAQSLHTGTRVLSETVAELQTASTQQERNVARQAAALQQTQVTAQEIKQTSMLASEKAEDVLNRASVAEEVGRAGEGAIRDSLGGFSEILSQAEQMTERIAQLNERTQQIGGITQTVKDLADQSNMLALNAAIESVRSGEHGKGFGVVAREIRSLADQSIQATDRVREILGDLSSAILSTAKMTEQSYTHMESGLEQVRGTGERLKELAAIIQDNATAVRQIAGAVSQQNAGIAQIFSAVTDLSSMMNDTQESLAATTRAAKLLQDVSEQMQDVARAYRI

SEQ ID NO: 11788 - protein, 193 aa, Myxococcus xanthus
MTSDLDRWCGGNWYASAIFADGHDATTSALVTNNIFEGNGTGVLLYFHALADVRRNLFWRNDYALAFNHLQDAAVVEENIFWKNTSLALGVQAGQVDIRRNVIAGSAVGLSHMYVQTGDIRCNVFFQNDQHVAETHAVPPRVVLGENGNVVLEPLFRDADAGDFRLRPDSPLKLADCLGDVDVTFEGLGLVAP

SEQ ID NO: 11789 - protein, 405 aa, Myxococcus xanthus
MAWPVTVLAALLGVAWLANFVTKKILLRGLHHVIERLSGPEHDTRLALRAVERLSNVVPSVVIASGLSLVPGLPAALVVLLQGACHVWTVATLALAASHAFDASNAFYERRPDARNKPIKGYLQVAKIIVFVLAGLSIVATLAGVKLLHVLTGLGAATAVLMLIFQDTLLSLVASVQISGDGRVRIGDWIEMPSQNADGDVIDIALHTVTVQNWDKTITTIPTKKLISDSFKNWRGMRQSGGRRIKRSIYLDQHSVRFLDDALQPRIYQFALLDDYLASKREELGQWNAQVAAVHPEPVNARRLTNLGTFRAYVERYLRTHPRINQNMTLLVRQMAPTEHGLPLEIYCFTASTAWAEYEATQSDIFDHLLAILPEFGLRVFQQSSDAMFMGLQRAQDCATPVVRG

SEQ ID NO: 11790 - protein, 80 aa, Myxococcus xanthus
MGVDNRKPAATDDIAHTLNYKAVSKRLIEFVGQSDFGLVETLAERCAAIVLEEFGVQWLRLKLSKPGAVRGARGGGAHRT

SEQ ID NO: 11791 - protein, 158 aa, Myxococcus xanthus
MSAPGYQPITKEQIPVVPVQGGGEATEHSRVRIIAGSYGDAKGPARTFTPISMLDVKVRAGEDFNLSLPSNHNALVLVANGRVTVDAESIRSGELAVFANDGETLSLRAEEDTHFIVLAGEPIHEPIAHTGPFVMNNHREIIQAIHDFESGAFGGIPE

SEQ ID NO: 11792 - protein, 272 aa, Myxococcus xanthus
MQRLEKQLGLRLFDRSGRVPRLTAKGEAVVAAAQRLHEDIASFQAVVGRLKSGEETKLALVVDAMFPTDALLDFVRELARTHPGVELALEVELLSAVTERVRERRATLGIAGADLDLTGLEQRPIALLKMIPVAAPSHPLAAVKGVLTEAHLASAIQIVLSERLPEGKTGTADRGVIGSRLWRVADLMTKHSLLVGGIGWGLEPEHLVRDDLAAGRLVALRLAAWEGGPPPQRPLALVRRKGTPLGPVATWASNRLTSLCQLALGGADHHTT

SEQ ID NO: 11793 - protein, 455 aa, Myxococcus xanthus
MAAGLFAPYFHDVYAQSSALPARLVLVLECNGVYPRALLSTGTRAALGGRANTSDRIFWDAYKDTPMVREGDNLASAISLGPLAASSGNIDLVNRSAVLLGLSNLIAGGGHSSGTGGLSCAVNGAGATFDAVIAPRLRRGAPFDVLRLGTSSARVSIVYETCALGPRKPAGIIVNPSLAFDSTFGSLLGGSTNGRDRKMLFDFALADSRKALAEFSGNSNERLKLERYVSSLESLRTREDQLEGMADRVRPYLPPAPKDNPLITGAGSPPDSLKWFEAQFQIATASLLGGLTNTVVLATGTSGFDVAYGPDVTDIPRHSLQHGLDAGQNWDRVAEVTRRHVQLVANLARTLATTPEVGASGSMLDHTAIVFMSDNGEQHHSTSREWPKLVVGGNALGLKTDGRTVVYPKYDAARNRQVSNLFNTLGHAFGDADFNTFGQEGSTRIAPGPLSELYG

SEQ ID NO: 11794 - protein, 692 aa, Myxococcus xanthus
MDGGLSNAQRALIRMRDDASPMPPAPHERASAADLAALETWIGEGMPVCSVLGGPPVTVVPEPNLLDQSALFSCTEGVRSDAPTRIRRLNRREFTRNVGGSVERSWTGFSFYDNPLDPSAIEQYSSWATDETLDEATVELFLPVVGEAAAPWTMNYPDGNRMERVYTNSRFRCMFDDANPSDSCKRFHLGQMLEFGVFFRPPTEDELTRITAFATEVIAQEPSYSSRNRADSITRISNAAWMMTGAMFRREMGAEPADGRVELTSLELGSQLAYALAGRAPSATPSFVWPYFSAPLEGHLADVATAAKDGSLTQDATTTALIEKYLGGVDAHQNGTPRFDLVQDYNEEQRSKRGQYWLGDGVAGFFREWLGYGHVAAVFKESPAATSRFELEGLGYISSVSYENLLTNFHPLEPTFIQQFDDLIARVVVEDKDVLANLLTTRTFYVPSMQHAAYDSHKGLSHPYNVSEILPATVAGRWKTLPATERAGVLTHPVWLAAHGGNFEDDPSIVHRGKWVRENLLCGFVPPLSSVQVAAQVGAHAADKNARRRLQEATAGSQCQSCHRLMEPLGLPFEIYNHAGFLRARDHSTSGGWTTPDGSSTLTSMPDPALDGPVRDAVELSERLAASRHVKRCFLRQAFRYFMGRPENASDACTLTQMEQAYDQNNGSFSKMLTTLMTSDTWKTRRVPQAGE

SEQ ID NO: 11795 - protein, 412 aa, Myxococcus xanthus
MTKAPMRLKAIVNHVDTHNSDRHSAGEGHLVFDAIDADGKPLPLTATLVYDLHASKPSDALHWARQWHALATQTPGTEAFNTTLQAVTDRFTAAPGRLQVSTTESVLDSARSKSTDARRLAKDFGNLLCTDSAAPTVTLLSPSPDSAVRGTITLTASAYDDVGVTRVDFFSGSTLIASDAQPPFIVDWDTTTSPSGTRALTAQAFDADGNMGISDPVSVMVDNFAPIILSGTPQYNPQTLNYVRGNITVGWTVTDQSLSGVVLAEFFQEGYLKGSLTSPTSLGYTFPWDTRVLANRSYSLTLRATDRAGNVATHTRSLIVDNAPPTSVLTAPANGDVVSGVVTLAANASDSQSLYYVAFEIDGVIQTPYSTTAPFTRTWDTTGKSGTHVIVAIAYDRVGNSQRSNAVTVTVP

SEQ ID NO: 11796 - protein, 355 aa, Myxococcus xanthus
MLFVVAAVLMFTGQGEEPAMETPKVEFPRRMRAPERERAERRRTHVMPVQVDAGTQERARPRDPLLAALPRGEGKTAVVIEANALRHSPIGELLLDCLMRDGGKRLQELRNLSGVDPLQDLDRLVITDEGMMLSGNFGNAKFKELLGERVSMDYGEGARVYEPGDMTVTRPDGSTARGRSEAAVATWNNELLVIGKSPDEVKAVVDRVEGRGPDEPPAISEGSTYGEMYGVLSVDQLARLLPKEQAELADRIRRVAQNVELHVDASGDVAMVAEVRGANGDEVTDLGKTLGAALSMARIKAQAEGEKDLAQLLDFARVQPDGTSFKLEMAVPLDVIKQRLAFCKEERSAAEAAER

SEQ ID NO: 11797 - protein, 179 aa, Myxococcus xanthus
MSPGRIEHLLALPIQRWHLLAGTFLGVMVLALGGTLYGTTGLVLIFGVKAGYWTAGPLIAGLLACVGFAAVYAVMLTAATLVRSAALCAASGFVFLVGGIIAGYRQQMTPFFEEGFGREAFRAVTLVLPRLSALAVAAGDIAASTPLEVRSLGLLLLGVLVFGFGALAVGFWRFEGKDY

SEQ ID NO: 11798 - protein, 292 aa, Myxococcus xanthus
MLYAGIAGSVLVGILLGLLGGGGSILIVPLLIYVLDVEPRTAIAMSLVVVGVTSASSAFLHARAGRVRWRTALVFGAGGMGGAFLGGRLNPHLAPDTLLLLFGSVMVAAAVAMLRRREAGPAATSVSPLPAARVLAQGIAVGALSGLVGAGGGFLIVPALSLAGLPMPVATATSLVVIALQCAAGLVGHLGHLDLPWVLTGEVLLAAMTGSLVGGRLAGRVSPAMLRKGFAVFVLTTAAFLLGAQSPAPLRERVWTEGLWLWSVAPLAVGIPVTVWRLRVARQRQAAQALPR

SEQ ID NO: 11799 - protein, 115 aa, Myxococcus xanthus
MDLTVPEGSAFGLIGPNGAGKTTFIKSILGIVQPTEGSIRVLGGSPEDPRIRARIGYLPERLHLPGTWTAPAFLATVTRLKGLPVDPAVNLRLLERVGLSDAVGRRSGGYSKGMR

SEQ ID NO: 11800 - protein, 138 aa, Myxococcus xanthus
TSNQTLAEQVHVSPPTCLRRVRRLHELGLIEKQVALLQPDRLAQLQGHGLTAIVEITLDQQGAEFLQAFETRVVADAQVQQCWRVSPGPDFVLVVHAHDMPAYHALAQRLFTHDANVRNVKAFFATHRAKFDTRVPLL

SEQ ID NO: 11801 - protein, 30 aa, Myxococcus xanthus
MSPVPFDDRGAARIYFGAAFTSVWDNPAAP

SEQ ID NO: 11802 - protein, 215 aa, Myxococcus xanthus
MGMKEVPLVKRFEGNRAHFADGTSATLDAVILCTGYQHKYRFLPNALRLESHNRLYPPGLYKGVFWQGQPELAYLGMQDQYYTFNMFDAQAWLVRDVIMGRTALPSAEEREADIAAWVEREEGIQDSFGAVDFQTAYIRDLLDRTDYPGFSVEKVAELLKQWLRDKQEDILGYRDRTFTSIVTGTRATPHRRKWMDELDDSAESFLAEAPERRTG

SEQ ID NO: 11803 - protein, 91 aa, Myxococcus xanthus
MAWSRDTRPSSSGPTRRHGGLVEALTRTGADVTRASLVQHLEALRDFDTGVSPPVTVGINRRVGVQGAQFAALDVATGGLVAASEWIPLTP

SEQ ID NO: 11804 - protein, 37 aa, Myxococcus xanthus
MRPPLVAAAQQAGYSIVSEYDGLPDHYLLFLQPASSR

SEQ ID NO: 11805 - protein, 574 aa, Myxococcus xanthus
MDVRFSPDATQVAYVRGHDVYRLDLATNIEHQVTKGGTEEKSHGLAEFIATSEMMRFSGYWWSPDGKALAYTESDTSGVEKLAIADALHPENDARRLAFPRAGKANARVRLGIIPITGGKTTWVRWDVEKYPYLATVRWPAKGPLTVLVQNRLQTEELLLAVDPRTGSTRTLLVERDDAWLTLHQTFPHWLEDGSGFLWYTERNGAGEVELRDASGKFVRSLVPPGAGFYDMAGYVEKDGTVYFTGGPTSDERYVWRLSPGGRPTRVTSESPALELARMSKRGGLLAITSEGPRRMRHTTVMKADGTRVGELPSVAMEPPFQPRVEVRYVGKERYPTSLVRPRDAKPGVKLPVIVDIYAGPGIPMVYQSMQQHLTNQWLADEGFIVVKLDGRGVSPTADAKLRKPKYDWPRLLLDEQVAALRALAAEVPEMDLSRVGITGASNGGYMSALAVLTRPDVFKAAVAVSSVTDWRDYDSHLTERFFGLPDEHPQAYEQASLLTHVKADQPMGKLLFIHGTADDNVLFFHALKLSDALFRAGQPHEFLPLSGMPHMVFDPVLAERMWEETARYFKRHL

SEQ ID NO: 11806 - protein, 216 aa, Myxococcus xanthus
MIQELSAITVREERDTGMGHETKRPATYEDLVALPEHQVGQIIDGELIAQPRPTSRHARATTRLGGELYGPFERGRGGPGGWYFLDEPELHFGADVLVPDLAGWRRDRMPEVPDTPYFTLVPDWVCEVLTPSTAALDRARKLPLYARAGVSHVWLVDPAARTLEVYQRVKRGWLLTGSYEDDALVRADPFPSSTLELGSLWLPEGAEKPSLLVAVP

SEQ ID NO: 11807 - protein, 47 aa, Myxococcus xanthus
MVVLGDGPRLDITPVGYNEWAWIIGWPSGARAGSTISFDIYCVAGPA

SEQ ID NO: 11808 - protein, 197 aa, Myxococcus xanthus
METMATALRRYFDESGFGEDGGYASDWVDFKLGPLPFPLPNTEARKRAVRFHDLHHVLTGYRTDLTGEFEISAWEIGAGCGDFHAAWVLNLSGMTGGLLTAPVRTWRAFVRGLDEQSTYGRDYEALLERNVEDLRAELGIGAGPHRAGLGAALRFAAAITAGAVVGSLMMLVLVSPITLALWWRGRRAKAQALAAAP

SEQ ID NO: 11809 - protein, 137 aa, Myxococcus xanthus
MLFLVPVLATGCASTAGATRPDEPATEAAAPEATPSAPSAPSAPSGYGYSKNDPIHVGGGVGGEHEYLQHLRGPEGQKIRYERGGSCCAFESEGAPFGSGMLDVYVVTYDGLEEPVMLYLNMYERKDPRAPEGFRLD

SEQ ID NO: 11810 - protein, 842 aa, Myxococcus xanthus
  unsure (1)..(842): unsure at all Xaa locations
MAATLVAVSGADPLQPIDVHVGQKNGNSASLALPVATTSSANGLAVWFSAQVWGGAACPAVHTPPTGFTEQLDTCLVSSSRGVLHSAATSELGAAGAQPAFTGSSTLPNTNITHAVVLRPLQPPATGEITLVGTTHASGKTVTSLTLSTPTGVAAGNVLLAHLANRNQIGAEITPPAGWTLVRTDMSTWSIRGWVFVRVATASEPASHTFQSAIASYLVGNLVAYAGVDPANPIDTHAGKSNSGSTAFTTPQLSTSTAGGAAVWFGAQAWTGAACPTPAIEPPVGFAETYDTCLVSSSQGLVFNAAFMPLAGAGLQGPFNGSSTFAETNVAQVVALRRAEVAPSSGVALRGSSHHSGLSIASLSIPKPSGTEANDALIARVTVRNNISATVTPPAGWTFLRSEQSAWAIRTWIFYRVAGASEPASYAFELDATTHMAGSVEAFSGVDPVQPIDVHAGQKNGDSASFTVPDVVTGSAGGLAVWYGTQVWPDATCPATGIEPPLGFTEAFDACLGHTNGLLFNAAYRSLTAPGLQAGLSGSSAFVQTNTAHVIXLRAGNAPTCMAGDTYASTFTLQGTVTAPEIVEPSGLAASRVVGNALYVHNEDTTAIVAIDTLNASTIGTFNVTNVTPADWEDLATGPCPSGSCIFIGDIGKWSANFPAGGSPTSFTIYRVPEPDLANGQTSGGLVAEAFPFVYPDGAKDAESLMVHPTTGDIYVVTKNGGTGQSGVYKFPQPLTPGVQATLIHVHTIQLPLNGDANFSAATAAAIHPCADRFLLRTYRTVYEFRATPGLGFESAVFATPVTLTDTTEGQGEAIEYEANGASYFTMSESPSPFKLKRVPLL

SEQ ID NO: 11811 - protein, 165 aa, Myxococcus xanthus
MTTLKEWLLAVMPFTALVLLWRFSVSREKRHTQTLYRAIDEGAVSEVQAILSKQAFPNLRSVVVASAIVRAVESRQVAVLDFLLSPELKPVTLTQKLDSFLHDQAMKGGWRGVVLWRSRNSHLFLPWRDLSKRDKLRLRAMATRVVEAEPSKVFLRHDVRGWTVA

SEQ ID NO: 11812 - protein, 72 aa, Myxococcus xanthus
MAVASHLQGQGLGARLVRTLEAELVRRGFTHVHLHAREPAVPFYERLGYAVFGAPYTEVGVPHRNMRKTLGA

SEQ ID NO: 11813 - protein, 792 aa, Myxococcus xanthus
MVKKEGYRAAEATLTLVRGRETDQTFDLTLITGGVEVTGTPEGAEIRDAPNGNILARVPGRVRLPPGQRVLHVRAPGYAPSQYVVDVPADGNVPVAVALRPQDRPTGRLVVTANRDGATVRVDGKPAGFTPTVVTLPEGEHTLEVESREVRPLRQTVKVVADEEVKVHAELRYAPPPVRAASKSLVAVDEAPASTTVLTQEELRAFGWRTVAEAVAGVRGFYLTDDRTYTYMGVRGFSPPGDLNTRILILWDGHSMNDVWAGQGFAARDLSVDIQEVERIEVVRGPGSALYGTGAFFAVINVVPRESLGSDKHLEVTGAVGALGTTRGHAAASWEDGNRSVLVSAAALTSTGADTTRLGSSGPIITGLDAERAAGGSLRARVGDLSFQAQFNVRTKELPTAPYGTVPGTEGNIVEDMRAFAEARYERQFTERFSLSVRGAFDISRYEGTYVYPEEDGGARTEGGAADWLTAEARARIGLFEGNVFTLGVEGQAQLRVRQDAGDLPLETQARTLVSAYLLDEWKIHPRLSVSAGLRLDKYVDLDSTPITPRLAVIARPYERGLTKLVAGNAFRAPNVYELYYADGISQGAALNLRPETITTFELEHSHDLTDELRLTVAGYHNRISSLVQLTAEDAASGDCGTAACLRFMNTDGTTLAWGAEAGVHWQPGRWLMVDVSYSYVTLRNASEEVANAAPAHLVAGRMMLPIGAGDMRVATQAIYQSARPTGPGGADSGEALLVGFGLSGDYGPLRYFAGVHNLLDARYSLPVSDENSIAPVPQYGRTFTLQLTGTF

SEQ ID NO: 11814 - protein, 23 aa, Myxococcus xanthus
MGVLLAFVTYGRYVLKPVVVAAA

SEQ ID NO: 11815 - protein, 71 aa, Myxococcus xanthus
MHRGEVVGMAVRTRKGVQPVYVSPGHLMDLPTAVEWVLKVSPKYREPETTRHAHRLVNALRRADGEAAELE

SEQ ID NO: 11816 - protein, 749 aa, Myxococcus xanthus
MSGGGSIAWGLKERRLGRLSPWPPFPPARTGGSTSGRETGLGPGREMSLGAPMRRLSSPWSELASHYAVVVVGSGYGGAITASRLARAGQQVCVLERGRELLPGDYPRTDAEFMSEFQVHFDPEAAADVGSPTALFELHRGGDVSVVTGCGLGGTSLINANVAMRPDPRVFLDGRWPDAFRADVDGLLEDGFAWAEHMLRPLPYPESAPPLATLSALAKSAEKLGGTFRRPPLAVTFEEGVNAAGVRQGACTLCGDCMTGCNFGAKNSVLMNYLPDAHRHGAKLFTEVGVRYLARDGARWRVYYRPMNAGRERFDAPDLWLTADRVILAAGTMGTAELLLRSKALGLSLSGRLGQRFSNNGDVMAFGYNTDVPVYGVGLGEAPSAGREPVGPTITGIIDDRATLRQEDGMIIENGAIPAALARPVTALLAAASAIAGQDTDRGVIDRVGELARIADSAVRGPYHGAMRNTQTFLVMSHDDGAGELRLSGDRVRVHWPGAGRQAVFTRVDERLRRATEALGGTFVRNPLWNKLTGHELLCTHPLGGCAMGERAEEGVVDHEGRVFAGPEGTEVHEGLYVSDGSVIPRPLGINPLLTISAVAERTVALMARRHGWSVDYSPVPEAPGPRPTQPLAVQFTETMYGYILRGGRRGLPASRGPRAQGYVAVPLHRHSGLPGPGGDARASAAPHATVGLRGGARAVLPSDDGGAGRAAPDDPRGRSSWRTADALPAPAGLRVRRALLRRRLQGRP

SEQ ID NO: 11817 - protein, 130 aa, Myxococcus xanthus
MTVERGVLHLMTHEGARPGGRRMRYQLPLVSESGERFFVDGYKDVHDDDGPDLWVDTTRLLVSIFRGEDASGRCIFRGYLRLNAKDFAVQLSTLRVLHAQGTVQRLAALARFGRFFFGELFETYVRSKAA

SEQ ID NO: 11818 - protein, 168 aa, Myxococcus xanthus
MPNDREQGKGAPQGSERQASRRDTPIEVRRRLRHESRTSQTYAAFIKHLCERGGMSPAVAEKAAVSVLCALEQRILSEEASDLEDQLPRKLTLLLHRCEKHEEELPPKFHREHLLRRVGEDLSLHPDAVEPVVRAVMDAVRHQITEGESEDVMGQLPPDIRDLWTRTV

SEQ ID NO: 11819 - protein, 98 aa, Myxococcus xanthus
MEEPPSEVARAVEFGKRREERAEAQELYWAAFARLQQEHPKEASAWDLYHHEDVEDHEECARRLSITVVNSYKRVSRAQAYLKLYLLDLHRESHGEEA

SEQ ID NO: 11820 - protein, 197 aa, Myxococcus xanthus
MTEPAKLRLTRESLLGLAYALAGGAAVLVGDRIAQEAHDIQSILFGTAVLVTPEQLYTVAIAGGAIMFIHLWWYRGITFASFDRTGALVQGLPVRLLDGVLMVSIGVMVGVCARALGALPVFAFSTLSAIAALMLELRLPWTFFVATLFGAIAGVGGYLFAFFYDFPVGGSQTVFAAAMVAVATVLRMLVHAVQKAR

SEQ ID NO: 11821 - protein, 551 aa, Myxococcus xanthus
MTLRAMTDVGAELGLSPEDVLPWGTHRAKVSLDALGKRGGRQGRLVLVSAINPTPPGEGKTTMSVALAMGLRKRGRRAVAALREPSLGPVFGVKGGGTGGGQASLEPAADINLHFTGDLHAITSANNLLSALVDNAVFYGQPVALDATRVRWRRALDMNDRFLRNVIVGLGGKAQGVPREDHFDITAASEVMAILALAEGLKDLEARLGRVIIGHTRDGQPVRARDVDAAASMVALLKDALMPNLAQTREGGPALVHAGPFANIAHGCSSVMGTRMGLAYADEVITEAGFGFDLGAEKFLDIKCRGSGLWPRGVVLVVTLRALKHHGGASPARVAEPDREALVRGFAHLEKHLESVAAFGLPAVLCVNRFPQDTESELEELRAFGKARGVETAVCDGFSRGGDGSLELADCVLEMLDGTDAAPPQPRFLYDVAQTPEEKVAAIARTVYGADDVAFTASAKKDLDAIRELGGAGLPVCMAKTHLSLSDDPTKLGRPRGFTLTVREVRLSAGAGFMVALTGEILTMPGLPREPAARRVTVHDDGRVTGLMQGE

SEQ ID NO: 11822 - protein, 395 aa, Myxococcus xanthus
MIVGDTLSRYSARRSQLLSGTASPGEVLEAAGDLLRRRSRLETEGVDAALRGLGRSQVEAWLKAQKPQSLQPVLLRAAEEAVEVALDGGEEADMWRVSALEGLSARDRAASAAHALAVWEGFHGALDGESAQLRDRFLAALQSLDSALRPRARWFIPLNPQRRQERDLIEPAEQDAAWWFSARAGCDDLVATWTANPQTLTAHLQDCDACRADMADAAPVDMPPRRHLTADDLWRLDMGLLSEDERTRLDAHTARCGECAQAVLALDEGEAAIEEALDMEEDGTVARSARTSRAPVSHRAHAARLPEQREVLDERRDFRVVLVRERQRVRLLVQPLSGRTVTAAVFLSPGRPSLKPAHGPEGIAFDLTSASSTGARSAHLSVQAGSETLERDFAF

SEQ ID NO: 11823 - protein, 783 aa, Myxococcus xanthus
MSPANPHESALLEDLNAPQREAVLHGDGPLLVLSGAGSGKTRVITRRVAYLVKVHNVYPWRILAVTFTNKAAREMRERLVQLLGAQANELVVSTFHSAAAQILRREAEHVGLTRSFVIYDDSDQLNVVKRAMREAGIESMQPREILHRIDQEKNAARLPEHMQVAPGDERGQLVRKVYAAYQERLRAANAVDFGDLLLLLVTLFRTRPDVLENYRRRFHHVLVDEFQDTNPVQYALLKQLAPPPSANLVVVGDDDQSIYRWRGADVDNILGFPRQYPGAKVVKLEQNYRSDQNILDAAHEVIRKNTRRMEKKLWSERQRGQTLNLMLNRDERAEGQEVARQILALQREGFIKLSSMAVFYRANAQSRVLEEALRLARVPYTLVSGRSFYDRAEVRDASAYLRLMVNPRSDADLLRIINIPARGIGDTTVERVTDFANARGVSLYEVLSQPEQIPALNGAAVKRLKGFRNLLESLTAFAQTNEEAAGAVDQMLRETKLVETLQAEGSDESQTRAENLREFLGAAQEFDLNRAAAAVAAAANPPSDVPPEVDAAPLTADVPALQAFLEQISLVGEADAEVGDGRVALMTLHAAKGLEFDAVFLTGMEENVFPHSRAVKSESTFLNEVASADGEPSEEMAEERRLCYVGFTRARKRLFVSLAQCRSLFGELRYNAPSRFLRDVPPALFGISEQEVPEAPRPMVPSTQRRRTWDEDDGPRIDRSYSQASSDMDGVGGDVRGMRVRHEQFGVGRVVSADGNGPNAKVTVEFGGGVGLKRIIARFLIPG

SEQ ID NO: 11824 - protein, 117 aa, Myxococcus xanthus
MDLRSVEAGPPALARFDGGLELRSVRGAAPALDAGPEAVLAAAGLKAPGKLLQDTEGTLPAGPVARYEFSQTGGARTLVYFVPRKDGFVLVTFSAPERDYGTLSARVERSLSTLRMW

SEQ ID NO: 11825 - protein, 386 aa, Myxococcus xanthus
MPTIRDDEIPSATGIPSSARRTDFVPPPTLAVTEELLRALPKTDLHCHLDGSMRLKTILELAEQQKIKLLADTEDGLAKAIHMGEVCESLEEYLVAFDVTLSVLQTAESLYRAAYELAVDAAAENVRWLEVRYSPALHLQKGLKMTTVIDSVLEGLRAAKRETGIKCGVIVCGIRHINPQTSMRLAELAVAYKNRGVIGFDLAGAEASFPAKDHRDAFQLILKNNVNCTAHAGEAYGPESISQAIHNLGAHRIGHGTRLREDGDLLNYVNDHRIPLEVCPTSNVQTGAVTSLAAHPLKFYFDYGLRVTINTDNRLITDTTVTKELWTAHSALGLSLEDLTTILVSGFKSAFLPFREKQDMLRAVNEEIAQTLAAFDQKRHLVKQPA

SEQ ID NO: 11826 - protein, 55 aa, Myxococcus xanthus
MESFLQEMARHAGIPLGRVGKAEEFADTVAFLLSPRGGYISGAAINVDGGLSAAV

SEQ ID NO: 11827 - protein, 474 aa, Myxococcus xanthus
MQPKLNRLLRALAREGLEVAYDGRLYSVRLLGDAHAPPAEVLLPPDLPVEGKAFQQLAQLAALRHPGGGEVLRVRATPDFHPGDSGVAIGSVLHTRGLVVPGAIGTDINCGMRLHVADISVEDFLAKRSAFVERMKGHYFFGTRDVTMASRASEALLRDGVQGWLLETLEQPLGCAGRADLAQLDAEVSRIHLGGGLKGHPRWAPESFTREGLVRDAGLATIGGGNHFVEVQRVEAVEDRARAWDWGVREGQLAFMIHSGSRDVGKHVGVAWQDRARQAWPAGTPLPASGILPLGDARLVTEYLEAEATAANYAFLNRLLLAELLRQTLRELFGDVEAPLVYDVPHNLTLPYEGGWLARKGACPAGAEQPVIIPGSMGATSFLMVGCGDARALESASHGAGRARSRFSLSRGGADQSEAALGLTGVDCITLRAERRVEEAPAAYKPIRPVVDAQVEAGIVREVARLSPLLTFKA

SEQ ID NO: 11828 - protein, 77 aa, Myxococcus xanthus
MTTTGGKLMFALPTQVLNGLVFFGALKMKNLQNYGLAMTAAIISVIPCCGPCACLGIPVGIWALVVLNKPEVKAAFT

SEQ ID NO: 11829 - protein, 335 aa, Myxococcus xanthus
GQKQTGKFITVRKKIPGEYIVVLKSPAQSLEQVEVQQATTSLITAYGGTAFAMYENALRGFAAKMTEAQARAMANDPAVDYVQENGVVKIAESQQGPTWGIDRMDQRKLPLDKVYTFTATGQGVHIYILDTGVRFSHREFGGRASIGYDAIGDSMRGNDCNGHGTHVAGTAAGASYGLARNAIVHSVRVLGCDGSGATSGVIEGIDWVTRNHISPAVANMSLGSDEDPALDDAVRRSIAAGVTYVVAAGNEDNDACKHSPARAPEAITVAATDNKDKRATFSNWGDCVDVFAPGNKIKSSWHYGDRESREMSGTSMATPHVTGLAALFLEVNPTA

SEQ ID NO: 11830 - protein, 256 aa, Myxococcus xanthus
MRGGTDVVLGHALPRSILYRGYVLLMLAGIERAGMQDAASTALFDALASQVVKALEHQLLLPSFSTSIWPCDSAPAAAALLLHGRLRGHAPSEAAAERLIARLVELSALPSGFPTRVDAKGRVVERTQRATTLAWTGAFLAMAAHPAAGTFTATLVRDYCARPAGSLLPLAACREWPRGVNGKEDSASGPLVFGGYSVGASALAIAATRLSDAHGTWHAHLVNAAREMGINDILSRPGKRPLEAVLYEWGTTIRPW

SEQ ID NO: 11831 - protein, 129 aa, Myxococcus xanthus
MPEETAMSTREVCLLIGHGGEVLWCDASDSPNQLPDSRARWEAIWRLRDVLEEVAHSHPDGPLGFSAEDESTTAALTSALGKPLRFSVVAPEGMVARLRGRDVLVAAEPWWAEALRSASGIRHTPSGLA

SEQ ID NO: 11832 - protein, 446 aa, Myxococcus xanthus
MRVLVVDDERNIRHTLRVCLEGFGCEVREAATPEAALAALAQGPADLAFVDLRLGTASGMELLPRLLAESPHLDVVLITAYATFDTAVEAMRRGARDYLPKPFTPAQIRHAVEKARRHQELASQLENLEGQLSQAVPEATLETASPAMHAAIGLLTRAAASDAAVLLRGESGTGKGVLARALHSMSARRRRPFVTVNCPTLSEQLLASELFGHVRGAFTGAVKDQPGRVEAAEGGTLFLDEIAEMSPGLQAQLLRFLQEKQFERLGEGRTRKADVRVVAATNRDLEKDVAEGRFREDLLYRLNVIEVKLPSLRERPEDLLSLARRFVSFFARAAQRPPPELSPATEKMLLAYGWPGNVRELRNAMERALIVWPAEVLEPQAFPDRIAAAGSPVMTLGGPHTLEDIEREHVLRVMASAPTLDEAARVLGIDASTLWRKRKKYESGEG

SEQ ID NO: 11833 - protein, 86 aa, Myxococcus xanthus
MQRAQQALVNAGARPLDLRRLAGQRLEVTYAFMGERFVSIVAADSLQVLDAGICLAGADGDVTLESLPSVIREAIETDVLVVTRHA

SEQ ID NO: 11834 - protein, 589 aa, Myxococcus xanthus
MTTQTQNPNALLPESQRGPAERLLDLVLGGSAHLWHNRPGLDVNGTWYAAAHATPFQRDKGRPVKPGLFVPAAVKLYRQLLDIYRLNAELMAHFASYALTQTDWRDLKVATCALMLVQEHAGQPVRDEQGGVAFHDDDWRAIGEAMVLHYERKSTRMLTPKAVLRVAELLEHPEIARLNREAGFGDPASRKAPLGRWKRVASKWLAAREANMPMLQGLVKAGYKETLKKLARKAGYKPRAQGFFEVLGWKQKQSAQGHREVGLNGLTLVKRERFDGLSEAEICEWIDLERLSYKEVVGRLPKDVGLTPAIMAALLPSLSDRDLRLMTPTLEELGLLTDPAIRARWEKAVHTATDQRALNIAKNVRSAVLRRKLEEASDNAARQAVAEATAETDVRVMFLIDKSGSMEGAIESSKEALSRILAGFPMDKLHIAAFDTLGTVLRPKAANRIAVQHMLAGLRASGGTAHASALYALHRDGVRVPEDAKLVVIVVGDEAGEAGDQFARAFRDLRIPVSAMALLVSVAHARGSTVRSCAAQLRVPFSEVNVDQFEDPYQVTRVLKALMDAPTLPGTAQSGWVERVMRTPLLKVA

SEQ ID NO: 11835 - protein, 235 aa, Myxococcus xanthus
MSRRTIVIGDLHGCYDEAVELLGKVGATSSDRIIFAGDLVDRGPKRRECVELAMRHEAILGNHEEKHLQQRHRADERLHPDHLETRRVLQPGHYDWMARLPRYLRLPEHNAIVVHAGMLPDIPVEKQDPYHLLHAQCIRPPASKSYWPSKAPHGWTFWTHHWKGPDRVIFGHTVFDAPLVTEHAVGIDTGCVYGRSLTAVVLPTWELVSVPARSTYRGGKDVARIPVHGDVSVFS

SEQ ID NO: 11836 - protein, 390 aa, Myxococcus xanthus
MDFRKKLAALLLALASTGAGAQPSEGAQKLPVGWYVTESAPKRYEAGVDSSATCEGNRSAYLRSLSPDENGYGTFMQAFGAHDFRGKRLRFSGALRIKDVEGWAGLWMRVEGPDPKQPLAFDNMQSRALVGTAGCKRYDVVLDVPKEATTIMAGLIMSGTGQAWLDGVRFEVVDTSVPVTDLLASRPVVAAAGPSGLEDEPAPVAKNDQLPLGRVGDVWFNHGRIAADKPYTRRKDGVWVSILGEEVYEHGIAVTGTLGQRALELKLKAGGRRTLIEGTWGGEPVNIQLTPEKLTMRWGRTMREMARHLDPQVGTTCNRYQRTEGPRVLDQLDVCGAALGTRPPNAQLIIALLVNGFSPTLPAGSIPIPRPPVRSRQALDTERTALPPSP

SEQ ID NO: 11837 - protein, 215 aa, Myxococcus xanthus
MSAAVQGLRMTTLRLSKEADEPAEATAPGEDEALLARRALTGERAAWDALVARHHRRVVVSLLARGVRVDRAQELAQETWARLIQQQQRGLLTELRLPNLALTQAAFLAADDARRARRESIAGAVDELPERHHPVDPSVSAERRLLTEEQLSRAHAALAQVSPSARNVFLLACDGQELPHAAIASRVGLSVQRVRQILCEVRKKLRTALEEETHA

SEQ ID NO: 11838 - protein, 63 aa, Myxococcus xanthus
MSFERAVTGDSLRVESEIDSQTVSLLFATAWVYDGEGRVCGRCQGVVKLSNLRWASGDSPAVN

SEQ ID NO: 11839 - protein, 191 aa, Myxococcus xanthus
MPVLQDGLLVVALGDAGLMALATQDGAKRWQRDLRDVLGMTLWRDTLYVSTRQGHVLALRLGDGTSLWEQAPAEALSSPPSLALGTVWVGTAGEVSALVGLSPSNGKEVARITLPDPLISEVTPVREDLLLVPTSGRQGRLIALNTTTWAQAFSVRADTPLRTRPVVLGDQVIVLGLDGRVLSWRLRKTDP

SEQ ID NO: 11840 - protein, 173 aa, Myxococcus xanthus
MGAEGLLLRPAKESDRRTLWRIHTRAVEALCLRAYAPHEVSTWVRLLKPEGYLRPERPRTVLVAERGRRAVGFGQVDAALGELEALYVVPDEAGHGVGPALLSALESAVWRGSAPLMGLDASLNAEHFYQRHGYASVHASRRPLTVDVQLACVRMQKQRPATAMGRWPAWRRG

SEQ ID NO: 11841 - protein, 186 aa, Myxococcus xanthus
KSIISELYKRAPVYVYDFAQNEVPGQEAKERGYWRDVGNIDVYYQSNMDLVEVDPTFNLYNDRWPIHTQPNNYPPAKFVFADEQNHRVGHAMDTLVAEGCIISGGSVRRSVLSPKVRVNSYSEVEDSLLFENVTIGRRCRIRRAIIDKNVEIPPGMTIGFDPVEDRRRFHVTPGGVVVIPKGMKVT

SEQ ID NO: 11842 - protein, 778 aa, Myxococcus xanthus
MTAAVVVIAQLVVVSRRVRQVSERLSSPRNSWAMACWESQGDSSTSVLSRSRTGILRRKVGWAVGVCNAGGVGVAGGRASARVAMAGARVQLADLNVPDVNPIQALSHLLQEERERLARLWAKRLRAETYDVEVPGRDLRAPLRRLLDELARLLKDRPDDVVRLWPEVVRPHGAFRYTQNFDPEDLTREFKSLEEVILHVYARRNGGFIESQVAELVAELVWEADAAAQASYARILKTEEVRFREAAVMESVLNQVDVGIMLAEVDGTVSFATPPVSRLMGVPMRAVVGGRAANTINPVLTQVNARHLTGEPFKLADMPFLRALKEKGPVRGVMMVVERPGGDTATLELSATPVWEEEGELAGAIQTFTDRTEAVNKTKALQSAHGELRRLQGRLLQRTRQQALGQLASGAAHALNNFLNVLRLRITLLQREFKPEHLEALDKTVQQIGELVARLQEFNIQRTQEQPTDVPVDQTVREALELARGELEQREHPVYVDLDLGDVGNVRADTGFFRELVVNLLLVSRDRMEAGGRLHVSTRAEGSSWLTLRIEDEGTPYAPDELARLFDPLRRDASAPQLSLFLAVARAQVERWGGELTAEVPASGTGTAFVVRLPRVHEGAVSTAPRPEPSRAEVMRPAGPRRFQQTRSVLVVDDDLDNARMMAEVLGEEGYEVQVAHSPAVALGMWDRRRYDAALLDAVMPEMSGWELARELRKKTPQALLAIVTGMDVRGQNRSNLALVDAVFRKPIDVGALDDFLGQSDTAASENGASTTGSAPPA

SEQ ID NO: 11843 - protein, 74 aa, Myxococcus xanthus
MIRARNDPQKLVALFGELEKVVKDHVTMEERDVLPKLGQKVTEQDLGMSCKDIVRTASEVRREEMQKLQGQANA

SEQ ID NO: 11844 - protein, 717 aa, Myxococcus xanthus
MMLAGGGAMAEESAVCEGRTSQPPLQRDAQGRVKVGEDVVATFKSRQPSARPEGVRAKAELAWTDRVSSPGATYIAPHFSQFALASGDYVIVRAPDGSREYRYEGFGKGEGNAPVRGGFWSGHISGDVAIVELWSTGGQAKSGYTIDRFARGFANLAALGEDLDNKALCGPDDSRNARCYQTSDPRQYKHSRAVARLLINGSGACTGWLVGNQGHVMTNEHCIANTSDALNTDFEFMAEGGACTSACNSWFGCPGTVVATSSTLIAVDAPRDYALVRLPTNPTATYGYLQLRNTTAFVDERIYIPQHPAAWGKHIARNSTHASDASGFAEIFALNRPACSPGGPLDIGYYADTQGGSSGSPVIANSDHRVVALHHCANCPNRGVPITSIISHLGSLLPQCALRSATCPDPYDVWMRDTWSDTGLEPDPATAGQDMWASPYIWIRRNPDGVANPHVHQNPELGATNYAYVKLHGGPRPGATGRLKLYYANASTGLAWPTDWTQFGDVAVNGFTPDTHIVQAPWSSLPGEGHYCLVARWESASDPMSFTETTDIDTNVRQNNNIIWRNVNIVDLESGSEEVHFIVRNVHEGIRALRLAVRVPETDRQRPFPGNGGRVVVRLPDELFKRWVEAGGKAEGMKMLREGEFEVVSPEGGVFHELPLGFREEHQLRMFFERSADATPEPYHLEVVQFDQDKPERESLGGIGYDIYTHGEPKPKQ

SEQ ID NO: 11845 - protein, 233 aa, Myxococcus xanthus
MAPDGLQSMLTGNLMLALQQAARVHGAELVIPESLRGCVRPAFSRGEDPGWIPGKELLRLQSNPDVYQMYLFHELAAGPAPVAEGPSWDEARRGFTKALREAVAFSAAQGSNFADAFKLALFALEGQAPRYDELSPERVPDYLEAVKAAGFDGRPVQVFEDRLGSLGLFQSLGMSEEKLRGLLAYLLSDVFGGMGSWNDQYFETPEAQQQYDAVSARLFSERSAFFVATLNAR

SEQ ID NO: 11846 - protein, 80 aa, Myxococcus xanthus
MSRKTMDCRKAPSDTHCTLTISGEEDEVFQAAISHAVSAHGHEDSGELREMVRGMLEDEAPEASMGQPMSMQEPQQPSRH

SEQ ID NO: 11847 - protein, 426 aa, Myxococcus xanthus
MVVRVPPVSAPLDLERVRRKVEAGEILSDAELALLRAEAQRGTGSALRLALAHALINAGAEREALPLLETLRRDFPRDLPVRLGLARALLGLERHGDAERLLTEVLAQSPGDPEVLKVLAVLGLRRGEADKARAYVADALARDPFDAEARLLKEELESVDLPPPSVPQEQVLRPEFTAALTAALGRARVAFRRQGKDLLVKLATGGVGRVDVGSLYAAYQESPGTQGLTAYADALAARLGGLSSGLSAEVAALEARLRPVLRPADFAARAVGALHRPGPAGLEVFYVLEDAEFVRYLPEAALAPAGLTPESADAAAWRNLASRLAPVRPVLVDQGEVRLAEAFSGLWAVAEGDGHDAARLLLPSQREELALLAGEGPLRVALGRRELVLVCRESDAAACEALARLMPSPDGIPGTFRLTEEGLSAV

SEQ ID NO: 11848 - protein, 242 aa, Myxococcus xanthus
MIRIDKSILITGASRGLGLALMNGLARRGARVVGVARHAAEMGAVAEALRWEGLEAHALACDVGDKEAIYPMVGAATALVGPLDVLVHNASTLGPTPLPLLLDTACEDLQRVLEVNVVGPFRLTKAVAGNMSVRGKGLVMHITSDAAVSAYPRWGAYGVSKAALEHLGRVWAAELEGTGVRFVSVDPGEMDTRMYRDAVPDGDYSQLSRPEAVAARLVEWVAWQSESVPSGARLEAAKLEAA

SEQ ID NO: 11849 - protein, 341 aa, Myxococcus xanthus
MKPARWPADRPEEGRLLHVEPRARRYRDTRVADLPSLLRAGDLLVVNDAATLPASLVGRTESGERIELRLLSREPDGTWTGVLFGAGDWRRRTEDRPPPPVLAVGAGLVVGGLKALVVAVLPPSPRLLRVAFDATGAALWSGLYRSGRPVQYAYLEAPLSLWHVQTAYGARPWSVEAPSAGLPLTWSVLLTLRKQGVRLASLTHAAGLSSTGDAALDAALPWPERSDIPAATVEAVLHTRASGGRVVAVGTTVVRALEGRAARHGGWLVAGEEVTDLLLGPGFVPRLVHGLFTGVHEPGSRHHALLQAFAPLPLLQEVAAHAEARGYLGHEFGDSCLLLDA

SEQ ID NO: 11850 - protein, 337 aa, Myxococcus xanthus
MALVYRGLHEMLQREVAIKELLPDGQRDRETLSRFRREALALAAFRHQNIVTLYDMVEKGESLFMVMELVDGPTLHTLIKEGPLPADVTGVIAARIASALDHAHFRHIIHRDLKPANVMLTKSGEVKLMDFGIAKDVGMEALTQQGMAVGTPSYMSPEQVTGVPVDGRTDIFSLGVLLYEALSGARPFHGKTAGEVFAKIRDGKYTPLSKVAPNVPAPLVRIIQRAMEVKPEDRFPDAAAMRRELDVFLAQEVQVSHAALLVAFLRHRQKLTETEAQQLMRPHELDAAVEVFDTGRSRQGGKLRWALAAAIALMTAAGTGLYFTQAQWAPLVEQLTR

SEQ ID NO: 11851 - protein, 632 aa, Myxococcus xanthus
MPLPSDVEDALSCLPLALVRVGPDLRVQWCEEGFARKTGVALHAGGDMRDALERTRSLDALERAIRDGASHTGHVITRALRQVRVQVKPASAGEAAGVWLVVEPSGVDDEGAFSQAVQEIARSVGETLEVDSVCAAAVVALVRCAHVRRAEVFLCEEEGGSLRRVAVSDLAGSESPEATFDSQSDPFRQALALRQAQLGIQRGYGDSMGSIFAAVPLCAPRRTVGLLLLYKEQGTSFSVRELDLWSAAANQLAVAVENARLLREAKAALQVREEFISIASHELKTPLTPLKLGLFTMERRLSSGQPVDLATVLKSKRQVDRLVGLVDDLLDASRLDAGRLALDLAPLEVGQLVAEVVDHFRAAFERPFAVEVPRERVWVRGDRDRLEQVLVNLLENAHKYSAPEEPIVVTVERSQGEARIHVQDHGIGIPGADQSQVFQRFYRARNVSHRHFGGLGLGLFISHSIARLHGGALSMRSAEGKGSTFSLSLPRMAPHDVRRLPHRLLLLDEDQTQEAAAEQVLLSEGFEVLTARDGAEALRRATHLPVDLIVLSTSATQGQTSVFLETFATLPRARPVPILLAGDERPWWAHEGTSLCTRPYRPEDLVTRVRNALSVERRSTAEAPLDLLSSRT

SEQ ID NO: 11852 - protein, 315 aa, Myxococcus xanthus
MAATVRVLEALKVPLDFEYKDAGTEVVAKYGTNLPHETVEAVLRSGIALKGPTGTVVGGGLPSANVGLRKRLDLYSSLRPVKSVPNVKTRYEGVDLVVVRENTESLYAGLEHIIVPGVVESLKIITEKASTRIARFAFEYARKHGRKKVTAVHKANIMKLSDGLFLDCCRKVGREFPDVTYEEVIIDNLAMQLVKDPTRFDVLVAENFYGDVLSDLCAGLVGGLGVVPGANIGERTAVFEAVHGTAPDIAGKGIANPTALMMSAVMMLDHLELGEAARRMENAIWKVYGSGEVRTGDLGGKATTREFTDAIIGAL

SEQ ID NO: 11853 - protein, 235 aa, Myxococcus xanthus
MAQLFRGELSRSDTWRTRLDTTTNWAITTTAAVISFGFASTQSSHVTFLVGIWMVVSFLLIEARRYRYYDLWNRRVRLLEEGWWAPMLRHEPMDPDALRELALELERPQIQLSLFSAISTRLNRAYGPILMVLMMTWFVKVYSHPKPPVDLDEFLARAGVAWIPGEAVTAILLLLTLTASYLFLSSFFIRAPLGELRTRPRGRRAALWESFYRPYAIHTRRKPTRRPRPSSTSEH

SEQ ID NO: 11854 - protein, 381 aa, Myxococcus xanthus
MGQVAEGGLTRHAPESLAHMNSVLRATFDSIAEGVIVVDLNKRVTAFNKRFLDIWGLTEEMMVDRDAERVLVRAAGGVKHPESFTSRIRERFEPSEEVDVETVELLDGRILERKSLPQRMGGAIIGRVWSYREVTAERQAEAERERLLREAQEAIRVRDDFLSIAAHELKTPLTPLKLHLQMLRQHGAEGDGASARHVDKSLMQVSRLTGLVNDLLDTSRIQEGRLTLKHGPVVLQELAHDVVSEMRLSSAHHRVEYEAPEAPLVVLGDADRLAQVLVNLMENAFKYSPSGGTVRVRVAREDRHAHVSVQDEGIGIPRDQQEHLFERFFRARNAPISGFGGLGLGLYICGDIVERHGGRLWVESVLGHGSTFRFTVPLAST

SEQ ID NO: 11855 - protein, 28 aa, Myxococcus xanthus
MIVGTERFMETVRRLELDGVSFRELPTH

SEQ ID NO: 11856 - protein, 163 aa, Myxococcus xanthus
MRDVARLETLEVSLYKKVTFTPEPQATDALWKDVLNWARYALQNPHGRAIVFANAHLGFDFQRFDRSHLQVTGTRVYVMLPPMEVKVELRPGETEVIDSNLDSEQTAQLLEKARLAFEQEVRSNGKLQRRARESAERSLRALLLTLGYREVLFVDHLPAGTAG

SEQ ID NO: 11857 - protein, 185 aa, Myxococcus xanthus
MNDDDLPGRLARNIRSLRETRGATQAQLSRLAGVPRATWAHLESGAANPTLSVLHRVAAALQVSLEELIAKPRASARHYPRATLPVRTRGGGMLRKLLPDPLPGMEFDRVELPPQVRITGVPHTPGTREYLACESGELVLVASGERFHLQPGDVVVFRGDQKHSYENPGARTAVGYSVVLLAPSI

SEQ ID NO: 11858 - protein, 363 aa, Myxococcus xanthus
MIRGTMPGMKPGTILGHEGVGVIEALGDDVRNLNIGDRVVIPSTIACGNCSYCRAGYHAQCNDANPNGPSAGTAFFGGPQETGPFHGMQAEKVRVPFANVGLVRIPEGVSDEQAILISDIFPTGYMGAELAEIKPGDTVAVFGCGPVGLFAIVSAKLLGAGRVFAIDCHEDRLDLARAQGAEVINFEEEDPLETLKRLTNGIGVDRAIDAVGVDAMHPHHGPAAKKAHQEKAEFKREVKEAAPKTNPKGDNWVPGDAPAQALMWAVEGLAKAGTLSIIGVYPAQVRTFPIGMAMNKNLTMKMGNCNHRKYIPKLLELVRTGVVDPTAILSHVEPMGSAIDAYRNFDARKPGWVKVELEPTQLQ

SEQ ID NO: 11859 - protein, 470 aa, Myxococcus xanthus
MHQERDAIRPGEGVFATGSMPEETAERLLATLRRYAALCRRHKAQVRAVATSAMREAKNSADIVRRVREEAGLNLEVVSGKEEARLICLGVLHRKPSQTRSLLIDIGGGSTEIVTAMGEKPDNLWSLALGSVRLTEVFDASRTVPPKQLRLMRSFVSDVLQKTLPPTVPNVPRVALGSSGTINAVVSFAAAENSGNATVRQLTQTVDTLAQMPPERRRKRFDPRRADIIVSGAVILEGVARHLGVESVSVVNRGLRDGILVDLLYRQDEHREDHSLADAALALGKRFYFDEKHARQVARLSLTLFDNLAALHQLPLSVRSHLEVAALLHDVGHAVSYERHHKHTYYLIRHADLPGLADRERELVARVARYHRRSPPELTHAGMAGLNPAEARTVRKLATLLRVANSLDVSHHQPIKDFKATNGRDGVALHLHTRHPVDLELWNADREVLNFRRVFGKRLTFHVHHASSGR

SEQ ID NO: 11860 - protein, 378 aa, Myxococcus xanthus
MRAEASLPPVTAPGLRLPLNEVREERVTLLDGGTEAYPRMLEAIATAQVRVHLEVYTFERDGIGARFLEALVAAAHRGVAVKVVVYGWGSIGASRHLKQTLEAAGAKVRVYNPLTSLCTGRSWRNHRKILLVDDSVAFLGGINIGDAYAANGDQPGWADLALELRGDICRQLGATLHAGASALESGAVKLFLSGFAGGHRLRKRYLQAIDGAEHEVVLAHAYFLPDKGFMRALKRASRRGVTVRLMLAGRSDVVFVRSATMRLCPTSCCAGVSIHEWTDSALHAKSALVIRKESAGGELQSGPAVACVNLHTLVEVEEPGVAAQAQRWLDKHLRGSRRVYLEDCARSGLQQWLLDIVGLAVARLAERFASFMGRRRKR

SEQ ID NO: 11861 - protein, 122 aa, Myxococcus xanthus
MPSQPSKELQTFPNPAADRDYEIVFDVPEFTCLCPLTGQPDFARFKITYVPDQSCIELKSLKLYMWAYRNEGAFHEKVTNTIADDIIKAIQPRKLTVVGDFFVRGGIGTIVTVTHDKSKQQA

SEQ ID NO: 11862 - protein, 83 aa, Myxococcus xanthus
FVGDAGPEAYWTLERFASELAALPQDGVIELMCHPGYRPETLKSGYAAQREVELETFLHPQAREVLARAGIVPVDFRVLTSGS

SEQ ID NO: 11863 - protein, 130 aa, Myxococcus xanthus
MATRRTLDLNRIRELLQRRRREILSANEGAHRELTALKNQERDPEYEENAQSELADYTLSSLMESQRREIMLIDAALRRMDMGVFGECVDCGFEIPIERLEALPFAIRCEEDASIHELETRGGPMASPSL

SEQ ID NO: 11864 - protein, 645 aa, Myxococcus xanthus
MPLGPDTVGRKLLWSIALPGLLVALLGVGHFWREARVAVQDATQVESLALAEFVASTFTLPQARGAPAHGAVTEVMRSDTRLFRSVEDVRVLTPDGRILWSRRSGEEGTTHPEAARLTAPGPERARSVAQMTEVIRPLGGPECAGCHTSGDVPGASILQLRMAEPALHQQLSSVFGAALGSMGLFVVLLALITGLALHFVLTRPLRKLSVAMRRAEAGDLLVRAEARGTDELAQLGSAFNQMLARLTSMKAEEIDTHRDLELVKEKLALKDELEDRLKELSLLFDVARSLNATLELDELLDAVTRLVTERLRIPEFSIMLMNPESLLEIKHAWPEGRGAEGLTFALGEGACGRAAETRKSVYLPDTSDRSSVFAKPDLVKGGLNSGALLAAPMVHMETLLGVMNFQRPEVASFSAEEIELLNAVADVVATAVKNARLHAETVKLTMTDPLTGVPNRRHLFQRMELELARSNRFGTPLALLMVDVDHFKRINDLAGHRVGDETLRRVCDVLRLRVRKVDTLARYGGEEFVILLPQTNKAEAMEVAEKLRRAVAESVELVQPGLPGNHVTVSIGASHFPSDASAQEELVDCADAALYFSKRTGRNRTTQYEAGMELHPGRERGPHTPTAEPPAVTAAPNPPGGVAKA

SEQ ID NO: 11865 - protein, 521 aa, Myxococcus xanthus
MLLPAVVAVFLVAILVAFIALGARSGGVYARISSSQVPTIELNREVMHRFPGLHRNVLAAVAAKAGGLEPLSAEVDELQSKLDLAGAVPDANRQRVDELKSSLATYWTNSRAAVTFAVEGDEKAASALASVESLAAALSHELERAVEADGQAIATSYAEVAGLHRATTWTVCVLVLLCIALTVGLAYWLHREVTLPLAKLTHVATRIAEKGDLTQAIDVSAHDEVGELARGFQVMVTRLRNVPTTIQTVVTDLTNAAKTLTQASQEQVNFLTNQSRSLTEASTTIAEIAQTSSMAASRAEMVLRVAGQADAFSASGQESIEKSAEGLQQIRQRVGALVGSIAHLSDQAVHAGEIIGSVKDLADQSNVLALNAAIEAARAGEQGRGFAVVAREMRSLSGQSLQSTQRIGKILLEINQAIRQTVGIAEGDSEKMEEGIEQVLASANTLKEITTVVQESSQAARQIVASVTQQNAGIAQMTEVMTTLSSMMADVVTATMTAEQAVTQINASLGQLHELSTGFRV

SEQ ID NO: 11866 - protein, 312 aa, Myxococcus xanthus
AEEVDLEPERKKEIIELERSLDAMDHFAVLGLKPGAPASEVKQAYYNASRRFHPDRYFGKNLGSFRARMERIFRRLTDAHNVLMQPDKREAYLRANPALAQAERAAAPPPPSAPPPSAPAQHLLTPEPPPVHQLSSPPPAPRPPVASSGPSSIPPPSRPLAPPPDDGASEARRAERQARLARHPYLARTGRLAELIARGKAAIASGDWERAYHDFHQVQTMDPKNREVALLLVKARRGHDSQRATIEVARGREMERHGDTHGAMSAYRLACSLDDRNAEAAWRCARLGNLLGQDAAESRGLAQRAVELEPDF

SEQ ID NO: 11867 - protein, 350 aa, Myxococcus xanthus
MDGREYLDLIGGIATCALGHCHPEVVAAAKAQLDSLWHVSNVFYSQPQIDLAAQLTEWSGLSRAFFCNSGAEANEALLKLTRKVMKDRGTPERFEVISFDSSFHGRTLATVTATGQAKYQKGFEPLPAGFTHVPYGDLEAVRKAVGPATAAILVEPIQGEGGVRMAPLGFLVGLRALCDEHGLLLLVDEVQTGMGRTGKPFGFMHEGIVPDGISVAKALGNGLPIGAMLCKEELGASLTPGTHGSTFGGNPVAAAAANAVVRILRRPGFLDEVQEKGAYLLARARELQGRLPAGRIQAVRGQGLLVGVQLDHKVAPVIAQVHEEGLLVNPAGDRTMLFAPPFIVTVRELD

SEQ ID NO: 11868 - protein, 405 aa, Myxococcus xanthus
MIGPTGVGKTEIARRLAKLAQAPFVKVEASKFTEVGYVGRDVESMIRDLVEAAIALVREEETEKVGPRAEELAEDRLIELMQGGGVKSSSATPPFGFAPPPPPPVQRVSDSAREKFRAQLRAGTLDDVEVEVETAESSPTFMRGFSGQGMEEIGVNLQDLFKNVPGMNKTRRRRVRVPEALQLLRKEKAAKLVDPDRVQREAVARAEMNGIIFIDEIDKIASREGGKGGGGPDVSREGVQRDILPIVEGSTINTKYGVVKTDHMLFIAAGAFHVSKPSDLIPELQGRFPIRVELEPLTGEDLVRILREPKNSLLRQYTALLSTEGVRLSFTDDAVTELARIAQQANESTANIGARRLHTILERLLDEVSFSASEMGPRDFQVDAAYVRERLAAIVQDEDLSRYIL

SEQ ID NO: 11869 - protein, 35 aa, Myxococcus xanthus
MAHTQMSARDVVHQSLTIAGEIDIYTNANISIEEL

SEQ ID NO: 11870 - protein, 548 aa, Myxococcus xanthus
MLVGLFVIGGAITETGLAGWLGQRLGHLAGEGEGRTIAVVMLATAALSAFMSSTGTVAILMPVVGTLALRRGIAPARIYLPFAFAAHLGSMLTLISTPPNLIVSGALRDAGHEPFRFFTFFPIGVVMLAVGMLFLIFAGKYLLPSAAQGQVAAQAVLSPEDFATEYGLGTLLHALRVPRGSKLVGRTLGEANLRSAHGVNVVGISLMGAAHPVVPHRPFGADEVLVVQGHEDAVVATVEHWGLERLPSLQSLSLPPEESLAEVVIPRRSALVGRTLRQARFRDQFRATVLAIRRGADAVVDASSPALKDFTLRRGDTLLVKGRKKHLRNLSEARKDLVLLAEPDPRTDRLADPRRATLTVIITLAMLTVMALGLLPNVVAVLLAAVAMVLTGCVRSADVYRTVNWESVVLIAGMFPLATALERTGVTQLAVAGLERLFTGASPHAVLAVLAIVTSTLGLFISNTATAVLVAPVALRIAESMELRPEPLLMAVAITASAAFATPIASPVNTLVMSPGGYRFADYARVGIPLQVLIVALAVLVVPWVLPF

SEQ ID NO: 11871 - protein, 300 aa, Myxococcus xanthus
MTSLSPLLEKFRAHLEDEKGSSPHTVRNYLIDLVDFERYLVERMKLSLLSGTHAAIRGYLGTLSTDHAPASRARRLASIKSFYKYLVRQKLLPASPAKLVKSPKLPKTLPKVLPVEEVFAILDMPDVKTVLGLRDRAILELLYGGGLRISELCGLDLLDIDRSGRIVRVMGKGSKERLVPVNAQSIRALEAYLARRGELLATIRKDQAPEAMFLNFRGGRLTPRSIARHLDTYVLKCALTRKVSPHAMRHSFATHLLGGGADIRSIQELLGHSSLSTTQRYTQVTWEQLQQVYDSAHPRA

SEQ ID NO: 11872 - protein, 700 aa, Myxococcus xanthus
MDADGNGRIRVAEVRTAVDWAAKQLKDRRGADASSDVLELNALSEEARPLRGAAEMILRTLKATDAGRISLAQVRESEKALRETGQNGDGIVAPEHLSEHLRPLAQELMASFPALTNRAGKAGVDAALVARFREERAKLREHREKQGAAFVWGDISLETAKRVRDVAPLLDAYFVQCRLVAAQPEAAASLRLRAERVEGALGDMAALGKAAGDLPIAPPDASGVLEWSRLLRGPAYEVLEAFRTDVATPMTGDSQRLSDSAWRGLAAKADGVLAWQAQLEANPVRTLMDTLPSVSDADLDALEAASAADLALKPTLDAVNELERLVLYQRWLLLFANNFISMPNLYMPKRLALVEKGTLILGGRKYTLSVLVTNRAAHSALTALGTTCILYVQVAPKDGTPGYEVAVPVTSGRSTELAVGKRGVFYDVDGVESDAIVTQVVRQPVSLWESMTMPFARIGEFITSKVEGLASAGEKTFDSTLEKGYTNATNAPPVAPSPAAGAAPAAAAAAPPGGGLAGIVAAGGLAAAALGSSFAFIMTQVKSLTLVDLISAATLIAIVVMAPAGLLGWLKLRRRNLALLLEGSGWALNDRLMLTPELSSLVTRRPKLPSNARVDRLDMVRSALVRQQEDDEAEGASGWTKLAITLAVVFVLLWQVRIPLLTWFCHAGWLSQDTCLALLPSQAEPAPAAAAPAAAPAKAP

SEQ ID NO: 11873 - protein, 547 aa, Myxococcus xanthus
MMRMRQGRLWTAGLMASLVMAGTGCKQGENGGSEAPGVRRAKAAAAAEKPPPPGAPGAGQGTLLASGRVTDLRVTSDGRFATYLVNGQKPRLDGIPPQMVLGELYAVPVEGGEPRKLGEGVTNVPGGQLVAPGSKYVLFLTGYNPATQSGALNVASLDDAKAAPVVLGTAVSYMLPSPDGTKLAYVDGGKLKLGTLPSGPFTDVAAEVSTAQFTPDGKTLLFKRRLSAAGGMAAISVEKPDAPPMKVGDQVGDYEVSPDGQRVAFQVRSESVRGLYDLYLAELPELKAKRLAVASGVFAFSPDGKWLARTENGKPNVPGDLYLGPAAGGAGRKLGVQVEKLAFSPDSQAVGFLEKYDSTANAGLMSVAALPDGTTKQVGGRVPNFVWGSDGRYVAFLSRILKPAYSVDLMLYTLGEERAAKVQQGVFGYGFTPGNGQVVFRSNCIRNGRSCDFMAMDLPRQADPRTWLQGIFSYKLSDDGQRVLVTYARMDSDTYDVAVYDVKTQARKTLDQGIQVPVSFGGKNDSLAVYAITQGPKAGIYSVPATP

SEQ ID NO: 11874 - protein, 457 aa, Myxococcus xanthus
MADQKQRVTVIGGGLAGTECAYQLSRRGVPVVLREMKPQKRSPAHKSDTLAELVCSNSLRSDNPESAIGLLHAELRALGSLVLSAADANRVPAGDALAVERERFSAAITESLLRQPGVELVAGEVEQLPEDGPVVIATGPLTSDALTRELERHVGTRLYFYDSIAPILSADSIDMNVAFRQSRYGKGGGDDYLNLPMTKDEYYRFIAEVKAGQKVVPHAFEEPKYFEGCLPIEVMAERGDDTLAYGPMKPVGLRDPRTGQEPYAVVQLRMEDVGGTSWNMVGFQTRLTWGEQKRIFSSFIPGLQQAEFLRMGQIHRNTFIDSPRLLAKDLSLKTEPRLYFAGQISGVEGYVESAACGYLVALALHARLTGTEFVPPPATTAMGALLRHVTGEAHPPDYPHQPSNISFGIFSPLTGRMKKAEKRAAYSARAKQDLAAWLPHAGVPAAGAPEHVDQRSA

SEQ ID NO: 11875 - protein, 193 aa, Myxococcus xanthus
MADPTTSAVDTPDAEAVARLSYRRALARKKRKEREAAGEIKELNITAMMDMMTILLVFLLKSFASSSAAVTASEDVRPPVSSTRATPKDTVAVTITPRNVLVGEREVLRLQNGQFPADKLQGRLVLPLDAQLKKEVEKLKYIAARNPSAPFSGELSVIADKKIPYDMLLTVLYTAGQNELENYRFVVLQKEGE

SEQ ID NO: 11876 - protein, 28 aa, Myxococcus xanthus
MADFLTRFTECDATCQQEIAPALQRSVR

SEQ ID NO: 11877 - protein, 173 aa, Myxococcus xanthus
MAFHYSRRKLKVREEEEAGELNIVPYLDILMNLIIFMLLSITGLATFGIINVNAPAYGAPTTGMAQENPDDAPKLTLSVLISKKGHFVSSENAILGEAGTPTIPVKADGAHDFSALNAKMVEIKSAFPKETKVIVGADPDVPYETLTQTLDAIRETQGRERRLLFPDVTLGAI

SEQ ID NO: 11878 - protein, 245 aa, Myxococcus xanthus
MIPSVSELLLDVTLAATEGGKLGVTDSVIKFFKDGGPFMFVNLFWLACSLAVALERIVTLVFRYNLNAPPFMEQIAKLVRSGNLDRAVKVCAMAPNAPLAKVVRAGLVNANRGEIEVSKAVEEAIVEHSPNVSKRIPWLWSLANIATLVGLVGTIFGLIGTFQALGNVPAEQKQVLLSDGISKAMNNTAFALSIAVICIIFHLFLTSYAKSMVEGLELNALKLENLLSRRGSVDPATTELEARAS

SEQ ID NO: 11879 - protein, 856 aa, Myxococcus xanthus
MATRTKKKVEETEAAEEKAPAKKAAAKKAAKKKPAAKKKTAAKKTAARRRTKKGDEDELPTVEADAEEEATPRGKGPHYLVVVESPAKAKTIKKYLGSGYTVKASVGHVKDLPKSKMGVDVEHDFQPEYTVIKGKEKVLNELKKMAKSADRVFLATDPDREGEAIAWHIKEELAHPDALRVTFNEITKKAIQEAIAQPRQLNQDNYDSQQTRRILDRLVGYQISPLLWKKVRRGLSAGRVQSVAVRLIVEREDEIKAFVPEEYWTLDALLEGPAGPPPFKAKLSKLDGKKVELKERVFTESLVAELQTASFSVAKVDRRERRRNAPAPFITSKLQQEAANRLSFTAKKTMTLAQRLYEGVPLGDEGQTALITYMRTDSTRLSDDAVKQVREFIDGKYGKDFLPDEPMVYRSKKSAQDAHEAIRPTSLEYPPERVKPFFEAMGEEDMYRLYELIWKRFVACQMKPAVYDQTSADIAAGRATFRASGSTLKFAGYLAVYGAGLTPEEEAEKEKAKAAGDENAEGADAVGELPVLNDGDALNLQKLLHEQHFTQPPPRFSEATLVKELEERGIGRPSTYAAILSTIQDKKYVEKLEGRFRPTDLGNMTNEMLVKHFPHELDVTFTATMEEKLDQISEGGANWKSVLHDFYGPFKETLEKAEAEMRDVKREEIKTDIPCEKCGNLFVIKFGKMGHFLACSNYPDCKNTKDFKRDAEGKIVMVEEETTDEVCEKCTKPMVIKRGRFGRFLACSGYPDCKTSKPISIGVSCPECKEGYLTERRSGRGKIFFGCNRYPDCKFAAWDRPLAEPCPTCASPYLLQKFSKRDGPYVACPNKECDYRREITEQPGGPGGSPEASSAA

SEQ ID NO: 11880 - protein, 39 aa, Myxococcus xanthus
MVTEVKERTSNCLMTRSLEELVPGDRAHMSAGASPSASR

SEQ ID NO: 11881 - protein, 156 aa, Myxococcus xanthus
MLSLAVAPTAYAQQENEEEQDTGGEMGGAEVMDEAPDSAPPTSVAMPPGAPRGRESAPGEVHSVESGDTLWDLSQRYLGSPWYWPKVWSYNPEIANPHWIYPGNQVRFFAAGEEVPTQVTEMVVDEGDVTAPMEMTSNDQVIVTGKIGVDLSIPSP

SEQ ID NO: 11882 - protein, 170 aa, Myxococcus xanthus
MEPDDEQMEMFISPAPDEGSAVSASAASAATMVASNEDAGEQQDPDVLDAEFDKAVNMLRTGNVEGGVEKLRRFADENPRHPRADNALYFSGLGQIGLNEFKGAAKTFERLIDKYPAGDAMLDGMLRLAECRMRLNQSADAKVLYTRVVTQFPGTAAATQAEQRLAALPQ

SEQ ID NO: 11883 - protein, 253 aa, Myxococcus xanthus
MSTEFLTSALLPVPHGFTTRAGGCSEGPYASLNLGFSVGDERARVEENHSRLAQAAGAPLEALSRVSQVHGDRVVEARSGEGAQGLRPTEGEADGLWTQSPGSWVAVGTADCVPVLLVDPDGRGVAAVHSGWRGTDADISARAVEVLVARGARPERLLAVVGPSIQVCCYEVSEELAQRFRARFGDEVVRWVEGKPRLDLTRAVRQTLVGAGLKLAHVDVLQACTACEPTRFFSHRRDAGRTGRHLNYVVHRF

SEQ ID NO: 11884 - protein, 197 aa, Myxococcus xanthus
MSVNYVALGDSTAVGVGAARGGGYPERLASRLSAVGLPVGLTNLGQSGARIRDVFTGQVKRAVAAQPTLVTLGIGTNDLWRGTPVEDFQDDLDRIARRLKQTGAPLVVVNLADLALAPVARLVPAALYEGRIEPFNAAIAEVARVHGMHHVDLFTASKDMIPKSPHFFSDDGFHPSADGYEEWADLLLPTAQTLVSR

SEQ ID NO: 11885 - protein, 409 aa, Myxococcus xanthus
MEDNPLFERFFGGGREGGRPRREPLRQGAGSGFIIDPKGVVLTNNHVVEDAVSITIRLDDGRSFSGEVVGRDPLTDVALVRLKEKVENLPTVKLGDSDALRVGDWVVAIGNPFGLASSVSLGIVSARAREIGASQYDEFLQTDAAINPGNSGGPLFNMKGEVVGINTAIVGGGSGIGFAVPSNLIGSLLPQLEKEGSVTRAWLGVGIQDLTRDLASALKLPVNQGAILTQVMPSSPAAKAGLKQDDVVIAIDGRTVTSSGELTRTVALKRPGSTSTLTLYRDGKKQDVKVTLGTRPDLEGVASGKQRPEDQQESSRRVGVSLQNLDARTAQQAGFTDSSGALITDVVPGSPADRAQLEPGMVVIEANRKKVENADALARIIKGAESGSTLLLRVTAPGGARNLRALRVP

SEQ ID NO: 11886 - protein, 311 aa, Myxococcus xanthus
AVPRPLHGPYAPVFTEAGVAAYARDPESSQQVWSTEHGYPGDPDYREFYRDIGWDLDLDYIRPFIQPTGERKNTGFKYFRITGKTNEKRPYDPLAARERASVHAGNFLFNRQRQIEDLASRLGGREPVVVAPYDAELFGHWWFEGPQFLDFLIRKVAYDQKTFRLVTPLDDLREHPENQVATPPLSSWGAGGYANMWLDGSNDWIYRHLNHCAKQMVELARDFPDAGELQRRALNQAARELLLAQSSDWAFIMKTGTMVEYAQRRTREHILRFQRLHEQLRGGSLDEGWLSLVEGRDNLYPELDYRLYLPA

SEQ ID NO: 11887 - protein, 168 aa, Myxococcus xanthus
MKCESCGGELLETRLDSYHFDESGLEDVILVGVIERRCEKCNEREVVIPRLKELHRTIAKALAAKNSLLTPLEVRFLRKHLGFSQADFAKRINVRSEAVSRWETGAEEFSWHFELLLRLMVMLELHERNYTVKSFDEVQEKRLTAPVRIFAEKSAWRPDSTNMLTAAC

SEQ ID NO: 11888 - protein, 862 aa, Myxococcus xanthus
SKVHSAGRRFLKRLGVSLLMALLFGGVLGLLVYLRPTGIVPPKDPPSAWVPSAAVDAAQAWLEGWERVTYDWRVRELGERSERPDEAVVIAIDDETLAEARQDVRPGVATQPWPRQLVGRMVHRLVQEGALLVLVDLPFTDLSPNACAEASPASLSCDDAAFAAQLAKDPGRALLSFTWEAQGPRVLPPANRLWPYRVKLGVYDASDAASLRAQAVLAAQRPAFIIPAGSQVEVWGGAMDAADGKALGSRLGATAHVIEERRAADDSYRVGPTELFVALAEVQVEGLDAANLIELRQVQHPVVPLLSGSAGFGASTLVAGQDGRVRAVAHLMSYTVRGKRHILPSLPLAAAMRLAGTRSLRYADGKLHVGDQYAFPMSASGLSLLRWDAPNAGRGSRGSLARSIRAWNVLLNVFDVADERPARFENDLEGRTVVLTRTAGESAHLRSTPLGPETPGGAILGQALANILRSEGITRAAPDLDLLLTVGLAFLGAFLALSLSFLLRSVRGAVLYVGFLVAAGAGYAFGAAYVFVEQRLWVAMAGPLLAMVGAFVATIRYAYGTERQIRDFVHNALGRYVSPDVARLVARDLSLMRPERRKMSVYVCDIEGFTRLSESMPPEQLVGLFNAYLTEISAVVRSTAGQVDKYIGDSVMAFWGAPVRTDRHAHLACEAALKMREVLTERQSAWEKKYGRRLSFRAAVDTGELVVGDLGSEMKSNYTVLGDAVGLASRLEAINKVYGTYVLAGDTTAQLASGSYVFRVVDLVRFKGRPQPVRVHELVARRGEITPRMQEQLALHEQALTAYHQRRFAEAHALFERASHEYQDTVAALYAGRCARFLVTPPPADWDGVHGMEEGEPSAAAA

SEQ ID NO: 11889 - protein, 110 aa, Myxococcus xanthus
MGPAAHARILQEKDVGAFDGQRWWVDRPQANGTLLRACQGDCEGPDALALEAWFDRVQGRTVAGGWRKVAGHVDDSGHPEPSGTLRAPKQLLRLRPGQRPGPAHPQPRGG

SEQ ID NO: 11890 - protein, 78 aa, Myxococcus xanthus
MRAQGGDAPPCTVTAEYTITLKRPTPMAGPLRLEAKPVEIQGDRAVIEGTLTAGGKVTATCRGTFVAVKPGHPAYHRW

SEQ ID NO: 11891 - protein, 520 aa, Myxococcus xanthus
MWGRLGLRTQVAIAVLVPCLAVVSFCVVYFPMHQREVTLELLQKRVRVVARLISQHPALLSADSTPESTARVRDVLSMLEAPEALNERGGFTLRYQGLVSAEGTVLHGRGSIPTAIRSLGVEGLEGCATSTQHDEVSVRCASGERIYVAGFGVQEALSSVDDMRGAVLAGLAGALVLGLALSLFISRAIAEPVARVTEVVRDVARGDMSRGELDVPATGEVRLMAQSFNKMLGTLRTSVMEMVSRTEQLSGASRGLLGASADQEHVISQQAAYAQQIAATFEELSRTAEQISSSTEVVESSARRTHEAVAEAMAVVAQVVAGINDIRTESKGVADAIVGLNQDLQQVSKIAQVINQVAERSDLLALNAALEGTKAGEVGRGFSLVAAEMRKLAENVSASARDIARIVEKVQDSGEEAAAKARVGMATSDRGVEVAEQASSVFQRIVELARGTSEAARQITIATRQQRQSSEQAVQGARNVAELVKQGVDATGRTTRIAQDLQAVAEGLTAVTSRFKTTRN

SEQ ID NO: 11892 - protein, 95 aa, Myxococcus xanthus
MGKKSDTTIENRVYLFESLASSYVASATEVLSSEDPAVRQRARRALAELAFVSCVMADTAHLPAEQVRAQVLGAPERVPEAPSKVSGGAARKRNK

SEQ ID NO: 11893 - protein, 144 aa, Myxococcus xanthus
MSPPQTPATGVVMTLVSQPQFKTQLTHGPSGTVNQTEAPRDNGGTGGSFSPTDLVGAALMSCAVTTMHLFASREGIALGEVSARVEKRMSPPPRRIAELVLDIQMPAGLSAEHRATLEKVGRECPVARSLHPDVKLPLTFSYPD

SEQ ID NO: 11894 - protein, 175 aa, Myxococcus xanthus
MHAKRLGIYLNDHLAGSVGGLELAIRTEVENRGNLLGRYLATLVPELKEDQSTLLAVMDALALKRDGLKTRAAWAVEKVSRLKLNGTLVRYSPLSRLLELEGLCAATEGRLSLWRTLARVSVKDARLAVFPFESLVQRGEAQRSVLQRLRAQAADVAFAEEPQPFGTGEPLIAGH

SEQ ID NO: 11895 - protein, 356 aa, Myxococcus xanthus
MESSARREEALLTPREIYERLDRFVIGQDGAKRAVAIAAHNHLKRLLARRLRRTSLIKKSNILLMGPTGSGKTHIARNLADILHVPFTTVDATEYTEAGYYGKDVEVMISDLLFKANHSVEDTQRGIIFIDEVDKIARRSQGARNGAGSRDIGGEGVQQSLLKLLEGREVYVPLNVTQAWNKSDFVQVDTRDILFICAGTFSDLHDDGDEGRRAMGFGAEDSAKRSQKRISTRQLTDFGMLAEFLGRLPVVVQLERLGEEDLMRVLTEPPDSIVREFRELLSMDDLEVDFADPGLREVVRYSVERGLGARGLRSVLEHVMADVMFEAPERRRRQVMVDAGFVRERLRGLDSTQLDV

SEQ ID NO: 11896 - protein, 70 aa, Myxococcus xanthus
MGPNVVVREDTGRKRDPLSPEDYQLMGWPGEVYYSAMTSEKMRRVVAEHIAKDAPVKELFGQPDSDDGEE

SEQ ID NO: 11897 - protein, 254 aa, Myxococcus xanthus
MAYKVSKDPRTDIRERTYVPNLLRGLGITAKHFFRNLFGTRDTNTQVVDRTGASLMTTVAYPEEKPIYPEGYRGLHRLVPREDGKPRCVACYMCATICPAQCIYIEAGEYEDEASDSEDRVIEKYPTQFVIDELRCIVCGLCVDACPKDAIRMDTYTHTPPEYTRQNFVYDIPKLLKGAPVSHPSDPWNKREGSEEPHHVHKEAHTRIGEGLVELKLPHGEHGGHGKALPAGAQAGHQAVVTQQGPIQVTKFIK

SEQ ID NO: 11898 - protein, 66 aa, Myxococcus xanthus
MKERNLATTDIENIIEGGVVNSEGEQKDGRWTYVIETPRMGLAVAFRCDEAGEAHELVIVSVWRKS

SEQ ID NO: 11899 - protein, 472 aa, Myxococcus xanthus
MFTIVFLMAGGMASAYLVGGLVEEHWFTGASRLTNVLFLVLIFVMVIATLLTMAERKWSAFIQDRMGPNRARIALPGLKNRPLGGLPHILTDVLKMLTKEDLIPAAANRFMFNLGPILAFAPTFALFAVVPAGPSVQVFGRNVDMVVATPDFGALYVLAIASLAVYGTALAGWASNNKFGLLGGVRATSQMIAYEVALGLSLVGIFLTFSSVQFPAIIGDIGNALTGGTGQGRYLWRTDGAFDLGLPAWGIFIQPLGFLLFFAASFAETKRAPFDLPEGESEIIGYFVEYSGMKFGLFMISEFVEVVVLAGVTTAFFFGGYHLPFGNEWLANLPIMQEHGWLLGTILGTVFWLKVLFLIWVQLLIRWTFPRFRYDQIQSLGWKILLPLGLVNVFVTGALVLWDPSLRALAVLGIAEIGILVVLTTTTKVPAGGAHGAHAGHGHDHGHGHAHGGHGAHDLPAHAHGVAPASTH

SEQ ID NO: 11900 - protein, 487 aa, Myxococcus xanthus
MAEGQVVKTTTPKVKEQQRAVMEFLLLNHPVDCSICDQAGECKLQDYYMKYDYRPSRLEGTKALKNKRKVLGPRVVIDQERCIMCTRCVRVMNEVAKEPQLGVFGRGSHERIDVFPGSELNSNYSLNTVDVCPVGALLSRDFRFKARAWFLSATPSVCTGCSRGCTTYVDWMSQDSYRYRPRENEAINKSWMCDEGRLTYKYLNLGRVLQAQVGRRTNRAGEAVPVTTRKEAVQAAAKALRSVQGSKQLAVLASPLASNEDLLAGLNFAKSTLGVSTVYVGGRPSGSADHFLMTADKNPNRKGLELIAKGLGLKLETFDALTTALKAGTVKALYAIGTEVPGNVDAFAEAAGQLDVFVAQAFTESAITAQATVLLPASVPVEDEGSFVQQDGIIQRFRKAYPPKGDVVPGWEWVRELTRELGGESTWKRAVDVWRELAGKVAEFAEFNWEKASPADREKPGINPLPAGADGRPAGYREFGTPRVRGI

SEQ ID NO: 11901 - protein, 415 aa, Myxococcus xanthus
MADTLKPEAPNPDTDAYAHESELDAHLQTKRMVINMGPSHPATHGTVRLKVELEGETIVKIDPEIGFLHRGFQKSCENVTWTQCLPYTDRLNYLSAMMNNFGFLNAVEKLIGLEIPERAQYIRVIGSELHRLTDHLTCVGATGLEMGGFAPFLLAMEFRELLHDRTAELTGARLTTSFGRVGGSNRDLPEGWIPRVHKTLDQGLALLDEMEGLLTNNRIFVDRTKGTGVISAEDAIEYGYTGPALRACGVDYDIRKTKPYWVYDRFDFDIPVGEHGDNYDRYLVRLEEMRQSIRILRQAMDTIPAGPIIVDDWRIALPPKPEVYGTIEGVMSHFKLVMEGIQVPAGEVYDATEASNGELGWYLVSDGRGRPYKVHVRAPGFPVLAAVPHIIEGKMLADLIPTFDTINMIGGEVEQ

SEQ ID NO: 11902 - protein, 170 aa, Myxococcus xanthus
MGWLQSIVSKGLGWARKYSLFTYPYATACCGMEYMSVAASRHDISRFGAEFPRFSPRQADLLMVVGTINLKQAPILKRVYEQMAEPKWVVAFGVCASSGGFYDNYAVLQGIDRIIPVDVYIPGCPPRPEQVLDGLMLLQDKIGNQVHRIAEREEANPTAARHNLLLSMNK

SEQ ID NO: 11903 - protein, 123 aa, Myxococcus xanthus
MTPTPLTPYLPLAVVLLLAGGMAMLIPQITTRLGPRRPSAIKATSFEAGSESSGPARQRFAVKFYVVALLFIVFDVEAVFLYPWAVNFQALGWFGYVEMLVFAVTLVVGLIYIWKKGALDWES

SEQ ID NO: 11904 - protein, 78 aa, Myxococcus xanthus
MAQKKAKRANRDLEKTYPRKDFVAKLRRLADAIEEGKAFNIQVAGERLRIPADALFNIEHERGDGVDEVEFQLRWQRE

SEQ ID NO: 11905 - protein, 65 aa, Myxococcus xanthus
MDRIATLYAEPRSSVARHVAQARERLLKLTHRELAARLKLDGREVESLLGLVQSRLDLSLHRLMS

SEQ ID NO: 11906 - protein, 143 aa, Myxococcus xanthus
MSQAPETLTPLLLAGAPESLHDTLRSAPALEALLTELLDQGRAAWPTVALAPAALLHHVGRHLREEGTPLDALKQLHAADVYLACACAQGEPQALQLFEKHVLQKAAARLSRHLTAMVDEVLQVTRQRLLLDVHGCAPKIAEY

SEQ ID NO: 11907 - protein, 1038 aa, Myxococcus xanthus
MGCPSETTLSDFLEGALPDAHRTRVLAHVEGCERCQEHLALGASAAEAVPPPVEGPLVTTGTQLSRYVVQQRIGRGAMGEVYAAHDPELDRRVALKLLRPEGRHLEELRLRLLREAQALARLAHPHVVTVYDVGVCEDCVFLALELVEGASLAEWLEAPRPWQDVVRVFVDAGRGLAAAHAAGLVHRDFKPGNVLVGKDGRVRVTDFGLARPSHRGVSGHAAPASLDTVTAPASLVDSPLTHSGALLGTPAYMAPEQLQGHGVDARSDQFSFCVALYEALHGVRPFEGRTLEALGQAAREGRIRAPERESKIPARVRRAVLRGLRAQPEERFPSMEALLTELAPRAGRRLAWVGASTAVACLVGLTVGYVAAHRRQARCELEAERLTTIWGPERRARIHAAFLATGKPFAAAAWEAVASTLDGHADTWRELRTDACTASRDAPHASWQTAACLDTRLWHLAAVVDVLEKADARTVQHAPQMVASLEGVSGCRDAPELANRPQPPDALRPRVDAARRKLAEARAHMDAGNHPGALKETTALLQDIQGLDYRPLEAEVLTLHGYAHGLAGKPKEAEEHLYKALWAAEAGRDDETVARVWNLLLWVVGDQMARMDEANRLVHHARAAVERLGRERFPHIATDLHLRMGGLLLVQGKLDEADAEFTQGLELARRTAGPSRPRVTYFLTGLGRVRSRQLRAEEALALYQEAQAYAFQERQWSPEHPVLALNLNNIATELLALGRTQEALDTFQRSLALLEAARSKDHASLAAPLNNLAGLLRREGRLEEARSHYARALAIFERSKGTDHPNTVTALGGLGMVAYDSDQLDEALAHNQQALERIQRSVGQDSPRLEMSLRNLGLIHLRAGRPAVARRNLTQALGLLQKANGTDSVVACGVERDLARVDLETGAFRAALTRCQRALALDEAAQGDDSPDVALDLACLGEAHLSLRAPERAVPLLERARRIHARVWLDRKEAARVSFLLAQALWERPAPEGREQATALIHEAKAWLEAQGLRARREHDELVAWQTRHLPRVSEVTR

SEQ ID NO: 11908 - protein, 165 aa, Myxococcus xanthus
MRQLGYPVRMEHVRAVAGDAQLGRPHLARVLVDRGWVVDVKEAFDRFLGMRGAAWVERFKLTGEDAIRLIRNAGGTATLAHPGSSRMERLEIRALAQAGLAGLEVLHEDHNPSVRQKYLSLAKELGLVPTAGSDFHGEAISADHRLGTASMPPELFARLKSRAQA

SEQ ID NO: 11909 - protein, 477 aa, Myxococcus xanthus
LYGVRRIHLVGVAGTGMGSFAGMLKAAGYDVTGSDENVYPPMSDMLRTWGIPAATPYRPENLDAAKPDLVIIGNVIRRVNPEATAVRERGLKQMSFPAALGSLFLDRSHSVVVAGTHGKTTTSSLMAHVLVAAGKDPSFLVGGVTQNYAGNYRVGKGPHFVVEGDEYDTAYWDKGSKFLHYRPRTAILTSVEFDHADIFRDLPHYEATFEKFVRLIPQDGQLVVCAAYPNAVKLAREGCPGRVVTYVAKEGADADYTPRNLSFGPEGARFDVVARGEVQGTVQLPMGGAHNVENALAVIAAAQGLGLTFDEIAQGLATFSGVKRRQEIRGEPDGVLVIDDFAHHPTAVRETIAAIHHRYPERRLWAIFEPRSNTSRRNIHQEDYAHAFPGAARASLKVPERHDKVPVGEELDVRKLITDLQAQGIPAEGSTDVQALVDLAAREARPGDVLLVMSNGAFGGFIDKVLAALAARAQKGA

SEQ ID NO: 11910 - protein, 628 aa, Myxococcus xanthus
MDLKELVDEVRRRGIGLPLLIRFTDVLRHRVVHLNEAFRKAMSDQGFKGGYRGVYPIKVNQHRYVVETLIEAGKGYNYGLEAGSKPELLAVMALLENENALVICNGYKDEEYIETALFYSRLGRNVILVVEKPSELPLIAEVARRTGIAPRLGIRVKLSTRGAGKWEASGGDRSKFGLTSSELMNCIGFMKDAGLLNSFELLHFHLGSQISNIRNVKNALREVGCFYVEVARQGAPLKYLDVGGGLGVDYDGSQTNFASSMNYTTEEYANDVVFGVMEACDRAGVPHPTLVSESGRAVVAHHAVLVVDVLGTSEFGPAPVPDKVDEKAPSVVRNLWSTYREVTNKNLLEAWHDAQDAKEESLTLFSLGHLSLEQRVAAENIYWATCHKIMRIAREQGEIPEELDSLEKALNDTYFCNFSVFQSLPDSWAIDQLFPMMPIHRLAEKPTRRATLADITCDSDGKIEHFIDKREVKDALELHALNDDDYYLGIFMVGAYQEILGDLHNLFGDTHAVQVSLGPNGGYLIDNVVAGDTVTEVLNYVSYTKDDLVAKLRKFTEAALRQGRITLDESRNLLRMYEDGLSGYTYLEREVDASFGSSASQLRLVPTPDASGARPTTPPAGASGTSGT

SEQ ID NO: 11911 - protein, 251 aa, Myxococcus xanthus
MVIDLIILGLVLFFAMIGAITGASRQVANVVGLAVGYFASRRLGPVAAPHLAEALGSPLFLGAIVGTVLLFICTWLAVRYALGALLLRILSTGQHNENRGVDRFLGFVLGGAKMGIIAWVVLSAIAFFEQHVVIAGRRVGLSPKESLSIEVARRYNLFEMTQFAPVKNLVEVAKAAGDPKRAGRLQDDPAYKALRKDPRFQRLLQDPKLKQALARGDTAALLRHDGVLQLIQDPDVAARLGAAARASEREP

SEQ ID NO: 11912 - protein, 164 aa, Myxococcus xanthus
MLERTATPADIKRAFYRESRTYHPDRFFHMDSKELKERINDLYKRVTEAYYVLRDDTKRKKYVVDVTGPERAQKLRFTEASEAETKAAAKKEQEEQIGTHPKGRQFFQQAQKDADAGNWSAAERNLKMALTYEPSNARYKERLAEVQKQSQDEARDKGGSFKIR

SEQ ID NO: 11913 - protein, 531 aa, Myxococcus xanthus
MRIRSDSDPEGTWAPVRQAFSDGIYHGAALSAVADGKDGMHLVYKDELEQLYYRHFDGNSFGFRVLVESSSDWATQPAITRIGDTLYVFYNRVRTLNANYELRVRTVGEDGTLGSAVTLDGDATFKGYLNAVDVLPEGSGEVPCLFGEAVDAGSRGWVSRVSLVLDEAPPPDPDPGPGPGPGPGPGPGPGPGPGPFVLELVRSHSTHELLAVDGAGTLYGIPAEGPRSRLMASTDGGRTFSDRGQRGGNLWTVAAMEGGTLLSVASHSGEYVLQRSTDGGMTWGNPLRLGTYRARGPQSFARLGSTWFFLEYQTFTSAAVPLRLWASTDGGATWSVRSMFTAQRHGDALVADPATGTLWATMGSSEAQAAVLRSTDGGRTWTSLLRGYEANAQTGVVHTGGALLFGQSTLFEPEHPKLLSLSPEGTVSSLMELPGPAYSLTAVPGGGWVMGTAWSRHGDVHASGDVFARLFISEDGVTWQESRRFERMSGADLTRADVWGTLPSGELVVRVEDASGFGSAGVGFQVLRVKR

SEQ ID NO: 11914 - protein, 173 aa, Myxococcus xanthus
MVSLPSDVLERLREDLARAVARVCPPRMADRRDDLVQTAMMRVMELQRREPDRSRLTPAYLYRVAYTALVDELRNVSRRREVQLEEVESLSEPPVASSDPEKAAGGSQIAQAVRDCLRKLVQDRRLAVTLFLQGHSVPESARLLGWDDKRTENLIYRGLAALRLCLSTKGFEP

SEQ ID NO: 11915 - protein, 109 aa, Myxococcus xanthus
MRDEPEPPRLRGGDTAAVASQVPEAVPLKRDACVLRWSGGPEGTRWSVRLSTEDLGWVHRVDSLETREYRVPAEVLAPLHPGTTLLWQVEARLPDGQVLRGATFVNRLE

SEQ ID NO: 11916 - protein, 158 aa, Myxococcus xanthus
MGVAGGAGQAWSQSVPVTRAVKTAFSYGEARDLVVASVVETGVRTGQSQFVTLQLLDHSGAVVAQTAGVVDQETPLRLTYRTPTATPVFARAIATVSAETLSAAAVTVERWSVAEPASWTGALVCYFELVPMPRPPPPPPGPVTLKCEPVDPPPPPTR

SEQ ID NO: 11917 - protein, 882 aa, Myxococcus xanthus
MLSSGKEAEGPYLRAAQTFRRLQDAEGEVLAAINLRAILLAQGRTEEAWDWTRRVVEVASASGRPELHARALIVEASQLYEVELDLGRAFRVLKRAESLVFPDGAEGLKKQYLSVMSTVSERLGRLEEASDVNARLVELTRSTGDLFLEAHARFTLANVTLRRLERDHVPADRARALELARQAMAAAERAGNPTLVARAVRLTADLLGDTPEDRREADALMERCMALAESLDSDERRLACLWTRAERRAGVDPTGAIQDSEASLRLVSEVNDPLFHALALRGRSTVAYRTQPLPQALEHAERALDALEALRQTQSDASSQAELFATWARDYHRLAGWTLEAGGATGKPATLPFREAVSRAFAVSERLRARTLLDALVAFRARADSGDTPERRAQRSEVQSRLVVVQRQLLDPSLTSAGREAALNELQELEHRERDLRPAPHKSVQEFASLASVEKGLREDEALLVFLVGDDEDLSGTSAGGAWLFVVTGEGTHVHRIPERTRLAAAATLFSGLVERRDDSERGAAVALHAQLLGPALAGLPPTVRRLLLVPDGPLHDLPFAALRERRDGPPLVARYELALVPSASLWRHWHGEAPFTPIGDALVLADPEWALKQRGARPAARSRAGIFDEAAQLGALPEARREGLGVERELRGTRVVPRLLVGTEASERALKRADLPLLRVLHLAAHAVVDAEAPERSALVLAPGSEDEDGILQPREIIQLRLDGALVVLSACRSASGAVLPGEGVLSLARAFFEAGSSAVVASLWPLRDEEAADLVEHFYRHLAKGLSVSAALRAAQLEAIDAGLPPAAWAGLVVLGDAALVVAAPREDGAPMVSGLAGALVIVAAFLGLLALRRWGRSSSERSTPVRRAGDARGHRFSGR

SEQ ID NO: 11918 - protein, 155 aa, Myxococcus xanthus
MNATRWFGLASLTLLLASNAFAEDKAPAATNAAVGRWTTIDDETKKPKSVIAIYEENGKLYGKIEKLFREPKEEQNPLCDKCEGSLKNQPIIGMTILRDLKKDDDEWSGGSILDPANGKTYKCKVAVEDGGKKLKVRGYVGMSLLGRTQYWVRAE

SEQ ID NO: 11919 - protein, 435 aa, Myxococcus xanthus
MKTVSGLSTLNGLDDAMALFGAGFEGVPLPGLQVGDEGEALSTLFDADEVDAQADELERFLRERVFTEANVESTEDNATVFRLKGEQICTDGRAPADADCVRFVDDAQLRVRATNLGDDSLELELLIGAKRAEPLALRFLPKAVSLVVDLGGLKGAVEQLDAESAGFLPKVMVGQVELKVTKEGESHWIVSASILDALRLELALEGSTFAFSSARAVPLVAFEADGQAKRARFSLDLNTTEVRLPYTGLAPALRGKDWTVSLAGISYSVEATENQTDFVVKNLGLGDAQTHLSLGNDKLFALDLNEQSGRHFDVTLTRGADGAPLLKVQPEFDLVTRFYLAPLKADPASEIPAAYEDATYRLRLSGGAGGPSLRAAPANSATGFKGGLQVVTGELLLSANDSQVVVAQGQCLVGAEPASENDASLLSYLRQGSCE

SEQ ID NO: 11920 - protein, 161 aa, Myxococcus xanthus
MPRLPFAVVVGALALSGCASAPAIPPLGPEGQGTSQRSGLKGSQPLDFQVKRYPGGEPYDLASDRGSVVVLDVWATWCEPCKDALPYYQDLANEYAAQGLKVYALNIDEDPRAIPAFLAETKVTLPILLDQNAQVAERTLKVRGHAHHVFHRPQGHGAPRP

SEQ ID NO: 11921 - protein, 296 aa, Myxococcus xanthus
MLALCAIWGMQQVAVKLAAPHIPSMMQMAVRSGVGALLVGLLCWVRGERGLLRRGPWRPGLVVGALFALEFLFVGEGLRHTHASHMGVFLYTAPIFAALGLHWLVPAERLRRTQWLGIAVAFVGIALAFGGGWLQGDISPGVLWGDALGLLAGLAWGATTVAIRVSALSDAPPTQTLLYQLVGGVALLLPVALLTGQAGPISMAPIAWASLLFQGVIVCFASYLTWFWLLRRYLASNLSVFSFMTPLFGVSAGILVLNEQADGFFAVGAVLVLTGILIVSGSSLLRHQPTLKTGTT

SEQ ID NO: 11922 - protein, 184 aa, Myxococcus xanthus
MKANRIVLVSGPSGAGKSTVARGLAEQSPLARAVHLHADDFYSYIRKGALAPWLPESHAQNTTVMTALAASAASYAVDGYEVMVDGVIGPWFFEPWLVAARTHRLDLRLIVLLPGEAETVARATRRVHADALTDADVVRNIWRGFREVALPEGHVLDTSNQDAAETVGAVRRGLADGRFRLESP

SEQ ID NO: 11923 - protein, 233 aa, Myxococcus xanthus
MTYNVLYSAPEEDVQKSLDVIEKEAPDILCLRELTPRFARAFRKRLGKQFPHVRLVPRKGTWGVGIASRYRLLRTEHFPQTPHRMPALEADIRLGEHWVKVACVHLMAPGARHQRADDLLTSMEKNAVLRHRQAEALVRRYARWRGPVLVLGDMNEGRSGKAMKAFASAGFQHACDGPDAACGATWPGTASVLPSVVEIDHVLGRELRLSGAKVLRAGGSDHDAVRATLDFPL

SEQ ID NO: 11924 - protein, 86 aa, Myxococcus xanthus
MQGKGWKWLTLVGLGASLAAFTGCNEQSARENSRQVGREVGKATKEVQEGAREAAKETHGAAREAAQGFKEGRGGSGNPDAGVDAD

SEQ ID NO: 11925 - protein, 126 aa, Myxococcus xanthus
MAAQFLYLLMGAVGLPFFAEGASGLERILGATGGYLVGFVPAAFLVGLAAQRGFDRRPWTALPLFAVGQLAVFAVGLPWLVLSARLGVAKALGVGFTPFLPGGLLKAAIAAVLLPLAWRLVGPRKV

SEQ ID NO: 11926 - protein, 494 aa, Myxococcus xanthus
MTEPEKQRRFSGVKLVIAVAVAAALAAAGVTALLVNIMERKQEAKNPFYRVVELDDTITDPEVWGRNFPLQYDSYKRTVDQQRTRYGGSEAVARTPSQADPRTVVAQSRLEEDPRLVTMWSGYAFATDFREERGHAHMLDDQVYTERQHVTQQPGTCIHCHASVYVPYKKLGDGDLIKGFEKMNQMPFMEARKLVEHPVSCIDCHDPTTMQLRVTRPGFIEGIAALKASQGVPNFRVNQDATRQEMRTYVCGQCHVEYYFKGKEKRLTYPWAKGINIDQIMAYYDEDGHSDWTHELTGAKVLKAQHPEFEMYNQGIHAKSGVACADCHMPFMREGAMKVSDHQVRSPLLNINRACQTCHKWSEAELLQRAETIQTRTFETRNIAMDALVDLIHDIEAAQKAGQSEEALAKARDLQKRAQFYLDFVEAENSMGFHADQEAVRILSNSINFSRLGQNALRPSGGASTSPTTRPQGAPAPLTPVSTDGAGETQQGSK

SEQ ID NO: 11927 - protein, 115 aa, Myxococcus xanthus
MTEQYDGWRKSSHHAVATCNDCHTPAALVPKYLNKASNGFWHSFYFTTGTFPDPIRIRPANRQVTESACRNCHASLVESIETPHADSLQCLTCHNSVGHPEGSGNPELIHQEVER

SEQ ID NO: 11928 - protein, 206 aa, Myxococcus xanthus
MLRDPGIWRCTLLIAAFNAAIFAWYQLGPFLFAGLENPWLSFGQSGFLLAAGALAGALMNRALLRRGWTAEALIALGVLLLGAGTALVILLTALLPQSLAFLSGVTLISSAYAVAIPNVLGIALRAYADRFGTAGAVLSLFYYNLLGAGLVIAGYGQRLDFALAVCALLAAIVSVRPMRCRGALSEESPPGGKSRIPCSSSGGGRS

SEQ ID NO: 11929 - protein, 214 aa, Myxococcus xanthus
MELKLAGSHYLAPPQYGIWLPPDVEHRGMNRFEASHCSLYLAQAWCRGMPKTTCALAVSPLVKSLLEHLRAHELAQPRTSAERRLFRVLIDQLTLAPTHGSYLPMSDDSLLEPVLTALEQHPEDERSLAEWARVLHTTERTLERRCQQHLGLSFSEWRQRLRVVKALARLEQGHSVEAIALDLGYSSASAFIAMFRRMTGTTPDKVRGHGFVAS

SEQ ID NO: 11930 - protein, 195 aa, Myxococcus xanthus
MTPVLPNPDDVLGTHNPLVIVLRDLLSAEECAALIERIEAEGPTAAPITTSAGFVMRPDIRNNSRVMFDDVPLAQTLFERVAPHVPHRLEHEWTLCGANERLRCYRYDVGEYFAPHFDGAFVRTRDERSLLTFMVYLNECPGGGATNFLSLGHSVTPRTGSALLFNHRLLHEGATVTQGRKYALRTDLMYRRPAS

SEQ ID NO: 11931 - protein, 354 aa, Myxococcus xanthus
ATLWDEPTTGIGLYTRCLASALEALGVQLTRVGAQSSGEAPRAKAGRTAWTLGGLPRVLQRSDALLYHAHGNFNLPLIRAPGMKYVLTVHDLIPLLMPETVSAAFRWQFRLWMSRSLMVADQVVCVSERTRQDLLARYPEAESRTVVVPNGVDHVHAPVLDDTSKDFLRALSLPKEYVLYAGSLDVRKNVDLVLDALERLRLRGRPASLVLAGQSWFGAGRVKARISRLRSEGFEVRSLGYQSDAVFYELMRRAAVFVFPSRYEGFGLPPLEAMRLGTPTIVSTAGSLPEVCGDAALSVGPDDANGLARALDRLLHSPEERRALGERGKAQAAKFTWKRTAEGTLAAYEAALRR

SEQ ID NO: 11932 - protein, 359 aa, Myxococcus xanthus
MQGYSDIAARTFIEVVGRYFRYPEKSLHALLSLNGSNALALYRALLDGYAAERNGRMPDTVALLCRRNDAQITELRWLCERFREFGADADLVHPDEVSGDDAFVAHGKKYDLVYRHLFVRRLEESPSPWVEDFLGTVPGKKAVFLNPPASQVEVKLTFARLSQALAEPALAEAARLTGDELEAVRASVPWTRTFQPGPTQGPDGERVEDLVALVAATPARFVLKRAWDYGGRAVFLGRSAGTVPYTERVQVAYGAPMTWAELCARTAADTAGGGFVVQEVVDSPPEEHLLCEPNGTVLPTSFFVDYSAYASVGLARQPAWGGVCRGSMSEIVNIVGGGGVLPLITSEVASKLLMAWKAF

SEQ ID NO: 11933 - protein, 30 aa, Myxococcus xanthus
MVRHVHEGFAEEFLAKYQTELEALLAEPTP

SEQ ID NO: 11934 - protein, 493 aa, Myxococcus xanthus
MGSCSLSLALGTPEDLADMFCRVEAIPYETVRSLLEERKTWNTLGDYLTHLEQLPLGPHVASFLGHSALRAHTMGLHRSLEPGLRPREDELRAMESLVREGLELGYVGLSIMTLKWDKMGGSRDIRSRPLPSTYARWSEYRRLTRLLRERGRVFQGVPNISTKVNVVLFFLESVGLFRPSLKTTVISMMDTRANRGIHRLIGVLSQVANRLLGADFRWQALPEIFDLWADGIDLVVFEEFGAGAAALHLQDAASRAGLLRTPEYRSRFRREWTNRFLPRAFHRDFNESRILQCPDASVVGKSFAQVAKEQGRDAVDVFLDLISTHGDALRWYTVMANDRREELERICRHPDILMGFSDAGAHLRNMAHYNFPLRLLRLVREAEKRGEPFMSVERAVHRLTGELAGWFGLDAGVLAEGRRADLVVIQPDGLDAKLDKVAEAPMENFGGFVRLVNRNDAAVKAVLISGREAVNEAGVSPALGRERGFGGVLRVQA

SEQ ID NO: 11935 - protein, 187 aa, Myxococcus xanthus
MVDSVEPYHRAFTDALRAKYGKVLATGRPRITRFRPGQSRFSLIDPTGNNIIFIQRDEPEDLEYGGSAKLTGLAKAIDNARILREFKNDDKAAARALDIGLARYEAEAPVVDRVRALAARMELAIALGDATTGRALKQQLQAVPLPEEARSQLSDELKAAERLEDWLARTRPDPAPSQRTGSPRRRR

SEQ ID NO: 11936 - protein, 317 aa, Myxococcus xanthus
MELHDAGQGGEVGTTYFDVVIDGAPARQLAVSRHQSSYLLATGLEVGLHTVELIKRTESLVGHSELVALEVHGELREPPARSGLRMEFVGDSVTCGYGSDVALIPGSPSWTAPTFTSKNQNPRRTYAWLTAGNLGAEAVLICYSGHGVYRNLDMSTSGLVPALYELAVPGHGVAWDFSGPSPDVIVVNAGTNDTFAGSGTDAYLPDEAAFKSAYRAFLTRLRTLHPRAHLVCTLGSMSDGRKQLEQNGTTTSAHVGDWLTELVAERQQQGDARVYRHVMAVQNPNVDGVGEDWHPSAATHQKMAEALTWFIRDVVRP

SEQ ID NO: 11937 - protein, 380 aa, Myxococcus xanthus
RARAGWWQHDNAWTSWVSPGSEAGPASRRPRPFIRRPSPECARALLFLLTANPGPAGYDGERVPGHRLGWTSRRSAAPTWRIWRKKPRMARTLDGTEISRVMRAEMAQDVAALQAAGVTPGLSVVLVGNNPASQAYVASKTRACESLGMRGQTLTLPEDVSKEALFAVIDRLNADPSVHGILVQLPLPAHLPYKAVLEHIHPAKDVDGFHPVNAGLAFVGDPRAFVPCTPAGIMEMLRREDIPTRGKHVVIVGRSLIVSKPLASLLMAPGPDATVTITHRHTPDLASFTRQADILIVAVGKQNLITADMVKPGVVVIDVGQNRVSDASSPRGYRMVGDVDFDAIQPIASAITPVPGGVGPMTITMLLANTLQAARQTQAR

SEQ ID NO: 11938 - protein, 522 aa, Myxococcus xanthus
CEPLKLDVALSPEAEHLLSVLREHPTPAEAARVLGLPVVDVERQALPLVKTALLLWGLPFRPNDFSTFESVRDAVAALPDLEARTRWLERFETLARLKADFESGDLAQRRELLPRLEAAFTEVTGKPARRGDGQVYADRLILYEEASSPFRLRFGAAFTAELEAALTGALELSAAYGEKVQQGFREQVRDALGPDAGPMDLLDYAVRLRPDGVTGSRFSPVPPVMLESEEGRARTLPVDFLGTSTPGGRYALPDVCLAAKPDGSGFEVMLARVHHHLLLWSWLSAFQPERERYASVASRWLEQDAAARGLVGLAIRRRNKGFYVYPGRRLVYSVSDVLDVDEGALTPGDVKVLPTREGPVLVDGQGERLSLYLPLDDFSSYPPFAALAHSQVLHAPLRTQGSHLPRLSVGGAVYQRERWNLAAERLGRPAGFELFLAVQRERRAGGWPRFVFMRSSKERKPYLIDTASPFAVDLLSHLARDAERLSVEEMYPAPEQLWLKDARGRYTCELRMQFTRWSEVPA

SEQ ID NO: 11939 - protein, 153 aa, Myxococcus xanthus
MPGENVVAPPVKKLKRPVEEVRAELLADADVKEQARLLKVPVEEYVEKIIDYALNPEKPPQIEIVPDEELKAKDPNVPTIEELQGHLQDIVDGRVVISRAHQRDGFSDQDADARFKSALASDAAQTGAPESRKGTSASDLHAAEGKKPSTDKN

SEQ ID NO: 11940 - protein, 133 aa, Myxococcus xanthus
MGGLKGIVGKVLNVVKPFVSAVNPLLGAAMGFASGLIQGKNPLQALMGAATDLIPGGGALKNTVGKFASKFLMDGAGGNSLLSGALNLATGKSKVTDVVGDLLKNTAKTGLSQLGMKNAAELSAQRMSQFLVS

SEQ ID NO: 11941 - protein, 126 aa, Myxococcus xanthus
MTPILYVPELHFAQVQEWLQFWNDAVTPETLPQTGFIIPGKAAGFLYRTDSSLAMIETLVAAPGLSKEERSAAVDLVVAAISEESTRLGFQVLVGYTQLDAVVKRAERHGFIYVDGGFHVIAKRLR

SEQ ID NO: 11942 - protein, 145 aa, Myxococcus xanthus
MLVVHQPGLHLTRVVSGPSYLAPWRSGEIVVGATEEDAGFVEQVTPAGLLHLSATVAKLAPRLRDARFVRAWAGLRAATPDGHPYIGRHPGTRRTYVATGLGGQGILTGAHTGALLAELVAHGHCAAAEPFSPARITDGSPLATR

SEQ ID NO: 11943 - protein, 211 aa, Myxococcus xanthus
MNRRERNTARGWNKLEDGPVIPGEGAEPMRRPRRIIGVFGSGKEDHAERVIPLVRWIAEAGFDLLTGAGSGVMRTAADAFVQVAYRHGISIGIVPGTVEGGEYRPRSGYPNPNVELPIYTHLPLSGEQGTEPLSRNHINVLTPHALVSLPGGAGTVAEAVLALRYGKPVILYGPPESFRRFPAELERTDSLERVAEFLRAAVRDPLRLAMP

SEQ ID NO: 11944 - protein, 273 aa, Myxococcus xanthus
MSQDSPDSLRRTAEEGARLAGRILADRFLGERTIEFKGGIDLVTDADKASEEALLAFIRERHPDHAILAEESGATQGTDSLRWLVDPLDGTTNYSHRVPHFCVSVAVEGPGGVLAGVVYDPMLNELFSAARGQGATLNGRPLRASTVSSLDRALLCTGFPYDVRERPEGPVGLFTRLILHAQGMRRTGSAAMDLAYVAAGRFDGFFEFGLKPWDIAAGSLLVEEAGGVIRHISGEPFDVLRGDVIASAPALAPALLSEAKRFVDGLREQPPRG

SEQ ID NO: 11945 - protein, 131 aa, Myxococcus xanthus
MISPDHPLASWFLIIAGTLFLVVFAIPLLLMPLTWARWFGWRLPEGNNHLTVYFGRCLGAVALAIILTAARFVSRPGPAIFDLIGWVCAGMVVVHTWGALKKAQPVSETVEIGFYAVVGVLAMWIRFNALS

SEQ ID NO: 11946 - protein, 1420 aa, Myxococcus xanthus
MSPVDIDPILATLAPYIPGAVLRRLERTEAHALPLVEPVRGAILLLDIAGFTPIVVSLSGAGPRGIDALQRLLTSYYTEMIDVVKDHGGDIYQFAGDSILACFEVEPGVDASGAVQRAARCALDVQQRLSRFAQLELLGQRFSVSSRIGIGFGEAHRVVLGATGMWMHPALIGQPLAQAVAAEKRATVGEVLLSPEAWALLPEPARQGETRGNAYRLAPTVPLRVPPAPGFVLPSGPEMVARCSLLLHPVLFTKITTAHQEFSGDFRDVTCFFLRFDSQRASARPEDFTRDLNAFYEYVQRESAHHGGVLLMTDFTDKGNVLYVIFGAPTALQSKEVLACRLACKLMRERESFPFVSSLQIGIATGPAYFGDMGSPWRKGYSALGEVVNMAARLMTHGQGSGIHIDAQTERKLHQGGFDTEFVEDARLKGVSRAVPVYRLSAEVRRSLFLKGKGDIVGRQREVAALRQSVDESLEGHGRICVVSGEAGIGKSRLGAKVVEVAEARGAHSLYGICYSYEMFTPFFPWKEVLVQLFGLHEGDDVETQLSQLRQGFAGLEDTGPEWIPVLAGILGLPVEESPLTRDLDARRKNQKLFQIILQLLEKVSRQTPVLLFFEDLHWADNISVDLIEYVAARLSPLRVTLLVTMRPGEHLKSLKGLPGLRWLDLSSLDDEDTRALLRLHLRMETPDTALEDLLLAKVQGNPFFTESIVQGMVEKGYLGPVAPGAERLELKRSLQGLELPDSIQDVVLARIDLLTETEKLVVRVASVVGRIFTLEAVAALAPGSVSPERIREAIDTLTRLGLILLELEEPFTCIFKHIVIRDVAYTTLLVSAREDLHRRMARFIEARAGENPVKSAGILAYHSLAGNDEVKGLEYTLMAARSAREQYANDDAVHHYNRAMEILGGTVALDPEEVLRKTHVVMKELAETLLNAGNYAGAILMFEQCLADEEQVPRRAEIHLGLGRAHQEKGESKRAIQELETALELMGRTMPRSMAALVLRSVLAMGLHLLYGLFPWLVRPLGARLPLYLKQLSTLISLIKIYYFADIGKLTWATLVATTMAERSRSEYGLSLATSYYGSLLFGSGMVGRSGHWCQRALEHARRSRDTAAEGVALSRLATQSIFTNEQARATEYGEQAVSLLRQVGDMWEVQTGLMMLATSQFLASRFQDAERAYLEMGRVGVELNALMHQGWSHAWVPMCRYLRGDGDVGELCAELEEGLRISIDVQDLANQCASLNHLVNVAVREHQVEEAALMAVRADEALWRYHVLVPFLQIGLVDAAEGALFALEQGAVSVPREQLWALYRRCALKARALGALYPYLRGPAMRVMARAKALKRGAKAAEPLFDRALEVLEATPNRWETGVAYLDAAAALPHRRTALLARARGIFTAIDAQAELRRVERMASGPQDTAPMLAAALT

SEQ ID NO: 11947 - protein, 127 aa, Myxococcus xanthus
MSVETASIYTGSSDRDAHLRSPDFLDADAAPKLTFRSTRIEPAGGASFRLLGDLTIRNVTQPVAFDARHIGTSKDPWGNSRLIYSARTTVNRTDYGIRWNKTLDNGGWLVSEKIDLELDIQAIPATA

SEQ ID NO: 11948 - protein, 1387 aa, Myxococcus xanthus
MTEHIEPRAHRFPTLVDVLCQRAESQGDALLYRFLETGDVDGPVEEWTYRRLDSRARSLGARLRALGAQGERALLLYPPGLEFVAGFMGCLYGGVIAVPCYPPDPTRLERTLPRLRAIARDCGARYVLTTSTIQEMAEFLTPQAPELGELQWIASDAVPEAEAADWKRPDLTSESLAFLQYTSGSTGNPKGVKVSHANILHNESLITRDFGLQAERSVGVGWLPMFHDMGLIGKVLQPLYLGFPCVLMSPIAFLQRPLRWLEAVSHFKGTVSGGPNFAYDLCARKARAEDVARLDLSHWDLAFNGAEPVRRETMERFAETFAPAGFRREAFYPCYGLAEATLIVSGGVKGTPCVQERYDTGSLELGRAKPASDAAEGPTARTLVSSGQGAPDQRLLIVDPETRVPRASNEVGEVWVAGPSVAGGYWDRPEETAHAFGARLANGEGPFLRTGDLAFLSPEGELFITGRLKDLLIVRGRNLYPQDLEMTAERAHRAVRPGCSAAFSVDVEGEERLVVVSEVDVREGFDGAAVVGALRRALADEHQVHAHTVVLLQARSIPKTSSGKIQRRACRDGFLAGSLEVVEVSGEEAAPVPEAVPSTPSAPLRERLALASEEARPALLVDFLRVEAARVLRAAPASLAPETSLASLGLDSLMALELHGRLEEELGVSLPVAFLWQHPTLGTAAAHLVDAWKGSAAPAAPPLKAGSLEGELPLSPGQQRLWFLDRLVPESALYNVHFQLRLSGALDVPALERALQGLLSRHAVLRAAFPEVEGQPRQLLPPLRPLDVAREDLRALSPAERDARLNQLARAQGEAPFNLSEGLLVRAALVALEDQEHVLLMTQHHIVTDGWSIGVLARELAALYRAEVAGAAASLGAPALQYVDYARWQRGLGGALDGQRAYWARKLENLPRLELPTDFPRPREPGFRGALHRFALPAELVDSLKAVGRSEGCTFFVTLAAAWAALLHRYSGQDDFGLGTIFAQRDRAELRDVVGFFASTLVLRADVSGAPRFRELLGRMRHTFHEALAHADLPFEEVVGASRAVRGGDNPLFQANLVLESLPPVDMDVPGMQWRPVLPVPDGAVEGTAKFDLQLAVVETPRGLEGALEYRSDLFSAETMARLAGHLEALLRGIVAAPDARVEDLPLLDEAERRSLLERWNDFTAPLSQDASHCIHAQFREQAARTPDAVAVVAEDGTLTYAELARRASALALHLRGLGVGPEVRVGLCAERSVEMVAGMLGILEAGGAYVPLDPDYPRERLTYMLEDSGARVLVTQSHLAGTLPVAGLHTVLLDTAEPYAAMPASPLALGTTPDNAAYVIYTSGSTGRPKGVVVPHGGVANFFAAMDVRVGHSPAGAWLAVTSISFDISVLELLWTLTRGFKVVVL

SEQ ID NO: 11949 - protein, 627 aa, Myxococcus xanthus
MSCLTPTLRPSEEPPVSPPFARPRELAVTVETSLPAALPSHAIEVDVGVALPVAFGGLRQVLRACEAAAPQVVHTLSRAHPSEWNRLFPGAIDGVPDLGDLALTPSERRLHRESEQMFWVLNVAAKAIVETLRASGRPLVLHGAGECDLVSLRAVMRAAEWSRLEGLHGTLLFTGWNVRRPHGAESFESRRQAYLDALCDRMRAPRVPTPGPVSSRALEAPVDLEGRYLQVAVDAAQAPETRVAAAILAIRSCFFTTNYEGAMLAAEQGLSVLAANTDAALASRVVQAWETLDTGFATPAIEIDRASLGDVEELKALFARSMGVVHVYTGAHDAAMEAFGRGLACRIPPELVARLHMFRALTLTKRFGQLPNARTEVAAGLAALERSTSPDRALQEGWLRNVCALTWFLERKLDMALVEEKQAMRCVGDLHDASATHLKINLISNASYLQETARQFGDAISTWRRFEKISESWGVNFAKHHRYRLAGLELAAGERDAAVAHFTEAFANADALGDSFHRQVIAAELGRLFLDEQQPAVAVDWFARAEEHARAIGDPLKTAESLAGQAVAAGRTDWSEAVRCAEASTTWPKQTEALKAALAQGDAKAVHEALPRARTKLNRPFDPVNLY

SEQ ID NO: 11950 - protein, 471 aa, Myxococcus xanthus
MRIAVIATYTHPTRLRLKEPSIMQSSVPELIAGLCPPHVEVEIFNEKERDIPMDRHWDLVFFSYLHSFYEHTKVLSTLFRQRGMTTVAGGRHASYFPDDAQQYFDAVITGEPEANVPALIEDFEKGQLQPRYQRPPLGPAAIRPYRYDLIDFTHNKLRLPGIEASRGCPFSCNFCVLTGNERYRYRPVAHVIDEIQQHMHWNPNFMGLMDDAFVFLDNNLGGSPKYLRELCEALIPLKKTWGCALTFNVLKDESLVKLMAKAGCRYVYTGLESLNPDSIKAMNKGQNKLSEVDAVIRRVFSAGILLSFGLIVGSDGDTNAYLEKLPEYLSDLQYFSVTFLGIVCPYPETPFFRELQAENRLLPGTLSRDYDGYTLCHRPKSLDTSEVVEHFHRLCAQLGSLPNIARHYWSKLTMSDMPRYKQTILFSGPEIVSIRNPVKNTARRYIAGQDALEYWDTQQMAQLGLQPQRLT

SEQ ID NO: 11951 - protein, 329 aa, Myxococcus xanthus
MSRPLPSASRDRKRLRAAALLAALLSLSACEGRETPPGPNEPCVGAACGPLQPPDTALEGSVRIATFNVQRLFDTVCDSDACGGSNYEALPTPSEFGLQADRLASAISRLNADVVLLAEVETQASLDALTSRLPRFGYSELGETGAAASVDVAVLSVHPITDVRGHRERTLWRPDGSATRFSRELLEVHLDVDGKKVIVFSAHFRSKSNDDAGRRFAEAVATRDIVAGAAQAAPDALVVLGGDLNDVPGSEPITALERDGALLRVSSDRPASETWTYTYHGDTQAIDHLYLARGGGTYVPGSFRAARDPRGGYGGSDHAAVFADFLPAP

SEQ ID NO: 11952 - protein, 539 aa, Myxococcus xanthus
MAIGVVTHGKKLAYTFDYHGRAEIEIVGEEVEGTLKPPRFRPRPQSPVFLLDEAESARVLGVGGDMCLGLVVGYEKMEARLNPRDKSILPRHTGIIGTTGGGKSTTVATLIHRAQADGIATIVFDVEGEYTHVDQPTDHAAMLEALKRRGQRPQGVKDLHIHHLTGRDSLNPRHRNKHAFSLKFSSLSPYALAEILDMSDAQQERFLKAYDVTKLLLEDFNIYPQTEEERRQVLDVDELSTGFPHMTIDHVLDVVSAYIYSLSDEGKSETRGRSRATPRKQASLLEENDDAEADPDVTAKAPSRGLMLRTEFKSNFGRVMARVMAQSSRHEISWKALASKLHRLRRLGIFDVGNEQGVAYESMLTPGRVSVIDLSDTDSPQLNNLVIADILRGLQEAQERRYERANAKDQSVTPVLIIIEEAHEFLSANRIAQMPVLFEQVAKIAKRGRKRWMGLVFVTQLPQHLPNEVLGLINNFVIHKIADSSVISRMQKTAGSIDESLWNRVSRLAPGQALVSFSNFTRPLMVAVDPAPVKRLLVE

SEQ ID NO: 11953 - protein, 350 aa, Myxococcus xanthus
MARFRKEIASAVDKEGVVKKIIRQQVLPKISANSRGGAKEAGVYRATPEELATVHQSLLFSGKVEAVNSISTSHESLPIGITQIGIAAVGYGGTSGTFSQRLFRKEMSDQRSNPVQEALACIDQRMDRSASPRERSLSKLARRGIKTYAERAVLVDKSEAEWRIGHGNPCAYELITGSGYMSLLRESINVLRRLILQQKKFVFVPSTLEERGILTIGHALQAGEYVIFETLERYGRRVIEQWKYGDRSQNFAARFVQECCPEVISGVFRASERTPPRSFYAHRDHVHLAARVAMADSILRPDRGFPMLLDVAEASCRSAFGEDGFMGLVHDAYAQAGANLEFFNEHSKRH

SEQ ID NO: 11954 - protein, 405 aa, Myxococcus xanthus
MSGKFVSRSLALLGICGGLSALGGCGDAEPVPAALEPVGQVEGAAIVDTITEGTYVIRSVMTNKCIDVASSSTADGAKVQQWDCNGTNAQRFRVTPTSGGYFSIINVNSNKALDIKEASTAANALVHQWGYGGGANQQFRFVKEVGSEFSIRARHTDMAIDVYWGNTANGTELVQYPYEQRTNQRWTFDRIDGGGGNPGTGLAAILSESTFNAMFPNRNPFYTYSSLIAAASTFPAFANTGSLETRKREVAAFFANTAHETGNYVYVEEINRGDYCGSWGPPGCYCVAGKKYYGRGPIQLSWNGNYCAAGAALGLPLHTNPDLLAQDANASWRSAFWFWTTQAGAGTMSAHRAMVDGHGFGETIRTINGSLECNGRNPGQVQSRINNYQHFTNMLGVSPGGNLGC

SEQ ID NO: 11955 - protein, 204 aa, Myxococcus xanthus
MTSFRAALTVLSLMTLPACFGTSQRPPPPAPTPAAEAEAARSSGGKLGPGDVVEVRVFQEPEHSGTWRLSSEGTIDYPLCGKVPLSGTTPSSAADQLRDCLARYVRRPQVSVLIREYNSQKVFVFGEVQKPGTFPVDNEMSIVQAITLAGGFTKLAAKNNTLVTRVVDGQERKIRVPVEDIGVGREKNFMLQPGDIVFVPESFF

SEQ ID NO: 11956 - protein, 384 aa, Myxococcus xanthus
MVDRSNRQRVMLLADLGAMTAIGLMWCFVAADRAGLWPLQNWHFYPPLAMSAAFSTFRVLAFSTATPLLVSKQNLGRANGMVELAMSAGQLLGPAMAGVLVVRMGLQGVLLIDLATFLFAVATLLSVRIPQPEPDAARTEPRKSLWTDIALGWRFIRERPGLLGLLGFSSAVNLITVLVTVLITPLVLSFTDPTTLGLVVSCSGVGMVAGGITMGVWGGPKRRILGVLGAELVAGVALLAAALPASVFVVACAAFVFMFTAPVAMGCSQAIWQSKVPPAIQGRVFATRRMLALVAPPVAALLAGPLTDKVFDPWMAPDGALANTFGQVLGTGPGRGIALLYVVLGLLLAGCVMLTASSPRVRGVEDELPDALLPQGLPAAQQQA

SEQ ID NO: 11957 - protein, 256 aa, Myxococcus xanthus
LGVHAVLLLKAGALPKTSSGKIQRHACRAGFLDGTLELIGAWRNPAAQEAPSEQVAEAPHPPGTPAWLRARVAALLRVSPASLDTQAPLTRYGLDSLQSLELHSELERELGIVLPLSALLQGESLDALARRLTEATPASEPNPGPAPLTGPLPLSYGQQALWFLHALAPTSAAYHVARAVRVRSALDVAALRQALHALMERHPALRIRITSEAGQPRQEVMSPVEVPLRVEDASGHDEAWLRERVTAEAERPNLEQ

SEQ ID NO: 11958 - protein, 92 aa, Myxococcus xanthus
MVALLPKQVYLSFDIDGLDPVLCPHTGTPVPGGLSFAEAVALIAGVVRSGRTIVGFDLTEVAPDPEGGEWDGNVGARLLYKMIGWMLKSQQA

SEQ ID NO: 11959 - protein, 416 aa, Myxococcus xanthus
MQKAGISPPAVAEFLARGALPPGLMPAKWPELPGQLHASGSPDGSGAQAGSGSAAGGNAQAAPAAGSTGQSGSGSAGAQTQSGAIGHAQSGAGAQTQSGAGSQAQAGAQAQSGAGAQAHSGAQTQSSAGGQSQAGASAQVHSGAGAQHQSGASTQAHSGSGAQAQSGAGAQHQSGTGTQAHPGATGTGASAGATVPTGPTGADAHAAPTTPPAAQKQSRTWMAFVGVGLALTVGAGAVVLSQLPSNIESELEDAGVTDALPVDAGVTQDAGPVDAGIPMGTLDVTVDPRVEVSIPGQYLGRTPVSAAVPAGRHVLTLSNPVLGIQTTRVITVPAGGRSSQQIFLNKGFANVRAPEGAIVTVDGRLIGAAPIEELDLYEGTHQLLVIVNNSRWQKTFKVEPGQRVTFDVNFEKPEEE

SEQ ID NO: 11960 - protein, 419 aa, Myxococcus xanthus
MNTSATEFDIIAWGATGFTGRLVAEYLARTQDSHRARWALAGRDLDKLEKVRQGLAAIAPSFAELPLLVADARDAASLDALVPRTRVVCTTVGPYARYGSELVAACVRAGVSYCDLTGEVQWMRRMIDAHHEQARQSGARIVHTCGFDSIPSDLGVLMMQEHMREHHGGHLEAVRLYMGPMRGGASGGTAASMVQAMEEASTDRSVRRIMAHPHALDPVPGRWRPESKDALGVHYSQELGQWTGPFLMATVNTRVVRRSNALLGHPWGEHFRYAEVASYGAGPKGLLRATGVTAGLGGVVAAMQVKPLRTLLEKKVLPAPGEGPSLEAREKGFFVAQLRGEGTSPRTGKQVRLKGKVAAQGDPGYAATSRMLAESALCLAFDDTPTTGGVLTPASAMGMRLVERLRRAGMTFEVEELST

SEQ ID NO: 11961 - protein, 457 aa, Myxococcus xanthus
MARLLIVEDNHELASLIVALAQSRGHDAKAAATGEAALESLGPGQHWDAALVDLLLPDIRGSEVLAALRAHGIPAIAVSGVYKGDRFAQEAVQVHGARSFFEKPFELITVMEALEQAGGVAPQPRAPPPIAESVLLDELLDTEDLIVLEEFPPEPSDAAEPLQVVPSTDPLPEPADTEHALPLPFGRREQVWSESTAPSTPPPPKRALPDWSLGGVLEDATVARLLNAYYEARHHGELKLQQGQVLKVVYFESGRVVYAASNLAAERFGRFCVRQGVLPEARLAEVAAFAKERGLRTGEAMLRMGLMDAAQREQLLVEQVKEIIWSTFTWKEGGYGFSAMRPRRTDLVKLSVFPGDLVLEGVAKTETLVTLRRHMPRSRRLFPTADAPYGLHELKLEGAQALVLAYADGSKTVEDLLALTDLPERQTLATLRGLELLGVLEERPDTPSRRHRISFGL

SEQ ID NO: 11962 - protein, 278 aa, Myxococcus xanthus
MMPRLSGVELCRRMKQEAQLKDVPVILLSAVLPQGAPEAFAFLHKPFEITDFESVIHKSLAASPEPRMAHAASPVGALGQWVAQTLQGPLETAREQLRRLECTPSVDRAALDTLAAQLQSMEAVGRHLRELAWLSSGEATLARIDTDVGQHLRDAVAAHGAHVTLEAPEEPVHAQVDPPRIRQVFDVLLANAVRQGDAEVALEISQTQLTVRVKDVGPGVAAEALAHLFTPFRMDAKGVRGPELYVASELVRLQGGALSVQSRPGEGSTFSLMLPRST

SEQ ID NO: 11963 - protein, 368 aa, Myxococcus xanthus
MVPDPKAMELVSSNHADDKEYLPMRVDATRLSIAVVNPHDFSTLDAIAFKTGKRVVPVVIPEFRMNQLLRRYCKAFRPLRAVDMNAVRPRPSAGSQAELAKAAETPPDLMSEEEFQSVYASALRGGADSDGDMGEEEIITGVEVLEAAPEPPPATVRPQVPVAPPPPPQAIAVPPQMVQPHVPPPAPALGGSPPPVQVPRAPEPPPTPLTFAEAQAELARSSDREDVAHTVLRFALGKWKRNLLLSVQGSLVTGWHGMGVGVRDAVVRRIGVPLREQSTFRLVRDTRSHYIGPVRRDAAMGVFYKLLGDGFPKTAVILPLLVRGKVVHLLYVDNGPDQLTPPDVGELLILSQSVGRSYEAMMRRRKSA

SEQ ID NO: 11964 - protein, 295 aa, Myxococcus xanthus
MEGAADLNARFNPDAPLTLEVSNQFARSDRTRTAAVGVGVLSLFNEARAKAPWRPGGGALELTPSVAYAVEFFQPLSSVSPVGCTESVCDPAAVERFDYGNLRVGAEGRWRFLPKTAVVLDTHLDVRSYFNDSTPGASLLRVIGGVAGLVSPKVAVTAKAGWGQNFGSTGGGTFLGQLEGTYLYSPTLSFKAGYLRTLEPVAAYGFFTDNRGYGEVRALFGGKLTVSGGLAVDFLRFDGGRNDTVVGVNIGPEYQFYPWLTGAAGYMLGRRSSSVDGGGLNYSRHEGYARLSVTY

SEQ ID NO: 11965 - protein, 128 aa, Myxococcus xanthus
MDVQGFHHVAIQARDIERVTGFYRDLLGFPELTRHLRPDGSLRSIWVGVPGGGFLAIEAAGGEPVSTPFRHEAPGLLLLAFRIPKAARAGVVDTFTRAGVPLENETRWSVYVRDPEGNRVALSHHPED

SEQ ID NO: 11966 - protein, 833 aa, Myxococcus xanthus
MVVPSHLTSEAPLTVDLFAGSGPHPIALFGNSDGLFRGQLDPAGTTFSAVMLPDGMSDVRITSVDVNTGNGSVHGEGFGLAVGVDPSGEPVVLGAVPASSADNAGTQWRVHPVFEGSALPGASQATPLEVSCIGSSFCLFILDQPSFNVVTYVNANAPVLDVGPSPIVVNETGTATARFSATDADSDAVRVSVDASSTPGADLVGVNIVEHPDQLDVTLVPQRPVCKDEEGLLRVYASDGLASHDVQATVAYRVVNTKGPAQPTVLPSRESTTASGASRVFTAQPASEACPAVRYVWSPVSGQSGAPLLSTDGGAQATFTPPEVLCQESGTSYAYEVRGVDEGGLTSSAAAIFTVDVAPWGRPLVPFASGSERTLTSGPGASVDVVPDALHTCEGTSGLPTVDTEWRLSASGSGIPDGVTVRTADGTAVTLHSPVSSERLRVEAAECAYGTLALTARNRIPVTGGGTQDSADAELRVRVEPSLEDVATGSLELGVVPSGEGDVDIALDTSLNCVDARTLKARMFLETLGGEALDSAVVPVPGTWRPALPRSCTLESYRVRGELFDDSEGPVREGGRAQTEIPNQPLPARLGALEAGALVARCGEGASATLTQTIPANACGEVAISWSQVAGPALSEVSLAGPSVTVSTQETGLEALVGQSITLRVLADAGGSNTATTDYVLPITSERFVDVRHAMESPTASEKGLVGVVVELRNTSECEVGGLHYLENVDGLEWVPGSVKLDGVAVEARAVDGGFRVEDIRLPAQSTQMLTYVGRSPLLSTPRLGGEMTLNGVPVSGDAAVPPPTSGCGCSGGGSGAAVFGLAALARVLRRRK

SEQ ID NO: 11967 - protein, 1195 aa, Myxococcus xanthus
MLACLFAAAMLVPLSTWAQALSQDTPSQASTIAGRVCQDVDGDGLCGADEPGLPDVRLVLTTGREVRTDARGRFHITGVDARVPDSVGGLHLRPGRHRLKVDTRSLPISSRVSPEAATVEVPWGAVVLQDFAVRSVTVEAAPVRLSFAKAPPMAEVAPGQGVVRFRVAGQASAGDAVTVSGVAAQVDEKGAWQAQVPLVEGENPLSITATGAQGTVRLYRQRVDVVPRDGGWLVAPRPMLPLATLQLPAGSDAPAASGASRVQVEAPLGTRIRTPEGEVVVGPEGRADVLVVLSPGRNQVPVRLSPPDAPPRDETLEIAAAVRPFAVGLLDLEATYAPRNGDVQLRGRGSAHAELRLGAVDLVGELDLRDTDGRTLNGASLPDWLRPRMPERFDRAADPDLAPAEWGDDSVSLTPNASEARLRFEARHAEHGRAGLGTYRAQLHDREVGRYHRPLFGPYAEVHAGEEATRVGVKAFGGSLTDPVRQVSAVPAHEELRATGGSLYYLGAASVAEGSELVRVELRDGVTGLPLGERHLIRGIDYDIDYFAGRILLARPLSFLAGEAWLRTSAPTESPEPVLVVDYAALRIADAGDTAGGEVWGEWRGSRLGLGAVREGREGRPYTLYTGRASTALGGYRMAAEVASSRGTAVDASFFGVSDDGGLSFIRPRPDMGTGAEAVSLQLSGPGLHGEGSVDAAFRLRGRGFSDGAHTDAARFRQSSIRVSQPLGRLRLTLLADERSSADPREPFMDSPFSARVLAAGVGWEEARWGVRAEVRDSRLNAARVAGVGPTLFGGRTSAGVAGSLRVFERLQLRAAHRQALALHGEGPGRFDDTFTSAGVDVEVDRTTRAGVFGGWGPELGPRAWANVESRRGQDVFYGGYSVDVDGPDFGAGRTLTGARTELPESGTALFVEDVGSHDATAVRLARAVGFQQQVTGGFSVGARYERGVRSLLDVDSPLRREAGGVFGQLVLARLRLDGRVELRREEGTPERGAATAVDRLQAVVALAAQAQLLEDVTASGRVDFARTVNADVLETRLVEGYAAVAWRPGPWLVVARYGITRELLPGVRSAFGDRALQTLSLLPAVRLGDRLSVAAGLHAGHTRAEDSGRWVWTGTLRPAVRIVGGLELGAELARRTASPEGERLTALRAEVAYRVDERLRLATGYTLLGFSGLGLSPDSSDNQDRLYLRAEVAY

SEQ ID NO: 11968 - protein, 591 aa, Myxococcus xanthus
MGKPSVQADGAELREDTAEPPLRTFVVTPRPGARDVVVRANVDGLAAQARYVLGPPAAEVRLALEPPAPVKGKDTEARLTVQLVRPDGTADDSGAPPVVRVSVGRVEGLERTGPGTYRARYVLPDTRYPEVAILVAFSAWPSPQSVHGAYGRVLVPLAASVNLPGTTEPDAEIAIDIAGQTFGPAVAGHDGRFRVPIIVPPGHRIGQGRVVDKVGNVRRMPIDLRLPPTDGLACVLQPQRLPSDGVSQARLVCATSDAMGQPVDDARVTTQVRHGTLRGPTRAPGGLLEWRYTAPRKLVSDERIEVAWPQRGPGSRESPALELVQGPVAMTRLEVGDALVHHGARTRVEVTARDAFDRPRPGATVELSALVGTFGPAEEPQPGTFISAWAPPATGAATDVDLRARAWGPSGHEPARITVWRAAGELYAGVSDLAGLPVPGQPLRVDGREVTTGTDGTVRLGPARPGTLEISHGVWTGLTRTVHVLGADGPVFPLERPLVSSAASQRVRLAPEIPVNVRLKVSGTRVTYWVEDANGQVLMGREVFVSLTGGQRAEERVEEGRTSFTVRAPGPVSVSVADVATGVTALAEVRP

SEQ ID NO: 11969 - protein, 566 aa, Myxococcus xanthus
MGLHFGTPGRSYPMLRTLALSCCLFSPLVFASTPELRTLTGTLHVVAGGPGDQTDPHVSGPLVAYTNESRGTSEIRYHDLRTSADAAIPNGGAFDFVSDISDGTIVFTRVSTSSAIYTFDVAVDAAPRELAPEAGSSRRSAVIGGRTVAWQDFGYTGVTSQPEIAVYDLDQGTLTRLTDDTFQDRAPAVSPDGSTVVWAKCDEQGLRCDIWQARRGAYGFSSQALTGSEGEESQPDTNGDIAVYASTRTLDGVTDRDIYWKPLNGGTEQRLALPGMDANPSISGSLIAFERRDPVRNDFDIVLYDLSTETLYAITETPENESLTDLSVDADGTVRVVWTVSENGDFNVHAFTFKLDDEPGCKLAAVDTPSPEAVCARPGTWPLLAALEVARTSGQPNGVALGFAGTGEGVLCVDNGYNGEDSTAGWVWINGRELVDPSRFKQGVPLVATRAPLDGHNSLAALISGKPGSAFRLRVYGPPAVCQPVADTSTGARVIPGRALKAVSSSSSAVSPATFVPEGPVHDTALRGCSTGGGPLTLSGVILLLACWLRPSARMRKALRHSHRAL

SEQ ID NO: 11970 - protein, 209 aa, Myxococcus xanthus
MDPGTEISVDELTESLSRILLSRGMATAVVRPGQRHTFEVKAANADAKATLQQAGAFTMSNNGDGTVAVGTREGEVTLLGQGKVVIVRAGQQAVVRPGQAPSEPSPIPTSLLLKVDWPTERTRRERELVVRGQTSPGSRVEVDGVSAKSDAEGNFQRKVVLREGRNTVDVQAYGVGRTQQKDTKDVVVDTTPPPLKTDTENIWNQPRDD

SEQ ID NO: 11971 - protein, 605 aa, Myxococcus xanthus
MLAATVLPLAAVGFLLLSRAEAELAARIDAEQRAQAVATAESVGATMMEVVDALARSAELIDWQAASDAETQGALRLLYGQSPAVSAVLKLDAEGRPLGAPVFRAQAIDGHPAFSLESLDRLVRSIPVQTLRGGGKGQAALGSAYVHSDEGRSAVAVAVKLAEGEGAPFAVAEVVLHPLEAVLRRRLGEGLGRIDLVDEERRVLASTASERRGQALAPELSAHLLAPALPLTELVRSFRVESPARRVSVARVPHGMRFDVLVEVDESTALAPVHGMRRTVLLSIGATFLVLLGLGALFTRRLNVRLAEVVRGAEAYGRGELDTRLKVSGQDELSELATTFNRMGEELEAARARMLRWNDDLRVRVEEATADLKAAQAQLVEAQKLAAVGQLGAGVAHEINNPLAGILGNVQLLMLDRGAADPDLESLRKIEQSAKRCKEITQNLLRFSQQRERAELRPVDLNAVVRDALSLTEHQLRGDGVALTSVLGDGLARVRADPGHLSQVVLALVSNARTAMLNSPEKRLTLRTGEVGGFGFLEVEDTGKGIAPNVRSRIFEPFFTTKDVWSNVGLGLSVAWRVVTEAGGSIEVRSEVEQGSCFTVKLPKA

SEQ ID NO: 11972 - protein, 549 aa, Myxococcus xanthus
GDMRAEIHATSSLPGYVVVSCWNSGDPISEESLERIFDRFEQARTKANRTVRGTGLGLAICRNIVEAHGGRIWCEPCTDGVRFMVVLPTEPPPELRRGDDVADAIQLPRRQESRGRVLIIDGEPEVAFIAKALMTGRGYDVRLAFDAEDGLAAARRYAPDTVMVSVRLPDVDGLRLAEILRHDPETRRAPLLVSSAFDERQRAFRAGADAFLVRPLAPDKLLATVDSLVRGRQGPAHGRVLVVDDDAKIAAICREVLENIGFDVALAGSIEEGRRSLRERRPDVVLLDVTLPDGDGFVFLEEIKAESAGGHISVIFISARAETSSKVRALKLGGDDYLTKPFDALELGARVESVMRRKEQELSASPTTQLPGSPAIEREVQRRLSARRPFAFCYLDLDNLKAYNDYYGFAKADGVVRQTGDLMREVFAQDGAPGDFLGHVAGDDFVFITSPESVDRICQKAIETFDRIIPLYYDRQDRERGHIEAEDRYGEKRQFPIMSVSVVAVMTDGTQDHAELARRAADMKKRAKAIAGSVFLRSDQERVVRSVAG

SEQ ID NO: 11973 - protein, 471 aa, Myxococcus xanthus
MCARAASVILLGLSLMSCQTPLRHHPREDAAALRYNLTYVREPEHVVDVEVVLVRGTPREFLFSQPGAVTTVSAHREDGGVQTLPVQEGRVLLPRGTRFLRYRYALDASIRERGPDFFQGSGDGDARHVAGRAYLIRPRVVKPGLRVELSLVGTDALLPWQPGENGVYRLRGEDLVDSGFHGFGGRRCQVRLPDAVLDVAILGHFTHLSDAAVCTWLGKAAEEVRTVRRAFPHPRITVRVIPAPGHQGPSVFGMVRWSSPPSISISVGQEARPEDFARDWVAVHEMLHLTHPVFVPRVPWLSEGLATYYTEVARARSGRQDSRRAWEELLGGFARGLEGNDTRTMQEAVSQDSFSLAVYWTGALFALHLDVELRRITGNTRGLDDVLELLAARGSSSTFGAFGAAVDAVAGQPLFNALLERHLPRPAFAEQAGLLEALGVQEGPNGVSLVPARDSLLRDSVVGRRSHGETP

SEQ ID NO: 11974 - protein, 81 aa, Myxococcus xanthus
MNVKALAAVVGTLSLAALATGCATKKAAEMEPATAEETGAESSGATESQEAAPAATEEKGAEGSCGAGSCGSGSCGGQKKE

SEQ ID NO: 11975 - protein, 187 aa, Myxococcus xanthus
MRNVGMLAVLAAGMATAQSPSPAAPPAPPAATAALEKASDVPDSAKLVRSTQALSGMREVLRSVLGKVEEARRTKDVVKLNCANEKLTQIKGLLRISEQADVSLQEAVSRQESSSSEHEFTKVMIARQKVGQLRSEAEECIGQLAFRTDENLFVEVEEPNNLPGGDPTRPPTPDIVLVRPPPASPVR

SEQ ID NO: 11976 - protein, 145 aa, Myxococcus xanthus
MDRVGRPFLLENPSYYARMPGGTLREADFLRRVVEQADCGLLLDVNNVYVNARNHGYHARAFVDALPLERVVQIHLAGHTCYPDVIVDTHGDRVCDDVWSLYRYVLARTGPVATLVEWDQDLPSLDAVLDEADIARASLREVAGP

SEQ ID NO: 11977 - protein, 245 aa, Myxococcus xanthus
MKPSLRDFFDSMGDYLAEPGPESLAALYARHPGWEAPRERVSLYGGFVLGHVRSALDKVFPLTRQALGQDAWDDLVVAFTRTRPARHHELNHLCEGFPAFLADAAASRGLAPFVPALARFEWTDFAVFASLEPSPERVERLMANPTLVVLEHDFHLCAYVRARGAATSPEAGAELALLWRHPEQLKTLYMAATPPALLVLKMAVEGLALADVVAATGMAEADLRATVTRFGRDGLVLLPDDSDGG

SEQ ID NO: 11978 - protein, 362 aa, Myxococcus xanthus
MRVINFNAGPAGLPLPALERARDELIDFQGSGMSVMEHSHRGREYEGVHDEAISLLTRLLGIPDTHQVLFLTGGASQQFAQVPMNFLRPGASADYLMTGVWSEKAFDEAKYYGTPRVAVSTARPDKRYTRVPRQDELRLESSAAYVHLTSNNTIFGTQWHTFPDVGNVPLVADMSSDFLWKGFDVSRFGLIYAGAQKNLGPSGVTLVVADKAFIARGRTDIPKIFRYTTHAENNSLYNTPPTLAIYLVRNVLAWIQSVGGLAQLEQWNREKAALLYGAVDRHPEFYRAPVERESRSVMNVVFQLPTEALDASFVADAKQQGMVGLKGHRTAGGIRVSMYNAVSVENVRTLAAFMDHFVKTRG

SEQ ID NO: 11979 - protein, 185 aa, Myxococcus xanthus
MKATLTAVVLSLMFAAPAFAKEVAGVKYPETASVAGKELKLNGVGLRSKLVFKVYTAGLYLETPSKDGAAIISSDQIKRVRMYMLRDLDKKTIVDAIGDGFKKNAGSKLPELQPKLDTFNAAIPDVKKGDELILTYIPGQGTQVSSKTGKEISVEGKDFSDALFSVFVGKSPVDGSLRDGMLGKD

SEQ ID NO: 11980 - protein, 82 aa, Myxococcus xanthus
MGICTWLVLGGIAGWLASIIKGTNARMGMFANIATGIVGAMIGGWIFSLMGGTGVTGFNLWSLLVATVGSVILITIVQAIRK

SEQ ID NO: 11981 - protein, 886 aa, Myxococcus xanthus
LVLGGSLMGVREAWQALGGVPRQLLVTGALWGYHAGFIGLGVLLSRRSMPVGRVLSGIGLALLPVAFIALSSLFALSPGLGVAVALGAAALGMVPLRSAGRLLHGTSAAALGLALLPSLFAGLPLMALEDAPWLRTLCASVGVMALTATVWRARKATEGKTALVSASAALYGALWLAVFCVVSAPSGFDALEPGSALFAGLTLWAQALATVIAVAATTDAAREAHPRVSPVLEIVAYAVLASGAVVGALGAFSSEPGGDFQVDLASALAPLIAAGVFFLLEPRRRALVHLMVMTTLLAGALFARTQAPTDPGWWVFGGTVATAGLMFLARWSAFPGLRIRLLAWTLLGSLVAMPLVSQVGSAASPWPQVLTGLVIAGAAHVAGGWRWRGLHYLGGVGLLFGVLAFVEGTPALEGSWGRLAVFALVSGLYGVAGLVQGAWAQPASRRDGLLPLDDLALCLAAAGVLLAVDSSPSAPDLLVSVTGLSASVLSALPTAVVTAWLLLRVRRDGSRLVGFLAASGLALAVSQVMGTVSDFASPRAALVAASLALGFAAFSALRGRTPLDAADTAAGRERRRMFDLFRLPLGARGLPLFTDGFATAALVQTVIAALTLAGWLARPTDAERATCLLAAGLLLLVALVAFVSRGFEAWHLRGSVVTLASLGAFIALTALLNRAGRPSPPDVAALRTSLIGIALWGVALATRRFGPWIAGLLEKPRHGKLYHWVPHLGVALLACVLLKGALLVGLPRPSRALALILPLMLLGPAVLMLLLSVSARSGRVTSVGLSLAFPGAAIWTARQRQFGPRLTQAWSSEGRWVRIGAESLHWLDKDAWLAPGDTVFLLWQRAFAGIAAAGLVYAVASLRGLPDSFQRLFQRHSVISVGEVLV

SEQ ID NO: 11982 - protein, 466 aa, Myxococcus xanthus
MHHPPEDTQRTHILDAIQKQKNALAPLRITGSPTEVGQGLVNLAELHGLLEDHAASRQFYEEALEKFQEAKYKPGQAQALMGLGVVKANFEDHRGAIEQIARAAMLFNESKDREGEALARACIWDYLRSLGMDTWAAAREVAHWARALHDWRHEPAFLFSHVFLQRLGWSFAFTKSLVDMARGVPVIYLVYGNYDEVAHRRGPRSEQARAELHRVDSYLAELYAVAGAVEQPYDVVFLSDHGHVDCLPWEQRKGQPLAQWLTAPHGDGPLSDDAVRGLCDGRAHPELDTQPRAPFTPVAIDCGNFAHVYLSGESKPLEAMALLERHPEVLARVTRSPDIGLVTLRRGNSAVALVRDGVYTVDTLDRAPLSAEFSKRAVADFLRVLPTMSTAGDLVLFGEAVQRGGTVGFAWEFGSHGGLTRTEANSLVCWPAKAPVDLSGLSHCVQLHERLAAVFLDNTPRLRLVP

SEQ ID NO: 11983 - protein, 539 aa, Myxococcus xanthus
MNDNALNANVGLKLRGLRLARNIKQADAAKDLGVSPAYLNLIEKGKRVMPFPLLWKALRYFDQDPEQFMSTLGEGRVDEALAKLLDEPLLKSLDIDPESLQSLSAEPKLAGTVAALFNLYKNTRTQLENVLAQLNVEERTRAQGGPGNGTSPGVRFDYSPFDEVSDFLEKHRNYFPELEEQADALRRDVRLERQITSGQLIRLLEERFGYRVLFDDPSPSGSSVVRRLDPEERTLTLSPFLTEQPLKFQIAASIGLLVMDREKLLERVLDAGRMRHGETQRLIKVNLANYFAGALMLPYGDFFKEVQRTRYDVELLSSIFGSTYETVAHRLCNLSDPKRPGLPFHFLRADIAGNISKRYSGTGIRFASGGGSCAKWAVHLAFLNPSQLTRQYSIMPDGTAYFCFAKVQLQPIEGSIVKGTAYSIGLGTHAENAKYLAYGLPTTDLRKDAIPSGISCRFCERTDCNQRAAASYRFAFAFDEYTKKDCFFSPILVHEKADKAEKDRHPGAHSLAVAANGTDGSEKDDSLDKTSRRRKGGDA

SEQ ID NO: 11984 - protein, 991 aa, Myxococcus xanthus
MPCGGWTRPAPTTRAATSWDCSKGAVSAGPARRPAQRTSTARAAGGAWIHRRAPSARPGRDPVASQGPPRLRLVLVPLYAATLWGCEPAPRPPSAAHNTPPRLEVSPTLDIIPLRVGQAMEFAATVEDAEEGAALGANVLWVSSVEGQLARGARATLAFREPGAQRLTASVVDAGGLAASASLHLNVLAPGAPVATVLRPAPGSTFNLGEVLGLECMAMTERGVRLQGRAVQWTSALSGPLPAGDVVRATLSVAGEDTLRCTAEDSATKVSATAEVRVTVRATRAPSVRILQPEPTEIFVKQGEAPPHGASVRFAATAQDFHAEGGAGNLDGAVEWSLAPSGHPLGRGPVLTHAFTTPGVYTVRARVVDGRGNTASDRVRVRLVTNLPPRCELELPTTENPRVLVGVPSRLRARCVDPETEQPVEPIWTTSAEPTPLGTGEAVSAVLSVAGAQVVSACAEDPEDTALRGCVERPVRAIINTPPTGCSIQAPLPDAVVNAGVPLTLTGSASDAEDARTGLRYTWVSSRDGALAQGPSTHTVRLSTPGHHVLTLTATDPWGLACAAAVAVTVNGAPDVRVESVMQGLLDCGRGPCVEGQPVVLTGFARPAAPQGHIAELAWLDNLAGSLLPVALPLPTATLAFPLAGRHTTVLAATDQDGAVSRAATSFTVLPLGRARLMEDVPDAQRPVVALALTPDGLRYADGASPRVYAERASTTVLDVNAPALSLHAFQGGGDNVLFVGTDGGGVLRCVQRTCTRHTGAMLGATGAAVSAVAAWESPDVLLLGTRRGLVLTRASDPASGGRAGTVGGRRLLEGREVRQLAISPDSSPERVTAWAATSGGLAEITLWADDDFEPGLAEVSVRLHAPPAIPDDDVLSVAVGPEGQVFAGTRKGFSALGQPGPALRDAPWRLQDEEIRTLHFERQAVDARTRDILWAGTKNGLVRYDVSADIATHFGTEEGLPDPDVSALLVAPGGPRYVGTARGLVTYPWH

SEQ ID NO: 11985 - protein, 301 aa, Myxococcus xanthus
MAELFIIATTEKAARVQVRVLGGQSVQVQPVAPTPASFLDLHVKTTNGFRLSAAEASVEGTPFQRLLLDAKGRLRVGPLPDGCYTVTVTALGFPATQVQDCAGPGEKKELKVDLVLDESLLGQGCQEIGCEEGLVCAPNKKCLECFGNSHCGEGLTCKGNRCEGPGPQCAPCTGDWQCAAGTHCEVLPEGSAACATRCGGDDDAPPSVQARPNDVGSAQCAPGFTCQSGRCLPDAANFAGCHALRRMDAPCTDDASCHELGLLEGRCVSGACTAPCATDLDCPGSRRCVDSSAGPICQAGT

SEQ ID NO: 11986 - protein, 148 aa, Myxococcus xanthus
MEKLSVIAASPLFEMLSSAELGHLAELARARHFAAGNVIFEEGDLGDSLFVVVRGQVEVARRQPQGGLHPLAVLSPPEFFGEMGLIDKEFRSATVCAKTDVDLLQLSAQDLREFRRTHGDGFTFIVVNIARSLSARLREANVRLATKD

SEQ ID NO: 11987 - protein, 502 aa, Myxococcus xanthus
MALLVGIASFDDPRWKGLRYTVKDAHDLGAALKDPARGGFDQVRMLTRREETTREAILAALRQLKKEASRPDDVVVVYFSAHGTLARDAKGELRRYLVTRDAAYRDIPQTALSMDTLKAEFDGLASRRRMLVLATCHSGSGKSLLPKELKAELEGIKSGFYARPLEESSRASMVFAACDWGETAREDESLRNDIYTHFLIDGLSGAADRNGDGAVTATEAHDHARRRTFAFTEGRQRPSAEIMEVGADPVVLSGSITRTGRPELFSYNPRLDGFTLKVDGEERTDLPGGATVTPGKRTVDLTKGDAVLMRRDVEVGQGDRLPLERLLAEAFPRRSLSMLGGMFSFADARSRTELLPMSPEVALSLRLEDQPIQDFGLLFDVAFSTGDRALKLTPDSEVPFRYTTVSAGVALPYLWRWERLTLFAGPRVAGLHLRRSFDVEAAVNGQRFFTVSPGVVGGIVWRVGERLELMTQAQFMLTYVVVDGQGQAVGFTGGWAGAGYRF

SEQ ID NO: 11988 - protein, 162 aa, Myxococcus xanthus
MRAVDPASQEGSAAEWTGEKGRARVALELSVVARDSAGVLRRLDPGSPVEDSDVLLLRYHATEAGTALLFEQRQGAAPELLGHFPLVAGTHDLQGPQGLAGVSLAGEEGPVTLWLVGSTGAPPEAETVSEMLEGRNGAGPQGQDPLAIIRFDVSVRSSQNRP

SEQ ID NO: 11989 - protein, 212 aa, Myxococcus xanthus
METVASTGPVAGGPLRGSGGQVGASEGLTEWVRRAAHGEASAYSEIYRRTRPLVTRLVGGFAQLDSDEVEDVIQETFVRAFRALPRLKEPGAFESWLLSIARNRARTRLERKSSTRRLEEDVADPDPESVPHIPEALQLERDIAVVRRLIAELPEGEEKRTVHLFYVEGELSAREIAEKLGVGKSAVTMRVERFRSRIKRELLRRVLVGRWE

SEQ ID NO: 11990 - protein, 345 aa, Myxococcus xanthus
MKARPIDNPPNPWASTAVEYLDEIPPSKLEVFEDHSRQVLSHNDSPDVGFSWSVNPYRGCLHACAYCYARPTHQYLDMGAGTDFETKLVVKPRAPELLREAFEKPSWKGETVVFSGVTDCYQPLEASLRLTRGCLEVCAEYRNPVGIITKGVLVERDLDVLQRLARDARLWVSISLPFHNAELARAMEPYAASPMRRLLTIRRLTEAGIDVAVSVAPIIPGLNDEDIHRVLAAAREAGATRAHHILVRLPGPVKDVFAERLRAKLPLRAERVLHRIRETRGGELNDSRFKHRMRGGGLYAETIHRLFHTAARKVGIRASYITEDAPDTFRRPERKPPPTPQLSLF

SEQ ID NO: 11991 - protein, 131 aa, Myxococcus xanthus
MKKLNTLGVVGLLSLAAVGCGGEYTPEEEQAMQQPELSDVEQAMESAWIDAGQTRDFSTWLFGVTPFSIQNVGTAPTSYYAYCGSNNISGTVNVGQTHSNLNLNCAWPGARLYVSNTSGTVGTHKLYVWTW

SEQ ID NO: 11992 - protein, 569 aa, Myxococcus xanthus
MVRWFHPSTLVKTGVKAFLSAVIGKQADRRLLDALTNPKQPLEQPYFDCTVDDENRPRDVLWLDYVSDLGDGWNATYAVATAVMNPALALEDPEGETHHTQGGEVLVFGGDEVYPTASVQEYYDRTVGPYEAALNHRRRVPSLFAVPGNHDWYDGLVSFVRLFCQGRTSEAWRTRQRRSYFAIKLPHGWWLLGTDMQLESDLDNTQVEFFKEVVSYMQDGERVILCNAEPEWAVSKIKAIAGRKALEGNLQFLEQLVLGKKVSIFLSGDLHHYMRHSGKDGRQKIIAGGGGAYLYPTHLPGEKRETEGFELRQCFPPSQKSRRLTWHNLAFPFLNPWFGVFMGAFYLQLGWGLASDMNSTGVSDKLSRVLHRALKGTGTLFLGGLTLVSAITFADARRGASWRWLAGGLHGSTHLLTAGLLTRAAATLVKQLGVGAPGSLRRDIASWLLLFTSGFLVAPVLVGLYLISSLNVFGCHANEAFSSLAIPDWKCFLRLRIDASGLTIYPVGIRRVPRAWKRGANGRDPVWVPDPADTRATRPELIEKPIVIGPTRALPVRVGVGLRPLASVP

SEQ ID NO: 11993 - protein, 531 aa, Myxococcus xanthus
MRNNFWDPSKGLHGMFNLWSFRGLGGVVSSGLGGGSLIYANVMLRKDEKTFVHEHPQTGGYEYWPVTRDDLEEHYDAVERMMHVQRFPLAHPPYDATAKTLAMKLAAERLGRAADWQLPPLAITFANAGAAPALGEPIREAAPNLFGRMRTTCRLCGECDIGCNYGSKNTLDFTYLSAAHRAGADLRTRAEVKEFWPADGGGYVVQYVDHAEAREGERREVASDQLQRVTLTADRLVLGAGTFGTTYLLLKNRAHFPRLSARLGTRFCGNGDLLGFLLRSVDSSSGTRLPRVLDGGRGPVITSALHFRGKEEGGTGRGYYIEDAGYPEFINWLYEGSQQAPLLRRGMRLAWRLVKGWIGLTRDTDVSEEIAEALGDCLGSATSLPLLAMGRDIPNGNMRLTRDGKLDIDWRMHGSREYFGRVRKSMEDIADALEAKMVHNPLSYLSRVITVHPLGGCPMGQTPAEGVVNAHGEAFHYPGLYVADGSVMPGPTGPNPSLTIAALADRFSDHLIAHWPRTTALRKHPTTEERI

SEQ ID NO: 11994 - protein, 216 aa, Myxococcus xanthus
MMHMTEPAPDLTFRERMSGPLAMGATDPMEGATQANAARFTMHCTISVDDMDAFTRDAAHTARLEARVSYPPLGKELPVQQGHFNLFRNAEEPGTKLMSYGLRFGAKGREYFLEGTKTLRDEPGFDLWRDTTRLYCYLHEGPDARGPVVGAGVLTLGKRALVELLGSMRSSRHGTAGFGAVSHFGRFFLGTLWDVYAPWARQAGEAPSASSMERSL

SEQ ID NO: 11995 - protein, 188 aa, Myxococcus xanthus
MFQKRHGLGQYVFDLPVNTEVSVKGGKGIWGMPKHLANLDFRIQDGTVSSRYDEGGQQVALIEIDRPRRAWLPLYATAVNYCAFRGMLFKSYIYFRGKFGFRLGKRAGARLVMGDHPRIRPLRALGISRRAFFTSFLPTSSGVLDDHFETWFLSQAVLPAETYPEGLESVMGMGQGKTPQKPPGPPHT

SEQ ID NO: 11996 - protein, 100 aa, Myxococcus xanthus
MSECVRAGHLVPVEGFQALPEDLAVREPETDARFVFLAGEQNRCFLSESQRRSFEHLERFRPGYHMLHLVPGYGHLDMFMGQDASRDVFPLILAELDKPV

SEQ ID NO: 11997 - protein, 447 aa, Myxococcus xanthus
MAATSQNKLLRVGVIQNGRIVEEHHVRREAVTIGHDAKNTIVLPATEGRPARFALLENQNQQFQLVIAPDMKGRVNLGSSDVDFESLRAQGLATRRGDLHVLPLPESARGKVELGDATLFFQFVTPPPDEAKPVLPTDVMVSRWKTMDRVFFGILAASLLVHFSGAALIITSETPQVAELELDELDDRFVRAIIPQRPVEAPKPADTGPAEAPKSDKPDAAPKEDTPAENKPAGDAAQQRRAEVVKKVSGKGLLKILGSNSGGGQGAFADVLGGASGGGDIAEALAGAGGVGVAREASVGASGGPRGGGTGTVTDIGAIGTQGGGKVDLGDKKETVVKGRVQDATPEIESADVDRDALARYVRARKAAIQSCYEKELKRNPNLKGKVVVRFTIKTSGRAGDIEIEENTLGSEAVGSCIRTTIRSWVFPFKPDDETAVSYPFVFAPAG

SEQ ID NO: 11998 - protein, 396 aa, Myxococcus xanthus
RSLLAKLGHGSGVWSNTRTLLSFARKQKLEVVGIDRRAQGERSLELRDAYAAERIARAARAPDRPLVMVLVGQYHVAPCHLPAQVERALGTETRKGLVVYQNAEGVWWRLAREGRVGAAEAVELADGTLCLMNASPVVCQQSFLDYLEAEAGDAPLLDRGAAERFREMSALIGRLAGVPVGRSLDTVDVATAADGDVLARIQRRGRFTQAELTQLRRHILSRESSYIPRARVAYLASLSLNHAAEEAAHFVRHCAVGDAMDAPRGASEAFYARCLEEALGFFGSKLVNPRRTCLGVAEWAKRFGESRGVERQIAAFVLAHKATEAEAPEEAVKLLPLRKDRLFHGVSHALGYLLGDRLYQAFDSGQVAKAEVQALFRDPFVDPRAAYFAWAERLGI

SEQ ID NO: 11999 - protein, 120 aa, Myxococcus xanthus
MGRTGVAAREFLDVREHARNSLVLRSGLTFRARSILVVVGLKNPLGAKPWQATGAALVGPDGAELKVARVWAPASLNPGDEMDVLVETEPVEGAPRGPFTLTLWAEDGKRPIILGNIEFP

SEQ ID NO: 12000 - protein, 404 aa, Myxococcus xanthus
MFVRFSTVIHPTGSPETLRDPRGFALKFYTDEGNWDLVGNNLPIFFIRDAIKFPDMVHSLKPSPITNKQDPNRSFDFFSHLPESTHMLTQVYSDIGIPANYRQMNGHGVHSFKFVNAKGEYKYVKFNWSSQQGVKSLTAEDAARVISEDHQHATTDLYATIGAGKFPSWELSVQVLDPKELDKFSFDPLDATKIWPEAQVPSIKLGKFTLNKMPDNFFEETEQAAFSPGVQPPGIEPSEDRLLQGRLFSYADTQRYRIGANYQSLPINRSRATVSNNNQAGSMNFANTKSDVNYEPSVSRETQDAPQYLFSNAPLRGTTQQGGIEKTDNFAQAGAFYLALDAGGKDRLIKNLAADLNQVRDAKVKARMVGHFFMANPDYGTRLAKAVNVKLDDAKAAVATLAAR

SEQ ID NO: 12001 - protein, 205 aa, Myxococcus xanthus
MIRKLLLGTLGLLMLGASVLTAAWMSLRATPAPQGRLLATSEAERYLLAAARAGETDIVAGLVQAGTPVEARDARGFSPLILAAYHGHADTVRALLSAGADACAGDNNGNTALMGAAFKGYADIVGLINQQPCAVDQSNRFGQTALMFASLFGRKEVVEQLRQQGASPDVRDGSGRSAQDWARTQEPNAPVPQAPTAPETSASAR

SEQ ID NO: 12002 - protein, 143 aa, Myxococcus xanthus
MAHQNPDYRQDTEDLFTSAAFVMDLGIQPVDIRPGEVEARLVVQPRHLQQDGVIHAGVQATLADHTAGAAAFSVVRKGQRVLSTSITVHLLQTASGEELRCKARVLRAGRRLIVTESEVHAVSGGTPRLVSKTTVTLAVMEPR

SEQ ID NO: 12003 - protein, 168 aa, Myxococcus xanthus
MLATVEAFERGSINPVVFVEEDGDLTVYVLQGTRDPMRFYLGGDIRFRYSPDGRTQREAVRLHQSVFAISLEPGPEGELYQGSAHSHVLFGGPLETELATLMLYPELGALTVIHAASRIAYFLTPDGAIRVLSEVPERQRTLRPDGTFGPLDMEEEAAPPPPSGQVDL

SEQ ID NO: 12004 - protein, 78 aa, Myxococcus xanthus
MARLEHRMDKAVAQGRLSQAQADQFKAEGRQLREEMKAQREASGGKLSDAQKDEMRSKMRAFREKMKSAMQANAPQKT

SEQ ID NO: 12005 - protein, 147 aa, Myxococcus xanthus
MRDLSAFEDASFDLIFHPCSNSFVDAVRPVWREAARVLRPGGVLLTGFTNPVNYLFDLALEKQGIFTLKYRMPYSDFTSLSDEERRRFTDVGEPLCVGHSLEDQLGGQADAGLAIVGLFEDSFGPEDALSQYYNGFIATRAMKLPVR

SEQ ID NO: 12006 - protein, 91 aa, Myxococcus xanthus
MRSAFALIVLLAAAPVLAQDASQASSSSSGATSPKKAPRKVIRLEAITVEGRIQKPQAMYILQRSNLSFDDLSRTESFVPKVEKSVEQEPF

SEQ ID NO: 12007 - protein, 139 aa, Myxococcus xanthus
MSLARWRRTLAENLDSVFLCCRAFLRHVATTKTGNIVIISSTAGLFGEAGHADYAAAKGALASGFLKSLKNELGRIAPLGRVNVVCPGWTAVDRSRDKLAQPGFVERVTRTMPLRKVAQPVDVERAVVSLAVGPNLRHM

SEQ ID NO: 12008 - protein, 80 aa, Myxococcus xanthus
MHPMVYSRMERGKMLPRVATLRKVAMVLRTSTDELLGLAREGRAGAKKQSSLQRRLMTLSEALDEEKLKALVVMASALSR

SEQ ID NO: 12009 - protein, 88 aa, Myxococcus xanthus
MDRGNSVFEEDADGHFLLSLDKLVLDEAVLGEVPLEERLAFRLAESVVHLFHRTVVEKVLSLSPPPEGLRFIPLAEWGDSSGFRCAKT

SEQ ID NO: 12010 - protein, 173 aa, Myxococcus xanthus
MVGLMGGGAMLAVGGGFGRGGLKTDVSGLQELAAVQAQLLPLDACHIEYGVRAGALPHRSTGSRKSASVTPCSGASVSYVSISVPEELQSSQVAFDMTRSSVSAPWKILVDKDQTAFPDLKQSLERLAPLIVEKYPEALATEIQRRVDSERAWQESKAAERARKEAAKTSYPE

SEQ ID NO: 12011 - protein, 186 aa, Myxococcus xanthus
MSVIKKNIIGFSVVTVGIALTGVVTMGIQPMGWMRTTNVGRLPELAAVQAQLLPLDACEVEYGSRRGSGGRRWIGSQEYAYVTPCGTPSSYRISVRVPSERQVRDVAFDMRRSSVSAPWKILVDKDQTAFPALKQSLEQLAPFLLTQYPIERQKDADLKVRLARERQERKDAERALKEEAKNSYPE

SEQ ID NO: 12012 - protein, 265 aa, Myxococcus xanthus
MVGAETTREQTPHLPITAEEIAEDAARCREAGAAMVHLHVRTPDGKPSQDAELFRAAIRAIRKRTDVLIQTSTGGAVGMTVDQRCGPLTLTGEDRPDMATLTTGTVNFGEEVFWNPRPLVRDIARRIRAIGLRPELECFDVGMIDEARYLAKEGLVDLPAHFDFVLGVPGTLQPRPEVLDFMIASLPEGSTWTVAGVGRHQLAYVDEAAKRGGNARVGLEDNIYVSKGVLAKGNWELVAEAAKRARAHGREPATPEQARKLLRLS

SEQ ID NO: 12013 - protein, 120 aa, Myxococcus xanthus
MSSHDAHYGGNLVDGARMLGLFGDVATELCIRSDGDEGLFRAYDSVEFLAPVYAGDFIEAEGEIISAGNTSRKMRFEARKVIKPRPDVNDSAADVLAEPVVVCRATGTCVVPKDKQRGQT

SEQ ID NO: 12014 - protein, 261 aa, Myxococcus xanthus
MVKPSKQIIRPYGDRRDDGVVQLSFTLPVPLSEKAKEAAAVFTKKMGFTDVKVAAAERAADTYTFFIVYARSSVALDYAEIDVPEVVVKKMSFDDLNAFIKEKVKRRIVVFGACTGTDTHTVGIDAILNMKGYAGDYGLERYAWFEAFNLGSQVPNEDLIKKAMARNADAILVSQVVTQRDVHKDNSRHFIEAAKAAGIHGKVQLLLGGPRVDHKLALELGFDAGFGPGTKPSDVANYIVHALLKKEGKEPKDAHYQGEPQ

SEQ ID NO: 12015 - protein, 151 aa, Myxococcus xanthus
MVLSAGGSADALAQVQVKNVSIQVPASWNRTEEGGTNKFQAPSGDAYFLVDVGAVQTAGMKAQTCVDKIVASIGGKGWERLKVGAQPAAKRQETDVAPDGSGAVDSVTYVGCDGKTTWSVVFYLEQTKKERFAPLAQKVGSSVKIQRAGGK

SEQ ID NO: 12016 - protein, 456 aa, Myxococcus xanthus
MVDKLKAAGVLNKGAAYWYGRALQLGAKSPLEAVERLTALPTEKLAPLSPEQEHNLREEVRAEARAALDDLKARIAQREELRKQFPMPPAPHKYVIVATGNIYDDVDQARAAAQAGADVIAVIRSTAQSLLDYVPHGATTEGYGGTYATQENFRIMREALDDESRKLKRYIQLTNYSSGLCMSEIAFCAAYEKLDMLLNDAMYGILFRDINMRRTFIDQYFSRRICALAGIIINTGEDNYITTADAYDAAHTVIASQFINECFAKRAGLKDWQLGIGHAYEIDPYREDTLLLELSQAMLVRRCFPDAPLKYMPPTKHKETDIFFSHTYDVMANLVAMWTRQGIQLLGMMTEAMHTPLLADRYVALKSAAYIHRAARGIDEEFTVREDGKIANRAREVFGRAEQLLQECRDEGMVTAIGRGHFGDVKREETGGKGLDGVLEKAPDYFNPFLELLEAQ

SEQ ID NO: 12017 - protein, 343 aa, Myxococcus xanthus
MSIDLYGLSRVVGEKGVLPQRAKQLDPSLPCRESELLIDVESLNIDAASFKQIKGEVGGDAKRIGERIQEIVRERGKMQNPVTGSGGMLIGRVKELGARHPARELLKVGDRIATLVSLTLTPLVIEEVKAVHADIDRVDIRGHAILFASGIYAKLPTDMPDTLALAALDVCGAPALVARHVRPGMTVAVLGAGKSGALCLAQARRKLESRGKLLALDVSQGALDLLSGIGLCDVALKVDATQGVDVMEAVSQATDGQLCDLVVNCASVGNTEMATILSVKDGGTAIFFSMATSFTAAALGAEGVGKDVTMVVGNGYVPGHAALTLDLLRTEPQLLQLFGTRYV

SEQ ID NO: 12018 - protein, 335 aa, Myxococcus xanthus
MNGLLESSELLSPALESNPLGDPARRKLTVYLPPGYGADERRYPVVYFLHAFGNSGGSWTNASGFAPTVPQRLDALVESGAIPPVIGVFPDAWTSLGGSQWVNSDAIGRYRDYLTKDVVGFVDRTYRTLPKAASRAVVGHSSGGYGALVMGRYHPELFSHVGAHAADSYFEYCYLPDLPKAAAALLKAGGVEAWHAEFRARVSETKMRGDDFPVVNVLAMAAAYSPKKGEPLNVELPFDANTGRLRLDVWNRWLVHDPVRFVPKFMDAFRKLKTVYLDCGTRDEFNIRWGTRMLAEDFKNAGVERVHEEFEDGHSGVSYRFARSLSVLVPNLAQD

SEQ ID NO: 12019 - protein, 186 aa, Myxococcus xanthus
MLDEIRRELGDCQRCNLCSTRKNLVFGSGNPRAELVFVGEGPGENEDLQGVPFVGAAGDLLTKMIGAMGYRRDDVYICNVVKCRPPGNRNPEPEEVAACEPFLRAQLAAIQPKVVVALGKFAAQTLLRDSTPITRLRGNWRTYEGIQLMPTFHPAYLLRSPAEKRKAWEDLQAVMKVLGKQPGSRA

SEQ ID NO: 12020 - protein, 280 aa, Myxococcus xanthus
MNVAMWDNPLTQENLAALLAYPRFSRVGPGAGMLACGDVGEGRLADVPAIVQAVAARFGAGPLAGKRVLLTAGPTREFLDPVRFISNPSTGKMGMALAHAARTLGAEVTVVLGPVGTVERGGLDIVDVVSADDMAREVLSRVGTVDVFIATAAVSDWRPETRAPQKVKKGASTSPEALTLVRTPDVLAEASRQVAGQPKRPVLVGFAAETERVVAHARDKLERKGLDAIVANDVTAPGAGFGTDTNRVTVLTRSGAQHELQGSKREVAQALIELLLVSPS

SEQ ID NO: 12021 - protein, 464 aa, Myxococcus xanthus
SDRPSGSDGMVPMRGMPAGTYSMMASHPDYQPSERREVTLTDGQTLKLEAELKPGAPLSGEVVDGQNAPVAGAMLVVVPRGAEPVQSDASGRFEFRALRPDRGYRLEVRHPGYDQVERAEGKAGGPPVRVVLKKRDVYRGRVMGDDGAPVRRFRVDEHDVNAPDGRFELPLPTAGDRVIASVDASGYEPLMVDRPASSDLGDLVLEKLPGVSGRVVDEGGGPVPDAVVSCDVCDDSVLSGQDGTFTVASPPYVTRYSLTARKGRLSATQSLERGARGPVELKLRQATRLSGRVYRPDGSPAAGFEVEAVNADRSEPLTIVTGPDGGYSVEISPGNYRFALGANREFSGEPALVVQVGGSEMSLDLGPAPGTASLAVQVKPERGRALWVVAGELGAVGNPPAVALMRSRWAQLVYQPRSEQVRLSGLRPGRYTLVWGNFHVETPGGPEVRVVDVPSSSDVVMMAH

SEQ ID NO: 12022 - protein, 72 aa, Myxococcus xanthus
MAGPYYYAWSSDNGKRLEICANDLTVHRSNGSTCTLTRGQTFTVYSGGSEWVSGHAWGNCNLDGQVQNGWFC

SEQ ID NO: 12023 - protein, 73 aa, Myxococcus xanthus
MRILLRARDAGVLRQDLPSAWLFATFEALLYAAWTAVAQGDLAANDAARTIHETLLHGHGTGHLTGARKARPR

SEQ ID NO: 12024 - protein, 184 aa, Myxococcus xanthus
MLWAGICLFVLSEFVSAGLVKLAIQSAMGEHLGANVVMALLGTHSLPSMPLFMLSALGIACLVLGGSFVLGNHLPRRIREALVSTGRLALTWYLGHVLLLVGLSVAGYGNRLSALAAMGVAFAGFAGVIAVSYLRGGAPMLLERMLRRFSTSSPGPGPDKAAVVLPQDVAPAAARRRDGEAANP

SEQ ID NO: 12025 - protein, 508 aa, Myxococcus xanthus
MDELVAQAGVSRVKVELEPAHEELRASAKALRVKRPAPEQLSEAKTAAFVVRKLVDKYEPQAARSQAIGQYLAEVKNTLVEVEVALQVRTLDAARAEVVQALRNVEKRSVTAEQFEEAKTAMVILEKTLETVHVKNPAISPVAADARQLLKDGRATMERRRYEVDLQQQRAKVDEARKNAVALVSQVQKETPSEAQLQAAENAVKQIGVVLEAGTALVKKDRDYALYAKESKERMAELNDRITRRKIVLAAGDARVQLASRLAATKEQLEVDKAISATDAEVETASKSVDEIMQMFETHAALERQDAGYAASAERSRADWLKMVEALEFAKQVRALRRLTGEALDVAGKAAASAASSTDLRKRRALYTSAAEKLKACQDEGARMVKENAGLAAVDVLVDGVRTQPQDVMAQCAQKAETLQAPLKRVDVELRFQEGQRKAYDAAKAHLSKGRKNEALAQLNDCIAEGRILENRYPDFKEQKFDIGGASMSMLELVQVCAKERKALQPSP

SEQ ID NO: 12026 - protein, 156 aa, Myxococcus xanthus
MCAELDGSNPTQVVGGIGSPSAIAVDVPNGSVYVIAYNNTRLVRFNLDGTNLETLASNLGGLGVGLAVDSSGGKVYYSTRGNSIYVANLDGSDVTTLVTNQTTVHGIAIDVTAGRLYWADWLGTVLRSANLADGSDIQDVNSGSARNLGLAWMPAP

SEQ ID NO: 12027 - protein, 136 aa, Myxococcus xanthus
MGALLLGVTLAVCVPHLPDWGGVWIFAGLAVGFGGLLVATEAVALPVPLRGLVYQTAVLSYGTYLWFWVVARVFERRNLTLGVWGLDLLAFITVTHGVAWVTYVAVERPALRLRDRLLAWQASRAEARDGVVAPGR

SEQ ID NO: 12028 - protein, 857 aa, Myxococcus xanthus
MALKCLAADVGTTLAIRVLRAEPSRAWSGVVHSMRGRPIPGFIVLLGGRHSMRSRSAVLRSWGLGVTLALSLGACGVESLEEKVRPLENGVSPGNGQALTRERPEASLTWDPYADAVASGTTAAVLNASAALGAPDGQAATLLGLLNTALVLDLGQGEEGTGDLRVYYQGLSLALVAQVDFLKADGTFIGSSSLHLVELGLGTHVAVATYPGNVPYRYVRLRGSVLALYLVDAVETSLRAVCGDGVLGRFEKCDDGNQLSGDGCNSVCEVEPGYTCTGQPSVCDNNSAPTVEDVHANTSEDIPVDITIPAVDPDGDVLDFSFTLPGHGMLTDTGASVTYTPNANFAGEDTFQVTVSDGKKQATATVSVTVTPVNDAPVAASATVTVGYNTSTPITLAATDVDGDALAFTVTDPAHGTLSGTGAQLLYTPAADFQGEDSFTFTANDGALTSHTATVIITVRGPPVCGDGYIDSGEVCDDGNRVAGDGCRADSRGVEVCGDGLVDSVTGEQCDDGGTIPGDGCDAACQLDAFSNVPPTLISGALDCTTANSNPGRKAAVDALGRFYVVMRCGGAVHVSVSVDRGHTWVGPTPLGITNAAEVAIEGGPTGIAYVAATSAGTLIFTRTVDAGASWEAPRVLSPAANPTVSLDSRGDALYISVSRGSTGVSVLQNFARGANDFSVTDVDQNNAFFDVIVDKISGDVFSVSDDPSFRIRSSSDQGTTFGPQSSPPGQAFFSDWTGSNGFIYVTGSFGDDNVDVIPMSAPGTSTQVPGLPTDIGPAPLRVIDADALGNGYIASQRGTGDIQLDRMLVGAAMILATDARTVGPGAAPAVAALPSNGGALVAYTNGTSVYASVVVY

SEQ ID NO: 12029 - protein, 370 aa, Myxococcus xanthus
MGEVARLIPEPESETSAAIRFGNAPQRCLFRLQRTKEAWAASLFPDEAHSPVEAFPEAVAALEKALGPRDGGARELNWSYQPNSRWLLAASQDECALWVIDSINPEVNATASKAMTREICECLEGTVSADDPYIRLPQTAYTMSRMGAGTALPSCDCTFAQTGEAGVTCEAYMGRPYSLPEFEEMQKDGRLTEKNRVENLKELEDLRRTHQGLLAANEDALAQWKTGDQKAALSAWTTLYRTWLENGRPMAGGTLDEFAVEDATLREQLNQQLEATIDLRAEILNNLGFALWSHKEWSQAEAVLDECLALLTATGHERNVLNLNRGDLFRDMGKGPEAIKAYRSFLLRKVTAAQRKYAERELRKLEQRSK

SEQ ID NO: 12030 - protein, 95 aa, Myxococcus xanthus
MSEQYFGPVLKTLGASPIALTRTLMAPEAYLLEALASTVARHGPTEPKAMRTALVEAYARYQRISLRSAGSVFSKLPPSEVALPGAVAPASRSSP

SEQ ID NO: 12031 - protein, 350 aa, Myxococcus xanthus
MRTLGESGRIAAQTGEAAAAFLSRLAPAFGVVANSVVVADHFKDMVDDPTVGSALQTFGDAVAWVGALVGTGLPGVGQIIEGVGLVVSAFGSLLVNKEKQEALNNESESILLEMGLDPDVARTLGHGDDQPERLASDLGLSPAQIQDLAKRYPTMFDAPGLGQAVIDAAKACGMKGQDAMGFIDSLSKGRPDFAWDLLGVMPNMQGDGTHPTATDESWRTYVQGRYPDAYAYAQQHAPDLFGQTAESRLKAGQDFEHYAGTMDSPLVYANLCEQNKGDEAYTSEFINRMKDNGSLDSFVQYINQHGLDAHRSGAKAALDAAVKTGVLSEADVQNYLNGSNGDAWHAILGR

SEQ ID NO: 12032 - protein, 379 aa, Myxococcus xanthus
MGVGTPLPACASGQLRIDWNNGTGGYTATIVMANGMRSQYLHLSGFNGGERYVQQGEIVGYSGGAAGAPGSGSSTGPHLHWHLVTAGGTRVNPLDYVGAGSGGTGGGLPLEDRRLGHLGTAGGWAHMLSNLVLPGNTTYGAFSPGPGQSPRAMANIDGVMMLVYAGSNGWTTMSSGLAMDPGAPLNVLRTPANASAQIFTLEDGRLWHTFDGNGWKKFPSSVTVSGNCTFSMTANGTDLHGLFNDNGRLFHVWADGSGWHKGDTQVDLQPGSDLVAVIQPDGSLQGLSLEFSRVHHIFGANGRWNRIPTTASLPTGTPIAGRAAYGWPQLVANHNGAITHVWGTSSGWMCVPTGQTTNPGRRLSLVPDVASASLVGLTL

SEQ ID NO: 12033 - protein, 220 aa, Myxococcus xanthus
MFRHALPNRLLEVIFGFQTGVTSHAWFLHHVLGHHRNYLDQTQDESGWKRRDGSTMGEAEYSVFNTLVAYPRAFRVGRSYPKVMRVFLAMGALQVALLGVLFWHDWYNALWVFLLPMAVSLYVTVWATYFHHVGLEATEHTHASYNILHKGYNLMTGNLGYHTAHHAKHGLHWSQLPELHAQLAQDIPATHYRQPGIPFVWTNPEAKIEPAEAEFGAITQ

SEQ ID NO: 12034 - protein, 112 aa, Myxococcus xanthus
PSHWTAPETFAPERWLDGGAARNPHGSDHFFPFGRGPRACVAGDFAIVYLRTALATVSARARIHVDSTEPFEEGFFFGVVRPQGVTGKLVPRQVQTLHPPTGAPPPPAVESA

SEQ ID NO: 12035 - protein, 1110 aa, Myxococcus xanthus
MRSRLLAALLALAGPASAAEAPAAPAAPYLQGMGRTPEQEALFQEVSSALELYESEAREFHREVQELVEQRYEQKRGALAASYEKRIKDLEAQERRERLDAIARFEEFLRRYPTEPRFTPDVMFRLAELYYERSSDDHLLAMKDYAERLEAHDKNPDAEFPTEPRVDYAPSIALYRKLLATFPDYRLNDGAWYLLAYCLEKQDQYGDSLHAYQQLIARYPQSRFATESWVRIGEYWFDNYEDPQALPKAAQAYEAATRDASHPLYDKALYKLGWTYYRLDRFEPAVASFLTLVEFYEAQRVAKGDATAGGDLREEALQYVAISLADDTWGGIARADALFAERGPRPYEAEVYQRLGNVYFDQTKHAPAIEAYRRVLQKAPDAPDAPMVQQRIVQAYERDRMLGLSFAESEALANLYQPGGAWYEKNKGDTAAIARANALAERSLYGSATYHHQQALVFKQEGKFEQARSAFDIAARAYGTYLERFPRTKSAGDMRFYYAECLYNAFQFAAAARAYEEVRDTDAANKHRPDAALNAVLAWQKQLTLDIQAGAVPETKTLRSTERPPGQAVKPRPFAPTEQKLVAAADAYVTLLPAGEKAPGIAYQAAELHYSHDDFPEARRRFETIIQAYPSHEVARYATNLTIETFLIDEDWRSVESVSARLASNDKVIDPSSDLHKQLVKFKLAGRFKLADQLMAESKYEEAAAKYIELVDESPRHEFADKALNNAAVAHENTRRFDSALKLYERIYREYPSSPLAGGALFRVAVNAENSYDFDKAVVSYQKLVKDYPDSKDREAALFNAARLLEGQQRYPEAAAAFMRYADLFPKAEDAPKNQYRAAIIYEKQGNPRGEVRALQEFVRKFASQSGQVELVVDAHRRMGDAHQKLGSTRDAQNAWARSAAEFDRRKLQPDTHPLAADAAAYSRFQLAELEFQKFDKLKIGGKGKALERSFTAKRNGVKSVNTAYARVYPYKQLEWTLAALYRRGYALERFANTIIETPVPAEVKRMGEEAVVVYQDALVQQTTALEEAAVESYAATLAEARKNRLTNEWTRRTLESLNRFRPKEYPVLKEPKQALAADATYPDGLVGSITGPVRSTQQEGPRLSGEGAK

SEQ ID NO: 12036 - protein, 124 aa, Myxococcus xanthus
MHIPPDALTFAPPKRRARPLPVILGEALREARLRAGLQQTEVATLINISRNAYSRLERGLMLPSVPTLYRLCTAVCTTPNELLGFSYSLPPGTSAIAKDALRRRVRQLNGRQALALIQLLSGER

SEQ ID NO: 12037 - protein, 96 aa, Myxococcus xanthus
MSLTQVQVAERVGLASAVYSRIERGLMIPSVETLKKLCIELMVSPEDLMGLTESPSSGSPTRPDDDVTLRRLIFLARKLDASKLDALVRITTELAR

SEQ ID NO: 12038 - protein, 76 aa, Myxococcus xanthus
MDALHRMYEHKDKGDLDSARQEMRNVLAVEVVPHYRAIAQGQLEAMADEHQQGERAPGASTRAVFARRTPLRLRGR

SEQ ID NO: 12039 - protein, 216 aa, Myxococcus xanthus
SGGTHPIAILQKVLDDACELGVFPSAQAVVLHRGAQVFGGVAGKVSGDTRFDLASLTKVISTTSLFLRLWTEGKVGPETLVSRYFPGTPVGDAGVTVADLLYHRSGLPPFVPFFAQALTAHPELLDADCPSALRARVRDEVIQAAAATPLAAEPQTLAAYSDVGFILLGEILSRAAGAPLDTLFSRHVAEPLGLSARFHRLTDFPADAMPAPTGAG

SEQ ID NO: 12040 - protein, 133 aa, Myxococcus xanthus
MAEGHLVGGNLSVLSRLIGTSYMPPLDGAVLLLEDVTERPYRIDRMWTHLRLAGVFSHVRGIVLGDFTGCEEKGADYSSADVLRELAREAGLPCAAGFPIGHGDINYPVALGTQVRLDADAARLTFLEGAVRA

SEQ ID NO: 12041 - protein, 329 aa, Myxococcus xanthus
MHGLAGVPAVESAALAGLGDGAPPPLVSAPPPTLALRASLPDWLADHFAREFGPEADDFCAHLNVPGPITLRANVLRTSREALAERLRSEGVETRPGPWSPLALHIEGPRPNLYGLRSLQEGLFEVQDEGSQLLGLLVEARPGETVLDLCAGAGGKTLQLGADMKDSGRLLAYDPDPERLDRLLQRSSRAHLTRVQVLRSLPESLDADRVLVDAPCSELGSLRRGPDQRFRIQPEVLTRFPALQQDILQRGARLVRPGGRLVYATCTVNRAENEDVVAAFLASRPDFRLVRPGAGWLSDACLRDGFLFVAPHRHGTDAFFAAVLERTAG

SEQ ID NO: 12042 - protein, 46 aa, Myxococcus xanthus
MEESQVRVGKRVWLPFLRARRYLQSRQALLDYSLTQFFHEAERYRS

SEQ ID NO: 12043 - protein, 264 aa, Myxococcus xanthus
MGGELELDVQHVLFGRPKQPGRYTLSLSAIHDWGRGEVKSAEVTLAHLDATAVVLVQRKGRRALEMHVFAGWGGRPGAGGAWGAVAGVGADAVTPTLDLRLRLEARRQHGGFRQGYFGADYELARLQAAGTSGLPLAQASFPEGYSVYAEAMVAWDAVLLGEVLQRHLHLSMGAEAFSWGRVDVDGRLAVQLLHRNLEVAVKGLAVGMRQPWARYLASGEVRWRFWGGRLYALGQGGTLLYPTAEGPLRPGAFASLGMGVDNGR

SEQ ID NO: 12044 - protein, 646 aa, Myxococcus xanthus
MGYTVVRQLDRGGFGTVYLATNGGQPCALKLVERQRVEGRVEKEISILLRLTHPNVVGIRGFTYWQAEQRDFALIFMEYVEGRKLSAWVKEENPSARRIAKVTLDMARALEASHEAGVVHRDVKDANVMVRDADGLAVLVDYGIGDYAGAPSGITQSMLPPGTMEYRPPEAWLFLQKKYFGKKVGARYVSAPSDDMWALGTVLYRLLTARLPFDSGSEAEYVQAVIGRTPVPPHHVNRFVPERLGMLCMRLLEKDPAARPDASTVCAALEALLSGAEGEAWDTPLFDAYGPNSATTENEGKVDKLARWAKRPLRQMRRGKAPGPELPEVPGEGRPAALPPEAPLVPAATRPVEAQLPGLALEAGVGAESAMEADGALEAALVAPVVEAGRPSVLARLRLGRVLGAGLLAMTLASGAYFSLRTDSPQPQAVTGQEVAPYIEKPQAAPAAAPTGPEATPAAVAPPATLPEVTATVTTTKSDSPTSPPVPAKKATRSVSSALATTALCATFACTGAQVRPPPEPEDCPEGAVETMAKLGVKVGYSHPGGFPIKGESRVISVREGPTQIRMYGKWGKLGDGTVFTGRLILGDRVYGRLTRARTREGTFPVCLEVLSTGGARGLELESGGNDSSKIRVWSDLEVRAVREFE

SEQ ID NO: 12045 - protein, 128 aa, Myxococcus xanthus
MLCFRLLRNGRHVATAGVSGFGVVSTILTWVRRPDDETRDNPEVDLHLGGSVGREYREHLKWCYAKDIRAGDVLTVEVREDLEPDPPKERRLDEEAGLDDVARLQLRKKALEAQLADVNEELAERGAA

SEQ ID NO: 12046 - protein, 390 aa, Myxococcus xanthus
MTKRSEDEVSTEEFPPRPPTPPSPSSPHFLFVVDDVRYEAVGELEVRSNGEKLLKAERRVADGVLAGPCLVRRIATPSTYMMRTRLIEEVQLAFRLNHPNIAQVFHMQVDEEADAPFAVMEYVGGPSLETLVTAALVRGKPLSEGFALYVGAEVADALHYAHTLTSEEGVPLGIVHRDVSPRRLALGPHGEVKVLDFGAAYSLMVGREESPENLLRGDVAYASPEYLRKEGLTPRSDVFSLGVLLVEVLTSKHLFEVHDVPVVASKETRFVTESPPTLPLQQMQALMETFTPDVVEKAVAHLSEDLKAVLHTALRLNPEERFATAADMRDALRGVAHAQLRAPYGRAEAAKEAALVVSEGGVLRDQVEFGEAGLYPDGLEKHELGLPKKE

SEQ ID NO: 12047 - protein, 657 aa, Myxococcus xanthus
GEGGGFALEVNAGTWVVSARRGDQLGRVPGPLSVAPGETLRGLMVTLGAASGLTGTVSTVEGAPVRGAILVASPAGGQGELGRAASEEDGEWRMDVPPGEYDVTVRAVGMTGRVFEAVVVNPGGHTPLDVRLEPATAALEGLVVDAEGRPLGGAQVRAEPASFSGVAHTALTDAEGAWKLEGLEARPTSVRARREGSQRWTSRMETLKAGVVTRADFTLADSGSVWGQVTRASGGPLTEPALVHAVPRGGSGTASTETDAQGQFQLELPAGVYQLVALLHQTPAIYFHMESDPFVTVPSGGAVRQDLLLKEDSVLSGVVLEPSGVPSPLAIVAAIQGGDFPMTRKERADEAGQFAMPPRPQGAQPLELVAHNAGRVGRLPAAHEDQAPLTVRLEPAATLRGRVVAGSGAAPDGFTLELLEANGEALPWAGAWPTTRRFAGSTFLLPDAPAQALKVTVRTEDGRTGEAQVTLRPGGTSDVEVPLTGGVASISGRAVWSRGGGPAPGVAVFLDKAVGGRSDAFTGQDGRFRLSDVRPGIHTVRLLPPEGRVETRTVKVAEAEATDVGDVTVSPRRATPGTLGAGFSEDRGHVAFAWLTPDGPAARAGVNVGDRLVAVDGQVVRDSTEAESRTRGAPGTPVRLHVRRANGEQEVLVTRAE

SEQ ID NO: 12048 - protein, 253 aa, Myxococcus xanthus
MPPFQMSGVRFVLAGALLFAVLWLRGAPVPTARQWGASALVGLLLLGVGNGGLVFAQQSVPSGVAALVVGSLPLWTALFGGLFGQWPRRAERWGLAVGFGGIVLLNLGGDVGGGLLPTLAMLVSPMSWALGSVWSRRLPMPRGLMSTAAQMLCGGVVMLGFSLLIGERPTAMPTPKAVLAFFYLVVFGSLVGYSAYGYLLRNARPSLATSYAYVNPVLAVFLGGLLAGETMTPTAWLAMGAILGAVVLLTRGK

SEQ ID NO: 12049 - protein, 222 aa, Myxococcus xanthus
MEELTERQREILSFIVKETETRGFPPTIREIGEHMDIRSTNGVNDHLKALERKGYLNRGEQQSRSLVATKRARLLLGLGARKDSGMVEIPLLGKVAAGAPLLAQENMEDSVKIDSFLLGGVNGREVFALRVKGQSMIDDGIHDGDYLFVKKTPSAQPGEIVVALIEDEATVKRYYPEGDRIRFQPANATMQPIYVSRAEFRSTMILGQVVGVYRKLQGGRTP

SEQ ID NO: 12050 - protein, 369 aa, Myxococcus xanthus
MAVGNALSVPTAHRPFMAVPFPKQAEGPYMKLMGGGPHELRRGQVTEEVQLAACLSHSLRAMKRYDAADALRRYRAWQPHAFDVSEPMTEVFEDCQTSGFPPLGAGRRVWLRAYRKPADPGSLARAAPLGVYLAGDAHALTQASLEDSALTHFDPRCQLACAAFNAAIGHAVTHGAGLKAADLIPAAESGLLLAGAALGRSASDYVQEVSFAASLLREDLAIAQQEDPMLYGPELHLHRPLHAVRVRLPAGLLGAAPRPQRRGRAPGRRPPGRRHGGPRHHHRRAPGRLPWRAGPARGVAKAGPGGPEHRQGAAVGCLSPPAPAGPEQRLRAPECAKPAGPSWEGPPPRARGHTGAAVRPLARVRTAGR

SEQ ID NO: 12051 - protein, 299 aa, Myxococcus xanthus
MRNVLADLEELGFLEKPHTSAGRVPTDQGYRFYVDTLVKLKDPTPRDRELIHAGLAHEADLAEMLGEASRILHSLTRHAGVVVAPRPESAVFRRIEFVRLREDRVLAILVGQSGQVHNKAITVEFPITSDELLKASNYLSELLREVPLESARERIRAEMDQEQALYNALTAKALKLGAAATDLASTERMLIQGTGSFFEQPEFADVERMRALFRALDEKHKLLSLLDRVQVANEMQIFIGAESDFSAAGDVTVIASPYGNQEQVLGTVGVIGPTRMDYRRVIPLVNFTAQVLSRVLEKV

SEQ ID NO: 12052 - protein, 301 aa, Myxococcus xanthus
MKAVVLKSYGDVDALAVQDMPEPKVGPGEVKVRVTAAGINPVDWKIRRGDMKAMMPLQFPTILGRDVAGEVMEVGPGVSDFKPGDRVMGVVNAGYAEKVVAPVESWAKVPESMDLKDAAALPLVTLTGVQLMEEAVNPKKGDTVLVIGALGAVGRAAVFAAKARGAKVLAGVRGSQKAEAQKLGVDGVFALDVADEFSKLPMLDAVADTVGGQVVARVLEKVKPGGTLGSVLGEPPEAKGRQITVRAILSHPDSRRLTQLGQAVAKGDLVIPVSKRFPLEQVKEAQKLAEQGGVGKVLLVN

SEQ ID NO: 12053 - protein, 53 aa, Myxococcus xanthus
MVYAFHGIRRTERTMFTQRNLVTGPGGALLVVGELGSTLLLLVGAALGEGRAP

SEQ ID NO: 12054 - protein, 264 aa, Myxococcus xanthus
MVKAGVHAIAPLGSTGVLPYLSDDEREQVAEIVIKRVAGRVPTLVGVSSLTTERTVHHAKHAEKLGASAVMIIPMSYWKLSDAEIITHYETVAKRIAIPIAVYNNPATGGLDLSPDVISRLLKIPNVTMVKGSTGDVNRMHRLVQLCGEDVAFYNGSNPLALAAFVAGARGWCTAAPHIIPKLNIELYDAIQRGDVAAARQSFYRQLPFLQFIVAHGLPRAISAALELQGTSVGPLRAPLQALPAERVEELRRILVGLEVIPGE

SEQ ID NO: 12055 - protein, 260 aa, Myxococcus xanthus
MSKTFTQTKEELVGKAKKQMDTTFGQGDWTVRQKLALTCRILFEGGHDSGLAGQITARATEPGTYYTQQLGLGFDEITASNLLVVNSDLEVLEGKGMANPANRFHSWVYEARPDVNCIIHTHPTHIVALSMLEVPLQVSHMDMCPLFDDCAFLKDWPGVPVGNEEGELISKALGSKRALLLSHHGQLVAGDSIEQACVLAELFERAARLQLLASAAGDIKPIPEKLGKEAHDWILRPTRSAITFAYFARRVLKKHGDALA

SEQ ID NO: 12056 - protein, 380 aa, Myxococcus xanthus
MFPRPRALSLIALLALTGCDDETPRVKPKDHAEGLYVKGTAEYLQGHFDAALASFEAMKQIAPDDPRLPAARGEVYLSMGRLTDAAAEFEAALKLEPKRSTNWSRLGFIQTQLGQVVEAQSSLRKALSLFPQDFNALESLGDLDLKKGDHDAAVRHFTLASNAAPSPEQKSALIMRALDVLSSKQRYPELLVAAQKAVDDGIHTADVLATLGDALVRAGNLTEAANAYRDAASRSPRDPTLWELVGEIQMKLDKPGDAISAYKESLRVQDRAIVHVALARIYLGMKDAAAAKEELSAALESVSGQDIRELRELASLLATMDRKPDALRILANLSAEQDHAKDAELHVATAQLARELKDTGILQAACARATAADATLKKCP

SEQ ID NO: 12057 - protein, 307 aa, Myxococcus xanthus
MLEANEAGRDAAPGVTSLITSRLAESPRLRVLSQWDVEAALDDERQQQLQGLKTCDRGDCFQELVALTGARYVVAGRLDRFGDQYLLTANLLDAAGGRILARPRAEAPEAEDLLRTAKAVSDQLFAALAPPEESVAARPLLGGSSRTGGGGLLLGLRVNNNFIEKLSNVNPGGDIEVGYWFHPEWVGFLQVGFSYVRSTQDGVRSGLSVLPSVVGARHYHNVEKSLRPYWGFGLGVQLSFGDFGIFQSTGPLPTVVGFAGLEYLIAGSVGFQVELGTNVAQAVLGLSESKLGDGLNLDLNAGIAYHF

SEQ ID NO: 12058 - protein, 58 aa, Myxococcus xanthus
MRGVLYGRFGKKGKEPHDGIDLAAPSGTPVKTAQEGTVLYAGEQRGYGNIASSSTRTS

SEQ ID NO: 12059 - protein, 171 aa, Myxococcus xanthus
MVSGINHGANLAEDIMYSGTVAAAMEGALLGVPAIAFSLVARRNFDFAPGARFARSLVSSALSRPLPPRMLLNVNIPGGVEPEGYVVTRQGRHSYGFEVVENEDPRGRKYYWIGGSDYQHEDIPGSDCNAVFRDKRVSVTPLHFELTDHGRLPDLSGWQVDGFNRHEPDGA

SEQ ID NO: 12060 - protein, 432 aa, Myxococcus xanthus
MTEISQILAREVLDSRGNPTVEAEVQLAGGARGRAAVPSGASTGEHEAIELRDGDKHRYLGKGVQKAVKNVVDVLAPALVGMDAADQFAVDQRMLELDGTATKGKLGANAILAVSMAAARAAADAHGLPLYRYVGGVQARTLPVPLMNILNGGAHADTRVDVQEFMVVPAGASSFAEGLRWGAEVFHALKKILKGRKLATGVGDEGGYAPDLPANEEALKLIMEAIDQAGFKAGEQLFLALDVAASEFFDKGSKKYKLKGEGKEYDSTGLLEYYRGLSERYPIISIEDGMAEDDWEGWKKLTDALGSRMQLVGDDLFVTNVERLGRGIETGTANSILVKVNQIGTLTETFDAVRMAHRAGYTSVMSHRSGETEDTTIADLAVALDCGQIKTGSASRSDRVAKYNQLLRIEGELGAAARYAGKSVFRALNQKK

SEQ ID NO: 12061 - protein, 141 aa, Myxococcus xanthus
MPGASRTIIVNAPIEKVFDVITQYERYPEFLPEVKGIRTENRKGNTVDVHYKVDVVKTINYSIHVTEERPTRMSWTYIKGEFMKDNQGSWVLVPEGEGKTKATYTVEMALGALVPKSVVSALVETSLPKMLDAFKRRFEAP

SEQ ID NO: 12062 - protein, 114 aa, Myxococcus xanthus
MGIGGAPEGVIAAAAIRATGGDMQGRLVPRNQGEIDRARSMGITDISKIYTAEELAKGEVMFAASGVTTGDFLKGVRFFGGGCETHSVVMRSKTGTVRFIQSVHKFDKKPGYAF

SEQ ID NO: 12063 - protein, 217 aa, Myxococcus xanthus
RGSEPGHDGLPRSDAKAATAARARRTRGRTVTPRVPFDEEALRAAVVSGDAAAREDVMRHLYEALSGKLYVLCHGITRDPSDAQDAVQETFLSIQRALPQFRGDAQLSTWAYRIAVRAAVAAKTRRERHRGDAVDIEMADPRAGIEETFETRERRRRLEVAMRTLSLEHRTVLSLFAVEGLSHAQIASVLGIPEGTAWSRLHLARKRLAAALESTAP

SEQ ID NO: 12064 - protein, 462 aa, Myxococcus xanthus
MKRYFIHTFGCQMNVNDSLRMSEVLSQMSYAPTPVPDNADLIILNTCSIREKAEDKMLSALGRYKPVKASRGALIGVGGCVAQQEKDKLLKKVPYLDFVFGPDNIARLPDIIGRVSAERERVVETAFVNSEEYVFPRADPETSRGKVTEFVTVMTGCDNVCSFCMAPHTRGRKVSRAFPDVLVEVADLAKVGVRQVTLIGQNVNSYAGGISFAQVLLRTAEVPGIERVRFTTSHPHDLSDELIEAFRVQPKITPHFHLPVQCGSDRILKMMRRDYTVVQYLERLAKLREARPGIAVTTDIIVGFPGETEEEFEMTMQLTEQVRYDNQFSFVYSPRPKTGAALREKDWGPVPHEVKIARLERLQKLQRRISGEITAALVGSEVEVMVEGHSRYDATKRFGRTPENRTVNFDGDAPAGSFVTVKVERATPNQLAGKQVALLKPPTVEPLPVPMAEAPFHVVAEA

SEQ ID NO: 12065 - protein, 169 aa, Myxococcus xanthus
MSSFLFDDNGFQDVPNRESSTDLTAADDRTLRWAAPPLDAAMLDALVCYQQTYLAQASGQGTETLAKAHTEALAASGLDPKTAEQGSALLRAFGGRRWAVRKLQDKLGQLQGGAADELQGRIQDELAKQERETNALARRYGEDALVLLRAREAELVDLHTRLTHLLSRG

SEQ ID NO: 12066 - protein, 355 aa, Myxococcus xanthus
MSPLAQAVLMGDRARLAQIFRMASLQLDLSRMESPLQAGFFSRRMLAAAGADKARNDMKSLEDELRARGLTPEGVEIVSRHVAAAMRKIEDAARQEVKRQAEARIRRRTDSAADKPLHLLTQAEVDQMESAVRTLAEKLRSRLIRKQRSHRKGALNVRRTLRRNLPWGGVPMVPQFRSRRPERPELVVLCDVSDSVRQASRMMLLFMHTMQSLFVRVRSFVFVSDVGEVTQYFKDLEVDAAIDMATAGKTVSLSANSNYGRALADFTRDHLGSITRRTTVMVIGDGRNNYNANNAWALKDLRRKAKRLLWICPEERGNWGIGDSEMLTYEKHCHQAVVVTSVSDLARIADQLVPA

SEQ ID NO: 12067 - protein, 232 aa, Myxococcus xanthus
LYSGPVTARHLEAAEAAVRALRLEGAVLTPKEGSARLLGKPALRSYSPLRPEVPLYLRPDAFAQAHAEANVGLVTSAVYELGARESDTVLELYSGNGNFTFPLAGTAASVLGVESSPVGVELAQRSAHEGGVTNVRFIQGDARKVCDGLVAEQRRFDVCLADPPRAGAPGLAKWMTALGVRRVVYVACDPASLARDAAGLVAAGYKPLALQVVDMFPQTHHVEAVMSFERPA

SEQ ID NO: 12068 - protein, 259 aa, Myxococcus xanthus
MSARMYVVGALLALLVPTLARAWPVDLVVPLEPGKERFHKLDTVDWVQVADASVADAELLPGSNELLLTGQKAGRTLLLLYAGGRFAVWRLTVGSPPPEDPAPRLAAARKACPDLNATSGAERSLSASVKDSACRLALLELLKTDSFVARELELTFELPVLQEQLTSLGEGLKPLGLEARYSGAGVVVSGAGSPEVHRKALWELFHRSVGRVPLDDQIQEVKPPEPTDAGVPDAVPPAVQAPREIPVEVLPPPKKSRTR

SEQ ID NO: 12069 - protein, 200 aa, Myxococcus xanthus
MGTDADRKTYLMSELQVDCDVLPPGRLSGTPVALRQKDAPTGCKLRRADDNSTSDEGRGLPLELSDVLPERTSCEAPECQRKWEIFSSRWDDGSAVFDIAVSWMKRGGKKDPCEWATEDHTALLLRPAGALAPLPLRSGGAFFGALYDSTGLRTVFSRTLGVLNVHDAAKPKVAPKAVRYGSPTEEELAHGKRTLSPCKK

SEQ ID NO: 12070 - protein, 154 aa, Myxococcus xanthus
MANTVGVNKMSVVTKDSNGVSVAFPDVCKTPSPAGPIPLPYPNVARSADTAQGSKTVAVEGNPLCVKDSNFSTSTGDEAGTAGGGVVSGKTQGKAEFVNFSFDVQVEGKNVARALDLMLHNDKNTPPFPLMQPPVMAAGQGSGKCNCLVCEKEM

SEQ ID NO: 12071 - protein, 146 aa, Myxococcus xanthus
MGTVQVDFEGNHHGPLEARLAVAVDEATLLRAIEARQEAVLCFERGTPTCPIVLGLLQPRSETPLLDAMLEAPDVEHQDGEVAIVANGQRVPIEGLLDGATEELELRCGRSSLVLRRNGQILLRGEHVLVDAGQVLRLRGGKTQIN

SEQ ID NO: 12072 - protein, 654 aa, Myxococcus xanthus
MKVFVEALGMASCLGPVIPACAAFRANLLRSSPSPDVDVAHAGDEAPRPVTICALPVATFGFSGVGRLVALACEVLKDVGTRVDLRGLGPETGVYLALPDPWERGLDLGEPDATEALRVEALGRRVLEASLRNMGLEWPGPRRFFGGGHVAFARALHAAQAALQNGGLRSCLVMGVDCLVEEPTLHALADGRRLKTPEQPVGLTPGEAGAALLLTTEGPAQRSTGAPQVMLHAVRLGEEPHPRGSDKPSDGRALAACAEAVLAAAGALRARPLLVSDHNGEEGKAREWGDGVAASAGVGRLAGGLPRYPPRLGLGPDGRTALVRSGTATRRCAFLREPCLRQRGRFRPRRRLDRNHCCASVQRSSAMTTGDARHNPNTEMARRLNGIYKRNLARKESARAAAKEEAKKSKPKKKAEPAPDGHLDPNAPLNGVLAKGDNYARRGYTYLKAQDGRGVYRNFDHVHLSEVRDMVKERAEFPGGPKENFNPTYTQQYPYAWEAHHMLPGSAFYYMMKDGKPAFTYKQIRLLLMSEYNINHGHNIINLPAEDWAVPVHSLICHPSDHESYTMRVMDEMRKVANDLQKLIDSGKPHGNLPELIFEELKKLENRFWIFIVKLSGKLVEAKVAGVRYVGPGSEHVRYANKDGGTHYEWGSLW

SEQ ID NO: 12073 - protein, 36 aa, Myxococcus xanthus
MMELILISDRAKNAFEQAGLTGFKLHPAEGFDDMFA

SEQ ID NO: 12074 - protein, 68 aa, Myxococcus xanthus
MTLLVKSLPQDMDVVSVTSNKDGFYEASLVLGDYRICTTFGRCTDFSVGINEVVRLDYEMSVGPGWSR

SEQ ID NO: 12075 - protein, 36 aa, Myxococcus xanthus
MMELILISDRTKQAFEQAGLTGFRAHPAEGFDDMFA

SEQ ID NO: 12076 - protein, 242 aa, Myxococcus xanthus
MRQVDPTASRDVLVRTVDELCVHFHVVAVATLLVDGNPQGFFLNLCRAAENWRRLLTHCRLKQWALPASRHMDPLLGAVAAGHWNLARQVAELSETRWLPDEEYRSEHARAQLFLALVSPGTRDVVIPRVEALEGLGLETETDRVACARALLDGDADTFSEAFKHAVLVHGEDIEKRAKLFTTPVTRFAPKRAIWLEGLAWLRLSERADIASFDEHFQYCPPLARTPMTSQYAGDWVVSLGP

SEQ ID NO: 12077 - protein, 190 aa, Myxococcus xanthus
MPEFGHVKAGRILVVAGEARRASRGTVKPLCFRGGKSTDRTGRRKPIIRIGGKRMLYCVTLRPLFFRGSTAQARVETVIHELFHLSRRFDGTLHSGRRHAVLGRNFSRKLKPLVRRYLKLCPPELLAAMAHSGEVRILQWLERPGPAYHPGSHRRVRKVYTEEQLYSGVARMVTPKVRLARDTSARSKVH

SEQ ID NO: 12078 - protein, 658 aa, Myxococcus xanthus
MPWTAWGGGSEAPATEVASSEASTAEAPPDAQVAQADAGPEPALDAEALPEARTVVTASRSPERLEDSAVATEVITRSDILASGARDASELLAAHPGLQVVQTFAGATVQLQGLSPEYVLVLVDGERVAGRVAGSVDLSRLSTEDIEQVEVVKGPSSVLYGSDAVAGVVNLITRRARRPLGAELRASYGSMQRLELDATGEAKGENWGLRLSGGLARRDAYLLDPTSIGTTGSSLDGIDASAGGDLRISEGTALQANATYARRVQRGVDVGVTGAIFDRASRDDSLSVRLSPQWRLSNNASLRVDGAYAWFNRRYLRDQRRSNALDTIEDTREQQGRLGAQLDAKLGDTHAFVVGAELLGEWLQADRLGEDGTGQRARASIYVQDNWTLVPRLKLTLVPGARVDTDTQFGTAVTPRLAARMDPTSWLTLRGSYGWAFRAPGFQEMLLDFENPSVGYRVHGNPDLRPERSRSFNLSVEVKPAESSLLWVSAFQHNLQDMIGVSTEVVGPQQLFTYVNIARARVRGGEMGVRQQLPGRISAELGYTLTDGRSEETGLALEGQARHRLTAQATWRHRTSGLEAWVRGALVGPRPFYPDTDGDGVANPYDAKTYVTVDARLGWRMREELQFFVLGTNLANAGNPTDLPIPPRAIQAGISARL

SEQ ID NO: 12079 - protein, 219 aa, Myxococcus xanthus
MSRFSSHSSFLGRAAAALLLAGSLSACGDDLELPSENPPTDGSHVNHVANDDGSYTTTVNATSSADWIGLDLDKGAQVSASDDTVWDLAFNRFNVRTRGGVSGTGNVAVAVLLETDFAAVTRAPADGYVADSEDGPDRGEDPDSAFQQGDGWYVYDMTTHALTARRNVYVVRSDAGDYFKVAMQSYYDDAGTPGMLSFRWAKVPGPASSGSAVTQPSSY

SEQ ID NO: 12080 - protein, 150 aa, Myxococcus xanthus
MLLNRFSVARTQALRLAEPELTTPVATSSLTWVLEKASATELPIMIFVGNPGCIQIHTGPVKNVKPMGPWMNVLDAGFNLHVRADHVHSAWVVRKPTRDGVVTSLELFNEAGENIALIFGKRKPGQPESPEWRALAEELATALPASEVSR

SEQ ID NO: 12081 - protein, 300 aa, Myxococcus xanthus
MSRAFGLSWVFMAVASLAHAAAPAPAKPPAAAAAKAPVNAAKLVTVGPAITETVFALGAGGQVVGVDDTSLALEVARKSPKVGYQRALSSEAIVALGTSQLLASEEAGPPGVLEQLKTVGVDVVVLPNKHTVEATRERIRTLAQRLGKAEQGEALVKQLDSDLRKAQERTAARKDAKPPRVLALYARGANVLMVAGAGTAAGELVTLSGGVNAIAGYAGHKPLTAEAVVEAAPDFILMPASSLEPVGGEEGLSRTPGLSQVRGWRLITVDDVHFMGLGPHLGKAVSRLQDGYTSPARGRK

SEQ ID NO: 12082 - protein, 362 aa, Myxococcus xanthus
MSASEIAPVSATYRTQEPIQPAAPRPWLLLTALLLGVVLLSLAVGAVPVPLLALAGSLLERVGLDIGHKLESVQQAVLLSIRLPRVTLGIMVGAVLATCGAALQALFRNPLVEPGLLGTSSGAALGAVAAIVMDVALSAHLGSLRMLAVPGAAFLGALGATLLAHRLGGGGGRTETARILLAGVAVSAGAGAGIGLLTQMATDAQLRSITFWTWGSLGGASWDVVGAATPPLLIALGLLLREARTLNLLLLGEREAWHLGVDVERLKRRLILAAALGVGAAVSVTGVIAFVGLLVPALLRLALGPDHRRLLSASALLGASLLVGADLLARTAAIPAELPVGALTSVLGVPVFIGLLSRKGAA

SEQ ID NO: 12083 - protein, 192 aa, Myxococcus xanthus
MRLGVLPQESSLGFGFTALEVALLGRSPHSSRAEGSADLAAAVAALDATDTRHLASRSYLTLSGGERQRVQLSRVLAQLSEPLASGHRYLLLDEPTASLDLAHQHLVLEAAARFAQAGGAVLAVLHDLNLAARYAHRMAVLAEGRVVELGAPAQVLSQELVARVFGLRVQVVEWPGSPGPLVIPEGRAPLTP

SEQ ID NO: 12084 - protein, 183 aa, Myxococcus xanthus
MLLVWPVSVLWLGEAVSSWTVSGVAMLCVGLAVMNLSRPSGAAGAGVAWAALSAVGIAGYHLSYKMALGTGAQPPALFATGLLVALPVLILERGRQQGWAAFRREALLAPGLVLTAGLISALSFGLLLTALAGGGAGVVLTLRNTSIAFALVLAALQGERLGRRQLSGAALVAVGALLLGVPA

SEQ ID NO: 12085 - protein, 460 aa, Myxococcus xanthus
MSVLSSSTITIAIPELQRHFGAELSSVQWTLTGFMLAMGTSAPLTGYLGGRFSFKWVYVASLVAFLVASVLCGVAWDTRSLVAFRFVQGAFCGAIMPVTMTLIYQLLPRERQALAASLWTLSSMLAPAFGPTLAGWLMTLGNWRWLFFMNVPLGLAAVAMAVRAVPYYRLEVPKAFDFPGLLTVITGTLALLIALSQGRAWGWTDSKTVSLAVLGTVSLVYFVVRQLRTHAPLLDLRVLANGRYVVTLLISSIITISLYSGAFLIPLFLQEIQGVTPLKTGLILLPASLSMALLMPLVGRMYGKLGPSTLMTAGVLLIAGGTYALSRLTPDVSHTYVLMWMLVRNVGISLSIMPASNAGMEQLSRELSGHASSISNWLRNVFGAFSIAIFTSLLSSFAAREAQVLAREGMTERRDIELLSFVTGINQVYLVATVIALVAVPLSLMVRKYVSGLEASRGAR

SEQ ID NO: 12086 - protein, 153 aa, Myxococcus xanthus
LDFSRYGESAWLPVATVAAGALLVGVLATLMEVTMRGLANGSPERWALRLSGFTSLLVTVLYPPMRMAMVVLNLMARTFGRTLRFEPPPPPLEELEKLLAAQAAKNEVDKSAPQLIRSIFELSDKRCRDVMVPRTEVVTVDVTITPDELLRLA

SEQ ID NO: 12087 - protein, 200 aa, Myxococcus xanthus
MTKDEAMTALPFHARVINAWGDVHVADVVAGRRADAYYVFAQGQLAEVTLHFHAPGAVRDNFNAVAELLTMKYGKPATREDSARDAEGRLALAQMANNLSEASANYHAWRSGVQPSGPAVDNFGRQMEANARTDAALAVHEYLLRSTWTETETELRLTGSQEPGARSLTLTYTSQRLKPYLSKELAVRDQQRKAEQSREL

SEQ ID NO: 12088 - protein, 117 aa, Myxococcus xanthus
MMEAYVTLHEAGFAHSVEAWAEGELKGGLYGVSLGAAFFGESMFALAPDASKVAFVTAAERFQGWGFQLIDCQVETEHLARFGAENWPRRRFLSALARAMKEPTRRGKWTEGAAADP

SEQ ID NO: 12089 - protein, 276 aa, Myxococcus xanthus
MRLPSPMFRLAVVLFLCAGCASAPTRPSSPAVLTAQRTVVASQGLTDATLRFEAQVTSPGEGVLVRADYELVADGQVVKTDTAKLDVALTPGEPTDLSFEERAPYVKNADDLARLSAQGGTLLLALRGTLVVRSGDQEQTIPFAASRAARVPRLPTVVVEELDGARYSDEEVQLNLRLGVRNPNPFPLRLEGLTWTASVAGKTLDSGTLAQADTVDASATGVYPVELTVTKDTWGPEVKALISKGLLPYGVTGEVTGPLLRVPYSLTGKVKLNVSR

SEQ ID NO: 12090 - protein, 221 aa, Myxococcus xanthus
MHVSHETIYRSLYVQTRGSLRKELAAYLRTGRPQRRPRGRASVLSGQLPGRVMLSERPPEAESRAVPGHWEGDLLVGKQGKSAIGTLVERRSRYVMLLHLPEGRTAPHVREALTHQLGQLPDALRRTLTWDQGKEMAEHVRFTIDTDVQVYFCDPHSPWQRGSNENTNGLLRQYFPKGMDLSGLSRAQLDTVALQLNTRPRQTLDWRTPAEVFAQSVAMTG

SEQ ID NO: 12091 - protein, 639 aa, Myxococcus xanthus
MKTASFLVLQLLTAQAAEPDSATLERTAAVESARLAESPDDADALYRLGTAFLALNTPKKAVAPLKKLVAQEPDLIPPKLALARALRLSGEPEQARTVLDTAIAAFPEESTLRAERGLLARVLDERDVAISQYAVAVELAPQDAELRFNLGEALQRANRTDDAIEAYREALKLDAKLNVARVNLGKALAEKGLNGEAKETLREATRQKLGDTEAHYNLGVLLMRENDLDGAIAEYQRTLAAAPKHASAHNNMGVAFNEKGDPRKATDAFLKAIAADPKFAEAHFNLGLAYYQLGDFARATKAFERAVVLEPQRSSGPYTQLGHLYLTQGKKKQAVEAFKTAIAKSAEDGKKTTEAYQGLARAWLSLGKADEAVATLKTAVGAFPKDASARAAYGEALRAKGDLDGAIAEYEEGVKLAPTPENRLALADVYAQKRVGAKAQPLYKALLDEDPANRAAKLALADLLLAMGDYVAAEGLLKPKDGEEADTAALARLGIVHSRRGRPDLAVSELEAVVAKDPAQLEARAELGFIYLRGGDGAKARKVLTSVLSVDPRHSLGLLYMGHTLYQQGNTKGAEKSFRNAVQADPNFAEPHNALGQLLEATKRIDEAKDAYKMAVQLQPDHPDAKDALKRLTASAPTP

SEQ ID NO: 12092 - protein, 211 aa, Myxococcus xanthus
MKRFVLLTLPLLSACGASYNMRVPDSMEKKLPYEARIELLEAENNLALAIDRVDEADNEIGRARDNIRRARSRKEAAEDEVDRASDEVSREVAKLAIAEAEARVEYLRARQRLSVGLRDVERLALRCAFAEFELARLQAARKAKVEGSERLDPKEFEEQVSECKAEVKEERAELAGDEKEEKTAREAWEAKKAALAKKTFDARASPYVENL

SEQ ID NO: 12093 - protein, 89 aa, Myxococcus xanthus
MLPEGYTGSLDVNLAEVLANGAQRGAIGRNVLDEPARTFPELRVGGLKVKALPSQQGQRISGEFHVTFVNGTHTYSGRTIFGSFEATVP

SEQ ID NO: 12094 - protein, 1089 aa, Myxococcus xanthus
MTGHLTGLIAAAMLAAAPGGAGRPGPGINPIVSKAKERDELIAKLKRDIFKVDRAIGETERLISKSRNAPYLPDLQFRLSELYVEKSRYVYYLQAESRPEGASGAIVSPETRLLKQKAVQMYYRLLREYPDFKDGDQVTFYLAHEQRELGQFDEMLKTLGDLTRKFPGSPLRLEAEQILGDHFFDKADLGEAEKHYQAILEAPPSPVHDLARYKMGWIRVNQAKHAEAVTFFEAAAASAPLPGVDVKKALNVKREALLDLVYSYTEAKPPKGALNYFEKLSDSRATYALALDKLGNRYFIKQQYEWAIPALRKLMEIQHDPELDLERGQKLYDAIKASKGKVLPDPEDLRILVRAAVQSKTDPELAEAERKKHLVELEEMARDLSTLLHVEAQKKNDKALYVSAAEAYQAYLGLFRPEQHVRTMMKNRADALFSANAYPEAARQFEELARYQVKAKDAKGEEEALNAALLAHFSTLKPEEAQTRNAFEVADARQAMKLLGADFVSRYPRSENALVVKFNIARAYYEDGEYPKAAELFTAFALSHPQHKEAPIAGNLALDSLRQLNDFKGLDETGKKLLGAPLPASFRADVQKILTQSRAEALDELALQSAQETGDVIQGLVKVADENKNSDIGEKALYGAFTAAREKRDMQAQRELGTKLVQDYPKSQYLSDVLLTLGRHAAEAAAFGEAAGWFEQVGQKLGGDFAAVDGWLAGARLRMALGEHKEAARDLEAAADIAGARKADILVMLAETRLKQKDYARAKTAAEAALKLDRHSAAAAAVLAEVQATTAPTAPADALIATLTTAVQGPNGGTEEAAKGLWYLGEILYRGYRDLPADQVEEKVAALQSMEGIYTQAASLGYAEWAVASLWKLALAYGHIADVVEGTAVPAGLSAAEAQQFRAAVKEQVTPLKARSDEAFKACLSRAESLEVFSAAVVGCRARTETAALPVPQPGTPTQPASLEELRKKAERTLNAEALEALGLAYLDARQYGMAQLTLGRVTELQDTRASAHSALGLALLHMGDAMGAREAYGRAMDSDPTFGKARLNLAALRCRFGDVDGARRELAVLKDVASLGGNDVDGGWKACK

SEQ ID NO: 12095 - protein, 289 aa, Myxococcus xanthus
ALNTSMVTLWGCSKTKILYLDARKEPALVRALLHYEGRDFQDAEEAYDRVKLPQLDPDRARLYLEEAWTRYKLGEPRASLGILTTMDAPSFRDEFLPDKYLLRALIYRDLCHYLPAKRAAKELTRRFADSLEAVRNREDLTQDVRLRRAANARGSTQRAARFLETLELEGERLGRYAGSFGDRLFSHLTKLYDLSRAEAVRVHDARLAEAVRQEADTLLRAAEQVRLMEYEVGLKLYERVKKGARIVAPEDEQILSPTQTAYRFDGEYWNDELRSYRVRIDSRCIEETP

SEQ ID NO: 12096 - protein, 180 aa, Myxococcus xanthus
MVVESDGVLTAGSAFAHADLVLAIVARVASPSLAHLVARYLVLDERVSQARYMVMEHLRVSDPALRAVEQFVAANLGRQLTLDELARAGATSSRTLARRVQAGLGMTPLEFVQRVRVAHASHLLETTHASVEDVAARVGYADTAAFRRVFRRYVGETPRGRRGNSRSRRSPLNARDSPAP

SEQ ID NO: 12097 - protein, 161 aa, Myxococcus xanthus
MEGSYAGRPLTLETEYRHQEKAYRIATIIRHELGDDFPREVVIRPEGLGDKFLKLFGVQDEQIGDAGLDAMLDLKNVTPQARAILLSAGMRRPLLNLARAFESFSIENGVLSAEVTDEVPCTPIELYGFLTPVRELADAVQGTRGHTQWRSEGTGQEGTQS

SEQ ID NO: 12098 - protein, 240 aa, Myxococcus xanthus
MLLYLQGDDFLSDLPLIAPHLRPGMVAFDVGANIGYLSMYLRSRIGPLGQLFSFEPEPENYAELDANFRNNHLRNCQAIQTAVGSQEGVITFATGLNGHVPVEGAEGISVPVVTVDGFVQKQGLSHVDFVKVDVEGFELDVLAGMRATLERPDKPILYIKVHGRGEYARADPRRVCEVLEGHYKNIRAYLPPDDFKAKRSHLRRLWGRVSPFDDIEQACRVDLREVKQHDTQRYQLLCLP

SEQ ID NO: 12099 - protein, 233 aa, Myxococcus xanthus
MEPPVSFGAEDIRDEKTKVFRALRPLEGREVSRAVVAGQYEGYLQEKGVKAGSRTPTYVAMKMNIDNWRWAGVPFYLRAGKKLKRRVTEVSIHFKSVPISLFSGEGATCQRLQPNVLTLRIQPQEGIALSFESKVPGEDVNIAGVTMDFNYQETFQRPVPEAYERLLLDCMRGNATLYARQDSVEQAWTFVTPILQALESGEGGPAHGYPGGSAGPDAAAALLARDGRRWTGL

SEQ ID NO: 12100 - protein, 223 aa, Myxococcus xanthus
MSATRTHVVPTESLPREAATWMARALQDTLATQRRVSLALSGGSTPGPAYRALAAQVLPWERVDVYFVDERFVPPDHADSNYRMVEDTLLRPLRLSPSQVFRMEGEREDRDAAAKDYAAKLPASLDVVLLGMGEDGHTASLFPGHPALEESEQRVLAVVGPKPPPWRMTLTLPVLRSARHVLTLVSGAGKQDTVRRALAGDLSLPAARVTNSEWMLDPAAAGR

SEQ ID NO: 12101 - protein, 461 aa, Myxococcus xanthus
MGVMGASLALNIADHGFRVAVWDRHAERIDEMHRKHGHPEVWGTESLEAFVQRLERPRKVLLMVTAGAAVDSMLERLLPLMAEGDVIMDAGNSWFLDTRRREEQCKAKGIHFLGVGVSGGEEGARNGPSIMPGGAPSAYELVRPVFEAIAANTDMGPCVTYVGADGAGHFVKMVHNGIEYADMQLLAETYDVLRRGLGLDADALADLLSQWDHGIAGSFLLETTIKVLRQKDPETGKPLVDLVLDKAGQKGTGKWTVQVALDLGVPIPSIAASLDARILSSMKDERVAAAPKLNGPVGQLSKEERAQLAAWTHDALYAARVVTYAQGMRLIQAASQEYQWNISLAELARIWRGGCIIRAKLLTPLREAFQQQPTLPNLMVSDAFAPVLERMAPAWRQVVGVATRVGIPVPVFSSSLAYLDSYRTAELPQNLTQAQRDAFGAHTYQRKDRPEAGFVHTEWGK

SEQ ID NO: 12102 - protein, 389 aa, Myxococcus xanthus
MTLDAGANLLHAVRELAPALSARSGEIEQARQLPLDLIATLKDIGVYRMLVPRSHGGLELNLVTGLDVLSELARADASTAWTMMIATESPQLFALLLREEFDAVYAAGPNATVGGAFNAQGKAVQVDGGYRVTGHWNFATGCRQSEWLFGNCVVLGPDGTPRAGPAEGMPETRAMLLPASEVRIIEHWDVLGLRGTGSHDIAIDAFVPQQRTFDIFTGQPSVPGANFVVPVLHYAMHIGAVAVGIAQGAVDDLLTLARSGKRRLYARTSLVDSPVFRNRLGRAETGARAAHDALRRMGEVFWDACQQSPMKAFALAPQVSATLTWAVETAAEVVTACYHAGGATSVRDGASLQRRFRDIHTLTQHAAVAEGWFTQEGSALLGFPVLFEA

SEQ ID NO: 12103 - protein, 231 aa, Myxococcus xanthus
MRRWSLADFRERFGDVEVEIMSGRDANPDHASQPDKHRQVVKLRDYVQRVETGGESNDFYMVPRNENWKRDGLARLREDIRAPAGIIDPELRPDMTTLLLGPPGTVTPLHHDNMNVLLGQVMGRKHVRLVPSFQRHLVYPRHGTFSSVDAASPDAARFPLYGEATVLEGVVEPGELLFLPVGVVALGARTGRERHCHVPSFPAPGRQHAPEDSAVDGRTARPLALNMTPRG

SEQ ID NO: 12104 - protein, 213 aa, Myxococcus xanthus
MHMRVGGVKGKVLWTAPLKRGDWSDFVLQVKWSPNAKTGFVQLWHNNEVVVPKTYVATQFGKEMNYLKLGLYRDDTIRPEASVYHDGFTMASTLEEVMPPPTPEPTPEPPAPEPEPTTPAPEQPGEDAPSEEPPDEPIVRTPDTQPRTRWGVTPPEDILSGESPLGADGARGCNASGGGTAGVPITAAVGLLSFAALFARRRKPAQARAHAKR

SEQ ID NO: 12105 - protein, 178 aa, Myxococcus xanthus
MNPIVHAELAWLAAQGLKERRDRILVTCAGLAPDLDGLTLLAGEAYYVRYHHVIFHGYVGAIVTAVACAALARQRLRVAALSLCTFHLHLLCDLAGSGPGWPIYYYWPTSMREWFWEGQWNLASWQNAVIGLATTLLCLACALRFRRTFVEVFSARWDAEVTRTLRRRFLREDFVREP

SEQ ID NO: 12106 - protein, 631 aa, Myxococcus xanthus
LILGLGLMAVGVLGASLEAPVTSVTVYSNQAQVARSGSLTVSGSRRVTFPRLPKNVDTDSIRVEAEGAEVSHVDVRTVKEEAFSHDEARKLIARMEEIDAALARITAERNVHHAQIEALRRVRPSAQSDSEAARAQTPPTTWDAAVSFLVDNVARMEARLRELEAQSATLQKEQQQHKERATTLGKTFGEPGVEVTATLTGKGATKVTLTYLTTGARWYPHYELQFQPETQRMQMAFYGRVSQETGEDWESARLTLSTALPANATELPKLSTWKLGIRERFIPTPRPHEESIQPVPDASNTPSQPTTSAEEMLRAQLLRLAGERGLTQPAASKPQVTAQREQGGMGAIRGTVIDTQSRQTLSDVVVTAIPSSREAEHVTVTDAKGEYLLPRLPSEAYTVRYEREGYKPHARRPIQIRSNRTLRVNAELLPDSLNESVEIVGHPPTIDVGSSTMGVNIDQEFIKRIPGSIQRSMSLTPPPGWRPPTFAPDSPVAVAGGYNLTFTSQHPETLLSNKGERSLPLVSESWPVQVERKIFPALSPNTYLVATLQGPSRNVFPGGDASLFVGADPAGTAMLTTIVPGESFTLPLGIDRAVRSARDVRLVESEKGFISKDEVGTYVVTRRFPIPTPAP

SEQ ID NO: 12107 - protein, 233 aa, Myxococcus xanthus
MTQNGSAHRNQVLLGVFQTEDYEVQALLRFPQTGVPAGAVVQSATLRFAVETYTSDFSIRGAYVQAPWNLGANGLGWQFRDDGLEWDRLGAAGQGTDLVAGSSFEVSTFPGTVSVHDVPLDVAVVQSWVDDPSTNQGVMLANSRIGKVAKVFTSLATQPERRPLLTIEYTAPAPRSDTTPPSVAITAPAAGATVQGVVGITVDASDDVGVVGVQLRIDGRNLDSTQLDTRLFL

SEQ ID NO: 12108 - protein, 356 aa, Myxococcus xanthus
DVVTGQLTGRTKGEVLAAIQERLGLSFDQFRRSALLAQGEFAAFLKADASERAELLERMTGTEVYSRLSMAAHEKNKAEQESLAKRAQGLAAIALMPEAERAAAAAALGEESRARQAVEALLKDAEGAAAWHVARAGLREAELAAEAKAKAATTALEEAAPRAARLEAVREAEAFRGPVAAADAAERRWAEAEAAQVARASEVEAALSEVSARRVGQLEAETARAAAQEREVATRPALEEAARLDARLDGVSREAGEARARAEKSQAALSEAKAELDAVLVREAEARDKGEAARHWLTEKAHWVALTSEWPRWHRELERYEGAQGERRKAGEESGRLLGEVEGLRETVGLQRRERD

SEQ ID NO: 12109 - protein, 414 aa, Myxococcus xanthus
MRLLHTSDWHLGHTLYDVSRDAEHAAFLDWLLETLEAQSVDALLVAGDIFDTANPSAEAQAAWYQFVAKARRRMPRLDVVVIGGNHDSAARLDAPDPLFAALGVHVVGGLPRARGAMDQERLLVPLHDAKGRVGAWVAAVPYLRPADLPPVPGDMGDRLVEGVRSVYAEVLAAARRRRQAGQALVAMGHCYMTGTELSALSERKILGGNQHALPVDLFPDDVAYAALGHLHKAQRVGGREGVRYSGSPLPLSLSEAGYRHQVLLVELEGDALREVQSLPVPRTTDMVRVPSRDAAPLDAVLTQLEGLPAHDADTLEWRRPYLEVCVSLPRPEPALRQKVEKVLEGKAARLVKLTPAYTGTGGALAEVQPGLSLKERTPEDVFRARYARDFEEPPALALLEAFHTLLTDVQEESP

SEQ ID NO: 12110 - protein, 876 aa, Myxococcus xanthus
MPFISNTLTQATGMAWAPDGSGRLFITLKTGEIRVVSLKDGQPETQPGNSTLVTQVFATEDSVYTGSECGLLGIAFDPNYVVNRYVYFFVTVSASEQQIVRYTDVEGTGRARTVVVSRLPTRGANNVGGAIGFGPDGKLYWAIGDLGNGTGVNADLTSMAAKVSRANPDGTPDSDNPFNDGVGPNNEYIWARGFRNPFTFTFQPTTGRLWVNSVGTDYEQVFVVTRRSHAGYSDYENNQPSTNDFITPVVKYRTNGSDTRGLSAGGAVRSSGVATFTTAGNHGFRKGERLTLSGVEDASFNGLLLVASVPSPTTFTVSQPSLPDAASSGGTATTQELGGSITGGTFYDATLFDEAYQDNFFFGDFNTGQLTRVTLEEDNSVATVDEWATGFTSQVDMSVGPDGALYTIGASGGVLRRITPETPGQKLVVSGLQPRVEEGGRAAFTVRLAEAPAFDVSVRVSRALGGSEDLSIVSGAALTFTASNWNVPQVVTLSAAVDEDETPEVATFMVVADGLQEVAVVATTIDNNSPRLVLTESQVTVVEGGTATFGVSLSQRPLRNVTVTVVRTRGDEDLTVQSGATLTFTTSDWNTPKDVTLAAAPDADAEDGTAIITVSAPGVDAREVEAFEQDTTLLPPAILSAPVTRAVVGSPYRYEVQATARPAPTYALVSTVPGMSIDAATGVITWEPTETGTVEVSVRVSNGAAPDAVQDFTITVSPDAPPTGILTRPEDGEHVSGTTAEFYGDCQDDVGCTHAELYVDDVLRYTDERTESPYYYGGEPSRWDTTGLTPGWHRVRFVVVDSTGQQGSAEATVCMGDAPCESPLLDAGTDAGTDAGTELPPPNEPGGCNCNTMPLAPLAWGSLAWLVLQRRRSRRS

SEQ ID NO: 12111 - protein, 165 aa, Myxococcus xanthus
MVVNHQSAADILAVMGLFRPYKFVAKASLFSLPLVGWMMTLLAYVPIVRGSSTAMNQLLDPCRRWLRRGMPVLIFPEGTYSKGGQLLPFKRGAFQLALEEHVPVVPVVVEGTPGLLDGDGPWMSPTASIRVRVLPALPPESFSPDSQALATQVRALFEQTLAKTG

SEQ ID NO: 12112 - protein, 537 aa, Myxococcus xanthus
MKDYEATRRDFRWERPEHFNFAADVIDRHAAERPEALALLWSDEAGQARRFTWEDLRRRSLHAARFLTEQGLRRGDRVFIMMPRVPEWWFLVLGCIRVGIVFMPGTPMLTPKDIRYRLEVAEAQAVIADVSCLERFDGLVGTAGKVRTWVSVGEGAPSPWGRYVSGVAEANAGAAFEPTRADAPLLIYFTSGTTGMPKMVLHTQASYGQGHVITGRYWLDLTPEDRHLTLSDTGWAKCAWGKLFGPWSQGACNVVYDFRGRFEPAKLLKVLETQKVTTFCAPPTAWRALVLQDLKAFDLSSLRHTVSAGEPLNPEVIDTWKDATGLHIHEGYGQTETVMIVGMFPSMAPRVGSMGKPSPGFTVSVIDDQGQEVADGQEGDIAVRVAPERPVGLFQGYLGDDAANAACRRGDWYVTGDRAVRDADGYFWFVGRADDVIKTSGYRVGPFEVESALLEHDAVAESAVIGVPDEKIGQRVKAFVVLAPGHTASPVLAQALQEHVKRTTAPYKYPREIEFVTELPKTVSGKIRRAELRTTRT

SEQ ID NO: 12113 - protein, 468 aa, Myxococcus xanthus
MTTPCTNLNLFVDGELSAPDAEVFRQHLGRCPECEAGLRELLQLELLASRALEGSASVAEPPPAKVTPLRPWMQRMSRTVVPVALAAGLAAVGVFRLQTQPEAPTDVWLAGADVRTLEARLSHPMADRFRPYEPMRGTSGAANPLPLRPLAELEEQQDFRGIAAAYALRGDWQQAESFLARAPASADRDNDRAVVALSGQRWEEALNLLGGALRQEPRHAQALWNRGLALRGLGLLKQAETSFRDVASLPGQAAGWTVAAEKRADEMRALRDAEAARWKRQVRETWTQLTEKTADAAYLVRQHPAVTRAALYEAVRTATSVDAVAALLPLASALDRLGEGTVLQDYVRDAASRDFKVRAPLAEDYAQLVKEGALVPGLLERLRVSQETDLYVGALLHTGEAARDAESLKALQRYAHGSRDPWLNLLAERERARSEEASGRAANAEHLLLATLRTCGAYNTLFPCAEIN

SEQ ID NO: 12114 - protein, 186 aa, Myxococcus xanthus
MSNLFNRDRRRFEAFIRQHRPSLLGLARRLCARSSLEPDDLVQETFERAMPEFEHLKDRTDSAAAAWLCTTMTNRFLDYCRRQRTESRGMPHLALVQDLAVSPEETQENWALVSTDAFQKAIERLKPHLRDAYRLHAEGKRYNAIAEHFNVPVGTVGSWLTLARRDLKELLLPQVAVAREQGATSS

SEQ ID NO: 12115 - protein, 914 aa, Myxococcus xanthus
MLKPAYDKVLVLALATPVLVLTVLLARTPSKGSGAPVSAQFWAERRSASRIEARLTHPEADRYRPRMSAGGCPVAPEPIPLRDLARLEEAGDLSGIASAYALQGEWNQAASFLERMPASPDRDSDLAAVYLARGSHEQALRLLDGVLKAQPKHAQAMWNRALVLQAMGLTMKAADTFEQVALMGEPGWSREAKANAREQRDATMERARRWKEAREATLALVDDPQAPLPLEAARKDPGIVRQAFYEVVRAAPSKERVLALLPLAQELDRGHGGSALTDYVKRVSGRNFTRRGVLSREYASLVRGKLNQPDKLLERVLASGEDDLFLGTAQHTRATRRMFSQVVERAKRQNDPWFNLYIEREEAIRETAEGQWWKAEQRIFNALQRCREGGLSTRCVDLELRLSILYADLQRLTEGEQHARTAWAWARQLREWDMEFTALEALAAITRSRGDFASSRAYVEEWSARGHVNCVWPRENLAHTYYLDNRMDDARREVDANAACKNEPLSLLFAVNLAELSRTRPKPGDEALLRQALTWANHSNPMPSDAVYARYVEGRFLLDSDRARGLALLRQTITEAEALPRGDSLAREAWALSYSSLVTDAGKAGEYTQALELMAAQLGTPVPQRCALAAAVHGERTVLVARGTQGQVLGHYETDRQGPFIRADTSRLVPDRLREVLRGCERVDVLAWPPVFGHTDLLPPEVPWSFRLGRTAQPRTTPTARRLVVSSVDAPALLQLPRLPQWLPSQEPEAVPLQVLSGSDATPARVLADMRDATEIEIHAHGIMDPALSDASLVVLSPETSGRYALTADVVRQQTLTGAPMVFLAACSAGRAASTTTSHEPFSLPAAFIDAGARAVLASTVDIPDAAGRFFDGVRRRIREGAAPAVALRDERQRWLERDSRAGWTRHVILVESY

SEQ ID NO: 12116 - protein, 169 aa, Myxococcus xanthus
MPRYERLRRLALRFPELDASAIETCITLLRASHDLSGAYEAHLGRHGLSMGRFMVLVRLFTTEDDDVERVRGLTPADLAESSGVSRATMTGLLDTLEKDALISREDHPEDRRMYTVRLTPKARQLIESVLPDHYRRIAALMAPLSEEERTTLRTLLAKVTSGLPLLKEP

SEQ ID NO: 12117 - protein, 29 aa, Myxococcus xanthus
RDFLEANKTTLGSDARFTWVDTDFLTKHK

SEQ ID NO: 12118 - protein, 254 aa, Myxococcus xanthus
MRTVYVAGHGPAVIVMAEMPGISPHVARFARWVRDAGFTVYMPSLFGRDGAYPRAEEGRAIMQRACVSAEFRAFAANESSPVTQWLRALARLAHEECGGPGVGAIGMCFTGNFALSMMLEPAMLAPVMCQPSLPLSDTGAIQLAPDELAAVKERLERDDLTVLAYRFEGDRFCTAQRFQAYTAALGKRFVPRVLPTSAANPTPPPFFAEVVGCAHSVVTAHLIDAEGEPTRAARDEILAFFAQRLGRAGAQSAT

SEQ ID NO: 12119 - protein, 406 aa, Myxococcus xanthus
MCGYAILRPIRNEMGTAGSVKGLDWLFTATFLVMLAAVPAFSALVSRWPRRVVIPRIYRFFLLNLLGFFVLLKLGVARETVARVFYVWLSVYNLFVVSIFWSFMADVFASGQSKRLFGFIAAGGTTGMLVGPFLVGRLAEPVGPVNLILISVVLLEVSAQCVRRLSGWAQDVQQQPAAAQGPVGGGVLAGLRLIVTSPFLLALGLQVLLYAATSTFLYFQEVRLVAALGSDAASRTALFGDIDFYVQLATLGLQTLVTGRVISWLGLGAGLAVAPVVTGLGFLGMAAMPVLTVLILFKAVRGASHYALERPSREVLFTTVDREARYKSKSFIDTVVYRGSDTVSAWLQGGLAKLGLGMTGLSLAAVPLAGLWLGVSLYLARHQRRQAEPVPAAAPEAPVSEEVAAR

SEQ ID NO: 12120 - protein, 413 aa, Myxococcus xanthus
MARGIVGSEILRIAAEIRERIAKGQKVCNLTVGDFNPREFPIPDPLREHITAALQAGETNYPPADGVLELRQAVQRFYERSLGLKYPLEGIVIAGGARPIIYGTYRSVLDAGETVVYPVPSWNNNHYAHMMDAKSAVVVTDAARGFMPTVEQLAPHLGAARLLCLCSPLNPTGTMIEPDALGAICERVVAENREREKQGRKPLILMYDQIYWVLSFGAARHVTPVSLVPEVAPYTVFVDGISKAFAATGVRVGWGVGPPTIIARMRDVLGHVGAWAPKAEQVAVARYLDDTAATETFLEGMRKSVEARLEALHKGFTRMREAGLPVQHIAPQGAIYLSVRFDLVGKGGLRSNNDIRKLLLEKANLGVVPFQAFGLDADTGWFRLSVGATSVKEIEEALPRVEAALREVLSSGA

SEQ ID NO: 12121 - protein, 135 aa, Myxococcus xanthus
MKRRPAQSVTLRSVRAGTHADFDRVVFEFDGPQVPGYQLQYVDKPIIQCGSGDETPLAGKGFLQVMLTPARGHDDQGRATVAALEMKPKLPTLLELVRTCDFEAEVTWVLGNKAPTDFRVMELRDPTRLVVDVKH

SEQ ID NO: 12122 - protein, 345 aa, Myxococcus xanthus
MDPEQYFEPDDAGTNAGSRNGPVLRFMNARMDKMLGEYDGLRLDHPHGLVCPWVYRADLPDALWSVQHGARLFSSPDLPDHPELAHFALVRPEQVDRAVPRYADRWVKDLTPEQVRRYSVLFDTVVEASRRNGRQVGDLLAEVLSTLPYPLERVLAQYGLGRFRVTQKADLHNPSDVYRSENVGLEDWVMVGNHDTKSLWRLVADWQWKGTLHAQAEYLAARLCPEPSEREAFARELSTSPGRLAQAKVADLFASRARNVMMFFTDLLGMPETYNAPGTVDERNWSLRVPQDWAREYRERLKGDAAVNLPAALAMALRAQGAPARARHQRLLEGLDTLARELRAG

SEQ ID NO: 12123 - protein, 878 aa, Myxococcus xanthus
MTVQLKPEALQAAGLSVAEVVAALQAQNLAAPVGRINAPLTEESIRLKGRLEKVEDFRTMVVASRNGRAIRLEQVADVFVGAEEPRTLALFNGAQAVGIDVLKARGYSTTEVADAVRERVHALQQRLPAGVKLEIVRDAGVRVENAVHNVQSALVEGALLTVLVVFVFLNSWRSTVITGLALPVSVLASFISVWAFGFTLNTMSLLGLTLAIGILIDDAIVVRENIVRHVEMGKDHYTASREGTSEIGLAVSATTFSIVAVFVPVAFMYGVAGQWFKPFALTIACAVLVSLFVSFSLDPMLSAYWPEPPRKQNPGFITRTLNRFNAWFDRQAERYKHVIAWALDHRLVMVLVAVGSLVGALVLQGTVGGAGFVPVSDRAEVELLVETPPGSSLEYTRRKVDEVTRTLRAHPEVDYTYATIGVPLALSAPGVDQALVYVRLKPKAERDMSQDALGVQFREEMKRIGGATVSVFTSGFGGAFKQLQYELRGPDQRVLTQLAQQVQKEVEQVAGAVDVGLSTRGQKPELEVELNRGLAGQLGVTVGQVAQVLRPAFAGLDVGDWVDPIGETRDVMVRLAPGARDNPNDLSQLPISVGAASGPPRLVPLGQVADIRQTLGPAQVTHLNRERVINVQANVQGRSLSEVGADIEKRLDGVKLPPGYMLTTGGESADQAEVFMRVFIALGMALMLMYLILVIQFGSFLDPLAILISLPLSLIGVVLALLITGDTLNLMSLIGIMLLMGIVAKNAILLIDFAKWSHEKGMPLREALIEAGRIRLRPIIMTTFALVAGMVPVAIGAGEGGDFRAPLGRAVIGGTLTSTLLTLLVIPTVYEILVDGRTWSTRMLRKLFRMKPPEQRPHVPGGGGGRGEPRPAPQARHD

SEQ ID NO: 12124 - protein, 378 aa, Myxococcus xanthus
MTLGQENVARAEVRQLRSGPGISGNLQARTAAAVRAEVGGTILDIKAQQGQVVKKGEELARIEDVTLKDQLIAASAAVRTARSALQVAEAEQERATRLSKAGVITQRDFERAELSVEQAKGQLAEARSRHALAQEQLNRARVVAPFAGVVSERQASAGDVVQPSAPLFTVVDPRTLRLEASVPAAQLEQVKVDTPVEFHVTGYGDRAFRGTVERINPVVDPATGQVRIYVAIPNTDLQLLAGLFAEGRVASKGTQAVAIPIDAIDDTGTEPAVLRIQEGRAQRVNVRLGLRDEVARQVEVRSGLEDGDVVLLGAARSEVAEGGRVKVSSPRPDSKPVEEAGPGVGGSEAPPPPSSGARQPTPRPASTQPPAEDAAPSH

SEQ ID NO: 12125 - protein, 320 aa, Myxococcus xanthus
MGAWKQTVAALVSAVSMVGCAGNVMEAEPVALRSGVAELVAPNGRNLNGRNLNGRNLNTPELGQLLVSVDLAGARIAEEVLGEVRLEGSVFHGVASSGPVSGQSFLGARFIGNLSSGDTVELRVDGIEPGAGADADVWAYLVSYYDAADALWKPACAAADGSALSAIPVAGRWDYRQGVAGGGAKVDDAARFTFACEGAAIAKCVRFGYRPWGTTADGLSLADHHQACTRMVRADFCGDGTSHTTDGQWVNLHDGVNVQTDTEAWLHEAEWDADGARCFTQTTRAAQAVSCPGQTQLTQCGKWAHFQAGTLIMSEVPPAQ

SEQ ID NO: 12126 - protein, 1053 aa, Myxococcus xanthus
MSPEAWAGEALTARSDVYSLGVVLYELCAGKGPFRDVPWRELPAQVRHRDASPLAQVVSGVDAGLAAVIDKCLRREPSERYATASQLLDALDALTRDDTVQAVPEGNPYRGLQAFEAEHRAVFFGRRREQRAVLERMRSEPFLLITGDSGVGKSSLCLAGLLPAVTEGGLEDGRRWRSVRLVPGRRPLAALVAALAPVLETEEETLAETLRAEPTSLVRRLRVKLGAQEGLLVYVDQLEELVTLAPPAEAELAGQALGALAEGASGVRLLATGRSDFLTRLSAVPGLGAEVPRALYLLRALSPEETRDAVTGPARVKGVRFESDALVDALVTSTLSAAEGGLPVLQFALAEMWDARDAAAGVMTQAVLDSLGGVEGALARHADAAVARLLPDQRVAARGVLLRLVTVDGTRARKTDRELVGDDARYRAALEALVHARLLVAREAQEGTSYELAHEALLSGWGTLARWLAEASERREVQSRLEAAAAHWEKLGFPSESLWGPRQLEETQVLDTGELTRRERDFLKASRRTMVRSRRTRHALVVGFVVSLGLVYGGLKLRERWSLDRQVREELGQAAQALSAVRQDWGTLRAERDEAFRLYGTGRRADADRHWNRAGAQAGQLRGRFDEVAGRLERALALAPGRADVREALADFLYERALWAEQDEDTAALPALLQRLRLYDTAGTRWRRWNAAASLTLETPVSGAEVELRPLTRDAQGRFQLGEPLQADPGRWLDAAVAPGTYQISARSLGYEPVVQWVLLRRGESRRLGVPLPRMGSVPEGFVFVPPGEVKFGSAAEASVREFFNAVPLHPVEVPAFLMARHEVTYAEWLAYVESLPPAQRAQRLPRVGTGGYAGLLTLGQVDGVWRLRFQPGNEPYMARAGAPLRYAHRTSRAEQDWLRFPVSGITFADADAYAAWLSESGRVPGARLCSELEWERAARGVDGREYPHGDTLGPDDANIDTTYGKQPGGFGPDEVGSHPASRSPFGVDDMSGNVWEWTRSWLEPGKAVARGGSFAFAATSARASNRELPEPSLRDVTVGMRVCADVAANAHP

SEQ ID NO: 12127 - protein, 141 aa, Myxococcus xanthus
MPTAKEPAPGGNKKRVLVVDDFDDAREMYAEYLEFVGFEVDTARNGVEAVEKASEGEPDIILMDLSLPVMDGWEATRRIKQDSRTRDIPVMALTGHVLAGNAEHARDAGADEFVAKPCLPQDLENKIRNMLKPSKGKVRGG

SEQ ID NO: 12128 - protein, 31 aa, Myxococcus xanthus
MTGPEQWVLARIEESAGTPSRRHLYVYRPNN

SEQ ID NO: 12129 - protein, 332 aa, Myxococcus xanthus
MDLARELTDFLGAVEQRLGSTLVDGDAGPDVKGDTLMEAARHLCLGSGSKRARPMLARLFGGAVGVPAERLVDVAVAAELIHSASLLHDDVVDAGMFRRGRPTVNARWGNIVAVMSGDLILSTGLFQLSQLDARLTRSALSVVSEMTRAAIAEVEARGDLDLPLNRLRFIAEGKTGSLFGWCGNAAATLAEHPEAVERFDGFGRHLGVAFQIADDIRDILGTDVGKPRYADVHSRTPSMPILLAVAKDESLRRKLKDAWAFSAITPDRTKEIGAAIEATGAVDASMARMNVEIEAALDKLGHFAKEPAGAELVSWARKLSAGIAEQVQGRAA

SEQ ID NO: 12130 - protein, 547 aa, Myxococcus xanthus
MKKHLVMAVVPFLAFGCGDDLVDADGDGIADGVREPDTVTVVTPANPKGTVSGQVLSTDLRPLTEVTVEMTIGSSAEPVSTVSDAKGNFTYKNVPAGSHVLLTFSKAGYATLRATAQVPSSAGNVPINNGNASFGPITLARLDGTLNFLVVTPQGRPAAGARATLEATPAGAISNGDESSSMVSSVVVEATANEQGLLTFTGIPSASELARLRNGNGEYRLWVSPIDANGDGVPETGGYVNTYYGAEVVANSTTRLISLPYSRPQNVPLSIESSNVASLRGAAVDMHPLRNLVRPGELIHLYFNQPIQQGSLLVRMTNEDARESLGVTATVNNGGYSATVNPGSTVEGKEYNLDVRAVSAEGGSLFNSQGFFFAGEPRGPQNPTAIVEARYHETSLALPASGQLNFGERVYVYFAHPIANKIANGYRVQVFFNIDLNNSGKLGDAQGEKGNLMGFDLIDDEPTLPLHTTTPAETAVFPIIKSGYSSRFYFSYPGPDNPNLLGTEISVGFSKLGSRGAIGTYENIWGQPLTSDIAITGIGVHPAPPLP

SEQ ID NO: 12131 - protein, 72 aa, Myxococcus xanthus
MRAQREVLGAEHAYAFAIGDVLRHFHLHLVPRYSQTPQRLWGRAAFDAPASDHLPAQELEAAAQALAAALAG

SEQ ID NO: 12132 - protein, 41 aa, Myxococcus xanthus
LERLYAALASGPSLNSRPHNSRQRVDLPTLNRLDGTAPHTF

SEQ ID NO: 12133 - protein, 321 aa, Myxococcus xanthus
MTHKRLKRIGMVGGGAMGCGIALELAIAGRQVVLYNTRADSSERARAKLERDASLLVETGLLAPEQAPAAIGRIRRTTVLAEAAVEQDLVIESIPEDLALKQQLFRELDQLAAPDTLLATNTTALSVTAIARDCTRPERVLSAHYYLPAHLIPLVDIIPGEKTSPDAVETVRRFIEELGKSPVVFSRDVPGSVGPRLQQALIGEAIRLVHEGVATPEMVDRVLTQGVGRRLGASGVFDRLDLVGLDFMTALLRGTGRPVPPVLAQKVERGELGQKTGQGFYSWTPESTAAYEERMARHLATQLREDRAAGRLRTPMAELAE

SEQ ID NO: 12134 - protein, 196 aa, Myxococcus xanthus
MRTETVLLDSAVLSDFLVDAIREYTTCTPELPPRSWAVLLGRVASDAMRVERVRFATNVRETDERVLQEFDTTIIPRFGACYANGRRGFWCEPRELLRITTEAEAQGLEVLGSIHLHPDWHRIGPPHERGLRVSQEPTPMDRHLFQGSGWPLNMILYLERREGRLYHSVGAWAPPDGQEVGAGCRALAIRMETPER

SEQ ID NO: 12135 - protein, 501 aa, Myxococcus xanthus
MIGLEVRARIRQLHYAEGWPVGTIATQLGLHHDTVEAALEDAPVASADRSTAKPTVLGPYTDFIDVTLKAHPRLRATRLFHMVKARGYLGGYEQVKRYVRRVRPGPQAEAFLRRNTLPGEEAQVDWGSFGKVRVGRATRTLSCFVLVLGHSRAMYARFFLGQTMECFLQGHVQAFEALGGVPRNLLYDNLKSVVLQRAGDVIHFHPRILEAAGHYHFVPKPCAPYRGNEKGKVERTIRYLRDSFFSARTFHSLDDVNRQLQRWVEEVAHQRRVPGDASGRTVAQALEAERSLLLPLPAHPLPTDVVRPAASGKTPYVRFDGNDYSIPEGLVRRPLTLVASSTTVRLLDGAVEAASHVRSWDKGAVVEDASHLAALARRKAHAHELRGRDLLRARCPHAEQLLQALTSRGDNLGNHTVKLLALADRYGSAETDAAIAETLARGALGPAAVAHVLDQRSRKRGAPPPLPLVLPDDPRVREQRVPQHSLNPYDALLGRDTEQVP

SEQ ID NO: 12136 - protein, 142 aa, Myxococcus xanthus
MIAQNIAYNAVQAGHPVLFTTASQLLLDLGSQDSARALDRRLKHYCTQAGLLVIDEIGYLSYDARNADLLFQVVSRRYEKKPIVLTTNLPFSEWTTIFPNAACAIALIDRVIHHASIISIEGDSYRRRMAEESRAERKARKS

SEQ ID NO: 12137 - protein, 401 aa, Myxococcus xanthus
MNAAAVQRLERYFQQIGEVLGEESRRGSFALYAMGLLGEGERKSVEPIAARACPDPERVDAMHQRLLHFAVDSRWSDRDVRRQAARYALEAMTRREPVEAWIVDDTGFLKQGKHSVGVQRQYTGSAGKVANCQIGVSLSVATRTEHLPLDFELYLPECWTNDAARRREARIPDDVPFKTKPQLALQMIERAVQDGAPPGVILGDTAYGTSSQFRAHLRALGLHYAVAVDPQTTVSVLDAQGRPRGNVRSVSALALHIHERGGFRRCTWRQGPQRDLSARFALRRVVAAGVPQREQEPLWLLIEWRDGEAEPANSFLVSLPGFRTKKQLIRLVMQRWRTERVYEELKGELGLDHYEGRRFPGWHHHVSVALCCYAFIVAERVRRFPPSARGAAEAYAQPLSA

SEQ ID NO: 12138 - protein, 231 aa, Myxococcus xanthus
MNIGIIGAGSIGATLARHLNALGHEISLANSRGVEGVTTIAASVGAKPVTVRHAAHAGPIVIVTIPQKAITDLPPGLFDDVPADVVVVDTGNYYPEFRDGHIGAIDAGQTDSEWVSAQLKRPVVKAFNNIQAGSLDTKGLPRGAPGRIALPVSGDDPRARQQILQLVDALGFDAIDAGPLSESWRQQPGTAVYCTDLDAEKLPKALAAADATKVAEVRRQNDLSVKAMFSR

SEQ ID NO: 12139 - protein, 198 aa, Myxococcus xanthus
MKGYLWTGGPGSPASEAPPADGRLAPWEAIAVDAVGNVIEFWGFKRNQGRVWALLYLRGEPLTAGEIERELDLSKGGVSMLLRDLERWGVIQRVRLPQDTVWRYGAENDLVRMVTHVIEEREAGFVARIRADLAEARRLAETQSGLPPDRLQRLEKMATLAEHVERALRLFIKTSRLDVSGVLSVFRDEATGARRGSK

SEQ ID NO: 12140 - protein, 61 aa, Myxococcus xanthus
MLTALQVALTAAGGFTIIRRILFGSAAIARAELAGAIAAGQVAEKAAAIAVLEQLDTRGDK

SEQ ID NO: 12141 - protein, 911 aa, Myxococcus xanthus
MQALLTDNGTGVVLHTPVSPGWRLRQYAQKKASVLDAVRDLAQQIGWEVRYRWRESSGTFALTFTEPNRTNPPLAWTFGPDDYRDVTKLAVSRTDVRNRVEVVFSDTGDLDVAGHAKTKSVVVEDAASQAAYGVRYMQIAEGASSNINSEVEARRMAEAALSDLCEPLADQEIDLDFFLPVELGDLFRFHPNGVHYSDAQNLAVTGFRHVFTAEGDARTTPTTRGKPSFGVSMWLEMDTRPGLGEPAHTSPPLVPLNINVTAVVNGFSLSLAPAASGPVASGYELHVSTSSGFTPSSSTLRGTFDTTAFGVSDLMPGATYFVRVVPRDSFGNRGNASPQLSVTPKQLEGASLSDAAVGFQHLLYPPTDNLIPNGYNEAGIRAVGKSPDGDRLVEDPVNARVGRWVRRVELTNTGAWPGLSWTGGYGSAVPGGRLKCSPGDEFFAEVYVKASSVTVGGMGTLHLLWEDGSGAYAGQGTSVFLGQVGTTYRRVTVKGMCPAGCTGVQLFWETQVAAADVGKRLYFDAVSMRKMVTFDLLAANTLKTSNYAEDGSGIPTAGAKLDNVGTTLKVASNNVQVGRYYLSDGFFRSVQALADTGSRIYYRGNNEGVPNIDRLNIQVLEGYAIAGAAGGAASFTWAHYHAVIQPQVVSDNLDALRFMEVGFYWAYSDSNAPQWLYGTSVPLADRKYQNGAVDGDASNATRAGFTFMYGDRFNRLRDAMANRLLYLKVRLHNASGYSAERWFFPPSSYNVNMLRSATGPASTPTGSGGGGGGTHGTCVAPWELVLLGDGSEVPAEMLRPGMRVLTMHEHERDGGIFEVTHVRRHQAARCTLTMTDGRVLVVTPDHRWRTFERGWTRTDALRPGETIDGVAPGRVARVEPMDFGDVMRITVRFAMTYIVQGLLAHNLKPRD

SEQ ID NO: 12142 - protein, 253 aa, Myxococcus xanthus
MLVEQTLEKLNGMKLHGMASYLRDWLARPGERDVGPADLVGLLADAEWMHRENKKLSSRLSAARLRQAAALEDIDYGHARGLAKTQVMELSTSKWAADKQNVLLTGPTGVGKSFLACALGQKACRDGYSVVYRRASRLFDELAQARADGTYAHVLKRLAKAQVLILDDFGLEPLGAPERKELLEVLEDRYQLASTVVTSQLEPKDWHAVIGDATLADAILDRLVHNAHRIKLGGESIRYVETNLTKGRKQAKG

SEQ ID NO: 12143 - protein, 378 aa, Myxococcus xanthus
MRQEHRAGEKLFVDFSGDGVEVVERDTGEVRVAKLFVATLGASSYTYVEPVYSEDLATWVGCHVRAMAFFGGTPALVVPDNLKSGVTHVHRYEPEENPTYADLARHYGFAILPARPRRPRDKAKVEAAVLVAQRWILAVLRNHRFGGLHEVREAVRPLLEKLNGRPMRHVGRSRRQLYEELEKPVLKALPVHAYELAFWKKARVHPDYHVEVEGHLYSVPYSLAHKQVEARYTEGSVEVFLGGRRVASHVRKHAKGYTTLKEHMPASHRAHAEWTPTRLLTWAEKTGPSTAALVQGLMERKPHPEQGFRGALGVMRLKDKYGEARLEKACARAVRHRAYSYKSVAAILQHHLEDAREEREEKPPLPAHENVRGPHYYH

SEQ ID NO: 12144 - protein, 129 aa, Myxococcus xanthus
MTKADIIEGVYEKVGFSKKESAEIVELVFDTLKETLERGDKIKISGFGNFQVRQKKARVGRNPQTGKEIEISARRVLTFRPSQVLKSALNGEAPPEDHAEIDAREEAAADAAEARGEDFDEEGMEDMEG

SEQ ID NO: 12145 - protein, 107 aa, Myxococcus xanthus
DTYRFKWTCKDCFTKELAKASPANASALERLRTRWWREAKGDEDLGKPRLESLLGGFEGLEGLEALQSLPGMDLEALQGMQGFEAFQEIDAQSKELLEQLIPGLMGE

SEQ ID NO: 12146 - protein, 310 aa, Myxococcus xanthus
ARAKVEAEAARTLAQGLDKTRNQGFMARLNGLFGQQRQVDESVLAELEEILFTADIGVRTANHLVEVAREKLKRNELKDPERIKGLIRDEVARICDLPVPRSLEGGGPPHVIMVVGVNGAGKTTTIGKLASKLTSEGKKVVLAAGDTFRAAATEQLDVWAERAQAQLVKGAEGGDPSAVIFEAVKKAKEEGADVIIADTAGRLHTKAPLMEELKKVKRVMDKALPGAPHEVLLVLDSTNGQNAIQQAKQFHEAVGVSAIALTKLDGTAKGGVVIGICDELKLPVVWVGVGEKVADLRRFEPREFVRALFD

SEQ ID NO: 12147 - protein, 285 aa, Myxococcus xanthus
MAVVGCGLMGSALARAFASAGHDVAVWNRTPGKASAVGGGTRAFDSLVEAVSGRELVVVSLSNYAAAAEVLSERGVAAALTGTTLVQLTSGSPADAREGLAWAQAHGVDYLDAAILAYPSFVATEYATVYYAGARGIFDRHVETLQAIAKNSVYVDEKIGAAATLDCAILEAYYGGSLAFLHAAAMCKAEGLDPKALFAQKNSFLGLISVTADAAQDMIEKNGFSGDQCSLNTHVAAIEHIVRLSQDARISARFPKELLDNYKRAVSAGLGDQELPAVFRTLTQD

SEQ ID NO: 12148 - protein, 281 aa, Myxococcus xanthus
MGLGMPDTGVELWVSDGSASGTRLVKDINPGAASSFPRSLTQAEGVLYFSADDAVHGRELWRSDGTAKGTELVEDTVPGPQGSEAQIFALFKERLYFATFTPGFTVTEIRKLDPDPSCHPRSNLVASIPNPYADLPFDFFIFVATSTATERKLYFTLFYDIGSPAPFDVQLWRTDATAQGTKLLYQPLIVSPDLRPPTPVPTDDGRVVFYAFDEAHGHELWVSNGQPSGTKLLQDIVPGPASSYPQDLLRAGDFIYFTALDGQLGREIWVLPVPKPQVASH

SEQ ID NO: 12149 - protein, 116 aa, Myxococcus xanthus
MANPVRFAFTQTAQPNLEFIVELSDEKTISHARKILSGEEKNEVHVHGRIIKRAAAYNPRFSFHLDPNTIRFFAMAIEVCDANMTYVEDHLDEAGGAFLPGGHWCPWDSKLTREIT

SEQ ID NO: 12150 - protein, 173 aa, Myxococcus xanthus
MDSHYDQVMKARAGADPSATRLYFAYSTILDRAAFEEWRSQHSYDFFELPEGRLAEAVDVDLVYDFPSRWWGGRVAGLTDSAGQKVYGRLFEIRGQDWPIIQHKEGFVTSMCVERPVRVRVDGQELEATAFVTNPRRTSADGPVSTRFVDALVRGAQAAGLPAAYVERLKRGE

SEQ ID NO: 12151 - protein, 109 aa, Myxococcus xanthus
MSSNESVLVTAATGRQGGATARALLAEGGTRVRVMVRNPKAPNAKALAAAGAEVVVGDFDEPASLRAACAGARAVFSMQSPLISTTGVDYSKELQQGRNLVEALLAECV

SEQ ID NO: 12152 - protein, 34 aa, Myxococcus xanthus
MNVAPVLARPEIARSYGLSPMSFETWARQRREMA

SEQ ID NO: 12153 - protein, 404 aa, Myxococcus xanthus
MDFQARLEALTHQLRPWSPLWSRSILQGWPGSGAAYPQDWLAYARSLDEAGEQRLDQGALAGVPPPALCALLGALQELTALPWHEGIHALTVAETQGLSAKKTHELERVLALLAPRTRFIHQAVDIGGGMGHLARLCARTFGWTFHSIDRDAALQDKGRRWLTRTHPRGGDTVCFIQASVEDGLQPQLDPLFSGRDRASIGLHTCGPLALTQLRKSQGAGFVVNIGCCYDKLEVPRDYPVSRFGSEHPLPFTPHALALTTRGRHHKTEVEFARMKRVYAWRFAFDLLSRRHFPERGFVRAGDAPRALYAERFAVYARDRLERLGLDPGMTDAELNAFEVSVRAETRDLLLCHLLRDRFARALEVVLLLDRALLLEESGFQVELLQLFDPRLSPRNLALIASRSA

SEQ ID NO: 12154 - protein, 153 aa, Myxococcus xanthus
  unsure (1)..(153): unsure at all Xaa locations
MSPLSFGGQTFFPQHSQDGFVVAITRANEERWAKQLGCEVLDISMDHRDDLVIVXRYEDGDDLGLGPLCGVPGSDTNLFAAKYDRVDGHPRWTRGFPMAHPPDVSTAIDRYRVSVDEAGASVFLGGLIAPLDVGPKTLVPSGVRDLFLLGLKP

SEQ ID NO: 12155 - protein, 573 aa, Myxococcus xanthus
MTNRHVAELFTLGLGMRGLRFQPGLDNVQVDFKRERGSSASAPFRVRRVLMIHPYWDMALMEVEGVDGLRPLTLDSRHVDEVREQDVVVIGYPAQDPRNDAALQHRIFRGVYQVKRLQPGKIMGARRTSSFGRMVEALAHDSSTLGGNSGSAILDARSGKVLGLHFGGRYLEANYAVSAHDLSRDSRVVDAGVLFTKTNVGGQLPWANAWKDNEGPPAMPPSPLPPSPVLFVPAPSGESLALTIPLHITLRLGVPALAGNGQTALVPGPAVPPPVPSQLWGGVGAGAPGLTQVDVAAAVAEAQRTRDLPYYDAEADALDRERYYAGVQPDSDQDAFYDGLHGLLERTHTVRPSYDPSRWLYPWVDRQKDLLLRSLYSAAGHSFTLQEILQKDLEVERERALRLLERPLTESLDEGFLEQLESALPYNCEHVVPQSWFKAREPMRGDLHHLFACEMRCNSFRSNNAYFEFPSTEAFQEDCGRAEQNRFEPGAGKGAAARATLYFLVRYPNAINSPAELAEERLETLLRWHQQELPSEWELHRNQAIFSIQKNRNPFIDFPEWAARVRFARGLGR

SEQ ID NO: 12156 - protein, 145 aa, Myxococcus xanthus
MAGARLETLPSAPRILEPHGATRFVLYRKDRVHFQEGTSHLQELRLTPEAKTRRVVATCCNTPVFLEFENGHWLSLYGGLWPEGTLPRLEMRTMASDLPPGVVLPEDVPNGKTQPFPFFVKLLGAWIMMGFRSPKLTFIHGTLHF

SEQ ID NO: 12157 - protein, 372 aa, Myxococcus xanthus
MSTRIIDSLAKYHLLGQTGLRVSPLALGTMNFGTDWGWGITSEDAHRLLTRYLEAGGNFIDTADAYTSGSSERIIGDYFAKHGGRERAVIATKFSANLSPGDPNAGGNSRKHIYAALEGSLRRLKMSYVDVYWLHVWDGLTPVEEVMGTLTGLVREGKVRYIGFSDVPAWYFARAQTLAERNHWEKVAALQLEYSLAERNVEREHLPAALAMGAALTPWSPLAGGLLTGRYTRDGNQPKGDGRAHALLASGNPVADKFLQERPWAIVEELVAVAKEVERSPAQVALNWVATRPAVVSTIIGASRLEQLEDNLHALDFKLPHELSARLDAASRPELFNPYVFFENPFFTKGMLAGNTTVSAEPSGFRGPLQPR

SEQ ID NO: 12158 - protein, 126 aa, Myxococcus xanthus
MTFVEGIAAIVNPALAVPPLTPIPDLEPQVTARLTTLLEQARAGTMEPVEFAYAPWWFWGQAVPFYQQLLQSLAPAGPLVLVKREVVGDDRLYTYLVQFGPKTLRYRVSLIPDGRVSAFRLNEHIP

SEQ ID NO: 12159 - protein, 341 aa, Myxococcus xanthus
MSTTSNRQWVLKTRPREAVSEDCFEWREGPVPTPGPGEALVRVTWLAIEPTQRTWLNANATYIQPVALGEVMRGAGVGLVIASRTERLAVGDWVAGLTGWQDYVLTGDAGLFGLNKVPDGVAPKAMLNLYGASGLTAYFGITEVGRVAPGETVLVSAAAGSVGSIAGQVARLRGCRVIGIAGGPHKAEWVTRTARFDACIDYKSEDIRARLRALAPQGVDVVFDNVGGHVLEAALDHLARGARVVLSGSVASGYKDGDYGTAPRNYMQLGFKRARMEGFIFLDYVSRFPEAFRELAAWDAQGALHCAESIAEGLEQAPSALRGLFEGRNVGKQLVRVTSIP

SEQ ID NO: 12160 - protein, 197 aa, Myxococcus xanthus
MPTTSTTWTAFAGQRLIASGPPADVILAARRALDTGESAPLLLFDDTTGRTVDFHLRGSREELLARLQPAPAPTEEDTGPRSPGRPKLGVVAREVTLLPRHWEWLASQPGGASVALRKLVEAARASSGDTDRHRQAQVAADRFMTTMAGNLPGYEKAARALYAGHRARFNQWTRSWPDDLRNHARRLAAPAFGKVTP

SEQ ID NO: 12161 - protein, 623 aa, Myxococcus xanthus
MVEFDESNGLVRSLTNPVGALSDPRSGDPMAIGLDFVQKHRDALGLGLNDLANLEVTDRVYSKVSGTTNLYLRQTYRGLPVYNGQLQINVDRDGRVLSVHSDFLPALESSLAGTTPRLSAADAVVGVAKHLGVRLSAAPQSLKAEPGARQRTRVAVEGLSTEPIDAELAVLPVRRGEARLVWRFQVHTLDTDHAYDVTVDASTGEVWTRFDWVAADDAYRVYPMPVESPNHTTPLPPADGRVLVSNPANATASPYGWHDTNGAAGAEYTTLRGNNVHAYEDTNNDGLPPAVQPDCTSLIHCDFPITLTGAPSTYIPAAVTNLFYWNNIIHDVQYQYGFDEASGNFQVNNYGRGGAGNDDVRAEAQDGGGMNNANFMTPPDGQRPRMQMYRWNTVTPNKDGDLDAGIIVHEYGHGISNRLVGGPSNVSCLSNRQQPGEGISDFLSLFYTAKATDTGAQGRGVGTYALNQPTTGVGIRPQRYSTSSAVNTWTYASINGMAVPHGVGAVFAQGMWEAYWALVNHHGFSANLYDATGTAGNQRMMLYFTQGLKNTPCSPTFTQVRDGIITAATTLHGGEDVCRLWTAFAAFGMGTNAVSSGSGGTTPTNGFAVPAACAAFSATAAKL

SEQ ID NO: 12162 - protein, 303 aa, Myxococcus xanthus
MRLIESGQIRLTDRVFGRGGLLGETFGAQGTYADSRVLNITVQHLLEHTAGAWDNDGADGTGDPMFMNTGMTHAQLIQWVLQNVPLEFAPGTTYQYSNFGYSVLGRIIERVTGMTYDAYMRANVFTPSGATSFAVGGDTLSARLPNEPVYYQLGTGAFSPYGMPVRRMDAHGGWVVTPIDLLRVPVRADGFSTVPDLLSASSLTTMTTRTTALDTLGNSVNYAKGWSVNSLPNWWHGGYIPGTRALLVRTDDRYGPSRSEEFTWSVMTNSNNSSGSGTPDINLDSLMWNVVNGVSAWPAHDLF

SEQ ID NO: 12163 - protein, 610 aa, Myxococcus xanthus
MTAAGQSALNVPGLDTVVIDDMRFTNLVERGRNVLTRVHLGNNELLQMAGRVHGRVEGGRVFILSDRPLHFASLRPTEPEFQLAGEPERVALTAAALGVRADELDLPVPLDRNAYRRALAKLQARGIVDAEGRLSDYGRAVEALPVERPWAELIVNAEEALLPLLAVCSSVESLHRMTREERNLDGLLVPGSDHLTAYNLYAEAFREAGTVGEVQGLPRHVFHAEKLAAWAEVRGVLVKALEDAALAMASVYRSVGLALPARMPFADPRAHRRFCDLLARFMPFDLVIDERTAWGEVARVSKTSVCGNLGAVAGTLRYFADRNGDSQAGIEGTQLPQSLLRRYARRHAAAPVYDVRFRSVVLEKRVDYFGFELEREVEVLRAWGPELAKAARHALAEALAQGEAPHPAVDRHRVAIAEVRELWRRSGGTTAPLGLSELTALYEAQLDGVDTLDDFKERPLRLELDALVPPEMRQALLALPDTVEVREQAVPLEYDVERLSDGAPRGVVRLHLPEKLARTLVEEELPLLDRPLRFSVARGRRGVLEARSLLELQELLDRPWMPDEIAEATRERSLPRQDRERGAPRPGEYRGHHGKAPRNGRRPGGGGRRR

SEQ ID NO: 12164 - protein, 30 aa, Myxococcus xanthus
MLANAIAVANEDDPLTASRVLRLALTGIRP

SEQ ID NO: 12165 - protein, 294 aa, Myxococcus xanthus
MMVTLAGAMSTAELGISLAEMIRRDKVHAITTTGANLEEDVFNLVAQEHYVRVPDPRSLTAEQEAELRDKGLNRVADTCIPEEEAMRKVERPLLELWQRAERDGRRHFPHEYLYELLLSGALAGSYQVDPRHSWLLAAAEKRLPIFVPGWEDSTLGNVFVASVMRKELETWSPIRGGAEYMAALADWYRETSSSAKVGFFQIGGGIAGDFPICVVPMLRLDLEEEVPYWSYFCQISDSTPSFGSYSGAPPNEKITWHKVDVDTPRFVIESDATIVAPLVFSYVLDCWGVRQQKS

SEQ ID NO: 12166 - protein, 76 aa, Myxococcus xanthus
MDHVWRELKLHISANRQYPSVGAQVEAAVLWVLSLTPTRAIRKVGILAEAASSTARRRRWARATASRESSSYSPRS

SEQ ID NO: 12167 - protein, 168 aa, Myxococcus xanthus
TRSAEAALLEDRLDVALCCYPVSTPGLVSTPLFRDELVAVLPAGHPLAARPYVSGPDLTEQAVYFYPLPAEDEERFRRELLPRRPDALRVRTLPLTEAMVELVRSGHGVSLIARWSLGPHLAQGGLVTRGLGRKGYWRQWSAVHKRHSPLAPALATLVDLLRSAVLSA

SEQ ID NO: 12168 - protein, 186 aa, Myxococcus xanthus
MEAAIGALSELGWAGATMTVIAERAGVSRGACQHHFPTRADLVAAAVEYVGHQQVEAVLRKAAQLPADARRTEAILHMLAGIYLSPVFTAAVQLWVAAVADAELRAQLAPLEARVGREFHRLTVQLLGVDDSVAEVRELIQGTLDLIRGLALANLLRDDSARRKKVLHRWALTLDEALSARRTRRG

SEQ ID NO: 12169 - protein, 292 aa, Myxococcus xanthus
MGYRSLFAPGCFSNRTIVVTGGGSGIGRCTAHELAALGANVVLVGRKPDKLEAVAREIQEDGGKVSFEVLDIRDEEGVKATVARIIAAHGPIHGLVNNAGGQFPSPLSAISKKGFDAVVSTNLTGGFLMAREVYLQSMSSHGGSIVNMLADSWGGMPGMGHSGAARMGMLNLTQTAAVEWAASGVRVNAVAPGWVASSGMDSYKDEGVRAMIPLLKKEVPLQRLATESEVSAAIVFLLTDAAAFITGDVIKIDGGASCNTKIFPLEETTASKPYEGFHRASAPRILGGESKE

SEQ ID NO: 12170 - protein, 333 aa, Myxococcus xanthus
MQTRQKLAVLVIHGIEVDDPGLYDTAVRLLRQHFAQHAGAGPDTLAVETVNWASVLEGAEKDLLARYAPADADTYWKSLYDSVRTVNQGHESALVPMMLRLMRPSLRGMDLRYPGLRWMLVHFVGDIIAYQTNPADPDVYTGIHRKVAEALGRLRQQAGDTAPLCVIAHSLGSVIASNYFYDLQAQRLAGRDIIEETVRAAQGSSPLERGETLSHFYTLGSPMALWSLRYPHAELDQPVQVPAPELARHHPGLRGRWLNFHDEDDVFAWPLQALSAAYHAAVEDRAVSVAGPLFSWTPLVHPFYWSDDAVMRDIGTSLAGAWVQLSSAAAVAS

SEQ ID NO: 12171 - protein, 150 aa, Myxococcus xanthus
MSDDFTLPEDKAERMERCAIFYTDVVPHNHALGLRLVDIRAAEATVELPYAENLVGNPETGVIAGGAVTTLIDATCGTAVFLRLGRFAPLVTLDLRIDYLRPARPGIVLTCVAECYRLTRQVAFVRAFVHQGDPGHPVASAQGTFMRTEE

SEQ ID NO: 12172 - protein, 426 aa, Myxococcus xanthus
MFSEVFTACAGATVLTAWAIALKLGPFLVGVMTALPFFAQFVQFPAAWLTGLFGHRRVALTAVCLSRVVMFPLAVLPWLGLPFESQQRLLLTVAGVSAALSVVGNNAWVAWMGELVPRAVRGRFFGRRTALTTLAGTLASLGAGLLMDRLRPTDGVGVALPLLALGACVMGIVTTLFMASQHDPAPPGTTPPLDLKGALVPFKDDNARRVLTYQVAWNAAVGVSAPFFALHSLQNLQMTFVIMALHAASVAGVRILAAPLWGRVIDRCGAQPVLMACSLGIAAIPALWLLPSAGTLWPLLFDVVLAGALWSGHGLAIFELPLTVAPRKNRPFYLAAFATAGGLAYTAAAALGGAIAAALPTQFTLGGHVWVNLHALFVLSSVARLGAALLTARIPEPGAHPVRSVRALLSRLLPRPIPAHRAALDD

SEQ ID NO: 12173 - protein, 154 aa, Myxococcus xanthus
MTTMSESTTPPLAELVRQVRKTREYKRLTDAIPYTRFMGIGVENLAGEMLCRMAFNPRNIGNSLIPALHGGTLGALLESAAVFELLLQTNTERVPKVISLTVDFLRSGKPQDTFAKAFVTRQGRRVANVRVDAWQDDRTRPIASAHALFLLSEP

SEQ ID NO: 12174 - protein, 239 aa, Myxococcus xanthus
MGGVVAGALALGGGALAQQNGTDDTESMVRMGRPEAIDQGQAPEPFEEGTGGAGSQGTPPDARGVALLRQGLLPIPTDEKAFLDELHQANQQEVKLGRLAQRQGSSQGVKDYGARLVKDHGQADQRLMAYARKQNLTLAEPQADTDFARTMERAEEASMAKLQSLQGPAFDRAFLAAMVGDHDADIAKVMAGQQQFSGNAGLQALLGDTLPTLREHRQQAYRLLGQETPRQARRAPGGR

SEQ ID NO: 12175 - protein, 450 aa, Myxococcus xanthus
MSWKQRLEKVSEGHYVLAKTKSMKVDADLFLSDKLLWGEGPEQPGLEDSVFDQVVNAASFPGVTRVAVTPDCHLGYGVPIGTVVETDGILLPTAAGYDIGCGMVQLQTTLTAEDVADATKRRRWIEEVTKRIAVGVGASRVQKQRRVTDRTFADVVRHGAKALGRGSSVTERDYIPVEDDRVDIPERAFGKREQLGSLGGGNHFTEMQVDQDGRVWVMLHTGSRGFGWNIAKHFFVEGAAQLGLKSRSEDHVWLDAESPLGRDYWNLHNMAANFAVANRLIIGEAVCAALEDVFGGTASVYYEISHNLIQKEAGKFVARKGATRAFPGGHPALKGTPWEKTGHPILIPGSMETGSAILFAEPGAQKSIYSVNHGSGRRMSRGEARRVLKQDVTDKRMAEAGILLNTRQTPLDESGPCYKNLDDVLETVEMAGLARVAYRLKPVACIKGAD

SEQ ID NO: 12176 - protein, 196 aa, Myxococcus xanthus
MQSLLRAHQEQAAQVARAVTEAEAVLKRQAEAAKARQEAASRAQHEAAKARQAELARAAAAARAQGHAPLPAAAARPATPPENDARRNGRVRMHTSIDMRSDSNFFTGFSLDLSEGGVFIATVDAVPRGTQVELDFTLPGGRPMKVTGVVRWVREANSRTPELMPGVGVQFTGLPAEVASAISSFITTRDPMFFPD

SEQ ID NO: 12177 - protein, 60 aa, Myxococcus xanthus
MELRERTVDVGPGEFIIIPRGVEHRPVAEEEVHVLLFEPATTLNTGNVREERTAEHLQQL

SEQ ID NO: 12178 - protein, 288 aa, Myxococcus xanthus
MCPPGGRLVDGRKGFTGPAALTCHCLLVEGRQGLILVDTGFGLEDVKHPRARLHPLLLKGIRPRLNEGPTAIRQIERMGFHAEDVRDIVLTHLDCDHAGGLSDFPHAKIHLLWDEYQQALAQATARDRRRYRPQQWPPETQWVTYPSLGDGERWFGFECVRDLTGLPPEILLVPLPGHTLGHAGVAIQNGSGWLLHAGDAYFYHGEMAPDRYQCTLGLRIAQKLNQTDGYLRWHNMRRLRELVHRHGRDVTVFCAHDSLEFELLEEQEKAPERSPLRTFVDTRPPLHA

SEQ ID NO: 12179 - protein, 289 aa, Myxococcus xanthus
DCGIAIDGCGGTLGCGACGPGEVCGGGGRHNVCGPAPCEPTTCEALGKDCGPVSDGCEDVLDCGTCTAPESCGGGGTPNVCGEPTCTPDTCESLARDCGAVPDGCGGMLDCGVCADGLTCGGGGAPNVCGHGICKRATCDVLGKDCGPVSDGCGGMLDCGACAGGLTCGGDGVPNVCGNSPCTPGTCETLGKNCGPVADGCGDMLDCGVCADGQTCGGAEPNVCGGGVCTPLTCESQGKNCGTVPDGCGRLLHCGLCPAGETCGGGRVDHVCGHPLCTPATCESLGKDF

SEQ ID NO: 12180 - protein, 148 aa, Myxococcus xanthus
MARPVPLRLQVVSSGDEPGVESVVGFPIQGLTDGFVGLGLHALLVQEAIKDLCIYAGLTGADSRFWQDTAFFLGLSGPRAPEQDLLVEQLQERLLPAVSRRCGLAFFPRLQKVLARGHVSVLAAMAEAGEAIASGQVQRALIVGVDSP

SEQ ID NO: 12181 - protein, 664 aa, Myxococcus xanthus
MERFKKVLIANRGEIAVRVIRTCHRLGYSTGAGFSEADRGAPHVLAADEAVAIGPSPAKESYLVIGKILEAAKTSGAEAIHPGYGFLSENADFARACRDAGLVFIGPEAEAITLMGNKRQAKLRMIAAGVPCIPGYEASDLDDEALAVEGERIGFPLMVKAAAGGGGRGMRLVHEASQLRAALRAARSEATNAFGSGELILEKAVIDARHVEVQVFADTHGNVVHLGERDCSVQRRHQKIVEESPSPAVSPALRARMGEVAVAAARAIGYRGAGTIEFLLAPSGDFYFMEMNTRLQVEHPVTELITGLDLVEWQLRVAAGETLPRTQEAISASGHAIEVRLCAEDPAKGYAPQAGRLLAWRLPLREGVRIDHGVREGQEIPPFYDSMQAKVIAHGPDRETARRRLVEALRELTVFGVTTNKNLLLYVLEHAAFRSGEYDTAFIARHAAASEVEGLYQADAKARALAAALLFHDEGLKLADTAGLDVSLLNWNTSHRHPVRMKLVSRGAEASVTVQPVSGEGYEVDVGDSSFDVSVLGLSAGVLDFSSAGTRGRARYLRDGDTLWLDLGSGAHAVTDVTFRPPSKSDGVGSGRLAAPMDGRILRVDTQVGAAVKPGDVLVVLEAMKMEFQVVADVRGTVAELNVSVGSQVKAKQLLVSLAAEKTA

SEQ ID NO: 12182 - protein, 517 aa, Myxococcus xanthus
MLARVSELRAIEAKVRNTENQAKEKFHKRGQLLPRERLMLLLDRGSPFLELSTLCGYGYHDDSDGSLAGGNSIIGIGYVSGVRCIVFVNNSAIKGGTASPWGVQKALRAQALALENKLPMVSLVESGGANLMYQQEIFIPGGETFYNQARLSAAGIPQVTVVHGSSTAGGAYLPGLSDYVVMVKKKAKVFLAGPPLLKAATGEVATDEELGGAQMHATVAGTADYLAEDDADAIRMAREIVAKLGWNAQLPPTERPAYAEPVYSPDELCGAVPVDYRKPYDCREVIARIVDGSEFTGFKDEYDAHTVCGWANLYGHPLGIIGNNGPISPQGATKAAQFIQLCCQKDTPILYLQNTTGYLVGTQPEQGGIVKHGAKMIQAVANATVPQLTVLIGGAFGAGNYGMCGRPFHPRFIFGWPNSRTAVMGGEQAAKVMSIVFGEKLARQGQVVDEEQLKAFCQPIIDQFDKESHPFNCSARMFDDGLIDPRDTRRVLGFALSVCREAKRRQVHPNTFGVARL

SEQ ID NO: 12183 - protein, 625 aa, Myxococcus xanthus
MDLYYAGEGRHERLWERMGAHLLHHHGVRGTSFAVWAPTAAGVSVVGDFNGWDGRLHSMRRMGSSGIWELFVPEVGEGTRYKFEIRPGQGGPNVLKADPFAFRTEVPPATASVVHDLARYTWGDAAWLEQRAQRRDVHHQPWSVYEVHLGSWRRVVEDGDRPMTYRELAPALAEYIKFTGFTHIELLPVAEHPYGGSWGYQVGGYYAPTARFGHPDDLRFFIDHMHQEGIGVLVDWVPGHFPRDLHALGQFDGTALYEHADPRKGAQPDWGTLVFNFGRNEVRNFLIANALFWIEEYHIDGLRVDAVASMLYLDYSRKQGEWIPNRWGGRENEEAIHFLRELNETVHRKHPGVVVIAEESTAWPKVSAPVSEGGLGFDYKWNMGWMHDTLSYFSKDPIYRQYHHNQLTFGLLYAFSEQFMLPLSHDEVVHGKGSLYGRMPGDPWQKRANLRALFAWMWAHPGKKLVFMGGEFGQPAEWNHDKSLDWHLTHDPGHHGILQLVSDLNRIYRDMPALHDADGEPMGFQWLQPDSAAYNVFAFVRRARQPGRHVVCIANLSPTVRENYRVGFPFQGRYVELLNTDAEQYGGSNLGNMGQIHTEPTGWDGQPASATLTLPPLSVLWFTPG

SEQ ID NO: 12184 - protein, 569 aa, Myxococcus xanthus
MPASPLRVGNASGFYGDRFSAVREMLEGGQLDVLTGDYLAELTMLILGRDRMKDPSTGYAKTFLKQMEQCLALVVEKKVKVVTNAGGLNPSGLAAALREVAAKLGVKVRVAHVEGDDLSAQADALGLGSPLTANAYLGGWGIAACLRAGADIVVTGRVTDASLVVGPAAAHFGWKVDDWDRLAGAMVAGHVLECGTQATGGNFSFFTELDARRPGFPLAELYEDGSSVITKHAGSGGAVTVDTVLAQLVYEITGARYAGPDATARFDTISLASHGKDRVRVSGVRGEPPPPTMKVCLNNLGGYRNEATFILVGLDIEEKARLVREQLEAALTRKPKELQWMLTRTDREDAATEEQAAAFLRVVVKDADAKVVGRAFSGAAVELALGSYPGFTMTAPPSDGAPYGVYTPAYVEAGRVEHVAVLEDGTCTAITPPGETRSLEPVEPPPLPPPVPGGPTRRVPLGRIVAARSGDKGGTANIGVWARTDAAWRWLAHALTEEKLRELLPEAAPLRIERHVFPNLRGLNFVVEGLLGEGVSSSTRFDPQGKALGEWLRSRHMDIPEALLREGQE

SEQ ID NO: 12185 - protein, 115 aa, Myxococcus xanthus
MATCDFMAAEPGCPTGTVCGVQGLCQEQAVQVASGFDFDPALIGEECTLGYAEFCGAEGARGVCLDLNGTGRGTCFPYTRARSDCGPGEELGYVSYPLAGGGYDRTYGFCYPDGL

SEQ ID NO: 12186 - protein, 70 aa, Myxococcus xanthus
MLWRASERSIQDSVRNALAKAREQGFRSVAFPVIGAGSGSFDEARALELMRQVLDVEAGALDVSVVRFRP

SEQ ID NO: 12187 - protein, 922 aa, Myxococcus xanthus
  unsure (1)..(922): unsure at all Xaa locations
MYHRAGGEGVQLTERTNDQKDLGEPAFSPDGRHVYFSQDVSPGKSFEYNKDPNGQIYAIQRLDLETKEIEPFITGPGGAIRPTPSRDGKQLAFVRRVRAKSVLYVTDVASGAERPLYDGLDRDMQETWAIHGVYPGMAWTPDNKAIVFWAGGKLHRIDVATKKVTPIAFRVRGTRTIFEAVRSPQAVAPERFSTKMLRWVQVSPKGDRVVYQALGKLYVKQLPAGTPRRLTKQDDHLEFYPSFSRDGRSIVYTTWDDEKLGTIRVVPTTGGEGKVLTQQPGYYVEPALSPDGKTLVYRASGDGYLMPGLWSRNTGLFAMPAGGGAPKRLARDGEQPHFGARSDRVYFLHVEHKEKEDVRSLKSIGLSGSEERTHLTSAEATELRVSPDERWVAFRENFNAFVVPFALGAKSATVGPGAKALPLAKVSRDAGEYLHWSGDSQRLHWALGPELFTRALKESFAFIDGAPEKLPEAPEKGVDLSFPVKADVPEGTLALVGGRVITMKGDEVIEQGVVVVRNNRIVAVGPVGKVQVPSGAKVVDVKGKTLMPGLIDVHWHGAMGMDGLMPEQSWVHASSLAFGVTTLHDPSNTSEEVFAASELARAGGVVXPRIFSTGTILYGASGAGYRAPIETVDDARSHLRRMKAMGAFSVKSYNQPRRDQRQKVLQAARELDMLVVPEGGSLLQHNLTMVVDGHTGVEHAIPVARIYADVKQLWGKSGTGYTPTLGVAYGGVWGENYWYQKTNVWEDERLLSFVPRRVVDARSRRPSMHVPDDEFNHFAAATVARELSDAGVSVQLGAHGQREGLAAHWEVWMFGHGGMKPLQALRSATLSGARYLGLDGEIGSLEEGKLADLIVLDGNPLQDLKHSRSVRYTMVNGRLYDAATLNEVGTRQRTRAKFFFEKDGNEGWSPKATEHTHTHACD

SEQ ID NO: 12188 - protein, 194 aa, Myxococcus xanthus
MAAQQAPAKPPAVRQDPPRPAPDTKDAARDAARAAEVDAPRPPSGEAAQKAEKEGGDTWKVDAPGFPARQVNIDVTEGTWMNVDVSPRGDEIVFDLLGDIYVLPMGGGEAKALTSGVAWDMQPRFSPDGKRIVFTSDRGGGDNIWVVDRDGSNARAVTEEKFRLLNSPAWSPDGQFIVARKHFTARRSLGAGEV

SEQ ID NO: 12189 - protein, 470 aa, Myxococcus xanthus
MSACPDENLLAAFVSGSAPVGKVAVVEAHLDGCADCRALVAAVAASSSLPGAVVVEREAEAPTRWDTGAATLPDAREEPVLPPGTRLGAYLLQGVLGMGGMGVVYAADDLRLGRRVALKLLRPLLAGAQDQGRERLLREAQAMARLSHPNVLPLFELGTAEGHDFLAMEWVDGTTLADWLRERERPWRDVLDVFLAAGAGLAAAHRAGVVHRDFKPSNVLVGRDGRVRVTDFGLARRGTGESPEAPAGVSEGASKASMLTEWGQAAGTPAYMSPEQRAGRAVDARGDQYSFCVALHEALHGERPGHLAASAAPRTSSVPRHLRTALARGLANAPEDRFPSMEALMAALSLPSPAWGRRGILALAGAGSLVVLGVLLWKPSFLFQSDAATPRAESLGRMAASLIVLRVGDVHELAVPGLQRIAVGEPSLVEVTVPRQGVVRLKGKEEGSTDLITWSHAGEMKSRVLDVTAR

SEQ ID NO: 12190 - protein, 53 aa, Myxococcus xanthus
MVRIAIDEPEIADIKALGKGVLRIIGKQAGETALLVWVGPENKRSSYRIVVTD

SEQ ID NO: 12191 - protein, 304 aa, Myxococcus xanthus
MRTQQSRSLVFLQQLGSGTREGYEALSGLEDTLVALCAAARQAWPGVTLAEEDFLRHLASCLPRDEDPSRVLASVHAADLYLACACVRGNAAAHVALERHVLPKAAASLARMRDTGVDPSEVVQHLRERLLVPEGDRPARMAEYLGSGPLAAWLRAAAVRTALNLQRSERRRAHAEEEAEALPLPTHAGMADVELDYLRKNHREHFQAALSEALNALPTRERTVLRLHVVEGLSLERIGTMYQTHKSTVSRWVARAREAALEGTRQRLAERLRLTSGELHSLMRVVQGELDLSLPSLLSSPGAS

SEQ ID NO: 12192 - protein, 676 aa, Myxococcus xanthus
MSVARERFIATYEALKRRLTQEPLATQLEAVSHAELEHEEAMQALIMEREDGVPRQRLEQIFDGHVADTRRRVMDSLRMLHQQTETRLSEGIHESLATDRSALGLSLLAGSLGLAGATMLAWTLTRKLRPIQQEAEASAERFQLLVEGVRDYALFLLDARGRVESWNPGAERIMGYREAEILGQPSSVFYPPDAVAAGIPDKDLVRARKDGRLHTEGWRVRKDGSRYLADVNVTVLQDARGLPRGFAKVTRDITERRRAERTQQLLAEAGGLFHQFQDPDQTVAELTRIMVPEVADACLLYLLSASGDLWPRAVAHAMPEKEAWLWDAARRFPPPPESPWGIWQVMRTGRSELKSDVSPETLARGLVGPEHLSLMEKVGVRSYLGVPLRVGRQTRGVFVLLTSAPERRLTVTDQVFVEEVAGRAALALDNARLWSEAQDAVELIGVAAHDLGNPLNTLQLLLRRLQRMELAEEQKARDGLAAALKQTQRLGQLLHNLLDLSRLSSGKLMLDVAPVDLSDLVHEVVERFAEQAAEAGCKLEFGAELGLVGRWDRLRLDRVVTNLLSNALKFGRGRPVEVRVEHAGVARARLCVRDHGVGIAPEAQRRIFERFEREPSGGQHAGFGLGLYIVRQLVEAHGGTIRVESAPSEGATFIVELPLMLLGSELREPPDIPLHS

SEQ ID NO: 12193 - protein, 59 aa, Myxococcus xanthus
MAGTNQCAQAVQEQRRAVEKLPAEWPAPERERFIRALEHYQRGCMAPNADSASAPTLGI

SEQ ID NO: 12194 - protein, 415 aa, Myxococcus xanthus
MGAFHAIFWGTAKLLGKPYADISLETMRRNVADGWEWDEDAFATNALGHPYQGSLAYTAARSSGFGFWGSVPFTVASSVLWELFMESETPSTNDLITTSIGGVVLGEVLHRTALAILDEGEPTVARSVLSLLVEPVGGINRYLFGRRKNDFLPVQGNFLQLMAGFTSNVDNYNDIDGTRFDVPNKMEGHLGVEMVYGPPLLTTGDYDQPFDYFTLTARMGFSRDTLTVGFFSRGLLYGDRFKFRSISGLWGLMAGYDFANPNTLRVSTVSLGIGGVAQVPLTSQLTLDVTANMAGVPFGHGGGLTSPESARDYHFGPGAQSAFELGLVRRGVGRVGVSVRNYLISGAFLGEGVELITYATARAELLLAGQHGVALEAFVANRAGEFGSDSDAIRQRATQIRLLWTVSKGTGFGTR

SEQ ID NO: 12195 - protein, 68 aa, Myxococcus xanthus
MSSYNHMKPPLMPALVFQLLIRVCTVAGLSPDAQPLPFLDHKPGATVMPMAVFQLAGLLPAPPAYTCR

SEQ ID NO: 12196 - protein, 50 aa, Myxococcus xanthus
MAVCIERTRARAEALLAPSNLSMRHRPSDFQGAPASSSRDAVPMEAAPRY

SEQ ID NO: 12197 - protein, 22 aa, Myxococcus xanthus
MTGTRTLINVQYCLPGCEIVID

SEQ ID NO: 12198 - protein, 175 aa, Myxococcus xanthus
MLACAYPAEGNDKVYRNIEDYLAPALWSAYSKDASEVKVKKLKGDSEWCDAFPNIAADQFVVPPRMKKELAEYVKQFGAKGVIIPVAHMYRSPIMKEILAPDGTQIGSVETERFGADGTAGLYVHYINESGELIYTGRSRTNGLGVLPDPIGYMRDHASDYAQQMTQKAPPVDLL

SEQ ID NO: 12199 - protein, 482 aa, Myxococcus xanthus
MNDLRGSGFTTVILWSFHIEENGDLIYNDIPVVKNGAYMGDPAWPTRLATLKTAPTSVNRIEVSIGAWGVPDFERMIRLVNGTAPGCGTTIVCGTGSNSILYRNFQALKAATGADAVNFDDESAYDLAPTTTFSQMLIGMGYKITFAPYTQQTFWRNLRNNLGSAVDRIYLQVYAGGAGNNPASWNTAMGMTVAPGLWSRNGSGCASGDSPATVQTRMSNWKTSAGISGGFMWLYDDIQQCSAQGTSAQYAAAINTAVSGNTPPVANFGVTVSGLTATFSDASTDADGTIASRSWNFGDGSTSTATNPSRTYASAGNYNVTLTVTDNGGASHTKSQAVSVGSGYANLALNRPTTSSAPCNSTESAAKAVNGSVSGGTTDKFCSLTSPAWIQVDLGTAQTVSSFTLQHAGAGGESTAWNSRAFTIQTSSNGSTWSTPVTVSNNTGSTSTHAITATPARYIRLNVTTPTQNSDPATRIYEFEVR

SEQ ID NO: 12200 - protein, 372 aa, Myxococcus xanthus
MMTLYIVAGFLPTFILSPFAGVWADRYDRRKLIVLADAMIALVTLALAVVFTLRGTELWLFFLAAAIRSVGTAVQQPAVGALLPQLVPEDQLMRVNSIQGTLHSVNMLGAPALAGFLMSVAPLQVLFYIDVVTAALAIALVTLFVQVKPRPRAPEQEGASQLTEIQDGFRYIRGHAHLVPFFGYLGFIMVLITPAAFLTPLQTARSFGEEVWRLTAIEMVFSVGMMLGGAALAAWGGFSSRMRTMVTSNLIMGACTVALGVVPHFGVYLAAMGIFGVALPLYNTPAMVMLQERVEPAYLGRVFSVMTMLSTALMPMSMLFFGPLAEVVSIERLLQVTGVLVILLGLLTPLHRRLMSFGEPKSPPVQSQELAS

SEQ ID NO: 12201 - protein, 283 aa, Myxococcus xanthus
MVLKQGWPHLVTMQGTFNVWGNNIVPGPQSGQPEPAPMFPSPGVTNRNVGFDPEFVFAGVKPPAVAPLRASFIQLSLDGGKTWAHPASTADFNAAEHKYGYEVTGGESALQVRIADKPVTDNSGRLKIVVVPAEELWLNTRSAAPVPSKQVLQKGKPYRVTMQGTFNVWGNNIVPGPQSGQPEPAPMFPSPGVTNRNVGFDPEFAFAGVKPPAAAPLRMSAVQVSLDGGKTWKHPASTADFNAAEHKYTYDLTGEDAPLQVRFADSPVNDNSGLVRILVLPGA

SEQ ID NO: 12202 - protein, 850 aa, Myxococcus xanthus
MFFSEFGDGDTPTLWDPQTNVLTTLPKAGFNIFCAGHAFMPDGRLLVAGGHITNDSGLPYAAIFDPFKLTWTRLPNMNAGRWYPTVTTLPNGDMLVIGGAKEDTTKNLIPQVWQTSKNSWRNLTGASLELMYYPWMFVTSTGKTLMAGYWKPARYLDTNGTGAWTSGPRTNYARSRNAGSAVMYDDGKVLITGGDNPPTNNVEVLDLNAAKPAWRTVRPMRYVRRQHNSTVLPDGTVLVTGGHSGPGTDNPNFPRLETELWNPVTEQWSVLAPASAYRGYHSTTVLLPDGRVLSAGSRYVKTMQVFSPPYLFNGPRPTITSAPASIAYGETFRVNTPEAASITMASWVRLGSVTHAFDENQRFMKLRFTASGGGLNVVAPPNPNVAPPGHYMLFLLNAKKVPSVAKIIRIGGGGTTPPPTDPPPNPGFTAVAFGSEWKYDDRNVDPGSAWTSSGFSDASWKKGPAQLGYGETDEATVLKKTTPAQPTVYFRRKFTVHGMVEQATLQVIHDDGVAVFLNGTQVFSKYVGSTAHSAYASGTASDNTLSQTTVSGARFVMGENTLAVMVKQANATSSDLSFDLELKVTTDGMQHDALFMESPNGGETLRPGNVQMLQWMTHGAGVDNVRVEFSPDDGANWTLVDQGVPNIDFYEWTVPNTVTSKGVLRISDASRPDIDDRTDLPFTISRTPQFQAIAFGEYWKFDDSNVNPDMQWTSVNFDDDAWRSGPAKLGYGDGDEHTVLNKTTPLQPSVYFRKKLTLGEAIRTAKLRVLHDDGVAIWVNGKLVYSRYADNGLGHGTFASRVLKDAVISTARFDGSAFVVGENIIAVMVKQANAESSDVAFDLELNLEAK

SEQ ID NO: 12203 - protein, 283 aa, Myxococcus xanthus
MLGIGLNLAFVGVEATYGILSGSLALLADAGHNLSDVLGLVLAWGASVLGRRKATERHTYGFRSATILAALLNALLLLVAVGGMGWEAVRRLGQPATVSSFTIMSVAGMGIVVNAATALLFWKGRERDLNIRGAFLHLAADAAVSLGVVLAGLLIYYTGWAWLDPVVTLVIAGLIFVGTWGLLKDSVNLALQAVPGHIDVRQVRERLVQTPGVSEVHDLHVWAMSTTEAALTAHLVMREPRLDDAFLDDVKRRLHDEFGIEHITLQVEEGALTGCCQLAFEPA

SEQ ID NO: 12204 - protein, 183 aa, Myxococcus xanthus
MSPEVLALLLQNRQRFLAFLTPHVGSVEAAEEVLQAALLKSVERGSTLREEERAVAWFYRLLRNALIDRYRHEQRQGRALRAFAEESPLSTEDAAELERTVCACVSTLTTTLKPEYSDALQRVDLDGQTLAEFAEAAGITHTNAKVRLHRARQALGRRLEQACGTTCCRKGCVDCPCEEAGGL

SEQ ID NO: 12205 - protein, 499 aa, Myxococcus xanthus
MRVGFWWVLAGLGLAGLGCGESVDAAAVDAVKETSEVPVQALACAPPGAVYKVKDVLPPGVPVPSNALPVPDWLTNAEGTLFFVVDLFDGPGVLWRSDGTSVGTVPVKEFPVIAGTYRDFSPLVAVGTRVFFLVKDPVVGRELWVSDGTEAGTRLVRDFAPGPASDDLMLFASVGDVLTFFRRPASRGPLELWRSDGTEVGTFRLVTFGAQDSFESGVPPVAGALLFTLHDAANGTYLWRTDGTAAGTTVVKRLDADLVWTQGTAVTATGLSVFSFYDEGPITEVWRTDGTPGGTVRLDSFGGYVRLLGALGGYVYVASGTAGGSALKLSRLSLAGGGKATATWLPNRYAGQPDARPYVEYSAVAGGKLYVSMAIGTSGPAPREVGLWVTDGTEAGTRELSRGLFTGDENYSPLFDTGAGTLLFSADGGETGLEPWVTDGTPGRTGLVADLSPLGGSNPQSFTRVGSTLFFRARSDTRGNALWAMPATVACPTQEVHAR

SEQ ID NO: 12206 - protein, 179 aa, Myxococcus xanthus
VDQEALTALEQDGAFSNVWLARFKNPAAHAKQVASEFAELTASASVTIGADHFKPLEVQAKKFKEVLAAAVRVDRFPKVWSTNDAKLNGSVSGQVKSFGGTLVKLRTSGTTMVEKNDLGIPLAQSTRGAALVRVASDGGFCRLYDDVGFSGTYKGGGAYAPLSYSSGIEDEFKVTVCSK

SEQ ID NO: 12207 - protein, 322 aa, Myxococcus xanthus
  unsure (1)..(322): unsure at all Xaa locations
RSISMGLFAYSTHVQWLPWLFASRVLAGATAGNLAACQAAVADVTDESGRAAGMGLVGAGIGLGMVLGPVIGSLLHVHGAWAPPLAGAVMAAAAMLGVLFFFPETHRPQAERHQEPGRPRVRLSDVLARPGLGAVLALTFLVFIGMTNLQVSLGLLAQARFGWGEQEIGRLFALMGLVTFVLQAFVIGWLTSRVRDTTLVLVGAACMGAGLTCIAAAGHGAMLVLAMVLVGSGTGLLQPLMASLASGFAGRELRGGVLGVVQSAGGLARVVGPVWSGFLYSRLGPGAPFTSGAVAAGVALLVGASLMXXCVQXAPPQSTLKV

SEQ ID NO: 12208 - protein, 370 aa, Myxococcus xanthus
MNRRPELDSLRGILLVLMTLTHLPTRLNTISNQPFGFVSAAEGFVFLSAFLVGVVYANKIEAADPNVLWRSLWQRALKVYGYHVALLAFAFAVIGTLGMATHRPAIHNLLGFFHEDPFTALWSSLFLLYCPPLLDILPLYVVLLLLTPFILLGARKAGWTRILCLSGLVWLSAQLGLKRALYDLLVFIPVLPWPPLRIELSGAFDLFAWQFLWVLGVWLGVGRATAPEKREVVSPVLLSGALVVSVALLLMRYQVGIFSIDLDLYGALIDKWTLAPVRLVNFLAVALLASWLSPKVFRWLRPRVLEALGRASLPVFSVHLVLCLLSLALLNENEDPLADWEEVVVLVATFTVMLLVACRQAAALRSSRTP

SEQ ID NO: 12209 - protein, 402 aa, Myxococcus xanthus
MWVLLVTLLAAAPARESPPLTFAESQSLAAKAALPASLARAVETRRVWDARLPWLAANPTLSVVPGRRAQPEGPGFELTVSVEQPLFLSNLAGAQRDAASAETRALEREAVAALLNRRLEVARAWLTLWSAQQAAATAEQEATLAGALRTSVADALALGGATRLELAEAEGFEAEAQVALLAREAEVTHARLSLAVLVGRQPDAHLVVAEALPEVALPPSSEEARWLARASELPDAEARRLLGVAERARAAEVRAARGWQVTVGAQGVREYYGGLSGLLMVGVTPPMFDAGQRERGALLAAAERLEGEAQEAALRAAAELALAFREREQTAAQLSVVEKSLAPKAEEAARLADVLLRAGQSTLPDVLRARRARAAANIRLALARGEASLAAARLHLLLSALP

SEQ ID NO: 12210 - protein, 369 aa, Myxococcus xanthus
  unsure (1)..(369): unsure at all Xaa locations
MTPFVRRFVAVPMLALSGACTSGSSTAEVPPAPPPARASAPSAWVPVRAASRVALAEAPALVLSSPDAVAALSAPFRARVQQVRARPGQQVKAGDPLVEVLMPKVVEPAGXASAASLRLEAYSRQVERLEALHAQGLAKLPDLADAQTQQAEARAALVAAHAVLRVAGIAPGEARGVAERGTVWLKSPIGGIVTEVRAVLGEMQPEASAALVRVAADGPARLEARLSVRPPEDASFAFVSSQGIAVPVRWVGQSPVVDAADGTWRAWFEPEDTAAVLRAGQGGRLRIQAAAGEDTVLVPARALAFDSARTVVFTRGGEGQPVRREVEVLATSGAEALVKGPLSARDTVAADGAALLLESQAGDADEVTP

SEQ ID NO: 12211 - protein, 252 aa, Myxococcus xanthus
MAVRLGDVAEVTEGALPRIGSATSNGRGETVYVMVQMLRDANALAVTGAISDALPDVRALLPEDVRLDVVYDRATLVRGTVRTVGKNLLEGGLLVVGVLFLLLGSVRAGLLVASAIPLSMLGATTAMVALDIPGNLMSLGAIDFGLLVDGAVVMVEGLFHRLAHLSPEEKQRSPREHVEETAVSLARPVFFSVLIILLVYLPILSLRGVDGKMFRPMAMTVVFALATALLLSMTFIPDAASWLIAPRARPRA

SEQ ID NO: 12212 - protein, 382 aa, Myxococcus xanthus
REQLVRCCLEDIAMGKLHGLTIGLDICSTLHMDVSLDDLDWCIERIMPANPAYLMSLPTKNDPMLGYLTTGFQDHVRIREQFGYKVDDRMWAFFQRLGVIDAEGKPTRHFGDPVWVYLQYLRAKGDSRPEADIRADAEQQLSAIRARGVPMARGHGTHPWDLEPALDAELRRVYVDSKKSLWTELTPAFITAVPEGVRLVSKSQDRTEYILHPETGEQLDASSLEAVRAMRARHAGRYDVQLMVSDGLNALAIMDEGQLAPYLETLRAALIAAGYQPAPEHLVLTSGRVRAGYRVGEALYAGMEDAARHRGLIHVIGERPGTGHHTFSAYITAPSGAVWSQPGKVDHNITRVVSGVALTAYAPSLAAPETVRLLQQLAPRGG

SEQ ID NO: 12213 - protein, 469 aa, Myxococcus xanthus
MVIQTTRVPDISLDAAVSEAGRMERGLLQAIPEVRQVVSRVGSPAVATDIMGWEMADVFVSLAPRDAWRPGLTRESLIEEMGQVLEARVPGGDPAFTQPIQMRFNELLGGAVTDVALSIYGEDLTELGLLARRAAALLSQEPGAVDVRVLAPPEVPLFEVTPRPLDSARAGLGAVDVLEAVSAVRSGVEVGATWDGAVRVPIVLRLTGASDAFSLAELPLPTETGGLVPLSRVADVRLTSSPGLVSREGGQRRLVVGFNVRGVDLGTVVERARSRVEQSLAPPDGYRLEWGGQYETLTEARQRLSLVLPAVALLIFAVLLFAFRRMRPALAIFANVPFACVGGMMALAARDLPVSISAAVGFIALSGIAVLNGVVLMSREQRLEADGHAPGEAVVMAARERARPVLMTALVAALGFIPMMLARGVGAEVQRPLATVVVGGLVTSTLLTLVILPTLYPWFAGRTRTQARA

SEQ ID NO: 12214 - protein, 155 aa, Myxococcus xanthus
MTPVLMLTARGTVGERVTGLRAGADDYLVKPFAFEELLARLEALHRRSEGQTQSWGGGAIHIDARRRMLTCGDREVALTGREFALLGELASRAGEVHTRSSLLAKVWGPSFDGPPNIVDVYVGYVRTKLTEVGAEGVTIQAVRGVGFRLVIEGAR

SEQ ID NO: 12215 - protein, 446 aa, Myxococcus xanthus
MWLWGAVVPVVAVVAALGVAVQVFRVVLERTLDEALLSQAAAESVSLFDAPDGRPHLHVEPSPLAGEVRAFVPATRLYGPDGTLLSVFPPESPTVYERVLPEDGPTSRLETQRLGSGLRLRVLTVQVRSPKGVPHVLQLVASLGTVDQAVGTFTSVATVLALLLGGVLIGIQGWQARGLARRLHGIADQVARSRDGGMVAPVPVDEPRDEIMEVRLALTEAAVRVRAAREAQERLIARAAHELRTPLALMRTGLDLALRRERGAEELRTVLEENRREVDRLASVAGALLELSAAGGALDFQQGDLRGLLDEAAAGAWAEADRRGVSLRVVGPDEADCRMDAMAVRRAVDNLLANALRYAPRGSEVRLELAHRDAHWEVAVQDEGRGIPETHREDVFTPFHRLERDAGGVGLGLSLVREVARGHGGDARVVESPGPGARVLLTLPGR

SEQ ID NO: 12216 - protein, 677 aa, Myxococcus xanthus
MVPDDSLTIRERAIAAWPPAWHGQNLRDILVTLGYDVDRPWRELPKKDRDWILFTEEQPTVPVYAGFTPAETQRALKRKAAPSYMGTFTGARRYVLQTFATTQSALMKRRVSQYMVSGDCPECHGKRLRRESLSVTFAGLDIGELSRLPLSELTDLLAPVADGTAKDVAALARVHPEKALVAQRIAHDVLARVNVLTELGLGYLSLERGTPTLSPGELQRLRLATQVRSNLFGVVYVLDEPSAGLHPADTAALLKALDQLKGSGNSLFVVEHEVDVIRHADWIVDVGPDAGEQGGQILYSGPLEGLKAVKASRTRRYLFGDAEKHRGTRRSPKGWLRLQGVSRNNLKEVDVDFPLGVLTTVTGVSGSGKSSLVSQVLVELVAGHLGHAVPENEDEGEELERTVIHTTGGRIASGMEGIKRLVQVDQKPIGRTPRSNLATYTGLFDNVRKLFAATPAARSRRYDVGRFSFNVAKGRCETCEGEGFVSVELLFLPSVYAPCPTCQGARYNAKTLEIQYRGKNIAEVLGMTVDAAHDFFSEDPLVQRPLAVLREVGLGYLRLGQPATELSGGEAQRIKLATELQRAQRGSSLYVLDEPTTGLHPSDVDKLMTQLEGLVASGNTVILVEHDMRVVAASDWVIDMGPGAGDKGGRVVVAGPPEEVVGLPYSQTAPFLEEALG

SEQ ID NO: 12217 - protein, 288 aa, Myxococcus xanthus
MAHLELIPKRDLSSFRKLAIGSWKTAYDPTVYGTLTVRMDKAMAYIEAFRQRTGVRLTVTHLVAKAMGEALRRCPDANAILRFNRIYLRQRVTLSTLVVQTDGGKVDLTSARIEDADKKNLKEIANDLEEAVRRVRERRDVALEKGKGTIQKIPYLFLNTFTWLLSFFMYTLNLDMSRFGMPKDAFGSAIITNVGSLGLDTAYVPLAPYTRVPIFVAPGAVKEVPVVEDGKVVPGKVMNINATFDHRFIDGFHAGVLANTLREMLENPFESFDALPETADAAPVAAVG

SEQ ID NO: 12218 - protein, 163 aa, Myxococcus xanthus
MKLEGSCHCRGVRFSVETHHPSPFMRCYCSVCRKTQGGGGFAINLSGDARSLKVRGRQHVKVYRARIQNPEDAKAHQSKGQRHFCGRCGSALWLYDPRWPELIHPFASAIDTPLPEAPELVHIMLEFKPDWVPVHAGKKDKKFQRYPKESIAEWHQRHDAEVG

SEQ ID NO: 12219 - protein, 255 aa, Myxococcus xanthus
  unsure (1)..(255): unsure at all Xaa locations
MIRVTDENHVKLMIAYRLHFEEANLRAIDLLRSGRLGEPLMMSALLTQQVRTGDIRTRVDVGGGALLDEGPYPINAARYLLRDEPTEVFCYTNEEQDPRFKGVDATAFALMRFSNGRIAQFGISHAASAVSSYRVVGEKGDLLXEXXXGYEKERKHVLTLEGKTEERVFATHDQFAPELLYFSKCVLEDQEPGPSGREGLADVRVITAMQESARTGRPVKLEAFPMKRRPSLDQLIVRPAARPPAPVNAPAPVQG

SEQ ID NO: 12220 - protein, 420 aa, Myxococcus xanthus
MADVVARLLADTQPAAVATPPPAPVAAPVLQVSSAGSPVKDLEARVRAVFARVTRYPEELLTPEADLEDELGIDSVKQAEVMAVLIKELGLTDAPQPSQRLRTISSICEMARARLAVAAPVREDRAPRQSPPPAVLPFAGKVAFVTGSGKGIGKVIAARLAGSGATVVVNSFHSRDEGERTVQEIVDAGGKAFHAWGSVAQEEHLDRMFASIEAQFGGLDFLVCNASNGLIGPFDRITPRDWDKAFRTCITGTYECAMRARPLMARRGGGSIVTMSTSMSQRYMHDLGCQGVVKAGVESLTRYLAAELAPDGIRTNCVSAGPVHGELLRMFPDAASRVARWESATPGGEICTAEDVADVTELLLGPKTRRVNGAIWVVDAGLSGTVDGLLPGASEARRSEAQRGSHRSEHDLRALLALDS

SEQ ID NO: 12221 - protein, 2216 aa, Myxococcus xanthus
MGYFAVPYDIHFDDTMAYGSHHFLTNFKFQCAGREHLLFSPDVFDVPEFRRDFDQVLLLTYEGYSRNLAPASLGDRLVVLTTLEEGGAVSIRFCFRTLKSDGTPVACGFQTVLCADRTSGALCSFPDSFLRCFDSLSGIFERAGARSFRDCVQQGGSALKEVFPESIRALAKSLLADPASLGTSRVVSLEGAPAASTAESPGALVLPPGATAFLFAGQGSFDPGLYLQLKALDPDLGDELQGVAAACRAVGVEAEPLLAARDVSGVQRALEELPQLDQLGIYLSGVLGARWMQRQGASPDVFVGHSFGEIAAMTAAGALDLRAGAQVVCHRIRALQVLPDDFGTLAAVALGESEAVRAIAECGASRLHIAGRNHARQTVVAGARGELARLRALLEGRGQGFTFVSSRYPFHHPGMAPAAKAFREMLDRVPMQAPRRRIYSPIERRAYVGGRPELADALASHLVRSFDFLGTVETLSRAGCARFVDCGTTGVLARIVQKIIPEETAAEVSVISKLLPAERSAPSAGIEPKSVDAAEVDESGIAVVSLGCILPGGAKDPETYWQNIRKGISGIVDQGLLQPELVTDFAGPAGTPDRTYTLLTGYVRDEDLVPPPGFDPTRFQQYVREQKLLAIALSQAMQGLKPVASKTPGRIQCLLGSTAEGSAEYDAALSVEAGEALLSARGERVHDIAALACAAREALGVEAISSDLAPHPTLQAVVTDVVGQGVATTLLDAACASSLYAMALGMKALERGDSDLILAGGVFSPGPGNSCLFSQFNGLSATGSRPFDARADGVIFGEGAGVVGLMRLKDAVAAGHRVHAVIRGAGLSSDGRSSSANVPRSDGQVAAMEACYSGAQVDPASVQYIEAHGTATPAGDATELRSIARVFGGKRSGVQLASVKALIGHVGWAAGAASVIKLCKAMAHRIFPVQSNFDAPGAALRAMGPGFEVNTREQPWPENGELPRRAATNGFGFGGTNAHLVLEEYRGPSSAPKSREGIPSEAELVVVATEGLFPDGRGRPEAGVPVEVGARFDLQALRLPPTVRLLPDISEDMDATQHLGLVVGSALAQKLGAFDALRSGTAIVLGLEGKTRRGVEAVQRVLAFTLQRRLSEKARREPASAAVLPLAERLYSAVMGSLRPSGPYTLQGMMPNVTPGRVAGALDVKGPNFVVDAGAASSSAALQAARGLLESGFELVLVGSTHIGRPGEVRGAQQPEEGAALFAVTTAEKARRLGLKPMCQLQLSTRGTKGTGAGIDLPPHSAAESLALLRAVHAAADGRAGTLRFHPDAATGVRLEVRLQPMADGLPVESMQSSSRAHSHAATEGRLGVSSRAAEQGGRIDASTSPLRTHPDAVTDGRSELPSRPSEGVRLASSRSVESASSPADGASGAELQAAAGGFDHAAPIQYLSPVLVERPVRKTRPSYLRGRRVLFIAEDVALARELAARAQALCGAEHLILCPGTGSDSGRVRYVDLTTDTSAEAGLAALGFEPEVILAVSRIEAGALEAAVVADTAMKHGALELLFLTARRAYERLSRGEVELVSLCIGAVGPRRCLHPMSGLFAGMLKSIGREVPARNVRAVSTTAMLLQEALELAEAELGSEVEGNHSIEVCFEGPVRCVRVLRVTDVTADLAATLDSRSVVLLTGGGRGVTAVLAGALLKRFGCKVVLVGRSDPDEAPLRVLQAREEDLPAMEREFYASELARNRGVRMPELRKRFERFLAARELKATLEGLGRLPGEVLYRAADVTRAADVDRVVQEIVDTHGRLDLVVHGAGTQTSKKLNRRQLGELRTNLGTKLLGLRNLREACVSRLARPVPFHILTSAFSYIGNDGQADYGAANEALDRLCAWVSDASQEVRWCSVGWLAWDGIGMTRGSEYRVLGASRHLRGIRAEEGEALFLQLVDGRPRQAINVQLTESERSYYALEVLPAEETRSLSAGPVQRELVVDSASVPCLEDHLVRGTPTLPGAWALDLMLQAAVGNGRPELRTVTIEDVRFSRFIRVKQGGRQHLRAECSPLIDEPGCHGVRVRLMGDIVHASGVVLEKDLVYAEARFTLTAEPPRGTPELDAAAPSGQALRVHDPHCAAGAPIELRKMFDCLEEIRIEPSARFARLGLPAEPRQAGSTVPALVLDAALRLSAMHVDGESSAVFAPIQFQRATFDRGLVDVRGGAPLHLSLKALPPRVDGDLLECGTVAALDEAGRLRMLLEGGLARPMA

SEQ ID NO: 12222 - protein, 427 aa, Myxococcus xanthus
MASGAEELAPTDAKARIHPQNARALLRAERLLASEPHFLPPPLPDCPGMIDHGVVRLGVAPAGHLNLPCPTNTVSSGTFGTRTIGLRYLPTNGEAAAPGSACEGWGVASADLGISGYSSADCGASSNLTAEINAPSPISTMSVVRVGNTFRVTHIYTPSPVTNHLYQVDVLIENIGTAFIADLRYTRGIDYDILPNTFSEYVTVAGTAGNPWVVSAVDNNFVSLDPLAINYSLMGGTGDFTNVGPGDLGAQFDFRLGSLAVGQVRSFRTFYGAAGNQADALNALSAVGASTYSLAKGNWNGTGDPLSPTGAPAGTFGATTGQPNTFMYGFRPPESPTSCTVECPRVLSHGVYTVDHSGDLDRCVVNGQYANNTVAVTYLFGERVEFICSDYGSPHGNPCNVGPGADTCNLAAFQSLCSSPTFAQYCL

SEQ ID NO: 12223 - protein, 295 aa, Myxococcus xanthus
MKRAHLDEIFAFMAVVDAGSFVSGGRAIGLTRSAAGKALARLESRLGVRLLNRTTRHLSLTDDGRVFHEHCQQVLAALDDAEASVGDHTGTPRGVLRITVPDAFGRLHVLPVLKKYLQTWPDVQVEVSFTDRVADIIEEGYDLAVRINVTSTDTRLVSRLVAQHRVFVCAAPSYLAARGEPQTLEELATHDCLLFSSRARRQRWRLRPKGGAYVTVEGQSRLRLDSGEAIRDAAVAGLGIAFLPSFLVDEDLARGRLKALLPSCETEVVRIMAFYPSKRHLPAKVRRFIDLLVEQ

SEQ ID NO: 12224 - protein, 620 aa, Myxococcus xanthus
MWLSIPIPDGGWTDPALYLGEITHALEVYADGQHIYTSGKIRPDSYEIGENLSWHIVPLPRDAQGKRVLLRIQSSNPNIGVAQAAQVGSKYDLLVYVTRQGQAPFVICCLLLAVALGAGGAFALHWRRRMLAGLAVSAASGGLILLGLSGMPTALWGSSAAATLGTTMGIFLLVAGLMEFVSDALLDNRRGWFQKAAMVFSPVAGVCALATLLDLGIGQRILVPFLPMAMVVLLVVLSVAITQAWLGNPDARLFVGGFAGLVLSIVLTILPVIGLVGWSLGNVTHWGYVALTLSLLGIVTRRSIMVVRTLEAHTHQLEARAQEVRNLAERMGNGAGELATVVQQLRSSSDEQTEGVSRQAVALQEAEQTVKEIRRSSQMTAEKASALAASAESAEQVGREGTAALERTLSDLAAIRTEVSDMARRIFALDERTREVSGIVDSVKDLADQSNMLAINAAIEAARSGESGRGFGVVAREMRGLADQSIQATHRIREVLDGVSNSMREAARSSEKGDERVRLSLDAVRTSSAQFQQLADIIGDTSSSVRQITAAVSAQDAGTHQMAQAIQELSGQMQRTLNTVQETQEAARSVQSLAESMSGMASHTLKAEGLSVPAAQAQAR

SEQ ID NO: 12225 - protein, 309 aa, Myxococcus xanthus
MLQDVLEQLTVIENGFVFRYVPAGTFIMGSDDGEPDERPAHAVTLSAFWMSDTSLSWSAFARLLDWPEPPEFPTDEQLDGFTDSFAYFNDSKIRLQYCENDTLQASDWHAHAIHTRWETGDGVIKTSQELFGTPARAGEGPLRYDQKPMVAVAPSLAEQFARRLSTPSVTYRLPTEAEWERAARGCFRGAAYPWGNEPPDASRADFDRFNDFSLRPMRAFPPNDYGLFGMAGGVSQWCQDHYDAEYYRHSPKTSPVCVLGEDIPKRTHVLRGGSWADCADALRVSFRSASDTGAAPNIGFRLVRVPSRR

SEQ ID NO: 12226 - protein, 408 aa, Myxococcus xanthus
MPFDAPAAAVLTRLTEHTADDVIGDAEAGDRDAVIGLIQHLSTKGYLRMDGRLAAARIDRAPPPDHLLGPLAVHLEVIGACNLTCTHCFAGELPRNQSPLSVKEMDALFAQLAGLGSFRLGLTGGEPLMRKDLLDILDAATGHGLHPCITTNALLIDERWARELGKRELVWLNVSLEGAQAGTNDAVRGAGVFDRVMEKLALLGQHARFTLAFTLTRDNVAEVEACVELARRVGAHTAVFRPLYPVGTATRHPELMPTFDGYVDALARLERVEADSDLFALDPFSPSAREELRGVVTEGPGCGAANTVASVSVQGNVNPCSFLGRAFESGNIRTRPFEDIWRDGQSFQRLRAKQTGDRFTGGCRARAQFYNGSAFAEDPWQAQSLGAATESHPLPVLGAERGQGGACR

SEQ ID NO: 12227 - protein, 32 aa, Myxococcus xanthus
MLKDDATGLGLASSATKAWVRWSFHVDDEGFK

SEQ ID NO: 12228 - protein, 199 aa, Myxococcus xanthus
MGTKEQEARERILRATIVCIGRDGLDATGIREIAREAQVNSAAISYYFRSKEKLVALALEQTLDQAFGNVLEDFDRLRLEGLGIREAFETLLEDLMSNSLRYPYIAHAHFHDALAHQRYDSSAIQRFNAFLAELAGRLAPGAPHLPENRLRMALTQVWASLSLLSMMPRLFDQFILLDFGTLDTRRAWVQQASRLLFVP

SEQ ID NO: 12229 - protein, 528 aa, Myxococcus xanthus
MLSAARLRQAGVDAIRIVEKGGDFGGTWYWNRYPGAACDVESYIYLPLLEETGYMPTEKYARAPEIFAHCQRIGRHFQLYEKALFQTLVQSMDWDEDARRWNVTTDRGDRLAARFVIIAGGILHKAKLPGIPGIETFKGHCFHTSRWDYAYTGGSPTSRMTRLGDKRVGIIGTGATAVQAIPQLGAVSQQLYVFQRTPSSVGVRGNRPTDEAWAKSLQAGWQQDRIRNFSAIVSGRALPVDMVQDGWTYIFQDGATQQARTPEEAVELRQLADYRKMEEIRARVDAIVSDAATAEALKPYYNPMCKRPCFHDEYLETFNRPNVQLVDTEGKGVERMTPRGVVVKGEEYPVDCLIYASGFEVSGDYTRMLGFDIRGRDGTSLRESWADGPATLHGMHSRGFPNLLMFTTTQSGWAINFVHILDEQSQHAAYIIGRCLKQGVEVIEPSAQAQQQWWDVILSRLRMGISFGGADCTPGYYNNEGVSPGPNAIRYATFGGDTLAFIDVLRAWRQGDGLVGLELSQGKVASKP

SEQ ID NO: 12230 - protein, 549 aa, Myxococcus xanthus
MFRCVSKSLAAGLLLMAAPALATPPKSYRQETVVAGSHFQGVHGLAVDGKGNLLASNLLGQSVHAVNLSTGAVSTLVGPPLGGADDVALGPDGSIYWTGYFSGQLMRRTPDGKTRVIARNLPGLNSLAFRGDGRFYVTQLGRGDALWEVDPTGRKPPRKVIDAPGYLNGFEFGPDDRLYGPLILKGQIARVDVDTGLIEKVAEGFTVPVAVNFDARRENLYVVDAATGELVRVRLPSGAKEVVAKLPTGLDNLAVGPDDQVYVSNMVDNDIRVVNPADGSVRLLVESRLSVPSGIAVVPDDPEETLYVADVYALRRVGGREGLVTQTTRVLSSQLNFPMNVSVTARHVVLSTAYLGSHSTLQVLDRGTGALLRTIPSPNGAQGVVELEDGTLLVAEAATGRLVRVDTSEPAVTTVLAEGLGGPVGLAADTKAKEPGVYVTEVRSGKVTRVRLSHGARRTVPSVLKAPQGIALHPDGGLIVAEVGRKRMVRIDAATGRVTVLASGLRIGLPESEGLPPGYIPTGVAVGASGTLYVTSDIESALYRFVPVP

SEQ ID NO: 12231 - protein, 397 aa, Myxococcus xanthus
MKASRRQLPVYVPPRTVWIVGTQVLLLILCWAALRAVYPVLTLLAVVLLLSIALSPLVRRLTQWGLPRGAGVAIVALALLGMMGVLVGSLVPMLIHQLQGLVQSMPAMLERLAQSRWVEELSTRYGVEVQAEDLIRFEPTDVAGRLINVLSSTLGLVAGGITVVVLTVFSLLFGEDLYESTIQWVSPRRRPRVRLLMSRMRKAVANYLAGTLLVMTIGGTVAATIALIQGVPYFLPLGLMVMMMGVIPYLGSIISAVLVGVITLAAVGLKDALIAVVVFIVYQQIESNVLGPMIQRRAIKMNPLLISIVVLCGGALAGLPGVVLAVPLAAAAQVLVQEVLGLRQEAWQRSHRMEDSKREPGRGAVEEGLLFAGPMAGPRPSAPPSREPPPPDTPSEH

SEQ ID NO: 12232 - protein, 426 aa, Myxococcus xanthus
MDSRGAPDVKRAVGGFLSVEGYDVRRLMTWIRLSGGVPSLSGKDPVGHILYLRRERPDVYRRTYKFLEPKDWLNLKLSGRCAASYDSITLHWVTDNRALGRIAYDDRLLKMAGLEREKLPDLVPASTVLGPLQAQAASELGLREDVQVVTGAPDILAAAVGSGAVGDFEPHLCVGTSSWLCCHVPYKKTDLFHQMASVPSALPGRYLLANEQESAGICLTFLKDNILYGRDAGAGTDGDAPDLYRVMEAQAGNVPAGSDQLIFLPWLNGERSPVDDKSLRGGFFNQSLKTTRAHMVRAVMEGVAYNSRWLFTYVEQFVGRRLDSLRIIGGGARSALWCQIHADVLGRAVQQVDEPVLANARGAAFQAAVALGRLTVEEIPSLVPVARTFHPDSKNAALYDELFREFVNIYKHNKAIFARLNRARSA

SEQ ID NO: 12233 - protein, 509 aa, Myxococcus xanthus
MALPDLKALSLLNHVPPRLLSAAERYLKAVPGVKGLLNRETGSLLSELESGLKPYRGKMQSFDHLPPTGRSREDVLRELQALESQEEYRWREGRVSGGVYNGDAEHIAFLNRVYALHSQSNPLHADLWPSATKFEAEVVAMTASMLGADVANAGQPEEARICGAMSSGGTESIMLAMKTYRDWARETKGITRPEMVAPASAHPAFDKAAHYFGIKMVRVPVGPDYRADVAAMRKAINRNTIVLIGSAPGFPHGVIDPIEALSEIARKKRIGFHTDACLGGFVLPFAMKLGYDVPPFDFRLPGVTSMSVDTHKFGYAAKGSSVVLYRGTELRSHQYFTATDWPGGIYFSPTFSGSRPGALIASAWAALVSTGEQGYLDATRSILETAAAIKKGIRDIPELHVLGDPLFVIAFGSESVDIFQVMERMSEHGWNLNGLHKPSAVHLCVTLRHTQPGVAEQFLVDLRDAVDYVKSHPSAKGTMAPVYGMAASVPFRGLVSDLLKKYMDLLYKV

SEQ ID NO: 12234 - protein, 210 aa, Myxococcus xanthus
MNPAEKAALFLERLREAHPDARYELNWSTPFELLVATILAAQCTDERVNRVTATVFPKYPGPQAFADADTAALEEDLKPTGFFKQKTKSVQAMSRALLDKFGGEVPHTIDELVTLPGVARKTANVVLNTAFNLPSGIIVDTHVARVSQRLGLTKKDKPEAIEEDLMKLVPQEQWTFFGPATVLHGRYTCTAKKPKCDDCIVKDVCPRIGV

SEQ ID NO: 12235 - protein, 305 aa, Myxococcus xanthus
MGKTRIKDAFVERLASDGFEVWEGSGLALPGAPAGIFRELLDATRALSPPAGTGRVSSADAERIQRFLEGRERQGIPASLASERTALFDSLCHALMPHRRPRLLVLEDWQHGDALSHALVEELVSRLSHTPLLLLALQRPSGTAPAPLTAEVLTVGRLGPAESAALLEGRLRNRGTLTPAARVALLRGSAGHPLHLLHAVTLHEEQPEREVPLTGEAAHAGAAGLAAPGTAGGAPGGVGAGPVVSPGGAGGVGGWGRAAGAAGDGGLAALRRGRPVHVGGGARPGRRRTAGGGVARGAPAGSGSL

SEQ ID NO: 12236 - protein, 249 aa, Myxococcus xanthus
AVYRFALGLADALKPDAAREWQRRLWEYMGDAHRLAGEPAEADAAWHTARTLDDEGLASPAGDRARRLFKRASVVLALGRYEEVLGLDREGRRDCLSAAPLLSVSLDALSALALSALGRFEEARARIVLAREQLQRAVRDDGPAWAGVEALLHRAMGSAQLGLGFPEAAASEYAQVLRWSERAGDTWEHSTALLNLGDAYSRAGDRERAAHFFQLALELDSRTGDRRGMAYTHHGLALLHTRAGAPELA

SEQ ID NO: 12237 - protein, 297 aa, Myxococcus xanthus
MRAPLLSLLALLTLVGCSDTPSDGPGVDAPVDRGPKAIPLDGDPNGMFWDAENETLYIADDQNHRILKYRDGEGVSLAVALPDAPPNSTNLGEVVRMPDGTLVTVRFGFGTAGAVLFARPDGTTGKVPGLPTNRRRIGLTVTEDGRLYNSYFVRNSNVNVGSIALLNLDGTEQEVVGALEKPVGVLAVGDSLYIADQIAGKVYRSPLARPAELTTIATLTEPDLLSLGPGGALLTGTRQGTVVSINPSTGAQRVIASGFQNVRGIAYDAVNRRLFLADHDGDESNGTTHFLQIVPVD

SEQ ID NO: 12238 - protein, 353 aa, Myxococcus xanthus
MTPLLTAVLGVLLVATPEEAPEGRFSVVPFVLPAYQPETSFLLGGAASLIYQPPASRGGRESQVMLAAAASTRGQFTLLLQPDVNLLDDRLNLTATASAARLPDRFFGMGARTRAEDEEDFTPIFFELELSPKWRIAPRLYVGPTVRYQHARFTYVAEDGAVRRMTGAEGGSTVQFGLTALYDSRDNTLNPVTGLVARLNLRRARDAWSSDYVFDVLRLDVRRYLTLPWGQRHVLAMQGLVDLRDGEPPFYDTGRLGGMELSRGYLEGRFRERQHLGAQVEYRAPLFWRLGPVAFVSAATVARSPRDFDMRDIKPAAGAGLRFAPMTDVPVNLRLDIAYGSEPSFYLNVGEAF

SEQ ID NO: 12239 - protein, 434 aa, Myxococcus xanthus
MGAGLFAGGAAAALGLRSALAPVSKDVQGINPRSDAWYDIRLTGDGLMDNQVLWFLSHATHGQSDVGDVLETASRIQPGDERSWFEAWTQTARRVHGHAQNAESKGHRLSAGQAYARAANYYRAATMHYTDLEDPRTLEVTRQAATTFEKSNGLLGYDVQPLAIPYEGTTLAAYFVRSPHAKPSAPVILLHQGLHAWPEETKWVWEGAARRGYHVLMFHGPGQGRSLREHRLSFRPDWEKAVSPVVDAAERISGVDPRRILLMGLSFGGALAPRAAAFEPRIALCIANPGVLSWWESTSSHFNRFLPGSLALLKSHPEQFDQAITALADRWPTAQYWLRDVYWKHGARSPSELFRKLEEFTNEAIVDRIRCPVLIMEGEAEDASPGQSQKLYDALRGPKHLMMFTHEEAAPLHCQAASTALAEARLFDWLDENV

SEQ ID NO: 12240 - protein, 502 aa, Myxococcus xanthus
MLAAGANLWAMVEMVDTADFDLLKAQLPGFDGFLSNDAAFVSGGTSPYGTSSQKLGVLYDSSLTFQSATLVRIGNISDFADRPPLRVDFTTEINGAETPLTVIVVHMRANSADPTAPREARERASAALKAYLDEQLPTQHVFVIGDWNDDVDESISLDPTSGAPLATPYQNFVSDSAHFTFITRELSLAGDDTSIGFENVVDHTLATNEAADRYVAESARVLYVDEWFPDFLNVVSDHRPVVSSYAFSAATGPLLRLKSPHGGTYQGGSTLPITWTSWGVGEVRVEVSTNGGTDWSVLAASVPAALGRFAWSVPDEAASNVWVRVVDVYEPAHADMSDAAVTIASGAARVFINEVLANEGTQASAHEFVELVNASPFPVDISGWTLWDATNGSARHVFAQGTQLGGGKAVVVFGGAAAVPAGQANALAASSGLLGLGNGSDSVRVRRQDSTLVDQYDYTSTVPGVSANRSPDATPDASFVAHDTLTPGVASSPGLRADGAAF

SEQ ID NO: 12241 - protein, 170 aa, Myxococcus xanthus
MTAARALFSTQGFANTGVRDIAALAGVNSSLVGRYFGSKQGLYRETLAQVLDIGPLLQIDRRQFGETVVSLFLGAHDASGPLAMLILSASDPEAHATSVELLQKQVIAPLARWLGAPDGEGRAARLNILWNGLLVSGRLLPIQRLSEGLDTSTQRWLAAAIQSVIDEGAT

SEQ ID NO: 12242 - protein, 109 aa, Myxococcus xanthus
MWIEAIIMPRQSATPYRPAPRKKRGADAIPASAPDRRPAYQAALDEGRRFWDAVLAFLKAHHLMDAVRWISEPGTIPLVTLHCTRIVLERLRQAPEFEAGLSMNLEVPV

SEQ ID NO: 12243 - protein, 1133 aa, Myxococcus xanthus
MNSLGADAWDDFFKRNGREFNVYIDPRTGTPTAVQGTIPLIPGDGFNNKVTMDEVRESIGRSIANVDEAAVGDLIFKFIADNQAAFNVDLMQMGNPRVTRINDDLIQVHISQQVNGVPVRHGRIAATISHGNLILIGTEAWANVRIDTRPRLAPQDALVSGNGFVGLNTSPQTLWQQPTLEIAPVALSGESFNGAVGTGYEHRLVYTYGFSEAGGNERWKTTVDAQTGEVLAVEDDNHYFDAQIKGGIYPSTNIESCTSNETCGTMQPNSPMPWANTGLPAPNNFTDGAGIVNYSSGTVTTTLAGKYVRISDSCGAINVSSTTGNLNLGGVNGDHNCTVPPGTSPGNTAASRSSFYELNKLAEQARGWLPTNTWLQGQLLSNVNINSTCNAFWNGSSVNFYRSGGGCRNTGEIGAVFDHEWGHGIDDFDANGSLSNSSEGYADIAAIYRLQTSCVGYGFFETVNTGCGLTPDGTGYNQQEAQVSGQSWCNTKCSGVRDADWAASVPNIPATPQNFVCPMCSSGSGPCSRQVHCAASPVRQAAWDFVTRDLTAPPFNYDSNTAFIVGNKTFYQGSGNVGTWHACNCTAGTSDGCGATNGYMQWLAADDDDGNLANGTPHMSAIYAAYNRHRIACSTPTVTNSGCAAGPTTAPANTTATPGDGQVSLSWNASAGATQYWVMKTEGFAGCDFGKAKVATVTGTTYTDGEVANGRQYCYSIVPASSNACYGAASACTCTTPVCAAPGTDVLAAPSGGATGVELSAVLDWNDVSGASTYEVQVATDAAFTNVVASATALTASTWTVSPALATSTSFYWRVRASNSCGGVGAWTAASTFTTRGCVALATPTLSSPADGATGVGTSAALDWSDVPSAATYEVQVATDSAFTNVVRSATALTASAWTVTPALSSSTPYYWRARAADSCGTSAYSTARSFTTTNICTPVAATYNATLRTPSCGNVCGCDTGTVLVNGRGTLSGGAEPNQPNTLNASCADGSSGTYHSDESIDRVVLRTVDHSAFSVGKQVTAEVTVWCWGTTDRFDLYYTTNTSAPSWTALTTDVACTGSGARTFTHTFNLGATAGNHAIRAQFRYGGTASSCTSGSYNDRDDLVFGVAAAVASAAPEKTRSVQGRSTQAAR

SEQ ID NO: 12244 - protein, 215 aa, Myxococcus xanthus
MDSIGHLGDNPESRAAAARFFTQHANAILAAASDASGSIGSAGAGKLSEFFTRTLFTEPSFEGQEAFHSFITSKLGDMQAQLEAEAHANPPSQDAQRLARSMGSLVGAIEGGFLLSVEELNKRNEAAEGMAGLIFKLKDLLPTSSIPGLGQLQNLTIDQIQNWVTEALKKKPDDPQDAIPFHQLFGEAISNPALRSVYDSARLTSLENRELGLNH

SEQ ID NO: 12245 - protein, 442 aa, Myxococcus xanthus
MPTAPSSDASAPRSEARPVEAGERLELLDALRGFALFGILISNVQMWFSGRVFPSREQFEASIASASLLDTITRYAFEVLVSGKFITLFAFLFGLGFAVQLGRVEARGGGFVPLYVRRLTVLLVVGVLHLFLLWYGDILSSYALMGFCLLLLRRRSERTLLIIAAVLVLVWPLLMSLLWRLPQLLADSPEAGAAVMAAAREKTSAIHARMLTAITGGSWWDVTKTSAGFYRDEFFTMMLAGLLTCLGRFALGLWAGRRGIFQDVPSHLGFFRRLLGWGLVSAVVGSVPGVVVTVLMQKKVLTPETMPVWLPLVLAPLRNLAQVGLAGVYLAGITLLFQRATWQRALGLLAPAGRMALTNYLSQTVISLLIFYGYGLGQVGKRGPFACVVICVGVFCVQVLWSHLWLSRFRFGPVEWAWRSLTYGKAQAMRRAASDTPAPLTA

SEQ ID NO: 12246 - protein, 324 aa, Myxococcus xanthus
MGAVLLGAVMGLGSLTRAEHLYLWPFLLAWAWLYRGGMPPRTLALRWGAALLVTAVVLAPWAIHNARVLRELNARTPHLEPLPVLAPVTVYGPINFAMANHATATGGFTPDSVNQMGQEGFLDVANSAQRHLLLHGYAEGLAWMRDYPADAARLWLAKLDRWLDGFRLGLGASNLPAGLNGARAPVDVFVPESAWLKWPLTLLLLAGAALSLRPAWRGFALFTAVLLHRALITVAFFGYTRGLLAVFPALIPLLLLPLVVLATRASTQRWATRLPAVAAAALLFFWVEAGVLALTAPRRFMASGSTDRASGKLIQDDWVRIWPD

SEQ ID NO: 12247 - protein, 187 aa, Myxococcus xanthus
MAEVQQPFLTDITEIRRRAREHLEEGAITEDYEGDVNATIKLLNDALATEIVCVLRYTYHYVAAVGIQSESVKDEFGTHAREEQQHALRIAERINQLGGKADFNPEGLLSRSASQYAEGQNLVDMIKENLIAERIAIQTYQEMVRYFANHDPTTRRMMEDILAKEEEHANDMHDLLVAHQGKPPLRS

SEQ ID NO: 12248 - protein, 219 aa, Myxococcus xanthus
MLPRVALVDPDLLTGAPAAVLASSGMDALSQLIEPYLSARANPLTDALAREGLRRSARSLRRAVLDGPDAPAREDLALASLFGGLCLANAGLGAVHGFAAPLGGMFDAPHGAVCAALLPAVLDVNLRALRARAPTHPSLPRVQELAALLTGRVDARAEDAVTWVDELRAALGVPGLGRYGLTEAQVPALVAKAKEASSMKANPLVLTDAELAEIASRSL

SEQ ID NO: 12249 - protein, 105 aa, Myxococcus xanthus
MSHSLLVVHVQVHVKQEHVDAFHQATLANARESVKEPGIARFDVLQDAEDPTRFVLVEAYRTPQAPAAHKETAHYLTWRDTVAPMMSEPRTSRKFVNRFPEDAGW

SEQ ID NO: 12250 - protein, 355 aa, Myxococcus xanthus
MDDNLGTRWSRSGRGSWVDYDLGSIQQVAGVSVAWHQGNTRTNEFLVSVSPDGYTYTQVYSGKSSGTTAAAETYSFKAVNTRRVRITFQSNNVNEWASIAEARACSSTTSTPTDPTPNPDPTPEQPPPGTGASVVWVGDFETNSRSQWSHTQMVSADRLALVSSPARQGRYALKATVRKGDDPINSSGNRNELVRMTREATGSEYYYRFSTMFDSSFPSAKTWQLFTQWHHEGNSGSPPVEFYVYGEEIRLNIGGNPGTIVWRTPLVRGRWLDFIFHVKWSPDSKVGFVELYLNGKVVLPKRYIATQYKGQLNYLKVGLYRNDTISPVGIVYHDGWTMARKLEDVISPTAVLKAP

SEQ ID NO: 12251 - protein, 497 aa, Myxococcus xanthus
LPVQLFTLQAFGYSSVVHLEVSEAREESGLVLMPVPRELVRYRHRWLRRAPPSRACTLSFDHPLWPQVHVRRQVLDLSYEGIAFLTEPGEDLLYPGLRQPVLEVATEGMAPVRLRAEVRNISSTAAGRRCGMSVRPLDAAGAQAWRALVEAQMHPATQVEGDWGDATWKLFDGSGYFRLPGKSPEDFEDAHPSFDATLARLEGRTRLGYRVVHPEGQSVGATLSVVKPYEGSWMAHQLARQPVKGSRTSAREALRDIYLRGYEPTQVDPEVKWFFAFCEARVRWVRFTKFDFATWYEHTGQTCLVPFQLMEAEVDGAWEIPAGIEVGTPTEAERAAFFQQVERTRPLAYREALDLVPERFDLKRAKERWGEAGMGRERELVVARHEGRPVVLAVLETAQPGLNLFNVLDGVRLVPLVDDATKEAQDAMVALLAHAADWYRARERKVFIHYVEAACVEYVERASLADLGEGKLWVISASLLPEFLEHLHEATTPPAGA

SEQ ID NO: 12252 - protein, 94 aa, Myxococcus xanthus
MLPGARWMLAAEHTKGKRSSTWDKHTKTRSGGKEKKDDRMRFSHGADDSNKEKKEEAKRKKEEEKRQKEEARLKKEEERIKREEDRRKKESAKK

SEQ ID NO: 12253 - protein, 99 aa, Myxococcus xanthus
MARGNADDARKLFLSLARQKPEVMGTRECGEGVRWARGLIADANFRLGQLEERAGARAAARRRYQVYLRILQRPALSLESRREANTRLRALSLKGRADG

SEQ ID NO: 12254 - protein, 146 aa, Myxococcus xanthus
MVPVAVLAREPVNIPNDGSGAGNVPRQEGRDRNFTNFGATMSIDRSSSGSQRNLRVGPQANGVGMPIREVTPDQEEMKRLSGKVLKLNGQMLYLETEPGAVVPLDLSALRIRKQPEKGQHVVAVYQVENTTENVALALAGEVQPKD

SEQ ID NO: 12255 - protein, 107 aa, Myxococcus xanthus
MRGVLATYSDKSRFGAAGLMLLLGLGVLLGAGSLALSAEPLIDDEWLAWPVGLLAPFVVGAVVAGFQKVKLWDWKFRFDLERFGAAFCVTTGFVLARFVGVPLLAGG

SEQ ID NO: 12256 - protein, 496 aa, Myxococcus xanthus
MFVRAGTLAPVDVRLVEASGREVRTRTVTTSEGTRVEFVSTEEAPRFITVAAPGGSGASGTYAYRLEDLGRDAHGDTLATATPLALTNTPFPLAIEFQDDADVFTFRTEPNQGFRFSCEGENVSVHLMDGEGAPVNGGATRNSSRVSAGQLSPVANTWFVRVYSSSDAALATQCQLDDLGQDDHANALQGATPLTAGLPVAVRLHGPNDVDVFSFFATAGHIYDIRFHPAVYERRFRLTDADGKTLAETQWNRIVHEAASTGTYYVHLLPNSSWGSDIEVRVDDLGTDDHGATPQTATLADVGETVTGLIHKQADLDAISVPLDADVFYRLSCTRACTLTTRTSGAPLYMMNIEDGLWHVHTPASGLVTFIVSSRSIPYDFTFKLDQASTDDHGDDAEHATPQVVPVNAAGVFELGSDVDVLSFELEAGRTYVVRGSRTTIRILDPLGAQVALAYERETGNQTFTAPSSGTHVAELKSENPYLPRETAWSFSLREQ

SEQ ID NO: 12257 - protein, 361 aa, Myxococcus xanthus
MKAVAVFPQKREVRVITDAPEPRIQSPTQVKVRTREIGVCGTDKEIIEFVYGSPPPGSDHLILGHECLGEVVEVGEAVRGLSRGDWVVPRVRRPCPHATCPPCRGGHPDFCITGDYTERGIKGAHGFGAESFVEDVAYLHRVPAELREVAVLTEPLTIAEKALRQLERFQDRLPWRAGPGRAVVLGAGPVGLLGAMALARRGYATTVYSRSPKPNVKAEASEAMGVPYISSKEVRPEELVRRVGAADVIYEAAGVAKAALETLKALGPNGVCILTGVPSKEEPFDVSPVLKDVVLGNQVLVGTVNAADVDFDMALEDLRHFQARWPGGLERLICARHSPEDFCDVVTGKKSGGIKDVIRFI

SEQ ID NO: 12258 - protein, 548 aa, Myxococcus xanthus
MKRQFYWPETNVLVTRFYTPDGVGELVDFMPMSGRKGMKEEREILRRVRVVRGQMVFRMECFPAFNYARDTHETKLIHSGATFSSDTLQLTLSSSVSLKKTERGVTASFTLHENQSAVFSLHPGARTSCEAVVHNHESSEELFRETVEYWRHWLSGCQYTGRWRETVQRSALALKLMTFAPTGAIVAAPTCSLPESPGGTRNWDYRFCWLRDAAFTVYAFLRIGFKQEAAAFMRWVEARCAEYDEGPLPLMFGIDGKRVPEEQELLHLSGYGGARPVRIGNAAADQLQLDIYGELMDSVYLSNKYAAPISYDFWRHLRRLVDWVCDNWELPDEGIWEVRGGQRQFVYSKLMCWVAVDRAIRLADKRSFPADRARWHKVRDAIFEDIMDKGWNPERGAFVQYYGGHALDAANLLMPLVFFLSPVDPRMLQTLDVMRKPPSQGGLASDGLVFRYDVEATLDGIAGSEGTFNLCSFWLVEAMTRASVARPDLLEEARLIFERMLGYANHVGLYAEQTGMSGEALGNFPQALTHLALISSAYNLDRTLGRRD

SEQ ID NO: 12259 - protein, 364 aa, Myxococcus xanthus
MASSLGGLVPASAAFRAGMSWPSAAPDFEVFLKGDEAPSPVTVHAAGEATLGFSGVGRLVALLAEALVDLGTWVDVAALGPGVGLYLVLPDPEARGFTTGKDPYEEDPDDARERIARLVDRLVKGTWQALGWPAWKGLVRAFPMGNVAFAQALAAAGEDLRASKVERALVCAVDSFISPETLTLLHQQQRLKTPGRPTGLMAGEAAVALLLTREETAESSMAVVRVAQGRDAAPLDGEQPPDGQELARQVLAALGPLGQDASAPLMVSDHDGQYARAFEWGMLQVRLRETDARFEQGAVWMPAKSFGHTGVASGAVATALVFRGLARGYAPTSSVLVLSSAEAGERAVIHLTAPGRSNPRLRRP

SEQ ID NO: 12260 - protein, 196 aa, Myxococcus xanthus
MAENGRRVQRLLADRGLPPPPARRNTPLLGALAAGHFSLAEAVAASSATQWQQGAEYEDEFLWAAALQHLTRTPSAPLESILAPLEKVGQEPYASRVAMARALVSRDAAAFAEAFAAACLDHGIVTEKRARSLATPVTSFAPHRFVWLEGLALLRLAERASIAPEDTSFRYCPPLARVPMTTTYSGDWAVDTAPTR

SEQ ID NO: 12261 - protein, 129 aa, Myxococcus xanthus
MAPPHEELKRFHDHKDVDLFVEPARFPELIAVLTARGYHRIWTRFDATSTHFYRYARHDEGGKVLLDVFVRRVPSVDAGGIRVVDPATLLTFYGDIHSTDDCVSVLAARRLLAKGHSPLGRVELVTQAH

SEQ ID NO: 12262 - protein, 234 aa, Myxococcus xanthus
MRLVIDALELCYARESIDTFVIGSGDSDFCPLAYKLRENGRTVIGLAVKESTSPLFVKACDEFIYLRPRQSRSDKGDKEKGRQSVSAEEAGHGKRGGRQGRDEKGRGDKEKTPQGGGKSQPKTEVPDIAREVVQSMLARATGPVNPSLIKEAIVRKEPDFDEREHGFSTFARLLAALEQQGLLRRIQQGRQWYVVAADFDVGGGDTKGKKRGPAHAAEEDDELESYPDPDEDEG

SEQ ID NO: 12263 - protein, 254 aa, Myxococcus xanthus
MERVEETLERIRLEAERAPGGVLAFDGDGTLWSGDVGDDLFLALLEHGDIRPEAHAALERLATAHGFEKSLPARELAHQLFAAFEAGRIPEKDIYEMVAWLFAGWRVDAVRAFAKDVVARHAVKQRIHPESRRVVEWARGQGIPCYVVSASPLAVVEAAVHEVGLDPLNVLACTPRTEDGTVLAGIIEPIPYAAGKVHCLRSRTSQPLYAAFGDNVFDLELLAASRVPVAIRPKPRLRARAAELPSLVQLHPED

SEQ ID NO: 12264 - protein, 336 aa, Myxococcus xanthus
MRVFHSLLPVVVAGLAVLGAGCKRESAARGPDAPLRLGFFPNITHAQALVGNAEGTFASQPGVGRLEVMQFNAGPAAMEALVAGSLDVSYVGSGPAINTFLKAGRELRVIAGAVNNGAVLVVRTVKTPAELKGKKLASPQLGNTQDIALRYWLKQQGLTTHLDGTGDVQIFPLSNPDILGQFLRGGIEGAWVPEPWGARLVAEGKGRILVNEKDLWPGGRFPTTVLVTTRQVLETQRPRVVALLRAHVRLTERWQEDPAGFTTAANVAFGRLTSKPLPAGILQQAFSRLEPSLDPVPQALATAAEHAKTLGFITDANIDGLVDLSLLDEAQAGAAK

SEQ ID NO: 12265 - protein, 253 aa, Myxococcus xanthus
MKHHAQKLLVIALLIGLWELVARMGIWSPHLLPRPLTVAQSLVAMVTDGRLVGAAGRSLGRLLRAYLMSVALGVPLGLLISRIPFFRNAVKPVVMGLQALPSICWLPLALLWFGLTDGAILFVVVMGSVLGIAIATEDSVNGVDPQLTRVASTLGVRGLRFQFGVLLPAALPGIVTGLKLGWSFAWRALLAGELLFVSGGLGQLLTVGRELMDVPQVMAVMVAIVIIGTAVDRVLFQTVEVRLRRRWGLTATT

SEQ ID NO: 12266 - protein, 198 aa, Myxococcus xanthus
MFQEAALFPWLTVRGNITFALAARGVPRAERRERADTYIRRVQLGGFEDALPHQLSGGMKMRASLARALAVDPAVLLMDEPFGSLDAQTRIHMQELLQSIWVRTGKTVVFVTHDVHEALMLGTRVVLMAPRPGRVVRDLEVHLPMPRQPEDAALNEMVRHVGGLLREVEGRAHTRSLQPAPTRAPAQPVLRPQVIPGP

SEQ ID NO: 12267 - protein, 107 aa, Myxococcus xanthus
MTHRHDLDQDIIAFALEKPARYVGLIGSNTKWARFRQRLEARGATAAQLARVRCPIGLEIGGKSPQEVAVSIAAGLLQLHHQGADTETTAEAPPSETPRMRGGSSGE

SEQ ID NO: 12268 - protein, 114 aa, Myxococcus xanthus
MKDVQGVKVDRTRAARRNRVPIFRPTLVTVHGEYPLFFQWATEEAEATRVKAQLEAAFANPGGKTVEFVRDDRNASLRVGGAFSGVGMLLLVFATWLGLRTRTHLRTEGASRAA

SEQ ID NO: 12269 - protein, 535 aa, Myxococcus xanthus
MRSTEGRAQVLEWLKDWESQVSHLSDAADLLWDDLYAELGLSRDERIPLTQVYSSKEVPRLEPVRAELTTTELPEDLSLEPLPRRRAFQDAARRKPRRKPPAPELEPGALYAFKLGPIDVGVDGRTSVYVAVTSEGEALPPVFGRRDAEGLEGLARDNPGLKRYCESRLARAGAGHGFASRPIPDSVTRFRAALALQMHWASVEPGLMVMPEVTEALLDATAALIRAEPWESWTNEEVFTVHLEGTVRGTRELSVMGSGGSEFGFALFDRAGSVERMSMSGLPGGNVDVLIPDSLGVTLEDAPDWVVKTVKDVTGLPFVPDVMRVQHNTPRLGNAEELVLAAAVAQALALARPEEREVNVELKVGDLHVRVRLEIPLPLLTGSYVGQLDLLSLATRRPKATHAPTRSLPTKKVSETLLEFAKPILEDVEDSEDPQAELFTCLALALSAWNAVVQDTWEPEKGWVERARATLKRMPRDVREMMLHDFELLVERKRRHFADDPRLLDALDIVQRPDDLSVRLAGVVTPGAWSEFVGV

SEQ ID NO: 12270 - protein, 259 aa, Myxococcus xanthus
MQTGDARLSRALSHAHPTVSTAALETGLLLGSREAWEHARGSASRGGLLALAVAGESKDLTGLLARLKDGSAPAEVIWAVGFSGRLLAAEALLPLLRDEAQGPLAAASFAAITGLPMVPPFLVEAPADEEEDAEEAEPEAEDLQAWLPSPRVLPGEVDAQAVEAWWTRRRGGFTEGARFLRGIPLTVEVLVRALETEPMRRRPSLAWEAALRGGGTPQMESRQWTRVQREQALPLRGQRPEWLARAGSWPQGRRGDTPA

SEQ ID NO: 12271 - protein, 154 aa, Myxococcus xanthus
MSATVGVNKLSVVHKDTGGTTIAFPDVCKTPSPAGPVPIPYPNVAMSSDTAKGTTKVSVDGKPVCVEDSNFSTSTGDEAGTAGGGVVSGKTKGKAEFVNYSFDVKFEGKSVARTFDLMLHNDKNTPPAPLLQGPVIALGKSDTKAKCLVCEKEL

SEQ ID NO: 12272 - protein, 69 aa, Myxococcus xanthus
MNAIAKDQIGRVKKLALKYDAISPQAKLFRCTMERRLILIREDVHAAFVQAGLTGFKVYVAEGWNGLEL

SEQ ID NO: 12273 - protein, 130 aa, Myxococcus xanthus
MSDLLISGRARQFIESLGITNAEWLPVVVKDHEGAVVGPDYAFLNLLGAEDAIDMARSVYEMNHISKDQIGLIEQLALSPDRISPDAKMFRCRTYRRLILVREDTLAAFQRAGLTGFRTYDAEGWDGVEL

SEQ ID NO: 12274 - protein, 60 aa, Myxococcus xanthus
MKDLVRPGKDMAMYCVQVSLSDEKDAIRFTDEEGEPVLALIGAMRFLRWLEEDGEVDEES

SEQ ID NO: 12275 - protein, 130 aa, Myxococcus xanthus
MSNLLVSGRARKLIESLGVTNAEWLPVAIKDHQGKVVGPDYAFLNLLGAEDAIDMERSEYEMDSLEKDQIGNIDALALDTSAIRPDAKMFRCTKERRLILIREDVHAAFEQAGLTGFKVYEAEGWDGLEL

SEQ ID NO: 12276 - protein, 424 aa, Myxococcus xanthus
MDTPVKKHPSLPRPIQGELKLDRSNQLLAEARRLVPGVTQSMMKRPEMFALGAFPVFLAKGKGALVEDVDGQEYIDFIGGLGANMLGHNDPAVVNAIREHLEEGVLHSLPTPVEVSAAQTLVDLIPGAEMARFFKTGADATSAAVRLARHITGKQKIITVGYNGWHDHFMFDTPGVPAALAALTLRMPLFTPPDEPALLASIEKNASELALVLLSVPYNRPLTPAFLQQVRATCTANNVLFALDEVVTGFRLAVGGAQEFFDVRADFVTLSKSIAGGMPLSAIAGPAKHLSRLSELQVSTTFGGELLSLYVCDAVLKGYRDGAYIQHLAHLGRKLREGVNAQAEAAGSSLRVIGYDAIPFFLFAKDPTEHAKQMQPFQAGMARRGILLRRDVTFLSTAHTEEQIDYAIEMTGEVLRSLAQPAAA

SEQ ID NO: 12277 - protein, 438 aa, Myxococcus xanthus
MWEPCGTSVRRLADIHPGPQEAAIQEGLHGDGLLFFTADDGQHGAELWTSSGTQGEGTRLLRDIAPGPEGSNPTDLTRVGDRLFFIADDGVNGRALWTSDGTSEGTSLVKRVLPIGAGQGEGQTLVAYKGRLYFSAAAPGGAHGNELWTSDGTDAGTHEVADLVPGEDSSFPRRFTVHDGSLYFVISVGEENWLVRSEGGAAFTPLLKVFEDTVIFRMKSVGGRLFFLVDPDEGEATLYVTDGTAAGTRRLRFFPGRYPHDLVPFQGRLYFSAGSDAPEGEELWVSDGTVSGTRRVKDIRPGAEGSAPAFLAVLGDHLYFAADDGQHGRELWVSDGTSKGTKLFADLVPGTEGASPTEVTAIQGWLFFGATTGHGAEPWVSNGTVSSTRKLDAGTARAPRAFIRSGWDVFFTAEDEASGRELYALPFRPANECTQTKP

SEQ ID NO: 12278 - protein, 239 aa, Myxococcus xanthus
MVRITLAGEDLEGFYSPGADDHVKLLFPEEGKRMPVIPTVTPTGLVLKEGERKPDARDYTPRRYDAAAGELDIDFVVHGTGPATTWASKAQVGDLLAVGGPRGSTFVAQDFSWYLLAGDQSALPAIGRILEELPEGTRAIVFCEVPDASEEQHFTTRANATVTWLHRNGVEAGHSDVLQQAIRGLEFPAGDYFAWVAGEAHTVRPIKDHLINERGANKSWVRVTGYWKRGTSDHHDAKG

SEQ ID NO: 12279 - protein, 581 aa, Myxococcus xanthus
MFAEEAFGGGWFHGKHNGSLVSCDGGFPESDHARVRMDLGSMLNVCPNAGGINLSGVPVLSQMFGVGGAVASEIIGEVEGTEGDTGLHLGRMSVPTQWPRWDTIAHQQAWEGWLQQAHQGGMSLVTISLVSNEFLCRALPYQNIKRPCDEMVDVDVQLQMARDFDARTPWAEIALSPAHARQIIASGKLAMVLSIESSKLFGTKNWQSELNRVYSLGVRSIQPVHQLDNRFGGAAPHNAIFQVSQFLENCHVDTDCGLTGNGFTLGFDVDANCKNTKGLTSEGRALVAEMMNKGMLVDVAHMSERSVDDTFAIAQSRNYYPMYISHGHFREVMHPGLAANEKTTPASIIRNVRQTGGMFGLRTAHDDTRDYTRTPVANNCQGSTRSLAQAYEFGRLGLKVNMGFGADLNGFIQQTRPRFGPHGACSAGFAAEAAFQAQQQLTAGPPPLGTDFDNYGLAHVGLLPDVVRDLKQLGVNTTGLEGSSETFIRMWERATGTRTGMADSAANIDTSGVAAYVPKETRAAQYPTSSTCTNDSDCASTQYCGWGLNAGKCQNKKAKGAICGSARECLSNNCRWTLTCG

SEQ ID NO: 12280 - protein, 51 aa, Myxococcus xanthus
MARSITDAGAFKIFMDEPMELGGRNGAPSPLDFILAAHAGCLTLKAATSEA

SEQ ID NO: 12281 - protein, 429 aa, Myxococcus xanthus
MLRTVIASTAALGLAAGCAPDSTAPVKVSALVLSSNGQYVPQEVELKTISDIVGLKGTVADLQGGARIVIDSQDPDLNNATTPEGYANALLKNAGRDVSANYISQGGVLWPADFHTWNMVTAYYSMERAYDYFRVVGNIPAADFKDPVTTYYFPEFVLADVDKDPLSDNAMYFSVLESFLMLPFDKLQRAPLAINAGIIAHEYAHRVFNLKAYNGQQFPEALSLWQQAGASPGANILKSFDEGLADYHAYGSTCQTTQGGKGCDTRFFSTSFHGNLYGQVTEDRDLARVDRCMDASLLNQLYNQNLSAFSGNEYRVGTLLASALYQAGEATGQRDVLLRAIVASYNDESTTTPGLYQLARATLADQSRFTLAVAASAIITHITDLRLKEAVCNELMDHLQIPREQLVGNDPNMCPPSAAGGTTCPRLDL

SEQ ID NO: 12282 - protein, 268 aa, Myxococcus xanthus
MLTQPGPVELETVVSCDWAVERGGLINLDHPTAKRAGLEDGDEPVQVFFHALRHPEKGLFIVDTGVETALRDAPEKAAMRGLVASAMNMEKMTVHAPLGEWLAKQQQPLAGVFLTHLHLDHITGMADVPAGTPVYTGPGEASDRAFVNLVVQGNSDRALAGKPPLSEWTYAREDAGLFDGAVDIFGDGSVWALWLPGHTPGTTAYLVRSTKGPVLLAGDVSHTRWGWEHDVEPGSFNNDADRATVSFKKLRAFAQAHPEVEVRMGHQH

SEQ ID NO: 12283 - protein, 58 aa, Myxococcus xanthus
MAQGQFSPLHPQITAAAIVGMGSRIPHWFEPGGPIAVETLAKTHAELALRMLGSVSGA

SEQ ID NO: 12284 - protein, 238 aa, Myxococcus xanthus
MTTPRTLWKLTTLSLMLSAPAFAADEVEQAQEDRGFALGLRAGYGVPLGHAAGSDLGETPKMSEVFKSAIPLQVEAGYFFNSNVYLGAYFQYAPVLIAEDCDSDVSCSANQMRFGINASYHFRAGEKLMPWMGLGIGYEMLKLNVSSSEDGVEATIGTGVRGIEFAALQAGADYRINDTFSIGPYLSLAAGVYQSSTSSIEMKNVPIIGDVSESESESIDNKTVHAWLSGGVRMQFRF

SEQ ID NO: 12285 - protein, 498 aa, Myxococcus xanthus
MRLHYVAGDRMAALNAFERCRRLLREELDTTPLPQTVALAREIERGPPAPKQVPPPTSRLPLSVLRPPVLVGRETEWARMEAAWEAGQTIFISGEPGVGKTRLAHDFAASRGNYLLLEARPGEQSVPYSSHVRLVRQMLARVPDPNLPRWVRRELARLLPDQAGQEGLPPPMADEADRSRFLEAQCQLVYQLAASMDAMVADDLQFMDSATAEFAVLMLSRRHAPEPGGRFPRFIDTYRTDELSPQATVFVQQLVTAGLAILVELQPLGSAAVGALLQSLELPGAEKLVQDVTRHTGGNPLFITETLKYLLETGGLERGWPEHVPASGRGQQLIQQRLERLSPSALLVARLAALAKTDFTLELASEVLEMNPLALVTHVAELEGAQILRGERFTNDLLFEVVRQGVPGALGTLLHRRLAVALEQRGAAPVVVAQHWLDGHEPRRAAPFLVSAANAEAAALRHLEAALLYHRAAALLDETGHADEAALVRGRVRNIPTA

SEQ ID NO: 12286 - protein, 349 aa, Myxococcus xanthus
MIPVRGYAAQDAKSPLAPFQFERREPGPSDVQIEILYCGVCHSDLHQVRDEWGGSRFPMVPGHEIIGRVVRVGDQVKKVKVGDMAGVGCMVDSCRTCPSCQEGLEQYCEKGNVQTYNGKEKDGQTATQGGYSEAIVVDEAFTLKIPENLDPAAAAPLLCAGITTYSPLRHWKVQPGQRVGVVGLGGLGHMGVKLAKAMGAHVTVFSHTDSKKQDATRLGADAVVVSSNKEEMAAQTGGFDFILDTVSAQHDINAYLRLLRRDGHLVLVGAPEKPLDVRPFSLIPTRRSFSGSMIGGIQETQEMLDFCGKHNIVSDIELISIQQVNDAYERLLKGDVKYRFVIDLASLRK

SEQ ID NO: 12287 - protein, 97 aa, Myxococcus xanthus
MTTTIAQAGFVQVTSPYPEEQELLDPALAAPTPQKAAQLRQKASHWLSRAQKELHDAIFARDGSEAGLDRYASARAELDSAETWALRVAEAFAIRRD

SEQ ID NO: 12288 - protein, 196 aa, Myxococcus xanthus
MVLAGAPPSDTDRERTLLRRARTGDPAAFRWLFERHAAGVWRFLKDLLRDEAAADEATQETFVRAHARLGALRDEDRLGAWLLGIARHVYLESLRHRGAHVDMDDEVHGSQVEAMLPTPTPEDLLLDRELEGLLAGALGTLREDRRAALLLRIDHGLPYEEISAVMGWSLQKVKNEIHRARLQLREHLAAHVGGHS

SEQ ID NO: 12289 - protein, 107 aa, Myxococcus xanthus
MPARPALDFAALESRLRKPVVPDAPKVNWMHWGKMLTAALASVAFVGITTLQVTRLPSADEPWPRNDALTTATRAVDWCDDPSREAVAALEARVGACLVASPLITLR

SEQ ID NO: 12290 - protein, 34 aa, Myxococcus xanthus
AAVLGGLGMWRAERAAQPVLVEVPFPEFAQLPAR

SEQ ID NO: 12291 - protein, 22 aa, Myxococcus xanthus
MQVVTFENGRLIDVQSAGYGSE

SEQ ID NO: 12292 - protein, 257 aa, Myxococcus xanthus
MRTASVKTWLLRCALGSLALSAPALAQDEDDPYAYPDEEPANDASDAYDRVRPKVDEADDFRRVSEQEYDDGEDGFKPLSGLDDPNLGVAVEFITGALFLDSPRGRAAETRLGLGVRATWEYGRILDNESLREALWADVRWTFGGTSDGTDFIRGKTHFHYFTIAPAYELKLGKSDFGFFAQAGGGIAYTSSTITIDTVETKVSGSKPLLQYGVGFRGRPRLTSSGNFRLAFRLEAMGYRRGYHNDFFLGGSLGTAF

SEQ ID NO: 12293 - protein, 1190 aa, Myxococcus xanthus
MHEPRLSELRDELSGIHHDARVRRMVELGRLAPTNPGVRELLGVLSQGDAFERYLALCAQFTWRDGGQVLSATTDASARVRSLAFRLVPLACDDAQALETLKMACAVRRQEGLLWGFMKTRRQAVIDAYLDWLATCTGVPDFADAVPLATSEGIRRHLPSALARPSVRFWSRMAHNAPGILAEVFAARLRAVTGEPDPVTRMYLNAYLHRIADQAPDAALELFELLLSRRIHPDAYDWHCLVLHRPEAAVSLLQRHEHAFPFEGQFARAAARLSMDSLVWLVRHAPSSLGDAKTLLPRLSETARRVVVEAWCATVDVAPVWGTELLRSISDVRERERVHARWSVAARNSDGVIALETVTALPIDLREREARRHLHEVVALGSRPEQRMRYACLLPWDEAEAALKGYIGHPDASVRGMALASLLAIPGLRPDEPALVDRALPLALARKNEQDPVRMLMLGAFVRWPRRVWRREHTEAVGRMLRDALDAADLSYQTAEFAETLLLRTFARAPEWGATWLATLLKERGRLFNARVGEYLTDDEVRAAAPQLLDIARGWAQRERGGPLLELVNSLGARVSLVAGLQELIVSMREETPWPLLALGMAQWQSKHDRAGFEATVGATVRRFLDLGWFSEVIALAHSEDAARPLHPELSSGLKRVALRLGKEAHSALVVLRRQAWAAFDGFLPELLKADASVICFPVVNTYLHRRRQELLTPYLSAPVITGRFSTEKTGWLLAFDDRGFFRWTARQSALYSHAVCRLVEDPERDTPTLLWGVSTLAALTWGTMEGLCTRVDDARPVVRERAIRVLGRCDQGQGVTTLLRCLEDARARIAIYGLRRAFNGMPPARVLSLLAGVPLTKVTVAKEVVRLLGELRVEAAYERLLELGGMSLHRDVRIALLRALWDHLEREPTWAVFARAAEDPDWVVASRLGDIPANRLTETSDRKLSALLGRVLARPEPEARIGLLSRAAYLPVRDVERAFLDACGARLTSPYDEEVSWAMRALLHRSNERDLERLEGMLEAVALDRRALNTAVTQLLAVEVKSRASYMQAARAAERVLSRDSRLAPLYIQCVMAARSPLELAETLVQMGEAGLLHADALEACRLVVSMLPKGELEAMEARLSASASAEARRVAVWCLVHDAAPGRGWTPERLGRLARLQQDASPLVSGAAQAIFPPREQAFSLKVPSKSK

SEQ ID NO: 12294 - protein, 273 aa, Myxococcus xanthus
MSNLQGKTLFITGASRGIGKAIALRAARDGANIIIAAKTTEPHPKLPGTIYTAAEEIEKAGGKALPCVVDIRDEQQIAAAVAKAVETFGGIDILVNNASAISLTGTLETPMKRFDLMHGINTRGTFACSQACIPYLKKASNPHILNNSPPLNMEARWFAPHVAYTMAKFGMSMCVLGMAEELRSDGIAVNAIWPRTVIATAAVQNLLGGEETIRGCRTPEIMADAAYAILTKPSREFTGNFCIDEEVLRGVGVTDFDKYQLVPGAELLPDYFI

SEQ ID NO: 12295 - protein, 461 aa, Myxococcus xanthus
MELGMAHGVSGFAWRNEDKPGAHVARMALFYLHNQADNGTSCPLTMTYASVPALRHQPEVAMEWLPRVSSASYDSRFIPAAQKSGATIGMGMTEKQGGSDVRTNTTKAHRLGEGRGPGQPYALVGHKWFFSAPMSDAFLVLAHAEGGLSCFLMPRFTPDGALNAIRVQRLKDKLGDWSNASSEAELHGAYAVMVGAEGRGVPTILEMVALTRQDCMIGSSGQMRQALVQAIHHTRHRVAFGKRLIDQPLMRNVLADLALELEAHVALTGRVSRAVDATPRDEKEAAFCRIATAVGKYWVCKRTPSFVNEAQECLGGAGYVEETNLPRLYRQAPLNSIWEGSGNIQCLDVLRAASREPASREALFAELLAAQGGHPAYDEATARLGKELANTDSLEVRSRTIVEGLALALQASLLIRAGNTAVSDAFCESRLGGAHGQTFGTLPAHAPMQMLIERAFSEGAK

SEQ ID NO: 12296 - protein, 294 aa, Myxococcus xanthus
MDISWDDARLFLAIAETGSFSGAARQLRIGQPTVSRRLAALEYAVGASLFRRGVDGAVLTAAGERLVLPAKKMAEWAGELHRAAESSDTSPRGLVRVTAAPYMCFDFLAPFSGAVAKKHPGLRLEVLSGIQYLDLGRGEADLALRARCPPNADLKRVYGVQIRNAVFVAKSLKAKLPKRPTLQQIPWVAWAPPFDATPPNPQLESIIPGFSPVFTADNYLVMLAAAEAGVGAMVLGDLRHRFVRERSLVPLDLDLGPYATSELHLVCAKSALDIPRVRKVSELLVEELEQAKKR

SEQ ID NO: 12297 - protein, 222 aa, Myxococcus xanthus
MLVLNQTRGHGEPALVVGMVEQVKRHYAVDARRIYVGGVSSGAVLTGTLLACYSDVFAAGMIGAGAMYKAATTISGTGFAMLFGSIYHPDDRGRDAWVCSGRPRHTVPVLVVHGTKDSVVDIVNGRQATRQFLQTSDYGDDGVANDSIRPVATQVTRATVPGGRAYTVEDYVYGGSLVARHIEIQGMDHAWPGGDSRYPFADPSGPDGTSIMWDFFRQHTRN

SEQ ID NO: 12298 - protein, 271 aa, Myxococcus xanthus
MPLLQLEELSLYFEESGEGTPVLFLHGLGSSGRDWESVAPRLTGRHRVIVPDARGHGRSGKPPGAYGVPRFARDIAGLCDALGLTGVHVVGLSMGGMMGFQLAVDRPELVRSLVIVNSGPELVARTLRRKFEFGLRLTLLKLLGPSVLAKVLAPKLFPKPEQEALRQRALEIFSANDPDAYLRATKGLVGWSVMRHLGGITCPVLVLASDRDYTPVSTKQAYVDLLPNARLQVLSDSGHASPHDQPDKVADAVEAFLAGVEDAAADARQPG

SEQ ID NO: 12299 - protein, 200 aa, Myxococcus xanthus
MHPRGTRAATLALAFATLGTAGSAAAQERRDGKRGDLNVFLRGGVGDYTGGLGDLTSTGPAWGVTLNIQPTTFLGFEVGYEGSRNGLTDSRLLEQPSLVRQGGSALVKVSPPFLTTVRPFVGAGLGVSHMNVRGPVEDLYQSDTMPEVPLAAGVEFNRGALTAGIRTTYRVLLSEGWADRAVEDTHGGLLDASLTLGARF

SEQ ID NO: 12300 - protein, 300 aa, Myxococcus xanthus
MASLQELACDEALVATGRAQAQAYARCLLQAALSVRLESPLPAGVTGMSHPTTRRIQMLFQPRPARAQGVSALLAALCLVLVPLAALSQGVAQGRAVTLAEAQALATSSQREGDLPVVVDAHVLARLNALTGSEKGRAFMKRALANLVTQREALSAPLRDKGLPEGLLAVAVVESAATNMPETDGRPSLAPGMRGAGVWMFIPETARRYGLEVSEARDERLDVARESQAAAALLSDLHARYGDWRLALAAYNQGTKRVDAALTAGGSRDVTALIGAGHLNDYAATVQAGLLILRNPHLLD

SEQ ID NO: 12301 - protein, 112 aa, Myxococcus xanthus
MHIVWRLGEVSVADVLAALPPERALAYTSVSTVLRILEQKGVVHSRKQGRGHLYSAVLPRDAYEAQSVRHLVETVFDGAPSALVARLVEAVPLSASDVDQLRKLLDAKGRKP

SEQ ID NO: 12302 - protein, 526 aa, Myxococcus xanthus
MGCDSQQTDTQVDVIISGCGPVGALTGNLLGLMGVRTLLLERDVAPHGEPRAFSCDDEGLRIYQSTGLLDLLQSDMRESRFAEYVGGTGKRFAEIHTGETDFGFGHTPLWFFHQPLLEGALRDGLNRFEHVELRKGVSVEAVVQDSDGVTVRYHDSFTGEQRSIRAKYLLACDGARSTVRKALGIPMSGRAYGEPWLAVSGTVVEGEVPEICRFVCDPKRPAFVATGAVNQIRWEFMMMPGETREHLEKSETISELIAPYVDPKRVRIERASVYTFHCLNAARWRHGNVFLLGDAAHTMPPFMGQGLVSGMRDASNLAWKLKRVLHGQSSASLLDTYEQERRPHVEAVQKLCVRVGHLFLARNPLVASARDALLRTLQRIPRVRKFIEGFEFKEAPAHASGYYFGDKGEYFIQPRVKLPSGEEVLLDDTLGNEFTVLCRGNAPSAELEAARELAESLGGRMMTFHPPAEAVDDASEDAPAVVDVTGKLADWFSKHAADVVVLRPDRFVYGAVRSRRLPELREALGV

SEQ ID NO: 12303 - protein, 301 aa, Myxococcus xanthus
MAFTPLNALNAFLVVGRKRSFAAAASELGVSASALSQSVRQLETRLGVVLLTRTTRSVSLTDAGRRLLESAGPPVEQALDALKTATARPGEVSGSVRLTVPTVAVTPVVTPILTRFLRLHPRVEVDLRVEDRLVDVVAEGLDAGIRMSEALERDMVQVRLSSSFRFVVVGAPAYLDRRGTPERPTDLLTHDCLCIRSETTGSIYQWELERGQRSWRVPVRGPFVSAHWKAHVELAEAGLGLAYVFEPSVAAELARGTLRLVLEPYAARVEGFFLYFPSRAQVSPAFRAFLDVAREVTAAPR

SEQ ID NO: 12304 - protein, 316 aa, Myxococcus xanthus
MRRFLRIFPLYYLALAVSFLVLPSLAGRLGLDERITTDGAVWYLLYFSNFYQLWVDTTHPILGVVWSLAIEEQFYIVWPFLIAAVSYRGAIRLCLGTIAMAILVRVGLTLYGASIESTYVVTFCRVDSLAMGGLLAMALRHPEGLGLKAFPWMRWAVWASVPVVLALVVLPVGPTFELVKRTGGYTAIAVLYAVCVYKAVAVSKGHVLYRFLTMRLLLTFGKYSYAIYLIHSPLDAILRRTVLKTPLKTVAGSDMPMQLVFYVVAAGLSLGLALVSWNLFEKHMLKLKDYFPYGQRPAPVPEGAQAERTEASARVA

SEQ ID NO: 12305 - protein, 398 aa, Myxococcus xanthus
MDFARELRNKNPEITAEEVRFAIQDKLRLERDGLDAHSPANTDRFISEAIAWVNQCYDEKAPPPTEADMQHWRAFAADLMSKNPKTTPEELKYAIIDAVRAKVTGTDAVTPENIDKFIQDAVKWVTQCYEDKEREATPAELKEWRAFAQEQLKKDPEISPEHLKYAITDAIRAKMTGTGEATPLNIDRFIEDGVKWVTQCYEGQERKPTAGELAHWRDFARKHQKANPDITPEALKFAIQDAIRVKATGMDGTGSTNIDQFIQDAVKWVSFCYEGQERDATPEEMQRWRAFANEKKKENKDISPEELKFAIQDAMRDEKMGTDAPASNRIEDHIRAAYGWLIYLNQAGPSQPSSEPTPNELHEWKKFAEKKLKETPEMTSEELRYYILDSLRTAMANS

SEQ ID NO: 12306 - protein, 151 aa, Myxococcus xanthus
MAAVKFGLPTDEDMTAVADLRAGSEPWKSRGETQEDSLKALTQLKPFIHVAKLQSQLVGYVTVERDGPVPGAAYLRNIVVKPELRRKGLGNILLEQALKAARDMYRKTIALRVDPSNSPAVSFYRKEGFTTVATVVSKKSGKLRLLMSREL

SEQ ID NO: 12307 - protein, 48 aa, Myxococcus xanthus
LADALERQDAKFPAALAPVVETCRELQTLAPQVATGLETAEREARASP

SEQ ID NO: 12308 - protein, 129 aa, Myxococcus xanthus
MKKPAVGSVGWMDLTVKDAVAVRDFYKDVAGWSATGLDMGGYEDFVMMPPGGGETPAGGICHARGKNADIPSGWMMYITVADLEQSLERVTAMGGRVLGTIRGSAKTGRFCFIEDPSGTACALYQSGSD

SEQ ID NO: 12309 - protein, 761 aa, Myxococcus xanthus
MTQPGLVRAFSIGRTVATFGGVIRPTTWNRGVGLLERASMPDLLVTHRSPHVRRIRVLAPLLWALASSTVMAAPAPETQEVPDTNGQPPTDAPTRERTKAEDAGRTVVTGSRRPRPARDVPATTTVLPRPEIDRSPTLTQDSLVRTVPSAATFRRTPSLVSDPTAQGLNLRGLAPSGVARSLVLLDGIPVNDPFGGWIFWRSLPRLGLERIEVVPSGGSALYGSGALGGVVQLVSRDITGTQLDADATYGNAHTGMLAARGAEMWGPVRASLEAELLDSDGYSIVSAAQRGAIDADTPSSHAVLNGRVEADATDSLTLSARAGLFREDQNGGTRLTTARVELAHFGAGARLRTAHGGTFTLDLFGRVQRFEQDRARITQDRSSEALAASQDVPANDQGASLIWTGPSWTALGTHVLTAGLDVRRMAGTSREQLFPPSPSETSLRLRDTGGTQLSGGVFIEDLYTPSPVLELSAALRMDVWRNQNGEQRLERANGAVDTTRFDDRTEQQLSPRLGLRVRPLEGLTLRASAYRAFRAPTLNELYRPFQVGTILTAANAHLGAERLWGAEAGVEAESSSLGLTTRVTGFWNVLDDPITNVTLEQPLPDGSTRQRENLGQARVRGVEASVDWKLARQWTALLAYTFVDPVVTRSPGQPGLVGKQLAQDPRHRGTAILTFHDPDIVTATVQLRVTGAQFEDDLNERPMGGYAVVDVSASRRLFWKLHVFGAVENLFDREYLAGRAGVDTLGPPLLARIGLRLRDAP

SEQ ID NO: 12310 - protein, 46 aa, Myxococcus xanthus
DEKALKQLLGSVKSGRVSVDDAVGKLKDLPFAELGYATLDTHRNLR

SEQ ID NO: 12311 - protein, 168 aa, Myxococcus xanthus
MGGRKVDLSIPRVLLTGPSDAAELLGGAAPVVSGWLGIQGGLRGALLLVLPQQDGAALEALLLEGQPAIHQTERDSVMAETANIVASACLSAMGRLTGWKLVPTVPTVRRGRARDVVSDAVGQVEGDASSVVVLEARFLATAAPPVGGQLLLVLARDSIRDLLARLGV

SEQ ID NO: 12312 - protein, 857 aa, Myxococcus xanthus
MTMDMSRYLGLFISEATDHLEALGRDLVELEREGSSSAVDSMFRHAHSVKGMASSMGFEPIAIVAHRVEDLVDAVRQDRGRLDRDLVDLLLTAADTMLAQVRAVAEGKQPDDSAALLTQLSQRVTTMTGQAPAATRVAKVTALKPEGGGSDGTGGGSDGSGTAGGSGTAGGSGTTGGAGGSGTTGGGSDGSGTTGGGPDGSGTAGGAGGSSGTTGGAGGGSGTAGGAGGSGPTGAGASPASTHGGGAAGSGTRSCVDGGSGAAGGSASPGVASGTGVDGAGPGPASPNLMNGGPGTSATSSAPNGAHGTSAPLSPDGATGGVVVPLSTRRASDVPGTDAGSAAPTPDLANSLKAAASAPLPETLAQRWAVRLRIAPTCQVPGVRAFLVHKRLTNLGTLVELRPALEELKAGRIPDGNIQLELETPAGEAGIHAALKNVAEVEVLSVKPAVAAPVVQPTLVPVPDGARASSDTASRTVRVRTELLDYFLDTVGELMLATARLREVGKVLPENTRPALEEGVYRLHTLVKDLHDKVMTARMTPLSLITDRLPRAARDIARRKEREVDLVITGAEIELDRAILEELSDPLLHLLRNCIDHGLEAPEDRAAAKKGPRGRVLVAVKRARDRVIIELEDDGRGMDPAKLKNAAVSRGLLSAEAAVRLTDREAFMLSCLPGVSTAKDITDISGRGVGMDAVKRVVENVGGTLEIDSERGRGTRFTLRLPLTVAVVHLLLVEVGEEVFGLPIAKVVGATEADGESLSRSRETALLPHGNSLLPVHSLDALVGVPAPRRLGARPFVVMDGDSGRVALAVDRLLGQEEVVLKPLSRPLDLLPGLSGVTILGSGRPVFILDVPRLLSA

SEQ ID NO: 12313 - protein, 122 aa, Myxococcus xanthus
MAKRVLVVDDAIFMRNMIKDIFASGGFEVVGEAANGLEAVEKYKELKPDLTTMDIVMPFKSGIEATREIIKADSSAVVIMCSALGQESLVMEAIEAGASDFIVKPFRAEDVLAVVKKVLGET

SEQ ID NO: 12314 - protein, 245 aa, Myxococcus xanthus
MSQTPSDNVDAKLKAAEDHLREVMLALPEVTEEFPWGHRTAKVKGKMFAILVLDNDGLGVTTKLPESNEAALTLPFTAPTGYGLGKSGWVSSHFKPGSEVPIGLLAQWIHESFRAVAPQKVLKALMAPGAAQAPKAKPAARKAKSAARKAKPAAKPAAPARTSAAAKPGAGAGKGGAAKRGVAAGRAVARTSAAGKKPASGKAAVGGKKSVAKPASAREGPTRRAGAKQTSTAKRGAAGSSRSKR

SEQ ID NO: 12315 - protein, 413 aa, Myxococcus xanthus
MGLALTGWMYASDGLINFVFPALSAGGKDAVRIGVAIIITGAAAALLPSWLARVTRVKVLSRSAYEISQGDLSKPVAAEGGSKRDEIDELTGAITRMQENLRELVGKIQETAKSVADTAIDLQRSAENVNGSTEEVGSSMEKIAGGAESQSQLVSKASKVITEMAGSIQRTTASAEDAARTTAETSSAAEDGSKAARLAGDKVKKVFNRIESASQQVFAFGEKTQEISKIVDAITQVAQQTNLLALNATIEAARAGEYGRGFAVVADEVRKLAESAGRSAEQISKLARDISGQSTSVVSAMKEGIAELAEGREDLTNIVRSMGAITDTIRKGSEKVHLISESAREQLKGSEEMVTAIEEIKLVARNNASSTEAIQAVIQEQTAAVSRMTSLASELTNLSVELQSVVRSFRLGP

SEQ ID NO: 12316 - protein, 315 aa, Myxococcus xanthus
MSGEFDFIRRFLAHFPAARVPVGPGDDCAVLPPSRGAQCVTTDAVVEDVHFTRAAFSPADIGHKALAVNLSDLASMGATPRWFVCALALPKDYPLRELTGLARGMAALATAHRIALVGGNFTSARELSVTITAAGELSRAPLTRAGARPGDLLYVSGTLGDARLGLEHLRAGLRRGAAVRRQRRPEPRVALGLLASRHASAALDVSDGLAQDLGHLCTASGVRAELEVERLPLSAAVRKALGPEGALAGGEDYELLLAVPPGRSRAFERACATGGHAITRIGHFTEGRGWVGRDRTGRVLPPPEGFDHFRPRAMD

SEQ ID NO: 12317 - protein, 183 aa, Myxococcus xanthus
MPTFRLKQDQAALLVVDIQERLCAAMDRDALDRMLSRTTAAIEGARALGLPILLTEQYPQGLGPTHSLLRMRVLKDVKAVEKLEFSAAVPDVLAALGGRTQVLVAGMETHICVFQTVRDLAERGLSPFLLTDAVLSRAQEDRQVGLQLCRDAGAHVVTVEAALFDLLGRAGTPEFKQVSAAVR

SEQ ID NO: 12318 - protein, 54 aa, Myxococcus xanthus
AVPFISEVKRTHTCGQLTATNVGEEVVLFGWVHNRRDHGGAVFIDLRDRDGLTQ

SEQ ID NO: 12319 - protein, 465 aa, Myxococcus xanthus
MKASWWLTALLLTAGAPRQESGAPAPGAAVSEVPGRPDDEALAGGGTTVFDVSHNAYGRALGNLAPTRWYQMREGKVLFMRDWAAHEEGLAGPLTNAAGCGSCHFKDGRGRPLPEMGPEAPLLVRLSVPAKDAPAGHHEPVYGVQLNDRGTADVPAEGTVQVTYTDVKGTYADGTPYTLRQPRYRINQLGYGKLAPEVMLSPRIPSQLFGLGLLAAIPDEAIHALADADDRDGDGVSGRPNRVVSVHSGKVELGRFGWKANQPTLEQQVASAFSEDLGLTSPLYPESNCTAKQEGCMTRVAAKGPALSRHVLERTTLYLRLIGVPARRDVLEPTVMKGQTLFQKTGCAACHQREFITGTVEDVPELSNQRIRPYTDLLLHDMGPELADGRPDGEATGTEWRTPPLWGLGLLETVNRQVRMLHDGRARSFEEAILWHGGEGARARERFKALSKAEREALVAFLRSL

SEQ ID NO: 12320 - protein, 120 aa, Myxococcus xanthus
MLPTPGWTPNCRPRTQTYAQCESACYANGYSNCNYCNTLCSLTVGFASAQLSSACLWQYNVAEPGVRLPNGQIVRADQIVLQEETSGPSNYPYLNFNRIDVQTTARSTVITGESLIPAGK

SEQ ID NO: 12321 - protein, 195 aa, Myxococcus xanthus
MLSGRPPASSYVLIDAENIDWAVSNVVGRKPESQDRVQFDRLVSFCETNFPAPVRCVVVLNARGEQLPDVMIGFVRALKSAGCDVALLYGRPDQKVVDLGILKLLENIRTQRPGAAVVLASHDGADFADALKPMLEEKRQVAVLGLREYVSQRFRELVPSGLKILDLELNAKVFNRPLPRMLPVNVDEFDPGLFL

SEQ ID NO: 12322 - protein, 472 aa, Myxococcus xanthus
MLDLPSFVEVVRSFSELYRVGIKVMDTAGDKLADVKVGHGDFCSYVFGFPEGRSRCTATVARVKDGPVALVQGARPARGDGAEAAGIIALPCFTGLRYLVMPVCWEGDTLGRVILGPFTPEELADFPPSLTDISGVDLSRAHELVARVRRVPERTAAQVLVHFGQVLAALVASGQRAFLATQLHIEAMLETHRDLEANNARLAQANIRLKELDRLKSTFLGTVSHELRTPLASIIGYSEMLAEGLAGALNPEQLLYVRTIVEKGESLLNLISSILDLSQIEAGRLRLVMGPVDLGSVIQTAVSSVAPQAQRKGVELEVRLPPLPQPRLAADADKLRQVVVNLLANAVKFTSSGGRVSVVMSEATAQHELAAPGYRVCVEDTGMGIREDQFENIFQSFYQVDGSSTREHGGAGLGLAIVKSLVEGHGGRVSVESEFGRGSRFTVVLPLQPPLSEHGGFSALAPTPSPSGHDRF

SEQ ID NO: 12323 - protein, 281 aa, Myxococcus xanthus
MSIASTPGTLPAFRVGPLPTIKPVVGREGVKLLRSTVSQSPTLQLNHAQRELTLKIVYYGPGLSGKTTNLRHLHAKASPEVRGRLLTVETHDDRTLFFDLLPVFFSTSSGFKVKVKLFTVPGQVIHNATRRIVLQGADAVVFIADSRRSATADNNAYWRNLQENMKENNLDPSQVPVVIQFNKKDLPDARTDAEIEESRRRGGEAVVGAVALRGEGVLETFHAVAQAAYRRLDMRAHLARNLGLTEAEFLGQIFRRMDLTGTALASMYGRAAGEARSGEGR

SEQ ID NO: 12324 - protein, 485 aa, Myxococcus xanthus
MRSGLKRNWAAFAVGGLLGAWVLGCGGSTTEGLESLEQGTAPPPSVSVDLSSVDLRTRLESIAGLTVLTDVEVNGFRFFTMDYEQPVDHLRPWGTRFQQRVTLMHRSETAPMVLDTEGTAIFEEPIPAEPTDLLQGNQLTVEHRFYGASKPADMDWRKLTMWQAAADAHRLVEAFKPLYGGRWLSTGVFKGGTAALAHRFYFPNDVHATVTYSAQHNRGLHDARHGRFILTKVGDAACRQQLASLQYAALTRRDELLPFMDGYDAQGFTFNTLGKDRAFEFAVIEVPFIFWQYYGMAGTCEGLPSPEASAEELFAFFSYVSTLEFTFSDQALEESAPLYYQGATQLGGPGYPEVHLRPLLRYAGEHLPTRFPPTGVRKQYEPWTVGLLEAWTRFEAKRVLLVYGDLSPWSASAFSTTTGNDAYRVIADDSIGFFGTLSALPEPQRSFLLGRLSEWADAPVQLPTGMDALRRREASDARMKAYRAR

SEQ ID NO: 12325 - protein, 140 aa, Myxococcus xanthus
MGCQMKCSEPVPDAGHALASLQRESPCVQVWRAAQVDVAFKEEPEDAVQQRTDTRLERRFTVARQLRGAYRHQDRWASVLEYEAGPVRGGVSYSLQVPDVLSDLTGQVVEWTSHREPASCPTKEDGEVPVLLSVDTCRHA

SEQ ID NO: 12326 - protein, 505 aa, Myxococcus xanthus
MGDDCAGEARSCVTFTAPDSGLYRVWVRAYAEGRGGTASLYRNGALLLSNQPFGGVPLSFAWNVKDTFRATSTTPGAGDHLVFLLRSNAEYLQHDDDSGPRSYPLVVAASTQNAGAQRVVVGRFPGSTGTASFVHDDALWSTIFSDNDEDEDGISNALEPLVGMNPDSKDSDGDGIPDTLELFGNDGFSFSEWGSPTVKDLYVEVDWMEHPTNPYLTRKPYAGLVADAAAVFARDAGVRLHAFVDSALPWHEVVCFGACSGGVDFYSLKQGGFSIGYPERRPYFHYAVWAYRQGSSTSCSSGKAEVLGNDLIISLGCWSSPSIQEQRGTFIHELGHNLALGHNGNDVAGQTSVVHASVMNYRYQMLGVGSPGSHTYSFGGNACAACSASPKSKCVSCRNGFLGCGFPGCGSCDCDVNEWGAVELDFLDDGDADDGTHRVLLAKYALDDKGGPVRFQPRVPHAEPPVAARRLKVERTRERLRARGQVEGQDFFVSTDGTTLYAECP

SEQ ID NO: 12327 - protein, 74 aa, Myxococcus xanthus
MEKERRYLAALNLVAKLATPPEPSTEDLRAGEVDARYQQALTVEQVKWRSLPPEEKSRQHDAFKEAFFRAEETR

SEQ ID NO: 12328 - protein, 214 aa, Myxococcus xanthus
MLLYELHPALVHMPLALLPTAAVADLISVTTGEGAWARVARRIWVVGSIGGLLAGVSGLAASQEVRLETPRARDMTFLHGVGNASVLLGALGVTVWRLRREPTAATVALGLGACGLALGTAALGGKMVYELGVGQPASMSNANAPALLSRDAPLLLVRDALRGVQWLVTRAREVLAGGRPLAKGAAGTAPEDESLRLPSPVAVFHGPGRPMPQA

SEQ ID NO: 12329 - protein, 260 aa, Myxococcus xanthus
MSIPLFKGTDVERLRRASQAAAGTLAFVASKLTPGVTTADIDQWVREDTARRGGKPSQLGFKGYPATVCTSRNHIVCHGIPNEGEQLVRGDIINVDVTTCLDGFHGDTSATFLIGEVSEDARRIVDVARRCRDAGIAVVRHGARLGDIGAAIEELAKKEGCSVVEEFGGHGIGHQMHGPPTVPHTGKRGSGIKLRSGMVLTVEPMVNLGRPDIRMLADGWTVVTEDGSLSAQFEHTILVTPDGCEVLTQPELALSLEIAC

SEQ ID NO: 12330 - protein, 514 aa, Myxococcus xanthus
CSKAGDRSELDLPESFSAWSRLSTTSETCVGTRCPQYETCFVTRMRKRAEQADLLVVNHHLFFADLALRSSGKRTEGVLPWYEAVIFDEAHALEDAASGHFGCSVSNYRLEELARDAVASLKEDDARHAMLRALAARLRAGADALFAQAPRALGLSGHEASVALRAEVMAKLSTPLEGVRDALAALSAFTVGEREPELAAITRRSDEMEEQLSFLEKAESSDHVYWAEQRGKGLFLRASPIDVAKELRERMYGALDTVVYTSATLAADSRFDFFANRMGLYGEDGQPVTRVRTLAVPSPFDYPSQAALYLPTHLPDPSAPGFIEEAAEEIERLCEVTGGRAFVLFTSLRNMVRAYELVAPRLPYQSLLQGERPKQQLLEAFRETPSVLFAAHSFWEGVDVPGDALSLVIIDRLPFASPGDPLVAARINQLQQRGEEPFEQYQLPHAALALRQGFGRLIRTQSDRGIVAMLDRRIVTKAYGRVFLDSLPPARRMEDVVSLSRWFNGPVRPVRTIR

SEQ ID NO: 12331 - protein, 170 aa, Myxococcus xanthus
MLSRGAAALLVVAALSLTTTGCAGRRREAFLLEKARNHVYRKPVAEVYPQALALLKEKGYSFKTGQGGFEATTEWLMQGAPSSLGTTQVRYLVRGIEKGPGQSSVEFTRQLVTQSAGAANTSGRAPDVSEPAVRADGGNITRDEALEWELVQRVDAESASALRAESEKIQ

SEQ ID NO: 12332 - protein, 48 aa, Myxococcus xanthus
MRIARVKGARREVRRELADISRAVLDLHRRDVPHGPSACPLCTALSRT

SEQ ID NO: 12333 - protein, 243 aa, Myxococcus xanthus
MARPADPHARSALVSAARREFARRGLKGARIEDITAACGLSKGAFYLHFPSKEALFGEVVGAFESGLMEMNGRRMARMEGFFQTHGIPGAQDRIERSDRYLRFLQLEKEHDLEALDWVWEFRDVSLVLTSGSQGTEFESLLWRVTDAQVERISHDFRRLQEAGAMDPELDARIFASIIVGSFLLLSTQMARLDEKPDLNAWANTLQRLCQEGTRPASPAPSKRVARRPRAAAEKPRKTPRKRS

SEQ ID NO: 12334 - protein, 352 aa, Myxococcus xanthus
MATAVLSLTACQKADASSSPPAKGSAQEVVPTVKVVSARTVRAAPSESVTGTLFPAQGLMVGFEVGGRLSVVRVKKGQGVKKGDVLAQLDPEIADAQVAQAEAAVAAAEAASTMAADVAARNEKLQQQGGVSEVAHRTASANAAQAQAQWMAAKAQLAQARASRRRHDLRAPFDGTLIDAPEQTGATVAPGTPLFNLERLDTLLLKTTVSEALRSQLEPGAKVRVESVGARVSSDEAVVRTILPSADPATRRIPVELAVPNADGRFVAHTLARAVLSLGQVQDAQVLPGTALSALNGDHVWVVASGQVRRVDVRVLERREQGEVVVLASSPLDSVVDHPTPGLSQGARVSVK

SEQ ID NO: 12335 - protein, 1023 aa, Myxococcus xanthus
MLSLCLVVLGLMGLGRLGTDLYPDVSFPVVVINTVYKGAGPGEIETQVIKPLEDAVAGISGVDKIHSYSRENVGIVVVQFKMTAPLDRAVQDVRDKVAGIVSRLPQDADAPVIGRVDLGATPILTYAVSAELPSQELRRLIDDRVKPALAQLEGAPEVRVTGGDTREVQIDIDLDKARAAGVSPLGIAQRVASENLDLPAGRLQLGASEMTVRSLGQFQNVDEIRDLPVARSATGAQVRLGEIASVTDGVAERRTLARLNGQDAVILEIVKQPGSNTVAVSEAVRQVMAQMGSVVGHGFQATLLINQSDIIQENAHEVWVALIFGGAMAVLIILIFLLDVRGTFISALALPTSVLGTFFVMYVLDYTLNQMTLLALSLAIGLLIDDAVVVREAITHRLEKGEDPVSAASNGTKDVGLAVLATTLALVAVFVPVAFMPGIVGQFFRQFGITISVAVLISLFISFTLDPMMSARLAKRRVPGEVRQENAVAAALRRFLDGTERVYESILRWVLAHKWTTVGLTLVLLVVSFGGASRLGMEFMPAEDRSQFFVDLTLPDSASIRETEARTADAEVLLRQLPEVTDVYSIVGKDGDVNKSRMRVLTVGKDARTKGIQVLKEDARALLEPGLVGTRVNLSDPPILEGMGDYYPIMVRITGPDLARVNEEAERVAGILRELPGTADVRVESNPPKPEMQVLIDRARASDVDLHAGALATQLRLAIGGDVVAKLREGITETDIRVRLSEKDRATPERVRQLEVYTPSGLRPLTDVARVEMKNGPSLIEHENRERQIAVYSQLGPGAALGDIARELKARVAAQPLPPGYALIYDGQMKNLDEQNDAFGAAFGLAFVFIYMVLASQFESYKHPLTIMVSLPLALVGALLGLVVTGFHLSMGAMIGIILLMGLVTKNAILLIDGALQNLREGDTVDEALLKAGPRRLRPILMTSAAMAIAMVPTAVGSGTGSEFRAPMAISVIGGVITSTFLTLLVVPVVFAGMERLGFKRRLPRDDAAAPPHQVEPKPGQAA

SEQ ID NO: 12336 - protein, 185 aa, Myxococcus xanthus
MPEKLVFEHTLEGLFVRGLGARVTPVLRERLREVGVDLERKLQPAYAFETWCFAVRVAARELHPDVPDDVGYALLGERLVDGYRETVLGRAAFGVIQLLGPRRCVSRARQMFRSGNNYTETRLDDVSPTEVDLWMNEAGAIRYFTQGALRAGLRAVGAPHAEVQVRAFTDEGVTYRLTWRNGHEA

SEQ ID NO: 12337 - protein, 153 aa, Myxococcus xanthus
MDRSAAAGIISRPLLGRLPLRRWVPQDLHSLMDYKGGTASVVAGVLSGDAVAKSAGIALGSTILGVSLLTDYRISLTKLIPIEAHEIADYAFGAASILSPFVLGYAKRSPLAAAIHVAVGVTTVLASLVTDYRCQTGMHLGGELATDPGAIGA

SEQ ID NO: 12338 - protein, 146 aa, Myxococcus xanthus
MMIRRPVADVFAAFVDPAITTKFWFSRGSARLQPGGTAQWFWDTYGVSATVNVLDFEPGARLRIEWGDPGAMTFVEWTFTALSPDRTFVRVVESGFRGDDKAVVARALDSTGGFNLLLAGAKAWLEHGIELALVPDHVPEDARHLV

SEQ ID NO: 12339 - protein, 97 aa, Myxococcus xanthus
MGRVTACEPPHLFAYTWAENHGDPSEVRFELTEREDGVLLTVTHVRLDGRDSLRSVAGGWHTHLDLLVDRLNGQRSPDFWEAYERVHAEYVTRPGFE

SEQ ID NO: 12340 - protein, 120 aa, Myxococcus xanthus
MKYLLMIYENEKAAEAMSEADVQRVMGEYGTFEVAIQQSGHFISGEELEPTTAATTVRIRDGKRLTTDGPFAETREQLGGFFLVEARDLDEAIGIASRIPSARSGSIEVRPVREFARPQD

SEQ ID NO: 12341 - protein, 349 aa, Myxococcus xanthus
MRVARNKAVDRMRRSARLEARVGELEAVAPSVDDAEWQTLPDDSLRLLFTCCHPALSPEAQVALALRCLCGLTTEQIARAFIVSPATLAQRLVRAQRKIRTARIPYVIPEPEALAERTEGVLHTLYLVFSEGYAATDGPALLRVDLCEEALRLARLARSLLPGDAEVASLRALMLLHHSRRRARVAADGGLVLLDRQDRSLWDGAQRDEGLAELGAALAMGARGPYTVQAAIAALHAQAPRAEDTDWAQIAALYARLVVLTPGPVVALNHAAAVAMARGPEHGLSLVDDLEASGRLADYHLLPAARADLLRRLGRKDEAASAYRRALAMVRTAPERRFLEARLLELLAE

SEQ ID NO: 12342 - protein, 480 aa, Myxococcus xanthus
MLGCGGVEEEVSAATEEARVQAQACAPGGTVYKVKDILPPDAPLPSPNVPVPDSLTNVQGTLYFGSDLYGDRATLWRSDGTSVGTVPVKEFIAPGPGYRGLSEFTPVGARLFFMVNASPFGRELWVSDGTGAGTRLVKDLEPGTASSSLSYLGQAGDVLTFFRNPSAGAGVSLWRSDGTEAGTFQLMAYGPDQEVSSRPLEVAGARLFTMSSTGAGTWLWRTDGTAAGTRRVKRLDAERIYISGWEHTETGVGVFTFWDSGAITEVWKTDGTPGGTVRLESFGGDVRLLGALGGHVYLSSVVGGGTSLRVSRVSLAGGGKETVTTLPNRYAGQPGAWPFAQMAVRAGGKLYLSVGIGTPGPAPREVSLWVTDGTAAGTRELSRGLSTSDEWASPLFDTGAGTLLFSTNEGGTGLEPWVTDGTPERTGLVADLSPLGGSSPEDFTRVGSTVFFRAYSNAWGDALWAMPTNVACPTQELLAR

SEQ ID NO: 12343 - protein, 90 aa, Myxococcus xanthus
QANGASLVVELKTVRDVSAVVVTESSPVAFWPFQKNDVIVRINTKQISRPSDILFVWRTGAPSSFEFEGLRGGTRLVFTGTAAEFPVLAL

SEQ ID NO: 12344 - protein, 56 aa, Myxococcus xanthus
IPISDDNPTLRTPVVTYLLLGTIGFVWVFIQGAGLDAYRLAASVCNLGMVPGELTG

SEQ ID NO: 12345 - protein, 262 aa, Myxococcus xanthus
MVRYGTGFTVDAVFFTHFHADHYLGIIGFLRTLGMTGRSEPIHLYGPPSAKRLLHQAVHLGVESMSFPVEIHELKDGDVVPRKGYAVHAVGVDHRINALGYALVEDDRPGRFNLDVARSLGVPEGPSFGKLQRGEPVTLEDGRTVKPEDVLGAPRPGRRLVISGDTRPCPALVKAAKDADLLVHESTFSDDEQERAVETRHSTAREAARVAREAGARRLVLTHLSSRHDTDPSKLLTQAREEYQGPVEVAFDGFTVELPLRD

SEQ ID NO: 12346 - protein, 251 aa, Myxococcus xanthus
MKATPLPGKKNFLAEAGIATPVPTIRGSIGAVAHEPFMAFDTKRLMDLLVAFTIGDFPERAGCSNYFNPHSPWYNVFYGAYGIRSYKRDGSPWGFTRDGRPDLDEMLEIPRLDYNFLTAGELGCPASKMCFEVLDVRQGREGPWHMAEVGCIIPSGLHRVQDAQAPDLTYYAVFGVPEEDYLVGGRESYEPVRMRGRMYFRPVAERLTLVWGGLCPDTPDGQRLMGAILDTMAPLYAGGMNAPRACGPQAA

SEQ ID NO: 12347 - protein, 92 aa, Myxococcus xanthus
MRGLRTLEPESASLFGEVVAYGRQMGCVMCAHVSDSTIARLQTARVASAAAADNNITVDCVSLEEAHSQLAKARSRYFLGATPEDAVEHAAR

SEQ ID NO: 12348 - protein, 188 aa, Myxococcus xanthus
MRLPRFPRVIGFDDGPFARRPGAAVPLAGVVCGGTRFEGLVWGRVRRDGWNATREVCRLLEGGKFLPQLHLVLLDGIAFGGFNVVDLPLLASRLKRPCVAVMRRPPDLDAVERALRRLPRADARWAKLKRAGPIHQLGGFTFQVQGAEPAWVAEALARVTDRGLVPEALRLAHLIGSAVVTGQSSQRA

SEQ ID NO: 12349 - protein, 67 aa, Myxococcus xanthus
MATGTVKWFNDAKGFGFIVQDGGGEDVFVHHSAINMDGFRTLQEGQKVEFEVGRGPKGLQAQNVRAA

SEQ ID NO: 12350 - protein, 113 aa, Myxococcus xanthus
MLTSCGPVPTEEQTQGGNDVTAEDHFRTQEAALTGDCFVQIECEGGNIKSCSGTGFACSANSANGGTVTCNGKSQSCRPIIQEPICSCRADGCCNQLCAISDPDCRFVPEGPK

SEQ ID NO: 12351 - protein, 323 aa, Myxococcus xanthus
MKYTQLGRSGLSVSRLCLGTMNFGWTAEEPESHAIMDSALGHGINFFDTANVYGFGENKGRTEEVIGNWFAKGDRRRERTVLATKLYAPMGDWPNEGKLSALNIRRALDASLKRLRTDYVDLYQFHHIDRATPWEEIWQAMEVAVAQGKVLYVGSSNFAGWHIAQAQAVAARRNFTGLVSEQSLYNLMARTVELEVLPSAQFHGVGILPWSPLQGGLLGGVLRKEREGKRRLEGRAKEALQKHRDRIERYEALADELGHEPGDVALAWLLHQPAVTAPIIGPRTSAQLDAAVHAAGVTLDAKTLSRLDDIFPGHKPAPEDYAW

SEQ ID NO: 12352 - protein, 269 aa, Myxococcus xanthus
MAKFRSIALLAGISVLGSACGAPESETQDTQQVSFEEFRAGAYQEPESGGFVVDGDIFLPTESELREFYEQSVGGIGTQQGALAVYYSGGRDIKWSASQALNLTYCVSTKFGGNYTRVVNAMKSAAAEWEAAANVKFVHVSAEDSKCTNRNNNVVFDVNQTNTSQYLARAFFPNSARRSANVLISTTSFQNISPWTLEGVLRHELGHVLGFRHEHTRLTSTGCYEDNAWRALTPYDASSVMHYPQCSGTQTGDLVLTSNDRSGARALYP

SEQ ID NO: 12353 - protein, 204 aa, Myxococcus xanthus
MRREHEGAAVRREFFRSAYLLGAPWDIGRPQQAFVQLWEAGAISGEVLDVGCGFAENALFLAAKGLPVCGVDMMEPAILRARETASLRGLDVDLRVGNALELATLGRRFDTILDSALLHVFEPGDRPAFAASLASVLRPGGHYHALYFRDGPRAVPPEALNATFGEGWRVKSIQEAHYEQTDPEGAQAWLATIERVPPSSSTED

SEQ ID NO: 12354 - protein, 363 aa, Myxococcus xanthus
MNSEGEDWLRKRRLVQPAFHRKHVAACGDTVVALTETMLQTWRPGDARDVHADVSALALDIVSRFLFHTPIDDEARHVADAVDAVMRHTDSPLRPPIWVPTPTNLRLRRALGRLNTLLATLVRRYREQPESRTDLLALLLSAPVPLSENQLRDELATMIMSGHETTADALVWAWYLLAQHPEAEARLVAELETVLGGRLPGAEDLPRLRYTEAVVKEAMRLYSPAWITSREALRDCELGGFHVPAGTMLAVSQWVTHRDARYFDAPESFRPDRWLSEDAQRMHRYVYFPFGGGPRFCIGSALAMMETVLITACVARRFRLELAPGCVVRPRPALALQPLGVWLIPRHRSHTTQEGEVRHAAGA

SEQ ID NO: 12355 - protein, 252 aa, Myxococcus xanthus
MIEAKNVSKRYGETLVVDGVTLSLPVGGVTSIIGPNGAGKSTLLSMMSRVMPMSSGNVWVDGLDVTTTPGDTLAKRLAILRQDNHISARLTVRELVTFGRYPHTKGRPTVQDREHVERAIEHMGLSALADRFLDEMSGGQRQRAFVAMVLCQDTDHVLLDEPLNGLDLKHAVSMMKRLRHAADTLGKSFVLVLHDINFASCYSDHIVAMRDGKVAFQGRPEDIMRPDVLRAIYELDISVQQIEGDWIATHYR

SEQ ID NO: 12356 - protein, 298 aa, Myxococcus xanthus
MALFMLVDVSGPWDFVLPFRGKKVATALLVGYAVAVSTVLFQTVTGNRVLTPAIMGFDYLYVLIQTCLVFFLGSTTVAGLDPRFLFGAEVIIMVAFSAMLHGWLFGMARGNVHLLLLTGVVMGVLFRSLSSFVQRVIEPNEFIFLQDRFFASFNDPEHDLLLLSAVLTLGVSVLGLRLLRACDVLVLGREAAINLGVDYQRTVSWVLALVAILVAVSTALVGPVTFLGLLVANIAYAVMRTYQQAFVLPAAALIAAIALIAGQFMLERVFRLDTNPRVIIEFVGGMVFIAMLMRKATR

SEQ ID NO: 12357 - protein, 250 aa, Myxococcus xanthus
MIARNRFVEPTTAGTAESASLGLLTATLLAPGLPVLGKMMVATVFALAGTALFLLVLRRIPLRSALIVPVVGLILGGIIDSATTFFAYRYDLLQTVNAWTTGDFSTVLRGRYELLWVTLGLTCAAYTAADRFTVAGMGETFTTNLGLNYPRIVALGLVIVALVTAMVVVTVGMIPFLGLIVPNLVSMVMGDNARRSIPWVAVSGAAFVLLCDIVGRVVRHPYEIPGGTIAGVIGSVLFLYLLLKRGARAG

SEQ ID NO: 12358 - protein, 177 aa, Myxococcus xanthus
MSGKDFIASVIANTEMLASVFGKEEKARGLIEDLRKSVADLQQMTATRGKGLVVLVTGGRMSAYGPGSRFGVIHGDFGVPEAVEGLRTSLHGESISAEFIREKNPDWLFVIDRDAATGQKEGNARQVLDNELVRQTTAWQKNQVIYLDPGVTYLTGGGIQSVKQLRDQVASAYTQAQ

SEQ ID NO: 12359 - protein, 459 aa, Myxococcus xanthus
MGGSMAGLLSARALADHFEKVVILERDSLPGMHAARKGAPQGTHVHVMLDAGHRLLERFFPGLLQDLQDQGAALIDSSRDVAWHHFGVWKSRVPQGLPLLVCTRPFLEWHVLRRVLALPNVEFHGGVSVEGLLTDASHQRVTGVRLKKAGVEEPLEAALVVDATGRGSRAPQWLEALGHARPDEEQVRVDLAYTTRLYEPPAHRQEDWKVLMQYPCPPVNWRAGFISRVEGDRWIVTLNGYFGEHAPADDEGFLAFARSLPQPDLYACLREARPLGPLTLHKVKESRWRHYERLARFPENWIILGDAVCAFNPVFGQGMSVAAQGAAQLLACIEEQARRFPTTLDGLAQRFRKRLSDTIRLPWFMGTNIDLQYPKAVGQRKPGVGVLHWYIRRMMERSSRDAAVHRQFNRLLHLQAGLGAVLQPSVALPVLADGARALFMPLHARANTDIRPAPPSSSP

SEQ ID NO: 12360 - protein, 107 aa, Myxococcus xanthus
MKTSRLIASLTACLSLSLIACGGGEANLDVPEGEAPVSVEQGLGYPPHCPNGDLIYWLENVQACTAKCGNTRQNGQPATQYAACQSNITGTRTLINVRYCIPGCELL

SEQ ID NO: 12361 - protein, 225 aa, Myxococcus xanthus
MLVVHGERYYTRGLTGVKPSSPKPFVTQPILYEWAWGGTDTHDADARKHVSDMRNPIGQGVASREARLVDQPAHRIEYLRGHPAKSGPAGFGPIASYWSPRLELAGTFDEAWRKTRHPLLPRNFDERFALCAPADQRPSRRLVGGEKVALVHLTPKGSLHFTLPRLSFGFATYFGAVRRFHEATLGTVVIEPEVKKVRMVLQTGLSVGPRDVDRLDFTAITERTD

SEQ ID NO: 12362 - protein, 174 aa, Myxococcus xanthus
MGFAPGEAAAFVAVMATPDTRRWRLAPHATVRAATTAHETKLIHSDDLNLGEGMTAAVAEALAPLEGTREVVEDVHSDLNGERYRAEEWGFVALRLGAAFRDAAAVHTPVSSCGEVGAATGALNLVICAQAWQRRYASGPRALLWGSSEAGLRAAALLEEPLSGSEEGAKPWPR

SEQ ID NO: 12363 - protein, 115 aa, Myxococcus xanthus
MYVGLEEFLYYEAFKELRLPQLPFRRKFSSPDDAAAAARYRADAVTALAEEKGFKRLPPVEHCALYERGDAALLLYRHPTQPTFSFILGCEDSAEMERLAQDFETRTGLKSVITR

SEQ ID NO: 12364 - protein, 79 aa, Myxococcus xanthus
MVRILREAETPGASVVEVARKHGVVEQTLYRWRQKFGGMEAGDATRLRELEKENARLKKLLAERDLEIEVMKEISTKKW

SEQ ID NO: 12365 - protein, 120 aa, Myxococcus xanthus
MCANGQKLKCLTVVDEHSRECLAIDVAGRISARRVIEVLSRLVAVHGPPKYLRSDNGPEFIAKALRRWLEANGIQTAYIAPGKPWQNGTNESFNGRFRDECLSAEWFSTRNGISSAAGLS

SEQ ID NO: 12366 - protein, 150 aa, Myxococcus xanthus
MEQSGAMLFGRNTYELMEGAWPAVARDEKAPRAMREWAQKLEAKAKYVVSGSRSDFPWQNTIKVEGDLREAISALKAKTERGVLVGAPKLAAALEELGLIDEYRIVVHPIISGSGPTLFHGLSSARHLELLSTQRFKSGVQALHFRRKAG

SEQ ID NO: 12367 - protein, 85 aa, Myxococcus xanthus
MIRPQQKQLKEHRALLSALKKGDEVVTSGGILGKIHLVDERTVTLEVSSGVRIRVLKTAVSAKGAVAEGTPAAPATAAGEKKEEK

SEQ ID NO: 12368 - protein, 434 aa, Myxococcus xanthus
MTEGMGRTERRRALGGYLTGLLLDGERKSIEPMAARLVEAPEQTEAMRQRLQQCVSGAAWDDSEMRRRLARQLECELPGLEALVIDDTGLPKKGVHSVGVARQYSGTLGRTENCQVAVSLHVAGEKGSGCIAMQLYLPEEWTRSRKRCKAAGVPSGVKFQKKWQIALSQLDDAMAWSVRRHLVLADAGYGDAREFRDGVRERGLHYLMGVQGTHKVWPPGAKPRQPQRAPGQNGRPRTRYVAEGVQPWAIEELALQLPKEEFQTVYWREGSRGEQSSRFAAVRVRTAERHVQRAPPSEEVWLLIEWPQEEKAPTKYSLCSLPANTPLKELVRLSKLRWRVERDYQELKGEVGLDHFEGRGWRGFHHHATLCMVAHGFLALRRALFPPEESTLDTARSAPPPSAPAAAPHWPLPTLPAPHRRPRTSSGAVTHVTG

SEQ ID NO: 12369 - protein, 110 aa, Myxococcus xanthus
MVEPINDAAGKTLVAAGSEVDGTMTELQPSTRADKPAAIRVNFDRLTTRTGMEPIAAEVVEAKPEVNQSHGRAEMGAAIGGLGGLAAGAILGHPFTGAVIGGVLGAGGWR

SEQ ID NO: 12370 - protein, 191 aa, Myxococcus xanthus
NVEITMYFKRVSDSGINWGGMVSFARTNHGTTGSENRDKCDTRGIGARMRYDGKIDFEKETNHPDSKYVVQKKYWSSSLPKNTWIGHKHVVYDLPGGKVKQELWIDLTDGVNGGQWTKINEFIDDGTQFGKGGSPCASGIDPALPLTAGSSRVGSESGKPNITVYFRSDGVSTDGLWYRWGSVREIQAPST

SEQ ID NO: 12371 - protein, 45 aa, Myxococcus xanthus
MPEPPVEENVCIEETAAETICPPGTMPAIAPTPVPTALAALLRPL

SEQ ID NO: 12372 - protein, 204 aa, Myxococcus xanthus
MKKLVGVFATIAMLGTGTALANNDGNKPKDSSAAQGGSGQVGQSEIQQDTTIGRGTTTTPTAPGQGGSGTMGQKAPMGQKELNGRVVKAESDKIFVDMHGAVVPLEVDRSTRFSDPTLKKAKDLRPGQEIRASYEVKETKNVAKSISLSGTGGAGDPTLTPDSSINQDNNKGGSGMEQHEGTGGAGDSSTMNPDTGSNTSPDTY

SEQ ID NO: 12373 - protein, 151 aa, Myxococcus xanthus
MGLYFERRGGTRIGGRIYALLMLAGKPLSNKRIAMLLNVSAASVSTNLRACTDMGLVEPASVPGDRQHYYVIHSQGWEGKLRVAEESLSAFGRLCSEALAVPRLAGNRSLREASAFCDFYKAELTGIAERWRAANAPRPPRPVKTSKGRTA

SEQ ID NO: 12374 - protein, 247 aa, Myxococcus xanthus
MNPTASQSSIVSITNVTKDYTLGKVVVPALRGVDLEVHAGEFISIAGPSGSGKTTLLNLIGCVDTATGGVVRVAGQDTKQLTERQLTNLRLNTIGFIFQSFNLVQVLSVFQNVEFPLLLQRKLDKAQRRERVMQLLEQVGLASHAKHRPNELSGGQRQRVAVARALVTRPQLVLADEPTANLDSVTGQNIIDLMKELNQKEGTTFIFSTHDAKVMSHANAVVRLADGKFLDRISAAEASRAMASGGH

SEQ ID NO: 12375 - protein, 255 aa, Myxococcus xanthus
MLSAAALAVALLSAPAALALEQAEQVKLLATIDDRQRNGGDYKAMVYLEQKEKGKADLVYELVVYRRDEDDKLMMLFTKPKTEAGKGYLRLDKNLWNYDPNVGRWERRTERERIAGTDSRRADFDESRLAEEYDPSYEGEAKLGKYTAHLMTLKVKPGVDVAYPVLKVWVDKASGNILKQEEYALSGRKMRTALYPRWKKMFSESKKDDVWIPEEMRIYDEIEKGNSTTILVKTVDLRPLEANLFTKAWLESKSR

SEQ ID NO: 12376 - protein, 399 aa, Myxococcus xanthus
MGEQQEAKQSGGKGDTRVEPGMVRFELLHEDTSGTKARRGRLHTPHGPVETPIFMPVGTVGSVKGVGPDDLLTLDAQIILGNTYHLMLRPGEALVGEMGGLHRFVSWNRPMLTDSGGFQVFSLSEKRKITEEGAAFQSHLDGSRHFLTPERSIDIQETLGADVIMAFDECPPSTENRAYLEASLARTTRWLHRCVKAWSRERSSLFGIVQGGLHEDLRKRHAEEVCAVDLPGYALGGYSVGEAPEAMHDGVAYSAPLLPRDKPRYLMGVGTPVDLVTCVEHGVDMFDCVLPTRCARNGLLFTSEGKVVIRNAAYARDNRPVDPACSCYTCRNFSRAYLRHLFAAQELLAMRLNTIHNLHYFLGLMAEVRRAVAEDRFATFAREFRARAKAQEAERTRGR

SEQ ID NO: 12377 - protein, 538 aa, Myxococcus xanthus
MTPRTLTLAAALSAALTGTPTWAQSEERPDEDALFGGGQEKTPAEAPAGEESGRPDEDALFGGDGSEPTVDVAPGTTGGATERQPPLTAPDENRDADVLNGPATRSAFDTEDVVDDPLKIGGQFYLRGFMAGSENTSLRQTSFSAPTLVDGYLDARPSDRIRGFVVGRLNYDPAIPPRTTADAPANPRVLLDQAWLRFDLERTVFFTVGKQHVKWGTGQIWNPTDFLSPQRRDPLAFVDLRTGVSMLKVHVPWESKGWNVYGILVMDDLGTDVGAITDPSGSPTSQAGGSDPVNRLGRLGGALRAEVLLGPAELGASAVAQNGRKPRFGLDVSSPLGPLDVYAEVALKEGTDRPLYRIPEGTTLEDIAQNGVQVEAYIPSRLTPQMTAGATYSFPYGENDLAVLGVEYFFNSTGYTGSFGYPYLLLKGAFNPLYLGRHYGAAYLFLDRPGPLERTSFNLFTLGNLSDRSFTTRLNVMHRALTYLTVEAYGSVNYGRRGGEFRLAVDVPEGLVVDGQPIPAFSIPAPTFQLGAGLRISL

SEQ ID NO: 12378 - protein, 444 aa, Myxococcus xanthus
MRLWIAIAAGWGLGQLPNAPVMIPPEDPSIRDPAAAALQDANQQAAEEIEGLRPPAGYVYEAPEDASPRDFVLTPVLPDGAPPPMPGQVATEEAAQRYEPVPSPLEALQQEQAAMGGSGQQTGADGTSTGQATTGGTTSGAGGSGVTGQDVSGSGTSTGNTGTGGAGTTGPQQDGSGTPPENTVPAEQQNLGNTGATAAQTAPQQGTPTGQSGTGTTSAVPSPAPATPAFIGRSEPIGRSEPIGRSEPIGRSEPIGTPPTVAPANNPMGTGGAGTPNTNQPTPAQQMEQLNERVKQLETQLNERDADLTVRNQAVQLQVDTYGDRAVDVEQARQDRLTQIQTASQWMLAADTALEQGELDVVNALDIADNAFVDLRDSAEEDGQGTVVVHAERVRALLNLARNFVNNRDGYNARLALQEAGVQLSILRAANLERQATGNVLLNP

SEQ ID NO: 12379 - protein, 1089 aa, Myxococcus xanthus
MGEDGGVPESGLAAADGGAEDGGALAAADAGTEDGGTLAAGGTDGGEQDAGATYLMASDADDDGGTVLGGGQSVFAGADGGFNYTYAKSLGDKSGGVRFYFYERERMVAERAAPLIEEAYRYLVDQFKYVPTKTFPYILYSSYQEFLQTNLFAVSEGTLGLTSTGEDLKLTLPYLGDHRLFEEVSTHELAHQFTIQKVRTVAEQAKMFGDPLQAIPLWFIEGLAEFYAKRGMDPEAEMLVRDLLVNPDLFKGYAFLDFFSPGPYGYLWIYKVGQVRVSFLEEEYGAGFIQRVLEESPRLAGGSRDSPSLKFEELLERLTGDNPKRISARFENWLKRRAFKTYLASEQSAPALDLLDKAPGYTTAMASSPSGNVLGLRTIVPETGESRLYIMDPRVPDKTVKVAGDGVPGVESLHPISGRSFALTNDKLAFIAEITGRDVIYVQDYTHKSERRGADVLVRRNAIRTGIDREVGLVVDLSLGGRTAYRIDRHGLLAAYSPAFSPDGRWVAFIGINDAGLRDIYAIDLQAGPDAPPLQLTDDVFSEREVTWGPSGIVFTSDATSHRQFNLFRVRPDAPRQVERLTSEERDHTAPVALADGRLFFTAFNNSSSDLHELTKDGRIVRRTDLTTGVFEPGPGPDGSLWMLFHVSGERRPAVLRPPRMLALDVPAEPPPEPPNPLAVRPLTDAQNYEPFTRQNLEFGPFFGFAGAGGGGFVGQLFAAASDRMKDHQFLLTLAVYGSFDLTDGYLLYVNDKSRTTWGGGIFQSLRFRVDRTFEGEEGAQNAFFTSGERFFGALGSVRYPLSTFLFVQGDLAIGGTRYFLDDYTEFELFFPERNAANRELLTAWNARNRAIRFQTELSGQIGYDSLKYHYATGPLSGSAAMLETTVGVQPFDNQAYGNVRVDAERYFPIYGRANIFIRGGLGTTLGGRYARSYFLSSFDTLRGVNFGDIQWLLGRHYVYSTLEAQLPLNDIIRVAFLSDLEAIAAIDAGGVGEGRDDLWNHRVVNGVVGFNLALGPLLLRLHFARPFDVGAAAGRPDPGWVTNFSLGIAGLNGFFDQANTGKSVGPSPTPMSPALMPSMGGGYTAPRR

SEQ ID NO: 12380 - protein, 517 aa, Myxococcus xanthus
MPPVQTSVPQYELIIPEETMRMFEADPWTPEQDGLFKANGTTYRVQVRLRGASARFFPKKSWNVSFEDGVRFEGRTSLNLVAEYADATLLAEKIAFDLLEAMRVPASKGTLVRLNVNGAYQGVFLEIEQVNKAFLRAHSYADTDGTIYRCGWKDCEFKMAKVPYQGDWAKKTNESQPDDKLWEMVGAINHTPEPQFVSEMEKRFELEHYLRAMVMDALMSNNYVEDSESYFIYDRAVARWSYVPWDLNNVDSRWWYPISVEEMSQSTRNMRHPLFSFTLTDAWVAKMYEQRKLETASYPGYLPVFSNLATRVVMNPVLRERLEARLDKAMDELFTSEVMGAHIDKLHALIDPHMRDDPFMDYGRFTAGRAYLKRYVRERRDFIFKELERLAQQQPTLVLEAVHPREGWVEVGNRTSAPLSLAGMVLTTQLRISLAQSPSHLHTQVRAPFGAVLPELTVAPRQRVRLNAAQLGIQMPANGEIGLFDGRSVVGVKDLLFYGDLGAGKRYERGSRGWEVR

SEQ ID NO: 12381 - protein, 136 aa, Myxococcus xanthus
AIDLSRYFDLIKEAQVVRVRGRVTELTGLIIKASVPNVRVGELVLIKSRNRGAVKAEVVGFQGDEVMLMPLGELHGIGPDSEVIPTGKPLSIKCGEALLGRVLNGIGEPMDGHPLPEEGLIDWSVDRDCPDPFTRQ

SEQ ID NO: 12382 - protein, 192 aa, Myxococcus xanthus
MNAEVFEARQGASAILEEAQREKERILAEAQREREDLLAKTREQGRQEGLAQATEIILRAKMQAGEVLTGHEQDVIALSLKVAEKIIGRSLEKDPELMVELCAAAIENLRSARSMILRVHPKTAAVLRAKKPVLMELIGRAVDLAIKEDPEVAPVGCIVQTEFGTVDAQLPTQLEMLQNILLPDTARKEGPA

SEQ ID NO: 12383 - protein, 727 aa, Myxococcus xanthus
MLLLTAVTFCGQESLGALEHLPEEEGALLRHRAQELLQVPREKRIPALVQEIKRLVKDRRGQLWSAEPERLAALLQRERGALVEVVLRALPGTLAEAVRAHLPPSRVKLTREVRPQVLDIVRWKLEELLAREVAGQQAAGFKFADVLQLQQRELLTMCDRLGARVLGPALAGLPDAEREAMLEQLPPDLKLLATKAVAANAPRKLPEEDARAQLEPHEGLTRPSVALRSAGAQRLARACVAQSPEFAARMLEKYRGEFGSLLAKWVREERVRPTARGDGGRTDIVMDLERLATRGLIERPVRLATPPPPRQSAVLPPPPGARKAAAAAAPPAAKAAAPGGAAPAGAAPAKAAPAAGAAPAKAAAAGRDVPTRPPARGQAPGAARQGAGAPARRDFMAERAARNAGVLSSREPSRVATPAKRQDGSAVQRMPARREPANEGGAGARREGEGPDTRPPRADPEGARIGPPPSRLGQRGARPRPQDPDTLSERDRARVAEGSRVHSRPPDERSRVAEGSRVQAGGQGERSRVQAGAQDERSRVAEGSRVHARPADERSRVAEGSRVHANVPDERSRVAEGSRVQSGAPDERSRVAEGSRVQARPADERSRVASRGQQRPAEEPPRAARMKFGAAEPEREVSEVSRVFRSRASGTQGGQGGGRAKPPEAEPEPERPPRVLVGRAITSPALAPMPKPRGEGTSVQRRPRSPSGTDRPVPPGAGGRGTKGGTR

SEQ ID NO: 12384 - protein, 165 aa, Myxococcus xanthus
MLLKAMGGEVSNALNQIDGVLEARAIVMIPENNDLTQPENKPMPSASVFIKYRPGEGGKPPIDTAVVQQFAATAVPELKASAVTVLMTQALPPSAETDAESRLQDVLGLRMTAASASQFKVMFAGAFVLVLAMLGLTMWTFMRGGSSSAPATRAGARTRGRPPEA

SEQ ID NO: 12385 - protein, 70 aa, Myxococcus xanthus
MMTQIVGDLEKGQVNLEHIIKQASSGKAFSNAELLSLQASMYQYTQQLDLTSKVVEKATTGLKDVVKTQV

SEQ ID NO: 12386 - protein, 112 aa, Myxococcus xanthus
MGHFDKAKEIFSGAAALMPRSEVPQLALGAVEFSQGRHDKALQAYRVAQRLAPQSGLPRAHAGEALLFMGKVPEALKELKAAMDLDPDGDGARLAQSLIQAKEAGVLPPAKT

SEQ ID NO: 12387 - protein, 238 aa, Myxococcus xanthus
MFASGLEAEIQEALGGGEYRVRFHAPPGASLAALLDAAGRLPLPPYITREPDAADAERYQTVYARASGAVAAPTAGLHFTQETLAALAARGVHRALVTLDVGPGTFLPVREDDLDKHHMHPERYTVPEATAKAINAARAEGRRVVAVGTTVVRTLESATDPETGRLRAGPGETTLFIRPGFAFRQVDLLLTNFHLPRSTLVVLVSALLGRERTLEAYAEAVRAGYRFFSYGDAMLVSE

SEQ ID NO: 12388 - protein, 110 aa, Myxococcus xanthus
MGAPYAGVMNTAVAGNLGGAVAPAGGGVVAGGLGGAVAGSGSPLGLGAQGSGSTTDTVNGNFSLNKMAEENSQLLNLQAAIQQESQTFTAISNVMKSRNDTIKNSISNVR

SEQ ID NO: 12389 - protein, 91 aa, Myxococcus xanthus
MPPTAKPSQTAQDLPAPSFPAIESLLEAASVEEVRGFFDGVKTGLTELKGPKVEQGKKAQAAIGRAEELLEMLVETRERLIAESKGGKGRK

SEQ ID NO: 12390 - protein, 213 aa, Myxococcus xanthus
MRGLEPDGTLVLPGRMMQTAREADLLFQLDLAARTTAIRQAVKHGLDTHLFINFTPTAIYDATVCLRSTVEAIHAAGIAPERVVFEIIETDQTADAEHLRGIVDFYRKSGFRVALDDLGAGFSSLNLIHRLRPDIIKLDMELVRDVHLDPYKGSIVEKLLEIARTLGIRTVAEGIETHEELRWVRSHGVDFVQGYLIARPQSPPVGATPSFTD

SEQ ID NO: 12391 - protein, 404 aa, Myxococcus xanthus
MLMGLAATERQSTPESFFLASEFQGSNNVTMRFAVAGCSSSGPGQMSGIFRRCANGTADMKGTFEAIRLGRRAGEAEASGVELVSEVKLTEATATNVAVAHGHAYVTAGAKGLITFDLSDPSQPRQVRQYELSNDYYTDALVNGNTLYVASRRSGIAVFDITNPAVPVRLRSVPESVVEVNSLALDGNVLYAASPAPNAEVYVYDVATPAEPKQLRRYFVEGAEPRAGEVPLHVAAMGGRLYVSNWSFGMTVSDVTNPASPKLLGRFANGMSAATAVGMVGDRVYAFDAGEDWGAHLSVLDVSAPATVARTGEFRTRPEVSIRSVAFSGTKVYLAYGQDGLRIVHVSVPGSPQQVGYYNTWRQTHAGHGVVFLEGLSKVHVPGDGFVYATDSSRGLLIFRETTE

SEQ ID NO: 12392 - protein, 64 aa, Myxococcus xanthus
MLLQHSVSGFSPLSELLRVLGVRTRREIDLEKFAIKALRGDFERIPMEGGPMARANAALVAAQS

SEQ ID NO: 12393 - protein, 605 aa, Myxococcus xanthus
TAANLSPAEIATLLAVPQNPNRRFPTAQNTARLKSARDGVARRLLDVEALPRGPEAARVSAETVLREVRDTPVPTDLKPFPREAPHVAVWLRTQRPANARLHTTLDAGTQRMVERLMRDAAVGLAPRGIYNGTAVVVDRQQAEVLALVGNFDFFDQKHGGQIIGFATPRSPGSALKPLLYAMGIDLGMVGPEQLVADVPTAYGGYAPRNFDGRFQGLVRLEYALSQSLNMPFVRLLERVGVERFLGALQAAGVTSLVQEPGYYGLSAAVGGIELTPLELAGVYVALAGDGRAPPLRLLLDEKAAAPVEVLSPGAAWLTRQALSLRDRPDFPARRRLTGMPARVHWKTGTSFGHRDAWAAGSGPRHTAVVWLGNFNHRPSVHLVGADAAGPVLFDILEGVGPRGLNLPDESVNPPDDLAVVEVCAYSGHLPTDACVQRKHVYARRSAVPTARCPYHQHVEVDVATGLSVGPMCRTGRKTEPRVYVTWPATIRRWLEEQHRRLPEPPAAAPGCEPGGARAAPSIVSPAPGHVAVLIPGVPASQQEVPLEAEASHERALTWFVDGALLGTARADERVWWTPSVGSHEILVTDDRGLSAKRTLEVRMRP

SEQ ID NO: 12394 - protein, 84 aa, Myxococcus xanthus
MRKAALGRTNFLFVGHEVAGENLAGLYALVATCEANQVNPEEYLADVLLRVQTHPNSRIGELLPHEWKRRRVAEPPDTVLQPSP

SEQ ID NO: 12395 - protein, 198 aa, Myxococcus xanthus
MSASDASYYAWASRPESAREAKDDSLTKVVATVHEASRRRYGSPRVFQELKARGSRLSRKRVARLMRQKRLRARPRRRFVKTTDSAHPHPIAPNVLARDFFADKPNSKWVGDITYVWTAEGWLYLAVVLDLFSRKVVGWAMSDPIDRQLVLAALSMALLNRPAQDLHHSDRGSQGGFNGSSQHSTLRSCDGEQQESTG

SEQ ID NO: 12396 - protein, 94 aa, Myxococcus xanthus
MAQHALLRADTGLAIYFCDPHSPWQRGTNENTNGLLRQYFPKGTDLSRYSRAELATVALALNSRPRKTLGWKTPAEALSSYLYLLQPNGVATTA

SEQ ID NO: 12397 - protein, 50 aa, Myxococcus xanthus
MSRKEWPKTLRPRVPPILFAPWRLGVKWALNFPKLRKVLEEDVYPHFPRR

SEQ ID NO: 12398 - protein, 74 aa, Myxococcus xanthus
MDGVELRRKLGYTRLKSLDFEVERTERGYVFTGRGYGHGAGLCQWGAKALADKGREYREILSHYYPGAELQQLY

SEQ ID NO: 12399 - protein, 91 aa, Myxococcus xanthus
MVNGDGVMVRANTLKVGDTLLRVDGRKVDLTQVSVFRYTGKVWNVKPQSKVKMENVLDVEGLMTGSVRFQNEWANDYFRLTVREALDVDGL

SEQ ID NO: 12400 - protein, 250 aa, Myxococcus xanthus
MHEIIHQWAGNRITMAHATDFSWKEGIAEYLTYVYELSKWPADAAKTRAHWDRLARTAMYYPGTSDNPVPFLTFAGETYGTGSMIFFVQLEDLLPGGQETIVRAITDFLSGPPRARSVAELQGALEQASGEDLGDYFQAWVYGTGDADWPTFQTDAVRANGELSLTVTQSALQPGKLYPAKVVIRLKGDTQELDVPIDFGLHPTTGTITVSVPFEEDVKSIGVDPENRVVSWNANASLSPLEAPPQHWIF

SEQ ID NO: 12401 - protein, 81 aa, Myxococcus xanthus
MLALATSPIDPSLSDVAKKGLVGEKYDLFFKLAQIDRQAAVDAFGRLDNPKLRSLLREALLAGLHESGASYEEVQRLTRHL

SEQ ID NO: 12402 - protein, 343 aa, Myxococcus xanthus
MKSMGTTQLVYFLDAQGSLFLAYELVREGERGDAPARDTVYVDPATGSVLDVHPQYHAAQNRRIHSAGNGSNLPGTLRRQEGGAATGDGHIDDNYDHVGTTYRCYSTIFGRDSFDDAGATITSTVHYGSRYVNAFWDGRQIVFGDGDNFNSGELGRDLDVVSHEFTHAVTQYDSGLVYRNESGALNESLSDIAAAICESWARGTVDADVWKIGEDIWTPGTSGDALRYMDNPTRDGSSRDFYPERYVGTADNGGVHWNSGIPNLAFKLLVTGGTHPRSKTSINVSGVGMNRAAQTFYYANQFYFTANTTMAQARALTIQAAADRYPTDTVNAVRDAWSAVGVQ

SEQ ID NO: 12403 - protein, 91 aa, Myxococcus xanthus
MLLADGTMVKAHTLQEGDMLLGSNGLTLFLSRVTVFNFKGQVWNVRPASLNKTENVMSAEGFLTGSVRFQNEWAADAYRLSIREDVDVSGL

SEQ ID NO: 12404 - protein, 656 aa, Myxococcus xanthus
MEGGANSPSFPSGDACSGPALPPRCHCASCVEPPRPQPPLSSPTCAGSCHCARPRAPPSAGRIAPLRARGDSLIGTRSRHEAGLASRLCALVLLDPSSETDMHRSPGSILPSRGASPRPFLPVNVLLVSVLLALGSGCGDSEPDKTNDCPNPSVGCGQQDSGTPDAGAPDAGNPDAGIPDAGDPDAGNPDAGHPDACNPDAGNPDGGGPLPTVPTLIESSQSAHQVSAGQTVTFHVTGRDDLACPLQFSWDASSGTLGSPETSAATSDVTWTAPHCVLWSSEVTITLTVTNNARLSTSKSFTVSAPRCPGPVVSGGVSHSLAIRGNGTLWSWGHNSFGQLGDETNATRHAPVQVPGLTDATAVAGGHAHSLASRADGTVWAWGLNGGALGDGTTSTQYAPVQVSGLTGAISVAAGSSFSLALDADGTVWAWGMNGSGELGDGTTTDRLTPVRVSGLSNITALAAGTGHSLALGADGTVWAWGLNFHGELGDGTTVSRPLPVQVPGLTGVIAVAAGMYHSVALRNDGTVWAWGWNLKGELGDGTTTQRESPVQVPGVTGAIAVAAGGYHSLALLSDNTLRAWGKNEDRQLGDGTNTDRHTAVQVSGLTGVTSVFAGGGHSLILRNDQAVWAFGSDVSGQLGDGNTPSGHGPVQVSLP

SEQ ID NO: 12405 - protein, 536 aa, Myxococcus xanthus
MLGAFLLAGAASAELPDYTFQLQARTNLAVNTEEGSYNVELGSLTSAGSFFIPVTADRQVAFQLAITREGRPGVWYGQNGQGGRIYLLPDGLGADARLGEVSLNSHRQLVFAVTGTNDASKNGIYVLNADEPDAPPQIVRSPLGSSSWSSLVMNEAGQMAARVTLSTGYAYVLYTPNTTGGFDAKVLAAEKYVDPGYPYTFLYSPGANDLGQIAAAVDLQAPTSSAWYQELRIFNPDGTSQVIADTRGHNPDSNIFRFAAVQPAINNLGQVAIQATLLEAAGRQSTAILLWDGNELKVVAQNGMDVPGEPGEAIGTVEVFPPDINDRGHVVFRATRKSDGFRAVWVSDGENLKRVVTEHDILPSDKGDARVDQETPSNPVFSGMPSINRHSDISFGVGLAPPETDQVEWGTALYIAQSSLWTPDAPDAGTDPEPDAGTEPDAGTEPDAGTDPEPDAGTDPEPDAGTEPDAGTTPDAGTTPPDAGPGTPEPQPNPESDSGCGCQSTSAAGLWPFALAGLAGLTRRRSLKRREQPPRD

SEQ ID NO: 12406 - protein, 335 aa, Myxococcus xanthus
YFQAIKTAGLAQITYILGSEGEALVVDPRRDVDVYLDVLRRQELRLRYVLQTHRQEDFVEGTSALARLAGAQVVAGRHPITGHADVRMGERERLHLGALTLVALHTPGHTPESMSWAVYLDPHHAQAWGVFTGDALLAGETGRTDLAAPERVYENAALLFDSLHQKVLPLGDQTLVFPAHGAGSVCRSGIADRELTTLGFERLHNPVFTSSRSDFIQRKVQERLHRPSYFSRMEEVNIRGGVPLSADSSAIPFLEPKRFQWESHSGLVLDVREPESFAGGHIPGSLNVWMQGLSVFGGQMVQPGTPLFLVLPAHVDSKEAVLALARVGLDQGLER

SEQ ID NO: 12407 - protein, 455 aa, Myxococcus xanthus
MDELRPACELASQGLWPDLVILVDVDPDLARLRKRLGKLQSKRVSDGDSRKGLVGAGLAVRVRESFLEMARKDPQRWIILENNDVPLRVLEQRLVDAVVARLEGREQQVQRIVPAPARPRNASPTTLENLEERFFQTLDTVEQREPALAVWMLSGIPGLAAHQKRLAFAERFPGLTARGMAGLADVPAMGLREVLADLAPAEVAFSLTGRMDSRAAMLRQRLYAQAPTEVLASLKNDGSTPAWALRERAMRDGRLADVLAGLAGQDCEESWLVREAGMQRKLFSEVASSLTSVPGARADALREVLLPHDRLAVLRSTLGLDTPVARGLREALAGKALKLVLRSLTGLDTEEAWTLRERGAPQTKEALDSVDGMDGTRAWKLRVDHLGRWPTTALSSLKGLPMGPHAQALIERVLAEQPDRLPVLRNAYAVAATARALAQQPARTVRVGTSPRMEA

SEQ ID NO: 12408 - protein, 217 aa, Myxococcus xanthus
MLERLSDAAEPFTRWARASAPGKPFSSSVGVNTYQALFRHALEGALPGDTIAHVAPPASQALPPHEVLVRTRLGQSGFTVVTNGFGWVPQASGKRDSGAAHVELAAWMDSHSPERALALSALGTLMQSNEGSQSAWAPGDIAVVSDPLLGLRHFVIAQGPAVPLPPGSPVNLFWVIPLLAAEFEMVRRAGPLHWANQLLKDPSRRTELVQRWSLGAN

SEQ ID NO: 12409 - protein, 249 aa, Myxococcus xanthus
MATGFTTERVLSVQHWSDRLFSIVCTRDSGFRFQNGQFVMMGLEVEGRPLMRAYSMASANYDDTLEFYSIKLQDGPLTSRLQKVAPGDQVLVGTKAVGTLTVANLRPGRHLWMLATGTGLAPFLSMVKDPETWERFERVTVVHGCRHVSDLSYSKFFEEVLPNDPYLGDLVRERLTYFPTVTREPFRNQGRITDLLRAKPLSPEHDRVVICGSHEMIKETATILEGFGFEEGDSHERGDFLIEKAFASR

SEQ ID NO: 12410 - protein, 335 aa, Myxococcus xanthus
MGELANGIGLTPTMYSPQPTYRGNFNNFGDPAFPDPARIRLDVNTAPGVYDLSVGGGNTFTCDRCVFGYQDEGSPAEKFFVADAGTLLLAVKVSPQQTLGALTNVTLRESVDAPPLNAPYWGSAVVPGGECRWIRFATWNTVRQDGCDPRQGSLTANLPDTTCVPNDYVASDGTLERALGTQVQGEACTKTAAASESELASTDCEQGFACTDLLSENAQCLKTCDFMAPNPGCPSGTMCGVYGLCTEQSVLEQNGFTFDPALTGEICSLEFAHYCGTEGARGVCADLNRDGKGECYPYHRARSECGPGDELGYMNYALSGGGFDRGHGFCYHDGL

SEQ ID NO: 12411 - protein, 237 aa, Myxococcus xanthus
TRRFFQDIDEAHLRRALNAFPGELLVLHAPADRYVPLEHARRWMAMARRPASLMLLEGADHFLSHDADAGHAADVLGVWAARQVTPVREREAPLPPGVVEVHEAGEGRFAQDIRVGAHRLRSDEPLSVGGEDTGPTPYGLLTAALGACTAMTLRLYAARKGWPLEHVHVRLSHEKVHAKACEECETKDGKMDRLQRTVKLEGPLTDAQRATLVAIADRCPVHRTLASDVDVHTDVEQ

SEQ ID NO: 12412 - protein, 183 aa, Myxococcus xanthus
MISSEQRFVWLDLEMTGLDPETCSIIEVGVIITGPDLRPIAEIERVIWQPEEVLLRMEPVVREMHTRNELLEKVRASNTSLRVAERDVMALVTEHCALGEGILAGNSIHTDRRFLIRYMPLLERYLHYRMVDVTSLKVLTRAWYPNLVEPRKAPSGHTALADVRASISELQYYRDTLFRGTPA

SEQ ID NO: 12413 - protein, 359 aa, Myxococcus xanthus
MVRQVKGAGTLVPEYIRWLTADTAGRVERIHVRPGATVTADTLLLELSNPDVQLQALEAERQLASVEADLIQVRMELETQRLAQEAMVAALINESAEAGRRSDANEALHQKAHIGDLEMQQAREKAAELSRRLELERKKLQVVASSMKEQLTAQQGQVERLKAVARFRRAQVESMKVLAGEDGVLQDLPLELGQWVTPGVLLAKVVKPERLKAELRIAETQARDIQPGLKALVDTRNGVVEGQVARVAPAASQGTVRVEVSLPAELPRGARPDLTVEGTVELERLGDVLSVGRPAGAQPNATMALFRLMPGSDEAVRVPVQLGRGSVNAVEVLQGLQEGDQVVLSDMAAWDAVERVRLR

SEQ ID NO: 12414 - protein, 810 aa, Myxococcus xanthus
MMDALRRDVRHTLRSLRQSPGFALVAVLALALGIGANSAVFSVVNGVLLTPPPFSEPERVVHLQGNIAQAGLEDISLSVPEYFDLATLSRAFESVAAYRGGNLTLTGRDIPQQLAAVAATPSFFATLGVSPVLGRAFTEAEAVQGRERVVVLTDTAWRVHFARDAQVLGQTMQLDGEPYTVVGVLPAGVAYPAWAEMYVPFVPTETQRQEDQRGARFLSVVGRLKPGVTQDAARTDLARVALEMEEAVPSRYRKVGWSFSVTSLDEKVVGNVRGTLWLLLGAVGFVLLAACSSVANLLLARMAARGREVSIRAALGASRGRLVAQFLTESLVLSLAGGVLGMLLALWGTDALVALVGEALPRASQVRLDARPLVFTMGVSLLTGVLFGLGPALHGSREDLSVAMREGSRGTEGHGSGRMRAGLVVGQVAVALVLLVGAGLFTKSFLALRAVDAGFTPEGVLTGKLVLPSARYPDAAHKVAFQRELLGRLQSLPGVEAVGVTNLLPLGGRSDSSFDIEGRPQAPDEVWPAVEFRSVSPGYLRTLRVTPREGHLLEGDGTEGPDAPWQVVINKTFADLYWPQGDALGQRLKLHWDTAQWTTVVGIVDDVREWGLDTPARPAAYYPAAKVPTPFLALAVRAKSGGSPEALRTAIEAELRAVDGNLALYAVAPLTRLVDESISSRQVSALLMGLFAGTALLLAALGISGVIGYSVAQRTREMGIRMALGASRTRVLTLVLGQGLRLTALGVVLGLGLSLGLARLLDAMLYGVAAYDGWTFAGVALLLGTVAVLAAWLPARRATRVDPAIALRAE

SEQ ID NO: 12415 - protein, 252 aa, Myxococcus xanthus
MTNDTKTAASPEGAVAQEDAGAEPGKALIHLDGLTKVFETEDVETHALSNIHLNVRKGEWVAIVGPSGSGKSTLLAVLGLLDTATRGAYLLDGRSVLDLSATDRALVRNRHIGFIFQSFNLIGDLTVFENVELPLTYRGMPAAERKQRVERALEKVGMAHRARHMPGQLSGGQQQRVAVARAVAGDPLILLADEPTGNLDSKNGEAVMQLLTELHKGGATICMVTHDPAHARVATRTVSLFDGRIVQDEQRR

SEQ ID NO: 12416 - protein, 200 aa, Myxococcus xanthus
MPSPLISLRNVEKSYPLAGGRAWVLRRIDLDIQPGEFVTLMGPSGAGKSTLLSILGMLDVDWTGEYLLDGQAVHAMKPKARGELSRRTIGFVFQQYHLLDNLTVAENLEVPLSYRDLKRGERDALVGDMLDRFQLVGKKDLFPSQLSGGQQQLVGIARALIANPKCCWRTSPRATSTHSRRSKSWRSSRASTGTAPPSSR

SEQ ID NO: 12417 - protein, 41 aa, Myxococcus xanthus
MEVFQGLNRDGTTIIQVTHSEANAAYGHRVIQLADGWLQGA

SEQ ID NO: 12418 - protein, 470 aa, Myxococcus xanthus
MSRALALSEGTTDREQRYIVAGSLLAEKGPANGRNAFVRDMECLIDRYPEDGDARLLLAGFLLDGYEPDGRPGQGQPYAQALLRELLRSHPDHAGVHHAWVQAMLNSGRPEAARDSAHRLVALAPRAGPALLSAGRLLQRVGLVAEARRVLEATVAADDAYLAEEGLHTADAPSAEAAMRLLSQGCAEAGQYGESQAWARRLRQRVEGAGGDDQALLFAAATMVSAHLRFGFWRAAADVPMELSDTASPAERALRDGMRQYTRGLSLLEAARLGEVERVCNSLDAQHALLAEARRSEDLALCPRDVARVVEVAAHELRGALEVRRGEVGRAEATLTRAWRLERRLRAAGPAAFSRPAREALVRLRLRTEREDKAVGLAKTLVAERPGCGHLRLLSAESQVALGAWSSAVEDFAAFLDCWRDADPHQPELRRARAFIAGRGRLLRLVRPPELLALRETGAPALAAHGTVSC

SEQ ID NO: 12419 - protein, 235 aa, Myxococcus xanthus
MDASFSALFEGAKAELSALSVTAILPRMLAAALIGTLLSLRPWRLLMKRALPKVDMIQAQVLLCAAAAVITAVIGDSLAKAFGLVGLGGFVRFRSGLKDPRDAAILFLMIGLGMACGHGSLGLASVGTVFVMVLLFVLDCFNREEAHATAKQRLVLSAQSDDLVGAEATLRRVLGERNVMVKSCALDFDGRRLELEVEEPEPGSLAAALGRTEGAALRGLRWTAVNSRSAREERI

SEQ ID NO: 12420 - protein, 360 aa, Myxococcus xanthus
MRAGARDYVQKPWDNTRLLATLRTQLELRRALKRSRRLEEENQHLRRGQGNQLAMVSESRSMQPVRRLIERVAPSGANVLVTGEHGTGKEVVARLIHGGSTRSERAFVAVNSGGLSEGVFESELFGHVKGAFTDAKSDRIGCFELADGGTLFLDEIGNMPLSQQAKLLRVLQTGELHPVGSSKTRRVDVRVVSATNVDLSRAVAEGRFREDLLYRLNTVEVQLPPLRERREDIPLLAAHFLAEQGRRYGRPNVRLSSEALEALLAYAWPGNVRELEHAVERAMLMASGDEVTQEDLLLKRAGREGMARLEEMTLEEVERYLIERALARHEGNVSEAAKGLGLSRSALYRRLQYYGIKGAR

SEQ ID NO: 12421 - protein, 187 aa, Myxococcus xanthus
MAPRPSDWEEDAKSGLGIVARRSQSLARFMSAYASLARLPPPTPGAVEVDAWVRRVAALEKRRKVGVRVGPGLVLRGDVDQLEQLLINLVRNAVDAVLSAPEAAGDVWVSWAVLSPGAVEVWVEDEGPGMTDTGNLFVPFFTTKPQGSGIGLALSRQIAEAHGGSLRLENRPEGKGCRARLKLPQGA

SEQ ID NO: 12422 - protein, 806 aa, Myxococcus xanthus
MLDVEQRKVTHFREHLFATEEPVIDAAGNDIFENGQPKVIHARDLLFDAFFGLRSGGTQRWLSTQEADRDASGYAAWAPEKTGGTGLGALVQRVGTLEATTFVFAPQGLPHASFVMALRVRNTGTSAVTGVSAFSLHNFHLGFGRPGVMADVDENGETVELSGDDFVEKGFAGVLVARPLGAVARKSAWLSTTTGPQNAYAVVNGGGGQDLQDFTAQPSAGTGWATAYQFNLGDIPAGAERCVGVAFARHGDPAAGATVRQWLTEYAGASSAQALVDAEVARWAAFQTDTVKVPAGMSADEESLLRHSAVVLHMAQVRSRDVYLREFLSRDGEPRRTRFKAPDGTPASLPGVVRHAGYGAVLASLPPGQWTYAWIRDGAYAVAAMATLGMQSDARDALSYYLNADSGRFQHWRELEPYSMPPYIITLTRYHGFGVEETDFNEAGPNIEFDGFGLFLWALRHYERTTGDTTLVDQTWPTVSTKVGDALVALINPVTGLIRPDSSIWETHWKGRQRSWTYTSLTAARGLCDAAELAQRVGDTERAQRYRQAGESLRRAMAEKLTDSKFALASNLEELRKGRGYWDAAVFDAFAFELFDPAGKIAQATYHGLDLRLSSPAGAGWQRNDDRYDHPDGADMSPWGGEYDSAEWVIVSLRGAMAKRMGGDAARADRVLKWVTDQSLKNYLAVAETYDELNGTYKYNAPMAGFGAGAYALALDHRAAGVSDPACGAYFDESTLTKQPDAGTGTLDAGTQQPDAGPQTPDAGTPPDSGADVGGGGCNATGPGAVALWVVLAFAGLAVALRRRGA

SEQ ID NO: 12423 - protein, 174 aa, Myxococcus xanthus
MTEASLEDLARQALERCRAAGVRLALVEACTGGLLGATLTEVPGASAVVERGFIPYSYESKVEQLGVPLALLQAHGSVSAEAVEAMAHGALARSTADWVLVETGIAGPGGGTPQKPVGLAYLAVLQRGGQATVERHVFTGDRGQIRRAIVGRSLALLVERLGVGDLPPTVSAGG

SEQ ID NO: 12424 - protein, 50 aa, Myxococcus xanthus
MRDPGQALLVCGDSVLAECIEHKRLQFRERVILLQQGGKARKKCWKGGES

SEQ ID NO: 12425 - protein, 206 aa, Myxococcus xanthus
MGRLVRERGIVRYFEIETLGDINNSELLFLDQEPEVLGLDGYCLAAGEPIGTDYPSEVKVKPSEEHAGIQLSSLLGNNFNYLIASAAVKEAVSEHCVEAAIEYLPFTLLDHRERVRSQDYFFINPLGSIDAVDAAASDIKYHRSGAVVAIRKLVLDPQKLIGAPGLFRLKQDPQRYIVSEPLVRAFKERGFTNLVLREIAVSAVKA

SEQ ID NO: 12426 - protein, 76 aa, Myxococcus xanthus
MMEEREVRYRRLAEKETEAEEVLATEAYVSIEGLALVRLAVRAGLKPQEDYLFIPSTALELPRLRYRADSWKHLML

SEQ ID NO: 12427 - protein, 51 aa, Myxococcus xanthus
AAIVVTGSVLDVALGWGLKRQKVVPLSAYISCCSLALLLNYSHSSWLLLLP

SEQ ID NO: 12428 - protein, 122 aa, Myxococcus xanthus
MKRLLIVDDELAIVEALQDILSVEGYDVDTAFNGAEGLHRMADAKPDLVLLDLMMPVMDGREMLRRMREDDGLRDIPVVVMSAGRISDEERRSSARFLAKPFELDVLLDTIAELLVEPQPNA

SEQ ID NO: 12429 - protein, 431 aa, Myxococcus xanthus
MRFFHAEEVGRALSYESGSAALKAEGLAGLSKLIFRAVREHGATVLVVDGLVAMEERSEDPLSFREFLHGLCVHNALAGCTTLLLTGQRGDPSDPRYAMVDGVVALAQERVGVKSVRLAEVTKFRGGPQVPGRHGFEISDNGLSIHPRIEALYTRLPTRTPSTDARLTFGIPALDEMLSGGLVRDSSTLVAGPPGCGKTQLGLHFLAEGARRQEPGLYLGFVEPPARLVHKAERLGLELGAHVEAGRVHLVSRVAAETQPDALAEELFGWVKQHGIQRLVLDGLESFCQELTDSERTPQFLAALMHELLNLGVTPLVLQQTRALATPEADARPDVEALVDNVLVLRMVALRSRNYRVLSVLKARESDHDTAQRLFSMTPRGIEVAADSESAEALFNGQAPSHAAPPRKPKRKTGSKPVRRGKPSRRGGRGV

SEQ ID NO: 12430 - protein, 261 aa, Myxococcus xanthus
MRRSWVAVFAAGWLVACGGNSLPAGDSQDPTPGGGLPGEPVQPGGPDDQGNGEEPTGSQSLWPLTAGSTWTYDIQDPVEGNFQKQVTVVGPGEVPDQPGINAVQVHSRQDRVRNGTLYEEYSWQVELTNGLVVRLREDDYRNGQQVRSTTWSPATVKSVASVPDALPWTYKSDVLEHITLGDGSKDQKDPTYIWKVLESGVTVTTRAGTFTNAVKIQRDKVNNNGEVKPDKTRFYWLVPGIGKVREEGERTEDLAAYDIKP

SEQ ID NO: 12431 - protein, 519 aa, Myxococcus xanthus
MSASLLEVFLDHAHRAPERPLLTFEQERFTYGQFATHVTAFARGLKQRGLQPGERVALFLENSARFAITYLGVQAAGGVVVLVNTAYRQVELAHILSDAEVCGCVTGAAGAAELVPLRAQLPSLQWFITGERPTTALPESLTEVPFDTLLAEGTSATAPLVMPRPEDLAVLGYTSGTTGRSKGAMLLHRNLLANVRAVTEAWRWTEQDRLLLTLPLFHTHGLMVGLHGTLFTGASADLRRRFNAAESLTALRDDASLTMFFGVPTMYSRLLEEARASRVKPRALRLWVSGSAPLSPQLFADIEAELGARILERYGMTETIMNTTNPYEGERRSGTVGFPYPGQEARVVDVRTRQPQPCGETGEIEVRGPHVFAGYWRRQDATAESFDADGWFRTGDLGDVDADGYLRITGRARELIISGGFNVYPREVEEVLAMHPGVAEVAVLGLPDADLGEQVVAVVVPHPGATPPESQSLVDWCKDRLASFKKPRQVVFTDALPRNALGKVQKHLLRAALVPPGTR

SEQ ID NO: 12432 - protein, 176 aa, Myxococcus xanthus
MTSLARPARLTWQNGGTFLRVLLTQVLYVAPLFWFMELAQNVAWRWMNGDWGWVFPKSPYHWFSFGSLILWAGCVALLWSLHFFWFYPRRVKVWPRLAIGAGVCWAGEWVGGYVAANVFNHPLQVWPGSPLVYVHYSALFFWVSNCIVYHLLTNDVVDLTPEYDAPPTTTRRAQVA

SEQ ID NO: 12433 - protein, 208 aa, Myxococcus xanthus
MVRTKPFRNFEGESMGDTTLRQVFAHSCNTAFVTLATGIGGDALSAAARRFGFDVPYFPGLTSAGASFPAPADAIELAAAAIGQGRVLATPLHMASVAAAAESGEWRAPYLVEGLDGGPSSLLSNGVRAPLSALMRAVVMEGSGKAGRQVPGLGGKTGTAEFGTVAPLPTHAWFIGFRKGVGFAVLVEGGGVGGRVAAPIAAKFAGAL

SEQ ID NO: 12434 - protein, 106 aa, Myxococcus xanthus
MRPSGKTQVLFHFEGDPGAPLSTTVRREVQAPAESALDGVAHPAALVPVDSATGAILAVASRPLSQPVHRALTGRYPPGSTFKVVTTEALLAHRHAGGLHLSRAHR

SEQ ID NO: 12435 - protein, 259 aa, Myxococcus xanthus
MGPVAEAEAYLRAWAAGDVASMRRAVVNPPAYFEVMHQQFRDGLRIVSSQFELGPFQRDGDARVATYRAVHLLRGLGEWELDGALRFVRHQGQWRVQWTPAALHPEAREGDLFSRTRTAPLRADILDAQGTPLTLQGEVITIGVDPTRVRSRADVAAALQAHAGVSTAQFDAALSAAGTATSRFVPIIDLPPARYQQVRPALAPVPGIFFRRKSARTPADGFAAHTLGRVGEVTAELLPQIGPTYLPGDLVGLSGLERA

SEQ ID NO: 12436 - protein, 154 aa, Myxococcus xanthus
MAVNTGVNKMSVVTKDSGGVTVAFPDVCKTPSPAGPVPIPYPNVAQSSDTDKGTKKVSVAGNPVCVKDSNFKTSTGDEAGTAGGGVASSKTKGKAEFVNFSFDVKFEGKNVARAFDLMLHNDKNTPPFPVMQGPVIAMGKSDEAPKCAVCDKDL

SEQ ID NO: 12437 - protein, 345 aa, Myxococcus xanthus
MGHPTIENETPFAFDMMGLADEDGRPLLLLVVKATYDFGTSGLKLAGEQLPVTWGGESWGKPGESSDKYEPESAFIKLATDVALIGHAYPPQKGATEALVALQVGPLKKAVRVVGERTWFKSMGHVAATKPLPFDKIPLTWERAFGGWDRTDTVKPAFEPRNPVGVGFRASPRHFEEGLKLPNLEDPATEPLRDFGQKVVPAGFGFTSPHWQPRARYGGTYDESWNKSRKPLLPKDFDRRFFNAAAPGLIAPGYLKGDEPVIIAGASPKGRLSFALPGQAAPIVTVALAGGEDATPPMHLDTVTLDTDEEKVTLLWRGHVALGEGLHDVRGLKVTAQGVTAPKAA

SEQ ID NO: 12438 - protein, 267 aa, Myxococcus xanthus
MEARLPPKRVAARVRSVPRGARPVQSGQGLARAPPVHASMPCPGHCKLRAQVLQHARFPMPSPHTRALLAILAAVCIVAAAGFRHAQNVKGSRGGRISGPKLAWLFYAVFLWFLACPLVALDVAVPEEARGVLGAFAAFMWLRGVAELYLLYGVKRWRPPYGVAHDVACIALVLGGLFWGRARWLGVLGPEDLWALAFLGLVLVSLFVEVAYAALFFHAVEGRTTGEDGIWFADEEQARFRRINRLTLALNVPLYAGLVGLLAVGAW

SEQ ID NO: 12439 - protein, 478 aa, Myxococcus xanthus
GGGRLVDFPEVKEVLVEQGRPEDGTDNEAVNMGKTFVRFTPEETWRKGWDKERLVREMRASLLEIPGVSFNFSQPIKDSVEEAISGVRGKVVLKIFGTDLAAMRGTLEQAVTSLQNVEGVVDLGLYRDSSVPQLQVVLDRPALARAGIDVSTAQDLVETALGGRVVTELWEQERPVPVRVILPGTERDDEARIGGILVPTSSGGHVPLREVARLEKALGRASINREANSRTLALKFNVEGRDMGSIIQEAMATVEREVTVPEGTFLKWGGEFENQERALGRLAVIVPISFLVVFALLYAALGSMRSASAVLAGAPFAMCGGVLALAVTGIPLSVSAAVGFITLLGQVCLASLLVVSAVDDRRKAGESLEAALPAGASSRFRAVLMTALLAMLGLMPAALSSGAGSETQRPFAVVIIGGLVTAVLVSLFALPAFYSVIVGKHVASTGSRDDEDEDLDSGVEHIGPKGHGPEQGTAGVAA

SEQ ID NO: 12440 - protein, 138 aa, Myxococcus xanthus
MFTRNEQSTIALVGVGLPLPLFDRNQGAVARASAEMQAEARALEAELAEARAELSRAHAVLEGRKGALARLEHDVVERLPTVRRMAEDAYREGRGGILELLDAFRSLKDMRVLHLKQQETVKLAEASVLFAAGLDTAP

SEQ ID NO: 12441 - protein, 264 aa, Myxococcus xanthus
MRRHFGPIMEKYGVDLVLTGHDHNYERSKPMKGDAVAGSGEKGIPYLVVGGGGATLRKLPGSKPDWSVIRDNQAYGFLDVTVVDGTLTAQLLGVNGDPVDRFTLQKELPPQEQLPEGAMTLVVEGERGVAPHRAFFRATPSLEAATVTWDFGDGGTAEGEAAEHVFAIPGQYTVTATATQGTVKQTATALVQVAETPGEEPQTPDDGTTDPGSPEPRPGLPDSPGPPDDGMSSSNGGCTAGPTATLLPAALALLAAGLLHRRRK

SEQ ID NO: 12442 - protein, 94 aa, Myxococcus xanthus
MVHAEGAAFIADTGYDADRIRANVRKLGMKPVIHSNPSRKRALPLDRTLYRMRYRVECFFHDLKRFRAVATRYDKTATSYLAVLHVASMLLWLR

SEQ ID NO: 12443 - protein, 391 aa, Myxococcus xanthus
MLGLLLARAGVEVTVLEKHADFLRDFRGDTIHPSTLELMHELGWLDELLALPHQKAPVLRLQRGAHDVIVGDFSHLPTRARYIAFMPQWDLLDFLARKAAEYPGFHLRRCAEVTEVLREKGCVVGVQARTPEGSLEVRASLVVAADGRNSIMRQRAGLEVEVLGAPMDVLWFRVSRKPEDPEDPMGRFEQGQIFVLINRGDSWQCGRVIAKGSFDALREAGLVSFREDFARLAPFLADRAHELATWDDVKLLTVRVDRLRTWYQAGLLCIGDAAHAMSPVGGVGINLAVQDAVAAANILAGPLLARHVTPMDLRRVQERREWPTRVTQRAQVLIQNRVLGPALRSPAASTALPLPLWLVQHVPFLRRIPARLVGMGVRPEHVRTPAAPPRA

SEQ ID NO: 12444 - protein, 115 aa, Myxococcus xanthus
MDLSEPVSRCNCSICTKVGGTQAYPKPSAFRVTAGAEHLGEFRKGSSPNFRSFCKHCGIHCFSAGFVEELGGEFRSVNIQCLDDVDPGELKVVYWDGRHDNWEAGTRDRPWPIRS

SEQ ID NO: 12445 - protein, 179 aa, Myxococcus xanthus
MAGTRSEERDALRRTAILDAALECFLRFGYAKTSLDDIAKRANLSRPLLYLKFKNKEDIFAAVFESLFEARYPRVEQVLARPGAAGDKLLQVYEIILLEPWELMAGAPMASEFYTACERLLPEVEARHRRRWLKYTQAVLESRPLAEVFMLAVDGLQSDLPTTRVLRQRLELLVERFTG

SEQ ID NO: 12446 - protein, 604 aa, Myxococcus xanthus
MLMNLGWSNALKAPEANLAESGRLTRKFDEISQRTGQFQINLDLSDERDWKFLQGRLRSAGKDAKNSPELFRRLDAGRERALARQGVANQVETERAWCNHFLKYSQPHVATNNGYTTFFPVVEVVCKDGADYIYADLFNYDVNEDETQTVLVSSDAGEEYGGGMGFDDVKAPATIATGKGRTLRMESLVMAMGPNIDQTSYIVERAAALNAPTTLTFTHPRKVLEQASRAEIVACQLRGGADCDYAVAGYQNGTLAPYPPSPTGVAASYSNQPGVLNASDFWAFNAPYNYQNLYVPVRGTLSAGAEGGFQCVVAQIDRARVQLIAAQTGRTCLNETFFANSIPIGGNQSYINVLTNVNWLFNLPGQGSGTSPDSCAAETIINELTRFNIHVAGKVRCNTKVKSFFVTYPMPTTGVTPNIYFWNSCMAEGTQVKLADGTLAPVESVKLGDKVIADAKGTVLTVTDVARGNEAKPLFRLRDSVGHDVTLTEMHPVIMSTGKVVAAKNLKVKDQVRTVKGVSTLTSITPVSPDKMRVYNLRLGTDPELLAVGKNGRTLYAGGFLVGDMTMQDELQAPKREPQVSLLNRLPKAWHTDFRNGVRSTQSR

SEQ ID NO: 12447 - protein, 71 aa, Myxococcus xanthus
MMALDESSAAGSLREGLAALLGDGSLVPALASLLSAAFDRAALAISTGGDAKAYREAMLALIERVTAGAGC

SEQ ID NO: 12448 - protein, 471 aa, Myxococcus xanthus
MYFQGYGVNPTINTEEERFSTFSVDTDSASYTLTRAYLERGSLPNEQAVRVEEFVNTFDYGYAHQGSAPFSVQVEGFPSPVRKGYHVVHVGVKAREVSRPQRKPSHLVFVIDVSGSMNLENRLGLVKRALHLLVNELDERDQVSIVVYGSTARLVLEPTSAVHAHIIRAAIDSLHTEGSTNAQAGLEMGYSLAASHLVEGGINRVILCSDGVANTGLTDANSIWERIRARAAKGITLSTVGFGMGNYNDVLMERLSQVGEGNYAYVDRIEEAHRIFVRDLTGTLQVVAKDVKLQMEFDPKAVSHYRLLGYENRMLTKEQFADDRVDAGEIGAGHAVTALYEVKLTEPSASFGTLRIRYKAPEGGDSKLIEKPLPSSVLRPAYGRAAPPTRLSYVAAAFAEKLRGSYWVRPLTYDALFSFWEEIGQPLKARDDVAELGALIQKARALDHREDRFEAFAPVSTMDFDRVPTLP

SEQ ID NO: 12449 - protein, 497 aa, Myxococcus xanthus
MAAAMNEMGYAAMALGNHEFNFGQDVLNKFKNEVNFPLLGANVRNSADGSEAFTPYIIKTVCDVKVGILGLVTPGVTTWERAENIAGLRFDDPLQTAKDYVPRMKEAGADVVVVAIHSGPDRQPTGSASNPESWLADYADDSKWADRGNLPGENQAVQIAQQVPGVDVLLTGHTHQPIPKMLLRNVDGGEVLLTQPNRWGSHLADVQLQVTWDGERWGVNTHDAQLHVVDDTVAADAAVTQSTQVHHDTTVAYVNQKIGTTTGVFPGGFAGRYVDGPLGDLINIVQEQAALEAGFAVDLSLGAIFTNDVSLPEGDVTLRDAYSVYIYDNTLYVMEINGSILRRAVEMNANYFTTIDPANLPQTPAEAKATSPSIADYNWDLYSHIEYGYDLTKPAGSRTTHLRFKGNEVTDDQVFIVAINNYRAGGGGGYSMFKEGRVLWTSADGVRDYVARYLQENQGLSPDAVNTCNFTLGPDLYTPYYAATFGPAKCLTVETVD

SEQ ID NO: 12450 - protein, 320 aa, Myxococcus xanthus
MQLNVPKLANEEPVPGLQHKYKETVLIFPKQGQTCHAYCTYCFRWAQFVGDADLKFASREIEPLVNYIRAHPEVTNVLFTGGDPMIMTEAVLAKYIEPLLDIEHLEAIRIGTKALAYWPQRFVTDSDADDILRLFEKVVASGKSLAFMAHFSHPNEMVPEIVQEAVRRIRGTGAVIRTQAPLIRTINDTPGTWESMWRTHLRHGMVPYYMFVERDTGPQDYFAVPLAEAYDIFRNAFQSVSGLARTVRGPSMSATPGKVCVDGVAEIAGEKVFVLHFIQSRDPELVGRPFFAKYDEKASWLFDLKPAMGATHFPWEEPSA

SEQ ID NO: 12451 - protein, 427 aa, Myxococcus xanthus
MSWFDTTLSRLKGLFSRPVTRSTTGLDVPLDAHGRPQDVVTETVSTSGPLKPGHLRQVRRDARLLPKGVRRYTPGRKKWMEAAEARRLFSATLRTRNRNLRDLLPDEAQLARYGLPVWRTEEDVAAALGVSVGVLRHYSIHRPRERVRHYVTFAVPKRSGGVRLLHAPKRRLKALQRRMLALLVSKLPVSPQAHGFVPGRSIKTGAAPHVGRRVVLKLDLKDFFPSVTFARVRGLLIALGYGYPVAATLAVLMTESERQPVELEGILFHVPVGPRVCVQGAPTSPALCNAVLLRLDRRLAGLARRYGYTYTRYADDLTFSGDDVTALERVRALAARYVQEEGFEVNREKTRVQRRGGAQRVTGVTVNTTLGLSREERRRLRAMLHQEGRSEDVEAHRAHLDGLLAYVKMLNPEQAERLARRRKPRGT

SEQ ID NO: 12452 - protein, 472 aa, Myxococcus xanthus
MATQRKSRPHSRSAPKKSGAPSGKKPSPSERPERPLREDLVLQACLEAYGSVRHEGRMADRALDFTLRRKANLYSNERRAVAERVYGLLRRQRTVDFLLSRAHPRFDSLETSRQDVLRLAASRVLYGEPHGLVARQSALAPPDAQALGALPEAAAALEALPARERFPIAASLPDFLADRFLQTFGRDAARAAEAMNERAPLVARANLLKGDRDALAQRLKAETVDVKPTPLSPMGLVLETRINAFSLESFREGMLELQDEGSQLLGMLVDAPPTRVVDACAGAGGKTLQLAAQMKNRGDLHALDIDERRMEDLKKRARRAGVHNVRAQLIPHEGPEADAALTPLKGKADRVLVDAPCSGTGTFRRKPDARYRLTPEDLEMHVGRQKALLARFATLVKPGGRLIYGTCSVLREENENVVEDFLAKHPEFTVKPVAELLGAELAEKVGPGPFLRLAPHTHGTDGFFGAVLVRAK

SEQ ID NO: 12453 - protein, 485 aa, Myxococcus xanthus
MALQALGGLIWQSDAWNETWGGGLLDPLITVHPDRVFFEAFSQDQSAYGLVIVDRGLFEPEGAVRCGTTNVDFTAWLWAALAEMRSTRETHLRIGPEGLDVRTTGAGGRFEQKVDVPEPWVRGLLQLQGGMAMPGTRLTARPVDLLAAVRFLSHTKAKVSPRALRYELHPGEDARLMLEPWEHPVPLKGAAHGYTAPRIIRTWGRRRLRLLEPLLPYAERVDIYLKGRALPHFYVAHLPGGVRFLLGLSGWTANHWTNTAGMDLLLEPARDSALAERVLGVLRERFHASTEDVATALGVDTARAAGALAAQCAAGRAIFDVEARRWRHRELFATPVDLGRLYPPDARREEAERLEAAGEVEVTSAAPREKRKVRTLPTPEGPVTREVVHRDWVVHGRAGPQSGVELVMNDEDRVLFGRCGCEYFGEHLLNQGPCAHLLALSRLARAQRRELRSSEPASEDALAARAAGADARRRPTETLDPGDDE

SEQ ID NO: 12454 - protein, 481 aa, Myxococcus xanthus
MDIGWGRLDEPTALALDALDAEAARPFILEHLPWRGPRERQPMWNTLRERAQARGDAALASALYRRCVDEPTWCRDALALARTVQSPAELVAALKAHHPEAPMPGAARLFVELAEARGRDVVPYLLGHLQAVAPRWSALGRKDAKGFPELLALARARDWDDVWGALLRTSAMAETYDAEVLRLVQDDASLPARTRRRLLQLAGAGGEWNLPGLGLARVQPLTDATATALYARFPELVRGPFRMHVASGWRAAYPKLVMRALEANDEDLLDYLASRAAMHLPATGSAKEWEKVLDALAAHYEPLPKEGGVFARRAANALGALPAHSIWTFDALMEKNRLARLFFLRSDDFYLAEPRAVRDLLEAPQIHVQALAFRLLGRNSAKAREVAAQNLDLLQATLLRPLHRRTRHAAFDALANAAAHGVEAARVLVPRVRDAFALPDSRYPKESLMALLARMLARWPELRDTAEVPHVFGLPAKGDGA

SEQ ID NO: 12455 - protein, 139 aa, Myxococcus xanthus
MKTVGGLAGTVGATLLSAHRHGRVTPELRKLGIWSALTLLVVDVSTYTTNRKRRSPVFLADAAIQAALLAAQWRARSRMPVVIDARASSLRDPSRYGAGEHGRWNILPGESRDAAGNRDIVDEGSMSSFPASDPPSYMG

SEQ ID NO: 12456 - protein, 375 aa, Myxococcus xanthus
MGTAALLALLLTVVTIQAWPALGQAADGARRARMERSPQWQDGHFDNPQPLRNDTWGSIASMFSASPDVSPAQGALPSVTLDGSAFGAPPATGLRVTWFGHSTSLVELDGQRILIDPVWSERASPLSWIGPRRWYAPPLALTELPAVDAVAISHDHYDHLDHRTLLAMKDWDTSFIVPLGVGAHLVGWGIPESRIIELDWWERARVGALEVVCTPARHASGRTGIDKDATLWAGFAFLGPKHRVYYSGDTGLFPAMKDIGERLGPFDLTMIEVGQYHSAWPDWHIGPEQAITAHQWVRGRVLLPVHWGLFTLALHGWTEPIERVLAAGEATGVSVIVPKPGERVEPGAPSSLERWWPSLPWNTAAQDPIVSTQLD

SEQ ID NO: 12457 - protein, 166 aa, Myxococcus xanthus
MEIYSSSQNKQKTLKPREVYYSRTKLIIGVVIWTVASGLCGILTFRLANSLGAMALCGAVNLCMVWMLYGCIRPLGNLDKPALIIGRDGIRFEDGLLIEWADMTENTYYSQSYMGIPTLKMIQIKTTLDKPKTKKMRVAALDIDSDEYLELCDTYSKRAALAPARA

SEQ ID NO: 12458 - protein, 56 aa, Myxococcus xanthus
MRWDDIESIRFQDEFGDGVSTRELIIAAQGKPLKIDEARIVNAPVLLAYLSQRLAS

SEQ ID NO: 12459 - protein, 142 aa, Myxococcus xanthus
MKITSYYPVIMTNDVAGTAAFYTAHFGFSPRFTSDWYVHLQSDDAEHVALAILDGRHETVPAVARGTVAGTILNFEVEDPDAVYRDVQAAGLPIHLPLRDEAFGQRHFITADPNGVLIDVIKPIPPSEDFAKQYEASALPVG

SEQ ID NO: 12460 - protein, 131 aa, Myxococcus xanthus
MALAEIFVPLAVGILQGILVMKFVRPLLMERLGGLAGLVRSRANTFLGIVQMFLLLGVVAACNAAYAPQTLAWLQERDILPFEPTLLVLRISAIIASYLSGTNLVHLASALSDDTESNTLEPLPLNNRRQR

SEQ ID NO: 12461 - protein, 556 aa, Myxococcus xanthus
MPVWTPGSYMVREFARQVQDMTAHAPDGTLLPVRRADKRTWRVDAKGVAVTLRYRVYANELTVRTNHLDGSHAYFNGAATFLYTEDTRGLEHHVTVDAPSGWRTFCALGQRANTFVAQDYDELVDSPFEVGPHTPLTFSVEGVPHEVVVWGDTVQDPERLCADLKRICECQARVFGGLPMPRYLILLYLTDRGRGGLEHKASTALLFPRVGLSTNRGWEDLLTLVAHEYFHLWFIKRVKPRALVPFDYAKENYTSLLWAFEGSTAYYDNLFVRRAGLMSAQRYLTRLGETLTALHATPGRRVQTLAEASLVSWVKHYRPDENSPNSAISYYLKGEVVSALLDLEIRRATGDARGLDDVVRVLWQRYSDGSGVPEDGVEAVASEVAGVDLTPFFDRALRTTQPLDYSVFSHVGLELNFRPREAASDKGGTPPRNRAGEGKPKGWLGVTTRGSGTVAVVMDGSPAQDAGLYVEDDLVALNGWKVDGATLLSRCEERRPGETVRLTVFRRDRLLEIPVVLGTKPAEAAWLSRVERPTDAQKAAYQAWLGSPWEESPGQS

SEQ ID NO: 12462 - protein, 601 aa, Myxococcus xanthus
MAWRRRFFESTKHLLDESSWELSNISDRRVSNPIEYIEMRRKVGGAPWSANLVEHAVFAEVPDRVAASRPMRVLKDTFSDAVHLRNDLFSYEREILEEGELSNGVLVMEKFLNISPPSAAHLVNEVLTSRLQQFENTVLTELPSLFVEFGLNPVEQAQVLTYVRGLQDWQSGGHEWHMRSSRYMNKGSGGAGGFFLGPNGLGTSAARLPQSPTALGLTRLKNFSHVPYQPVGPVKLPKFYMPYSTKPSPHLDAARRDSKAWARRMGMLDVLPGVPGGYIWDDHKFDVADVALCGALIHPHATAAQLNLSSCWLVWGTYADDYFPAFYGHTKDMAGAKVFNARLALFVPEDAGAVVPPPTNPVERGLADLWARTTEGVTPASRSLFRKAILDMTESWVWELANQIQNRIPDPIDYVEMRRQTFGSDLTMSLSRLAHGDALPPEVFHTRPIRSLENSAADYACLINDVFSYQKEIEFEGELNNGVLVVQRFLDLDPARAVSVVNDLMTARMQQFEYIIANELEPLARNFNLDGKAQDKLKQYVQKLQWWMSGVLIWHQTVDRYKEFELRASRKLAPRLSSGPTGLGTSAARITSLFANLRSGA

SEQ ID NO: 12463 - protein, 344 aa, Myxococcus xanthus
AAQSRPGPVAGVGPVVLGASAGVRIRSTENEPGRDYGTELEQGIVVSTRGKGLRGEIALQAAESLVEPDFALELLGGVRLPVGGGFEAFAIAGHGFTDIPGTPSIRAAAGIAWAHQPPAREDVCRSGRSHTPEQCPALDDDGDTVPNGQDRCPLEAGPPENDGCPDTDADGDGVVDREDACPNEAGVAAHRGCPEPKQEPTPPPPAPEPAPQAPAPELAPQAPTTEAPTRLPTEHHVQFPVGQSTLSDSERRNLDAIADYLKANPGVSLRIEGHTDNTGPEELNRTLSQDRADAVRQYLIQQGIESSRLTAKGYGPAQPIASNDTPEGRSANRRVEFVTSTTGE

SEQ ID NO: 12464 - protein, 420 aa, Myxococcus xanthus
DPATTGEEACARQMVESLANRAWRRPAKPDEVAELMSVYTLVRESGDGFELAAKFALRSVLLSPHFLFQVVETQAPGTGKSELSARELASRLSYFLWSSQPDAELTSLADAGRLADPEVLEAQVRRMLKDPRSEALVQNFAGQWLGLRKVDGITADPALFPGMDSELKRAMREEGESFFRAFLNEDRSALELLDADFTYVNDRLADYYGLPRPGSTSVTRVSTGDGRRGGVLGQAGVLAQASLATRTSPVLRGKWVLGKLLCQEPPPPPPGVEALPTQVPPGSTLRQITELHRANPRLRGLPRHAGPHRFQPGELRRGRGPWRETDNGSPVHATGNFKGVSFQGPRELATILKGDPAFATCMTRQALAYGLARALTYEYEATVRYVHTRFSAGGHRLPEMLVAVALSDSFRNRCPVPAAE

SEQ ID NO: 12465 - protein, 57 aa, Myxococcus xanthus
MGDDPCQPGQYCADATLSYCEPGCTSDVNCASNQECVKEYREQVGTCLNICTSCAYD

SEQ ID NO: 12466 - protein, 233 aa, Myxococcus xanthus
MRAVVFQHEEHEGPGLLGPVLQAAGFTLVNRFRTVRREDVDAELLVVMGGRMAVYESEQHPFLRQELGILMERLAYERPCLGFCLGAQMLAAAAGADVFPGKNGFEVGVGPVRWTPEAQKDPVLSGARPRTVVAHWHGDSYAPVPDATLLASTDRYTQQAFRLGTSYGFQFHLELTASELGRWIDIEADSLQQRGKNLQELKAQLPKLKAAEADNTEVLHRLAHHFARVAAGR

SEQ ID NO: 12467 - protein, 483 aa, Myxococcus xanthus
MLLGAAGCGTEVEDADFTSQESALSQKWELCGKEAVRLADIHPGPVGSNPADLIHGDRVLFFTADDGTHGRELWRSSGTEGSGTSLVKDIYPGLAGSEISNLTRVGNRVFFAADDGVHGYELWVTDGTSAGTYLVKDIYPGPEDGIRRPDPFYWINDPMLVEFGGVLYFGANDGVHGYELWRSDGTDAGTYLVEDIEPGPANSFPRRLVRVGNEAFYFVASKRGPWSDEIHLWRSTGVPGAIPVLSLVGDNVIFDLLAVKSRLYFLVDNDEGEASLWKTDGAASNTHELRYFYGEYPHDLVALGSRVVFSAGAGEPEGEELWSSNGSTSSTKLVKDIWPGPMSSSPSSLAVLKSRVFFAANDGSGEGRELWVSNGTGSGTRLFKALAPGGGSSDPEALASIEGTLFFSASDGVHGHEPWVSDGTRSGTKALRGLAHGSASSSPRDFVRSGWDVFFSADDGKTGRELWALPFRPKGECKQHHAY

SEQ ID NO: 12468 - protein, 301 aa, Myxococcus xanthus
MLPTVRENFVQHLVRHGYDTWLLDWRASVELPLRQFTLDEAARHDMPAAVRLVREHSGADSVQAVVHCAGSATFFMAMAAGLLPDVQSVVASQVALHHIVPPSTQLKAMLRLPDVLDITRDYLTPDEDPSSPLFQAAFGAFVDLWRHECDSTVCRRLTFMYGQLFRHARINRETHDRLDEQFGPCNMLTFRHLAQMARSGYAVGFDHGREENLRRYGRERPPSYLRAEHLKRPITFVSGEQNGTYMPASTELTYEWLREENGASYYRRKVLAGYGHLDTFMGSTASQDTYPVIRDALEAMA

SEQ ID NO: 12469 - protein, 64 aa, Myxococcus xanthus
MTEVNATSRDYTLPEGCPVCAADLPVRVTAAGPSAVCRHCGWLGRPLITVTHRGLRVSYDGAQA

SEQ ID NO: 12470 - protein, 316 aa, Myxococcus xanthus
MPAFLYVTVVRPLLQEGRSALGAWIRGLDTPGLLTVDPVLIGLLLLGVLWLPAALLITAARQPLLTLFDVPGTLRIVRRLGRDYTLVAGTLVGLGVLHLMTHGVALLLRMLDLFVISRVLAEAVTLVIPFTAAHVVGLLLYTRGDALGYGLEQDYLTPVLGDAQPSRMAPPLRDAGPIPFTGAAARAIETGSSNDDTLEALAAAVNARDVPLAMSLYATVRQQPRLRVPPEHHLFVGQAAAVEGNFPLAVAALESAADTAPDEPTAPRALVLLARVLGERMHDAPRAEEVYRYVLHRYPDTAAARFASERVSPTSD

SEQ ID NO: 12471 - protein, 242 aa, Myxococcus xanthus
MAFCGAGYHYAAEEELNAFLSEAEAMPASDFPAMREAAPAQVRETLLATGYFLRAWNRMGLKRERAAEDDLERGLGSLEKLGIENELTWWGWAFIHFRRERYDESARYLDTLAKSPYLGETERRDLQASADAMRKHGERLPIFLQARAAAILGQALVARAGGPEKILVTLLGPERAGQVLAPILWMDRVRQGLAQRSMDDIARAAGDSFEGVRAAGSKGLSALKEKLLGGGGDTKTAAESPP

SEQ ID NO: 12472 - protein, 203 aa, Myxococcus xanthus
MSPTKKAAAKKAPTAELPTIAFASPAEWASWLEANHASSRGLWLKLAKKGSGIESVTYAEAVDVALEWGWIDGQKNAFDDTAWLQKFTPRGAKSVWSKINCEKVEALIAAGRMKPSGMEVVALARQDGRWDAAYESPSKATVPEDLARALAANAKAAAFFATLNAANRYAILWRVHTAKKAETRARRIEQFVEMLARHESLHA

SEQ ID NO: 12473 - protein, 445 aa, Myxococcus xanthus
MDSRTQRYFEDIQLKHFGRLFGRLVRVRLFLSLLLLLSAVCVAVIDGAPWRCVFMSVVGVGAFTYFFHEFRRFQRDGVDARSVPLNLWMGQIILTSIIVGTGGIASPVLPAALPLGFLSSLAATPRDRSRLLMAQLSTLMAVSFFQISGLVQGLPLWFLGAPSAVLLVAGALVTAIMLCVCSAAGGAIRTTFDNMLSEALASRDELLATHRSYAGALEAMSGEIAHELKNPLATVKGLTQLMAREAGRAQPAERLQVLSGEVVRMQGILEEFLNFTRPLVPLTVSPVDLGALCDEALVLHEGLAAGHGVRLERKGTEGVEAVCDSRKVKQVLMNLLHNAIEACPTGGRVTVEVRALPVGEARVFVRDSGPGLASDLEARVFDAGVTTKAKGSGLGLTVARALARQHGGDVTLANAVGGGCEAALTLPRELPAEILRPLHGVANVG

SEQ ID NO: 12474 - protein, 477 aa, Myxococcus xanthus
MWDEAKEGGTTRVLVVDDDAGVRFTLREMLKSLSGVEVDEAVDGEDALEKLSARPYELVISDLRMPRMDGMELVRRLSLFSRSPRVIVITAHGSERFAVEAMKAGAYDYFRKPFDVDELLAVVSRALESVRLREENARLSGELNLSRSLVFVSEPMARLAQLVQRAGSRDVTVLITGESGTGKERVADALVRASPRANRPFLRFNCAALTEELAEAELFGHARGAFTGAHRARPGLFREADGGTLLLDEVGELAPTLQARLLRVLQEGEVRPVGEDRPVTVDVRIIAATHRDLRRLALEGAFREDLYYRLNVVQLRVPPLRERPEDIPVLARVFLDRFIDRFHTGPLKIPDGFFEQLRALPWPGNVRELENTLESLVALSSEGRLDLGQLPSAEPAGADSGFPGASSDPVRPGPQDGAPGAGLKERVEAYERGLVLDALRIAGGNRSEAARRLGIGRATLHDKLRKYGLDDGGEERS

SEQ ID NO: 12475 - protein, 437 aa, Myxococcus xanthus
MHRHGAFNLALAFNFFSTFGKPRPHPTDNEEWQRFEHGTPDGYQFFLDLGPLGNADAKHMKGDVAFWKDVTAHPNYDSFWQARNLLPHLKNIKAAVLTVGGWYDTEDLYGPLRTYAAIEKQNPGISNSLIMGPWPHGGWQRGGGESLGDADFGFATSETYQTLALDFFKHHLKGGAKPDVPEAMVFETGANRWRRFDTWPPKGLRETRLYFQPKGGLATTAPKTTGASFAEYVSDPAKPVPYTQEMMTGWSKDYMTEDQRFAARRPDVLVFETEPLERDLTLAGPLEAELWVSTTGTDADWVVKLVDVNPGKVRGWRKGDEEKGQKNRGHQQTLVRGEPFRGRFRDSYSEPKPFKPNEVTKVRFVINDVFHTFQRGHRVMIQVQSSWFPFIDRNPQTYVPNIFEAKEEHFTRAFHRVYHSAANPSFIQVGVLPSLDE

SEQ ID NO: 12476 - protein, 360 aa, Myxococcus xanthus
MTGTQGPDTGLVRLDGSEGEGGGQILRSALSLSLITGRPFHITRLRERRDPPGLRPQHLACVRGADALCGGAAFSEGATVGASELSFTPAPVRAGDYLLEVGTAGSTPLLFQCLVYPLALAGGGRLTLRGGTHLPHSPSFHYVATVWQPVAHAYGLPVLLSLVHAGFYPEGAGEIVAEVGPPQEPPRLVELPARGMLREVRVSSFTGGLPFTIAERQSRAAVGALRERGILAEADNRPLAVTRSVGTVTFVLAQFEHTIAGFTALGERGRPAEDVGREGGEALARFMETGGALDEHLADQILLPAALLAAGRLGPASPGTTRFTAARITDHLTTHARVVERFLPVRVTVDAGGSVEVRPA

SEQ ID NO: 12477 - protein, 445 aa, Myxococcus xanthus
MGRVELVGYAAESTALGVGLSRVGIRPQFIRRGDYKTAPELFTRPVVSDIQTRTVESFLDERYADLLDVVARGRRKTPEEVRALIDQGPFSARRAVDAGLADALVSEANLPAYLGLAKPGDGEEETELEPMETYLSTIPFPPVRWKRLRRNPRVAVVPVSGIIIPGKGASGKMATSETVVKALRAAGRDKRSKAVVVYISSPGGTPLASEQMLEAVQRVARKKPVIAYMDRVCASAGYMVAVGAKEIWSAPHAMVGSIGVFAGKFDMSGLMEKLGVHKTVLVRGQNAAMLSFSRGFTPQEEATLEAEVEEMYQAFLDIVAKGRGRTKEEIHQLAEGRVYSGVRGKAVGLVDQVAGFEEACRHALSLAKVPAAERFEIMTYGAPKQRVNLLKLLMGASHAQTYALCPTALSLNGLGGTEAFEDAARFGVADVVGRVFPDDQWPFGG

SEQ ID NO: 12478 - protein, 357 aa, Myxococcus xanthus
MLKALALLTASCLAQAEASSAAKVEEKLPFVTSLHFENDVLAKSDRLYTNGVRIEHFGEYDGCRSIARTLRLPDGVQHRYLCGGSLAQNMYTPSRIVPLPEQEVFPDPNDRPYGGWLHGGIFFQHIYAGRAPADSSRLTLQATVGVTGPASGAAQTQRWLHRTLNDIFGHTVARIPVGWEKQLPTEPAFHFSALREQPLLWSPVVDVTWSAGAMLGTVFVNASLGGTVRVGYLARPYGLAPIMPSVVKELEAQRTPGEASSELMAIRDERAWEAYLYARGQVRVVARNLFLDGTLFRPSISVRKAPIVGDSEFGAAFRTGGFQFGLSMVFRSQEMADPPNPLLSGHRFTQIQLSYLH

SEQ ID NO: 12479 - protein, 103 aa, Myxococcus xanthus
MERAVDDCQAEQVSLKVEVLSAEGARVRGATVTGTNVTSNVSITGVTDDQGVSTAINESLAPSAVRVVATAGAKVSDAQQVEWVCDTCNCQPEPATLQLQLNP

SEQ ID NO: 12480 - protein, 169 aa, Myxococcus xanthus
MAPAGNDDFPPDPLLDEDERQDRSSGSNGPAGFVPEFVRRMAVAGLGALFMTEEGIRNLAGQLKLPKEALGFILGQAEKTKDEVTRAVTEELRRFLQSEKLRDEFLKLMSGMTVEIKAQIRLVPPEKEEKPSGSEAPAEPTRSRRSATPSVVISELNAKRPSAKRTKKE

SEQ ID NO: 12481 - protein, 127 aa, Myxococcus xanthus
MVVITILGLIAAAVGVSVMSNLEEAKQKTAALDIKTLETGLKLHYMKTGSFPETQAGLEELLQARSLERLPQDPWNRDYVYMNEGGNPVILSYGADGVPGGDGSDADISSQVASPSASAARRPKGLR

SEQ ID NO: 12482 - protein, 122 aa, Myxococcus xanthus
MLLTRLQSPRPGELCFQARSATVAVKGRAWCDPKTLVGYVYRDPTGWDVHVAQSDVATCELERFTRPHPFAAWRPDGRLTSTVGALEFHAPEPLEGVRYIGWDETSVSDAPGEAPPAVAEGA

SEQ ID NO: 12483 - protein, 97 aa, Myxococcus xanthus
MGRALLGVMKLLGPWRMLSKAQHGFRTSNNYTEVRITETGPTEAEVWLNEPGMLRYFKQGVMLAMSRAAGGVAASVDVRAFDEHCVTYRVSWKDSGR

SEQ ID NO: 12484 - protein, 315 aa, Myxococcus xanthus
MFAAVILAALFPEFGTSGGPMHADVVADVGIFAVFLLHGLGLPAAQLRAGVVTWRVHVVVQAFTFVVFPLLWWLGDVLVGRWMPADLSLGLLYLCAVPSTISSSVAMTGVARGNVPAAIFNASLSSLLGIVLTPLIIGLFASATGHSLSMGQAILKLSALLLLPLALGQLLRPLVGGWFARYRPYTNAFDRVVILVLVYSSFCDSIASGLFSDYGAAVLGIAFAGAVLILAIVLMLTTRTARALGFSKEDEITVVFCGSKKTLASGVPMARLLFGANPALGLIVLPLMFYHQAQLLVCSLLAERYAKRPAGQPSA

SEQ ID NO: 12485 - protein, 486 aa, Myxococcus xanthus
MTRTKRREAERGVETWFTPSFASLFIGKGRYHGDLGVPMPLPPFGRRHSQTVARDGPVDYSAASMTHQAAASGLSIFQHRDFRFYLLARLCAVLAVQIESVAIGWQVYELTGSALALGYTGLAQFLPFLSLCLVGGQVADRVDRRTILAVCQTVMLVCSLLLLAFTLGHIRDVRFVYGVLVLFGAARAFHAPAGSALTPHLVPPEHLTRAVAINSTTWQVATIGGPAVGGILYGWIGAAGAYTASATLCALSVIWILILKVRTGRASAEPLSLSTLVAGLGFVRRQRLLLGSITLDLFAVLFGGAVALLPIYARDILHTGPWGLGLLRCAPAFGAAVVAVFLAMRPMGGNTGRKMFIAVAIFGAATLVFGMSRSLPLSLAALAIAGAADMISVVVRHTLELMATPDDMRGRVGAVNMMAIGASNELGEFRAGGFAEYLGAVPAVVAGAVGTLAVVALWAWAFPELRRVDRLESFARTKEPPATPAS

SEQ ID NO: 12486 - protein, 78 aa, Myxococcus xanthus
MTAEEREAAKQRAMGNNLNSYGKDVQLKQKPIPWMAIGLAGLVFVVAVPFGIRAYRNTSKDIAGQNTFGANRGDDEVA

SEQ ID NO: 12487 - protein, 181 aa, Myxococcus xanthus
DAPVLLFANKSVLEFYPRFGFEPRRQTLFSASHVARPGETAAPQLDVAEADVRARLRMLSDEGLPVTERFGARGTAAIASWYAANGFARPLRALSDDAWVFTEVEGETLFIDDIFARAPFDLRAALPRLIDRPISSIQFGFTPERWWPGAVEAGEDMEADLFVRGVPSPREANLFPVMART

SEQ ID NO: 12488 - protein, 255 aa, Myxococcus xanthus
MFKPFEDLLVEAVQARGARQVLDVGCGTGSTTLAVARRLGAQGHCVGIDISAPMLAAARARAEAEHVAASFIEANAEHHAFERGRFDMVISRFGVMFFDDAVQAFVNLRRSARENAGLSFVVWRSPSENPFMTTAERAAAPLLPNMPARQPNAPGQFAFADGDRVHRILEQSGWMDIGIHPIDATCTLPEQGLLQYVTRLGPVGRVLHEADERTRTRVIETVRAAFNPYVHGDEVRFTAACWRVEARAPAEALSA

SEQ ID NO: 12489 - protein, 293 aa, Myxococcus xanthus
MSADTVEQLLQCALSELTARFVTQATPVPTGLLEALDADPRAGAHALARRIRSRQEKNRAEGQRMRKLLRFETELWEQGHTHIAGVDEAGMAPLAGPVVAAAAVLPKGFRLKGLDDSKKILDAEKRESLAEAIKRDAVAWAVGRAEVEEIDRINIYHAGLLAMRRAVEGLSVKPDHLLVDARTVPECSVPQKGIIKGDALSLSIAAASILAKTTRDRWMAELDDQYPGYGLAAHKGYPTPHHLQVLREKGVLPIHRRSFAPVREALGLPTGSPPSALQAELFPEAPSRTGVKS

SEQ ID NO: 12490 - protein, 826 aa, Myxococcus xanthus
MSEKRWSERFEGVMGRLAVRNHRKPFQALLLALVLTVLGAYFARTLTLNADFVGLLPKNFPSVQDIEKLRKRFGGQGNVVVVGMRADPEVLKRFADDMAPKLGALSEIRYVSHQRPRSFFDEHSLYYVDVDDLETIQERIDARILWEKQQANPLFVSLVEEDPPSVDFADIEQKYTGRANQRLSGQGDLYYINPTERMVVLMAKPRGSAADLNYSKKVVGQVEDFLAQQDLSKYGPGFKTAVTGTFKKKIDQQRVIVGDLASASTLAMVLLLAYLAFHFRSALSVGLTMAPVMAGLGWTYGFVGLAYGQVNLLTGFLAAVLGGLGVEHGIHLLGRYTTLRSEGMNSEEAVDESFRHTGFSSLIAALVAALTFLSLAMSEFRAFREFGIIAAVGMLVSIFSYVLLLPALLGLATRFGWSPRVQQEGAAGPLSLLARWLPRSYRGVGIVVGVGVLALVSQAYRISFNYDSRTLEDYKQASAVLDQKVNDILGYSQTPVVVLTDSQEMEREVVRQLEARKVARGKESTIDFVGALDDLVPKRQDEKQAILQAISAKLEKLDPERLPEDTRNTLVRALNMAKAKPFTQEALPTSVRHQFESLDGSTGGVVLVYAGGVSLSDGEGTRKFAKEVRGLQMPDGSQVSAAGEALILADILDMVSREGPRILAAAVLSVLVAMWLTLGKLRTALICMLPTLLSVVGLVGLMSLLGLQFNYLNIMVLPVLVGTTVDAGVHLVQRLGERGADFVSVYAETGRAIMGGLLTSAIGFVALILAKHPGLNSIGDLANLGFGINMVIVLLGFPSLLLLVERWRRKHSTSSEEQTEQPAPEA

SEQ ID NO: 12491 - protein, 309 aa, Myxococcus xanthus
MERKDVKDVVVVGGGPGGLSAALALGRGRKKVLVCDGGTPRNAAAEEVHTYLTRDGIPPREFRRVAWEQMRPYDVELREARVLDVERAGTVFRVALEGGDVVEARRVLLATGMVDVMRELPGYSDLWGKAIFQCPFCHGWEIQDRAWGVLATNAVSLDFAVMLTGWTRDLVVFAMDGFEVPSDKRALLEKAGVRLETRRIRGLIAAGEKLDAVELEDGTRVPREILFDRPPQRQSSLVQRLGLELNEEGFVKLKGPGETSVPGIYAAGDLGTRAQAAIVAASAGMLAAGMLNHDLNLERAGAAHGPAQG

SEQ ID NO: 12492 - protein, 153 aa, Myxococcus xanthus
MRLLSEEVARNEPGGEEAARSLLRLVLIELERMTAQTGTSEPPSLGLSRKALTYIETHCLEPLSLAQVAKALGRSSAHVAGVVRQETGRTVGEWILECRMAEARRRLRGTDERVDIIAERVGYADVTHFIRQFRRVHGVTPAAWRRKATAGAP

SEQ ID NO: 12493 - protein, 465 aa, Myxococcus xanthus
MKKALVIVVGAAVLLLVFMFVAGEQPPGQPEASGGGRQLDLSGFDPARVSGLELSGVRRATLQRDGSGWTVADPGSPESRFLADEAMVKGALESLTRVAGAKFVTGEAGRLNEFWLDDARGLKVRILQEGRPPLELVLGKDGAPNGGTYVRKAANADVFEHPTLLGWLWRRRVMDWRDARLVRGAPGDITQLVFRVGDEAPVTVTSNGAPGGWRLAEGTQVPEGFRFSAHVVEQVVRDLLEVEAQDVLAGEAATEAKAALAQAHDTVEARLKNGKSVVLRLSRASESKDTVFVQLEGDARMYEVSAVAASQVRKRLVDFRDLLLLRFALEQVSQVRIQAGDTTVVVAKEAHGWVLIEPQSPPESFRFDASQVEAHLIWLQRLEASRLLDAAVQDVQAGLSPPVASVEVSEEGGAVQTLRLGNAVPDAPAGYQEVYARGSRDGFTYAVEDRARAWLSRGLALFSGP

SEQ ID NO: 12494 - protein, 76 aa, Myxococcus xanthus
MEDFLPPGTKPPKNADAMTQCLYRIETYDAWLQRGEKMTFVHFTPREQERCGLRPEVMDPGASYAISDDGVILKRD

SEQ ID NO: 12495 - protein, 164 aa, Myxococcus xanthus
MLKTAWNEWSLKALQLETAVLALEEIDLPEEMHALQEAAEEKLLALARAWKARQPQREPRTWERQTLPDGMPRDAELKDLVEGFKEDGKSWTLLRATSDLKEVVETVVSEGRACMAAGGEYYLGQWDAKESVLEVGRDDDADEPGTGLVLEPTGELQYTPDPEL

SEQ ID NO: 12496 - protein, 522 aa, Myxococcus xanthus
MNRKVSVCAGMMAAVVAFSASAEETAGGPSSSAASGAASVDWPGVARELSAPPLVAAAEQPVNHALAAGAPAGSAPASDAVNPVASSNGASSMPVVPDGANAPSAGAPEAKAEADANEVHIPFSLTLVPGLSTSGFHTGNVVNNVSIGLVATHAKRVDGLAMSLAGNWVGEGGLSGAQLAVGANLAQGPVTGAQLSVGANVAGADLLGLQSTVGVNVVRGNAEGAQLAVGGNIASGEVNGTQMAVAVNVAGKSLLGAQLGVGANVSGGPVRGFQAAVGANIATGRVHGLQAAAGLNVAGQMTGLQMSSGVSYVRNLSGAQLSIINVGGEVDGAQVGIVNIASNVTGAQVGILNVARELDGEAVGILSFVGGGQAHVQAWTSDVALTNVGVKLGGRHIYSLFTVGYSPSIDEDRRRFVMGAGLGGHIPAGRFFFDIDAVSSTVHTKRLFDDSKHVLAQLRLTAGWQVARHFAVFGGVSANTLVTWDDSDPWKELGIGPQWRHVADEGRTTVRMWPGLLAGVQI

SEQ ID NO: 12497 - protein, 329 aa, Myxococcus xanthus
MVLREVGQPLHETRLPIPRPGPEELLLRVRACAVCRTDLHVVDGELPKPKLPLVPGHEIVATVEAAGERATAIPVGTRVGVPWLGWSCGHCRFCLAGQENLCEQARFTGYQLDGGYAEFTVAHQRFCFPLPPEYTDVHAAPLMCAGLIGFRSLRMAGRERRLLGFYGFGAAAHLLIQVARHQGRRVFAFTRPGDVEGQRFARELGAEWAGDSDTVPPERLDAAILFAPVGALVPAALRAVDKAGVVVCGGIHMSDIPAFPYALLWEERVVRSVANLTRADALDFLALAPKVPVRTLVQTFPLSAANDALTALRRGQVHGAAVLEVAALG

SEQ ID NO: 12498 - protein, 111 aa, Myxococcus xanthus
MNRALQITYRGMETSEALSEHIRDHAGKLEQFYDGIVGCHVVVEEPHRHKQHGRHFHVRVDVSVPGRNIVASRDPQARTGHEDAYQAVTEAFDAARRQLQHYADALNTHHG

SEQ ID NO: 12499 - protein, 122 aa, Myxococcus xanthus
MAKAQGRLDAFVLFLKPEGTGEDWEQGELWRSAAAIPGVTALRDEGGVQAERFGAVTSGQVLFYDAGGALRFSGGITTARGHVGDNAGRAAVEALLGDAPAEALAGHAVYGCELEDPRGSVP

SEQ ID NO: 12500 - protein, 136 aa, Myxococcus xanthus
SADRDIDEWMAARGITLPEARARTRAVLEEVGLTRPGRQRMSEPKLLKAAELLAGRFFSVCADGACLKVAQASGREPMRIEPRLHCERCGGSANRRAEVAFVEACQRYGVRRVVVVGGSPAVREELEAKLGHQIDF

SEQ ID NO: 12501 - protein, 454 aa, Myxococcus xanthus
MALKERAARLFREHLSAVRVRTDRLFAGLMLGQWAVGIVIALFGPRGSGAQLQAAVLVGTLLSAFPMVMARWRPGSMPTRHVVAVCQALWSSLLIYLTDGRVETHFHIFGSLAFLALYRDPWVLLSASITTVVDHVMRGTLWSHSLYGGLPPELWRFVEHAFWVAFIDVVLVYSCRGMLRELREVAVRRAELELAREREHAKARELDRALRELSGFQEHLIRVEKLAAVGQLAASVGHELRNPLAAVRNSHAYLSRKLTRDPAGAADDPRVPQFLGLMERELNACAKIISDLLDFARERPPALQPCPLRPLVDEAIGVVPQREGVRIVNDVPESLPVPHLDKEQFRQVLVNLVQNAVEAMPVGRNGVVSVVAEGGDASPWRIRVMDDGAGIPPEVLPKIFEPLFTTKTRGTGLGLAIVANMVQRHGGTISVRSEAERGSEFLIELPAAAAAQAA

SEQ ID NO: 12502 - protein, 254 aa, Myxococcus xanthus
MEDVAVAPARILLVDDEESLRITLAANLELEGHTVLEAANGEEALRLLEKQSVDVVLTDIRMPGLHGVELLRRIKQERPDMPVVLMTAFTAEELVDDALAEGAFTVLPKPFDVTHALDTVLRAAAAPQVLVVDDTEQVARGMVRALSTVGLRARAVYSGEEALASLRSGEYDVCVLDLVMPEMSGPELVSKVRAANLSVAIIAVSGHVVPEMLRRVAAQGAVVCMTKPVPLRELVQAIARVRGRPQQGLQGARI

SEQ ID NO: 12503 - protein, 242 aa, Myxococcus xanthus
MAGRDLQARERAAVADVVASTLRHDLRNKLASIRNASFYLMRQVKKTDLWSADPRVETFFQLIEKELTSAEDVLSKRAPPPTGGTRPRCSAREGVERALAEAQVPPSVEVVRDLKEQGGVPLEVEDLALLVRCLVDNALEAMPRGGTLTVRTRDAESGVCLRVEDTGEGLAAEAYSRALEPFFTTRPHHAGLGLSIVHRTAVRHGWQLDLGAGPSGGTYVEIQFTGLEAGAHDRNDVTRGSK

SEQ ID NO: 12504 - protein, 126 aa, Myxococcus xanthus
METNWTFGRCLLLVEDDPSNRMTLSALLEDAGFAVVTAGSYSEAAGLLNRPRAYDAVLLDQSLGDGFGTGLIPLVRHHMPKTKVVFVTGHDGKIDMPVDAVFRKGGHFDDLLAFLFKLLPQRPLGA

SEQ ID NO: 12505 - protein, 283 aa, Myxococcus xanthus
MAGMRATRPGILEAAVRAAMEAEFVSRDVRPAYQPIVTVHGEVLHNLRYDHTLREGDLLLADVGGESPAGFACDVTRTWPVTGRFSTTQRELYDVVLRMQKASIDAVQPGTRYRDVHLAAHREMARGLVALGILRGDPEELVVDGVTALFFPHGVGHLLGLDVHDMEDLGDRAGYAPGRTRSPEFGHRSLRLDRDLEPGMAVTIEPGMYQVPAILSDARLMARAKDRLQRDVLARYADVRGIRIEDDVLVTSDGNEVLTAAIPKEASNIEAVMTNSARPAPGR

SEQ ID NO: 12506 - protein, 351 aa, Myxococcus xanthus
MGAAAVGALAAGLLLVAGLYVRGGDSTGTQASVDDAIRRTAHGAVLGTSGDAQAGLSSAGAGAAMRTAASSGHAIGASTSTQAAVSGSSPDAALAASSHVSGAASSMAVSSTQPGIGSALLRDAAKGLRASVPASEPARSPGTPVAESLAVVSPAPFKRKAPAKPDEAAALPPAPVELDFGDTGAAGAASQDAIATSPGDVAAEAVEEDTSEKGPYADLDEAFARELGFTEDADAELSKAEAPARTVYVPPAVDVKEHLTPEDVKQVVLTNQPAITACLRSHAQGTPMEAGGRFMVQWSVLPSGETLNVSMDTAALRATLLSRCIEDVVRRWKFPVHQVRMQEPIRFPFIF

SEQ ID NO: 12507 - protein, 110 aa, Myxococcus xanthus
MPATEPPEPTELHVCHRCLVRLEASAGGVDLPRRLREALAGRGLAERTRVMASGCLGECPRGLVSVLVVPDSGSGAHVQLIDPAKDGADLAEHVARLPGVQDGPPRAGRP

SEQ ID NO: 12508 - protein, 182 aa, Myxococcus xanthus
MIRRKFFKLFGDAFHIYDEAGNLAFYSKLKAFKLKEDIRIYSDEEMREELLTIKARGILDFGMTYDVTDATTGERVGALRRKGLRSILRDQWLVLDANDQEVGKIEEDSMMLALVRRLLTALIPQSFTGTMGLNQVLAFHQRFNPFIQKIDLDFSMDTHRQLDRRFGIAAAVLMCAIEGRQQ

SEQ ID NO: 12509 - protein, 187 aa, Myxococcus xanthus
MSIASAGTEQRPSLLLVDDDSTLRERLARAFRERGWDVTTAGDYDEALAAARRESPEYAVVDLRMPGRSGLEVVRDLLTVDASTRVVVLTGYGSIATTVDAIRLGAVNYLPKPADADDLLAAFARASGEPSVATSERFEAPSLARAEWEHINRVLADCGGNISEAARKLGIHRRSLQRKLQKYPPSR

SEQ ID NO: 12510 - protein, 348 aa, Myxococcus xanthus
MLWDTLVLTGLLALSGGTHNPFTTLYLVNVALGTVLLPSRWMWGLLGFTLTAFGSLFVLQDVELPAGLSRPDHAELMRLHINGMWVAFAVAAGFIVYFVQRVTRALGAREQELAQARALHARREKVASLATLAAGAAHELSTPLSTIAVVTKEVERALATAGTSESVREDLRLIRQQVDRCRDVLVQMSADAGQTTGEPFHPVPLGRLVEDMLAELPGAERVTVELPTEARDWRVHGPPRALARVLRGLVKNALQASQVSRPVELRVQARGEGALLEVRDAGTGMAADVLSRAGEPFFTTKPPGEGMGLGLFLARTLVEQLGGSLELRSTPGRGTTASLSLPVTEGAP

SEQ ID NO: 12511 - protein, 269 aa, Myxococcus xanthus
MKLLGLSPVDEPVKRLITQGIVNGPDGRKMSKRWGNVVAPASIVQKYGADTARAYVLFAGPPERDFDWSDEQVEGVYRFLKRVWALAATHQAAAAGATHDGPYEGKALEILRAAHKTLKRVGEAIERLSFNTAIAGIMEGLNALYALGTPETAAEKAAMAEAVRLLAVVLTPFTPHIADEIAEAYGSKDFTVAQSWPEFDPALVVDDVIPYAVQVNGKLRAEIRVAADAAEADVRAAAEADEKVQVALAGKTLRKFVFVPKRLVNFVAT

SEQ ID NO: 12512 - protein, 416 aa, Myxococcus xanthus
MGRVERALGAMAAHNHRRPVLALLLVLVLAALGGFLARGLHLNANLVDLLPSSFESVQDLRELERRFGALGWVAVVGEGADPASLKRFADDLAPKLEALPGIRFVEAQRPGAFFRDRALYFLSEEDLREVHRRLEARLQWEQQQANPLYVPLVEEEPPSLDFSDLEAKYTGGAGQRLATSNGDYYLDEGQRRIVLLAKPDTTSADLGFSRKVTDEVRGLLAAQDLSKYGPGFKVDITGTFQKKLDQQKQIARDIGVASAVATALMLLYLLFHFRSALAVGLVLTPVGAGLAWTYGLVALVFGEVNLLTGFLGAILGGLGLEHGIHLLGRYLHLRGTLGTGQDSEPQPFEVSFQTRASVDVLLEWVTLSEANPHTQLVFALSWDTWLDGVSAEQPPANVDLVGNVARSVVPPSSVAP

SEQ ID NO: 12513 - protein, 290 aa, Myxococcus xanthus
MRYAMVLGVTLASLGAAAEERWTAPYQIEAVSGRTARVVLGEHAPEDVASRLQVMTLVGTQGMAVARFQRTESVCTVEEDVDLPPVCHTVGVYTQAKGTPDIGEHIVALAGTVTGTVSMPAPKTERERPVPGQWTSDAFERPVDEGADPFTPAGIPAPGYRWKTSPEGHVTLESSRDGQSDDTRVPLDSCTQERQGPFTRLECFPGAPHIAPGDSPGASLLYVDRRPLVVSFADYGEASTELVASLRVGGDTQYLVHVGLKGQAVTGLLFREGNAWRLLLRPADYPVIGC

SEQ ID NO: 12514 - protein, 48 aa, Myxococcus xanthus
MVARGWQAPTAYRELRQARWQSTLNDRQLNGLADFVAAWQARTSERAA

SEQ ID NO: 12515 - protein, 332 aa, Myxococcus xanthus
MRPEGRFQALKGLAVATALVLPSVAAAGAVLEPKLSPSDNYGENFTFIGDLDGGTFIFVQLTVTNIGPGSRTGLCRTTVLTPGKKAWSAQTKVKARDWRYDAESSTLKMGPCSARSTDGATRVEVPLDGGRVLLEYAAPMTPQGQEGTEVEVGKDRYHHEVTLAFSALKATVKRPKGEDVVYTGGGYADHTRSTIAPAKLAKRWVRFRALLGGEKLVLLAREGQDGEYGPVYAWEEGAKARSLEHFTLAREGVKERSSWTVELFTDGSSAMVLRSTSLMQRSAPVEDLGAVLGGLVRSVVGSPVTYLHRAVLEREGKAPVTGLMEVTLEGDL

SEQ ID NO: 12516 - protein, 411 aa, Myxococcus xanthus
MAWLTGNLSPSARIWTALAPAIVACTYFIGGLLLFCIRCAFKGIPRDEETLKRGSNGLVGFFLRHYFFWVIQPLWAVILRSGLPANALSMLSGLLGISSGVAVAAGRFALGGWLFLFAGILDVMDGRIARTRKEANPAGAALDSVLDRYVDSAMLMGLAWYYRDTWVLLPALMALLGSSLVPYVRAKGEGLGVNVRDGAMQRLERVLFMGAGTALSPILEAVFWPEEKHPMHWLAVVGLVFVAVMSNVTALSRFRNLVKALAPKRQEARSGKAIIGLNALAGAVATAVDFALVLALVEWAGVLPAWATVLGCGLGAVVNYSINRVLTFKSTGAVGRQLARYSVVSGTSALLNAGGVALLTLHPQLAYALGWWLVRGVVYFAWNLPLQRDYVFNNDAAASEDALMEQRPHAA

SEQ ID NO: 12517 - protein, 192 aa, Myxococcus xanthus
MDLLCGFAYAAYLYEVFILAIFFFVKKDSLFERLCWGFLAANAIGVVIYVLYPAAPPWYVLQYGPGPADLAAPPNPAGTARFDELLGISYFASFYSRSTNVFGAMPSLHAAYPFLVTLFVWSRGWAWRISTGLFALLVAFSAVYLTHHYILDVLAGLGVAAVAFLAVESVYARWTATTPWAVSLTTRGDTRA

SEQ ID NO: 12518 - protein, 444 aa, Myxococcus xanthus
MENKRSVAKPDGKLAVLIPGLGAVSTTLMAGVELARKGKGHPIGSLTQMGTARLGKRTDGRTVKLNELVPLAELKDVAFGAWDIIREDAYEVAVRSGVLSDKHLEEVKPFLQSIKPKQGVHDPEFVRRIEANHIKATKTHRESIEALRQDIRDFKKELNATRAVMVVCSSVETFRPLPESFKTLAAFEKALDENSPDINPTALYTYAAIKEGVPFANATPNASVDTPALQEMAKQESVAVAGRDLKSGQTMMKTVIAPALKARMLGLDGWFSTNILGNRDGEVLDDPAAFKAKEVTKSSVLDTILQPDLYPELYKKYAHKVAIHYYPPRGDAKEGWDNIDITGWLGYPMQIKVNFLCRDSILAAPLVLDIALFLDLAKRLEWRGIQEWMSFYFKTPMAQPGLPVEHDLFIQLTKLKNTLRVVAGEDPITHLGLDYYGDDLPLSK

SEQ ID NO: 12519 - protein, 135 aa, Myxococcus xanthus
MWTHARDFDGELWFFTREHSPKVDEVTHDHHVNLAYSDPTRDRYVSVSGRCRLVLDKEKARALWNPTLKAWFPDGLDDPELALLCVRVEKAEYWDTPSSRMVQLTGMVKAAFTGQPYAPGDHQKLDLDDSAPLPH

SEQ ID NO: 12520 - protein, 192 aa, Myxococcus xanthus
MQLLHGERRWRLPAQGEDWLIVPSVDLERLKHPQAPVPDVFVSSALKRWLATSAAHTLYAMYEALGGSRPLGLSGLERGRYEQRLQQRLTEAFVHGELVALPMARPVLLPTPWPEPPPLTSEETPVEEQTWLAIELKDEEGNPIPHARYLVTLPDGSTREGTLNKNGYARVDGVNPGQCQVTFPELDGQSWS

SEQ ID NO: 12521 - protein, 95 aa, Myxococcus xanthus
MNRDAFIVGIAEIPGDITSVEAEKMKSHVFGDTGVLAGVQRSRVRMTDGSEVTDAVYFTDVWQRRDGTWLMVFAHSSPAAPTEAQQAPEGAPQQQ

SEQ ID NO: 12522 - protein, 175 aa, Myxococcus xanthus
MWCLGRDVLCPEGNLLVRRGLVRHARPEGAEGQSPYTVGLPDGGRLTLWGFGALCECGEAIFVPRAGFAPVLLEGVPGHLPFRAEELGPARLPTTGHERRALRAGLASLAGWLAEHEDWISSEMGPSWRRECFGARRKAAPVEADGLASAWRRFASRLRSLDSGFNVCTAPVAGA

SEQ ID NO: 12523 - protein, 128 aa, Myxococcus xanthus
MVPPVELDSLREARLESRYFREALALTVFALLGLWAQPVALKVLGLGMAALGGLLALTCRSHGLVLVPRQGAQVRWPLGLARRGSPRDTRLLAAWTSLSEALRVRGVAVDGESSPLPPPPTQDGGPLS

SEQ ID NO: 12524 - protein, 166 aa, Myxococcus xanthus
LKLLSRSWEPVVGHKPRIAVLGLNPHAGEGGLLGREEVEVIGPAIRKARAARVDANGPIPADGLFAKPDEVGARYDAVLAMYHDQGLIPAKALDFERTVNVTLGLPVPRTSPDHGTAYAIAGKGEASCVPMVEALLKAAQLAGARLAHQATGRRARPGPLRPSPGR

SEQ ID NO: 12525 - protein, 160 aa, Myxococcus xanthus
MDFLKRTGDELKRTTDDLRGEAERLLKEVKDPQNQAKVKEGLEQLRTWAASTSKVAAEKIEVAVRQVEGAVERAFTNEEGGERTPPSRPAKAPAEPAAEAKAPKASASRPAAKKAGGKSIGRKKPAAKGAATKTAKKAVSGSKKTIGRPKKPVAKTTAGA

SEQ ID NO: 12526 - protein, 261 aa, Myxococcus xanthus
MDEEDEVTVIEVEASGPSTPVEAEASASPADTTSPPSDAEATPSEDVAALRQEVESLKAQLEFSQAKGRETMERLREAHERAKEAQERTVRHAADLENYRKRAQKEKEEVQRFGSEKLLKDLLPVMDNLDRAIDAAAKSPDLDSFEKGVAMTRKSFEDALGRHGVKGFSAKGQVFDPRVHEAIQQVETADVPAGHVAYEVVRGFYLNERLVRPAMVVVARAPAEPVAAAEPPAVAEPATATTDTEAPAAPAQSENSSGGSQ

SEQ ID NO: 12527 - protein, 569 aa, Myxococcus xanthus
MVGFTDSGERLVGQIAKRQAITNPENTVFAAKRLIGRKFDSPEGKKAIGVSPFKVASSPNGDAWVEIRGKGYSPPEVSAIVLMKMKQTAEDYLGEQVSEAVITVPAYFNDSQRQATKDAGRIAGLSVLRIINEPTAAALAYGLDKVQDGGTERIAVYDLGGGTFDISILELNAGVFEVKSTNGDTFLGGEDFDQRLIDYLAKRFAESNNGLDLRKDRMALQRLKEAAERAKHELSSAPETEVNLPFITADASGPKHLTETVDRATFEALVTDLIDRTIEPCRIALKDAGIPAQQINQVLLVGGMTRMPRVQQKVKEFFGREPHKGINPDEVVAVGAAIQGGVLKGEVKDVLLLDVTPLSLGVETAGGVFTKIIDKNTTIPCKKSQVFSTAVDNQPLVSVHVLQGEREMAADNKTLARFELVGIPPAPRGVPQIEVSFDIDANGIVHVSAKDLGTGKVQQVRVVSNSGLSEAEIQAMISDAQSHASDDKKKKELAELRNNADGLIYTTEKSLEEYASLLSEKDREEIKADLERLKEVLNTSDAAVLKESFQRLEGSAYRIADAIYTGQAS

SEQ ID NO: 12528 - protein, 98 aa, Myxococcus xanthus
MDVTEGIVISLITAMVVGVPLFGLTLRFSLKPLVEAFIRLKETQHGGMEVRLLRERIAHLERVLEAHGLMDDHLSLSLRPGAPERLPAVAPLKDRERV

SEQ ID NO: 12529 - protein, 477 aa, Myxococcus xanthus
MADVILEDCLERGLSLDSGLDVFLTQCARLVHARAGFVSLRGTRGPVLTRVLGEPGVDVLEAAHWQGVRKLDDGRTLFCTRLALGSLELGGLGLVVEGAFDGGGGLVMQLVEAIGEQLDSAVLGFLALTDGKGALERLDALSGEPPAASRGHIGRYEVVTPLGTGGMAQVLVARTRGPEGLGRLVALKRILPHLSSDPSIVQQFLDEARIGLRLSHPNLVHFYDFGEAEGAYYIAMELVRGVDLERLLRAAKGPLETAHAVAMVCQGLAGLHAAHVLQGEDGAPLELVHRDLSPHNLMVGFDGRVKVLDFGVAKARAQRTVTLPGIVKGKPLYMSPEQARGMRLDARSDLFAMGLVLYQSLIGARAFEKPEELATMHAICDEALPPRPSHISRALWDVLETALAKRPEARFGSAREMADRLADACRPANDSELVRLMAKHFPDRHREFMQLDRSASAGGRALDETPIMRPRLRKSSP

SEQ ID NO: 12530 - protein, 74 aa, Myxococcus xanthus
MLGALVAGRLARHRLRPLPGLALVPAPPPAAREPAALETDTDPERPSTPLERVRRRGPNGREHPWSEPGLPTLA

SEQ ID NO: 12531 - protein, 231 aa, Myxococcus xanthus
MRVFTADGTRLGTVVGCGGETFAIEGGLLRLKSFTARYGDVVDVRGEDVHLGLTRDEVSPEHDSPTQARSGHPESVLSAGFATPGELVVPLAREEAHPHLVVREAGQVRIHKVVRTEVRHFSVPVRREELVVERVSEQTVDAEGPPAPEAMASARPVLEGLVPFEAGTFVIPLREERVEVTRSVHVWQEVAVSRYTDEVLRQVHATVRKETAEVEERGEVLHDGPLDGLHS

SEQ ID NO: 12532 - protein, 395 aa, Myxococcus xanthus
MLLAALAVMVAACEKKTQPAPSGEGGTQAAQGQGAAPGGAPVDANTILLGQVGSLTGGQATFGISTRNGIELALKEANAAGGVKGKKLSIRVYDNQSKPEEAAQAATRLITQDKVALILGDVASSNSLAMAEKAQAAGVPMITPSSTNPTVTDKGDYIFRVCFIDPFQGFVMAKFARENLKLNTVAVLQDNKSAYSIGLADVFTRKFTEMGGKVTAVESYSQGDTDYRAQLTAIRKSQPEGIYVPGYYSEVGIIARQAREVGLKVPLMGGDGWDSEKLFELGGSAIEGSYFSNHYSPDNPDPRVQKFIADYKAAYGAVPDALAALGYDSARVAVDALERAKDLSGPSVRDAIAQTKDFPGVAGTVTLDAQRNAVKSAVVLKVEDGKTQYVTTINP

SEQ ID NO: 12533 - protein, 306 aa, Myxococcus xanthus
MAQLLQHLINGLAAGTIYALVALGYTMVYGVLKLINFAHGDVMMVGVYMGYATAFALGRDMRSSLLGVAVVFAVAMLGCALLGFLIERFAYRPLREKPRLTALITAIGISFALSYGFQLDLGFLPGAAPRAFPEVIEPVEWLVIGDRDVVVWNWQVISFGIAVALMVGLQYLVFRTRFGRAMRAVSWDHRVAALMGIPTDRVIALTFMLSSALAAGAGLLYAIKDTSVSPLMGLYVGLKAFVAAVIGGIGHVPGAVVGGLVLGLVEEFVVGYAASTWRDAVAFGFLILVLLVKPGGLFGRVAAEKV

SEQ ID NO: 12534 - protein, 157 aa, Myxococcus xanthus
MWVAAGCGYRLAPRGDGLPAGVTSLCAPVFLNATPEPTLETVFTRFLRQELIRVGRLGSAESCDGRMEGTVLSVANTPTTVVGKSTSPGFFFRVSARAQLRVVKDGQVLKQTEVFGSEDYVLGSGDILEAEANRQVALERLAEVLMRDGYDRLAGAW

SEQ ID NO: 12535 - protein, 354 aa, Myxococcus xanthus
METPAIPAPEARSAVPASLRGLLPVLLALPVLVLFQWLMSDAPFASYLLSVVGVNIILAVSLNIVNGMTGQFSIGHAGFMAVGAYISGVLSLNLKDVALSFLPVAVSDQVFFVVSLLVGGLAAALCGFLVGLPSLRLRGDYLAIVTLGFGEIIRVVVQNTDAFGRALGLSGIPQTSSPAMVYFFVFLTVLVARRITGSSHGRSLWAIREDEVAAEAMGVDTTGYKVRAFVISSFFAGIAGALFAHFVPIINPGSFTFVKSMEIVVMVVLGGLGSTTGAIVAATFLTLLPEGMRSLFTLLGAEGSLAQKVDQIRMPVYGLLLVALMLARPQGLFGTKEIWDVLPRWIPRKRRGLA

SEQ ID NO: 12536 - protein, 162 aa, Myxococcus xanthus
MKGAFINYRDWWRALLLTPRFQQEERELTQQAEHLLEVMGLSHRRDEEARNLPYGEQRRLEIARALGTQPKVLLLDEPAAGMNTREKADLMVLIRKLRDDFKLGVLVIEHDMKLVMGICECITVLDHGETIARGAPAQVRSDRKVIEAYLGDSYLESQGGAA

SEQ ID NO: 12537 - protein, 167 aa, Myxococcus xanthus
MKAHQLVPRGMAHAPEGRGVFPNMSVQENLELGAYLRTDTSGIQQDLEKSFTLFPVLKERRKQMAGTLSGGEQQMLAIARALLSKPQLLLLDEPSLGLAPQVTEAIFRTLREVNATGVSVLLVEQNAHLALNAAHYGYVLETGEVVMAGPGKALLESAEVRRAYLGE

SEQ ID NO: 12538 - protein, 248 aa, Myxococcus xanthus
MSPLSRLVASLATLSLIAAACAGQQKPDNREASSTIEEVANEGGEETPTVAFNVLDAPEGFTVKLPGPPPQAQRSEAALPKRTDKATLVTYAANEGGVSYIVNAVDYPEAFVATVPAEALINGGIQGIAGQVGGELKSSEDITLDGYPGKAYMLASPSGEVKGRSFLVGPRVYNLITVYNAGIGAPGADEFLTSLTLVNPPPKIEIPEADAGTDAGTAGAADGTAAAVEGGEDAGSAPDAGARRRRAK

SEQ ID NO: 12539 - protein, 255 aa, Myxococcus xanthus
MWDPAQYSRFRDERKRPFFDLLSRVDAASPSQVADLGCGTGDLTRVLAERWPSAQVSGVDASSEMIEAARRGAPVGSVRFEVADLADWAPSAPLDVLVSNAALHWLPDHEVLLGRLVAKLAPGGVLAFQVPANFDAPSHRRVDEVRALPRFASVLAPVRRRPVESLPVYASWLFGLGLTVEAWETTYLHVLPGEDAVLEWLLGTTLRPVLAALGEEEARAFVETLRPLLRESYPAQPYGTPFPFTRRFVVARRVA

SEQ ID NO: 12540 - protein, 224 aa, Myxococcus xanthus
MFRQVADDVHVLAVEFRIGGMDLGGRMTAVRLPDGGLWLHSPVRFSPEVRAAVDALGPVRFLVAPNLMHHLYVQEWAAAYPDAKVAAPAALRRKRPDLRIDLELGDTAEAGWAGVLDQVLVQGMPKVDELLFFHRPSQTLFVTDLAFNVHRTGSWFTRMYLKLSGAWQRLAPTMLVRSVIKDREAVRASLARTQAWDVERVVVCHGDVVEQGGREAVRNAFARF

SEQ ID NO: 12541 - protein, 245 aa, Myxococcus xanthus
MPSPGSSGGGRKPAPGRRRGAASLAAPTPASAPTAEPSEREARKARRQEGRRQAILVAARAVLVRGGVLGLTLEAVAAEADLSKPSLFYYFRSKEDLVGALAVEGLEREVKVLEAAVTAAASGVEALAALVRARVDLYAEDLDGFRVVYLWPQLTGRQSEAHQSRVLALSGQLNDVLEARLQADARAGRLAPGLQPRRLANLAWTVAHGVLSLGAGLEHSGVGTRFTLSQLRDEACAVLLRSSGR

SEQ ID NO: 12542 - protein, 181 aa, Myxococcus xanthus
MGISGRSGKQGSGFTCAECHSGGSTPTVTIEGPTTLAPGATGNYTLVIRGGPAAGAGYNVAVSDNGGTLNPGSASYKLSGEVTHKNIQAFSGGAARFDFTLVAPSTPGTVTLYGAGNSVNENGTDQGDASAATTLNVTVATGGGNGGDGDGDDGGGCAAAGGIPLLGAALVLLGTRLRRRR

SEQ ID NO: 12543 - protein, 287 aa, Myxococcus xanthus
MSLRRLLPILFLMGPLACATGPGYLASTESVAAVRRAPGELRVMTFNIQSGARGLERVAHVIRAAVPDVVALQEVDAKSTRARGLDQTEELSRLTGLKYRAHFRTTDLFGGAYGIAVLSRFPLEALAQYPLPGPRGAEPRTVAHAVVDVDGREVSVYLTHLVRRPFNSDTRVRQSAYVARLMAQDSRPKVLMGDLNDGPDSRSTRLLRRALHDVAAATGGTGGTYPLPLFLPTLRIDYVLACDAFTFVASRVLRVDVSDHYPVVADLRLKPEAVTVVAERAATGTAP

SEQ ID NO: 12544 - protein, 196 aa, Myxococcus xanthus
MVGAGVLTCGVFGLAWVVDRFGQREQAVPADVLVVLGARVMTGGAPSGALRARTEHAVALYHRGVAPRLVFSGGVGVNPPSEARAMLALATRMGVPAEACVLEEGSHSTDDNARLTAEVLRGLGARRVVVVSDPYHLLRARNYFRLYGWEVATSPALETERNLDTFDRIYWTVREAVALLLHPRVLLARAPTPSAP

SEQ ID NO: 12545 - protein, 543 aa, Myxococcus xanthus
MAGAVRLAEVAVELSPGLPYARFELAELYALEKPGDVSRTLGQVRQALATLAQDARYRRPALADLGALVLLAWGATAVLLMGLFFLRKLRYALHDFHHLLPRVVSRWQSLVLGLLLLSLPWVLGLGVLPALLVMLATVSLYLSRTERIVAAVLVAGVGLFPLAAGQLARVTAFAGTPAEDVYLLERGGLSAEEARARVLARMESRSATFAEVLSLAYFESRRGLLKEARTHFKAASALKSSDARLLTRFGNTLVALGDAEGAALLYVQASQSAPDLAAPHYNLAQVVRRRAKTLPDSEVGKELDRAATAMASAQALDGTLLVRDPPPEDRLLLNLLLLAPQLAESDWLPLADGTGAGRQVETQVSRWLLPGLPPGPMASAGAAALAVLLALWGFLGDRLKAAKVCERCGRAVCVRCDPELGIGSKQCGQCVNVFSRRGLVPQQLRARKQLQVDRHQAWTGRVAYSLGAVLAGAGHVASGVPVRGALYAFGFLFALAAVLLHQGLVRGPYGEAPLYLKLAPAALLLLGVHLLSLRGLRRLRRGE

SEQ ID NO: 12546 - protein, 252 aa, Myxococcus xanthus
MRHLFLLCAVSTLLSGVSAQADTVLVFAAVSTSDALQELAPAFTRTTGHAVEFSLGASSDLARQAVAGAPADVFLSADTAQMDAVEKAGLVAPSTRVDLLSNRLVVVVPVDAKSAPSSPAGLRGLKRLSLADPEAVPAGVYAKAWLVKAGLWKALAPNLVPALNVRAALAAVETGRVDAGVVYSTDAAHSKRVRVAFQVPEQDVPRIVYPAAALTKGAAPEAGRAFVRFLQSDAARKVFTRHGFGVPSARAP

SEQ ID NO: 12547 - protein, 143 aa, Myxococcus xanthus
MEVVFTPKAVVLASAVMAFPLLVRSARSGFEEVDPRLVAVARTLGDSRTRAFFRVTLPLAWRGVLVGTLLAFSRALGEFGATVLVAGNIPGRTQTLSLAIFQRTQLGRDAEALRLAGVAALLAFVAVFATEAVTRRRGRRVRA

SEQ ID NO: 12548 - protein, 279 aa, Myxococcus xanthus
MGYVPQDALLFPHLTAEQNVRYGVRPGRASRVDEAVEILELAPLLRRYPATLSGGEKQRVALARALATDPALLLLDEPLAALDVALKERVLPYLLRVRDEARVPMLYVTHQLGEARVLAREALLLDQGQVRAAGPAAEVLGAAARGLLAGEGDGEENILEGVLERPDDGGLRLRMQGGLSLWVPDSPALAPGTRAAYAVPAADILLSIQPLTGVSARNVMTGTVVNVESVATGEDAATVDVAGVRWVVWLTSASVRELGVVPGARVSLAVKTSACRRLR

SEQ ID NO: 12549 - protein, 153 aa, Myxococcus xanthus
PLFRMAGMLAVLTLLCACSDGRGTSGAPRLPAVELSPTTVGLAYEAMFTASGGEPPLRYTVSPPPAGFSFYTGEGRLLGPGSEAGDFSITVTVRDADGLENVRTYALKIYPRPEVTSDGLPAATAGDNYEHVLVATGGRPPLQWELVAGSVPT

SEQ ID NO: 12550 - protein, 291 aa, Myxococcus xanthus
MVVRSIDGEKLGKVFAIGDGEFHIEKGLFFPKDYLVRYSEISRIDGSEIILSHGKEMLSRLTGEDRTGAVAGTGGGAGVGPGAVGLGADQAAARASTGMDATTDTVGRKGTYDTGYDTRLGADARHGTGVDTDTAGLKATDTTVGARDIHGREEDITIPLHKEEVDVLKRDVQAGEVRVHKDVVEEDREMDVPVRRERVRVERRDVSPGRPAMNASFQEETVVVPLRAEEVEVQKRAVVDEEVVIHKDEVDEERHISEHVRREEVDIRTEGSDERARTLNAPSDDPLKRGY

SEQ ID NO: 12551 - protein, 687 aa, Myxococcus xanthus
MRRVLVLLPLLALASCKKDESPGAAKVTVDYSGFLPGCVQVNARDEGSGKELSTTVAGKGERTGGSLTVAVIAPSGWGSTIQVEARAFEQTCEAASPVVTRSTSVTLTPGTPVPVALSLQATDGDGDGYVSVLTGGTDCQDNNPDIHPGATELCNDVDDNCNGQSDTVELRLGQSCTEGEGCEGVRACGGNGEVLCNMPLAVYAYPDVDQDGHGDRNAAPVAFCAGIPQGYVTGPASDCNDNNASIRPGATELCNGVDDNCNDEIDETFTDLGTACTAEAQCAGVYVCDASGIATTCQATTTPNDWFLDGDGDTFGDGTAVTSCVSPGAGYVQAGGDCNDGNPFTYPGATELCDGLDNNCDGNVEGPEVCPSGGANWVAQDVGAMDQEWRSIFTEVPGDVTVVGNQGGVAILTVGSTTFQTNATNCGDLSRGWNAVWADMANQGRGYLGSSGGHLSFVDRSQVACTETHGNLVRSTQGLVGFRHEGTLELHGVTQNSGTVNQGLTFKWTGGIGPSALSFGPAAVAPLFDIHGRSRAVMFAVGGTDNGGNRGRIHRFNPSSGQWQSESVETSIPGMGRLRGVWVVNDKVAFAVGERMGGANTVLQWNGSTWSRMPFPNTNSETLTSVVAFGARSVYVTAKSGRIYRYDGTGWQILFDNSAFAFNDIAGTSPADLWVAGDNGKILHWPQ

SEQ ID NO: 12552 - protein, 200 aa, Myxococcus xanthus
MLMVWFGAHNAVAAPHEGLEARLQTGDIVLHTSRSSQSQAIQKATQSPLSHVGMVEVTEQGAWVVEAVQPVQRIRFSKWKARGAKGGILVLRPRELSDAQRQQAVAAAKAHLGKPYDWLFGWGDDAMYCSELVRKAYAQGAGLEYGKMERLDSLRVKGLEQQLRERYGKRVPLDLELVTPASIAADVRLEVVHSDFPSVR

SEQ ID NO: 12553 - protein, 185 aa, Myxococcus xanthus
MRLFTAVTLGPAIEARTTEELHRLRPLAPQARWVKLEGLHLTLVFLGDVDDARLPAIREALAPIGARHSPFVLSVVGGGAFGAPTHPRVLWADVCGATDALKALQADAAQVLRPLGFEPEHREYTAHLTLARAKHPRGDAALLACVQALKDTSLGEGRVDQLVLFESKGGHYLPRVEVPLTRTLG

SEQ ID NO: 12554 - protein, 477 aa, Myxococcus xanthus
MAEKLTPREKGFSEWYVDLVQKAKLADYSDVKGCMVIRPNGYALWENMQRVLDKMFKDLGHKNAYFPLLIPESYLKKEAEHVEGFNPQLAVVTHAGGSKLEEPYVIRPTSETIINRSFAKWIQSYRDLPLLLNQWANVMRWEMRTRLFLRTTEFLWQEGHTCHETEEDAEKETRQMLEVYRTFAEDYMAMPVMTGQKSESERFAGALRTYSIEAMMQDKKALQAGTSHNLGQNFAKAFDTQFQGRDGKMHHVWQTSWGVSTRLIGGLIMTHSDDAGLIVPPKLAATHVVIIPIFGKASDAEKAQVLEKTNALAADLRKAGLGVVLDDDDTKSPGFKYNEHELIGTCLRIELGPKDLAKNSCVMVRRDVRQKEFVSLDEAVSKAQAMLDAMQKDLFTKAKSFRDSHTFEVNSYEELKEKADQGFLLAHWNLDPKVEARIKEETGLTTRCRPFDLKQEPGKCVVTGEPSPGRIVFSKAY

SEQ ID NO: 12555 - protein, 73 aa, Myxococcus xanthus
MAIPAALLPVGLLHYRARRRSRRPAPLRSAVGLGLVSLAILRLAGNSRRKVRRVPSFSAFLPDEFTASVASGH

SEQ ID NO: 12556 - protein, 371 aa, Myxococcus xanthus
MSLQGTLKDFGIGDILQLIGQQQKTGTLHVRAKDQEVRIGFNDGHIIKAESVTRKRKELIGAMLVRSELITETQLEAALETQRRTLKRLGDVLVSSQALTAERFQAMMQLQATETLYRLFTWKSGTYEFIQEPVEPDAEAIHPLRAETVLMEGFRMVDEWPVIRQKIHRDDLVFERIKALPQPRGEEGGELGAIGPSERRIYDELSPGRDLRKLVDISCLGEFETCKALYNLVKGEYVRPILPEGAPAPVSGDQRLLARVAGPLGRLVATVGVLAAVVLVVPRALRPDHEAGVAAVFADSAAQRHVSQAQRVRIEAALEVFRLERGELPERLDSLVQAGLLKPGELKYPWREEYYYRRLAARQFILLPPLR

SEQ ID NO: 12557 - protein, 169 aa, Myxococcus xanthus
MVQTHGEAAWKAFLTDFAKKEPFFSKPVMPVSRMPADAFLRLNDELLARFYNNNPSAYWQFGVKSAEYALGQGQLKAMFSQGDFRRFLLFTPGIWKGYFTEGDLNVLPGQDHTDLHITHVPRPHPYFELSVMGFASGGLAYLGAQNLKHQVLKGFTRNDNEVLYRFNVG

SEQ ID NO: 12558 - protein, 108 aa, Myxococcus xanthus
MALMDARRLVDACLGADVPALVHREACSKPGCSPKFQVLVRPEDGPRVAALLQQRWMDSIEREGLVPMGRTAAPAAPLSEDGEPPCPACGTAAPLLEGACSDCGLQLD

SEQ ID NO: 12559 - protein, 88 aa, Myxococcus xanthus
MDMDPALAESQELPPSGALVTEVAPASMAEHAGLLPGMVVVEAANKPVRGAKDVVTALRKTKPGESVLLRVALPGGALELRALTVPKE

SEQ ID NO: 12560 - protein, 102 aa, Myxococcus xanthus
MGELARRLGVTEKTVTGVVDRLERQGHLLRERSATDRRVVHCRLTEDGQSTWERLNRVVVHGMHQFLGILDVGDRKALFRILEKLVKRMSAPATPTPRERAG

SEQ ID NO: 12561 - protein, 90 aa, Myxococcus xanthus
MQGATETLQAAATTNPKHVQWLLSRRFPELYGRRDNVEAKSPEDQAADTAALRELLIDRLGKFLPDELPASVPAEAAPSEQFEDKGASDA

SEQ ID NO: 12562 - protein, 291 aa, Myxococcus xanthus
MAAVDQLPLVLRIGSREDPPQLLLTGTPRPLKKIEELLFANAETQELKPGVVLRTGSSLSNFANLAPSAVANMRALANTRWGQQEVLGRLLFDVPGAIFGSAKWGRVEADAHEYAQQLDRRIVSVDPSPTSETGSDETGIIVQGCKSSALFGADGVPLKRVSVLADLSRRASPREWATTAIRAYLEWGCDALVVEVNTGGEMVETLISTVAGEMGVSVNVKPVRATSAKSKRAEPVSALAEAGRVEFVGTFPKLEAQLSKFTGINGRRDDRADAFCWGVHDLVFVEQFFAV

SEQ ID NO: 12563 - protein, 320 aa, Myxococcus xanthus
MRAAFRGSSKRKGTGLELSRWASAPPRREVPALLAAYAEMPWLGTIVDTVGDAFADVTWRAFTRQDPTTRKSLVDVSLRRACGDVRRERLKSLVETGDAVELPDHPLLRLLADPNDYMTGRDFAKLFCLHYDLTGEFFAVVEELAGVPVGLWPVPPDCVLALPDLSKPKSERTYTVAAGGRTFLLPAASVIYVKRLNPADPLGRGIGIAYSLGDEVDTDEHAARFTKNAFFNNMLPGAVIAIEGFNESQAGPARAFKESLARESGGPGNAGRVTITSGRTTVCSGSTRPLATCIVDHTAPLPHGHSCGWCTGCRRRLWAT

SEQ ID NO: 12564 - protein, 136 aa, Myxococcus xanthus
MVYRVPPEIVGDVTSSNKATSYAAREHLAEQATKPRAEVFLASMQKHLAPRFEDDVLLSYDSPVPADREHRLRVMGTLPSAFTFDEWRVEAGFKPHPERQGFAELLPGQKPNEPGETPTPVEGSSAEAHAEATKDG

SEQ ID NO: 12565 - protein, 166 aa, Myxococcus xanthus
MVDIEFDDEDEFAKKVERKVSKGILNAVSVRYLMLPGQYRQNERGGYDCDAQELLEVSVVTIPGNSRAVRSKSLDEAPEDIVERIAARVVELLDARAEVKSTDEDEQKSEPDEEDIEDEAKSTDEEDVEDEQKSEPDEDETKGFNAADAAKSFVEAFKGYIRGVKE

SEQ ID NO: 12566 - protein, 354 aa, Myxococcus xanthus
MVKALGPEVARELMDAAARSAPGRAEPGNAPRGTGVYASAENFGGFAKSVIAAGRRTGAGELVDAAKRFGNADVQKAVQLSKFDSAGVLVPIQQSGEVIEFLRPDAAMLKLGVRTQTFKGELHMGKQTGTSVFKWVGEGETVPKSAPKYGKIVLKAHKGMVLTDISNDLLRTPGVGDAGVGEDIRATVADGLDDAGFNGDGTGAAPKGLFAQLDAAHTFASTGTTAAAYLSDVDKAVELPLTAHVRMGNAAWVLHPTRATALLQLQNSGVWVFRQEMLDRGTIRGFPFVMTTRVPVSRITFSADWRQFIYGIDEDLILSEHDVRAEYDETTVRAIVKGDFKVRQPKAFSSITYT

SEQ ID NO: 12567 - protein, 321 aa, Myxococcus xanthus
MERRLGVRVGQRGTEFHLSGPSDAVAFSVRLLENLEEMIRAGRPVYREDVEQGIKVLGRGAESLQEVMLGPVLKSSGNRQISPKSINQKRYVDAIRSHDIVFGIGPAGTGKTYLAMAMAVAFLQERKVKRIILARPAVEAGEKLGFLPGDLQEKVNPYLRPLYDALHDMMAAERAAQLLEQGVVEVAPLAFMRGRTLNDAFVILDEAQNTTVEQMKMFLTRLGYNSKAVITGDVTQVDLPTGKMSGLNHARAVLKNIDGIHFAEFSEVDVVRHPLVQEVIRAYDRADVAQREAQAAREAATAAAHAPAATPATATEPVAVE

SEQ ID NO: 12568 - protein, 137 aa, Myxococcus xanthus
MNANSTDAGVLVGIRPGTVPAAVSVGTRNSAAVDRFGFDSCVLTALTGTATGAPTALSLAAKLQESADGQNGWTDLPDAAVVPLTAPNAVARLNVRLPTAQSYLRVVETVALTGGTSPTLGASSLIVLCGPDEIPAT

SEQ ID NO: 12569 - protein, 98 aa, Myxococcus xanthus
MRQGRPDALAVTYTGGYVTPGQVALDASQGPVTLPAEVEEAAILEACALYRGRGRDADVSSESLGDWSVSYRERSAGQRLASPRAELLVAPHVLWRAS

SEQ ID NO: 12570 - protein, 139 aa, Myxococcus xanthus
MARDTAADLATILAGGGLNLSAGANLFLGPTLEDDDATVPDVACFVLQTGGEPPQSYIGGGRKTYRTVTCQVRVRSARERFREGQALALAALDVLHLASAAPYVLIEVDEGSPNYIGTDGSDRHWWTFTVDASFIDLGA

SEQ ID NO: 12571 - protein, 31 aa, Myxococcus xanthus
MVVNSYDEKLTPGGVVEFTCKLLGNGAPVAV

SEQ ID NO: 12572 - protein, 193 aa, Myxococcus xanthus
MPAPDFTGTEFRIADPELRRLNPGAPVFVEVSPSGDADAWTPADAYVDPLFGDVHLASAPGPSALVRVSGYALPVHPLALVRSISLTVTNDVVELQVMGDAYKRRSVSLRDFSGELTGLALTELEVEALAEGIPLLIEVGKASGAQVFRAWVKVPELSHKLTPGALYEHTMKFLGFAFQSEDGAAFAWGYGSP

SEQ ID NO: 12573 - protein, 117 aa, Myxococcus xanthus
MSNKHKLLAKNRRVLKSVEVDGVKVNIIKPTMGDRLRLIEQAREAGEMTEKNEPTGDRAGARMLGRIAVCVLHDAETGRPMFSVNDIDELLDESWLEDLATDLTDAFNVSEEKMRGK

SEQ ID NO: 12574 - protein, 667 aa, Myxococcus xanthus
MLVWGTAAALAGGALGTAAGVVKSTAEIVGTVVAPALDGAGKAVVRFSGFVRGETPVVEGNLKKVAKGAEQVDASFAAAFRNAAARILVVAAPLAAVALAVAGVVLLAGTLYKAWNDASTGMRDAFVSAWRGVTEVAGRAVAFFRELFTGLGAIVGTWARGQLETFAFVVRNLARMAAPLARALNLDGVAASLEGLKDLNGDALLGGLKGFADGALGKLKDGFASVWADVSYGAGYAFDGVKLIGGDAAAFLREKFGGVFDDMLSGPKGKLRTPSAGPEIEAGRVQIGNFNAKEFLTSVGNVAAVIEQVARKKAKELADALARAVDEAKRTLTSRFTQALGGLYELFERFEQGMLVGGVWGGVIAVVAELLAQSSTFATLIQMTAGFIQFVADALGRVLAPVLPLLASAFNMVAPLLDAIVPVLEMLLAPLQAIAPVLEVLGTLFQGLAPLISVLGQILVALTQPLALLAGPIMKAFFAVVRIVAMGILYVVKGVGTVWNGIIGFIAGVFRALSKIPVVGGAFEKMARGLDSMKVPMDQVDGALNTLRDTTYESAAANSAAAVAQWENANATKKATEALSNVPSGFKVALARFNAQDPITGQSQTVHGASPVTSSPAVPVSGGNVSVGQIVIQAAHDPAETARQVYIEMKREAGRRRGNGEWLNGRY

SEQ ID NO: 12575 - protein, 69 aa, Myxococcus xanthus
MAPDSWVPEVAAWHSARAWSALPYLSAGGAFSVGETKVLGEVRDGEFVEFIHQGARVIGERLEFTLREV

SEQ ID NO: 12576 - protein, 971 aa, Myxococcus xanthus
MSPSESEWQTLFHGDIDEVDFAGEQLVFRGRDLGGRLQDTFIEVERAYGDDAQGVAVEVVMQAILTDNGTGVLLHTPVSPGWRLRQYAQKKASVLDAVRDLAQQIGWEARYRWRESSGTFALTYSEPTRTNPPLAWAFGPDDYRDVAKLVVSRTDVRNRVEVVFSDAGDLDVAGHAKTKSVVVEDAASQAAYGVRYMQIAEDASSNIDREVEARRMAEAALSDLCEPLADQEIDLDFFLPVELGDLFRFHPNGVHYSDAQNLAVTGFRHVFTAEGDARTTLTTRGKPSFGVSMWLEMDTRPGLGEPAHTSPPLVPLDINVTAVVNGFSLSLTPASSGPVASGYELHVSTSSGFTPSSSTLRGTFDTTAFGVADLMPGATYYVRVVPRDSYGNRGDPSPQFTVTPKQLEGASLSDSAVGFQHLLYPPTDNLIPNGYNEAGIRAVGKSPDGDRLVEDPVNARVGRWVRRVELANTGAWPGLSWTGGYGSDVPGGRLKCSPGDEFFAEVYVKASSATVGGMGTLHLLWEDGSGVYAGQNTGVFLGQVGTTYRRVTVKGTCPAGCTGVQLFWETQVAAADVGKRLYFDAVSMRKMVTFDLLAANTLKTSNYAEDGSGIPTAGAKLDNVGTTLKVASNNVQVGRYYLSDGFFRSVQALADTGSRIYYRGNNEGVPNIDRLNIQVIEGYSIAGAAGGAANFTWAHYHAVIQPQAVSDNLDALRFLEVGFYWAYSDSNAPQWLYGTSVPLADRKYQNGAVDGDASNATSAGFTFMYGDRFNRLRDSLSNRMLYLKVRLHNASGYSAERWFFPPSSYNVNMVRSATGPASTPTGGGGGGGGSHGTCVAPWEPVLLSDGSEVPAEMLRPGMKVLTMHEHERDGGIFEVTHVSRHQAARCTLTMTDGRAVVVTPDHRWRTFERGWIRTDELRPGETIDGVAPGRVARVEPSAAGDVMKISVRFAKTYVVQGLLAHNLKPRD

SEQ ID NO: 12577 - protein, 177 aa, Myxococcus xanthus
MTRANFHRVDLDRVFLPFVAVSLEVITRCAARGVRYVATHGFRDLPEQAELRRLYVAGKGGKASPAGLSAHNYGLAFDFVCDASPRPGVQPDWRESAYRVLGDESTKAGLVWGGRFGDSPHVQWPGYVSALQLTPLRTLVQQSSLADVWARLDAERLSPKWRAANPKLAAELERLGF

SEQ ID NO: 12578 - protein, 706 aa, Myxococcus xanthus
MRLHLDELTEAQSDSEPEERETPRRRKPAASPEMLELERSTREKMRAELQERFFGKRDAVLEAEDFQALYATRFSQEAETATLLVLERAYRSERGAIHVAGSREELAREAHQGLTVRDVVNKAEESLSGGSTQVVDVPEAHQEMERFASVPGNLMPDAPGVQRRAILRLAQRLVRPNLTINIAESDARRNQAAQAVKDAVISIKKGQRVIGDGELVNESHLVILRGMRAETDRLDLVQLQVGGTGLVGLLIVSTYFFCRAAFRRFRPTRKDGVLLGLLLLGLLGLLQIWVSIADAVQDRYTALPIEAFYYAFPVAAGAMLVRFILTQELALFFALVFACLTGVMLGNSLAFGVFTLVGSLVAADRIVKAKDRVGIFRAGLVTGAVNLVAVLFLFLVEGKGLSADTLITAVSAFAGSSLAVPVMVMALTPLIEATFGYASDIKLLELANLNHPALKELIVQAPGTYHHSIIIGSLVENAAETIGANPLLARSCAYYHDIGKGRNPLYFGENQKGENRHDALAPAMSAGMINPHLTDVLEMARQYRLHNLVEDAISNYLGTRTGGYFYHKDLKEQEVKEGAPPIDESIYRYPGPKPQFREAALVMIADAVEASTRSMTDPTTPKLLAQVQKIINLIFSEGQLDECDLTLKDLNLISQSFLHTLEGIYHTRPAYPAGAVGGGKAPPLVVAGAVPRPAEGKDKARTAGGT

SEQ ID NO: 12579 - protein, 61 aa, Myxococcus xanthus
MLTALQVALTAAGGFTIIKRILFGSAAMARAELAGALAAGQVAEKAAAIAVLEQLDSRGGK

SEQ ID NO: 12580 - protein, 26 aa, Myxococcus xanthus
MPIIVDEEIKDALEANGIFGGKFEEV

SEQ ID NO: 12581 - protein, 156 aa, Myxococcus xanthus
MLGVVLLEMATGKNLLFHPDDITQKVMGSLSVKSRRRVIQAIKRATLAGASPMVEDAIWRAATLTDADVDAMTEGLPQGLRVTLNRLLRVSPRERYQSAGELAKDLAGWVGGTFTKADAAAELRARAAQAEEMLDALGLTPPRGRGKRHPDDVTTS

SEQ ID NO: 12582 - protein, 125 aa, Myxococcus xanthus
MCGAPYRTLGNTEAALYLLVSMSDARLEQFKKMVVDFPDSPMSHFSLGKLYLERRQYPEAAQALESAVRLDPTYAAAMVALGDAWAGAGESDKAREVLGRAREHALAQGHPGLAEEIDERIADLS

SEQ ID NO: 12583 - protein, 577 aa, Myxococcus xanthus
LGLPADPATKDLARIYYLPDAPVGAEPYTASGDGAPLDVDALLAMSRAGLPTVAAPVPSPKPEEPADLYELRALLRRIRKPEHLAIVRRALAGEPLAAVGEQDTTLNTLMSCAAFVLPLSTPEAVVIELFRASFAATDWREGTEHLCEQAVLKLRRHRERRKARDASRLADNTAIWETLGSHAPESAASDGPGIEEDAPDPDAWMKELFLDITKDTRRQIRNCEANVAIVLSKSPEWRGVFRFNEVTKKLEVEGGPLGPSVDIETLDVLVANWIQLSKYGRLGLMPKAHVVAQQILAVAKRNSYDPVADYLGGLVWDGTPRLDGMLATYFGAQGDARYLQAVGAKFAISAVARALRPGCKVDTVMILEGPQGLRKSTAFSILGGRHFSDAPIDVTSRDSAMLASQFWFIELAELSTFRKSEDQALKAFITRTEDTYRPPYGRSNVQAPRRCVFVGTTNDDDYLRDPTGQRRFWPVKCSRIDTDALKRDRDQIWAEAVVRFHQGEDWWLSNEEAAGAEQQAALRMENVGDSRKEVILRWILEMPPEKRPSDVTLLHVGIEAFALHPAQVDHRISRENR

SEQ ID NO: 12584 - protein, 513 aa, Myxococcus xanthus
MTPAHKVLLCILDGWGIRQERDNNAIVLAGTPHLDKLASPYPFTELQTAGLAVGLPEGQMGNSEVGHTNIGAGRIVYQDLVRINRAAESGELAQNPVLRAALDGVKADGKALHLLGLVSPGGVHSSMDHLFALLKAAKERNVAHVYVHAFLDGRDTPPQSALGYVEELERFLHETHTGRIATVTGRFYAMDRDKRWDRVHQAYEALVFGRGPKAPDALSAIRASYAEKVTDEFVKPTVLAAGDGTPVGRIQDGDAVIFFNFRADRARELTQALAFPEFKEFDRGGLRLGRYVCMTQYDETFKLPALFEPDQPQDIFPELLSRQGLRQFRTAETEKYAHVTFFFNGGREVVYAGEDRHLVPSPRDVKTYDLKPEMSAYEVTAELVKRLDSGKYDFALVNFANPDMVGHSGRLDAAMKAVKAVDECLGALGKACERNGWVLAISADHGNCEQMVDLETGEPHTAHTLNPVPFHLIHPDFRGQKLRPGILADIAPTLCKVMGLPQSKEMNRQGLLP

SEQ ID NO: 12585 - protein, 243 aa, Myxococcus xanthus
MTYLARSLPGAIVKDTPGLLLVDSGLPCNTFNVVCRARLERHEADARIAAAVSHFRDKAFPFAWWVGPDAAPEDLDARLSAHGLVNAEQELGMSMDLSRLPGLALPSGLCIRRAEDEHTLTDFARVVAANWEPADPHVLDFYARTAHVALAPDSPIRFFVGYLDGEAVAASECHRAWGVAGLYSVATVRHARRRGIGAALTLAPLLDAREAGYRTATLQASAQGQGVYSRLGFVPQGTFREYQ

SEQ ID NO: 12586 - protein, 340 aa, Myxococcus xanthus
MKLAVGLPDLHPGKGAPVGAAFTSEGFLYPYLVGSDIGCGMGLWNVDLLARKAKPERWAGKLDLEGPWTGDTEGFLQEHGVKSSGYEAALGTVGGGNHFAELQRVDAVHDAKVFSALGLEADRLLLLVHSGSRGLGEAILRAHVDRHAAGGLADDSSEAQTYLTRHDHAVAWGRANRALVARRMLDGIGAMGQRVLDVCHNSVTPRRDTGRTQWLHRKGAAPSDEGPVVIPGSRGALSYLVIPTGESHASAHSLAHGAGRKWTRTAARERMRERFTAESLTRTAFKSHVVCENKDLLFEEAPPAYKPIDRVVTDLVEAGLVRVVATLAPVLTYKTRARPE

SEQ ID NO: 12587 - protein, 30 aa, Myxococcus xanthus
MTLPHRLARVVLIEQLYRAFTILKGEPYHK

SEQ ID NO: 12588 - protein, 189 aa, Myxococcus xanthus
MATKKKTTAKKTTTRAPAARKKTVSGKTPAKKKVPAAKKSAAKAPAKAAAKAPAKKKKAKLPVAPPQKVGPAENPAAKALAHRIGNLLVDKKAQDVVILDVRGMTSYADYFVIASAETDRQVSAMAENVQVQLKTGDEPMRPIGTEGFQTGQWVLLDYGEVVAHLFLTDLRAHYDLEGLWADASREKLA

SEQ ID NO: 12589 - protein, 187 aa, Myxococcus xanthus
LAPPGWSEPAQRPEFDEVVIVLTGELTIVVEGRRERISAGEVGLVPRGKRVVYRNDGQGACDYWSVCAPAFRPELAHMETPKPRVQENHVTIQVAHGQGRDFARLLTTWARAYLVQLELSGVELSLSLVDDRAIRRLNRTWRKKDKATDVLSFPAGDLPKGTPGPRPLGDVVISLDTAKRQAKEVGL

SEQ ID NO: 12590 - protein, 236 aa, Myxococcus xanthus
MRKDRRGGSRSYSDLGTTAFLEYAPDVRLALRVRAGARRFVYRPDPTANFGGPEVGVLGRYRFDRRHSLSVFGDWNSRRFGTPPRARPPETGGGSGFLAGRRQDAALTAGASYTYRGPLALGLTYAFQESSSNSYGETIRRHRVSANAGVRLPWRVTLLAQGSLGIIQYPDGIYLSPEIILVEEDEGQNSLSVKLARPLTESLDLEVAWGIWSTRLPRNSLTYTRQVFSTGFTWRY

SEQ ID NO: 12591 - protein, 85 aa, Myxococcus xanthus
MTPDVVYEVLVEGVTDAHDNPVLAPYHRASFAGFRPARPPSRSFQLWDMLPRHNRRDDVTGDLHRFISCLQEVTDLLLSDLDAYT

SEQ ID NO: 12592 - protein, 131 aa, Myxococcus xanthus
MALTAFTSRLGLGQGRIRPQRATPASGEYLFVLGDEEPGRRFELAPGDFVEVTQPVDVTGVHLVRTALRLRVPAGVPAGLAWEASLVVDGVKYARTLGRPGRERLVGDMAANVSKLSGVHTVGVRLELVSP

SEQ ID NO: 12593 - protein, 2867 aa, Myxococcus xanthus
ALLHETKLMDKESAADAWRVIAERDPASREAAATLDRLYTESGRHADLAWALALRRNQEGQSPQGREVSFRLAELQRTVLDDPNAALGLYRKILAEDSGHPGARAALEAWVKAAVPASGAALDVLDPVLVQVGDHARRVALREARMTSALTVEKILLSGEVRRIYERDMLQPSLAFMSAVKSFAQGLDREGVQPDLERLARETGSHEVLAEIYETAATELNAGDPAALELLRRSAELRESLDQPEEAARLWKSLLADAPQDRQALEALSRLYEKGENAKSLSEVYTRQAQLATDPEERVGLLLKAGEAYANAGEDAKAIETYRSALALRKVPEGLLALEKLYAKSRRFVEQADVLDQLADGAADEGARRNWLLKRAQLLEKEVGPAESLPVYRRLLELAPGDGQVVAGLERLMAHEAPRSEAARLLEPVYRGVNDTRKLVDVLEVLLPGVAPERRLEHLQEIATLREALGQTSLAFVARLRAFNEAPQEAAVRDELERLAADSGAFEEVAAAYEDQLELGAQDPLAGDLWRRLAGIYDNRLKRYDLAVRAMEEMSRRDPKNKSVLDAIARVHRRTGAHRELALVMRRQVAAEANASSQVNLLFELAHLAEETLADKSLAAQSYREILGLRPENANALKLLGRVLAEMERWPELAQHIEREIQLADERGAQEEASDLRVRLGRLKVSRLDDPRGALELYQAVLERRAGHAGAVGALEEMARSESPLRGAAASALEPVFASVGNHLKQVEMLESRASAEAVPQERAALLRRIAEIYAGSLENAEMGFLAATRALRELPDDLRSLELCVALVDKAEAPEELAAILTEVVGKAGDASRAELYRALARIQTDLGEPSEALVSWKRVLELRPTDTEALDGTVRLVASQGKPTELLEVLRRQLAVAEDPARRATVLFQMGTLQEEQLNDALGALATFRRLLELKPDDLPTLERMEALCQKQERWPELADALARRIALISAEEGLELKFRLAIVRESRLLDRTGALALYGEVLSVQANHAGAVGRMEALVAREPQNLLAVETLLRALRISGDITRLAQVIETRVGVSGDAFERKALLGELATLRESQEESELAFLALFRAFKEDPNDAAVRARLENAADASASYDELLAAYEEALPRVAEAADAAQVCLRLGQMLETKLRDSDRAICYYERARTLHPTVQEPSLVALDRLYLQLEAWPELAGILEALVAGVTEPSDRVGYLFRLGQLYQERLDSPDRAAGAYEGILALDPEHLASARLLEGIYESAGASEKLYGILKLQAEKVSGAERDRVLAKMAQVSAEGLADLGGSIDLYRELLAKNARNEQAFSALESLYERADRPQDLRELLEGRLAVTLDPREVVRLNERLGRVVYRLLKQPEQAVPYFKAALDRDARHRGVLDTLRELYDETGQREELVGVLRRLIPLQESSDGVKALRLRLAEVLAGMGRREESLDAARRALEVEPHQVPELDRVHELFVSLRAWNDAVRALELKVQVHLLTEEREQAVAAYFAVADLWVGQGGKPELSSGALEKVLELDPANRTAYERACDLYRTHNDWRAYAQVMDRYMPHLVTDEEKLAALRELARVQEARLGQKDVAFLALCRALQLDASDDTLREEVERLADETGSHEELAAVYEEVADELPRGALAERLYATLARVHDTHLDDPQAAEAAFRKILEFDPTNATALDGLAAVFQRRGRQREYVVALEQKLEAAGSIEQRKGILREIARVWDEQLEDPVESASALLRALELEPDAETLGVLTALYRRQRSWPDVASTLLRARDLADSIEERARIQVEVAGVYERDIGDDESAVAAYRQALELDPVNREALDSLERLHTRLDHPADLLAIYERMLELSEDWREKIRVLFRSATIWEDKYQNPANADVCVESVLAIDPQNVQAIKTLIRLRRAQARWEDLIAAYERQLALAVSPQEQAELYVDIGNVQYQQLKALDRAVNNYHAALAVDAECRPALHALGTMYERSGNWPFALEMLSKEAELAGQSKDAVELYYRLGKINEDMLMDTGSARTAYQQALAVDPGHLPSIRALKGIQEQEKDWSGYEQTLRQEAEQTEDPAAKGRALLDVARYHAETREDRDTATGYWQEALKHIPDSLEAARPLSDVYIAHEDWASGERMLDIVTRKMAEMAVADKDSVSAADLCRQLYRLGYVAEKLGKRDKALGCYEKAYELDATYLPALEGYGNLLVQTRRYEGALKVFQTILIHHREELTDLEVVEVYWQLGDIHAALNQTDRAQNHFEKALAIDPGHEPTLRALVALLEKQGQYEKSAELRQQLVGVLEGEARAKVCLELGRIARDELHDPYMAIDAFTNALKSQPDAPEVMDQLYVLLRETRQGQKAADVLARMLALPALGLEPHKAKRVWFALGELRRDDLKDVEGATEAFNAALDLDPRFVEAFSALEAMLGAARQWKQLEENYTKMLGRLPKTPETHVARMALWRALGDLYLQVLKHPEGAVAAYGVAAKGLPEDAAVQEAFADLAGQMPGREDEAIAALRRALPNTTDPRKVVGALVRLSALRKNYDGAWLAAQAVSGLLGEAGEDEQEILTKLGPYAKNKEKVEPRPLNDQLWHNHLFHPKARGPLAELLGLLFAKVGHLYAVPSQQYQLVPKRHRIDVASAPEYHVHHYRYVARVLGMEAVELYSPFLVATRERMAKRSNEPAPEPLINVELLQTHPASLRVGGKYFAEQGQKEVYYLLGRTLALARSELAFSQRVAPERLEAILQAALSLVVGNVRIAEAQHLVEPERRLLERSLNEPDRAVLAKAARAWLPTATPQAVRQYLEGAELTAARAGLLAAGEMEPVRRMVQGETGSAFRVPVRNKLRELLVFATSEDLHELRVAVGTHVEVQVRR

SEQ ID NO: 12594 - protein, 662 aa, Myxococcus xanthus
MISDDKIGPKGVKVRCKKCGHTITVRPAGATAAKDSASESSTSEASASTDVGKGSDASAATMPATLGTPPEGGLFTDVEEDEIGAVFDQVLSSGTQKIPTEAANEAAAREASAENVRKLAEAEAEPDKEEAKANAAAHEWYVAIDEKQVGPFNVEKVKDLWDRGEVGPDSLCWRSGFSDWIPLSETAELASVLAPRPSKPVIVAPEPVSGSTPAVSSGPVQSAFSAGKGARGDSGPAGASEEAVGWKPSAASVLASLVKEENDALSKPPPTPAPALGREPVSQSRLLDVPMPPPEPVSSPSLRGAEVPMAQPMASPMPYGQQPMQQYPQPAPMPYGHQPGPQYAQPMPAPYPPQPSYPAPYPPQGGGKGKTGLFVGIAAGLLLVGGGAAALFLKGGSGADAAQANPPVVAATPVATPSPTPSSPPPPQANTAPVAAAQPPVNSATAPPPPPTEVAAAPVNTPPPETPPTAVAAAPVATPTPPPVETPKPAETAVAKAERPTNRRTSSSSRREDSEPRASAPARAERPSSSDSDDDFDELFGTKKSAPEAKPSSARPTAYVPPEPGGGVPDRLQQSDIMAVVLANKPAIIKCVNEQKKKDPSLSGKLVMRWTIQTSGKTSAVSSRTDEFRTTYMASCISGLIKSWSFPRHKRQGEPIDFPFTF

SEQ ID NO: 12595 - protein, 298 aa, Myxococcus xanthus
MQLRKMMLVLTALGAMSGLMAGCGDDSTSPGACTSNDECGESEICHPTAQVCVQTCNSGSDCPSTAKTCAPLGGTSTTSICQCSTDVLCNGGTDSESTGLVCSNLDNVCVTACTSDTECTGDRTCNVSTGQCEEGDTGPASCTGEGLSTCAYGQICSSGTCSAPPAPTCQNYKDFPNKADLGTTGPIIYKVGFVNATTDTAFCPANLPKRLRIRINAYSNTPFPDTSTELSRFFYVQTDGGRLNASISRSEGNYIVTGANRSNAEIIVNLCVAATSTTNSAGFYFSDGNFVCHQSNYQ

SEQ ID NO: 12596 - protein, 139 aa, Myxococcus xanthus
MAEGASERLNCAEGTVQLGSKEEGLSCVKSGTKAGARTSHGAYVEYHPNGVKAAQGQFENGLKVGTWTFYDASGNKRGTAEFKDGGWHGQRVMYFPSGKPQRIEEYKNGRKNGVVKDLAEDGRVLSQVRYENNREVAAQ

SEQ ID NO: 12597 - protein, 126 aa, Myxococcus xanthus
MAGHLKTELVVQALDMAVGQRQPQSVVHHSDQGTQYTSIGFGLRCKEAGVRPSMGSVGDAYDNAMCESFFATLECELLARRRFTSHAEARMAVFRFIEGWYNPLRRHSALDYESPAGYEKKHRAAA

SEQ ID NO: 12598 - protein, 177 aa, Myxococcus xanthus
MTHANFERVDLDLVYPSFVVVALEVIARCAARGVRYVATHGFRDLTEQAELRRLYLAGKGGKAAPAGLSAHNYGLAFDFVCDASPQPGVQPDWCESAYLVLGEESAKAGLVWGGRFGDSPHVQWPGYVSALQLTPLRTLVQQSSLAGVWARLNAERLSPKWRAANPKLAAELERLGF

SEQ ID NO: 12599 - protein, 61 aa, Myxococcus xanthus
MLTALQVALTAAGGFTIIKRILFGSAAIARAELAGAIAAGQVAEKAAAIAVLEQLDSRGDK

SEQ ID NO: 12600 - protein, 45 aa, Myxococcus xanthus
MTDAIKSAAKALSKAATKGVLHKRTASRRISRLAKAATKAARAQA

SEQ ID NO: 12601 - protein, 57 aa, Myxococcus xanthus
MGRSEGPALVIRYDRVKLPGQDERPVCFVVEKPADGYEDGRVKAFNTGGGYVVDRWP

SEQ ID NO: 12602 - protein, 278 aa, Myxococcus xanthus
MQTLEGIPATDGAGVRLTRVIGQPSLRNLDPFLMLDRFHSDDPGAYINGFPNHPHRGFETVTVMLDGRMRHRDSRGNSGLIAGGGSQWMTAGRGLIHSEMPEQVQGLMSGFQLWLNLPAKEKMCPPAYQDHTPAQLAEERLSPSGSRARVIAGHMNGLQGPVRERPTQPLLLTLALEDDRPFELDTPSDHTAFAFVSTGEVDLGPEDTSKPVREGSLALLGPGSRLRVRARNRRSELLIAAAMPLREPIVQYGPFVMNTREEIQQAFDDYRAGVLDQG

SEQ ID NO: 12603 - protein, 288 aa, Myxococcus xanthus
DSGKQRLGLFIARKPDDVHRAAEASSERLREGRPLSVLDGIPVVLKDEVDLAGFPTTLGTRFRTQVAAADSTVAARLKAAGAIILGKANMNEIGINPIGLNPHHGAARNPWDTGRITGGSSSASAAAVAAGLCPLSIGADGGGSIRIPAALCGIVGLKATWGRIPETGVPPLCWNVGHVGPMGLTVDDVAAAYAVLAGPDGHDLVSQGQSPHHLSGYEDEGLSGVRLGICWDYFEDADADVVARCKEAVAALSAAGARVVEIPPPDLNTVLWTHSCIILSKMSEVMLP

SEQ ID NO: 12604 - protein, 548 aa, Myxococcus xanthus
MLETVTKGFRAAKNRLAGKSELTPELVDESLRDIRVSLLEADVAFDVVKKFVARVREKSVGELVQTTITDTAGQKRKVSPMDHFIKICHDELEALMGPVDTSLKLKPKGQLSGIMMVGLQGSGKTTTTGKLASRLLQEGRKPLLVAADIYRPAAVDQLKVLGERLKVPVYHEPGIQPPELAKRGYPAAREQKCDVVLIDTAARLAIGESLMAELESIKGNVQPDNILLVCDAMIGQDAVRTAGEFDRRLTRDGFILTKLDGDARGGAALSIKEVTGKPIKFLGMGESMDKLEEFRPAGLAGRILGFGDIVGLMKDFEKVVDEKKAEEDAKKLLSGQFTMKDFVEQIRMVRKMGPLKDLLEKFPLFGDLTEHLNPDEKELTKIESMYDSMTAKERLRPDTVNNSRINRIAKGSGRKVEEVKELLQKFGMMQQVMGTIGQNPGLLGRIPGFKQLGQLSQMKNMDLSSMFGGDPKMMEKMMSGGMPGMGMPMQLPQIAPGYTPPMGQAAMAKARLMGYAPPSAAGKSEDRDAIKERRKREKENKKKNRKKK

SEQ ID NO: 12605 - protein, 276 aa, Myxococcus xanthus
MRKKKSAAHKRKDSASKRAIRKRQRSEPKPLSLKTINNVLTVLHKLLTLAEEHGVIRQAPRVKPFGKLPKPPFDFLSFEEADQLLAVAEPEWRTLLRVAIKTGLRQGELIGLRWHDLTLTRGLLHVRRTIWRGIEGLPKGGRERTVDLPASVVDALNAHRHRRGRFVFCQEDGQPLTKGKMAAPLGRALRAAGITREVGQIGWHDLRHTYGSHLAMRGIPLKVIQELIGHATIEMTNRYAHLSPDTRREAVAVLDRPLALPCDIRATWKEAAPNRT

SEQ ID NO: 12606 - protein, 352 aa, Myxococcus xanthus
MGIDKADVRAVYHYNLPKGLESYSQEIGRAGRDGAPSVVELFACPDDVPSLENFALGDTPTREAIQSLVTELLGLGPELSVDMFALSTRHDVRPLVLRTALTYLELEGVLRQGTPYYAGYKVQPLMPIDALVGRFQGERVQFLRDVFSQAKKGRTWYSLDPAEVASSLRQPRERVVRAIEYLEEQGLVLLQVSEPRQRFTRLRPQEDAAALTALLHQRFQQREAQEVTRVRDVLKLVTHAGCQSNALVAHFGQRREQPCGHCTFCRTGAAQVLPAVRQRPALPAGLDAAGFRALAAKHPESLGHPRQAARFLCGLSSPALTRAKLGGHKLFGALEGWPFEEVLDFCGRSAVD

SEQ ID NO: 12607 - protein, 459 aa, Myxococcus xanthus
LSACAPPVDETDTALTQQSFAGDEDDPDSHSQGTQLHATPVRTVMYDEALVQHDGALRVANLKLTRGEIVANMPLSVDGTTPSLMFCGGGAPANEKRSCGFVVDGQGVCSPGSLVTLMGGDSGSPRNRCTGAPVVRVCAGEAPCEHQGPGYLASANSSFSLNNCPAVTFTCPSSGVYTALAGPGTPNTTWLMQLTSRSSTYPTTRKILRGEELIGARLRQPSMGPALVVEDVINANALPNTEGSGMWEPSGHTFLYQVRYTTASVPLCPTGANWAVPVKGLFDLQGDRYESPRAFTLGCDAGVIAKCYRWGYHPWLDGATSGPITEAHWSCTRMARADYCGQGTSFTLDGTRIRPWDALTPAIISAPSPDSSSNDLTFEAGWNTAGPACLSHLRWKHLTAPCVPLNPPIYDANGNIVNDCRDPNTPYAPGKCAEICDNAEEAAQYYGSRVFNHSAINTP

SEQ ID NO: 12608 - protein, 187 aa, Myxococcus xanthus
MKAWIAGALSISLAAGSALGAAPAPEPVDATLRTSAGKEVRLSKWRGKPVILFYEDKDSTKLNSTLKKELFARGQERGILDAAWVLAVANLQNFDFFPARQIALSFVRDEEKKVGVPILVDMDGALGKAPWKLPLKTSNIVLLDAEGALVYRHSGRMKPDELMTFFAVLSRLVGVDLNSPAPSEPSP

SEQ ID NO: 12609 - protein, 396 aa, Myxococcus xanthus
MADTTLTPGAELERLVDIMRKLRAEGGCPWDREQDLRSLRPYLLEEAFEVLEEMDRVAYGGSWRTFCEELGDLLFQIVFHAQLASELGEFSLADVAKAIGDKLVSRHPHVFGNGQRMEGAEQVLDNWAKLKAAEKKRKTGREGSVLDGVPVAAPALMRAERLTEKASRIGFDWPDVASVRAKLTEELGELDEAIAANDRDAIEHELGDVLFSLANLARFVGAPAEDALRMAIRRFTARFQHIESALRAEGVALGDATLEHMERHWQEAKAREKALPSPTWVPRAPVTTLRLGVADLPAQRAFWDVLAPRLGWITRRAPAADQARYEDGGILIAFEAAGTPTTGLRLSLTAPSLAAVERLPGILAEIPGSRLIQHQAGRLTFQDPAGLVWEYTTSVE

SEQ ID NO: 12610 - protein, 377 aa, Myxococcus xanthus
MDAKTLEARARAEGTPVIESDTATFVWRGRGPICLQGDFQDWRGKPLPFKRVAPGLWARTLTLPADAYVEYALEDPRGQRVEDPLNRHPSDNGFGGINHSFHMPQARSSLPARHPRGAPRGRVTRHVVDTGDVDLPGQRRVYLYAPPTDASVPLVVVYDGEDYLRRVRLPELVDTLVAEGRMRPVALALVCNGGETRSMEYACSEYTVGLLKWKVLPLARQKLSLVDERRSPGAHAVLGASLGGLMALYTGLRMPDVFGRVLSQSGAFAVEGHDFVVFDLARPPPRRPLDIWLDCGRFEGLLEGNRRIAPVLSEAGHQVELREYSGGHNYPAWREDLVHGLERHFPPPPRQAPGVIAFFRAVTRARPPCGDTPEDAR

SEQ ID NO: 12611 - protein, 197 aa, Myxococcus xanthus
MSRIDGGNRPSSPKGPAHERASAPEQRPASGTATQGTKGVQAHRTVQTFQGRSDFEPDRRPAQRAVTAPPPDATAIAGADAELELLSEFPDQADAQGGLASAMLHAHANEPASQARIVERLKQDGRLESLFGEVFREGNPYVEQPHRNAVVRALGTAMARGTVTSDDLRAFARGAYAQEWRQIGSELTTPRPLTEKP

SEQ ID NO: 12612 - protein, 465 aa, Myxococcus xanthus
MDTARFILFALVTGIATVAVHVYLYRRLFTATSEHRAWRRVGMGVMTVLGTLLVLSWSVTRFLPMDSTFAVATAVWTWMGMAIYLLLALGVLGAVRKVAARMQRSSGEPAVVELRGGETASVSHAHAVDGSAQAGGTLAATGTESVSVTPEALATSGHGAAATHAEAAPVAMAERPGGATSEAPAPVDVERRRFLARATAGGAVLAAGGVTGFGMWSAFHPPVVNEVAVKLPGLPKALDGFSIVHLSDIHVGPVIRRRFMDELVRRCNALRSDLVCITGDLVDGHVASLAPAVSALSELKSRHGTYFVTGNHEYYWSDAAWAEALERMDVHVLRNRHVRIGDTAASFDLVGVDDWSAGKMGFSQGYDLAAATAGRDSERASVLLAHQPSNWKVAAREGMGLQLSGHTHGGQFFPFTLAVSAIWEHDAGLFHEGDRHLYVSRGTGFWGPPLRVGAPPEIVRVTLLA

SEQ ID NO: 12613 - protein, 103 aa, Myxococcus xanthus
MLAAEAADSNDQVAEAIRDKLALYATTLERLIRHGQQMGEFRQDVDALAAAHSLLGGLLGMLVHQNLFRASVDYDPLYRAVMRIHLAGLVQATGFDCVNASQS

SEQ ID NO: 12614 - protein, 283 aa, Myxococcus xanthus
MDVAVLTFEGLPQLDAFDASLLPALAALGVEARPVVWDDPAMDWKTVRLALVRNTWDSHLRRDAFVAWADKVGRLTQLHNPAPVLRWNTHKHYLRELEEKGVLVTPTTWVRKGDTLDVGELALRHSWDAVVLKPAVSAGALKTHVFPRAEAPAATARLAELTREGDVMVQPYLTAFETEGERSYVFFDGVLSHAVRRPPTLLDAPRGFSEPTAFTPEDAAELRLAESVLEAVGRPLLYARVDVATDNAGQSRLQELEATEPRLFLSLDAGAADRLARAIVAKL

SEQ ID NO: 12615 - protein, 178 aa, Myxococcus xanthus
MARALLLSLLVRQHMALKEKFRAKYPHPWLVWEAGAWNVPEVVEGNVAATRLPLTDLRDCLPAGDALCFELVGQTDGSPLRLGRASNNALVVNDATVSREQLHLSPTLEGRWTVTRVAASRTVTLGGTALEPEQPTVLQPGVQLHVGDVRLTFHAAEDFDERIGRIAAQVLAQTAAPR

SEQ ID NO: 12616 - protein, 146 aa, Myxococcus xanthus
MANGTLWILVGNASRARLFATDAKAEEDWRLVEEFHHDESRARQAELIEQADNPNAGTLHGPPAENEPNGRRELEHDRFARELSVFLDKAHDRRDFDKLVIAAPPGFLGRIRRLLSARVRQRVLLDVDSDYSNVPAKELPNRVPVI

SEQ ID NO: 12617 - protein, 46 aa, Myxococcus xanthus
MSVFQEGLETVVRRLAAVTSMEGFTRRVSGARGVAERWDAARGLAS

SEQ ID NO: 12618 - protein, 204 aa, Myxococcus xanthus
TVMATNHAGTARTQATSYAQIPPVPFKVVLTSDTDGVYTDLHLYEPTDASAKDGTLDVRKMAHVYWADTASPSGGTFFLNSQGGDFDQPAYGPYLYIHRSPPKGVYLVATNYWPSGDKAHTVATLNLSLFEGTPNEIRRMVRIPLATPGTTRVLAWVNVLGDGQAEVFVPSQDPRPKHAAWPKNLDEALKALQSNEDGGGEGEY

SEQ ID NO: 12619 - protein, 116 aa, Myxococcus xanthus
MMETKWAYLIHLLGWTLPVIAFQLVVLVRHYKERSGAVLKAVLPPAFIMGLYLSIADHLAISTGIWNFGEGKHLGVYLGVVPLEEVVFFLITSVLVSLGLALFTGLVALLGEARAS

SEQ ID NO: 12620 - protein, 128 aa, Myxococcus xanthus
MTYARFLGLFVVVPILFLAWRYRRTFTGRSLAPMGLLLIVVYAATSPWDNLAVKRGLWGFDPERIWGIKLGYLPLEEYLFFGLQTLLVGLWAQARLARALAPDAQASRPAAETGERREGALTAREVAP

SEQ ID NO: 12621 - protein, 213 aa, Myxococcus xanthus
MAGLLRYTHHSFRALDAMSAGAKAVCGKALGLSPVAVESLRRLADHIGEDLELAKRLHAQGLGVVLSSAPAVVPLDAEVLWAAPLSRFTRWMQVLASHRPALYPTVPLLFTPTLPLTVLAAALGSPVLAGSVVGLVAVRTLLALRLAGLHAPVADAGRAYAVTDWLLGEALLLAAFLRSLWRQGTVTWRGQTYVLRPGGRMIRVAPELSGGPG

SEQ ID NO: 12622 - protein, 308 aa, Myxococcus xanthus
MMRLAKLPALPDAAGTYRWFYADVTAGPYSAVCIFMLGSLFSPRYSVAARRGGRPLEHSAVNFALYHAGVRRLWVLSEYARAELDAPGRLRIGRSTLSYEGDGTVRMAVDDGTAPWGRPVRASLTLEPMTPVGEVVQLMPGLPHYWQALAPRSQARLEVSSLGIEASGLGYHDTNHGGELLGARLSGWHWARTHREDETVVDYHLPEGVAPLRVVAGARGVRCERGPTLVESRPTHITGWGLRVPSRLHAGNVVVGQPKLLESSPFYARLEARQGPLDSLGEVADFRRFHSPFIRWMAHFRTRMGRAA

SEQ ID NO: 12623 - protein, 485 aa, Myxococcus xanthus
MKRTRVAVVGGGIGGLTAAGLLAKDGHEVTLFERGASLGGKAQAVIVNGITLDTGPTLLTLPHLVRGTFQQLGAEDLLPRFTELEPQCAYRFEDGCDFTAYKDVERMAESAAGVRPGERDGIRGFYTEAAAIWRAAGEPYLEAPFEGMAGFMTRVAKRGVGAVMAGMKMGTLHELAARHFKTDHLRQYVGRFATYTGASPYEASAAFALIPHIEHAYGVHHVRGGIGALVDALGQAVRRLGMRIHLDTRVRFERTREGYQVGPQEGTERFDSVVVNADPLERLARAEEPLALSGFVLLLEVEGRMALPHHTVLFGGDYRREFDELFGGQLASDPTVYFCNPSATDESMVPPGRTGLFVMVNAPALPVDARGAEQATRDWEAGAERVKAQMLERLCRHYPALKGRVRVIGQRSPVDLAAQGAPGGSIYGFLPHGKFGPFRRPRIRGNTPGLFFAGGGTHPGGGVPLVMLSGRFAAELASQHLRRDA

SEQ ID NO: 12624 - protein, 281 aa, Myxococcus xanthus
MVDGDDAASAADALPVRLARARQRVAELYLPMPELASRELGPPADRVKGSEAATPWDAREFAALEHTVRHFRIPEQPFQDLISGMEMDLTKHRYATWEELDLYCYRVAGVVGLMLTPVLGCSDAAAVEPAADLGRAMQLTNILRDVREDLERGRVYLPAEELAAFGLSEDDLRRGQVGARWRSFMRFQVERSRAYYARAAAGVRYLTGFGSQRMVRLMGAIYGDILRDIEARDYDVFSARAHVTTRRKLALASAAMVRPAAVLPAPQGEVRMPLLPTGAGG

SEQ ID NO: 12625 - protein, 344 aa, Myxococcus xanthus
MYADVSRFFQDERLRAAMTFQTMYLGVSPYASPAVYGLLPFTELGVGIWFPKGGLYAIPQALERLAREEGVRFHYGAPVERILTDGGRTRGVRLEGGEVVEADAVLCNADLPYAYEKLLDPKATTLKRKEKLRYTSSGYMLYLGMKRRYPELLHHNVVFGRDYKGSFDDIFERFRVPEDPSFYVNAPTRTDASLAPEGKDALYVLVPVPHQHPDLDWKVEGPKVRAKFFARMAELGFPSLESDIEVERVFTPDDWAGTFNLARGSAFGLSQNFTQIGPFRPSNQDARVKNLFFVGASTQPGTGLPTVLISARLVTERLMTWAHAQGVSLSPRTAAATPLEGVAA

SEQ ID NO: 12626 - protein, 361 aa, Myxococcus xanthus
MALTLPDAQPPTGLLPLEQAWLQLVQTEVETSLAELFELPDEAGLDVRWTQALTQARAYTLRPAKRLRPALVMAGHCLARGSAVVPSGLWRFAAGLELLHTFLLIHDDVADQAELRRGAAPLHRMLAPGRAGEDLAVVVGDHLFARALEVMLGSGLTCVAGVVQYYLGVCRHTAAGQYLDLDLGRAPLAEVTLFQTLRVAHLKTARYGFCAPLVCGAMLGGASSGLVEELERVGRHVGLAYQLRDDLLGLFGDSNVAGKAADGDFLQGKRTFPVLAAFARATEAERTELEALWALPVEQKDAAALARARALVESCGGRAACERMVVRASRAARRSLQSLPNPNGVRELLDALIARLAHRAA

SEQ ID NO: 12627 - protein, 1164 aa, Myxococcus xanthus
MQVPGLERVKAVASMDSDSLALLDTGAVFAWGANGSGQLGDGDTTDRATPGPVPGLNAVASVVGGAQHALVLRKDGTLWAWGGGLSGQLGHGGSERHVVPAPVMRLAGVTSMATGSFHSLAALGDGSVWAWGRNTYGQLGDGSTAERHAAVRVEGLGGVRSVASAAHHSLAVGMDGTVWAWGRNAAGQLGDGTTLDRARPVAVPGLTSVTAVAAGGSHVLALRSDGSVWAWGYNALGQLGDGTTVDRLTPVRVSGLGAVVAVAAGSYFSMALQSDGTVWTWGEGFEGQLGDGGGVQRLSPVRVEGLANITRVAAGSAHALAVRGDGTVWAWGDNGEGQLGDGSWADRFRPVQVPGLQGITAVSGGRSHSMALQGDGTVRAWGYNGYGQLGDGTLTSRVRPALIPGLTGIQALHPSHLHVLALHADGTLRGWGYNRFGQLGLGAAGWSAVPVQVRGIGRVDRLSVGRAHTLMVRADGTVMAWGENGSGQLGDGTSTHRTGPVSVPGVPCVRSVASGIQHSLALACDGTVWAWGANARGQLGDGTTTPRVTPGLVEGLRGVVALAAGGDASVALRADGSVWSWGGNASGQLGDGTLTDRALPAHVEHLSNAVPVPVGETHALAVGEDGALWAWGANGSGQLGDGGTAPSLTPVRVKGLERVASVAAGRAFSVAVRDDGTAWAWGTNPSGQLGDGTNHARSVPNQVTSLKGIRAMSAGAHHVVALSADGTVWTWGDNTLGQLGDGSSSPTGMWPRQVPELRGVEAVAAGEQFTVAVLLDGTARAWGSNEYGQLGDGKTGPQLTPMAVKIEGPKIRPPVRTVRAWGQHAVVQMSDGTVQTWGDNTFGQLGDGTTTRRAVPLTVYGLASVVAVSSGAWHSLALLSDGTVWAWGANGFGQLGDGTSTPRTRPVQVAGLGDVVAIGSGGYHALAVCSDGSVWTWGYNAFGQLGDGTAESRSLPTRVEGLEGVVAVAGGDHYSLALHSDGTLSAWGNNASGQLGDGTGTTRYSRVAVKGVDGVVDVRAGATHTVALRGDGTVWTWGDNAFGQLGDGASGTRMRLVPRPVPNLSSVSAVGAGARHTFAVALKGTVWTWGRNSHGQLGLGDNTNRTEPLRVRELSDVTVVSGGADFSLAMKRDGTVLSWGSSLYGSLGLGATGHRSSPGQVALP

SEQ ID NO: 12628 - protein, 1255 aa, Myxococcus xanthus
MMAGATSMAGAGGQAGLLRNVDVNNTALQEGLGEGVVNSDTFPLGDTNGNMVASGCTYTSMPSTSSLPRSAAYLPHVSEGISAAALNEFLCLSTGTNNVMQPRTAVIHGIGLTAKEIRVMAENGTGLIWSPRSNISLYGDTAMVSAYKNQGVTIALGTDWLRSGSMNLLRELQCADYLNTSHYARTFSDEDLWRMVTSNASDLVDTFEKTGRIAEGKVADLAIFQLRTFTRSPHRAVITSNPEHVVLTMRGGKALYGDQALMAGLRGADTCDTLDVCGASKEVCLQSEIGKNLEALTSGATAKYPLFACGTPENEPTCSPRRASLDSRWPAVVNSSTSYTGEVRAADKDGDGLVDSVDNCPAIFNPIRPMDNGKQADSDGDGIGDACDPCPLEAGNACTSFTVGDDDHDGIVTWLDNCPFVANPDQADADGDGKGDACDACSSVPNPGDLGCPATIHELKTPVGGSLPLVGKPVSILDVVVTGVVKGGASSQGYWVQTYPLPSGTSVDNSGLYVYSPKGDLAAGDRIDITTGVLTVYFGLPELTEVKYVKRSSGNEVPAPVVVTTADIRTGGPRAAALEGVLVEVRDVAVNTGVDEFGQFLVNEAGDAGQPGLMIDDQAYAFQVPSIGTRFGALRGVLTYNFNDSKLVPRFQADMPLPPPSLTGFGPDGYARVGGTGPVNTFPQALTLSLSSAYAEALDVVITSSNESALSVQDGRITIPAGQTSATVQVNAVAPAQSVTLTATLGGSTQTATIRVLGADEQPEVVGVTPGDVTMVPGGEVVFTVQLDRPAPANATVALSVNPATGFGTFVPANGTLTVTENATEAVFSFITDAAATATEPGTVTASIGATSASATVTLDQNAPRLTALSPSSAVTIPAGGTQTFTLTVDRAAAQDTVVELAVVPGAGVQNYGTVPASATIPAGATEVTFTFTADAQGEGTGTVYASLYGITQTTALTVLPPPPVLSALSPSTAAVLTGRTFTFTVTLDRPAQTDETDVALTLEPATGVGLIPASVRVARDATTATFTFTADEVSSPAEALLTASFGGVDRTAQVSVILTAEGGLVINEVDYDMPGAGDSLEFVEIYNNSSTPASLSSVFLVFVNGSNMSSYQKIALAEVNGGVLGPREYLVVGAATVVGPLAGRAGVHTLQRGTTDFIQNGEPDAVALYDEATDALIDSLSYEGHVVNATIAGTDTKFDLREGDADTKTLADSNTAQGSLCRDADSTDTDVNAADFSFTTTVTPGAANVITKTP

SEQ ID NO: 12629 - protein, 127 aa, Myxococcus xanthus
MGSFQQFLTDKNIPTEKLLRLSRQLESYGSEGRTLLKKRSARRRDKDTQGKSYESLSIGKPKSGRGISAQQLQAALGDLPLTASVRGKLVRAVNAVLGKQGGSPVDAPALFGASPVRRGATAKKSAS

SEQ ID NO: 12630 - protein, 222 aa, Myxococcus xanthus
MRRVLPVLLLLHAPAPVANGTVGVRPLVSAPSASDVTSHDAEASTTPETRDVLLRRLVARVALAQVRKQDAAWHPDQRDCAGLIRFAFRSAYKQVAAERLSTPLWRDGRGRPSDFADAEVLLQQSFQLLGRDDATRESLRTGDVLAFRQEQDAGPIFHLMLVVRPEDRAHAPARVVYHPGEKGAAVRTGVLHHLVTEAPLEWRPVPQNASFLGFFRFKEWMS

SEQ ID NO: 12631 - protein, 524 aa, Myxococcus xanthus
MRRLLAAVFCAAVVLAACEDDSPPPPTPPPPSTETYPDAGTRPDAGTQEPWACQRSTTVHNAPMRLLTRLQLEMSRATSSAQRTEAIDRFVAEVEEQGGRPLVSDVKAGHPRVAFFVRGEAGRDTFVAGDFNGWSATATPLVQVRDTDLYVAEVEVPRTGPQPYKLVKDGDFIADPGARHVAWDDFNRHDVGRFNSLIYPELQDAAKGRLTAWYGVPATVLGDARDVFVYTPAEYDGPECPSLPVMYLHDGNESLTRESFAEAADSHYAARPADSAVLVFVALPDQSVRLAQYTFPPARAPGWPTPRGDDYLAFIRDDLMPRVEASYRVKTGPQETGIAGASLGGLISVYAGFQMPEKFGFVGSQSGTLFWPHDGVVDRDDGNAMIVRASQEPVVPVRFYVDHGSPVAGCTRDGEEGGDDCQSNLEFVEALRGRGYGVAHWNEPGAEHDWAFWKRRLPKLLCNFRNAWPGGVRPVVRPHSFATMARASRSAAPASSDRNRRGSVASSSCSRDWPALSVATSTRA

SEQ ID NO: 12632 - protein, 490 aa, Myxococcus xanthus
MQTMQSSAEAPVSDAGPRASDEELQEGSTLGNYQLEQLLGEGSMGRVFQARHTRLGRQVALKVLRPEHARDGGFVRRFFQEARTVNQINHEHIVEIFDFVDESAMGGHVYCVMELLRGQSLSSLAQAEPLTLARIQRFVVQVCAALGAAHQVGVVHRDVKPDNLFVIHRAGQPDFVKVLDFGVAKLLTAEGSTTGTVDGTIIGTPAYMAPEQAAGLPVDARSDIYAVGNILYELISGKPPFQAPAFGHLVVQIITQPPPPLPSHLPSGEPVPPQLAELVMRCLSKEPEARPQSLTEVTTSLLLLPASAQALTPAPAELALEASERPTHKVQVAVTGRWHRRAVVTVGTAALVVVAAVVTWSGMQPEPAPAEAPVAQVADVVGRPAAAPQLLPPVTLTVRSFPEGAQVLRLDTGELLGVTPLVKQVSGEAAPLRLRVELAGYAPLERMVDLDKHAELEVPLVKALPSPRQKPAAGTQRDTGKKSRERPVAQ

SEQ ID NO: 12633 - protein, 263 aa, Myxococcus xanthus
MKTFESRLRVWCGLLLVAGAVGCTVNFPDDVPYTCTETADCGGDGYVCTSLPDNGPRYCCLPDPTEVCNGLDDDCDGLVDNLETACYTGPEGTLDVGLCHAGESICTRDASIACVGQVLPGTEICNGLDDDCDGTADEDFDLKTDPGHCGACNNDCSFLQDCVNGECVRRQELDCANGQDDDGDGFPDCQDRADCDGKSCGPECVCEGGSKTEVSCTNGEDDDGDGLVDCADRADCPTETQCGPLRSDRENDYPRCQVNGVCL

SEQ ID NO: 12634 - protein, 308 aa, Myxococcus xanthus
MVAQASDLVETRERLAEGHDAAVRCAEAACFAEPAELLDADLLTTGRLSLEDAGWTLRTWTYDRDLRVVHEDFVTGRNPRDEDFANEAAAMLSKRLTALARPRAMLTVNVNVPQAVVKVGERIVGVGSVEVRQAPGAVAVEVSADEYGTQTRTLDLMPGARETVDVMLEISGPAPDGPPDDSVVGVASSRKAPQKSLFKRPALYTVLVGLAAVGAGVVMGMAAKDVEKRGGDADGDGMFDVTRKERLDAQSQANLATVLLVGGGAVTAGSVAWLVLVPARSAPASTSVAPGSGGGASTSLHIMVGGSF

SEQ ID NO: 12635 - protein, 223 aa, Myxococcus xanthus
LGLSGFESQIFYDNLRVDTPDRMPFTAAPRAPTPPPGPYADDFNRDTLGDAWNATNPSAVKLVDGALVVELMHNRPVWLKQPIPTNATIEFDAWTDNPEGDIKVEVWGDGRSFYAGDLRLQYTATGYVIIFGGWRNTQSAIARQNEHANDRAVRDGAAVVPGKRHHIKITRNGGTLAWELDGQPYLTLKDPVPLEGPRNQYFGFSGWKNRVHFDNLKIQPLGP

SEQ ID NO: 12636 - protein, 447 aa, Myxococcus xanthus
MGQPTQFAIGAFIQSLAQNPGLEQELQALGPRAHVYVGTGLGDLPTIRSISLDLYRAQRRWDRFWSAPERNGALRKWRETQEPLPGLPPEPSTVDEATRDEAEDAWWHFWAGRSPELREYLDELREIEAIGVPEDGDVESAKLAVIKEKRTRNARLQKKWMSPEPPWNAVSSNVLWNIHNTPASQISMMGRITGMTFAPVAACSSFGYGLRLAINAIQLGQAKAVVMGMTDPPPMPLTVGGFYNARVISADASISKPLTALRGTHIAGGSVVWVLGDLEHFTAKGFKPLGMEPIAVGVTADADHIITPSKEGPTLAIREALAAAGCAPEDMGSWDLHATATPGDYLEVQNLRDVLPEQVLITARKGTFGHGMSAGGGWELTAQYLGYGQGKVFPTPLKEAELNKQISRVHGRFVFDEAVEAPAGCAGKLSMGVGGINACVISRPWSK

SEQ ID NO: 12637 - protein, 775 aa, Myxococcus xanthus
MNLTKPIRLALAERGYTNPTPVQARAFRPAIEGKDLIVRSKTGTGKTAAFGLPLLEKIPADERRVRALILCPTRELALQVADELKMLAKHKGLKIAAIYGGASMKQQEDALEEGTPIIVGTPGRVFDHINRGNLKLDACDHAVLDEADEMLNQGFYEEVTRILDRLPKTRQVLLFSATVPTDIQNLIARYTTNAETLLLSGDVFTVEHIHHIRYDVSDAFPKPRNLIYVLEKEEPQNAIIFCNTRDDTALVTAVLNRNGFDAELLNGDLPQKERERVMGKVKRGEVAFMVATDIAARGIDISGLEYVINYSLPEDPAVYLHRVGRTGRIGNKGTAINLFSGRELATYTSLEKKYGIKFDKREMPAPEEAMRLWTERHVREIQEAAGGSVFEGFLPLAAQLKPRADADDLIAFLLKYFFSHLRMEKAAAAMAAEGREPPQERKFESREGGRRERGERKERGERRDRERDDRREKRGESSERERERRPRRDDARRERGAESGRGAAALEAGPGEAKLWVNLGTADGLGPGSIATALEDAGAPVGKVVRAELRPTFAYVFVAEEDAAAFETINGKQHGAKTLRVEKSKPRTERDATPRPPPSPDAGPGEAKLWINLGMDDGMDEAKLPAALEAAGAPAGKVLRTLLRPTYGYAYVAEEDAPGFEAVNGKPHGEKALKVERHRPRGARPERRPRTEALPEVPGQTRLWVGLGKQDGLDEAGVAAALEAAGAPAGKVLRTDLRPTYAYVFVADEDVAAFEATHGKPHGERTLKVEQAKRK

SEQ ID NO: 12638 - protein, 409 aa, Myxococcus xanthus
MSAVEGTNYYFRKAARIMDVGTPIETLLATPLREVKVQVSIEMDSGEIRTFLGYRIQHDNSRGPMKGGLRYHPMLDQDECASLASLMTWKTAVVNVPYGGAKGGIACDPSQLSIKELERLTRKYVDQVQDVIGPTRDIPAPDVNTNPQVMAWIMDQYSRYHGHSPAVVTGKPLELYGSKGREAATGRGLLYVAREILRDLGLPVKGTRFALQGFGNVGGHTAQLLWEDGGVVVAVADALGGVRNPQGLDIPSLFEHVKRTGTVTGFSGGASCSNDDVLGADCEVLIPAALGHVLTRENAHAVRAKLIIEGANGPTQPEADEIFEKRGIFVVPDVLASAGGVTVSYFEWVQNLQHLSWEEDRVNAELEKSMKEAYERVAQVARSRKVSMRTAAYILAIGRVGKATVLRGI

SEQ ID NO: 12639 - protein, 405 aa, Myxococcus xanthus
MVTLEDIQAARERLRSAIRPTPCPQSDYYTERTECAAVFFKLENLQRTGAFKERGALNKLLTLTEDERRRGVIAASAGNHAQGVAYHARRLGVSATIVMPERTPLIKVSRTRDDYGARVVLKGTNYDEAYAEALRIQKAEDRVFIHPFNDAHVIAGQGTIGLELLEQCPDLEVVLVPIGGGGLISGIACALKETRPDIRVVGVQAETIASMKASVEAGERVLLAAAGTTIADGIAVKRVGDLTFPMVQKYVDEVVAVDEEEIAAAILTLLEQEKSVVEGAGAVGLAALLSGDVPAARGRRTAIILSGGNIDMNVISRIIERGLVKAGRLVQLEVRLPDRPGMLAKLTTQVADLRANVVEIHHERAFSKAGLGEAMVEVTLETTGPAQIEELERALHRLGWQVARK

SEQ ID NO: 12640 - protein, 463 aa, Myxococcus xanthus
MSPAALLSALLLTAAPSSPGQKAKSLAASRAWEELYLAFSAGEASDVPTPQRGTVATALQKGCEALKDEDPVMAYSLGERATVYEESAGALRCLARAARKTDQRATAEAALRKGLAQYPKDGAFGLELGRLLMEEQDAAGAVAALEKVPAKSKEAAEAKRLLVQARAKTTEETAARREAERLELRMNGATSGRPTVMVETQPTVAGQGRGSTRSASLNYESGTGADGMRTRSNSRFVIRYFNNDRDFGQRAEYEGRIVAALDEAYDFTRSMLGEVRHAPVDIILYTLAEFQTHFGAARARTVAGLYSDNAIRINDAAELTPQTKATLVHEYVHAALDELCGGYGNNLPVWLNEGLAEYVEWRYMGGEDPERSVRNYMARAAKANSLPKLAQMEGSSLIMQRNPTVAYATSAVAVRELVKRGGTGRFLTMVREVGQGRPIDEALTEHYGKTRASLDEDVRAALQ

SEQ ID NO: 12641 - protein, 522 aa, Myxococcus xanthus
MTSPKSGPPKALLIGVVTVLVGGAVAGAFFLGRRSGQSGDGGGTVTNLLGGERKGPPSAGAGVEGMPEPAMTALEVPGTAAPSALWVDVHHPGKVRDALAANVWLRDQLQKPLGQGFIGAWAAFFGSTGEDLQAGFKGAVLDLFAGQLLDAPFRVTWFAGDARSSTPAFILPKPGRAATSAYEALDGVASRGGMTAPHCPGGGSEGTFEMKRWLVAEQTLWAGRLKDRLVLARHPVAVLHGLCAELPALKAKDGVDVELGYDAEAYGREVQLLSSVVGLAPGTRLQFGVEAGRLVGRGIAGELLDGPARLDAAPLSDDLLKLVPEDTPVLLAFQLKLPESLDPETLKAYWEKGGGKGPTRTRQVALVWTPRGDAKLPVELAVLWGRTDDAAALEGLFSGGYNRLVRGTHCNHVVLASNDAELERLRKACAGQQPNMLNAAGPVVAGLRAPTSVAFGVNTGRLLSGLTMDGYLSEFRVSRNAPMPSAAPPEIEAARSDLESLPYLGLRGTVQGDSLVPGGFGS

SEQ ID NO: 12642 - protein, 284 aa, Myxococcus xanthus
MREFRFLDEKRKLGSLSPVEEARWNELRAQLGVDDAPAADAAAWQQQAAPQGYYADDGQWYPYPAGYEQQPQGYYADDGQWYPYPAGYEQQPQGYYAADGQWYPYPAGYDPNQGYDPNAQAYAQQGYDPNAQAYAHQGYDPNAQAYAQQGYDPNAQAYAQQGYDPNAQAYSQHAYDPNAQAYAQQAHDPNAGYAQGTAEAWQADPQAYAAQSAQQQSYPTAPAHQPAVEPDNLSLSDDIDIPALSEPVAVDHARRRWTGSVCNERGAITQHRADVLGQAAVHGG

SEQ ID NO: 12643 - protein, 1858 aa, Myxococcus xanthus
MSSDKQPSTVDDQSASFADVTADIQQNAQPVFEEAQPEALSVAEDDFSEVGSDTPAVAASAEPETSLEASFADLSMEVESAPDAPVAPTGDALASTEVEVPSSEVELLDGTADSEPVLAHEQSPAPIDDAWASAPLAVETEHMDVADAGDIIDVAAMAEPEAASQAADSEIALDSSEMVEASAADSADTTDAWDAGATTDVTADAMATADHGATDFIAASAGDTYEAQPAEIALDTADEASAEAEPTEIALDAAHVSDAAVEHASEMAFDASAGSEPGANYSPAEIALDASDVAVPEAYPETALTASDASDAATAEAYPAADFATAEAYPTTEFATAEAYPEADFATADVSDASTAEAYPEVALTASEASDTTAAAPELALSASDVIETSAPEPELAAADASSEVVAEASPYGSAAASFEEPFAETAFSEGDATAAGETYAEAVLDAAEVSDTAVSEHAFATSETSESATAEAYPEVALDTADVSDAATMELDSVETAAEATSDTALASSAWGSTDAAEEFATTEYAASDVSELAAIETAPETAHSTYDHSSEAFDGKEVVLDATEMSEPEIALDTSDVAESPSAQSPSEITLDATDVAESAPIEPAAEISLEASDVAEPQSAEIALDGSEVSEESPAQQGSVPTLELNAAEVSSDEPSLDVIDVESAPGHAGDEASFQAADGGSEQPTLEVIEVGTEATASEVDFPPEAAPFASSDVPSLEIRPVQVGPDLHAETIEVAGDPPQSSARTPSAEEMFDLSGNPEEAVPLAAANEFLAHGHFAPTDERSVAMAEGDAGAIELQPEWASTSEQPAAEAAQTEWATSGEQAAASDAYAGWEDPVSETVELQAEWAEPVTASEWTTSEQTAAATGHAEWAASDTGIASEAGQAEWADSTTELQPEWVAAEGAAAPEAQPEWATSAEQAHTEAQAQWTETAAQAALGSEQTEWAANTPEAAQADWASSSTETAPGEIQAEWAEPIAEDGQAQWATAEAPPSDGWNTASTEAAPVEVQAEWAESSEASPTEVQADGSTPTLDAAPVEVQAEWDDPAQQDGATLTAEPAATEAQAEWAAPEIADATTDAQAGWTTPGADTAQSEWTASSENGWATAEEVQTEWTAPATETAAQPEWATTPAAEAARTDWAAPGTENAGQPEWATPATEAVPGEGAQPEWASPATEEVQAEWATPAAEAAASSEWASPAAEGAQAEWATPATETAASSEWASPATEEVQAEWATPAAETAASSEWASPAVEEVQGEWATPATEAAASSQWASPAAEGAQSEWATPATEAAQAGWAAAPVEAAQPEWASPAAEEAQGEWASPATEEAQGEWANPAAEEAQAEWVTPAEGAAPAPEWASPATEEVQAEWATPEEGTAPAPEWASPATEDVQAEWATDAAAPASEWASPATEEVQAEWATPATETAAQPEWASPATEAAQPVWAAPTEGAQAEWAAPEAEEVQEEWAAAPAEGAQQGWATPTEAPHAEWSTPATEEVQAEWADPIEEAAPAAEWASTSAPAASQWDTPADNAPAAAEWSATSHDTSATWDAPATTEWSSEQTANWNEASAEEVSLADTATPASAEWNDASVDVEPVMEEAEPIEAASAWEAEPILDSAPVTSQWAAASTDSPFGAQAQDFTEAMPIEEEEVSMELEQEVAEIDVEEEAVVPPPAPMAAIPVVASAPVHFAQAASLATAAQAQHTAVVMPAAPANHVAVEREPLFDDTAIVGGTALTSFVEGEHRVIIHTVEGQVKRGTIRDADLLDEVISLEQQSGFAAEQIPGKRVKAIFFMLAAGARQPQVEGQKIRVTFNDGRQVAGFSQDFQGSTPGFFVIPADQRTNTARIFIYRSSVQAVAEG

SEQ ID NO: 12644 - protein, 514 aa, Myxococcus xanthus
MDPVALGLLRKELIKLMGMTAARGTFTRLGYAHGWRTAEAMKGAVPWKDESLWRRAGGRLHTLQGQVRVEPVQRRADEGPEPFAEAQWHDSYEAEQHLLHLGQSDQPVCWSLTGFASGYMSYVNGKPIYGTELRCVGKGDAACHYVGRPAEEWSTECTEVLRLYETQCMEGMLAQVTEALRQAERKLRAKRQSLARAGVTEDPAGMVARSEAMQRIINLARRVAKVDSTVLVTGESGVGKERIARLIHDESGRAHTAFVAVNCAAVTESLLESELFGHARGAFTGATHDRAGLFEAAHGGTLFLDEVGEVPPSMQAKLLRVLQEREVRRVGENTSRKVDVRLVAATNRDLAEEVRQGRFRQDLYYRLRVIELKIPPLRERRDDVLPLARLLLAEAAERLGRRVSGLSPDAADQLLRYAWPGNVRELSNAVERAVALCEGTRVEREDLPEEVRAAPPSLVPTGNPQRLEDMEKHYILAVLAQNGGNRARTAEQLDIGVATLYRKLKQYGHPEAAH

SEQ ID NO: 12645 - protein, 138 aa, Myxococcus xanthus
MDGSAVHVDRGRDIAVLRLDAPAPVRPLDVAQALPAPGEQLVFAGRNDRPDEPQQAVLERLGRCPSLPEVPAVLFTTIRGRPGDSGAPLVDARMQVVGLVHGGAACRVAAPTAGLAEVVAQLSRRGPALARQAPPPPR

SEQ ID NO: 12646 - protein, 111 aa, Myxococcus xanthus
MAGKKDKGPQDARPRDIGDDQQAGFHAGENFQPRNRGQVADAQDRGAADASRHLAHEHGDAAPHADTPWEARVERGEEWTSQDVPDREARGDEEPDSAVSRQGLVSPPPEE

SEQ ID NO: 12647 - protein, 80 aa, Myxococcus xanthus
MDGYALCGHFRSEPTLKHIPVIFVSGYAPRTEGPADQPVPDAYLVKPVKPPVLIAQLHALLARAEAVTPAAPTIQPAWKS

SEQ ID NO: 12648 - protein, 516 aa, Myxococcus xanthus
MAGEQIDIPVIIGGKHIRTGKTDTVRMPHNHQHVLATLHEADASHAEQAIQAALAVKDDWARMPFQSRAAIFLRAAELLASRYRPILNAATMLGQGKTAHQAEIDAACEAIDFIRFNVHFAEQILGWQPEAAYQTWNMTDYRPLDGFVFAVAPFNFTAIALNLATAPAIMGNVVLFKPSSTAALSAWYIMELLREAGLPDGVINMLPGDGPTVGNPVLASPHLGGIHFTGSTPTFNAMWRTVGENISRYKQYPRIVGETGGKDFIVAHPSAADDLEALAVAIVRGGFEYQGQKCSAASRVFIPESLWPKLKPRLQALISEIRMGDVSDFRNFMGAVIDEKSFKKVSSYIDLAKSDSGASIVAGGDVDRKQGWFVKPTLVQLDSPTHRILREEIFAPLVGLHVYPDAKYEETLREVDQAASYALTGAVFARDRKAIDTALRELRHAAGNFYINDKPTGAVVGQQPFGGGRASGTNDKAGSGLNLVRWTSPRTIKETFVPPVKVPYPFMDNDPNEGAI

SEQ ID NO: 12649 - protein, 247 aa, Myxococcus xanthus
MCVDGDELLYLDEATVADPAKNVRGGIPVLFPNAGPLPGDTYSVDRQQYTLPQHGFARKLPWKVRQADTSRLVVELSSNEETLRHFPWRFDARLTFSLAGQRLTLESAFENQDTRPMPLHLGFHPYFRVPDAAKAQAGVDTDATHAWDNWRKQDVNVTGLNLTEEEVDLHLKDHSKPGTTLERGPGLKPIRLSWSPEYRVLVVWTQRGKDFVCVEPWTAAKGALATGEGLPHVQPGTRTSLRFDIQG

SEQ ID NO: 12650 - protein, 118 aa, Myxococcus xanthus
MPGRYVLETEWLDSGGGSLGPGTASRFLVQGIVLTGGGTALRVMRGDRITQSIGVGYVDKEIKTDEDYAQAVHDSQASGVLPTRQNYFRDLEIELEILRRSDPEAAARFDADALAAHP

SEQ ID NO: 12651 - protein, 278 aa, Myxococcus xanthus
MAEVQRHPLLTREEELQLARHYKESGDVNAAYRLVASNLRLVVKLAHEYHRNPLSLLDLVQEGNIGLMQAVKKYDPERGVKLSSYAAWWIRAYILRYIMDNWKMVKLGTTEAQRKLFFKLRQEQEKLIAQGFEASPKLLAERLNVTEQDVVEMDQRLGHDEMSIDAPLGNDDDSRTTRADRYLPSNSMPADERLGAEQLKALFREKLSEFARTLEGKERFIFESRLVSDEPLTLQDIGDKYGVSRERARQIEAALINRMRDFMREQIPDFDLVASPKA

SEQ ID NO: 12652 - protein, 1572 aa, Myxococcus xanthus
  unsure (1)..(1572): unsure at all Xaa locations
MKCLIRLAALSALMLSGVALAKPLYITVPRSYGTQEPVAVDVAFEDKGPVELRVLKPENLDAFIRAQGDLRRAYQTPPTLKNPGRALSRGFNAVRTPGMFLLDTLSPAFRDEVGEVLPRAPQASGSGEPLAKVAEGPERLVGVPPGFTVTRSQWLNLDLGGAERDFNVPGFNASGSSGFQERRVTLAPLPAGTYVLQLVQGRVEGQVVLVVSDLTVQLKQTDGQVLLRVAGRDQKPREGAEVQVYLPKGKGPAGKTNAKGEVTLEVSEPRVIATATAGGDTAIVDTDFYSALAVAPDVFIYSDRPIYKPGHEVKFRGVVRQPDTFLARLFTPKKRQVQVKLVSQEGRALTTRAAVDEFGAFHGTLKVPDDLGTGVLRVEAEVDGHPHQGEARVQDYVKPTFYLEMEPASETVVPGQTLRAKVRARRYAGGTPDATKYEVFLYRSLLDAPAWVDDAGKGGQGSDVTYGSASTTEGKLSVPERLYSSVEARGAYEDPWSSASAFDANGEAEIEVAVPALAAGEERLPYRYSLTVRARDDQETFANATSAFFLSKVEVLGLARYSDAVVAKSGDATLAIRATTLSGKPYGVTQGEVEFVLRKADGSEKSLGKRSFSTAADGTHREKVPTSDVGSVLARVVVKDKNGETWQGEESLLVIGGADEPVARVPNLTLASLSGTLAPGDTAKLVALMPDSWGSGGRDAGPVWVTLSGASLYDTQVVELTGRTLVHSFNVEKRFGSAVYASVAYPTATGRWEERTVAFRVIPRERTLTVELQPRRAEATPLTEQSIDVRVVDHEGRGVVAQLSVGVVDKAVYAIQSEFRPRVLDFFYPPARNNVSNFFSSEFQGYGYGEALARKMAGLPDHAFASIKPPSRQTKDLERDTAHWDPAVVTDRDGRATVRFTLPSNQTLWVVTAVAADTSGRFGEGTSEFATRGGLNLYAALPQFLREGDEAVASVRLSAGEKSPASQLLDVKLASLGALKADQFEHKVELAKGGEQVVPLTLKASSTGAAQLTVNVAGGKDSLRDLKRFDVGPAAVEDVVKVSAWGGGALEVPAPQEATLARVELVLQPSIVDAALSNVRELLTYPYGCLEQLVSTTVPNVAVYQVLQKAGALAKLDTDTQALLAEARSRSVQGTARILDMSVKGGGFTWFGGYETPSLPQTLIALDGLAYAAEAGLVDRADPRLVESARWLEAQEGLPPEYEATRAYVLARLEGSKQAARVRALVQGAEGGDLYPLALAVLAAEKAGVIKEPALQTQINALVARSAQGYATLAALGPGQSLEQSEAFFRFPLRRVGMTAIAAHAGSFGTLDITRARXRXLELLSEPDLSTFDRSTTLLHSLWLLERDAKAMQGMKAPEVKGVKTPVKFAPRGLGLVAVLAPGTRTVDVGGFDGVATLRATTRTPLSAVQPKAEGMSIQRAYYVLRESGKVRLGAGDTVSQGEEVYVELTLDARGDNRVRSAYYVVEDAVPAGFVPLQEDKAFRGPPHSLPLVPEALKRRVLNPERATFFFEEPAWWSDSPRTVGYVLRAQFAGTFSAPPAHIEDMYAASIHGRTAADSLKVVPSKKHLGDL

SEQ ID NO: 12653 - protein, 170 aa, Myxococcus xanthus
MPPDPPDASTVSGHLQGLARRIRTLRERRGLTQEDFAARCGISVSFASLLERGERSPSYETLLQVAAALQLPLWELLRLEDTQDAGVHRLEAFVRGRGLARVDVDRLLSVAEVMFNEPTRATEDIQAVRPEPARCGEPGCEKPVLARGLCAAHYHRERRRKAASPGTGGT

SEQ ID NO: 12654 - protein, 165 aa, Myxococcus xanthus
MMVSNVTGSFNVKSGTLNLDDKDITKSKVEAVLDASTVNTGNAKRDEHLRAPDFFDTAKFPEITFKSTKVQKAGQGKLKVTGDLTMHGVTKPVVLDVTGPSKESKDPWGNTRTGVTATTKLNRKDFGLAYNQALEAGGVAVGEEVTVNLELSLVKQADAAATDKK

SEQ ID NO: 12655 - protein, 246 aa, Myxococcus xanthus
MVALDADAYPQALRRFGGEAQARALVVVSAHWETPGEIRVTASAQPSLIHDFYGFPEPLYRLRYGAPGAPSLAEDVVARLKAGGLPTVADAERGWDHGAWVPLLHAFPEAKLPVVQVSMPLGASPADIARMGEFLRPLRAQGVLLMGSGGIVHNLRRLNFQEKAASVEPWAAAFDAWIAQKLEARDFTGLQSWLDAPNARLAHPRAEHLMPLYFVLGAALPEDRLTPVFEGFHHGTLSMRSFALRA

SEQ ID NO: 12656 - protein, 229 aa, Myxococcus xanthus
MGLPGLETTASKLAVALVAGSVMFHLTKSQSGGLLLLFPDLVFGKLYLWQPLTYAFIESSPIGIIFGAIITWSIGGYLESIWGSRRLLMVALGIAVSAGLITSLLAMLVPGATVQAYAGGNVMTSVLWVSYGLSIGRGQTNFWGLPLSGNALAGIGTGFMMLSDSTSGWLTQVPDLLGLCMAFAYVRGASPRKLWLHLQHWRLQRQLKGRSKHLQVVRQDRPDRDQYLN

SEQ ID NO: 12657 - protein, 65 aa, Myxococcus xanthus
MGVISFTGVKVFSTTLARDRENMGENITKWLKENSNLEVVDRVVTQSSDKEFHCLTITLFYKPKA

SEQ ID NO: 12658 - protein, 71 aa, Myxococcus xanthus
MSNEVDAKTARERAKAIAEQRRAERRNRKRKCVVCSVEESDKTPLTAHPEGIGPACKDEVTCLSRKAASGR

SEQ ID NO: 12659 - protein, 398 aa, Myxococcus xanthus
MKSVSKNEEIYFLSGKRTPFGTYGGSLKDLSATDLAVESAKAALAQAKVSPEDVQHVVYGNVVQTSADAIYLPRHVGLRTGVPVPVPALGVNRLCGSGFQAFITAAELMLTEQAAVVLAGGTESMSQAPHVIRGARWGLPLGKGSLEDMLWTALTDSYTGQPMALTAEQLAVDYSLTQDQVDEYAVLTQKRFAAAQEAGRFQDEIAPVTLKTKKGETVVSRDEHNRPETSVESLRKLPKVFKKDGVVHAGAASGICDGAGSMVMATGSFVKKHGLQPIGRLVNWGVSGCDPKIMGIGPAPAIRQLLERAQCQLSDIDLFEVNEAFAPQYLAVEKELGLPRERTNVNGGAIAVGHPLGASGARITTTLVYELKRRGARYGIGSACIGGGQGIAVLVEAL

SEQ ID NO: 12660 - protein, 215 aa, Myxococcus xanthus
MNVLAELGIAVAGLVLALVLLSMNLWRSILFLFPSSVRVEPEAPADQMDLPLELSGRANQLQALGFVPLGSHEEKPRLQRATRSYDWAHPGECVFATLHEGQGGAPRLYLLTPLASGGFVITADYRRPALEVPGVYLAGSLEDAPPDRLLRAHLRRLDGLQPAGDFTWEGRVAAGRSWYQGLGRKEIRKQNLQGLLWTVIALAIVASAFFGPRAP

SEQ ID NO: 12661 - protein, 218 aa, Myxococcus xanthus
MAPTPLRFLLDFISPYAYLAWTRLPALAARHGRTVEPVPVLLAGVLNATGNIGPAEVVPKRAYIFKQTFRIAHDLGVPFAPPPTHPFNPLLALRVTAAVDDVEARSRLVSALYVSAWGGGKGAESPEAVGAAIQAAGLDAQALLAAAQTQEVKDRVRRNTEAAVAAGAFGVPTYLADGELFFGVDSLGHLEQFLRGEDPLTPADVERWRTLPASASRR

SEQ ID NO: 12662 - protein, 1192 aa, Myxococcus xanthus
MVVTGRYRVEGLLGEGGMGRIWLATDLHEHRRVALKEMQVPAGLTAGKTEELVLMFRHEFFAMKKLQHPGTLKVFDWGMTEAGNRFITMEVVDGQDLSSLGRESPLDTRTLYRVLIQMSQVLAFLHSRLYVHCDIKASNIRITSAGAVKLMDFGVMHQLGTPSPGRLKGTLEYLAPEWQRGASIDGRADLYSLGVMAYYLVTRRLPFKRNTPAALLADHLTRPPPKPSTICPVDPQLEEIILLLLAKDPRERFQDASELMEALCHASGEPMPEEPLSARASYLHVPEVVGRAAELEALMNGLAEADWGQSRAVLIGAPAGVGKTRLLQEFELQAKLAELPFGRGQCRAEGQAPLTPIVQAVRCLVPLTPSEMMERLGPKLRQLLPGLTPDAGEVHPVAGEEKLAFFGALAEWVQALGRRMTLVLCFEDLQWADSATLEVLNVLIRALYGTRGMVVGTFRNGELSRLSLAFQTVDEKITTRMDLEPLAAEHVRTLVELALPGLAVPAAFVTRLHETTGGNAFFATECLRALVEEGALTRVGGRWSAVEGLDTRPLPASIHDAVLARLGSAPAEQVSLLRQLAPAGRSLELPMLRALAELPESELFAVLDGIVERQFLQEVEGRYVFTHDTVHQAVYDSTPEDARRVAHGRVALALQTLHSSRPELSRTVGWHYLRSSEPELAIGPLLDAGRAAIEAQALLEATLLLKEAAMLLEAAPDFPGRDRLLLRIWVTMVEVGYSSDPPTSLVFARKLSAHWASTVDLVDGRTQAVAALEAACAAPEAERPARLKALFREREADTFASTADVFWKQAELRILQAMALASVGRTEELTALLERVRAEQPEVSPYRAAVQLAPAQLCAYTGRFSGVLETQYEQLNRLRGLCEVMGRLPKRLAWALGMGGFTMNMNLALRGEPLDAQALRDGYAVAEAHGFTDVRGFHLFAVVTRAAFTGDGAAFVPAFTEKTELVRRLGNPRLMERNLALFTPPYYLERGEHEHVAAVVARAEALARVLPEDRWLQCHLRVYQACRDVLFEDAGAARRSLPAALAAAREGGVRMETLLRVYQSRFEREQGNLVAAQDAAEAALARATDPVLANPWDEILSRRALAALLPGEEGLTHLRRALALAELTGNVLQVGLVRLALAERARDAESSVVALEAAEAAFMDARASSLLALASSLRGALQRRAGELRQSA

SEQ ID NO: 12663 - protein, 736 aa, Myxococcus xanthus
MGLAVAVAVLLAATPTFVTRGDVTPEAGLRREAEAAWTALEARYVQEAGGAPAKPPASIVLQKGAALSPQRNGQGRPGLVELRQNTPGMLDERLRLALRHELAHQFLWWACPQSSEDRLFHEAFSVAVSGELPSWKEGPYLSLSRAASVLAGAPEVDTPRARRALARLLNESPGFSPALSRRLRQCQDGARWASPLSIDELAGVGVREARPATVVVSRHSGEVLLSEGDVRRALPYGSVLKPFLYAAGAEHPTLPPRPGVPEWVCGAGVPAKVDARTALLRSCNGYYLDWEARGSAPRAFGAWGPVLASVGLTGLPEDMAEATGLRSTLAVSPWGVAQAYRLLAEARPDVVALLADNAARGTLAELPASESLVGVATKTGTVRDAASRPQFGWIAAVDPDLVAVVVRPGAMPRQFAEEVPKALARARKQAGLEAARVQVLGLLPPGDVEARCSGAGFALVEGVPRAGEEAWTPLASLTQRGAAVCLGAPWRVRFPGGPGEGRDYAGVFITSEPPPYRPPPGVPTTPSAMKARRGSDFVFRTTRLQYAAGVVSAEDVTLTGEARVALARVVAHNEQHGHSRHPGRPVCDTTHCQAFRGTVRVRSEDAKALGLAPLKWRKWLTFSQGGEEPWRQARPRAEVERLLGRGLVSLHFKAGRVHYLRAETDGDATFDTARSVPCDLLRSGLKLPSCPRTASFNGESLMFEGRGRGHGEGLDVEAAKAAGSGSDVILDDAYGQ

SEQ ID NO: 12664 - protein, 458 aa, Myxococcus xanthus
MKKTLTSLLCAAVSLTLLSLACGEGNPPQVPQPLEDGGVLWTECSPEGAREDCSQGESCIFVASHDRHLCVRACDSQTACEHPDAVCCPSSGEGAEGGHCVPSNACVPTDAGVDGGSNEETDGGTQEEDAGVDPEPDAGTDPEPDAGVDPEPDAGTEPDAGTDAGTDAGTDAGTDAGTDAGTDAGTDAGTDGGTDAGHTPIRVMASNLSSGNYQSYDPGHGIRLIKGVHPDIVLMQEFNYGSNSASDIRSLVDQIAPGFHYSRETGAQIPNGIISRWPIIQFGQWPDPRVSNRDFAWARIDIPGPRDLWAVSVHLLTSSSSNRNAEAQSIVNEVRSQIPEDDYLVIGGDLNTDSFSESCFATFRQVVTTAGPHPADHNGNTGTNSNRNKPYDQILVDQDLRQYQQATVIGSSTFPNGLVLDSRTYRPLSEIAPVQSGDSSSSNMQHMGVVKDFLVPNF

SEQ ID NO: 12665 - protein, 434 aa, Myxococcus xanthus
MLPVLVHLTFTSLWSQLLLYAMAAGTVGYVVFNGWRSAEGELDARTGTRVPVSAQDRLLRAAGYGVVGAVLAWFALQYSLPPGAFPGAKGEGIPVHTYGLLLALGFITAVTVAGRLAQDEWRTLELKDGAWVDVEGPKKREQIMDMTVWILLGGIGGSRLLFVLVNWQDYARDWTQVFSLGGGLVFYGGLIGASVAAFVFARMHGLDFWRLADVCIPTVSLGQCLGRLGCFSAGCCWGDVAPAHAATAVHFPGSGVAQDLLGGVGNTSSLAYSSQLQDTRYVVEATGEIFHHAAPGAVRISDWVAQQGYTLGVYPTQLFESVGQLVLFVGLLYARRYRRFHGHVLAFWLMAYAVLRSTVELFRGDVERGTLHGLLQSLGAGELAAAVPLEAWYNVSTSQFISLCMFTFGAVLLAQKGRRRESEAESLGPTPSAA

SEQ ID NO: 12666 - protein, 336 aa, Myxococcus xanthus
MNKLKGAFIRSTSAKFRVAGLYNKFLTYERLWMRTLQEIEAGTYRRDVFKARRRAETRKAGATGTAGQKGVVELPEDISDMDFEEVEELIRPRPVNEPQVAASFLQATGGAPSKGPPAVAPLTPAIAPLTPAVGSTPLRGAPAVAPLTGIPSVAPVAGTPPRGQPTVTPAAGGTPAHGTSVAPPGMAAKAPGAVASTPPPSRTSAVGASSTPPPSRPVATGAGSMAPPPRAPGTGTAGNIPPPSRPASMPPSSAASRPPSASGGGGLADDKLRAVYDAYVTAKRRCQEDTSKLSYESVAATLRKQVPELLKQHNAKAVEFKVVIKDGKASLKAVPK

SEQ ID NO: 12667 - protein, 117 aa, Myxococcus xanthus
MVMGLSLGTGCMSPSQEAQERLAALEAEGEAMDAVLDSVEERLLGNQAMLQTWQELGRRHQQVTQLHCETSDPHMIAMMKHYKKQEDRARQLKRRGSGVASVDKAVLTSGKAPRGNN

SEQ ID NO: 12668 - protein, 301 aa, Myxococcus xanthus
MKSLRLALAVLSLAATACRDKPVDHLQRARDATFEKRPDEALVEYRKAFDALRHDSSPEALVLRARALKGAADVYWLEQRKVKEAVGVYRELIQQCPESPEALESRIILADLLRVHYRDLRGAIDQLTAALKLNPPQGAELHYLVTKLYFELGDYQQCELETRRVMERFPTSAYVDDALYLQAQAIAMMEGRRQEASRTFADLRTRFPDSELAPHALFEMGKLRADAGENEKAIETWVDALKTHPDPALVQDYIARARRRIANTTAAGVGQREVAFDRVRPARTSLEAVGGRPEEAAHEHD

SEQ ID NO: 12669 - protein, 39 aa, Myxococcus xanthus
MNPDTLNDTVIGIGVLAPVALLPAPVLPGLPIGGRWPGL

SEQ ID NO: 12670 - protein, 470 aa, Myxococcus xanthus
MDPITPPLALGQKHVVVLGAGFAGLTAAKALARHSALYVTVLDQRNHHLFQPLLYQVATSGLSPADIAVPIRSQFARKPNVSVHLGRVTWVNLKERWVGGEGDVRLRYDYLVIACGAQHSYFGKSEWEDFAPGLKTLEQATELRRRILSAFEQAENERDAERQRALLSFVVVGAGPTGVELAGAIADISRTVLVRDFRRIKPSRARVFLVEAGPRILPSFSEKLGVRAHRDLAALGVEVRTEARVTAVDAEGVMLGSERLASRTVVWAAGVQAEYLTRGLGVPLDRAGRVQVAADLTLPGHPEVFAAGDVAHVELDGKLVPGVAPAAMQMGRAVARNVLADLRGRPRTPFRYKDKGAMATIGKHRAIAETGRARLTGFVAWVAWLFIHVWYLVGFKNRFGVFVTWVWSYLFSTRGARLITEREWRLSPKVASERAPHAGKVTAGDPTAPTSDARPPDGTTTTAAAALVAD

SEQ ID NO: 12671 - protein, 260 aa, Myxococcus xanthus
MDALLSELSSADPRIRLVEVDYSPAVTKSLSEQFFGGSRLPMKDSRGGPFHSYFFGLAAAKHPHVMHLDADMLVGGASRAWMAEAAAQLASREELVSCSPLSGPPRADGTIAGDSRWYEPDAQGSHAFRFRRFSSRAFFVDRDALVRRIGPLQAKLAPPIHVLRALRAGNPPYREPENLVTRRLKRRGLWRLDFLGAAPGLWTLHPQYRSPTFYERLPELVSRVESGDMPDAQRGQENVHDCLVDWSDVRAARRKWWRRG

SEQ ID NO: 12672 - protein, 439 aa, Myxococcus xanthus
MRITRTASRRKLFGALLCTLSVAACGPAPEGEPSGEKSPEMGSQENPVVYGTDHRTDVYAYPASALRTRAEKSTVALMNPSDFNASNPNNVTFNASTLQSAYNLCSTQRFLNDPTPAFCSGTLIDDDLVLTAGHCITSASACANTRFVFNFYRTSATTLQTVTTADIFSCQSIVARQQGTVGGRNLDFAVVRLDRPATPRFEPAPVRPGNTALPLNTGVSVIGSGSGIPFKIDDGGWVRDARAGTLDYFVANTDTFGGNSGSGVYENNNVTVAGILVRGVTDYVSQGGCNVVNQCTDTGCGGESITYVRPAIDAYCAVAGSMRLCGTTEPPPPPPVKTFTFNVTNTNSAQQNTTNVSVTLAAGQTLSFGTCSLPQAAGTGDTYLRLFNTATNTQVAANDDSCSLLSYVSFTAPSAGTYQMRVGCYSSGSCSGTVAYSIQ

SEQ ID NO: 12673 - protein, 322 aa, Myxococcus xanthus
MVRLVSSGTEATVAAIRVARGFTGREHILKFEGCFHGAGDPFLVKAGSGVETLGLPDSPGVPSALAKLTLTAPFNDLAAVERIFAENGQDIACAIIEPVVGNMGVLVPKPGYLEGLQALCQKHGVLLVLDEVMTGFRLSRGGAQELYGLKPDLTTMAKVIGGGMPMGAYGGPRDIMEKVAPAGPVCQSGTLSGNPVAVAAGLACLKALAAPGTYARLEEVSRMLEVGLLAEAKAADVPVTVNRVGSMLTVFFTGEPVYDYTSAKKADTARFGKFFHAMLNESVYLPPSQFEAAFVSLAIGEPEVAHVLAAARKAFRSLGKTG

SEQ ID NO: 12674 - protein, 609 aa, Myxococcus xanthus
MASPQFAGRFRDEARVVVRLHHPNIARVYAMGEVEGQLYLSMEYVQGKTLSRLTYRLRQLGRTLPLGIMLHLGQRLCEGLAYAHDATDEFGNPLHLVHRDLSPANVCISYAGEVKIIDFGAAQSTLKEQQTAPRVVIGNLTYMAPEQARKRFVDRRADVYAVGALLWELFAWKPLAQRGDPVERWRRAAYPQWEPAGSVRQGVPTSVDAFLMRALASEPDNRFPDAAAMGAELARMKAKLAPNVGDADVARLIAAAFPREKKAEELVLRELLREPRSRALTEPALATVLAPPTALAFEHEGIDAPEDYVPAERGDAETSKAPSSAHPPDANVPAAPDASVRGTPAKAAHAADELEVTVRGIPGRAPEVPRAVNAPRVTALYGTEDEATVVEGGASRARRGLPGGERAHLGVEEEATVVHPSRGPVASVPLDADEETTVVQPERARMAADAGVASKSDVGSGAANSGASLGGDAAATEAVDAAKLMVALERAEASRSQGARATASEDVTVTEVNPARALQSLSPQAAQLRRATRETQVGFGVDISQAVDAAAVEARRLELVRAITGDEALPVPEPEEDFGTWLRGGRPWLVAGLCAGACALGLALAWTLA

SEQ ID NO: 12675 - protein, 88 aa, Myxococcus xanthus
MEVKEPRKPGGSDGSELGETARQMRAAQPYIAAVWKLVGGAVVGVLGGYWLDGWLGTGPWLLVVLSLVGICVGFYGFLHEMARLGMRK

SEQ ID NO: 12676 - protein, 37 aa, Myxococcus xanthus
MAAVPFIAGFFGVYFALQWIEVSYVMAASKESAGGDE

SEQ ID NO: 12677 - protein, 446 aa, Myxococcus xanthus
MRTLIQTLAAVTLLTAPLASAQTTPESAPAQLCENQLDQNKQPEFSEENLEIESSTVLITEESPARLQLNTNRTALNVENIYFPFDQNVTISYVYESAGASHALGYMYMDDLRVRGYVDSNGNLVDSNNNGIFDLHEDLFNLAPRSGDKARPYIGESRRCTRNFVSDGETYNQPELAMNSECRNTFDENHREIADARPGYTFEYNITDVVGAFANDRDNPGGAFSDRGLFPHIPNLLEPPSDRNGNLGLGRMVFLLADDDDGRSTYGNLSPVPDTGDYPDGIPDYDVSHYDPRGLPRANNPDRGISPYDRTVDLGMIEGGKEVIFFVVVFYSSRNHGPNEGYVYPCVKQDPDGRCALHLRTSINVFFSKAAWNMDQNPEGGTIVAERNIGCQYLEGCNRDNPASTPDQACRVQGTNEYLCGWLDGPIEEQNTTLYRLANKSSTVGS

SEQ ID NO: 12678 - protein, 153 aa, Myxococcus xanthus
MNRLILLSLLLLPGLASSATDEGKLAFEKACARCHVVTAQGQKKTKAAAKAPNSRRRGPSVDLGPVVPMRTPDQLRAWLAGPNQIKPKTGCDTRLLPDGDRELLLSYLALSLHPTPPTREEQLRLQLKQDLAARQAQKQRQADEPSRRSQGKK

SEQ ID NO: 12679 - protein, 219 aa, Myxococcus xanthus
MGVVTMVTLAVLLSYGVVSREAEVQGDGRRYKEAYFAAEAGLAEGREAMRIRLGNLQSYSSALAAMPQVNEPGLPAGGDRPYLEVLQGPGGVGGWNSLAIDESDLAPTERQSPSGDAYAAFPLQTNVRYRVFVRDDEDATTSGLDDDNGQVWLIAVGEVVGRDGSRPTRAVIQALISNENAPAVTSPGPTQEGGGPAGTFDGSGTVTDVGNEVDITPAP

SEQ ID NO: 12680 - protein, 252 aa, Myxococcus xanthus
MGQPKAQVTMRFHGALNDFLSPAHRHQTFSHALRGRPSVKDLIESLGPPHPEMDVVRVDGEAVGFTHRVQPGACVEVYPTSMVEEPGVRVGPPLQDTPRFVLDVGLGRLVGFLRMLGFDALWRNDFADDTLARLSHDEDRILLSRDIGVLKRGEVLRGYFPRSTDPAEQLVEVVRRYGLTSRMHPFSRCVACNAALTSAEPSEVAGRIPERVAERHSRFQQCPDCQRVYWAGTHHQRMQALVVRLRELEGAP

SEQ ID NO: 12681 - protein, 94 aa, Myxococcus xanthus
MARFKNLMLEFGPLALVVNYVIFGLVVVGFYAAIEFGFQPSSTGEKAGSWAAAYAASQVVKPLRLAAVFVLTPLIARIPPVARFIERNKHKWSF

SEQ ID NO: 12682 - protein, 203 aa, Myxococcus xanthus
MADAAEQALGGVDLLVNNAGVVSAGPVGELSLSEWKRVLDINLWGVIHGCHVFVPRMRRQGSGHILNIASAAGLVYVPDLAAYNVSKAGVIALSETLHAELKATGIGVTAACPSLLRTRIASTGHYTKDTLRTLAGLMLDEARLGPEVVARRLLKAVDARSLYTVPMADARWGWRLRRMAPSLFLRAVAAMNPSARAWLLRRR

SEQ ID NO: 12683 - protein, 304 aa, Myxococcus xanthus
MLHLTPRRTLDLEAPAAPGRPSHVTASIGLVRSGDWLYTVADEPLHLAAFPLSRASPGHGVVLFANHQPEAPVSLKSSQPDLEVPCLLAPQGSSPHGSLLMLPSGISAGRQRGALVALGADGTLAGDARAVDVTALYTQISREFGPLRIAGAAMSGGLMRLLQRGSGEPGTDALVDLDAERVLRGLEAGALGPDVVRMTRRWELGQAGGMRLSFTAASPLPGGRMVFTATAGSTGPTATVSGSVVGVLAPDGSPQFLDALEGHVTVTGVDARVEQGRVRLLLAALSEDGAGPANLLEATLDVPA

SEQ ID NO: 12684 - protein, 430 aa, Myxococcus xanthus
MEELHEAWPVLSVDERLEGFRLLPASVADDFFLALSAREQAELILHLQPAERRTWVRLLPPDDLADLVQAVEPEQAESILSQLDDASRREVNVLLAYAEDDAGGLMNPRFARVRPDMSIDEAISYLRKQARERVETVYYAYVLDAEQHLLGVLSLRQLFQTASDKRVADVMQRDVITVSEDTDQEAVSRLFTEHGFMALPVLDVQQRMKGIVTVDDIVDVVQEEATEDIQKAGGMEALEAPYFETGFFGMLKKRIGWLLVLFLGQMLTATAMSSFEDEIATAVVLSLFVPLIISSGGNSGSQASTLIIRSLALGEMRLRDWWRVARRELLSGLVLGVVLGVVGLARILIWNSISGVYGEHALVLGITVALSVLGVVTFGTLAGSMLPLVLRKFGFDPASASAPFVATLVDVSGVLIYFTVASLLLRGTLL

SEQ ID NO: 12685 - protein, 181 aa, Myxococcus xanthus
MVLGLLVRLGPDTVSVIQVTQEPDSRACTFRLGPSGAFVASEAPCQRLPGVPAGIEAGAVWTRVDTLLPPQPGQTLYRWAAVDGALTERGTLVVDAPLELVSAPLRPGFAIPFIQWRQSRIGSAVPVPPESQGPLGLELLPGNADLSPGLRTLSPRFYWEAGGGQGLGGTRVYERRASSLK

SEQ ID NO: 12686 - protein, 129 aa, Myxococcus xanthus
MKLGYIILYVPDVSAAIVFYEKAFGLARRFIHESGGYAEMETGTTALAFVEEGAAKEHGFTVRHLRPKEDAAAIELALVTPDVATAYTRAVEAGAEATQPPKQKPWGQTVAYVRDINGVLVELCSPMEG

SEQ ID NO: 12687 - protein, 264 aa, Myxococcus xanthus
MAEDAQQQGYTQWAPPIEMADAVDAFWQFWVPRKPHDVPLPRQHRVLPDGCTDLIFGFQHAPGPVWLAAPRLAVVGPMKRFILVDLEPGGVSLGVRLRPGWAQALLGVSPRELCGLNVSAQDCSPALMQFQRRMEDCASPAQAMALLQRTIARRWASFRSMAKPRAVQALGHLQASSGQVRMAALARELGVSERTLHRDILDEAGVPPKLLARVLRLQRAVSLLRSREGTDLCDVALECGYADQAHLSRDVRELAGVSPTALVG

SEQ ID NO: 12688 - protein, 165 aa, Myxococcus xanthus
MSTFTDFKTADLCDAHAGTPRFQIAEPGFQDYGGVRTFAGPISTVRAPEDNSLVRKALEEPGQGRVLVVDGGGSRRCALVGDQLALLAQQNGWAGVVVNGCIRDAEDVGRMRIGVKALGTHPLKSLKRNEGQRDVEVRFAGVTFRPGHYVYADLDGIVTSESPLG

SEQ ID NO: 12689 - protein, 325 aa, Myxococcus xanthus
MPQTKLEARKALGTTGLQVSPLCLGGNVFGWTADEATSFAVLDAFVDNGGNFIDTADVYSSWVPGNRGGESETLIGKWLKSRGARERVVIATKVGSQTELGKGLGREHIQRSVEASLRRLQVDVIDLYYAHYEDLDTPVEETMAAFDALVRAGKVRALGTSNHSPQRLTESLEVSRRNNLARYAVLQPHYNLVERKDFESSLRGICEREGLVVAPYFALASGFLTGKYRKDQPPPKSARAEGVLKQYGNARGWAVIDALEAVTRRHPGANFAQVALAWLAAQPTIVAPIASATSASQTQELLGAFTLQLTEEDLRALDVASSREA

SEQ ID NO: 12690 - protein, 361 aa, Myxococcus xanthus
MRNPRGRFGWVLLAGALGAAVVGTRLGRAPERNTAPVLDASTPQAADAGPSTRPPLPAHAQPLKEVPCEFTALLAEYRQGHASPAYRRYVREQLRGLVESLSEDVHWQHLSDEQDADVLALLSDTWVLRYALEGQARILERLVDRVSETPDARLRAVLIRSLQQTGEPSTQLLGIQVLQGRDVYRDWVTDAAPEVRAAAVENFREEAARNAGRYRVVAERAVSLATVAEDPATAAGLLGASSIEAVRGPSVAQVRTLLQSPKSPVVRAAAARALATSPVTELSASLDALAARYSAEPEASVRAALLESISRLGLSRAVPVLERLRDTNAAARDEVNPWIALLAEHPQRWEMLDTARRHSHR

SEQ ID NO: 12691 - protein, 168 aa, Myxococcus xanthus
MKNDFQAGGSEEPYLTRLLTLARESEDRHIRALAVELAASLSVRLDARAVEQLAWVLENDADANVRELAALALSDGRDTRAVLNHFSAAFPGEQRLCVRWALLRYTLRAGGAEALPQVRDYSKQDRRFARDVADFQALYDAGHVDFDRLWLNKRVYHRCPEDVEARTP

SEQ ID NO: 12692 - protein, 792 aa, Myxococcus xanthus
MLRTTEGERRVELTVIPSGTEWVVLVRDVSARARRRSVLQRLAELGANLPSLRTEGEVLRRMFSSVEELGLGCAWLSPDRLGVRLGQTFVPPGMVPTEAAALSGRWVRDVVGQWPPLLKRAWRDGAAYTDELPQEAERFLRGARGVLVRQGIQRAGQTRAIAVRIDVEAQPRAMLALVADWLREEELPPVRLFGAQVSAALDAALTISRLSAQNTALAALNRLASVTASAPHPQALFAPGTDEIAGLLGCDAVAVLLPADDGEVELAYSSGLDTEGSEDFTRRWRAGNLCLQAQREGIPLEREVESCPDELSEELRRQGFRTVVVVPLRVRSRGVGTLSALFRERRPLTPLERETLQAMGSHFAAAIESHRLLHELRGRAEDLALLHEVAKALAATLELDKLLHIGATSLARIVDTSDAYVFLPDVSGERLQLRAMTGGSPELQGPALPLLPADASLASVAFHTREVVMVEDARSDLRVNEEVRRLPGARAFLVLPLVVHERPMGVMMAVETRRPRRFTVAEVERASAIANQLALAREGARLVEDLQASYVELARTQAQLVRRERLAALGELSAVVAHEVRNPLGAIFNSVASIRRIVGPDSAAVPLLDIVGEESDRLNRIVADLLTFARPPAPHPYAVPLSPLVEDAVRGALAEAPGQVRVELDLADDVPSVTVDERMMRQAFLNLAINAVQAMPQGGMLRASVRRATGTPEVEVQFVDSGPGISPDVRARIFEPFFTTKAKGTGLGLAVVKRIIESHQGRVALESQPGQGTTFRLYLPLDTSAAAVSEGW

SEQ ID NO: 12693 - protein, 172 aa, Myxococcus xanthus
MPKPLVLTSPRFKDGDLIPIAYTGEGEDISPPLQWTDMPAGTKSLALIVEDPDAPDPRNPQMTFSHWVVYNIPPSAQGLPEGATPDVLPEGARQGQNDFHRQNYGGPMPPVGMHRYYFRLFALDTVLPDLGRVSRTQLRKAMEGHIVGQAELIGLYTKVHHRGAESPGATPA

SEQ ID NO: 12694 - protein, 225 aa, Myxococcus xanthus
HTTTAGTTRDHELKVWSDASGASYSFVFNHAGKVQCATPGFRAESRLRVRATGFAAHKSCRFCDPLAAELVDSDGHVLYPFATQLDDLVLVRECIQTDIVLELAPCAFAESLQAWPDKAAYEASRKPGKALLGSQFFIPNPASLMSKGSPPRPVEPRAHFTGHVEAADVRTNGVTGHPFQHALVRTYGGTYDVLAAADEATPRLRPGNIVRGTFWLVARVTAGLG

SEQ ID NO: 12695 - protein, 59 aa, Myxococcus xanthus
MLAALDRLESHPRFYRRTPITLDDVGRVEAYLFPKERLAGRPIIESGCWRRYLKERKQS

SEQ ID NO: 12696 - protein, 59 aa, Myxococcus xanthus
MQDIAFRVERLSLPEYIDWVVGNARRFDGVELQAQGNIGEEKAASLVDEMLRTGLASKG

SEQ ID NO: 12697 - protein, 67 aa, Myxococcus xanthus
MELPLGWWAEQHGNDNLVYALIDHVEEALELIGASLFLAALAEELGERVVLTVRKEEPHGPGPAAPR

SEQ ID NO: 12698 - protein, 360 aa, Myxococcus xanthus
MGLAQPLPAETQRPAESVRVSPPSSSRAPYIAGPLFDWAFFLLPPLLALGLGIVISGTPFSDTPVQRLGQEKTWAGLMVGSLIHAHLVAVFFRSHGNPAIFRLYPLRFILVPVLAWAAIRGSAVVAAGATVLATFWDVWHSGLQTFGLARIYDRNQGNPPEVGRQLDFWLNHLLYAGPILAGATMLDHFNSFESFDGVGMPWLASVPARMTATHRAWTLGVVAVGGMFLLFYIGATVRLLRQGHRPSFHKAFLLVTTGACSIYTWGFNSWGEAFFIMNLLHAIQYLALVWAMEGERLRERLRLKWRWLALALFLGTVLTYGVWAELLDASAESLWALTLVVSLMHFWYDGFIWSVARRQV

SEQ ID NO: 12699 - protein, 296 aa, Myxococcus xanthus
MPPDKAEGSGKAVLIVERQGGGTSSRVKLRFDRKGPLLVGSVVNTRFSSNSMDLLTQRTHSSNYTAPMSDDENDEGDESESDGMAHGVSDLEATVLPSPGQVSWGQKHWKGPEDADLKVSLRRRGDLLVVSVRLRDDKMVTATDGSPKAILAADHLELSWTEWAATKSGTNQYVQLGVARNARGTPVATWFRPPWKKDTPLPTIRWTSPDAVEVDLRLRWLMPTPAKLGYYDPTSVTPQLKVSFSDGDGKGQETLVDVNAGMLFFAEPGRPFPTVEQYVQPWMRVADDATLRSLTL

SEQ ID NO: 12700 - protein, 426 aa, Myxococcus xanthus
MLSPEFWIRRAPSPDEVLLDADQVAAKRMRAFGPDGGLVDLKRIPATLTRAEVASWVKDAQQTPIQAAIDEQGRLVTEAMLEELRQNTAAEHIPEASTARYGLSVRRTPLRSLPSERRFFAAENLRDYESLQAGILFPGEPVVIAHHSADQQWLFVLTTQGPAWVRRGDVAEGTADTVFSYVAKAPGRVVTGDQVRTVFTPEAPGVSELELDMGVALPRADVAPGEPVNGASSYASWPVLLPVREQDGTLAFQSALLRRTADTAPGYLPLTRANILRQAFKFLGERYGWGHQFNARDCSGLTSEVYRSLGLFLPPNSGMQGKSAALNHRLFTAQDSHTERLRALARAQVGDLIVVPGHVLMLIGHVNGEPYVIQDVPYAVFKDPATQQLRKTKLNQVSVTPLLPLYADDTTLYVDAMTSLVHVTQP

SEQ ID NO: 12701 - protein, 101 aa, Myxococcus xanthus
MRSRLFVAKAERLDTTQLGLEFAYKLAALDALNHQLGQPAASAPADPTETGGARPPGGKRKPTGRRDLREADLPEERIELNAPLLEGSAPRSGWEESCQLA

SEQ ID NO: 12702 - protein, 62 aa, Myxococcus xanthus
MVIARAKYRDADAADTAEPTSVTAPLPPQLLPRALATPSLLAHILSDKFCDGLPFHRQECMA

SEQ ID NO: 12703 - protein, 263 aa, Myxococcus xanthus
MLILILATFGSLYLVLCVVVFALQRSLLYPAPKGTPPLAESDGFSRLPLEGGLYVDLFHLPAPPGAPTVVHFHGNGEEVLTQMGLGSLMQARGLGFLTVEYPGYGASPGHPTEEGIYAAAEAALAWLRAKGVSAEQTVLSGRSLGTGVAVEMARRGHGSRVMLVSPYTSIPDIGATAFPFLPVRLLARDRYDTASKAAAVKLPVLIIHSEEDTLIPVDMGRRLDTLFPQAVVETVAVAGHNDVLEDPGKVYRHRMASFALGEP

SEQ ID NO: 12704 - protein, 145 aa, Myxococcus xanthus
MLWGRVTYEMMESYWPAVARGDEEAPPAMREWAVNLEAKPKYVVSSTRKDFPWTNSHHIAGDLRTGVQKLKDATPAGVLLGSGKLATELDRLDLIDEYKFLVHPRIAGHGPTLYQSGLPSTRRLELLSAKPLRSGAVAMHYRRAR

SEQ ID NO: 12705 - protein, 106 aa, Myxococcus xanthus
MEGCSMSEREKKRRQRRSFLPEFKSGAVKLVLEEGKSIAEVARDLDLTETAFRRWVEQARTDRGQGKPGALTSEERAELSQLRKRLRQLEMEKELLKTRRPSSRRR

SEQ ID NO: 12706 - protein, 166 aa, Myxococcus xanthus
MNLEQKYEALLHEAKRRQLPDVAGIRLVFQTLSLASAIDRDCAALLAPHGLSEGRFVLLFLLDAAHDALAPNKLAERAGVTRATVTGLLDGLEREALIERHYDAQDRRALRIRLTRKGKQTAKQVFDQHSRWIASLYGNLSAAERGQLTALLDKLAGNLTARKAEP

SEQ ID NO: 12707 - protein, 258 aa, Myxococcus xanthus
MSPSLPRKGATRATDIPPDVLDALSHGEMQTATLAECMALDQARLLRAVFPELSPDALAAADAACKLGILKRMSAIGALLLEELGTAGIERSRTHAADMVRGWACFMVGARPELDLQARLATIRPLADDSHFGVREWAWMSVRRHLARELDIAIAELSAWTSSRSEYVRRFATEALRPRGVWSAHIAELQREPGRALPILSPLRADPSVYVQDSVANWLNDAAKTQPGWVRDLCDQWLRGDPADATRRICKRASRNLK

SEQ ID NO: 12708 - protein, 154 aa, Myxococcus xanthus
MERSVEDNGVLQACEELGIGFVPWGPLGQGFLPGKLPLDAQARFDAKTDLRKTFPRFSREVMQANQSILDFLKAFGEKKGATRAQIALAWLAAQKPWIVPIPGTTNLDHSRENLSSLNVNLTPEDLREIEAAFANITVHGGRMDAKQMDQIGKD

SEQ ID NO: 12709 - protein, 48 aa, Myxococcus xanthus
MLYGSNTLVLFYKTFSTSYTYTRIGKVENASELAATLGSGNVTVMFEL

SEQ ID NO: 12710 - protein, 688 aa, Myxococcus xanthus
MIAARLGPDVPEAEAAERPEGATTAMSLYLAVQTDGRVVTTLPRTEMGQGITTAVAMLVAEELDMALDQVDVRSADADPRWAIQLTGLSSTMRFLTGPLRAAAAEARARLVTAAALRWRVLAHTLATSHGVVSAPDGRRAGYGELAEDAARVLLPAVSSQPRPVSRFKLVGQPTGRIDARDIVTGATRYALDLDIPEALPTVVARPPTLRGTVQSVDDASARAMPGVVAVVPLGTGVAVVARTFGQALAARAALRITWTPGPASALSDADIRTRLRDGIGPRPLPPLFTTRTLEGRFDFPYLAHATMETQSCLARVQGGQAEVWLGAQDPKYAQREVARALGWELTPWRVTVHIARAGGGFGRRFFTEAAVEAALVSRAIGRPVKLMWSRDDDMRHGHFRPASHHRILAYLGPGGRVLGWHHRAAIPTVEFPHGFGDALTALAGEVLPEVTSAVFFALSQKLPYGFGWVSQELRDVAIPIPTASFRSVFTSQVGVSNEVFVDELARELQVDPVALRRERLTSNRLKAVLDKVATEGQWGRSLPPGVAQGVAVLEEWDSAIAHLIEVDVTGGTPRVLRIVIAADVGLPINPKGIEAQLQGAAVDAMSTTLSAGIHIDAGTVREGSFADYRWMRMKHVPSDIQVHLVRSDDRVVGVGELGYPSAAAALTNAIARARGSMPTRFPILDEGV

SEQ ID NO: 12711 - protein, 159 aa, Myxococcus xanthus
MAAHQFILNGQTVLVEAPEDLSLLWVMLHVLGVTGPKYGCGVGVCGACTSHLDGEAFRPCIHPVGGLSGREVVTIEGLGAQGLHPVQQAWMEEDVAQCGFCQPGQIMAAVALLKKNAQPSDADIDAAMSDNVCRCGTYVRIRAAIKRAALLLRSGAGGG

SEQ ID NO: 12712 - protein, 293 aa, Myxococcus xanthus
MLERGDVVAVEVPGYAPAWRAFEFAGAKISHIPIDGEGLRTDVLEKTARRLSGKLKAVYVTPHHQYPTSVSMTPERRIKLLQLAEHFDFTIVEDDYDYEYHFEGEPLLPLHATGGSRRVVYIASLSKLLAPTVRLGYLVASEGCIRKLKETRELLERQGDVVLEHAIAELFEDGTLQRHARRARREYKARRDHLLSRLRATPALDECFDYSVPAGGLALWLTLRKGSIDSLVARAREEHLLMAPGSTYLPKGRLDAVRLGFAAHTPDELSRICDTLARCIPSRPGLRPNLRTS

SEQ ID NO: 12713 - protein, 675 aa, Myxococcus xanthus
MTVEYKLTIRTGTKLGAGTDADISIVLVGTRGESAPRVLDKHFHNDFEAGAEDVYALSSEDLGDLVLLRFSNAGGVAADWLLDWAIVTAGEKQWHFPFYRWVLSGATVDVLEGTAKLARQASSERESTARRELLEARQRMYPWRAPEMTEGLPGALDLREGRPLPKDELYRGLTEGSYEVVIAKTLAAIKLNLPMLTRAWNGLVDIFDFFKHLEVPQLAQRWKDDLEFARQAVQGIAPLHITLVPSLPQGMPLTDDDVRGLLSPGTTLARALDAKRIFLIDFEILDDIRMYRKVGEDGVEERRWAPAARCLLYLDDQRQLRPLAIQLGRDAQKDPVFTPNDDAYDWLAAKIYLRCSEGNSHQMVSHALRTHFVAEPFVMATMRNLPDPHPVYKLLRRHFRYTLAINEGARKGLLDAGGVFDDFIATGGPDKGHLQLGKKGFQRWTLADNKPRADLERRGVLDPAVLPNYPYRDDALPLWDAFEEYVGGVLRHFYRTDADLEADTEMQQWWKDLTEHGLPVDKLPCRELRRVDDLVDILTTVLFTVSVQHAAVNYLQYEHYAFVPNAPLSMRREPPRQKGTLRAEDIPEMIPTKSQMLWQVAIGRALSSFGDDEEYLLHEGGWREEYFHEPELVAIRQRFQERLRAQREAVEARNAGAEVPYTILRPDRIPCGITV

SEQ ID NO: 12714 - protein, 294 aa, Myxococcus xanthus
MSNPTSPVIGIIGGSGLYQMDGLTDVEWKKVTSPFGEPSDELCFGTLGGHRVVFLPRHGRGHRLAPTDINFRANIDALKRSGVTDLLSLSAVGGLREEYPPGTFVVVDQFIDRTFARDKSFFGTGLVAHVSMAKPVCSRLGNAVISACEGLGVVARRGGTYLAMEGPQFSSSAESHMYRSWGCDVIGMTNMPEAKLAREAELCYATVAMVTDFDCWHPDHDAVTVDQVVSVLLGNAGKAKGLVKNVVPLLGSHTGPCAQGCHRALDHAIITAPPAWDAAMVEKLSAVAGRVLRR

SEQ ID NO: 12715 - protein, 356 aa, Myxococcus xanthus
PNLLSRGLFSLFFGGRRKPLASLPGPAPGILGNIGDFLGAQPWDVCARYARTYGPVAVAWLGPSPALVLNDPTLIHEVLETRRLEFEKGNIGDQIRHSVTDDTPFIAQQGEDWARKHAMDPLAQPWTPAWQAAQVEPLRAAILESVEALLQQPSIDLTPTLRKLTFDAFCVATVGEKLPTSVYDDFMLLAAAADARIQAKLPLKFVSPPKGFADAKERFYGLFLDKVRAARKAPAPHRVDLMSWTLREMPQLDDVVHANLLGGFFFGGVFSSSTTLVGAFHQLNKYPATEERLALESPALGQGPLTLQRLKDAPWGEAVAYEALRILPAVRIFLRRTPPTPTRLAEVTLPPGTTLI

SEQ ID NO: 12716 - protein, 224 aa, Myxococcus xanthus
  unsure (1)..(224): unsure at all Xaa locations
MHPRTGLPADGLCHIEMMHVHTAAPMHADTLYRTRDNVYVFIGDPTPFGYEGPQHAYYGHHPVVLNVLVRIDVDVDVVEYCYHDGPHYHAYPPPPRQEFVDKEDVHYYAGEYPQEYRRESPKLVRVNTVYRSWSAPRPVVTLAPPPEYHGPVIQVGLNIPLPSVEVRVGTPRXPPPPPPEWERDVIRHEHVHVHHDHCEHHVHKKHKHKHKHKKHKHKKFKGRD

SEQ ID NO: 12717 - protein, 380 aa, Myxococcus xanthus
MCTYFGLNDSKFGRIKTAGFERLLAGITLNPRADKKRLARASTCTPSSPRGSFADMWDWVALPEVGGLVMMLRSECWKCLALVVALLFTGAAHAQQRKGDQPKDVGIDTADIERRTGAKGELSADEGVFKVNLPRTDLKVGAAGVKLIPPLGLTAWAAFKRVGDATMVMGDIVLLEDQVNPVMDVALQNGLEVTALHNHFFWEQPKVMFMHISGMGETARLADAVGKVFTRLRETAGGKGRVPRASVDPARSKLDVTKLDALLGQKGTSKDGVYKVTVGRTVRIYGHEMGKAMGVNTWAAFAGTPQQAVVDGDFAILESELQPVLKALRAANIDIVAIHNHMTGEEPRMLFLHYWGVGPADALARGVRSAMELTLAPTGP

SEQ ID NO: 12718 - protein, 52 aa, Myxococcus xanthus
MPTVGGKNAGCKVGNLPEYSFGCGATGFLRGLVVDSANTSLYVGYVLDESCL

SEQ ID NO: 12719 - protein, 222 aa, Myxococcus xanthus
MRVPLADGTLVVTAEVPPDALVPSLLAVSDVFGTGWFAADAANVNPGSTVVVVGDGAVGLLAVLSAKQMGAERIIAMSRHETRQALAREFGATDIVSVRGDEGVARIKELTRGIGADSVLECVGTQESMLQAIGAARPGGFVSYVGVPHGVSLDGEKLFFSHVHLHGGPAPVRRFMPQLIDLVWSRKVNPGKVFDLTLPLEKVAEGYRAMDERRAIKALLRP

SEQ ID NO: 12720 - protein, 212 aa, Myxococcus xanthus
MPEARIRMAYAAGCRELGENKVQEALGKAEAMADLTDLRWSVIGHLQTNKAKVVARFASEFQALDSLRVAEALDRRLQVEGRALDVLVQVNTSGEASKFGLPPDEVARFFRDLPAFSSLRVRGLMTLALLSADPARVRPCFTLLRELRARLREEAPAGVTMNELSMGMSGDFEWAVEEGATIVRVGQAIFGPRALPDSHYWPEPNATSDPTS

SEQ ID NO: 12721 - protein, 477 aa, Myxococcus xanthus
MLKAVAPIELVKRRHLLQGRLGQAPSLDRIQADYPEAMTVRMERESPGSTRTDAFFGERLLNGMFSTLMDGDPEAPGDPEAFRLYFPWNAYEQDGVHCLPDVDVRLRLVEGRLLPVRIILGMREPGATAPGSPVTRRSYTPADGEAWEAAKRMARVSATLETELGNHLGQCHFNVEQYAIAAHRNLRRSPLRWLLMPHLREVVLINHSANGFLVGPTGYITRASALTERSVETRLLHLMGSYDWKGFAPAPPICESHRYARAAGLFWRLVGEHVDAFFAEHGAALEAQWSEVRRFSDDLVGHSAPAFVCRYLRATVPGRAAPWFVRSERMDLDAKVAATHAKAVSAVTRTDAPQPGEMEALKQLCRYVIYFATFRHAWANNLQWDDAGEVLYACLGLRWGKAGALSTEADHDVAPPPEEATEMLWISWMLSKTSYGFLLANEEADVHPRFVECLRAHAAEFSALGMDIRTVSSRINI

SEQ ID NO: 12722 - protein, 236 aa, Myxococcus xanthus
MEEGLEALELLREVTHRLAPLTSRLGAMAGVRTPTELPASTRGGRKQVVAAPKGRAAVGRPVAAKPVVSQARTEEGTRACAVIGCERPSRSKGYCSAHYQKLRLLMRTNRRPSAWKDDALPQSVGDVTLPRGRAASKALREGGARKKAPAPVVAPPPAEEKAPAAAKKSAGRKAAGAKKAARAKKAPAAAKKSVAKKAPAAKKAAAKGGRQVKTTKAKVGAGKRKKGRSSSQGSLF

SEQ ID NO: 12723 - protein, 114 aa, Myxococcus xanthus
MVFPNYGRSKGGPIVGASMGDLEFYANGARRTLNDASKSRWHDKERQLLAAIEAEIARQRGGDEGGGSDGGYGSQGGYGNQGGYGGSRGGGGFGGGSYGGDDIPPPNDDDNIPF

SEQ ID NO: 12724 - protein, 256 aa, Myxococcus xanthus
MELHRRLELREDAFGLVVDDGCGGTPYVLDMVKKMMEGGRFRTVAVVASAFTSPLVNREVYTDELPPGPGRSKTLQGYLSMYVFGDGAGAVVLQSKPGESGAEGILASFSGNAYGDLVIRKGGGLLKLPYQPGRMRPADMAFVVDGFRVARSYPEYMQKCLDAVLGPRPELRSKVERYYFHQPNKRVMDAFVERAGLPREAVACNVDRYGNTSAAGMLILLAEDLEAGRVRLGSGDLVVVAAVGANVHYGAQLVRL

SEQ ID NO: 12725 - protein, 368 aa, Myxococcus xanthus
MKVHGKPMRSIWLAPDAQAAEAIDQTRLPHALVSVRLTTLDEAAHAIRSMLVRGAPLIGATAAYGVWLALRADASDGALEHALAVLRGTRPTAVNLHWALDDMRQLLAPLPPAERVAAALRRAEAISDEDVAINRAIGAHGLKLLEDAWMRKGRQGRLEVLTHCNAGWLATVDFGTALSPIYQAHDAGIPVHVWVDETRPRNQGAQLTAWELGQHGVPHTVIADNVGGHLMQHGQVDLCIVGTDRTTAQGDVANKIGTYLKALAAKDNGVPFYVALPSPTIDWTLRDGVREIPIEQRDGTELSDVTGRLASGEVATVRITPEGSPAANYAFDVTPARLVTALITERGVCPASHDGLLSLFPERRGRAE

SEQ ID NO: 12726 - protein, 195 aa, Myxococcus xanthus
MDPNIAKELDARLALATKDDTARGLFFNGVVSAVRTMGGDAAVERCLAASGETRFIDFFNYPVAAFLRMSFTAAQVMGPEHGGFDGALRRMGVVATTDFLSSAAGKTLLLLASDSPKRLVGNLHSGYRAAVSYGERAVKWTGDTSGIFTMKRDFMPPAYHEGTLQAVIEAVGGKQVQVHGRQTGPLDTEYTLSWQ

SEQ ID NO: 12727 - protein, 192 aa, Myxococcus xanthus
MLGVLLLSAQAGANEVVMQFRTQEDPASPADPAVCAAAPFEVNVKLGGSVYVPEHNPKDGKVVDGGGRRVGSATACVQVTDSAFPAGQQLNVYMRYNLPEGRFTARGTCTLVSNDVPAAGLVLAGCAMRLVDVPKGFVGGSVSSTSVFNPRKLPGYATGSYYTLYAYRDGHQRDASKVTEAHAAEAAARARE

SEQ ID NO: 12728 - protein, 483 aa, Myxococcus xanthus
MDRKRMEFYTALGYRAPSAAATAQTTSGVASADVSELPPLGPDDLGALRERFLREPEEVLSLIRQDLGAPVSEGALVHVLQELEQSLREPEAALQALRQPAFQARASVSLPPDFTFPLMTTEIPIDASRTRFEPVADLRGWLLFSGRAWLHGGWHRAEFRRHDDAHHATRFRYELREPAPGRPVEVALFGGFGTGEYPARYVARQLIMRGERLEYAVHLGGVYYAGRRGEFDAHVAEPLEPLLPVTTLMTLNAGPEMRSGGTPFYRYLDERRGASRAKQVQEGSYFCLASERFQLIGLDTAYFEPGRHQEPALLSWLESVLKEGRQRGATNILLSHDAPYRYGEARHAGLLEDLRELAVERAQVDVWFWGATPYGALFDRSAALPFLGGSLGHAGLPVRAVTPGLKSPAPVRFLESHARFPEWTDLRPELGNNGYGSLLLHEDGTLGLQLLDWRGNVRCTAKLAREGDGPLTYQHLETSESAL

SEQ ID NO: 12729 - protein, 168 aa, Myxococcus xanthus
MARDIVIWPHKVLTSSTKPVTDFGPPLETLLEQMAESMKEAEGIGIAANQVGESLRVALVGREDGTFFEIVNPQILEKKEPVTMEEGCLSVPREWEKCPRFHKVKVRYQDKSAEWHELEAEGRLAHVLQHEIDHLDGHVFVDHLSSLKRTLILDRMKKLQKVKARQKG

SEQ ID NO: 12730 - protein, 232 aa, Myxococcus xanthus
MAEAARATRSIPERVARFREDYRRKHVSPRYSGRAHFVFTSLGSLAVIGFAVSHLEGRRPLEWLTLPAVFLLGNVVEFLGHRGPMHHRRWGLGLLFQRHTEQHHRFFTHEALAYESARDVKMVLFPPVLLLFFLGAVAAPLGALCFVLISPNVGWLFVASAVGYYLTYEWLHFCHHLPPEHPVARLALMRQLRRHHEAHHDPSKMQRYNFNISFPFADWLFGTSWRPDNDRR

SEQ ID NO: 12731 - protein, 435 aa, Myxococcus xanthus
MQGDRGPEGPAGAVGPAGPAGPQGSVGPEGPVGPLGATGPQGDVGLGTVTRTTVEPAAGNCATGGVRLEMGVDVNRNGTLDAGEENVALTRFVCNGPVGPQGGQGPAGATGPAGAQGPSGSVGPQGPQGPQGPMGSLGAYGDGSTGAYNVPSGNTVDLTTATGYGTLAGRQHLQFTNVTISGTLIVPSGTVIRATGDVTVNGTIIVDPSAEDNGTGPAEAGVARAAAGEPQGGRGLLPLQAAQLLRPGGLGGGAGAKQVGVAGGRGGGSLVMLAQGAVRIPPGGAINANGEAGGTASNLPGSGGGAGGAIVLVGKGSITVGGFVRAVGANGGAGNNAGGAGKGGGGGGGGGIVQLLSTTTPSVTGGILVSAGAAGATANPTGASQAISAGGGGGACGGNGGSGGGGTLAAPQPSEAGAAGYDLRTVTPTPENVFL

SEQ ID NO: 12732 - protein, 172 aa, Myxococcus xanthus
MKKTRDEALNLQEVGDMEARWRGLATQLLELGDDAMDAQLLVAFRAAREEGVVPPDAGFFLVAHILTAMADEAIGDEPRVCRLALELELMEREYGVEQGVWLSGEETPPEDWEALRAAYEAACDEARATFFTAYGEEEMARLYLDDRICFHRRFESGRRFFHGLPMLPEHLH

SEQ ID NO: 12733 - protein, 251 aa, Myxococcus xanthus
MTTDSAHRLLDLLWERYAAEVPYARTFVQLSGGRFRNDHVALRSLARPGGGIALFSQSFIRLGWKAAGAYTFPDAHLSAIYLSHPAGLPRIFISELKQEELSPRARELLARLPEDPAPPEDVDALAAWFGSPPPPDEAALLELEKESQYGAWLLAFGRKVNHFTGSVDDVEAWQKRMREAGVPMKADIEGAPGTSLRQTATQAAPLPVLLEGGGSRSWPYAYFEIAQRTPDFDGFLGPQARALFDMTKRGG

SEQ ID NO: 12734 - protein, 294 aa, Myxococcus xanthus
MRLHLVDGTYELYRAHFSPRPGHAAPDGQDVKATVGLMSSLLALLHDADEAVTHVAVAFDNPIRSFRNALFDGYKSDEGVPPELHAQFDLAEEAVRALGVTAWSMKEQEADDALATAAARWADTVEQVRLLTPDKDLGQCVRGSRVVQVDRRQEKVLDEDAVRAKLGVPPASVPDLLALMGDAADGIPGLPGFGEKGASALLSAHGHLEDIPAEASEWKVRPRGAEKLAATLREHRDAALLYRRLATLVTDAPLPGTSSLEDLAWKGVPPAVYEAFCDRLGLTTLKRRPKRWAP

SEQ ID NO: 12735 - protein, 542 aa, Myxococcus xanthus
SLAPVAYQLWQQELRYDPSHPIWPDRDRFILSNGHASMLLYALLHLAGVKRVTREYTVEDAPTVSLEDIKKFRQLDSSTPGHPEYRWTSGVETTTGPLGQGVSNSVGMAMASRWLASYYNRPGFEMFGYDVYAICGDGDLMEGVASEAASIAGHLQLPNLCWIYDSNHISIDGSTDLAFTEDVGRRFEAYGWRVLRVPDANDLNAMGEALRTFKTARGKPTLIIVTTQIAYGAPKLQGSSKAHGEPLGDEEIKGTKRFYGWPEDEKFLVPDGVRERFQERMGARGKQLRTEWEQKFAEYRKQFPELADQLERMQRRDAPQGWDAELPTFPADAKGLATRDSSGKVLNAIAKHYPWLVGGSADLNPSTKTYITGGEAMKPGEYAGRNIHFGVREHAMGSIVNGLCLSKLRGYGATFLIFSDYERPAIRLSALMELPAIHIFTHDSIGVGEDGPTHQPVEQLASLRAIPGIIVLRPGDANEVVESWRVIAQQRKHPVVLVLTRQPVPTLDRSKFGAASGVARGGYVLSDAEGGKPEVILIGTGS

SEQ ID NO: 12736 - protein, 166 aa, Myxococcus xanthus
MTKKLLAAFLLSTALVSAGCGDDHPEEEGVDAEACEHLQEGPATAVISNMGTNNPPPEIRADHRRYDITLMSGSEGNQGMVAFAASEAADYVIYTNADVPLSVTTSSGEAVEIEESTSSSKGCTDIKGRHVVPLTVGTHYLTFGPTSVATFGVLIEESHGDHGHEH

SEQ ID NO: 12737 - protein, 223 aa, Myxococcus xanthus
MSGACEHLALRESMIATARRMNASALNQGTSGNLSVRVKAGFLLTPTGMDYDSLVPEDLVLMRFDGSHEGRRSPSSEWQLHRDILAARLEVGAVLHAHSMFCTTLACLHRDIPAFHYMVSAAGGTDVRCAPYATFGTAELAAHVLAALEGRKACLMANHGMVAVGRDLAAAFKLAVEVETLAAMYWRALQVGEPVLLDGAEMARVLEKFKTYGQQPTPPSREA

SEQ ID NO: 12738 - protein, 402 aa, Myxococcus xanthus
MFLPFFYELRRRGLKVGAQEALALAGALRAGLHDSHLDGFYHVARALLVHSETQLDAFDQAFLAHFQGVETASLELTQELLNWLEEARERPDLSPEEVALLEQLDPEEIRRLFEERLKEQKERHDGGNRWVGTGGTSPFGNNGFGREGIRVGGGAGNRQGRALMQAGARKYAGYRDDVVLDTRQMAVALRKLRAFARDGAPDELDVDESIAATARNAGELEVVTRPPRRPNTRVVLAMDVGGSMDPYAALVSRLFSVASQATHFKELRTYYFHNCVYGKLYATPQLTGGITVPELVAQVGRHHKLVMVGDASMAPYELSIRTDAQGHYKTDGLEGLTWLMQLAQHFERNVWLNPEPMGTWRSGTISVIARIFPMFALTVEGLGEAVTHLTRGRTVRGAAARR

SEQ ID NO: 12739 - protein, 282 aa, Myxococcus xanthus
MSQAPTPVRFKGTDTYLTHESLQAAVNCALTLQRPLLVKGEPGTGKTLLAEAIAEALGHRLITWHVKSTTRAQDGLYVYDTVQRLYDSRFNDGDVRDIRKYIRQGPLGEAFSSPERVVLLIDEVDKADLEFPNDLLHELDRMRFRVTETGDEVVAKHRPVVVITSNNEKELPDAFLRRCVFHFIDFPDAELMRRIVGVHHPGLDSALSEQALKVFYELRSFTRLRKKPSTSELIDWIAVLKAQGVNDLKLDEQLPFLGALLKKEQDLVSVAEAFGRGRRPRA

SEQ ID NO: 12740 - protein, 189 aa, Myxococcus xanthus
MLVEPNPHIALNMADDPRLSREELCERLSLLAERGLIRVHALPDGLQELFSPEEISSAIDARQSRTPFGYSLTDAGGAIWEHHARPDWSRFVNAGQEPSADEAQDAWVIEAASLEAADAEFHFHESLGDVHQPVGESKHGEVLTPWQVTYWKTLPHGYRLRYVTVPRPADPARSRSVPSRPPWYTRVWL

SEQ ID NO: 12741 - protein, 109 aa, Myxococcus xanthus
MLCERGKDLEVTFRDVQADDHRGRAHWDANYTFSGTGRKVLNRIDAEFEFRDGKIVRHRDHFDFWTWSRQALGPTGLVLGWTPLLKKKVQSKARKSLDIFMRERGIPQE

SEQ ID NO: 12742 - protein, 79 aa, Myxococcus xanthus
MAAVQGMRLRDFLLWDALALCLSAPVVVALGYAFSHSVDAVAKGAARAEHLLVLATTAALLAVGGLRRLRTRRLAQRPR

SEQ ID NO: 12743 - protein, 82 aa, Myxococcus xanthus
MPAHTHTLNVSSQHGDTETPIGTVLAADSTATVLNYRAAPIDGTMNPAAIGVSGGSQPHNNMSPFLCINFIIALEGIYPSRN

SEQ ID NO: 12744 - protein, 193 aa, Myxococcus xanthus
MGPDAVFNLLSTERLHLVQLPPDAAWRVLAYHEANREHVSTVSPARPANFFSVTYWRTRLAQDREDFRLDLSLRVFLLPRKQSIQLSPIIGNISLTNIRRGPLQSADLGYGLDHRYEGQGLMTEALRALCDYAFNVMGLHRLQANHLPENLRSAAVLKRLGFQVEGIARELLLIDGQWRDHVLNALIAPGRRG

SEQ ID NO: 12745 - protein, 409 aa, Myxococcus xanthus
MLKRGWKALAGVTALAAVGCAHAPPPQELLNARAAYQEVSTSPQGRERPRDVAAARDALLEAEREYDRSQDSPRTRSLSYVALRKSETAGARGTADLAARRQAEAQATLQQAQARQWQRSQAELDAARQQLAQAERERLQALQQQQQSRQHAVTQQQEAERMRMDAQRRQHEAEQLRRLAQQQEAESRRLAEKTTRLQEEAQRRARAESESRRLAQENHELLQRSAELEAEQEARRQVERELERERQARLDAEQRATEALTQLESTARDVKVREEERGLVLTMSGQVLFASNAVDLLPTAREQLTEVAHALKVSDSPMVIEGHTDSMGSDAMNEALSYRRAEHVREFLISQGVSRDRIQVRGLGEYRPVANNSTPEGRANNRRVEIILPRGGEEATGGSGAEPPTTPRR

SEQ ID NO: 12746 - protein, 119 aa, Myxococcus xanthus
MRLKLAAMLLGLTMVGCAGRQVLPAPNEHRVQAEASLRSAEGAGAARVPEAALHLEFARQQIADAERLWVEGEQEAAELRFMQAEADAELAQALARAVPLERESRRLAAQAESLRRGQP

SEQ ID NO: 12747 - protein, 454 aa, Myxococcus xanthus
MRSDTSAPFDIPDLSLPQQLPGRLALPIDNADLFRKARPPEEHTRPGAARLHVLVQVSHLIAEAGLDLSMVLQVLVRKVSQALGDACVLQLLSEDTTRLELVTVHHPNAEARAVLDASMRRCPGRVGEGLSGRVAATGQPLFVPRLQAEDLRDERVPEGMPFLRHYGPHSVIVVPLGVRGRVLGTLGVMREAQGREYSVEERALLESLAARAALAIEDARRYGAATQAVKARDELLSVAGHELKSPLNALQLQIHLLARMAREAMAVDGLAERAERAAKAGQRLGLLIDDLLDVSRLSSGRLGLKREEVDLAALTRELVGRMSEELALAGNEVRLLLDRPVSGHWDRLRLEQVLVNLLTNAAKYGAGRPVTVEVEAVGPVARLSVRDEGIGVSPEEQERIFEQFERSASVQHFKGLGLGLWITKRIVEAHGGSIRLTSEPGKGSTFTVELPLPA

SEQ ID NO: 12748 - protein, 677 aa, Myxococcus xanthus
MKRYGAGLLTAWLLAVAPACGDSDEGAPPDAGLPDAGDSGIPDAGDSGTPDAGEELPPLLVPAGCNPLASEHDCLLPYPSDYFLEEDAALPSGHRVRLSEAAKLKAPDGAAFDFTDLHPADGYSHGTQVLALFPDGVDDARLPSVTSPTAATNGNTVFLDAERGEGVLHFAELDPRAPDDARRALLLRPVVRLRNTARYIIALRGLTAKDGTPVPVPEGFRRIRDGQTAGDPLLAPLAARYEADIFPALEAAGVPRAELQLAWDFTTESQEGVTQDMLQVRRLAMEALEATPPAVTVADVRDDVDANVARRITGTLRVPLFLESDQPGALLARDEEGRVRRNGDAEVPFTLQIPRSVWGQSVAPVRLLQYGHGFFGRQAEADGSFVRPFIQATRMVVLTVDWWGMSQTDAPGVLQAMAGNPGQTMRFTDRVHQGMVNQLAVTYAARTTLGALTELQDDGVRVFDPEQTYFYGISQGHILGGTYVALSPHVSRAVFSVGGADFSLMMFRARPFGMFLDAIAQTVPDALDQQKFAALTQTSFDRIDPLTYAPHVLGDLYPGAPASRRVLVQYGLGDAQVPNVATELHARAMGLTQQLPATWRVPMLPAEEGTVEGSALVQFDFGLPSPLPGTVADLPAADNAVHEGVRRDDDGREQVDRFLRPNGQVEVTCDGICLGGN

SEQ ID NO: 12749 - protein, 336 aa, Myxococcus xanthus
MKTRALHRLALLAAAVLAVAAPGCRHAPPLDPGLDADGDGVLNGEDACPTVRGLARLQGCPAKDTDGDGVEDALDKCPRHAGPASREGCPIRDSDEDGVEDAKDACPRVFGLLERQGCPVDDPDRDGVEGAADKCPDEPGPASREGCPIRDADGDGVPDEEDACPDEEGLPSLRGCPERDVDGDGVADHRDNCPRERGAVDNQGCPAARKQRVVIRPDRLELLERITFAPGTAALQPRVQPALDNVADVLLVHPRLGVIAIEGHTDNRGDPDVQREVTLARAEAVRDYLVERGVPPDRLEAWGFGPDKPVESNETAQGREANRRLDLRVVAPRGRP

SEQ ID NO: 12750 - protein, 486 aa, Myxococcus xanthus
MSASSPLFGDLLLKLGIVSPGQVQEALALQALTGQRVGEALISLGYVTREQIQDALGEALGLHQDKSPLQPALGELLVGLKYVTLAQLDEALARQRRDGRKLGEILVELGHCTYKQIYEALGLQNRIAGRQDLPRPSSDGRRRVVVVDDSPLACAFVQEGLVALGYEVLCFQDPFEALESMGRLQPVIVLSDLEMPGLDGVELCRRLKEGPSHAVPAIILTANDVEAERVRGLRAGADDYVNKSASMDELAARIESVVRRTGETERMRKLFARYTSDAVVEEILKSADAVVLTGEKREVTLLFADIRNFTGLAESLPPEQVVGVLNQVLGRMSDAVLTCGGTLDKFLGDGLMAVFGAPVARPDDALRALQSAKMMMDALTDLRIEAEAEWAAGGREGQPLVLELGIGINSGVVVAGNIGSTVRAEYTCIGDAVNVAARLCALAGPGEILVGERTRELVDANETAFEDLPPVRLKGKQQPVPLFRAL

SEQ ID NO: 12751 - protein, 140 aa, Myxococcus xanthus
MNASSDEPPPSRRSPVLFVGLVFGLGLVVAVLVGALSGSKAVHADRIHQDLALLEEALGRYRADKGTLPEDADVEELLVPAYLPSVPLDPWGRPYRYTSNGEEVFLSTFGKSGDRGGSGEEQDHTNHDGHAVPKVEPERT

SEQ ID NO: 12752 - protein, 453 aa, Myxococcus xanthus
MAIVCVTNLSPESLAAAHVAAAVAGRLQESLLLLGVAEGDAFLDDGTGALVLTQQRLEAEAARLETLARVVHYRLQAGTSADEVLSDEECRHARWIVVAASGWRTPAWRRATVPERLSRYGCAPVLAVRSDTALTDWARGRRRLLVLVGVDPGSSTTGAAVSFLRELRRVGPCDVLATYVCSPMDERERLGIHSPVHVELLEPALQGMEALDPIVERVLQREVREQVGDLVGEGRVEVVLEPGFGRPADHLMHVAHTRGADLMVVGTHQRSGVKRLWHGSVSAGVLRHAAQSVVCVPPMVQARRADRPPRSVLVPVDFSEACTKAISHARTLVGPGGRVHLLHVHRRKLEDRGFADHYGVLPEPARDRDQVLQRLWELVPRDETAQTVRWSVEGVTGEDVTLAICQATEREGVDLVCVGTSLEPSRLRDALEGEVAHELVTRCRRPVMVVPSA

SEQ ID NO: 12753 - protein, 155 aa, Myxococcus xanthus
MSQENTGKPKRGLKRPIEVVRAELLKDPETKKIAEAVSMKLEDYVELVLKYAQDKDKEAEVAVISDEELRRNGFNPLSSEEAANILIKGMKGELPGSPPDFEASKFTQDKASTAGKPSLTSPPVGGAAPTGPQDPAARQELMDQLKKGSSGGNRP

SEQ ID NO: 12754 - protein, 142 aa, Myxococcus xanthus
MGALKSVTNVISKVASTVSKIAGGIANIGGKAMEFLQKPLSSLVDPIAKFIGDKVGKLPLVGKFLGPTAENLVKQGAASFLGEGTLGSLGFLSKIAPKVQDITNIAQAVKGAADKVGAFAENPLGLQNFQNIIAQNHARFVE

SEQ ID NO: 12755 - protein, 162 aa, Myxococcus xanthus
MPNLSQAKAEQYLPHLNRAMAEANITTPMRKAAFLAQLAHESGQLRYMEEIASGAAYEGRRDLGNTQPGDGVRYKGRGPIQLTGRANYRAAGQALGIDLEGNPQRAKDPDVAFRIAGWYWSSRNLNTYADAGNFREVTRRINGGYNGMADREMYYRRAQNVF

SEQ ID NO: 12756 - protein, 411 aa, Myxococcus xanthus
MVVLGGWSRPEGSKEAPTDVLEGIRARLTRSLENWTVGADDVRAVHTALGSLPAGTYRAALERLQQDGLLGAYVKAQDAGSRLAFLEQAESKGALHRRSGESGPVGPLGYPAVPDVFVNDRRLPGAMRDAVNAHAIDVGAGFYRAHTEYLGRYARAVDGAQSLQELGALGPPRAAHLSESLLGLEWKDPSRRDYEAAWKAGIGQPKTLNLTVQHVSARQRELSGERAGGTVQLHGKVGVSSESAQWSAKAALDTRGHGELKGDVGVSARAGPVGVELSHDSSGETERKVKVNLGLVELSLASDGEQRVAVGVGSLFQVHATLNAKKAELGGGVSAKLKADGSQASAEAGFSMKGLTAERAQQSFGPGHRNVFQPPAELASRTAWDALPESTRAAYAKEGWNRDAWTRALPR

SEQ ID NO: 12757 - protein, 141 aa, Myxococcus xanthus
MATERAQRFVDALAKLEKEGDLEALVSLFSDDAQVSNVASPQVFSGQEGARRFWREYKGTLQRVESTFRNMIEAGSRVALEWETQGTAHNGAAVAYEGVSIIEWDGDRIRRFYAYFDPHALGLELTSGNAPRSEVPATTPA

SEQ ID NO: 12758 - protein, 287 aa, Myxococcus xanthus
MTRFAAFFVVLSLIAAPHTAWAQQRQTESAKKTRAVKSSSKTKATKTKAAKPVKATSKRKPAKKGKKATPAVDSRGVNAPELQAQPMMQVEPAKPLSATDDAPTVQKKSGEAPAEGGDSLDFDLLEPAEAAAAAQVDPDLERRIGRRRTMLKLHQGLGFAMAAGLVGTTVVGQLQFNDSFRGGGDDRNLLGLHRGLAIGTSALFATVGLLGVLAPEPFEKEFQWDTITVHKMFMALATVGMVAQIVLGIMATDRFGRLSETDMATAHQISGYVTLGAVSAGVFTLFF

SEQ ID NO: 12759 - protein, 114 aa, Myxococcus xanthus
VEHLRTHFPERTTGLEARELDAHVERALQAARDYGLASRRELCRFLNLCGLHGWDFDRRPRNAWMKAMLTAPDVTAPGARLDRLVEHSLHRLELESHRTRLEGEFGLHRRERRS

SEQ ID NO: 12760 - protein, 53 aa, Myxococcus xanthus
MTVLFKSEKQAVAEGSFDISLDAYNVNRPSLLMVKVDDVLVLEPKLVFEVEGT

SEQ ID NO: 12761 - protein, 316 aa, Myxococcus xanthus
MAEQSQQTPSAVAGPLLHLGCQSCGARLVLEPALRTTRCPYCAAPAVVERPPVPGVPEPVFALGFALTHMAAKAHVARWLRSRSRFTRSGIRSAAPGEVRGVYVPAYLYSVLAQARYRASIGENYQETETYTTTENGKQVTRTRTVTRTEWRSLEGELTSYVADVLVTASKGLDNAELEALEPFDLRGLARYTPALISGWVAEEPSLTLAQCQELARKEAVERVGGLLSRFMPGDSHRGLEHQSRLDWEALDVCLLPVWVLAVKYAEDAPPLRVLVNGQTGAVHGEAPISSWKVLSAVVALLAVLALGWLLTGGGR

SEQ ID NO: 12762 - protein, 187 aa, Myxococcus xanthus
MFDAGVDVSWTADSNAGSRRSDWAPHAGRTRFDFEGIPVPASRGLKVRECEALAPHYQRGSRLDTPHGPEGAHVERFEATRSGARRSVLEAVERLAIERLQQGVIPGSRFRNIHVAVALFSLRTQRLALPVYVLAYRYRDKPYRVLVHGQDVQVVLGEAPISPLRVAAVILATLLVLVAVLYGVGVL

SEQ ID NO: 12763 - protein, 116 aa, Myxococcus xanthus
MGMAMEVYSRLERGKMLPRTQTLRRLCDVLQVSADTLLGVGRPDGAPVMPRKTVKEDPVELRRMTRKLRELEPGQLRAVSRVVNAVVTVLPQPAAPAPAAPAKPAARAARKRRATG

SEQ ID NO: 12764 - protein, 156 aa, Myxococcus xanthus
MTQMEMRMRKLALLLFVGLWLGCRADGTDSTEGTLPLHPQETYTYPGCANEDYNCPRLKTVHCALESLRTERDSCQQDSDCVAVSVNGRCTGYGECPPAMVNTASRAEFATRAAEEVLRYCTESPICASTGQCAYPSFVPRCKQGHCVAEPGDAGS

SEQ ID NO: 12765 - protein, 288 aa, Myxococcus xanthus
MALDGASNAYVVDSSGRVTRYDPSGQVLWTALVAVENPSWPELAVSASGHVYVLLSLGNHEIARQLKLIAVSPQAAERWSLLFNEGQFNYTWGLAVNAQGEVYLAGSVHNRDATSGQSVFVKSYLRKYSAEGAIRWETQDIGSLFAVNPEGATSTLSPGDGTTEGFTQRWIGANGMTQWNAAVSNVPGVVTLQTFSPSGTLLIGGHELLAGGTEIGRGWFAAMNLTTRALGPVTYVEGSTGGGGPVRISGLALTPGGHVVVTGGFSATWDQDGGFIRVYDGRVLTGVP

SEQ ID NO: 12766 - protein, 125 aa, Myxococcus xanthus
MTTLRKVMLVDDEDDIRTIGNLSLSRVGGWQTVLAASGAEALEKARTEKPDLILLDVMMPGMDGPTTFGRLRAEESTAHTPIIFMTAKIQKQEVARYLELGALGVIGKPFDPMTLPQEIRELVPG

SEQ ID NO: 12767 - protein, 815 aa, Myxococcus xanthus
MGRPWATSDNDRYRSALRHLRVASGDLEMDVLRERMGLRTLHGSDPEDFAALRARADALRQFPSFLSAMDRRTMNAALDLFVSALEESAALLERARAADARGEKEAADAAVQALLEGTVSTRAERLINTYLELYERTQARNERSRIIFFIVSLALVAYVLVVMVRLSRATADLATLNTDLERRVEERTKALSAANDGLRASEARKAAILEASPDGILLLDGGGDLLELNPSAQKTFQVVAADVVGRDFLSVALPAELPDGARQKVLAAGRNTASGQATRLESPCLRRDGSTFPAELTIVRVPGEGPPRYTVFVRDITERKAVERMKNEFISTVSHELRTPLTSIRGSLGLLEGGIVGDIPPQALDMVRIARTNTERLIRLINDILDLEKMEAGKLELKVSTPECADLVESAFASVRGMADGAGVSLHAEVTGTPQVKADRDRLVQVLTNLVSNAVKFSPQGAGVTVRVGEEEDGRVRFSVVDQGPGISQEQRARLFGRFQQLDSSDTRSKGGTGLGLAISQAIVEQHGSRITVESEEGRGSTFTFTLESARPASVTPPPVIPEDVSRHEVLVTTADAELASLLGGLLAHEGYRVVRATSLIEAAKHLDTALPDALVVDMRLPEGHALDWVRRLREQPRTHELPVLALSGRSEDAEGVPHWVDWMPRPLEESRLLKSLRYATRQPGQARVLVVDDDASTRRTLCAQMERLGVQVFEAADGESAVELARETTPDLIVLDVGLPRLDGFEVVDILRQGKGRATPLIVFTGRDLTRMDERQLTLGITRHFTKSRASEEELVSSVRDLLNGLLARKAHPS

SEQ ID NO: 12768 - protein, 673 aa, Myxococcus xanthus
MSSRTLLFLEDDKDLQSLVGTFLREKGYRVEPARSAAEAQAVLARVPVDAAIVDGLLPGMTGADFIRELRKTQPKLPILFASAFWKDLKSHELLTRQLGVVRIIHKPYKPEELLVWVNQLFPAPALPPPPPPEALEEAEEVNVEVDDLAASLAALNAEYGARLKEKVAALEALLVRGRGGDAAALEEAYTVVHKLHGTAGSYGFAEVSIRAGQLEAVLLPARAGAPVDVAALDASFRTLAAAASVPVKPAAAPPQSSEGVLLVVDEDAKLLAEAERMGRQVGVGVVTARTADAACEVARRQWVDGVLVHLDLGGPLGGLAVAHALRAEESLPVLPLAVTGARDVLEERVAAAHAGASLFLPRPFTARDFSAAAERMVAARRPERARVMVVDDDPDAIAALTQALASDQIEVVGLSDAHGLMEALAQHRPDLLLLDVQMPGPSGFDLCRILRSTPEWQELPVLLITAHLGLEFRLAAFQAGADDYLSKPVLREELRARVQARLERTRLSRERAERDGLTGLLLRRPFLDGLRARLAESRRQGKPLALCFLDVDHFKQVNDRYGHLAGDRVLMWLGRLLGARFRREDVRGRWGGEEFVVGLLGESAGSASEILARTAAELSDMTFDGDTGEPFHVTFSAGIAVSPGDGDTVESLLRTADARLLRAKENGRNRIEA

SEQ ID NO: 12769 - protein, 275 aa, Myxococcus xanthus
MEEAKAVQPGKRIPVCHGGTLDPFAEGLLLVLVGQAPRLFELLHAVPKVYEAEVVWGTETDTGDLHGRPVLQGDTAALTPGALDAALASFVGWREQVPPATSAKKVGGEPAYRKAHRGEAVELPPSRVYLHAARWLSHDLPRASRLWLSCRGGYYVRSLARDVGRALGCGAHLSTLRRTAIGPWEDPGLGQRVWLHGRDLLPWARVRTLTDAEVGELRRERPVPASGLQPADWTLPPGFPDPEAPIRGFHQGCLAFLLRERDGALWSELELRGGL

SEQ ID NO: 12770 - protein, 617 aa, Myxococcus xanthus
GAPPPWQRVIEQAYASEISPPFSWPEPTPPGAALLGLVEPLVHAAHARLVSALDTCLRDTPEAPFEPEHTARMLLAPLPRMLMPLLGRTLAVELRIAQLEGRLQGDTPEARFLDFAQHLRRRDVALDILAPLPGARAGKPVEYVTAWEATGVELMQRLARDAAALWHRFHGGVPPGLLVEAQGGLSDPHRGVRTVFLLRFASGLRLVYKPRPLTAEAVFQQLLSWLNARGLTPPLRTVEVLSSDGYGWMEYVEAAPCQSAEEVRRFHLRQGALVALLYALDVTDIHYENLIAVGEHPVLVDLETLFHPHTLAASIRDVEKQPGAVLNGTVLKSGLLPQPAWRAKDGTEVDFSALGAGEGQLTPLGYLVATAHGTDQLRFERRRMEIPGAANRPRMEGQDVSVTAQADALAQGFSALYRLLAEHRDALLAPGGPLAAFEHAPVRVLFRGTASYDALLHESMHPHAMGDALDRQRFFDHLWLAVKERPYLAALIPFEHEELQRGDIPRFTALPGSKDLWSGAGRHLPDFFDDSGLERARRRLTGLSPDDHERQLGLLRSALGRVRLAASPGDRPRYPFREPPAPAHPDALLAAARRVGERLVALSFTGAGHSHWLSLEM

SEQ ID NO: 12771 - protein, 136 aa, Myxococcus xanthus
MAISKRGLVDRVKEVPVQAGTRGARVLLGTAVVTARGVANLQSKIRGTPARGRVKTSAATGTRRTAKAARGVIESGKPTKAPARRKSPSTKTASAAGANNQVGRKSVPGQAAAARRGTAKTPRPATRAKRGQKHRH

SEQ ID NO: 12772 - protein, 124 aa, Myxococcus xanthus
MVGVQDATASHGAGLQLVSFSVDPKYDTPERLTEYGERHGADFSRWSFLTGDYEQLKETIVQGFKVSMGREPGAPEDDLLSIFHGTHFVLVDDAGQIRGYYDSADSDSTERLIRDTRRLAQTGH

SEQ ID NO: 12773 - protein, 183 aa, Myxococcus xanthus
MTLPGDASVLTGSAGITVRTAAVEALLELGYPYALEVPPDALERARSEQRLPTTAAPTSRLLRSPILATTATLLCLALQLILMALPDVRTLDDVGALLTPYLLPVIAPALLAILGTWTKTRPLQYLGSLGLGIQGLFWFGGVFMLTRMASKVPWLWVAAPWYLPFIACYLVWPRPLPPPEADS

SEQ ID NO: 12774 - protein, 75 aa, Myxococcus xanthus
MTDDVEAVTPDDTLHDVIGLMGRRQLRRIPVVERDDGIVGIISLGDIALRADHDEELQQALERISSKRSFWSRLG

SEQ ID NO: 12775 - protein, 284 aa, Myxococcus xanthus
MLDPRAIFERMVHQLAPTPEAARAIVDHRLYRFLSELVAGVQEYAAAEALDAFLTDGRYELILLDTPPSRHALDFLDAPGRLARFLDERIVSLFGPEKRARGGRLWHGAQAVVDRVLAGIFGAGFTQEMRGFIGAFGGLFSGMRLHTERLHQRLASPDAAFLLVTSPEPASLREATWFRETLAARGLPFAGYVLNRSWAHDDVLAAPEALLEHTGGDRHAEQAVAALSRLASVEQARAQAHRDVLDRLTRHLPSGTLAVAAPDAGAELEEFSGLVRLGDALAAG

SEQ ID NO: 12776 - protein, 194 aa, Myxococcus xanthus
MGLMYQLLALLRRTRPDGRFVHPLTVVDLPATGHALALAALPQRVLSLMPGGPIGRDVREGLDFLQDAARTAMVLASLPEPLPVSEALTVAAELRRLELPLSAAVLNRMPEDPFTPESRAALHRMLAAHGPHQGWRELERLERARAASVRLSRALRAPLLTLPELHATGPALVEALAEGFAPHPEHAPWQEALP

SEQ ID NO: 12777 - protein, 406 aa, Myxococcus xanthus
MSTEHAAPALSTRDFIDLEERYGAHNYHPLDLVIERGEGCWVHDVEGRKYLDCLSAYSAVNQGHCHPRILETLREQAAKVTLTSRAFRNDQLPHLYKALRELSGLSRALPMNSGAEACETAIKLARKWGYTVKGIPEDKAEVIVFANNFHGRTISLISFSTVRSYRQGFGPFTPGFTVVPYDDVEAVRRAITPNTCAILMEPIQAEAGVLIPRDGYLKQVAELCKQHRVLFMVDEIQTGLGRTGKTFAFQHEDVRPDVIVVGKALSGGFYPVSAVMADDEVMGVLRPGEHGSTYGGNPLGCAVARTALDVLRDERLVERSAEMGTSFLAMLKTLKNRHIVEVRGRGLMIGVALDISARPACEALMKEGVLCKETHDSVIRLTPPLIVTQAELDWAFERIKKVIEAL

SEQ ID NO: 12778 - protein, 227 aa, Myxococcus xanthus
MAEIRELSRVSVNKLGEYLVATPARRKRIIHDQKHPPEQQYLRYPEASHAITDFLCRGMDLSILREHQRRFACSVPQSEFEAQRLQLCSEALERFADLVPWLDLEETLISAVGAEPPVLEVAGVTISVRPEVVLQRMDRHGNARVGLMKLYFSKHQPLDERSGQYIGTLLQRFTEQHLCPLGPCDHRLIQVVDVFAGTVFTAPRAHIRRLSDVVLACEEIAERWSVH

SEQ ID NO: 12779 - protein, 102 aa, Myxococcus xanthus
MAQRDKQQQPGIQPPEDYYGRTEEPRQHAPETEESEEKRDLADAAESPEVTHRMRTIDPTERTPGAILDEIGDGDGPRSDAGTNPLPDTYWSAYPYGEPQRE

SEQ ID NO: 12780 - protein, 364 aa, Myxococcus xanthus
MLLKLYRGAPHVVMEYVEGRSLDTVLNLAAMRRRPLSAEFAAHVTAEVADALSHAHGLTDEWSRPLNIVHRDVSPRNIRVGVHGEVKLTHFTVAASSLSGREVTSQELVKGDIAYASPEALRRRKVDARSDLFSLGLVLLELLTGRHPLMVDDLAPVLESEPLELHAQGPTWMPVKEVAARMAQVGPEQVERLAAGVAEPLRCILLRALRQNPSERFQTGAEMAEALRAWLDSQGGHRGRQAIAQEVEQAAVEATVRRNQAELLEGGLHPEGLTVEEAALAGEPSSETPLGEAAGSAVRLSQVAELTLEARITQTVEPAADVQHAATEAPDEARPEASSSQPPSPPEPSDTAPESTTPEEPDTP

SEQ ID NO: 12781 - protein, 408 aa, Myxococcus xanthus
MGRLLFLLVFNVSAWAVLRSLWPGLLRKWRLGAFALGTFLSLVAWLYSAVAGRHAQLPVGDAALRVFSVGWSVAIIMIVLAGAPFLLLRRWLDRPARQEPPLTAPEANPAPPVNMARRNLLTNAGRAVPLLAAGTSSVGLANGYTQFSVREVDIHLPGLSPAMDGFRIGQITDVHVGTFIDTQYLQDAVRAMNDAKVDLQVMTGDLIDDLDQLDGTMAALSECKARHGMLAILGNHEHWRGLEAIRQAYADVEARGGPVRLLVDTSHAFEHAGQRVRVVGVDYPMSGRSHRVKAERMQQSAEAGFRDVAPEEVVLCLTHHPDFFPLAAERGARLTLAGHTHGGQVAFLGVPALWFVFKYMLGRYRQGDHQLYVSGGTGHWLPFRIGVPTEVTVLTLRATGASAAGRTS

SEQ ID NO: 12782 - protein, 316 aa, Myxococcus xanthus
MRLEHPNVVELLGYRRWPDARDGYLVLIMGYVEGPTLSEWALAAQPTPRRAVQVFQQLALTLDAIHRAGVLHRDIKGNNIIIRASDGQPVLVDFGSGDHACSPVLTEDTLPPGTPSYRSPEALRFWAQPRPAGSRYAFAPTDDLYSLGLVLYEVLTGSFPYPTQLPPAGLLASIESGGFPLPSVRNPRVPKALDAIVARLLSPSAAGRPPSGAALFDALDAALAGADSAWDEHLFPPLAPEEAVTEEALEFFDGDEEARELRHWMRVPERARPPASFAPPTEPASPWALTEVRASTGWRRWRDALKRLWATLRSWR

SEQ ID NO: 12783 - protein, 486 aa, Myxococcus xanthus
MEAAERVKVVDVNEATVRLLEARTRDEVLRTLSLSRSRVFVPEPLKAFTAELLLLWEGGTRLELETELQTLGGRHIEVMLTLTRPSRERSDRVFVTLREVTAQKASQLARQESEARFRNMADHAPVMLWVTDVTGRCIYLSRTWYEFTGQTEAEGLGFGWLKAVHPDDSEHSGAVFLGANARRSPFRLDYRLRRKDGEYRWAIDSASPRFGLNGEFLGYIGSVIDISERKQAEQERERLLAAMDEAIRLRDEFLTVASHELKTPLTPLSLKLQTLARATQERRGPELLERLPADLEVMQRQVKRLSTLVGELLDVTLISSGHLHLELEPVDLGALVQEVAARFEGESQRTGTPIQAKLDEVVVGQWDRGRLEQAVSNLLSNALKYGVGHPVHLQVGRTAEHAWFSVRDEGIGIPPEAVGRIFEKFERAVSERHYGGLGLGLYVTRQNVQAMGGTIDVRSTLGQGATFTARLPCQMSNVNAAREKAS

SEQ ID NO: 12784 - protein, 458 aa, Myxococcus xanthus
MPDCDFGSLAGLERQGAIYRAEIRYETQVQPGTVRVLPENGGFQFDASGQPMSVMGRKPHAATMNGERFFISSEPTSQTGLQDRYTFIGCHAQGPRSLTGCVLWCRGSTLRQSGSFRAERMTWREGEPESANLQLLSEMPVGLDTPVDVYVTHGHAYVVAIDRRGVGGGLAVFNVSNPYIPVQQTVIRFGHSDYWNAVWARDNALYVGSARSGLLVFDLADPRLPAFVRNHPSGGSPVDVHTLFVDGNRLYAMSPSHKQTLIFDITQPLEPQLLTRFTYPRSVGYPHDAFAYEGRLYINHLDDGFLIAGLGGETPELLGRYTYPHAFSHANAVGTFNGRTVAFEGGETMGSHIRVLDVTDPANIVKIGEYRLRGLTSVHNMLLVGTRLYVAYYHEGVRVLDVSNPSQPREIAHYNTFRESDRNRTDKLTDGAIGIRVPGDGRIYVVDTSRGLLIFNEP

SEQ ID NO: 12785 - protein, 78 aa, Myxococcus xanthus
MILKGERLYVAWYHEGVRVLDVANPTQPRQVAHFNTFRETDPHRADGAFEGAIGIRVPGDGYVYVVDTSRGLLIFNEP

SEQ ID NO: 12786 - protein, 73 aa, Myxococcus xanthus
MTSPLRPGWVLLSVLILLLSATTGCDDDPPPPIPDAGQQPTDSGTDAGSEDAGTDAGPEAPWDGGYTVLGRPG

SEQ ID NO: 12787 - protein, 346 aa, Myxococcus xanthus
MEAKLQTQATEARRQAEGLGQQITGLNEQLEQGRKALAGREDQLRAAGAAQQKLTAERDGLAGQLQQAEARLQQQAQQANQERADAKRAADELAAKLAKTEQRITQFAQDAQTQATEADARAKDLQGQLSARAKKIQDLELAVENAQGAKSRAEKELNAKVAAAESKAHEASTRLAAAQKERKDLEARHAKEQEDLAAKQKAELERRDAIKAQEVARLQQSVQEKSKALKVAELELARYKSKSATTATPAKAAAKPAAAEDDELAVRTQLNQVIAPAAAAQAPAPAKKPAAKPAAQAPAKKAPAPAPAPPAALSDESEPTDRTLVIQLPTAKEDDDWTALVDELDK

SEQ ID NO: 12788 - protein, 270 aa, Myxococcus xanthus
MDKPILVEGPAGVGKTELAKALAQALGREFIRLQCYEGLDEAKALYEWEYAKQLLYTQLLKDKIGDMVQGTTTLAQAADRLASSDAVFFSERFLLPRPVLKAQLSERPALLLVDEIDKADPEFEAFLLEVLSDNAVTIPELGTFRAKHIPRVLLTSNAARELSDALKRRCLHLHIDFPDRERELRIVRSRLPQVPQVLAEQVVEAVAAIRSLDLKKAPSISETLDWAQSLALLNAEQLTADVVASTLNLVLKYEGDIEKAKANLSQIAQA

SEQ ID NO: 12789 - protein, 381 aa, Myxococcus xanthus
MPHVKDLRQHAAKARDMVAQRLRGRVPPEALDREIRHKELVLVTGGGGGTAYVYLGVMSLLGEYGLEPRLLAGTSMGAILAIMRSRLTRFDATDMINIVRGLSFRKLFRFISTESRYGLPAALRLFLRAGLGRFFSAGPENSGMRLKDLPVPTLIAVGGIRRGMLPRPLEYYERLLGTSPLGLLNPVGVARRIQAAMGAMAELFTRPEITARLYLGADDTTGDFDALDAAGFSSALPGVIHYDVLREDPGMHTLVEGLMGQHGVARLIDGGLVDNLPAKAAWKAVARGRIGTRNAFILALDGFAPKLTTPFWLPLQRLAAMTVAPNLPYTHHVKRFPRTLSPLDVVPSVELASKALQFGRTALAEDLPFLRRMLAPLPPVL

SEQ ID NO: 12790 - protein, 285 aa, Myxococcus xanthus
MTHALHYGLGVFEGIRAYKTHDGRLAVFRLREHVRRLLDSAHIIMLKIPYTEDELFDACVNLLRAQKDLFANGAYLRPVAFMGDGAMGLGAVNPTRTAVTAWDWGAYLGDKGIKEGIRAKVSSYTRMHVNVNMVRGKITGQYVNSILAKREAVLAGYDEAILLDISGFVAEASGENIFQVNKKGIIKTPPLSGPILDGITRDTVLHILRDSGRTVEEVTFTRDALYITNEIFLCGTAAEITPVREVDNRQVADGKPGPITRYVQDMYFRIVRGQEPRYADWLTYI

SEQ ID NO: 12791 - protein, 446 aa, Myxococcus xanthus
MAPPAGYDYDDNPFKLENPSILDIAPPEPKSVEDTGLKMGILSDIALKYLYYAGTGTGMGIADEMRLPWPGVIEHVVDFLATEKLVDLRGGKGFGRASVEFILSEKGREYARDALTRTTYVGPAPVPIEQYNALITSQTEETPVVSQEELVMALSHLTVPAELMDKLGPAVNSGRSLFLYGSPGNGKTSLAEAVSHMFGGEVFVPHCLEIGNQIIQVHDRLIHTPVSLEVGRDASGRRQTFEMDNRWLVCRRPSVVVGGELTLAMLDLIYSESTRFYEAPFQVKANGGMLLIDDFGRQKVHPTDLLNRWIVPLEKRVDFLTLHTGKKFEIPFDQLLVFSTNLDPKELVDEAFLRRIKYKIEVGNPDEEAYREIFSRVCEAAGIPYVDQAVTYLIEHYYKPRSMELRSCHPRDLVSLIRDAARYRQIPPALSKDLLDQACEVFLVNL

SEQ ID NO: 12792 - protein, 177 aa, Myxococcus xanthus
MPSVKQLRPFALATLEAFLEASGRVVLVQQPPEPVFQQVAMRLGEARTVGMAHRTRLVDRLFVMLRGFDALEVHFLRPETEGEEFSVGRIEGCSLVVPDPSVSKLHAILRWHAQAGDCSVRDQGSMNGTWVNASSLGPDQDRMLNDGDALAFGDAQFLYLRTETLHAHLRMASPSRG

SEQ ID NO: 12793 - protein, 224 aa, Myxococcus xanthus
MAALFPHRTSAEASMIPVVLEIRNHKAVCDFIREEAAGAKKQAQITLTTIKRMHDLFLGNTPEAQTERARMERRERTEKELAKERDRSGLRKDMPLHRTYFHDISQPAKIQPELEKLVDYTASAEFREFHPIKQAATVQHKFVQIFPFTEHSGKVGRMCSNLILLRNGYMPAVIHSIDRQRYYESFRGPAAGFRTVLMDAMENSLDNGMKYFRDLGRKFKALNS

SEQ ID NO: 12794 - protein, 204 aa, Myxococcus xanthus
MLVEYLRAARLEPSAEVATGLFYGIKADTRDLGRETTPTDVDSYLWLFPRMDKMLLAQIEHPELPARYFQLYHTAYERAKVYGTAIVTDLEEVYSPDMVAEVAERLMFLEGMKWSLAFGTYRNQLFLSLRVKDRRMNAGRLIREICEDYGGSSGGHGSMAGARLPLSGKLAQRKALKRELVAKFLEAFGVANERPVSLLYAQDS

SEQ ID NO: 12795 - protein, 235 aa, Myxococcus xanthus
MWANNETGVLQPAREVALACRQRGVLFHTDAVQAAGKVPLSLREVDADLLSLSAHKFGGPPGVGVLMVRKSVDVRALTPGHQEGGRRGGTQNVPYAEALALALALADAELTETTARLTTLRDAFEREVTARLPGVHINGGAAPRVPNTSNLRFDGVEGEALLIALDLEGICVSSGAACASGTLTPSHVLRAMGLSPAQARGSLRFSMGPGTTEADVARVVDALVRHVPHVRALAG

SEQ ID NO: 12796 - protein, 181 aa, Myxococcus xanthus
MTPDLIDTRGLKVQSRFLAAPYYQKARTVALYAPIRGEVPTRDILIAALQDGKIVCYPLSHVHGRILSFRAIKSESELEPGRLGVREPTNSADLIAVDQIDLFVVPGLGFTREGKRLGRGGGYYDATLRAASQRSRRVGLAFNDQVVPVLPTTGDDVDMDLVVTESESLRGLYRDWDFLDT

SEQ ID NO: 12797 - protein, 257 aa, Myxococcus xanthus
MGDVVGRPGLQAVRTLLPRVRAQHGVDVVVANAENSDQGSGITSETAHYLLDSGVQLLTSGNHFYSKKAILPWVKEHPDLLLRPANYPKGTPGKGHSVVKLPDGRALGVINLEGRVFMRTEASPFEVVEGLVEELRQQTPCILVDMHCEASSEKNAMGVHLDGRVSVVVGTHTHVQTADERILPGGTAFITDVGMCGPLDSVIGMKKESSLTRFLGKPAPYEVAERLVYLQGVVVDIDDATGQGRSIHRVREHLPGT

SEQ ID NO: 12798 - protein, 420 aa, Myxococcus xanthus
MNPDALRKATPEEQFEEVTRGTVDLHVPEDLKKKLQYSYDTGKPLVIKAGFDPSRPDLHLGHSLLLTRMRRFQEFGHTVVFLIGDFTGLIGDPTGRNATRPALTRDEVKANAETYKKQVFKVLDESKTQVRFNSSWLDSLGTEGMIRLASRYSVQRMLERDDFKKRFRGEVSISIHEFLYPLLQGYDSVVLKADVELGATDQLFNLLVGRQLMKEEGMAPQVIMTGPILEGLNAKAVDGKIVGDKMSKSLDNYVGIDEPADTIFGKLMSITDDLMWRYYELLSAKTRAELAEMRAQVESGALHPKAVKVGFAQEMTARFQGEEAGKKAAEDFEKRFAKKELSTDELPLVEVSLGGAEKLPVTKLLPESKLVASATEARKLMAQGGVRVNGEKVQDVKAELGAGEYTVQVGKLKAARVKLG

SEQ ID NO: 12799 - protein, 207 aa, Myxococcus xanthus
MDREVLDLCPARPDVSVSEGDVRRFLSRHYDDPRLQRALSVAGRPGARQANIDWLTGLWVSTGPRNAFTHVFCGDDWQRGPIGGLHFLPRYAQLEAEGRLCYQGPVRGAAALKGDAYLIRFKGVAPWSCGEKRVGGFSRGPDAVGLMSIGTRAFARCCARGGAKKEGGVYSAPDLGGTNWRIWCGTRNGTYGIATLHPTDDKATCGE

SEQ ID NO: 12800 - protein, 133 aa, Myxococcus xanthus
MTALCISLLSAGGAAYCYTRADALQVQGQWLMERGTAQAEDYAARFDGAAADAQLKTFAERRAILEKAHGWQRGMLLGVLIAALATVSAYLLFLLKRLNDQLLDATGSGAHEGTDRESASPEPVQALMPSPQR

SEQ ID NO: 12801 - protein, 99 aa, Myxococcus xanthus
MEEAMPGCAHCGHRLDIIANQVGRRDECPHCGEDIRSCRNCRHFDLGVAKECKEPFAEVPKDKDGANFCELFQIGEGGIHEKESRDALLNAAESLFRKK

SEQ ID NO: 12802 - protein, 429 aa, Myxococcus xanthus
MRWLKNLYVQVLLAIAVGVILGWLRPDLGESMKPLGDGFIKLVKMIIAPVIFLTIVAGIAKMGDLKHVGRIGLKALIYFEVLTTLALVVGMVVVNTLKPGAGMNIDPAQIDTSGITQYRASASQQGTIPFLLDIIPHDFLSAFTEGKLLQVLLVAVLTGVALTRLGPMGQRVLDLSDDLAQVFFGIVGMIMKLAPLGAFGAMAFTVGKFGVESLSSLGRLLIAVYVTCALFVFLVLGLVARLSGFSLWKLLRYMRSELLLVLGTSSSESALPRLLKRLETLGCDRGAVGLVLPTGYSFNLDGTCIYLTMAAIFIAQAVNVDLSLGEELTLLGVLLLTSKGAAGVTGSGFITLMATLAALNGKVPVEGVALLLGVDRFMSEARAITNVIGNTVATLVVSKWEGVRDDTVMHAELDSGPKPLEGMSLGHGA

SEQ ID NO: 12803 - protein, 801 aa, Myxococcus xanthus
  unsure (1)..(801): unsure at all Xaa locations
MTVQISQRTLEDLXFADVLRALAQRCRTEPGRERVLARPFLATPEAVAEALALVAETRSLSQEQFSLPLGGVTDLRTPIGHAAKGGMLEPRQLIDSAQLLFAFVRTREALDERRARVPRLVEIARRMPSLEPLARRIDQCFEPDGEISDRASPELREARDRARGLHRRIKSRLEEMLHDETFLPKLRENYYTIRNGRYVVPVVANYRSEVDGIVHNASQTGQTLFMEPQAMVGLGNDLAIAQSEVTEEERKVLQALSDQLGRESERILEGLDAVAELDEAESVAILSADLGASMPAFENVTEMQLRQLRHPRLVLKGAEVVANDVTLTGDAKALVVSGPNAGGKTVTLTGVGLCALMLRAGLPIPVAEGSRMPLYRSVHSTVGDAQDLEQGLSTFSAHVVMLRDIIGAVGEGSLVLIDEIAADTDPREGAAIAIAVLEELMSKGVVVLVTTHLEELKALAHMDPRFLNARVGFDSKRMAPTYRLQIGAAGQSSAIEMAARVGLPQNVCERARELSVSAGGPLTKALAAAEEERRKLYEELERARVAAQEAEALRADLEKQKQSFERERRARMMQFNDDVHAASEHAAAEVQKLLTKLRAEQNEKALAEARQQLQQRADEALKRAQAAKAELFQVEAPGPANLKVGAWVHHSGLNRDVEILELADNHAVVSAGGALKMRVPITELSGARTRKPQQAKFPERQKQDAALKRAASAAPSEVEATHFRCDVRGMRADDALAELESFLDRGMRSGEDAALVIHGHGTGALKQAIRDYLAASPYIRMYRPGEGHEGGDGVTVVALRA

SEQ ID NO: 12804 - protein, 361 aa, Myxococcus xanthus
MWMAAAVAAVVTTGCGKASNKPALPEQTGPAALGVRAITPATELSADVTRVTGQIRSKNEAVLGPQATGTISRMNVRVGDKVKKGQVLAALDASNVAISVEQARAVKQAADAALELATSSLERTRKVAESGGVAAAGLDQAVIGQKQAAAQAAQAAAGLRLAEEMLRDHSIIAPFDGVITARTKNVGDSVAMTPSTPVFSIVDTTGLEVRAQVPESVVDKVRVGSKTQGTVSPSGARFDVQVAVVGAVVDASNRTVEVLADVVGEPSPALRPGALVELDFSTVNQADDDKGLFLPTQAVSARGQEGFVWVVQDGTVRKRDVRVERVLPGYVRILQGLGADERVLADSSLDVKEGTAVRVVQ

SEQ ID NO: 12805 - protein, 1031 aa, Myxococcus xanthus
MLAVVVFGINAYPRIGVDQFPDVEFPVVTVTTVLPGADPESMEKNVSDPLEEALNTLNGVEQLRSINLESVSQIVVRFTLDTKVDVASQDVRDRVQATLSKLPTEIETPVVEKFDIGAAPIMTLSLSGALPIEEMTRVAEDVVKPALQRQPGVGSIDVVGGREREIQIVVDPERLRGFGLAVSDVSQAVQAQNLDVPGGRTMDSGRERVVRLTSEAKSVDELRNIIIASPNGAPVRVRDVADVVDGPEEARSSAKSGDRSAVALVVRKQSGSNTVQVAESIKESLGEVNSLLPEGVRTEMVTDNSRFIRSSIAAVQFDLVLGGFLAVLIVLVFLRNLNSTLVAAVALPVSVVGTFAVMAALGFTFNVVTMLALTLSIGLLIDDAIVVIENIVRHLEEGKTPMQAALEGASQIALAVFAVTLAIVAVFIPVAFMDGTMGMFFYQFGVTVAVAVLISYAVSMTLTPMLSARMLSHHGNPTGISAAVEKVLVATETGYRNILASILRHRAITLVIAVVVLFLTLFMASFLKFTFIPEQDNGNIKLAVELPIGSTLQETQAELDALDAQVRALPGIDSTFATAGGGVQEEVHKGELLINLVPLKDRAFNQGELKTYLRGAITPRSGVTVTVQDIAAVGGGGARTQQIQFNLRGDNWDEVIKAAEKVQATMRQNPGLVDVDMTFRSGKPQYDVKVDRERAASLGVPAASLGATLRAFLGRDKFGDYREGGETYEIKVALPPQTLASADALGKLTVRSMTGQLVELRNFATITPADGPVQIDRESQKRQITLLANLASGYALSDGINFLNAYAEKELPKTVIYDFEGNAKEMGKAVAAFGSALLLGIILIYMILAAQFESFVHPFTIMMSLPFALIGAIGGLLVTGQAMSMFALIGVIMLMGLVVKNGILLVDFTLQLREEGKTATEALLQAAPVRLRPILMTTIAMIAGMIPVAVAKGDGAETRAPMAITIIGGLVTSTFLTLGVVPVVYSLMDQLTEKFKRRKGPDATSGTPHAVGPKHGAESPSVAAAARVETA

SEQ ID NO: 12806 - protein, 199 aa, Myxococcus xanthus
MRRPDDKPAALANRRGDPGAEGQDPPEDGGSEESHGLMEEDVETSTPESRRLHELLIEFSRYRSLKNPLAGICEDLQLTPTQMHALSWLGNDGPVQVGVLALRVGITRKTITGVVDRLESMGLVERTRDVEDRRAVVVRLTEQGSSVFARIDRGMDASLRRVLSLMSPEDRDAVFGILERMLARLTAEAESASGDSQAS

SEQ ID NO: 12807 - protein, 407 aa, Myxococcus xanthus
MTMTAILLVSLTMGLGAAAPAGARAEVTWPAVAPSTVQLRAPGSAAPPSDVSSLLASRCRQWAATPDNAWALAHGLALDGRDFRTRDGQPAADAIIARYLRRTPPPSHSPAAAQRLFFDSRTANGTPVEPHPALQLKSLLHAGYPARHRFNASWGPVMVQALVEQLQLDFRPSLVAHPEGAWALDALSLAMEPGTTFRTSEGTTVHIDTVMRDALATLEAAQAELSAAMRAGRTQVPKRKQGIYAHPCGGLHYFQAVAGWARHASVRKVWRKRLDAQVDVLLYRLDSEGRQYEAALADAPFAHRLPLLVQMLKFQGHLLETLGRYRDDTRWRPTKAQQQTVERARTALEHTVRRLEAGGAFDGWPALAERQPQLALDLLGDTCHAARGEALWRTPAVSAPAAQAPAR

SEQ ID NO: 12808 - protein, 263 aa, Myxococcus xanthus
MAGEEALEDGALLLWTSPLAWDEAGVRRRVRYLSMASHDLRGSLANVRSYAALLLNGRVPLEPKVQRGLETILRNADRSLAFSQDFFDASRADLGSLPCEQERQSLLPLLDAAVERQRAAASAAQVALVLGLNPEQAVPEVIVDGARIQHAVESFIQYQLARAQPGEVIRLGIRDFAPRVRVEVRRDGAPLTDEDAAAVFQREERAFREKRLEDPLRVYLARQEVEAHGGSVGVESDRGGSTLFLTLAQAPVAALGSPATMQA

SEQ ID NO: 12809 - protein, 76 aa, Myxococcus xanthus
MEILLIMGVLLLLFGASRLPQLGSSLGSAIRNFKRGFGGEGEDAAAPGDKKGSGTLSSSTGVQNDVTKSQTPSGHV

SEQ ID NO: 12810 - protein, 56 aa, Myxococcus xanthus
MANEPKQPKPEQSAPKPEERARPRTSKADEAREDGMPGYGQPDADVREQSLPEQSW

SEQ ID NO: 12811 - protein, 305 aa, Myxococcus xanthus
MAEVYRARVLSGPREGWTVALKRLLPALTRDPESVSLFAREAQLSKQLHHPNIVTVLDAGALEGIYFIVMELVDGRDLGQILRRCKVRGIPLPLDFAVYLGKVLLEALAYAHSATGPQGERLGIVHCDVSPSNLFISRVGEIKLGDFGVSRVLVDGKLQGGEVLGKPYYLSPESLLGEVNPEADLWAATVVLYELLTLERPFTGTTPDAVFNAIRARQYRPLRELRPDIPEALEAVVARAFAERPEDRFPTAEEFAQALTPHYDERVGTPLAIAAVVRGLFGASDEVPAAPSPSGTPPTPGTRAE

SEQ ID NO: 12812 - protein, 418 aa, Myxococcus xanthus
MPPQASLIPREEGGLAHGDRNGPRNGRIGSNFCRASRAPQGTALEQSYSASKSSNLLGIPARVFGNDKDGGRRGQGILARLQGRRGTSMMERARIHPHMPPSLLNKGLATVLSVASGLAWAGPPTVSSSYQGDSYGVVSLRMQGDQLVGVATGGPCGFEPDTEVLSGEFQDNVLVGQVLLCQLGPHCEPRVNQPALVVFNPDDGVMTALFRLKDGCRSPVLKNDSLLLLRPLSRDAEAVAPGRAASATAAVAASATADGANSSAAQVAAGLGRQGEVSPLEEGQRQLAAGNAGVAQRHFELALSKDPRSAAAVVGLGASQLMLNDVSRAVKTLEAGRGLGRADVHLWLAYAYQREGNRNRSRESLRKAFEQGWMPAGRAAEAVAEQALREDIETLMQQQRTRKRGPVRPSAGAGNTTP

SEQ ID NO: 12813 - protein, 1698 aa, Myxococcus xanthus
  unsure (1)..(1698): unsure at all Xaa locations
MGQAQLVEMERVADHAVRAHSLAKACAATYPQSTGAQRCRVLMAAIEAPEFSMGSLASDGPGRRSVEVTHRNVSMLHFRAYSVDLEKRLAQVDDYNLMPDSAPLKALVKGQRPVATWSVPLPKTEDFREHRTFVTPPLTARGTYVIMASAHEDFRATNNRIVAVYLTVTPWVIVARPSNGDLLEVRLVDGDTGEPVSKVPLRLIRVDYRQGFKEVARILSDADGAATFDSVPGDGYRSYVLVAEVGRNAIMHPGQVPFYKRHQPGDVQSALVFTDRAVYRPQQKVLWKAVAFSGRGEQARYQTLADRPLQVTLFDPNHQVVESREVRTNDFGSAAGEFTIPTGRMLGAWSVIVSAGGRAAIRVEEYKRPTFEVTLKDAKAQLRLNRPATFQGEARYYFGMPVTSGSVRWRAFREPVLPWWWWGPPSGSSQREVVATGTSPLGADGGFTIGFTPEADERSAATPGLTWNYRIEADATDEGGETRSASRAFRLGFVAVEARVDLDTGFLREGAVAEVRLTRSTLDGAPQPGPGKWRLVALNQPAQPLLPADEPQGLPEYKDPEAVFTPTPGDNLRPRWFGAYSPESTIRGWTDGAQQATGSVQHDAEGLAVLKLPSLKAGAYRLHYETTDAFGQTYTVGRELVVAGKTTPLAVPAMLVAERETARVGEVARLMAVSGFKGQPLLLDIYQGERLISRRKLTAGQSSGVVEVPVTAELRGGFTVALSTVRDYQFLFFSKSIFVPWDDKELQLEFATFRDTLRPGAKETWRVTVKGPKGAKVEAGTAELLSYMYDQSLDLFAKQTPPSVASLYPQRHASVDMQSSASMGDTRWVVNARYDEVPGWSPPAPDALLFGEGFEVGGPGRRRMRHMVRGGMGGMREGXVPRATMAPAPGAPPPPPLAEAPARAEAKMQADKEERFGSGGATPDAPQPLRSNFAETAFWAPQVLTGADGSATLEFTVPDSVTAWSVWVHAITRDLKGGSLQRTSRSVKELMVRPYVPRFLREGDRAVLEVMVNNAASRPMQGTLTLDIQDLELQKSVLSDFGVQKASQSFRVEAGKGTRLRFPLTTPTRVGPVAFRVVARSENHSDGELRPLPVLPGRMHLAQSRFVTLKGKDSKTMQFEDLRAGGDPTRVNEQLVVTVDTQLFYSALQALPYLVDYPYECTEQTLNRFVSTGILSSLYGQYPSVARMAKQLSERPTQLETWDAVDPNRKMALEETPWLEMAKGGAGPEAGLVKVLDPKVAAAERTSALAKLRKAQTSSGGFPWWAGGPPSPYMTLYIVHGLSRAMEFGVEVPPEITRGAWGYLARHFREEYATKLMKEERGWEFLTFLNYTASAYPNASYTGDALTEAERAWMLAFSYKHWKKHSPYLKGYLALTLKRAGRGADANRVWESVMDSAKTSPELGTYWAQEDRSWLWYNDTTETHAFALRTLTELNPKDARREGLVQWLLLNKKLNHWKSTRATAESVYALVKYLQAEGALGVREDAQVTVGPRVVRMSFAPDEYTGKKNQVVVPGPELNPATMSSVVVEKTTPGFAFASATWHFSTEKLPDSDRGDFFQVSRRYFLRERQGKDARLVPLAEGAVVLPGDEVEVQLSLRAKHAAEYVHLRDPRAAGLEPENVQSRHRWDLGIVWYEETRDSGTNFFFEQLPAGEYTFKYRLRANMAGQFKVGPATVQSMYAPEFTAYSAGAVLTVGAAK

SEQ ID NO: 12814 - protein, 255 aa, Myxococcus xanthus
MHWVVQHNLFNEPGFHTLMGVLRRGEIPHTVVKVIPFDGGVEPTVDVDGPVIVMGSLSLTRYAKRRGWTPGAFLNDNFDFRIWREKLGHHLLNADAQVHRFGDVPPREGPFFIRPCLDDKSFSGMVTTWDDFNAWRASALALGEGATVDADTWVAVSPLKHIQREYRMVVVDGRVVTGSRYKLGDRVASSPEVEPDVRDFAQAMADTWTPDRAYVLDVFMHDGGLYVGELNNLNAAGFYAYDVAKMVDAIEAMPW

SEQ ID NO: 12815 - protein, 206 aa, Myxococcus xanthus
MGKPYRPKDHYFQKAKQEGLRARSAFKVDELIKRFPMVKKGHVVLDLGAAPGGFLQILADAVGPKGRVIGVDIVAIRPFSQPFVQTAVLDVLADDFDAKLTELHAGPFDAVISDMAPKTSGIKATDEARSLRLAGKALELAAARGRPGSSFVAKVFMGRDFEDFRNQIRALFEEVKVVRPEATRGASMEVYLVGLRRRAPEAPEAN

SEQ ID NO: 12816 - protein, 379 aa, Myxococcus xanthus
MPHPFTEEHEAFRNTVRSFVEKEMTPHGLEWDRAGIFPKELFRKAGDLGFLGINHDPKYGGSGLDYWYVTVFAEELSRSLNAGVNMALLVQSQMATPIINEIGTDEQKREFLEPALKGEKIAALGVSEPGCGSDVASIKTTARRDGDDYVINGSKMWITNGTRADFITLAVRTGEAGYGGISLVTFPTDVKGFGVSKKLDKVGNLSSDTAVLYFEDCRIPARYVLGEENEGFYHIMTNFQGERLVGAITTVAGMERMVEDSIRYGNEREAFGRPLMKFQVWRHKFVEHLTAIEAAKRLTYHAVDLFDRKENPVKEVSMAKLFAGDLAQRVAYDCQQFYGGMGYVEETSIARMWRDVRLITIGGGTSEVMKEIISKIYGF

SEQ ID NO: 12817 - protein, 390 aa, Myxococcus xanthus
MSSLPLTGLRVLDLSRLLPGPYATLVLADLGATVDKVEEPEGGDYIRQMPPLRDDVSGLFYGLNRNKRSLTLNLKQPEGREALKRLVRHYDVLVESFRPGVMDKLGVGESALRAENPRLIYCAISGYGQTGPDRLKAGHDLNYAARAGLLGYGGEAGGAPAFPGVQMGDIGGGSLFALVGILAALHERERTGQGRFVDVSMTDGALAFLHMHLASRLYMGTEGVALQRGKEALNGGYACYGLYRTADDRWLAVGALEPKFFAGVCERLGRPELLEDAYAPGESGARVKAELTRLFAEHPLAYWQERFAGSDLCIEPVAEGDDVLKDPQLQARGLFVEAEDAVLGRKVTHLLTPLRMGETPLRAPPTLGQHSREILEAAGFTAQELARLGH

SEQ ID NO: 12818 - protein, 46 aa, Myxococcus xanthus
MTISVSNDDFVKIREKKLNAQMAAMQGKLKFKPMDMGLAMKLAKLL

SEQ ID NO: 12819 - protein, 74 aa, Myxococcus xanthus
MMPVMDGWEFAQRMRQKPPEVARIPLIVLSADRNVGSKAADIGAVGHLAKPFELNDLLDMVRRSLNPAAASTIA

SEQ ID NO: 12820 - protein, 388 aa, Myxococcus xanthus
MVPSDSVMLFLPLAHVFAQVVKAAWLSMGYRLVVAESVDKLLANLVETRPSVLPSVPRVFEKVYNNVVANGSAAPGLKGRLFRWAFKLFDEYVEARSQGREYATLGFALAKKLVFSKVHAAISEKLGGNMRVFISGGAPLSPKIGYFFDLLGLKVLEGYGLTETCAGTTVNREHKIKIGSVGAPVPGMEVMIASDGEILIRGPAVMKGYYKNPEATAEAIDAENWFHTGDIGELDADNYLRITDRKKDLIVTAGGKNVAPQNLENALKTHAIISQAMVYGDKRPYLVVLITVSEEGARRLLLDQGAPVGTYADNARRPEVQAAVKAAVDQVNTQQPPYATLKRFTVLENDFSQETEELTPKLSVKRKVCTQKYRAQLDRMYEGTTVVD

SEQ ID NO: 12821 - protein, 198 aa, Myxococcus xanthus
MALDAAPEDYELVWRKARILQWQADGAANEKLKKVLGRQTWDWGEKAVKLNPARVEGHYYAATGIGAYSQAVGIMKALGEGLEGKFNERLDKAIQIDAGYDRGAPLLAKGRYYYELPWPKRDLAKSASLYEKSIAKHPQMLRAYYFLAETLLKDGKAAKAREAIQKVKQGSIAYDPAEGRRVQEWSKKVEADIEKELR

SEQ ID NO: 12822 - protein, 29 aa, Myxococcus xanthus
MGKVLLKVYPQWFTENEEHLVSQRTSDSA

SEQ ID NO: 12823 - protein, 119 aa, Myxococcus xanthus
ALQYRGPAGVAGAATTPEWGFGFKAFPFAQAVPHRLSVRVYGAGVIEATRNMFRLWRGEHPMPHMHDWFVQRLRMDFDREVPFQMGGDVIGMRRSLEFDLAEESVQLVDWRQLSRMVRT

SEQ ID NO: 12824 - protein, 233 aa, Myxococcus xanthus
MPGPVSYTYEYPRPALTVDCVVFGLDDEDLKVLLIRRGVEPFAGRWALPGGFVRMEESLDDAARRELDEEAGIRPNHLEQLYTFGAPGRDPRGRVVTVAYFALVKLSDHVPHAATDARDAAWFSVWDTPKLAFDHVDVLGTALQRLKGKVRYQPIGFELLPPKFTLTQLQRLYEVILERELDKRNFRKKILAMDLLEELDEVEQDVSHRAARLYRFDHKKYKQLEKAGFNFEL

SEQ ID NO: 12825 - protein, 197 aa, Myxococcus xanthus
MLVRNAPVSARRPANSPSESPAAEKPNAAAAPAAIHQKDSFSNTTTALQRTAKVGAAPAGDHGKLMMEYLTGARPPPADFEKVIGYKPYAIQTPHGQRMQDPLGYASVPLKIGPDKEFDPAAKTHDYGYDLLRYFDKKGTPLGPDARKAADALFRKDMFDYANDQKGALNRFKYRSWAQIYATAVELNSKRQGNGPP

SEQ ID NO: 12826 - protein, 267 aa, Myxococcus xanthus
MSALPFDVAAASVLGREHARAGRNNQDALCIRASEHGLVAVVTDGCGSQPCSELGAQLGARRLARAALVRLADGERVDEPTFLPGLREDVLCLLSELRADLGREVMGDFLFTVVGAVVTPSLTLVFSAGDGVWALNGEVHPLGPFPGNAPPYLAYALMHGEDVALTTRALVPTEDVHALLLGTDGVVDLERLATTRMPAGNELVGPLSRLWTEDRYFANPDALRRRLALLNREAVRADFASQQLARTPGLLPDDTTLVVLRRRMGRA

SEQ ID NO: 12827 - protein, 625 aa, Myxococcus xanthus
MDVWLEGKKVRLNPARALGKGGEADVFDMGDGRALKVFKPPEHPDYTGLPAEQAAARVRLDEHQRKLRVFPAGLPGRVVAPQALATDKKAHEVLGYAMRKLDGVEPLRRFGEPSFRRAGAASGRVVDLLRDLHRTLDAVHASGVVVGDFNDLNVLVAGTSEAYLIDADSFQFGGFLCPVFTERFLDPLRLGSTGTQGLVPSRPASIESDWYAYAVAVMQSLLCVGPHGGVYKPRSAAARTTSAGRVLQRITVFHPEVQYPKPALPLATLPDDVLHHLHRVFVEDLRGVFPYPLLEGLRFTPCASCGVEHARAACPTCQPHATATATPVTSVRGQVTATRLFSTRGVLVHASNEAGILRWLYHAEGAYRREDGRVVLRGALDPSLRWALQGDVTLVGRGGEVAVLAPGRPPDRMGVDAPEGQSAFATNARHRYWAVGGGLWRDGAYGPERVGAVLEGQTRLFVGPRFGLGFHRAGGLRGAFVFDAERLGLKDGLSLPWPTGKLVDVDCVFDGPSAWLFLVEEAGGRTLHHCVVVGHDGAVRASAVAEAGDGSWLGSAPRGRCAAGDALFCATDTGLTRVELRQGRLEAVREFPDAEPFVDAGCSLFLVRQGLAVVGRQDITVLRMN

SEQ ID NO: 12828 - protein, 309 aa, Myxococcus xanthus
MSATDAFNLHLLLIDVQKDFCFPEGSLYVAGRSGRGAVDDSRRIAEFIYSNLGALTNVTATLDTHFAYQIFFPSFWVDQDDQPLTPYREVTREQIERGQARPNPAMAKWLCGGNYPWLLKQVKYYCEELERAGKYTLYLWPPHCLLGSDGHALAGVVQEARLFHSFARGMQSWAEVKGGNPLTENYSVLRPEVLGRHDGQPLAQRNTQFLKTLLTADAVVIAGQAASHCVKSSIDDLLGEIVAQDAALARKVYLLTDCMSSVTVPDGKGGFAADFTPQAEASLKRFADAGMHLVKSTDPLASWPDLRIA

SEQ ID NO: 12829 - protein, 265 aa, Myxococcus xanthus
MSSKANGSGIRKLFEDAHAEGVLSPAGLQALTVVDLGAQIQAGLGVCVEDVQSSEVVLVTVMPDDSGSIDYSGHSKTVCDGHNLVLDALLASKQKDGVLFHTRYLNGFVLNPYRPVEDVVRMHGKNYRADHGTPLYDQSVVLLGTVLAKAQEFSANGVPVRTVTLLITDGSDQHSTSAKAKDVAALVNDLKRAENHIVAAMGINDGSTDFRRVFREMGIDDKWILTPGQSAQEIRAAFQVFSQSAARVSQGAASFSRTALGGFGQ

SEQ ID NO: 12830 - protein, 397 aa, Myxococcus xanthus
MSDSPRVLLIAERFPPDIGGLARSGARTAGSLVKLGARVDVLAWTRTAAPGALQTVEDAGDVSPFARGVTLHRLGLFGSTDLSMQHTLDVLGYLHAKQRYDLVWGHYLSPPGFLAVAFAESVGIASTVSARGNDVDQLMFPPGDFARLLWTLQRARVLTAASADLGRKMCMLLGRDETVEVIPNAVDTGIFSPGPADPALRERLGIAPDEAVLGFSGELRHKKGLPFLLSALTEVRRVRPACLLVIGEVRPRDAEHLVAFRAEHPEDAARILISGPLDTPEAIAAHLRLCDVYLQPSLWEGMPNALLEAMACARPVIASDAGGIPEAVDAGRNGFIVSKALLNHLGQACLDVLSLPLEQRAAMGAAARQRIEERFQAHAEAEVLRRVLARAIPSRSS

SEQ ID NO: 12831 - protein, 242 aa, Myxococcus xanthus
MTLDEGLEDALAWRLTLWPGLVLLAGTVGCFVVYLRFRRLDLENRRYTLASQVIHRLRRDIGPDASVRLELDFTPVDSPEKLLGKHTTPSGWEAENFSDPWFSLQTRLLDGTHLRIAMVQRLMKRSRTRRSASGKYKTKHRQDSWALLQVQLRVKAARHQDLALLEPEARQAMRLPGDVAVDKLQLGEDRMFLRTLVEKDWDAGPNVQGDAVDAPKTVVMMLLSLYQVLNYSRQLRQQAKAS

SEQ ID NO: 12832 - protein, 231 aa, Myxococcus xanthus
MMGMGRFLLCCSLVALTGAAGCSKPGDAEVPRAVRAQEAAGAPVAAADVKGLEGKLKFKDDADRERFSLKPKDDGAKLVDGEERELARYKWKGASLKVSGPDDVALGYVVGSAGGALTVRDGEQRQVLFTLARQGPGWRLNDMKGTLLYSVWPEDDGARIQDGAGADVARVKVREGKVSLRDAQGRTLLATKSLLAAEAAACLAFEALELPLRMALLFHLQAPPSQELAQP

SEQ ID NO: 12833 - protein, 89 aa, Myxococcus xanthus
MPLCEQHVTSVGAEMLCATCARHHEDSTGDRNGEDEDHPSYYYDNYGYYGASASSGSGRAHDANDFTEADGASLRHEDDASFEEDMGGS

SEQ ID NO: 12834 - protein, 352 aa, Myxococcus xanthus
MAGRWLVYALGGGMGHLTRASALARAASRRGHAVVLLTNSPFASGLPLEDVLGTGVEVFRLNPALGREAVGEVVEQCLADVRPDLFVVDTFPRGLGGELAPMLPSVRARKVLIHRDVNPTYVKQYGLARAVDAFDLLLVPGEAAPFANHPRAVRTAPWLLLRASELLPRDKARARLGVPAEDPRALVAVMGCGTPEEVGEAGHIAARLDAMLGPEAVVRWLVPPGAAMDVPAPRAKQGSRAGASLEEGLALRMATWPALAVLPGVHVLVGAGGYNTVQEARVTGTPFVALARPRLYDRQALRLRPEERAGSVEALVTRAAGLARARPARSLRPYVNGTDDAVTLIERTVLSA

SEQ ID NO: 12835 - protein, 91 aa, Myxococcus xanthus
MSLRSWLAATMGVLTLVTLAAATLLIVLTSVLDRSAATLGVAFGGIRVSEELEVGLLAHDRMVREGPVKVPRGPGGLSRIELEALAVPADG

SEQ ID NO: 12836 - protein, 137 aa, Myxococcus xanthus
NSKLVFATVALLSTSAFAEEDLKPAQEEAKASFEEKISEALAAANEKCGTKLTVKTDFQNFKPEAWANSSYGSYCEAAINGITSMCERPAYKKAIAKKVTGVSCLFGGVKPPEKKDGTNDATLRNLSLDKGTLAYRM

SEQ ID NO: 12837 - protein, 397 aa, Myxococcus xanthus
MGELRRIASTAAERQRLDAVREDVDVYFSAQWDPVRAEQEAGPALDAALSGLEQVSSINVERARVARSEAERWNDMADSVGVVLCGLLLLGVLVVSVLLRRVALQPLRDISQSMRRFGAGCRRARAPEAGPTELRDMARTFNEMANSLAHQQEQQLAFLAGVAHELRNPLSALKLSTALSDRSRAQLTPERMDRTLSLVGRQVERLDRMVGDLLDATRIEAGRLELRPEVRDARELAREVVELYRSGDTGHGLRLSLPDVSVPVRADPARLEQVLHNLISNALKYSPAGSTVEVSVRREKDTAVLCVTDQGIGISEEEMRLLFAPFQRAGNARQRAPGVGLGLSVARRIVEGHGGSIDVTSQPGHGSVFCVRLAVATEAVRHAEEDAGLTSLEDTLH

SEQ ID NO: 12838 - protein, 201 aa, Myxococcus xanthus
MKTPRRAAPLAALLALGGLGACASRQQAPTAAAKPEAPRAAEPVVRSTEGGFSVAIPGPVSEERRSQETDVGAVTLHTFIAVRPEVDTAYYVSYTDFPAAAVSQADPRDVVARASHGALEALGATGLSARPLVLSGFPGWEVEGVSGPRHLRGRFFLVGPRLYQQLLLHPEGKPPQDADRFFESFQLDPQVAAMLTGERRS

SEQ ID NO: 12839 - protein, 433 aa, Myxococcus xanthus
MPVRPERTAEVQALAEKLGAPGAKVEDPCVAPLGNGCARTALAPFFASLDALATGTATRPVVIEAFGNSLIAGDRIVDVLRDDLATAFGSAGRGVLLVDRMAPYGGRGRTSASSSGWQPRTLGELRAPPHAFGVTGVYHVATNAKARSRFKLDGEPRGTLWWLDVPGAGAVSLSSGGKVLARTEPTGSGLSRATHFELPEDAQTLDVVAEGQGAVVQGVVLQHARPGIVLDTLGVPSSDASLYARIDGATLTSQLAERSPQLLVFFLGGNESKRIEWKRLDMEKLRTDLRALLRRAREAAPGSACLLVGPMDAVKGPGAKAQALTQRSSLEAVNAAEREVALAEGCAFFDFYAAMGGKGALARFHASGYMHDDLVHPRGAGLDVLGHLVTDALLRAYVETPPSARGVAAVMPTPSGAGAAPTGVSEPSAEATP

SEQ ID NO: 12840 - protein, 711 aa, Myxococcus xanthus
MVCEPASLDAEQSPRAFSEEVRGALDAVVRAELSQGPVAGLSVGVTRGAERWVCAYGLRDVGRKLPATPRTTYRMASVTKSFTAVAVLQLVEQGKLNLYADISTLVPTYPAKQWPVTVRDLLGHVSGVPTYDGVASTRNVKAVSTEAAIAAFAGKPLAFEPRTRYLYTTWGYNLLGAAVETASGQSYRDYLREHIFKPAGMPNADLDITATRDEHQAKGYRIQGAALKPSRFLDVSSRFAGGGTRATVGDMLGFGRAVLSHTLVSRETMGRMQTSMSTLDGRLTDYGMGFATYPLRGHYVVAHAGGQPETTTLLMMLPAEDTVIALASNVEGEARRMRRLSIRLLEQVLEEGNTRRDVYVADPVDAVVHEGLSRVASYGLSYHQWATRGPGVLPEETDLPGAFAQVSAMLNRKEIGRDTRAALERVRSGHDPRLRALFIRVGAHMARTLEKVHGGARLKDYTVEGPLAFFEDYLAACDAKQVPEAERISESLRADVLRLAASWKRAQLPELQRLRLDEEKNPEARWAALRKSVTASPGFHPDYSDELLRIAEGFAWRKQPAARRRWLERAVELQPRGLDARWALAEALLAANPEEAVLPHLREAVATPQGTLALAPRNFLKRLINAESTAVAAGLLRAGVALHPDAPELWDALAKREQSLGRKAAATAALREAKRAREAPRPEAAPVPSVPEVPGASGPVPDDHGLVPAGK

SEQ ID NO: 12841 - protein, 185 aa, Myxococcus xanthus
MLRPSATFERARPEGSVGSSLGFVALSNLAASFTTALFYLALLFAIPREMMDGDNVSQSWFRLAGVGVFGVMMVLAPVIGMLVALINSALDHVVFRMDGTGQPFVVTLRANALSLSPYMMGLIPFCGMYGAPFWALGLRIYAYRSLHRTGWSTAAVAALAVPLLSCGLFFAAYAVIAVVGASIGG

SEQ ID NO: 12842 - protein, 338 aa, Myxococcus xanthus
MRVAVFDTHRYDRDALEAANARFGHALTYFEPRLTLQTAPLAEGFPAVCSFVNDKVDAATLEVLHAGGVRLVAARSAGYNHVDLEAARRLDMRVTRVPEYSPHAVAEHAVALVLSLNRHIPRAFSRVRDWNFSLDGLVGFDLAGKTVGVVGTGRIGRVAARIFKGFGCNVLCCDVAPDAAFERELGVRYAPLDTLFAESDILSLHVPLTPGTRHLVDAAALARMKRGVVLVNTGRGALIDSKALVAALKSGHIGGAGLDVYEEEEGVFFQDLSGQVLQDDVLARLLTFPNVLVTSHQAFLTHEALANIAETTLASLQAFERGEPLVNEVRAEQVLRAR

SEQ ID NO: 12843 - protein, 430 aa, Myxococcus xanthus
MSIVCATNFSDAARRASTLAAELARKAGTSLWLVHVLNPDSVRAFGKALLGSAEAVLSDETKRLEQLGVKVEPVLLTGEPAVMLEGFCREQGASLVVASRAADESPFGGEGGTVDRMAQSLTVPLLVMRDPAPLEAWVRGERSLKVFLGVDRSLPFEAARDWVLTLSKGGRVDVVGGRVYWPEEEARRLGLRQALAFGDALPELQHVLERECAELLAPLAQGGTPVRARVEMGVGRIADHLVDLAEQEHADLLVVGTHHRRALGRLWSVSRHALRLARMSVVCVPAQAMAVGTDTPLPEYREVMVATDFSETGNRAVAHAFALTAPGGTVHLVHATESKPSLEEEAQMREQLSALVPKSANDRSVRLNIIPGSKDVVATLAQTAERLGVSAIVMGTHGRSGWKRAVLGSVTQSLLLRTDRPVLVVRPPAT

SEQ ID NO: 12844 - protein, 39 aa, Myxococcus xanthus
MGRDGEESVPAESLAGWAQTIHYELVTRLGAHLKRTVVA

SEQ ID NO: 12845 - protein, 917 aa, Myxococcus xanthus
MPNLLRPAALAAVALLSACGARQNPPATAEPPLAQASRQAVSATPPSPKLRLPTEVRPTGYKVALTLDPKVSSFKGAMDITLDVTKPTSVVWLHAKSLNVTGAVFIQNGSAFIGTPVKGEEDFLGFSVAKPLAAGRARLVINYEGVASEKETDGAFRVNEGGDWYIYTQFEPVDARRVFPSFDEPGFKVPWQLTFHVPAGVVAVTNTPQESEEVRPDGGRTYRFARTQPLPSYLIAFGVGPFDFLPAADAGQKKVKTRIITPRGRTAEGAYAAQVTPEILAALEDYFGIPYPYEKLDVLAVPLLRGAMEHPGLVTFNSRLILAKPEEDSLGRQRAFSDTQVHELAHQWFGNLVTMQWWDDLWLNEAFASWMTPRIVESWRPAWDAPVERVHDRARALDADSLLSARRIRQPIESANDIHNAFDGITYGKGSAVLSMTEEWLGRDVFQRGIQRYFRKHAGGNATANDFLDAVSAESGKDVTGMLGSFLDQSGAPLVTASLACGADGAKVVLTQQRYLRLGAASPGPQTWKVPVCVEYAAGGKEARTCTLLEGERAEVALSEAKTCPDWVFPNAEGAGYFRVQLDGDAAAKLAKSGMKRLSRTERVTFLTDVRALALAGTIPAAEALALTSRLANEPDRVVTLASLDLLELVSSRLLPDEKLKDRARFLRETYGPRARQLGFAPRKGESEDTRLLRPRLVRLAGRDGRDPKLLAEARALANKWLKDNRAVAPEMVDVVLALAATENDAAFREQLVVAVRSEKERRTRQHLIGALSSFTDPVLVKQNLALVFEKGLDPRETMWMAFAASQGLRTQDVAFDFVKENYDRLVGDSPEALLSLDAAGRMAYIGSNFCDAGKRQQVEEFFSERTAKAPGGPRVLAQVLEIVDQCIALKKTQAASVESFLAKGTPSRPPQAPASR

SEQ ID NO: 12846 - protein, 227 aa, Myxococcus xanthus
RFRDRADAGRRLAARLLPYRGGEVRVLGLARGGLRVAYEVAHALEAPLDVWVSRRIDVPGRMTVLGAVSEGGGIYLDQDALRGLGLPEVEARSLARAEASEVDNQVQRLRGTSEPAMGGFTVLLVDDGLVSGATAMAALQVLRRQHPARLVLGVPVGTPHGLARVRPEADAVHCVEVLPAMRDVSEAYDDYRPLPDVELRQLLVRAREPVQPREVLESTDLGGFFRA

SEQ ID NO: 12847 - protein, 114 aa, Myxococcus xanthus
MGSVMHFALVQHATCLEHGEVMHVEAGDSHGAGHAEASFDDVRLASKSTEADSHGSDAHCVHAFFRREAPPPQQDTPFLLVAPARSEPALAVFRFHAEPVARLHLAPKASPPRA

SEQ ID NO: 12848 - protein, 168 aa, Myxococcus xanthus
MAATYVHATQDVDEVWLMPSWQHPFGKQMEPFEHRVAMCDALCAETSGWLKTSRIEQEPGLSGRTVDTLTLLVARHPDIRWSIIIGSDILRDLPHWKDFHRIEELSRVMVLNRAGYPAPNTLGPPLAEVSSTLIRDLLARGEAPSDLVPARAIAYAREHGLYGLKRTP

SEQ ID NO: 12849 - protein, 174 aa, Myxococcus xanthus
MPTVLTLVGPLRRHTRRALMDRCGDLLLEGTVELLEPLPQAELAALHHACDVVLVPLPFNDRNCVQGCCPLKLLEAMATGTPVVASNLPVVSTLAAPDEVMLIRPGSAKAIAEAVKALRADPTLGPAMSAKARARVERDFPWSRAGEALVSAYEERLGMARASTRRSTSASACA

SEQ ID NO: 12850 - protein, 92 aa, Myxococcus xanthus
MLYDHDDFHWALLEEERQHIVQVLKGKVLVGELVIPGREVTEVNIAPDPDTGAQGHFLVELMGGPKEDPQALYHFIMAHGIDPAPGHKDLKH

SEQ ID NO: 12851 - protein, 61 aa, Myxococcus xanthus
MMPVMDGEEFVGRIQQEQRLAELPIILVTASGRAHLPGVRAILKKPFDMDVLLSTVGEHRH

SEQ ID NO: 12852 - protein, 117 aa, Myxococcus xanthus
MEKRNNRVANWTRLHRRFGDHVRKLRTARELTQEALAERSDLSVDAIRRIERGSFSPSLDTLGKLSKGLDVSLKTLFQGFERERSNAVAEICDFLSLRSGREVELAWRVIQAMFEDR

SEQ ID NO: 12853 - protein, 143 aa, Myxococcus xanthus
MPGLVSLLLLSAPVLAAEPATQDKAVFEAELQRNLEAFEKNMDRSMPIPCGHPPMRPERIKGEDLQFAPSQLTRIKETTYQLRCTFHLDGTATDCQMLKPGVDLDAKSRETIKQWRFKPAIYKDKPIATTCTVSGKLKRRPEN

SEQ ID NO: 12854 - protein, 376 aa, Myxococcus xanthus
MVEGRFPLERNMSRHLGPAVILGSTLLLGSACKKSEDPAPEPSATPPPAPTEPAPGYTLSFLEAASPSGCTWIRHESSGTRKPLATVDAVCERLKLAWGPRGRQGLVMDRGNGELPPRAWQVDFESGQSTRLLLPELGHTDTLGFDEAGHVVALVSQLEDLPRKMESGSEYFLFDGKRFLLPEAEGSPGLAHAYRHEAGQWKHLETVATLYEMDGALGTEALATASRLTSSTFSQDADRLSESELEEGNEDAARLDAVVKDRGHTAYGMWVSMETHQGPLYSWEATGELPTLMLPLRWEVNDRLVEPEQLALAPTSTVALRMRGRLLLVSAEQAARVYDAKTKKRIAALENVHGTRFWPQQRTVTAAAPASTVTEP

SEQ ID NO: 12855 - protein, 45 aa, Myxococcus xanthus
MTTLPPWLSRMSSLKSLDLYQTSLPPEEVEALRKALPECNVGFRT

SEQ ID NO: 12856 - protein, 295 aa, Myxococcus xanthus
MDFGLRRYHGTDAGLKVARAAYVAGVDSTSNVLAGKTYGIPLAGTMAHSYVQSHDDELEAFRAFVRVHPNATLLVDTYDTLRGVQHVIRLARELGEDFQVRSIRLDSGDLLALSKAAREMLDEAGLEQVRVYASGGLDEDAVAKLVARGAPIDSFGVGTAMGVSSDAPAVDMAYKLVAYAGRPRVKLSSGKLLLPGAKQIYRREVDGVARGDVLTCRQDTAPGRPLLQPVMRGGQRLPEASPTLEAIREFARSELSRLPPEIRALSPAKPPYPVALGQALLRAREHEVELWSAAT

SEQ ID NO: 12857 - protein, 101 aa, Myxococcus xanthus
MDLMGDTLCCVVHDKNDLTRDDLLNALLFVHGKEPEPKVVQIGPRYFLTPGRLVGAAEQTCALLDKVDRNLRFSAFRLDGHSIVEPQVIVLEKKSPKLSLK

SEQ ID NO: 12858 - protein, 221 aa, Myxococcus xanthus
MRTLFIGDVHGCAEELDALLTQCAWQPDDRVVLVGDLVAKGPDSAGVVRRAREQGFLAVRGNHDAHVLRWHAGRGPRGKKLKPEHQQVLDTLTPEDWAWLESQPLYRFFPELNVVAVHGGLVPGVPLEAQKEDELLNLRSILPDGTPSKRVDAGAPWASLWQGPELVIFGHDAMRGIQRHPHAVGLDSGCVYGGKLSAYVMPEGRIVSVLAKRAYVDVDAS

SEQ ID NO: 12859 - protein, 542 aa, Myxococcus xanthus
MHCLDGRLAEVAALTQLFTRADAGTVELAARAAEALPPLGKCSDLAALAAREPQPTDGASLERARTLVRVRALKAAGKYTEAVALLEPVVKAAKDADDRHGGADALLLMGQLREETGQPRDAETTYFDAVWNAEAGRNDVAAARAWTRLVHASGYVLDQHALGHRWRERAEAAIERLGGDGVLRAQLQARVGALLFAQGRYTEAAEQQESALSRLEATYGPDSLEVTDVRLELGATRMAQLRADEAMRLFEQALSTRRAALGPSHPDVARAQLELAYAHWRRSDVEQVEALARGALEVFERALGPEHPDVASAINPLAAALQRMNRSDEALRLQERALDIALKVEGADGAGALITLGNLATLMARVGRSEEALTRFHTMLAPLEQRLGAQHPYVAQTLRATGKLLMMDQRYTEALPYLERARAILDAREDDAYGYRTGTLMDLGRALLALDRPLQAAELLERVVASGARSPQAPSEQARARFFLAQALWNAKRDRPRALQLAEEARESLVTLGTSGQEALEEVDAWRARLPRPTHIPAARAP

SEQ ID NO: 12860 - protein, 392 aa, Myxococcus xanthus
MACLDENTFVALLMGDLPPARATEVDAHLDTCSACRRMVAEALRAQAPDDDPPGATTPLTNSRPPSGKGPSLERGTAVGRYLVLERLASGGMGVVYSAYDPELDRRVALKLLRVAALGLEAEQGRAHLLHEAQAMARVSHPHVVPVYDVGTFGPQVFLTMELVDARTLRPWLKDAPRTWRQVLALFLDAGRGLAAAHAAGVVHGDFKPENLLVGQDGRVRVTDFGLARNANPLDDVSPLAGGTPAYMAPEQMEAHAPADARSDQFAFCVTLFEALYGERPFAATTPHELLTEVRAGKVRPAPRGTHVPPWLRRVLLRGLSASAMDRYTDLNALLVALQHDPASRWKRWLPAVGGTALLLMAVGLTHALLSSRARACQRADEAMFSEWGPEAQ

SEQ ID NO: 12861 - protein, 120 aa, Myxococcus xanthus
MLVSPEDDPELAYLKRTYRAEFSDCFSTALLALEPRQRNVLRLKYLDGLSIDQLAALYGVHRSTTARWVLGAQETLLQQTRQRLTERLRLTSSQLDSVLRLISSQLDVSLSRLLRSRMND

SEQ ID NO: 12862 - protein, 265 aa, Myxococcus xanthus
MAMPEKSDAERREIARGAYINMSRVVLESLPSGDRLPLDWAEQGVEGDAAWQALKARVATGKGALLVTAHFGNWELLGEMLIRHGVPLDALVRPLKGALNTRIAENRVRIGAGLIYPRGAIQEIIDAVNRGESPFMLLDQALPAKGAAFVPFFGKLASTTPAMAVAAARTDAPVFVVMGVRNGRGGARFRMEVEGPILPPAPGECADPITEHTARVTAALERCIRKYPDQWMWLHRRWKVQPPPEAALPAGTTPPPSASGAPPAG

SEQ ID NO: 12863 - protein, 250 aa, Myxococcus xanthus
MSDTLLTKLDSGVLTLTFNRPEKKNAFTHAMYEAATRALKDAEGNVDVRAVLLTGAGNVFTAGNDIGDFMEHPPAGEDSAVFRFLRALVDADKPILAAVDGPAVGIGTTMLLHCDYVVASERARFHMPFVQLGLCAEGASSLLIPRTAGFALASELLLFGEPFDAATALRAGLINKVVPDASLQQVATERAATLASRPAEAVRVTKRLIREPLRAQIRETLAREGGEFIQRLQSTEAQEAFMSFMSRGRK

SEQ ID NO: 12864 - protein, 260 aa, Myxococcus xanthus
MHVEVPEQVRGRTVILVQSTTPPAGEHLLELLLMADACWRMGAARLEAVVPYLGYARQDRRARPGEPLGGRLVADLLSQGRFARVLVVDLHSPALEGCFGAPLEHLTSLPLLAEALREHVTDTSVVVAPDLGAVKRAEALARLLNRPWAVIHKVRLSGDEVHASGLMGEVRGRRPILVDDMVSTGGTLAAAAGTLRDAGCTEDFTVATTHALLVGPAVERLRTLPLTRLVSTDSVEPVLGLPFQHQVVTLAPLVARALRP

SEQ ID NO: 12865 - protein, 844 aa, Myxococcus xanthus
LLLPVWFAIGSKYVLTFQGRHVFNPSMFGVAMSLLFTRELITAAPAYQWANGEVALSAFILMAALVLFFFRVGRGWLVVSFLFFYALQTALRAYVLRHHLPPEVLFLGTLGAPSFFIFVFYMLTDPTTSPGTRRGQILLALAVTLVDLVLHFKESVYTFFYAALTCATVRFLFVHARAAWQRGLRESLSTLVSSGWLKRAVVVGGLGGLMVGGYTLAATPGVRTSPLDFRMERVEARAAGLDSTMGNTLEELDPRLGHVAKWLVAVGDSVAVGDYDGDGRPDLFLTHPLARPEDHAILYRNLGDLRFERVPVPALERFATRYKEEGLPGGGTFVDWDGDGDLDLAVAVAFGPVRLLRNTLRETGTAGFEDVTEAAGVTDHAVSLGLTFLDYDRDGHLDLFVLNVMTTHLPGYEPPVPLNLFRLPEPEHAEDRRMFRFMHDGWHNAANGGLNALYRGRGDGTFEKVDIAAMGMPETHWSLAVSTVDFNRDGWTDLYVANDFGPDDVYLNEGGKHFRRVAGRLFGEIGKDTYKGMNASVADFDRNGWLDLYVSNVHHSLQAEGSLLWMVGPGKDAFTPEFRDEATFRGALNERRFGWGAAAGDLDNDGWPDLVQANGMVDDRLDAARWRIPDGQRKDYWYVNHKLMQSGPEVHTYADKWGDIRGRTIYPNEARRAYLNLGDAKPGHFVDLARELGLDDPDNSRGVLLSDMDGDGDLDALITNQHGPVSLYRNTLRSEGRQDAHFVGLTLVGHGGRTHRSAVGTRVVVSYEEAGKRVEQVQEVGLMGGFSAAADARLHFGLGRYTGLVTARVHWYGGDVQEVSLSSDRTHELRQPPDAEVLQGRAGP

SEQ ID NO: 12866 - protein, 257 aa, Myxococcus xanthus
MMSPLKGSTVRRDALTEAQRGQMLALMQLCYTGVSPERFAEDLEAKQYVILLHTRRGGELVGFSTLRVAEELAGGQRVEVVYSGDTVIHPDWWGHKVLQVCFGRFVLSRKLRHPLRPVHWLLLSAGFKTYLLAVNYFPRTMPRRDWTPPPGRADFLHALAARWFGAQYDASRGTLRFQGAHYRVRDGVAPIDRAAALHPDIAFFAERNPRHGEGEELVCLVEIRWWDLFLALGRSVSGQLRGWARRGLRNAGVRVGT

SEQ ID NO: 12867 - protein, 441 aa, Myxococcus xanthus
MTRGLLAEFQRALAPMLFELLHRRPALREGASYWSISPLARKQVRTAGGIPVGSAEDSAYFSRVLRPLLSRIFAVPGEVGALPDVESCRYVTLWHLVAREDLSLISVWNPSFLTLLMDALERHGERLADDLMRGHCRPPASGAAYDEAATQAVLDRMRFSPRPERASLLREVLRGGWSARALWPRLSLLSMWTDAQAAHALPAACRRFPGVEVQGKGLLATEGVVTVPLFDAPAPVLAVRSHFFEFIDSEQPTSRPRLAHELEQGRTYTVLLSTSGGLLRYRLGDLVRVEGFQHATPCLRFVGRADAICDLVGEKLAGTRVGAVLDAVLPDFFGGARPGFSMLAPEWTPAPSYVLFLETDAPASRLAAAAEAVEHALCEGHHYRYARALGQLGPVRAVRVADGARRYEARCVALGQRAGDIKPVDLHRLTGWSDHFSGAAT

SEQ ID NO: 12868 - protein, 325 aa, Myxococcus xanthus
MVAVDEAKDRRTGVPVYSLYGSTFESLSPRQESLQGLDALVFDIQDVGSRYYTYVYTMALAMKAAAKARVPFYVLDRPNPLNGVAMEGNLVGEGFRSFVGLYALPNRHGMTAGELASLFNVQEGFGCELTVVPCEGWRRGQFWSETGLPFISPSPNMPTADTALVYPGMCLGEGTNVSEGRGTCRPFEQFGAPWVDTDQLLARLAKEELPGVAFRAVGFTPTFDKYTGQSCNGAFIHVTDREAFQPLRTGVAIFQTLHDIGPGSFDWRADAYEFVEDVPAFDLLCGTDQVRRGIEAGWPLERLLEGFSAQTETFARHRTSYLLYA

SEQ ID NO: 12869 - protein, 208 aa, Myxococcus xanthus
MVTRFPNGVTNLVENFMDVPHTLFVHPGWFRRPASKRVPATVRRTAGSVLVTYKQAQDTVTGLGRLFNPRGLPLLHTDKFYVPNVTRVDYLWGEHGFVINSQCTPIGPTDSLVYTAISYRLPVDVPGALVGRAMMPLVRWYTRQVIQQDVVIMDIQREALLDGPGGGVYSGTEADLHHADIEAYRRWLREGGQGSGPEDAERDMAFWI

SEQ ID NO: 12870 - protein, 110 aa, Myxococcus xanthus
MAGKDEERALTREDLLAMAREMGVSEAAVESVISARTGRDKAQRRMRRAYMGLASHATSYTIVMGGLTLIDLFSGPGWWVQYPAIGWGMGLAFHAMGTLLAAFNHADRQR

SEQ ID NO: 12871 - protein, 422 aa, Myxococcus xanthus
MMESVFAVVDVFFVGRLGADAVAAVGLTESLLTIIYAASAGLSIGATALVSRRIGEGDPERAARTAVQAVGLGVVLSIPVSVAGVYFARPLMTLMGGSPWVLEHGIRYTQVMLGGMGSVLLLFLINAIFRGAGDAAIAMRVLWLANAINIVLAPLLIFGVGPFPELGVMGAAVATTFGRSCGVAYQLYRLARGSGRLRLRREHLRLEPGTMLAMLRMSGAGTAQALVGTTSWVVLARIVATFGSAAVAGYTIALRIVLFALLPSWGLSNAAATMVGQSLGAGKPERGEHAVWTAGRINAVFLGSLGLLFVLAANPVVGIFTNDAAVMKEAVLALRILSASFLFYAFGMVLTQAFNGAGDTTTPTVLNICCFWLLELPLAWVLSGPLGLGPPGAFLSISVAFSVMALVAVVLFRRGTWKHRVV

SEQ ID NO: 12872 - protein, 522 aa, Myxococcus xanthus
MSPLEGRIDEGRREEMLDRDLFSVTVQASGLYRFSCTRLLLVECRVRLLDVAGNAHDMPSAVEGARVSWFPTLSEGTWYFEVSSRDSYGRYTYELASLGVDDHGDTLEDATVLEAGSGTSFPVRLSSPFDADVFTFRSRVGHGYRFICEQAPNPFLQLTLQSATGLLMDAVQGTSGEPLTVSLQATSERDWLLMLAADHGTFPVDAACRFEDLGPDEHGDTLETATPVTPGVPVAVTLQSRDDVDVFSFTGEPGHVYTVRTEGAGRWSAQVVDEDGANVALTTTDQLRVRLNRWGTYSLRLQGGAPWEHSFVLTLVDAGTDDHGDSPETATFISPGITITGRFDSPQDTDAIAFHTQARAIYLASYAPFADLSLNPRGAVGILGLGSGRHLFSARDARQVTLMFQPLNGVEGFSLTLEEVAFDDHPDSSEDAQVLALPASMSGVVQSAVDTDVFSVWLEEGRAYRLGLDAGTLRATLIAPGGLLANLRDGRFVASRSGLHTLFLAGASGLEQVPWRFTLQAE

SEQ ID NO: 12873 - protein, 60 aa, Myxococcus xanthus
MLMALGVGLAAGFGMAFMPSTAEANAPEFTQSVCERNSDCDHFCGEGFGHCIRGMYCACM

SEQ ID NO: 12874 - protein, 239 aa, Myxococcus xanthus
MARQSPEHFSLEVDGTRWCWHNRLLGTRTDFTPGDAASLPLAPLDWFGRQVQEDLLLLAGTHEGFPLVAGQLCFPSGWCLGDKLGRSLLAVHEPVPQFNAKLGPSTLKLMEGLKPGRPVTRCNWAISVTERLDLEPRTLPEWRHLFDGITPDNAGERCFLRLERQTLTRLPRTRAILFTIHTYVAPVASEVEAPGRRQRLARVLRTVPADTAAYKRITPVLAPLLGYLEAGEADAGWNG

SEQ ID NO: 12875 - protein, 259 aa, Myxococcus xanthus
MQKTWLVAGMLVLAGCQQQGKTDSTPAATATAPGASANPQTEDQKTLYALGLSIGRSVSVFDMTPEELEYVKAGITAQVKGDKPAVELETYGPKLQELARARSTRKAEAEKEKAKAFLETASKEEGAQKTESGLIYKELTAGTGASPQASDIVKVHYRGTLPDGTEFDSSHKRGEPTQFPLQGVIKCWTEGVQKMKVGGKAKLVCPSDIAYGDRGAPPNIPGGAALVFEVELLEIVKPPEMPAMGGTPPAGKPSAAEKK

SEQ ID NO: 12876 - protein, 276 aa, Myxococcus xanthus
MRQGLLLMMGALLLSACVQGRSREVLREPSATGAVSESEFKALHTLREDAPPAPKGQEVEVAGTKAYLSLPQGAQGPLPAVIVIHEWWGLNDHIRHWTDRLAAEGYAALAVDLYGGKVATSRDEALALLKAVDPARAQETLTAAHTFLQQDARVQAPRTGTIGWCFGGGWSLHAAMAMPELDAAVLYYGNPVTEARELAAIRAPVLGIFGTKDPSIPLETVQAFRQALDDAGVRHYILEFEAEHAFANPSSERYDAQAAAGAWQQVAAFLDQHLRQ

SEQ ID NO: 12877 - protein, 861 aa, Myxococcus xanthus
MKAALASGADAIYFGLDEGFNARARAENFSLATLPETLALVHRAGARAYLTLNTLVFEPELPVVENILRRIAEAGVDALIVQDPAIALVARAVCPQMEVHASTQMTISSAEGARFAKGLGATRVVVPRELSVAEIRRLASETDVELEVFIHGALCMSWSGQCLTSEAWGGRSANRGQCAQSCRLPYDLVVDGQTRELGDVQYLLSPKDLAGVMAVPQLVEIGVHSLKIEGRQKGPQYVATAVQGYRRWVDGVSAGTPDTGALRKDLADMTLSYSRGFSHGFFRGSDHQTLVEGPFPKHRGAYLGRVESVHGRDVRVVDDTEGRPWTGGLGQDDEKARPDAPVGKVSSPLETATPVPAEVSPRPGMGVVFDDGHPEDKHEPGGPLFRVERKGRGWVLGFGNPGPDMGRVKPGQRVWMTSDPALAKRTEELLGRGEPEGRVPLELTVTGAAGSPLTVLGRARGGHVYSVSSEVALAEARGGGIDEALLRDKLAALGGTPFTLTGLDTSGLAAGLHLPVSEMKALRRRLVAELSEAVARGPVRTVNEGSTLESLRASLRERVQPTPRAVEDVRLLPLCRTDEQLEAVIAAGLPEVELDWMELVGLQRAVERARAAGLRVTIATVRVQKPGEEGYDARIAKLKPDAVLVRHWGAMMHFLERPPAHGETRPALHADFSLNVTNSVTALHLLGLGLDTLTFAHDLDAVQLGAMLEHLPAERFTVTVHHHISTFHTEHCVYSHTLSHGRDYRSCGRPCEKHRVSLRDHKGLEHPVVVDVGCRNTVFNAQAQSAASLVPSLLARGVRRFRVEFVRESREEASRVLSAYQELLAGRISPAEAVRRAAVHEQFGVTKGTMKVLNPTFTVQR

SEQ ID NO: 12878 - protein, 136 aa, Myxococcus xanthus
MLAVALLSGFALRGGPRWGKDPERVKQLVTWKLDDKLDTLDATESQRQSIHAVKDRLFSDGVQLMQEHRAVREEAFQQLASDTPDRQKLHALVDARIEAMRAFAHQATDAALEVHGTLTPQQRKALAEQFREHVGP

SEQ ID NO: 12879 - protein, 177 aa, Myxococcus xanthus
MATLPPQVQKHRALVGVGAAVVLAGVAMLAFSGDETVRAIKAVERAPEEERTALAKDVRTLIMKEEDSGRRNFLLGRLTEATGKPDDALKVYATAVKAGSRAAEDRLIEMLSHARCDVRSDAASTVGRLQLKRAVSALEDLKSDGGPDDGVRTGLFGISKCDSKVAAESALKGFKER

SEQ ID NO: 12880 - protein, 370 aa, Myxococcus xanthus
MVGGRPDWERFREVIGTVIEHSLAASRPGAKVRAYGEMVDVLCLDGMPDVAVELEALWNDLSVLYPLSLLCTYAIGHFGQAAHARPFLDVCKAHAHVIPTERYTRLADTEGRLREVSLLQQRAQALEVEVKQRQQAEQALREALHRRDEFLALAGHELKTPLTALQLQLQSLPSAAARKDGGGRLLERLDKAIRHTERLATHIDGLLDVSRIGEGQVPLMMEPLDLSRLVRDTVTRAMTPAAEADCPLQLMAEVPIEGVWDPLRIQQVVGNLLVNAFKYGRGRPIEVRVDGAPDHARIIVRDHGIGIAPEHQERIFHRFERAVPSSAFGGLGLGLYAARQVVVAHGGTLRVESELGQGATFIVELPYRPQ

SEQ ID NO: 12881 - protein, 356 aa, Myxococcus xanthus
MLKDVNAEALFREASARQPAGSTRAAAEAPVRPTTERAFIGIDVKNNKAYRLRTDTANLERVAEELARRGLNGASRGTLDDAARLEPVNGDEALTSGTVSGQTWSNGVDTRIRMGLTDGYATNSWPYRTIGHLSAGCSGALVGRRVVVTAAHCVVSAYSGWNPIFNTFTARRDGATAPWGVQDAIWYWVPEGYINGSCNSVASCNRYDVAIMVLEDDFPNGHPGWMGHWNASTDTLKTWSSFMRGYPGCGHVAAPASCTARTLYGDTQQCKTSNAYSPDADGWHQEIEIGCDGSPGQSGSPIYSYDAPVSGPVVVGQYNQYYCDATGCAGNAFPNRMGHLTPSWNNSISYFKSLYP

SEQ ID NO: 12882 - protein, 169 aa, Myxococcus xanthus
MGQLYTFRDKHPLVHPTATLFSSAEVTGDVIIGPGCIIGPGVKILGDGNGPVRIGAGVQVLANTVLHRLSDHTLTLEDGAIIGPGCTVHGSHVGANTVVEPGAILCDGTRLGRGSFVGAGSLVKQGSAFADGAHIEGFPATQTGTLASLPPVPRWALRPEDLPGLRRIG

SEQ ID NO: 12883 - protein, 368 aa, Myxococcus xanthus
MSNFRRATRDDNTALLDLFGTVPMQGDLVLSAQRAPDYFGLYTMQRGETEVWVHGEHGRLDGMGAVHVRDGWLEGRPCRVGYLGDLRTRFSARRNRGLARFYGPMIEESAQRLGVDTFLTAVMASNAPALHALVRRRPGRVSQPHYTLLRRFSAVSIQFLLRRRPRRSAVTVRRATPADVPAVSALLDADHRARPFGYRFDTGELEHRLAHWPGLRIEDTYLAFDATGALVGCTTAWNPEAVKRYRVHAYRGGMRWVRWGWDTLATALRAPRLPAPGSDFRYFYLCNTSVRGEDPAVLRALVERVYADFHGQGFHFFTLYQDELDPLAPALKGFLQRRLDFHLYAVTPASRPRETFPAGRTGFEICLP

SEQ ID NO: 12884 - protein, 557 aa, Myxococcus xanthus
MSAAAPKSQWLGLGLWLVPVLCFSVLPVAALLWRGLGHSGTGGLDWLLAEGGALGNTLLIATGAAVLAFVLGAPLALVLQRTDLPLRGAFTVLFTLPSAVPAFIWGMGWLSLASPRAGYLNRLLGDDTFDIYGPAGIAFVEGVSGLPLVLLAGAAALRRVDPAVEEAARVCGASTLRALLTTTLPLALPSLLSGAVMVFLMAASSFGVPYLLGVSASPPTRVLTTRIYELVLMGGDEGLARAAQLATSLLLLAPMAMLVTWALGRAGRVRLSAGKGLSSRPFPLGRARGLVLGAVSMTAAVLVLLPLGAILLTSLQRSFGAALTWETLTLTHWAGVLLEPRTLHATGRSVLLAAGAGVLVCGLGLAAAVLRRGLRRLGTGVEALAVWPYAVPGTVLALALLLAFSRDLRFILLDRVAFVLALAHTPWLLLIAYVAKYLALGARNSDEALAQLDASLTEAARVSGAGPWRAFVDAPLPLLRPALTAAFVLAFLACATEITMSVLLVPAGTEVLGTLLFELQSYADPAAAAVLACAFIALVVVGQALLALLTRRPLDTR

SEQ ID NO: 12885 - protein, 348 aa, Myxococcus xanthus
MSLPMLLRAAGVATALVLLAACRIESAAPSAGPTLAREGTPSGDVWVYTSMYRHVLDALEPLLKARLPDVRVHWYQAGSEKVASRLEAERAAGAIRADLLATSDPFLYERLAREGALLRYASPNVLRVPRALVDLDARYAALRLSTMVLVHRQGGPPPPTSFAALAEGPWTGRVAIGDPLTSGTAFTWAVFCDAKYGASFFPGLRQRGAIVAGGNAAVLQKVESGEADAGVLLLENALAAQARGSPIQVVWPTDGAVVIPGPAALFATTPNPVAAKAVVDVLLSPEGQRIIVEKGDMHAVDPRLAGPRGEAGVSELLERARPWTPELLERGLTQGGAVKERFRQAFSQ

SEQ ID NO: 12886 - protein, 405 aa, Myxococcus xanthus
MLVTAALASCSGDEGGVEPTPDGGGGSTVDSGLPPEDSGTPDAGTGDAGEDAGTPEDAGTNEDAGTPDAGPAFPPNTLSGFGLFTGTPATGGLQPVEGNIPYELTTPLFSDYSVKSRTLYIPPDAQAGYSANDVLDLPVGTIITKTFSFPADLRVPEENVRAIETRVLVHRPGGWEAFPYFWNEAQTEATLANGGRVVRGVRFIGEDGVERTLDYLVPSKNQCLKCHHLQDAQENQVLLPIGVKARYLNQDHDYGDGPINQLQHLANLGRLTGLPPVNQVPRAPNAFNAEDGTLEQRARTYLDINCAHCHNPKGTAGTTSRLFLNVDNTEEFTLGVCKRPGSAGGGVGGEFDIVPGSHSVSILWYRMHTEESGKMMPELGRVLRHDQGSRLISDWIDAMDPRSCK

SEQ ID NO: 12887 - protein, 176 aa, Myxococcus xanthus
MERNTWGNNNTVDIAILSGLAIEPDPVQWAAGFFNYPSQDISIHDNTFTGGSGRMVDNGTPDPERRPLGALVGAVYQYGAAAHGVTGVEHVLWDGVDPAPRDESLANPINICFTRNTLPEGAQASVVDFDLQAVGGHLSAGPTPENAAAAWGETRRYAQGAEPYNCSGFTPALTIR

SEQ ID NO: 12888 - protein, 174 aa, Myxococcus xanthus
MARLLLKTGGALEQAESHLNAALQQAPNNPRAWYLRGLLWEERDDRRQAVQAYEQAVQLRASYEEARFRLGTLWLDMGDLLKSELHLRYLARLKPEWVQVRLQLAEVLEKQERLLDAEKELLAARGFQPASPLVLRRLADFYTRTGRPQLAERVRAALEAPPKRRMRDLKPSRR

SEQ ID NO: 12889 - protein, 427 aa, Myxococcus xanthus
MALPLLEQMIPRNAHGAPGTVPRRLAVFYTPNGIHMQKWTPKIEGPAWELTPTLEPLAAVKNDLLVVTGLANQPAFPDGDGHHAAATGAFLSCAKVYKTEGTNLRVGISMDQVIANHMTATRATRYGSMELGIDAGRGIGNCDSGYACPYANNIAWSGPRTPVAKETNAQAAFNRLFAGGIPGETQAQIEKRRAYGKSIIDVVRDDATALKGQLGTSDLQKLDEYFTSVRELEKQVEDVSVPSMACASGAAPIVSEDPTAKTKAMMDLIILAFQCDLTRVATFMLANARANKVYPFLGLSGAHHTYSHHQKSQSNYNALATIDKWEVTLLQYLLERMKSVIEANGLSMLDNSMVYFSSEIGDGDSHNHVNLPIILAGKGGGALTPGRHIVYQQDPLANLYIYLMQAMGVPNVTTFGDDGTGPLPGLV

SEQ ID NO: 12890 - protein, 389 aa, Myxococcus xanthus
MTFVNLSSQHADPPVVGVKLALRSVLVSPHFLFRVEKNAPPGSTEPYTLDNFELASRLSYFLWSSMPDDALFAAAEAGKLSDPAEMEAQVRRMLADPKARALVENFAGQWLFTRALGTAVPDGTLYGAFNEELRAAMRTETELFFAEFISGDHKLKDLIDAPFTYVNDQLAAHYGLPLPGSPTHKRVELTGHPERSGIFGKGSLLIVTSNPDRTSPVQRGVWVLEQLLCSAPPPPPPDVENLPPPITPDMTMKERMALHRSAPACQGCHRLMDPLGLAMENFDPIGRWRLQEVSGAPVDATGDLPDGAILNGVRDMQTYLKEDPKLTNCITEHMLTYATGRGLDEADHCAVKDVADKAEARGGRLVDYILSIVSSSHFTQRGAEEEQTP

SEQ ID NO: 12891 - protein, 568 aa, Myxococcus xanthus
MREAAEAAEQALETLSNDIRMDRGVYDVLAALDLSGEDAATRKWMEKVRREFRRAGVDRDDATRARVKALQEELVRIGQEFSRNIRQDTRTEALSPSALEGLPDDYVRAHPPGPDGKVRITTDYPDIVPFMTYSRDAQAREQMWRVFRQRGHPANADVLQRMVSRRNELATLLGYRNWAAYATEDKMTRTQQVAADFIDRLGMATEARAKQEYAQLLARKQKDVKGAKVLEPWDQDFYEDRLRAERFSFDSQAVRPYFEYGRVKAGVMDITSRIWGITYKPVKDARVWQQEVETYDVFDGDTLLGRIYLDMHPRDDKYKHAAQFDLVAGQAGKRYPEASLVCNFARPGELMTHDEVETFFHEFGHLLHAIFGGHLKWAGIAGTRVEWDFVETPSMLLQQWAGNPEVLKEFAKHHETNQPIPAEMVEKLRASKEFGQGLWARRQLFLSAVSLDYYSRAPGFDTTEALVALQTRLSPFKHEHRDGTHFEVAFGHLDGYSAAYYTYLWSSVIAKDLETEFQKKGFLDRETAMKYRRTVLEPGGSKPAAELVKDFLGREYGFDAYRAYLDAK

SEQ ID NO: 12892 - protein, 1633 aa, Myxococcus xanthus
MRAGLGYQLKAEATGVEGAVSPSFDVTPAAAATVEVTGLPQTAIAGSTHDAEVTVRDAFGNVASGYRGTLSVQSSDATATLPGGHTFTEVNAGRFRFTGITLRRAGTQRVDVQDAAQAGLAGRQDVRVSADRTSALAFARVPSHASVRAALTAVEVVLQDAHGNRTPVGAPSVTLSLVPAGGAPLRGVTEVAPMEGLASFSSVHVDTEGRFQLQATADGLTPATSTDIDIIDNVFPAIPVLAATAATHDSVTVSWTAVGDDGDQGRAASHALRYSLNPIETDADFNQATPVGGLGEPAEAGTQESAVLTGLQPGTNYYVALRVADNQDNAVRSSSLMVQTQVQGVTRLVFSQQPVDGDAGDTQPELRVSLLDEDGEVVTTATSPVTLTLEDEPDFTPLQVAAVAGVATFSGVVVEQAGTHRFVASATGLDPVPSDAFTIAPGDAVRLSLAGLVSPVAAGAGGSVVVTAHDAFDNVATGYTGAVRFSSTDAEAELPGDYTFTVADAGQRTFSGVRLLTSGPQSVAVVDTARPELTDTLDVEVSTGAAAELVLSALPAEVEAGEAQSLTVIARDGFGNIVTGYTGTVQFESSDPEATLPANYTFVPGQDAGQRTFSVTLVTSGARSVTVREEGNTGLEAALNTQVLSGPAVQLTVQLDSSTTRAGEPVGATVSVRDVHGNLASGYRGTVHFEIPGDAQATVPSDYTFTELDAGQRLFNVEFATVGTGQLVVTDTTTATLTGNASVTVQPGLLAALSVAGPTKSIVAGEPQSFTVSARDRFGNVLTAYQGTVAPASTDPEAAPLSAHVYTAADQGAHTFTITFETAGAQSVTFTDGDAPVSGTSDFTVEAGAPVQLAFVAPPEPGTVLEPLSETRVALQDAFGNVSNVTAPSVTLQLVGAVGVTLGGTLTVAPEAGVAVFSDLTVDQAGSFVLSATTENPSLPSVDTMVTITDDVAPAEPVLNASLVDNTTVRLTWLATGDNGVVGNAARYELRYSAGPMDPQSFALASEVPTAAPRAPGQAEEVIHALPPSQAATWYFALRVFDGSNNGSTVAFVSISVPGPCGDIVCAPRAPECDEDGVQRVAYAEACVVTAGLAECQYTATPEVCPGQDGVCVAGACDTAPAPVAGELVISEVMHRPDANTTEYIELTSTVDGPRDIANLRIRFDNGAGGETDFSVLTTGDRPLVVPGRGTFVLASNTDEATNGGVVAQYGYGSTLFELGHSGHLFVEMGATVVDDVAYSASFPQTTGRSMNLSSVVVGTRASQHAWYWCDSEEVLPGGGRGTPGGANASCGVEITGPVDHCAIQYPKSFATPIRAGRAESVYSQFYEPQVSTRNQNGNDGFPHLVAELGYGTDASSPASWTWVTAEPNAGFATPGNDDERVAPLNIAAPGNYIYGFRYRFTQGPAAAQAWVYCDQDGVVAEGSTGNYGTVTVVPPPAVANHVVISEVSGGNGGGAAATDEFIELYNPTNADVNIGGWLVQYRSATGPSYSGTVTIPSGTVIRAHGYFLLGGGNYSGPVARDLGYSFDVSSSTTAGGHVRIGPGLTTAVNDVAVDKVAWGTGNSPEGTAAPSHPAVGGSLERKALSTSTPATMADGSADASFGNGWDSNNNSADFVTRAIRQPQNSQSPVEQP

SEQ ID NO: 12893 - protein, 267 aa, Myxococcus xanthus
MADGVFRDGLLAGKVAFISGGSSGINLGIAESFVKAGAKVAINGRNVEKLEAAVKGLQAHGTAMGVAADVRDYAAVEKALQTVREAYGELDVVVCGAAGNFPAPALGMSSNGFKTVMDIDVLGTFNISRAAFEHLRKPGASLINISAPQAYLPMAMQAHVCAAKAGVDMLTRVLAIEWGGSGVRVNAITPGPIDDTEGMRRLAPSDEGRDKLAQALPLQRFGKKQDIAQLALFLASEGSSYITGSIMVCDGGQSLLGGGALMAALGM

SEQ ID NO: 12894 - protein, 345 aa, Myxococcus xanthus
MTESIALLGYGRFGRALSGLLLVAGIPHRVFEPRQDDVPDALRAPTLAESVEGAGLVVLSMPVSGMRSVLEELRPRLSPAQTVLDVGSVKVRPVQVLASVLGRDIPWVGTHPLFGPASLARGDLPRRTVVCPNELHPEAVRKARVLFERIGCEVTELSPDAHDALMVRTHVLTFFLAHGLLKAEAGKDLPFAPPSFQPVARLEEYARLEVPHLFGVVQSENPYARDARVRLLEALTQLHLGCDSGRSGAPEPVAAPPGLTEVRECVDALDRELVQLLNRRAQLIQQAAHLKAEHGLPLPDAEREASLLETRRQWAAEQGMDADDTEDVFRAVLRFSRRAVPTGSR

SEQ ID NO: 12895 - protein, 275 aa, Myxococcus xanthus
MDGTYKSLRIEKNEGVAELVLTGPGKGNAMGPDFWREMPEAIRALDADDSVRVVLVRGEGKHFTFGLDLMGMMESLGPLLTGESNLALERLKLLSLIGDMQQATEGMARCRKPVIAAVHGWCIGGGMDLIAACDFRYCSQDAKFSLREVKVGIVADLGALQRLPRIIGEGHTRELAYTGGDVDAARALRMGLVNEVFPTPEALLEEARATAKRIAENAPLVVQGAKQVMEYCADKSIADGLRYVAVWNSAFLQSHDLAEAFSAFVERRPPHFQGR

SEQ ID NO: 12896 - protein, 42 aa, Myxococcus xanthus
MTSEELHRKAVELIFRFELTGPVVPYNAPVAPYQAAPSIRAP

SEQ ID NO: 12897 - protein, 1165 aa, Myxococcus xanthus
MKDLIKTVKEKGMSSVAVTDHGNMFGAIDFYKKAKDAGIKPILGMEAYVAGPKGREDRSEKVSHHLILVAKNEEGYANLRYLSSTAYMHGFYYHPRIDKKVLAEHSKGLFALTACLGGEVTSACFRGDMDHARRAAQEYKDIFDPGHFFLEVQSNGMPEQDKANENLKQLSRDLDIPLCATADAHYIKREDARAHELLMCIASGKTLADGKRMKHSTDKLYVTSPTEMLEFFKDIPEAVHNTQRIAEQCNLELKLGKPMLPTFKVPDSHTPDSYMAELAYEGLRERFTELAATVTYPIDREQYQARLALEIGVIQKMGFCGYFLIVQDFINWAKKMNIPVGPGRGSGAGSLVAYALRITDVDPIPYNLLFERFLNPERVSMPDFDIDFCQDRRDEVIQYVGRKYGEMNVGQIITFGSLKAKSVLRDVCRVFALPFSEGDRIAKLVPEVLNITLREAIEMEPRLKEMMETPSNIGEVEGKPVTTRDVLEIALALEGLHRQPGMHAAGVVIADKPLWEFVPVYQPPGEKTLITQFAKDEVEAAGLVKFDFLGLKTLTVIQHALDLVKRNHGKDIPRHEIPLNDEKTWELMAKGDTAGIFQMESSGFTEMVVKLKPNCFEDVIAAGALYRPGPLDSGMVDVFINRKHGREKVSYPHPALEPVLKDTYGVIVYQEQVMQISQVLGGYTLGRADLLRRAMGKKKAEVMQAERAGFLEGCAKNNVDLKVAGEIFDLMEKFAEYGFNKSHSAAYGLVTIHTAWLKAHYPCEFMAALLSSEKDNTDKVVKHIGEARESGLEVLPPDVNQSDMEFGAVSGKIRFGLGAIKGVGEGAIESILEARKDGSFKSLFDFCERVDSRKVNRKVMEALVKAGSFDFEKRSRRQIFDTIEKAMNRGSASQKDKAAGQSSLFGMLAGPSSDGGGGGLKDDYVEVEDWSEKERLSLEKEAIGFYVSGHPLHQYDKELKRYARPITAVQRARKDDKLTVAGIVTVLRERPTKTGKRMAWVTIEDLSGSIELVCFPGKDGTRNVMGRDGKWAKQGPKPGFENWEHLLKSDDPILVSGTVQISQRDEDTPTPELIVDDIQSLKAVREKRTKRLELRVPADLLTEERVAKLHELAKKYAGATPVAVSVLFKGEGEALIGNTSIKVQVNDDLLLAVDRLFGMRVVEFG

SEQ ID NO: 12898 - protein, 429 aa, Myxococcus xanthus
YCVGVRGKVVSRGKNVNPKMKTGEIEVRASDLTMFNRSEPTPFPVEDSIDTSEEKRLAHRFLDLRRAPLQHSLMTRSKMNALTRSYMVGNGFLELETPFMGKYTPGGARNFLVPSRLNAGKFYALAESPQLYKQLFMVAGFDRYFQIVKCFRDEDLRVDRQPEFTQIDVEMSFVTQDDIFTMIEGLLKKLWGEVLGIDIPTPFMRMDFYESMAKYGNDKPDLRFGLEHVVLTDLIREHGEGGGVPMIWEAVQNKGIVKAMVVPAEKAMSRAESDKLEEFAKQAGAKGLARAKVADGGEWTQSPLSKTISPALRQAINQAVGAKTGDLLLFQFGKEALVHTVMANLRVHVAKKLGLIPEYGSGGQWKFLWVVNPPLFEYDDETNTWAAAHHAFTRPHDEDVAYLLTDPGRVKCHRYDVVLNGFEIGGGCH

SEQ ID NO: 12899 - protein, 175 aa, Myxococcus xanthus
MHAVEIAPGVFEHPVVKGAGGDSPVVSLSHARSVAAAVACGPEHIVGVDVEQLSPERTDVFESVMPQRELAMVRHAPGGGELAANVIWTMKEALSKALRCGLTAPFEVLEVDAFEGHVAGGYGCLFRNFAQYRARAWVLGGYVLAVVSPKHSLLHVTPADLERIRQVFGRDVSRS

SEQ ID NO: 12900 - protein, 277 aa, Myxococcus xanthus
MEVRFHGVRGSIAVSGSRIGGNTACVEVTSQGHRLILDAGTGIRALGEIMMREGAPQEATLFFSHLHWDHVQGFPFFTPAWLPTSELTLYGPGANGAQALQSELAAQMQPPHFPVPLSTMRSRMDFRSALHARPVEVGPFRVTPIDVPHPQGCLAYRLEADGHSFVYATDVEVRVQELAPEVGRLFEGADVLCLDAQYTPDEYEGRKGVAKKGWGHSTMMDAAGVAGLVGARRLCLFHHDPAHGYDMLEDMAEQARALFPVCEPAREGQRLVLGRAA

SEQ ID NO: 12901 - protein, 112 aa, Myxococcus xanthus
SVGPELRDLAEQRSGLASLRAKEGLQAFYRAWETGQPQVLVLVGEPARLREHVGQERGVSDAVPAARTPAMTGRAGQDAVSDHLKTVFGRVLKVPRQRLHDDVSLGNYGLRS

SEQ ID NO: 12902 - protein, 7831 aa, Myxococcus xanthus
MTTREVLAAFAEGRLSKVEARRRLAALRAASIRLPLSEGQKGLWAMQRARPESPAYNVPLAYRLRGKVDPARLTRAWEGLLERYPLLAGAIRVEGTEPVIVPSGQVSAEVHEVPSVSDSALVATLRASAKVPFDLACGPLARLHLYSRSEHEHVLLLCFHHLVLDGASVAPLLDALRERYAGTEAKAGLLEVPIVAPYRAAVEWEQLAIGGDEGRRHLDYWRHVLATPVPPPLNLPTDRPRSATGLDAEGATHSQRVPTEQALRLREFARAQQVSLPTVLLGLYYALLHRHTRQDDVVVGIPTMGRPRAELATAIGYFVNVMAVRARGLGQHSFGSLLRHLHDSVIDGLEHAHYPFPRVVKDLRLSNGPEEAPGFQTMFTFQSLQLTSAPPRPEPRSGGLPELEPLDCVHQEGAYPLELEVVEGAKGLTLHFKYDARLYEADTVERMARQLLRAADQVADGVESPLSALSWLDDEERRTLLRDWNATATPFLEDLGVHELFQRQARETPDAMAVSYEGHSLSYQALDTRSREIAAHLKSLGVKPGALVGIYLDRSAELVAAMLGVLSAGAAYVPLDPVHPEDRLRYMLEDSGVVVVLARQASRDKVAAIAGASCKVCVLEDVKAGATSAPAGTSPNGLAYVIYTSGSTGRPKGVMIPHRGVVNFLLCMRRTLGLKRTDSLLAVTTYCFDIAALELLLPLCAGAQVIIASAETVRDAQALKRALRTHRPTLMQATPATWTLLFQSGWENAERVRILCGGEALPESLKAHFVRTASDVWNMFGPTETTIWSTMAKVSASRPVTIGKPIDNTQVYVLDDRMQPVPIGVPGELWIAGAGVACGYLNRPALTAERFVSNPFTPGTTLYRTGDLARWRADGEVEYLGRLDHQVKVRGFRIEMGEIEAQLAGHPSVKNCAVVAKELNGTSQLVAYCQPAGTSFDEEAIRAHLRKFLPDYMVPAHVFAVDAIPLSGNGKVDRGQLMARPVVTRRKTSAVHARSPVEATLVELWKNVLQVNEVGVEDRFFEVGGDSVLAAVLVEEMNRRFDTRLAVTDLFKYVNIRDMARHMEGATAQARTGATEPAREDTASERDYEGSLAVIGISCQLPGAADPWRFWKNLREGRDSVVAYRHEELRELGVPEEVLRDSRYVAVRSSIEDKECFDPQFFGLTARDASFMDPQFRLLLMHAWKAVEDAATTPERLGPCGVFMTASNSFYHQGSPQFPADGQPVLRTADEYVLWVLAQAGSIPTMVSYKLGLKGPSLFVHTNCSSSLSALYVAQQAIAAGDCQTALVGAATVFPSANLGYLHQRGLNFSSAGRVKAFDAAADGMIAGEGVAVLVVKDAAAAVRDGDPIYCLVRKVGINNDGQDKVGFYAPSATGQAEVIRRLFDRTGIDPASIGYVEAHGTGTLLGDPVEVSALSEAFRTFTDRRGYCRLGSVKSNLGHLDTVAGLAGLIKTALSLRQGEVPPTLHVTQVNPKLELTDSPFVIADRLAPWPSLPGPRRAAVSAFGLGGTNTHAILEHYPRDSRPRERSQRSNAVRAVAPFSARTLEALKDNLRALLDFLEDPASAEVALADITYTLQVGRVAMPERMVVTASTRDELVEGLRRGIATVGGAHVGTVVDTSPSVDADARAVAEAWATGDSIDWDSLHGDVKPARVSLPTYQFAKERYGLSPAHSVANSSKTHPDAGVPLFVPTWQPWSEGASNASLALRHLVVLCEPLDALGAEGASALASTLADRRIEVVRTSSPSARLDARFMAHASAVFERVKALLSERLTAPVTLQVLVPEERDALALSGLGSLLRSVSQENPLVRGQLIRVQGSVSASALVDVLVKSARAGDVTDSRYHAGQLSRCEWREARVAKGDASRFWREDGVYVISGGTGALARLFVAEIGKRATRATVILVARASSAEAVDGGNGLRVRHLPVDVTQPNDVNAFVATVLREHGRIDGVIHAAGIRRDNYLLNKPVAEMQAVLAPKVVGLVNLDHATRELPLDFFVTFSSLAAFGNAGQSDYAAANGFMDGFAESRAALVNAGQRQGRTVSIRWPLWENGGMQLDSRSREVLMQRTGMAALGDEAGLGAFYRALELGSPGVAVWTGEAQRFRELSVSVSPAPPPHQVALDAVVSITEKVETKLKALFSEVTRYEERRIDARQPMERYGIDSIIITQMNQALEGPYNALSKTLFFEYRTLAEVSGYLAEHRAEESAKWVAAPGENSSSVIQEARPPRADATHRAPRADEPIAVIGMSGRYPGAENLTEFWERLSRGDDCITEIPPERWSLDGFFYPDKKHAAARGMSYSKWGGFLGGFADFDPLFFNISPREATSMDPQERLFLQSCWEVLEDAGYTRDSLAQRFGSAVGVFAGITKTGYELYGAELEGRDASVRPYTSFASVANRVSYLLDLKGPSMPVDTMCSASLTAVHMACEALQRGACVMAIAGGVNLYVHPSSYVSLSGQQMLSTDGRCRSFGAGGNGFVPGEGVGAVLLKPLSKAIADGDSIYAVIRSTSVNHGGKTNGYTVPDPQAQAALIRSALDKAGLSARDVSYLEAHGTGTELGDPIEVAGLTQAFRRDTDARAYCRIGSLKSNIGHLEAAAGIAGLTKVILQLRHKRLVPSLHAESLNANIAFGETPFVVQRGFEDWARPRVEVDGVLSERPRLAGVSSFGAGGANAHVLVEEFEMGPEKTPMRPGTPVLFPLSAKNPDRLREVGRRLCGYLFQARHVDAEHLRALGYTLQVGREAMNARLAFTARSADEAREKLEAFLRGDAGADVLLGEVDDDACAFGRARSAASQTLAQPLDESRGRELLAAWVQGREIDWGGLYGGEAPAPRRVSLPTYPFERRTYWLALKGQGVRTVSPSVLETKVEWIDAPVPETLPWRERLLSKLGGTVWVVYDEESDARRFVALLEQVSASGGVSSALQIHMHRFVRGAAVEGPRIDVGHEARATVFWLLPGAVGDTAGWLRAALPEFERWVSRGAGVTVYCLGGGTAATLEGDVGGLDAALSTMARPQDSWRCVFMEDDAHSLPSLQRFLREWIVDEGRPARSLVRYTGERRRLLQWGAMSTQSVGQVPVVQAMEPVYLLEKVWRRQPVSVSTAEGSTGSRWQAGSRVVVLVNPETAQFVSELRQALAPAEVRVVIAGALFSPEAGQALASELLREVGHVDVVIDVSDLYAQPRSVDDDKLGRVTFLQRLIREFSALSILHVTRGLQPFECAQPSLAGAKLVGLMKMLSAEYPHVVAKSIDLDVGAEALVELLGRELAAPREQSEVCYRRGLRFAPLLEKRRVERTDADGLERQPFDLHETGVYVVTGGTRGIGLEIAEHLVSRGARRLVLMGATPLPSRRGPDAGGRSPQDTLRLEKLAALERRVDSLDIHIGPLDDRTALAALFTRIQRERGPIRGVIHSAGAYSDIKTPAFVDKKAVDIERVLAPKVRGIECLSDVLEGADLDFFVSFSSLTGVIPRLARGLSDYAMANAFLDHFTAYQHQGRKRTCYRTITWVDWNETGAGARLSPEDKARLDQALGSLGMRSFTNDEGRALFEKSMRLGARSWVLLAYLHPETSWAEGNPMLAESPVTTQRRTVETPEAAPAVDSSGVKAAIRDAVCEVLQLPVDTLDDDRAFQRYGLDSISAVQLSVCLKRRLGSDVSPREFIEHPSVRSLSEYLGTQLDVAPPLPSVVPVPEHDAPAPRSQTRGGKDAQAVAIVGAAGFFPGCQSLQAFWDALDAEQTLLEEIPPNRFDYRPLFPDKSRSKWGGFIPDVASFDPGFFNILPAEAETLDPRQRLLLMAVYHCLEDAGQAPEKLKGSRTGVFVGAEENEYLLHLREQGVDTASGFDQAASMVANRLSYFFDLSGPSELVNTMCSSAAVAIHRAVLAIRSGEIDRAIVAAANVILRPDGFIKLSQLQQLSPSVRVQSFGKDASGHQRAEGVASVLLMPLEQAEREGHPIHAVLRGSAVNYNGRSGVSIAAPSRQSHSELIQSCYRSAGIDVRDVEYIEAQGMANPVADIAEWEAINDALKRLATAQGVDVVPGHCRVSSLKPLTGHMESASALGALFKVIHSFRRDKVYGIAGFESANSYLELDRQPARLATRTEPWRRNGKPRLAGLHSFGAGGNNAHLLVEEYVPQLESRPSAGGPPSRQWHVVPVSASSVEQRVDRVARLAATLRAEPELDLDAVALTLQLGRDAMKHRVAFLAEDRTRLQHQLDRYVAGERSEGVFEGSAEKSKGQRDAAAHPSLQASQREAQETAVAWCRGAVVDWQWPLEAKPQRVRLPVYAFKMQRLWVDAAPRQPREGTMPIAEHPASRPGDDTRFRARAESMIRTTLSPFLRVPPEQLDLEAEFSELGFDSILVIKLAAALRQGHGLVVEPAAFFEYSTPAQLIQHVSDQLARDAAPPSPASDLLPHAGATAPRNTDEPIAIIGLSGRYPEAHDLTAFWSNLARGADCVSELPSDRWPLDVFFDADKDAAIASGKSYGKWGGFLGGLYDFDPLFFRISPREVEIIHPESRLFLQCAWHVVEDAGYTPTALASERVGVFVGASKVGVAEQHHTFFTIPNRVSYALNLKGPSLAIDTACSSSLVAIHLACQQLQSGDCTLAIAGGVNTYTHPYHFADLSKLQMLSTEGRSKAFGAGANGFVPGEGVGAVLLKPLGRALRDGDHIYGVIRGSEINHGGKTNGFTVPNPRAQAEVITRALARAKVPARHITYVEAHGTGTDLGDPIEIRGLTEAFAAQTPDLAYCRIGSVKTNIGHLEAAAGIAGLSKILLQGQHRKYVPSLHSSTLNPHIDFGKTPFVVQQTCEDWLPCDAQGQSIPRIACISSFGAGGSNAHLIIEEAPAEAMTQDPQALVDGAALFVLSARTEEQLRTYAASFDAFLAQAPALSLQDLCYTLQVGREAMDCRLACQVGSIRELRERLSDFAQGRSTPELLTANIRKNPEGLASQDGGEAMRTGALSELGARWVKGGHVDWRSLHEGKRRRRLSLPLYPFAKQRYALPATPTAVSAVAPARLHPLLHENQSTLAGPCFVTHFSGDEPFLADHVVRGQKVLPGVGYLELAHEAVLRSLEPAERGSTAIRLEQVVWLRPFVYSAENASLTVRLSLVADESLSFRITSTGRSGETMLHAQGRARRGPGGVIAERVDIPGALAGCTRKVVNGEALYDVFQSIGIDYGPAHRVIDELAVGENRVVAKVSLRGTSLADRAAYTLPPSLLDGALQATLGLAMGQGALRTALPFSLDTLRILRPCPDQAWVVVEREPRGGANGPIVCAIRITSEAGEPCVVLEGFNARPIDSATAQPPADEQATLLWSPERVREPAPESPAPSFDHHLVLTCGMSGLTASDVERAVRDGRGSTSVSCRELQSRQERLDLRYLDFARQTLERLRETLAGTKGKLLVQLAYAGADKVVAGLGGMLKSAALENTRLSCQSIGFDGPVSAEQLAKALLENARTPGEREVDYEGASRFVTRWHERARLPVACEADTVGAVPWRAGGVYVITGGGGGVARLMAQEIVRRCERPTLVLVGRSDAKEPLLAAFREWEASGARVRYFVVDVADMARMAEVVAEVRREFGTVHGVIHTAGVIEDNLLARKSEAELVRVFAPKVSGLVVLDEATRGLSLDFFVAFSSIAGALGNAGQADYAAANAFMDAYMAHRQTQVAAGDRSGVSRALNWPFWRDGGMRMDAATEEAMTLGTGMVPMPTGTAMTALYRVLTGSASRVLVTVGRVESIRKLVGQEPVSRRERAPETPNAGDLQARVEAVLLEGVSELLKVPREELDADTKLSDYGFDSITFTEFANLLNRQLSLGLSPVIFFEFTTANALAGYLCESHGPRLLDQLGAEAAAFEPASPPSAPMPVEPARSEERVAPAQPRAREPIAVIGMAGRFPSADDLDAFWGNLVAGKDCIREVPNSRWDWRAYDGDPIREPNKTDVKWGGFIDGIDEFDPAFFGISPREARLIDPQQRLLMMYAWKAIEDAGYAPSSLAGSNTAIYVGTGHFGYGDLIKEAGIPIEGYTSAGLVPSMGPNRLSYLLDLHGPSEPVETACSSSLVALHRAMTSLADGTCDLAIVGGVNTIVTPDGHICFSKAGMLSRDGRCKTFSDRADGYGRGEGAGFVVLKTLSRAEADGDAIHGLILGSAENHGGHANSLTSPNPASQADVLMAAYRKAGVPMSTVGFIEAHGTGTALGDPVEVTALTSAYQTLVKADGDAASAQPRCGIGSVKTNIGHLELAAGIAGVIKVLLQMKHATLVKSLGCETLNPHIRLDDTPFYVVRETAPWPRLTDRRGVELPRRAGVSSFGFGGVNAHVVLEEYVARRQETASTQVMPGTPAIIVLSAKTAERLKVQAQQLRDALRHGRYQDGELARIAYTLQVGRDEMKERLAFTVDSLATLERQLTAFVEGTELESGLYRGTAGSRGGTAVVEEPASGLTERISRGEIAPVLESWVRGGKVRWHELHAGGRAQRIRLPTYPFSRERHWVLDTQTPAQPLRAGRVVTRATANRRAPIVLRDPSDLEAELMDAATPKRNTVVEAPEPERPTPTAPPAAPPPPSAAASSKLREELATSLAQALYIDRAQVNAESTFVELGLDSIVGVEWIHAINKQYGLSLPVTKVYDHPNLSLFADYLARQLGPTAPPPAPPPQVEAKTVRVAPVVSSPPPSVQAVQAPAIVKKEVAPAGTVRIAVIGMSGRYPGAENLRQYWDNLRDGVSGISELPYTRWDEATAKQFRQDRNYCHRMGALSDIESFDPLFFRMSPAEAEVTDPQHRLFWQEGYRAFEDAGYAGEALDGRRCGVYLGIMGSEYATLLQRSGAQAINTTGNSYAIAAARLAYHLNLKGPAIAIDTACSSSLVATHLACQALTSHEIDMALVGGVTLYLAPESYLAMCDAGMLSTGGACRPFDNGADGFIPGEGVGAIVLKRLEDAERDRDAILGVIIGSGTNQDGKTNGITAPSAASQMELEREVYRRFEVDPATIGYVEMHGTGTRLGDPIELEALSSVFKERTDRTQFCAIGSVKSSIGHTSAAAGVASIHKVLLAMQHGSLVPSLNYSEPNQHFDFQRSPFYVNTEHKPWKPNGHALRRAAISSFGFSGTNAHLVLEEYPAASRPPTVSAVGPASVFVLSAKTAEQLASSAAELRRFVQTLDAGALAHLAFTLQVGRAAMEHRLAVVAGSASELSRSLEGFLHGSPGKDVFVGTALGAGPASGQAPSTDDLNVLVGVWRQSHSYAKIAAAWVRGARVDWAALHGGQGPRRISAPTYPFAKERCWLPEHASEAAAPMAHAITDAGHPLVQRNTSTLSELRFTSTFTGDEPFLAEHRVAGRRVMPAAAQLEMARAAVVALLGAGERTKRVQLANVVWPRALVVETGATDIHIGLKPQPDGDLAFRIYSSPEYDSGMAVLFCQGTARLKTADMPGAAERSRVERNTLLRECGVDSLDGEACYRRFRAAGLEHGPSFQALRRIHVGREQVVADLSLPASNARAAASYALPPGILDSALQAVVGLARGKDDAPAALPFGLERLDVYRPCPSEAWAHITRPAANGPDSAMPCVDIAIYDAQGTLCVELKGFVTRAPEASRESAEHGREVLLMTPAWTVSSPRVDGTSPAKPGRHIVFLCETGRALEAALRPHAGDAELIRLESSHDRMGDRVQEYAGRLLSTFKRVLKSGPQGDVLCHLVIPAKGEQQLLTALDGLLKTAHAEEPRLKTRLIEVHEPEGASLASLLFARDAGWTGSAPVHTRRLARAAVAGSGTASVEHSAQRVRLAPGRRVSRDGRTGGAGDDFRPGDCSPCARCDADSLWPFVSSSDGAPVGDAPSFRRHGRIPARRRQPVGRSPAVDCWHP

SEQ ID NO: 12903 - protein, 1212 aa, Myxococcus xanthus
MLSAMDAVLQRLRALEHSGPRAPCRVEIWCDRGSPAAVCEGLWSFLQSLQLEHRNVEGQVVRLDDVGGRHWVEEVVERERRQGRGDSAVTYRGRKRFVRAAVRVPWPVPASRQELLAQGRKTYGVVGGGALGLALAHWLVEQCDADVIIASRSGRPLSAGPQASSRLRWCKLDVTDPRDVEQAVGEWAREARLEGLFFTVGHVEPGPALAKTDRELRRTLAPKCLGALNLLEQCHRLPCRFVALFSSQASRGEYQHSDYAAANGFLNGLADGFGAEGAPRFTNRLGEPLSVISLSWPQWRDGGMRLSRELSELLASSQGLIPMPNQVGFTALREVVRGGMRHVAIQYRLSEQPRKEAVVPAQAVDADARAKAEQTVRDVVGSYLGQPAHALDMEAELSALGVTSLAIVELGLALHRRHGIRVQPARFFQYTTPSQLRDFVAQELSKRASPAHAQVAAPESRTRAAPHERTEPIAVVGIHARFPGAEDVDAFWRNIVEGKRCLSEVPASRQEALLALAGDGSDVTRPRWGGFIEGVDEFDPRFFSISPQEAELMDPQQRLLLASVWSALENGGLIPEQFARTSTGVFVAAAPGEYPRVVSIPVSHPLGTTAVTASIAPNRISHVFNFKGPSEYCDTACSSALTAVHRACQAIRSGECEQAVVSAINLLLSPTTFTGFEAMEYLSVDGSCRPFQPEARGFVRSEGVGTLVLKPLSRAVADGDIIYGLVRGSGVAHGGRGLSLTAVNPLGMKDAIVSAYRAAGVSARTVSYVEAHGVGSPLADGAEVEAIKAAFREVDERARDGEPHVCHLSSLKPCIGHGELVSGMAALIKALMALRHAVLPGLPGFTQWHEDISVADSPLKVSSDSQPWRTPAGAEPSPRRAGVNSFGFGGVNAHVLLESFAADTRLAGGREGPRLFVFSARTADRLQEVARRLSSFLASNSDIVMADLAYTLQTGRHAFNCRLAVVARDRNELAAALSTYLASPERTSWAGTPIHVGEVDGSTRLGKFLSEAAGASLVESLLAEQGLERLAEYWVLGGHVPWARLHEGADVKRIPLPTYPFARERYWLASGCADSQASAHEVPLSPKGRGVEAISEAIREQLSLALSVPRAQLGDHVNARDLGADSITMMRLAQVLARTLGVDVRLRDLVDRSTIAAIASHVATLVRGREPRVEDTVPVAVPEQDALDMLKEGLLSIEDVAARLENDAHDNA

SEQ ID NO: 12904 - protein, 734 aa, Myxococcus xanthus
  unsure (1)..(734): unsure at all Xaa locations
MSVEAFWRALDRDQPLLQEIPRARFDIDAHFDPDGSDPSKSHSRWGGLIPRIEDFDPEFFGVSHGEAARMDPRQRLLLMSAYNTFENAGYAPETLRESRTGVFVAVEDNEYLAHLQSAGVEMADPFGHSPSMVASRLSYFFDLRGPSEVINTMCSGAAVALHRAVVALRNGEVEQALVGAANLLLRPELFVSLSRLGQLSRGKEVWSFGERASGYLRAEGVASVLLKPLDRAERDGDAIYAVIRNSAVAFNGRGGTSIASPSAASHAALIQECYQTAGVDARAVEYIEAQGMGTPVADIAEWDACNRALRELAQRQGVSLEAGQCRISTLKPMMGHMHSASALGALFKVIRSLETDTVHGIIGFDQPNRFLDQDVQPCRLARESSAWRRKGQPRLAGVHSYGSGGVNAHLLIEEYLPRRDARPPDGHGPQVVPLSAGAPDLLPGMARSLRQALDAQPSGSVHAVARTLQQGRDALRFRVAFVAESVADLQAQLQAYEEGRRSSTALEGVAEPGVEDRPNGEGDTEPRSAAQRWVQGGAVRWSRSGGADAFERMRLPGYPFALRRCWVEGRDTAAPVHASTGVLFQLKRVNGDRHQVRVSFDGGEFLFRDHQVATTPILPGAAYLELARAAAVACDFTHPSELTDVVWQHPLREDARGDVRVVFSEXXTGQVXFQVVSPNHGTVGSETGHVRGQLASSSHPEEEPRQLPQLEGRCPERLDGDVAYQWLIQAWLEY

SEQ ID NO: 12905 - protein, 366 aa, Myxococcus xanthus
MSLEELLGVRPPSQRRSQVSFSFLFFSDVRKDISSAEKYRFMRDVTLFGDAKGFTAVYIPERHFSEFGSIYANSAVMASYLIAQTKRIRFRTAGISLPLHHPAEVVEWWAMNDNLSGGRVDLGFGSGWAKPDFIYAPDAYEKRRAICAERIDIVRRLWRGETVPFPGPGGVDIPITVYPRPVQKELNVWLLITQNADAFAQAGRLGFNVFTMLYGCDLDVLRDRIALYRQARKEAGHDPETGIVSLMLHTLVHRDMALVRRAVEAPFKEYIRSSLDAHLAAGLGSAGKVSLKEIGEAEKNKILEYAYERYFSTGALFGDVGDARRMVEKTIAAGVNDIACLVDFGVDYPLVMESLPYLEKLVADYC

SEQ ID NO: 12906 - protein, 2088 aa, Myxococcus xanthus
MLNLINNHAHGYVVTPVVLACNDAGLFELLRQGPKDFDRLAEALRANRGHLRVAMRMFESLGWVRRDADDVYAVTAAAAAHRSFPREAQSLFALPMDRYLRGEDGLSLAPWFERSRASWDTDDTLVRELLDGAIITPLMLALEQRGGLKEARRLSDLWSGGDGRDTCVPEAVQHELAGFFSAQKWTREDAVDAELTPKGAFIFERALLFAIVGSYRPMLASMPQLLFGDCDQVFGRDEAGHELHLDRTLNVIGSGHQHRKYFAELEKLIITVFDAENLSAQPRYIADMGCGDGTLLKRVYETVLRHTRRGRALDRFPLTLIAADFNEKALEAAGRTLAGLEHVALRADVARPDRLIEDLRARGLAEPENTLHIRSFLDHDRPYQPPADRAGLHARIPFDSVFVGKAGQEVVPAEVFHSLVEHLERWAAILHRHPLVILEVHCLPAPVVRGNLSQSESLHFDAYHRFSHQMLVEANHFLLAAAQAGLFARDDVIRRFPRTLSFTRMTLTQFEKRSYRIRWARLGDLPALERLERECWDAELRAPDAVLKARVEKYPQGQLVLELEGQVVGAIYSQRIRDDGVLQGSTAETVDTLHTDTGPVVQLLGVNVSPSAQHSRLGDRLLEFMLQYCALSNDVASVVGVTRCKAYGRHAHLSLEQYVAVRDEHGLSVDPVLRFHQIHGAELGELVVGYRVRDADNHGHGVMVRYDVHNRVRRDAPVEDAESASPAPAVTARGVASTETEYYLRQVVARIVECDAAAVRLDLPLMELGVDSVGLMELAEHIGRRFELKLEETFFFEHNTLDRIGAFLAGRNQPVVAQPVSAPLRPAPVPAPSGEVSDQEIAIVGVACRLPGGVQTPQQLWDTLIARQSLVGTLEDIRWRWSGLGHAAASGHVAHASDVDRFDAAFFNISPAEAELMDPQQRLLLELSWQCIEDAGHDPLRLAGSDTGVFVGASGSDYKTLQDKYGRDIAPQYAVATSTSVIPNRISYFFDFSGPSVQVDTACSSSLVALDQALRALRSGECGQALVGAVSLICEPSNTVCYQRAGMLSEDGRCKTFDASANGYVRGEGAVVFLLKPLKKALADKDPVYGVVMGSAVNHGGRTAGLTAPNPQKQAELVCKALQAANVAPEEVGYIEAHGTGTSLGDPVETKGLVTAFDRMSRAKGTRSTGRCAVGSVKTNIGHLEAAAGAAGLLKALLCLGHKRIPANLHFEQMNPRIGFTGTPFYVSHEEHPWELSEGQARRVAGVSSFGSGGTNAHVLVREHVATRPVSNGVGAGGRYLVLLSARTERALERREADLLTWLQANPLEDLGDVSASLAMGRAHWGHRSAYVVSSHGDLCEQLSLAERRRASTVGATKFDSLRKQRFLQRLQQVFPHDVLLRAAREGAGFHDDLCALADLYLLGSEFDWQPMFSALLTRRLRLPAYPFERDSYWLHPKEAADGIPAVVKAPVREPQAGAGSWLCVAQKWVPTALEDGIDWRVRLARYAGKEIAIVYQEADDLASFKVLLSAACAGLGDRAPRVHSVDARDFGDALDGNPFPVLPDVVFSLGASKPEGQGALRAAQTVFRISQTLMRAAGERAVRLYHLHEVSPSQSAIDAEALGGFIRSAMLENAAHVWKVVGFSADGAALSPRQALLQEWLSDPEASPEIVGSHVCATPCEVRYAQAQRALATFVEVPPEQARTDFPKLRQGGTYLVTGGLGPVGEQVCRQMARRYQPTLVFFSRSSLDPVREAQLETLRSLGAKVEYLPVDITDPAALRGAWAEAKARVGVFHGILHLARLVEDSPIYSKRWASFERVVAAKARGTVLLDEVSANEPLELFLLFSSVAAFGIRGSSDYGYATAYQNAFARHRNEQVKRGERSGRTVSQCWGPWTVDSYMPERRDERFAAMGWGLIEPSQALEAIDQSLQLSEPVVALVRTPSLELARRVFGLARSNDTQPSASSPWAGLEEGLRRFEAGGAPAPAAVAAFLADYDLEQVPTALVERAHGLMFSAPVERAPRRLATGGEALERAVRDALTEVLKLRGDYSDDQTFQSFGMDSISATQLATRLEKKLAMPILPRWFLEFSTARALIRHLAAQSPQRQS

SEQ ID NO: 12907 - protein, 137 aa, Myxococcus xanthus
MGLFADFVVLSRESVYTTNFMRYGFTPGMGATYIVPKRLGYSLGHELLLNARNYRGADLEKRGVPFPVLPRKEVLPHAYEIARDLAAKPRLSLVTLKRHLVRDIRRELPDVIERELEMHGITFHHDDVRRRIEQLFL

SEQ ID NO: 12908 - protein, 262 aa, Myxococcus xanthus
MQAASPPHRDYQTLRVRFEAQTCFLQLHRPDADNTISRTLIDECQQVLTLCEEHATTVVLEGLPHVFCMGADFRAIHDRVDDGRREQGNAEQLYRLWLQLATGPYVTVAHVQGKANAGGLGFVAACDIVLAKAEVQFSLSELLFGLFPACVMPFLARRIGIQRAHYLTLMTRPIDAAQALSWGLADAVDADSEKLLRLHLRRLRCLSKPAVTQYKKYASELGGQLLAAMPRAISANEAMFSDRATLEAIHRYVETGRLPWES

SEQ ID NO: 12909 - protein, 220 aa, Myxococcus xanthus
MDVSYWECQGLRAMGAMGTDRFAREPERACRPFDRESDGFIFGEACGAVVVESAEHARRRGVTPRGILSGWAMQLDASRGPLSSIEGESQVIGAALRHADLAPERVDYVNPHGSGSRQGDAIELGALKACGLTHARVNTTKSITGHGLSSAGAVGLIATLVQLEQGRLHPSLNLVDPIDSSFRWVGATAEAQSLQNALVLAYGFGGINTAVAVRRSATES

SEQ ID NO: 12910 - protein, 46 aa, Myxococcus xanthus
MAMALAKSDAARARVHTAKALSDSDPDVKLQAQALDDVLAEHQRVS

SEQ ID NO: 12911 - protein, 116 aa, Myxococcus xanthus
MERPGRQHQANGQTTAHLGAEIASLAVPEGVTPQLWRSATFSGQAALVTVHEAWNAVRLQAVPGHRIGLVVGGTNVQQRDLVLMQDAYRERVPFLRAAYGSTFMDTDLVGLWHAAL

SEQ ID NO: 12912 - protein, 629 aa, Myxococcus xanthus
MAKELFDTQTGFKRQLLELDEQFKQRLGHSILERIYDARAARLDPLDDVLVSFPAIFMIEHALARLLIDRGIQPDAVVGASMGEVAAAAIAGAISVDAAVALVAAQAQLFARTAPRGGMLAVLHELEACRGFTSVARDGEVAAINYPSNFVLAADEAGLGRIQQELSQRSVAFHRLPVRYPFHSSHLDPLREEYRSRVRADSLTWPRIPMYSCTTANRVHDLRSDHFWNVVRAPIQLYDTVLQLEGQGGCDFIDVGPAASFATIIKRILARDSTSRLFPLLSPFSRIDRELDGVTRSCAMTEAPAPRAPAQVPPPPSSPWALHTRGAASAPVNARKAALFPGQGSQERGMGAALFDEFPDLTDIADAILGYSIKRLCLEDPGKELAQTQFTQPALYVVNALSYLKRLREGAEQPAFVAGHSLGEYNALLVAGAFDFETGLRLVKRRGELMSGASGGTMAAVVGCDAVAVEQVLRDRQLTSLDIANINSPDQIVVSGPAQDIERARQCFVDRGARYVPLNVRAPFHSRYMQPAASEFERFLSQFQYAPLRCVVISNVTGRPYAHDNVVQGLALQLRSPVQWTATVRYLLEQGVEDFEELGPGRVLTRLITANKRGAPAPATAAPAKWANA

SEQ ID NO: 12913 - protein, 436 aa, Myxococcus xanthus
MMLFLRPTEFLDRCAARYGDTFTLKIPGTPPFIQTSDPALIEVIFKGDPDLFLGGKANNGLKPVVGENSLLVLDGKRHRRDRKLIMPTFVGERMHAYGSVIRDIVNAALDRWPVGKPFAVHEETQQIMLEVILRVIFGLEDARTIAQFRHHVHQVLKLALFLFPNGEGKPAAEGFARAVGKAFPSLDVFASLKAIDDIIYQEIQDRRSQDISGRQDVLSLMMQSHYDDGSVMTPQELRDELMTLLMAGHETSATIAAWCVYHLCRHPDAMGKLREEIAAHTVDGVLPLAKINELKFLDAVVKETMRITPVFSLVARVLKEPQTIGGTTYPANVVLSPNIYGTHHRADLWGDPKVFRPERFLEERVNPFHYFPFGGGIRKCIGTSFAYYEMKIFVSETVRRMRFDTRPGYHAKVVRRSNTLAPSQGVPIIVESRLPS

SEQ ID NO: 12914 - protein, 99 aa, Myxococcus xanthus
MPFFYVVGAICIVLLIGYYFYTPPTMKLQRWSLATMIGGALGNYVDRVRLRYVVDFVSWHVGDRFYWPSFNIADTAVVVGAALMILESFREPRQQLSPG

SEQ ID NO: 12915 - protein, 374 aa, Myxococcus xanthus
MMQERGVALPFEDPVTNAVNAARPILDAMSPEARERIELLVTSSESGVDFSKSISSYAHEHLGLSRHCRFLEVKQACYAATGALQLALGYIASGVSPGAKALVIATDVTLVDESGLYSEPAMGTGGVAVLLGDEPRVMKMDLGAFGNYSYDVFDTARPSPEIDIGDVDRSLFTYLDCLKHSFAAYGRRVDGVDFVSTFDYLAMHTPFAGLVKAGHRKMMRELTPCDVDEIEADFGRRVKPSLQYPSLVGNLCSGSVYLSLCSIIDTIKPERSARVGMFSYGSGCSSEFFSGVIGPESVSALAGLDIGGHLRGRRQLTFDQYVELLKENLRCLVPTKNRDVDVERYLPLVTRTASRPRMLALRRVVDYHRQYEWV

SEQ ID NO: 12916 - protein, 83 aa, Myxococcus xanthus
MTDEQIRGVVHQSIVRVLPRVRSNEIAGHLNLRELGADSVDRVEILTSILDSLRLQKTPLAKFADIRNIDALVAFLAGEVAGG

SEQ ID NO: 12917 - protein, 299 aa, Myxococcus xanthus
MCGQTSLFAGQIGDWAWDTVSRLCGTDVLTATNASGAPTYLAFYYFRIRGTPALHPGALRFGDTLDVTSKAYNFGSESVLTVHRICKTAEGGAPEADAFGHEELYEQPQPGRIYAETFNRWITRSDGKSNESLIKSSPVGFQYAHLPLLPDEYSPRRAYGDARARGTFHDVDSAEYRLTVDRFPLRYAVDVIRDVNGVGLIYFASYFSMVDWAIWQLARHQGRSEQAFLSRVVLDQQLCFLGNAALDTTFDIDVQHWERVGGGEELFNVKMREGAQGRDIAVATVKVRFDAASEGGRRG

SEQ ID NO: 12918 - protein, 412 aa, Myxococcus xanthus
MNAYCGIARLDVLQLATHRGLDTSRFANLLMEEKTVPLPYEDPVTYGVNAARPILDQLTAAERDSIELLVACTESSFDFGKAMSTYLHQHLGLSRNCRLIELKSACYSGVAGLQMAVNFILSGVSPGAKALVVASDLSRFSIAEGGDASTEDWSFAEPSSGAGAVAMLVSDTPRVFRVDVGANGYYGYEVMDTCRPVADSEAGDADLSLLSYLDCCENAFREYTRRVPAANYAESFGYLAFHTPFGGMVKGAHRTMMRKFSGKNRGDIEADFQRRVAPGLTYCQRVGNIMGATMALSLLGTIDHGDFATAKRIGCFSYGSGCSSEFFSGVVTEEGQQRQRALGLGEALGRRQQLSMPDYDALLKGNGLVRFGTRNAELDFGVVGSIRPGGWGRPLLFLSAIRDFHRDYQWIS

SEQ ID NO: 12919 - protein, 79 aa, Myxococcus xanthus
MDKRIIFDIVTSSVREVVPELESHPFEPEDDLVGLGANSLDRAEIVNLTLEKLALNIPRVELIDAKTIGGLVDVLHARL

SEQ ID NO: 12920 - protein, 168 aa, Myxococcus xanthus
MPGPRCAENDWVALLVRVNHEKVAAAQLGKHGYEFFLPTYTPPKSSGVKAKLPLFPGYLFCRYQPLNPYRIVRAPGVIRLLGGDAGPEAVPAQELEAIRRVADSGVSSNPCDYLRVGQRVRIIEGPLTGLEGSLVTSKSQLRFIVSVGLLQRSVSVEVSAEQLEPITD

SEQ ID NO: 12921 - protein, 350 aa, Myxococcus xanthus
LKRVGSPAELRLTVARALERRALLNWKTEARQSAGEVELSWGAPAMHPVVEALRKVSPTQATVLLVGESGTGKEVTARALHQWSERADGPFVAVNCAALTETLLESELFGHEKGAFTGAVAQRRGRIELAQGGTFFLDEVGELKAELQAKLLRVLQERRFERVGGTRTLEADVRWVAATNRDLKAMMARGEFREDLYHRLAVFPIRLPSLRERREDLRPLSELLLRRIGDELGRPGLRVSPEAVARLEAFTWPGNVRELRNALERAAILADGPVVEPRHLWLDPTGAAGPVVDAPVSEGGRLPSLTLEELERRAIEQAIADEAGNRKRAAQRLGIGLRTLYDKLRRYESP

SEQ ID NO: 12922 - protein, 128 aa, Myxococcus xanthus
MHDVFVQLLRYQGALKDAAPSSLLHRIATTVCLNRLRGAKRRPEDREDELVLQIASADDTESRTAARGLLDRLFGRVPASSQDIAVLHLVDGMTLEETAREVGLSVSGVRKRLRALTAVLQELELEAA

SEQ ID NO: 12923 - protein, 75 aa, Myxococcus xanthus
MALVPSGTQVLPRAYELDDAPGFERFVFVSSDAPFDVAVVLAAAEALAGNPDASSAPLSLPGNLTQASLTLEKHE

SEQ ID NO: 12924 - protein, 174 aa, Myxococcus xanthus
MSEQGAFAQQSGDDVSESSSRGLRRGSTHMEFWLSDIQVANMGVKLGGGGVYFTLMAGLEPGRDARFSFAAGVGGHMTLSQRLWVDLDVTGGAVQPVRNPLEGDGGNVLGQARLMLGFQLMPRLAVFAGPTYNAWFSWGESDFDSITRLSFRETHPEPDQRLQHWPGIQVGLHI

SEQ ID NO: 12925 - protein, 368 aa, Myxococcus xanthus
MEFRIAADELKKALYRAQGIVERKTTMPILANVLVTANKGGITVTAFDLDIGVVSEHPAEVIKTGAVTLSAKYVFDIVQNLPDAQVTLKKLANNYVDISSGSAHFKIVGMAAEEYPKLPKEENAPLVQVGGNTLLEMIKKTQFAISSDETRYILNGVFFEPQSTGKVRMVATDGHRLALVERELPGDFKLKSGVIIPRKGLMELKRLLDEAPDAECHLGFAENSALFKKPGLTMVMRLIDGQFPEYQRVIPKEGEKIVLVPKVRLLESLKRIALLSADKSNAVRIGLEENQLIITASNPDLGEAKDVLELAYRGNGITIGFNARYLMDVLAVTETDEVSFELGDEHSPGVLHAPGDRSFTAVVMPMRV

SEQ ID NO: 12926 - protein, 440 aa, Myxococcus xanthus
MATHPDNLRARLEDRADLLEATRLRYRALRGMLASFFWKQRVRSQFELLLEVARTQPEVDATLAALKRRAAAEGWPANAAPMKLMREVERLREDVRRVAFKRLPAEGRPATLGEALLKLEETVLEAGPLLGRHIWARAVELLPRNLPELRAACAAAEVFEHVFKRPAPEGVLPFTVEEAEALQRALPLAETALAALWQRLEHFDTRGQVKGFLQARVSRAPQRVPRSGPELLLHVAFWRGVAWARLRASLGERLAPVVPADAEVPALLVWLAAREGRFERGAEPRMGGPGLFAPEAPGPQPRTDGAVGLRGVGVEVAGEVRLPACEAFGEGRAGLFELAAQLAALSRERPVGTWDEETAWARLWNAAQRARGEQGEDVERLRDALRLFILLRGQGQTPARLFSPERARVPTVEIGADAGAAVKDLPALVHAARAAAWRGR

SEQ ID NO: 12927 - protein, 97 aa, Myxococcus xanthus
METDVNPASRASEHEYLDVPPVVRAEHAEASLTRLIEQQTAKVPSHVFLVASLASMGASFVLEVTGRSHLSRFIGQWVSPLLVMGVYNKLVKIFGPR

SEQ ID NO: 12928 - protein, 507 aa, Myxococcus xanthus
MTAELAAREAAQVERRNLLQVFTQAPVALSVLRGYELRYEFANPLLQKLMGGRELNGRTQEEAIPDLSPELLSLHRGVLETGERAIAREYPITIDYEGAGRVETRFWNIIFEPLRDERGLVDGLVTLAFDVTEQVFARQAVESQQKWLEAVLDLMPMPVVMADPASGDLNFSNAAADRLYGLHIPKDVPTTAYGEHFHVTDLEGRRLSVDDLPSNRAARGERLDGLEVHWHTPAGRYALSISSETLPAMHGHPSVVVIPFLDITRLKTVEQHLQEAVRARDEFLSVASHELKTPLTSLGLRLQSFVRAIHADPESALAQRHGREVEAMRRQVTRLAELVDGLLDVSRISTGRLKLQFEPVDLPSLVSEVAARFELEAARAGCELHVTQAEGFEGVWDRLRLEQVVSNLLSNALKYGAGAPVHIDVAPGGMGARLRVKDRGIGIDPEAHARIFQKFERAVSERNYGGMGLGLYVTRTLVEALGGTIQVDSQPGEGATFVVELPLQPAR

SEQ ID NO: 12929 - protein, 184 aa, Myxococcus xanthus
MAELAPRAQATFASIGRTVDPAVYNYRPAHLEGDFAAADETALAAMLRESLSARLRRDMERGFTSVGPHSDDVSVTLGGRSARAYASQGQQRALVLGWKIAEIENLEAAMGFLPLLLLDDVSSELDPERNAYLMGYLAQSGAQVVLTTTDGSLVRGAAADDTLWLDVHGGQVAVRADAEPPPAN

SEQ ID NO: 12930 - protein, 167 aa, Myxococcus xanthus
MPRMTLLCLLVVMPLAGCHRTTFEDSVLTKPAVRYRIGKLPAYWEQVRLEDNDLAFAEEGTGRALSVNATCQGHDDPSLQVLTRHLLAGFTDRQEIAEQRIPMDGREALRSRHLAKMDGVPVQLELVVLKKDNCVFDFTYVSPPGLADGRMADFDALLAGFESERKG

SEQ ID NO: 12931 - protein, 250 aa, Myxococcus xanthus
MDRAKERLESLGALSRMTGQVFSRAVRPPFDWRGLVYHTESLGVRSLPIALLTAMFAGLVISLQFGYFLSRFGVQYTVGRVVILTLFRELAPVLTALTVGARIGSGIAAELGAMTVTEQVDAIRALGADPLRKLVVPRVLACLIVLPVLTVFADVVGLVAGALVVNIQYAITLNLFFQGALDAVLMPDFASGVFKGAVFGLIIGLVGCFRGLTVEGGTEGVGRATTQTVATTSVSVCLADFFITQLTLSL

SEQ ID NO: 12932 - protein, 83 aa, Myxococcus xanthus
MREGSLADLLILDYLPATPLTAENLAWHVVFGLGSRHVEAVMVDGVWRMWARRPLSVSPSVVAEQAREAASAVWARMAEAAKK

SEQ ID NO: 12933 - protein, 272 aa, Myxococcus xanthus
MRSSSQTTSEFAFQPPRPGEQLIYFEHLTKAFGAKRVYDDMDLDVRAGETLVVMGGSGTGKSVLLKCLIGLLSPDTGRILFQGHDLARFTEEQFMPVRRHVAMVFQGAALFDSLNVGENVAYPLREHFPDMPADEVRARVAEKLALVDLPNTERLMPSGLSGGMRKRVGLARAIATEPEVILWDEPTTGLDPVTTQSINVLINSMKTRLGCTSIVVTHDMVSAFTVGDRIAMLANRRIVQVGTPREMLHSTVPEVRAFLDARRVELFPGGAP

SEQ ID NO: 12934 - protein, 402 aa, Myxococcus xanthus
MSLFSPAGTERRLALRTGLFVAVGLAVASVVVMVIGQQSRLFERKTMYRAYFANVQGLNDESPVWLGGLNVGRVTGIVFSPDPNDPRLEVQFQVSSRYTDRVRQDSVAQLSSMGVLGDKAVDISLGSPTSPPVEAGGVLKSSTGGDLSSLLSGASQVMENSVAISKSLRAAVETYANPEMANDVTRGVAALRALLEEVAKGEGVLHALIYDKQAGREVRGLLANASSAAARVDGAVGELEGILREVRTGDGTAHALVYGQDGAKALTELGAAAGQLAGLIEDAKKSPNGAVHQLVYGDASGMFADLGSAAADLKKITATVAKGDGTVGGLISDPTVYEDLREVIGNVKRNRILRALVRFSLSNRQDLEQVGKVKGVEPRSEAPDAAPAETAPSAPGESAAQP

SEQ ID NO: 12935 - protein, 296 aa, Myxococcus xanthus
MFMLGTALHLSRQRALLLAAVFVFCTPLLSTASRALWQHGPSLLFLTLVLLCLVRAREAPRHVAWAGIPLALAYVMRPTNSLSVLVLSLYVLWTWPRQAWKFFAGALAVAIPWVAVNLIHYGSVLAPYYEPQRLELSASRVAEALAGNLVSPARGLLVFTPVLLMSAWGLWMDLRARTFTRLHAVLVAVVALHWAAISTFPHWWAGHSYGPRFFSDMVPYLVFFLVPVVRALQWKGPEARRGLTATFAVLAVLSLVLHVHGASSRAVYRWNSLPLDVDEHPERLWDWSDPQFLGRR

SEQ ID NO: 12936 - protein, 200 aa, Myxococcus xanthus
MAASLELARFFHERFPPTEDEKRWGFLSSSSLKATVVEAPNTKETKVPADVVLRGDIRLTPFYDLAEVQKTVTDFMAELDARLERDDAPAHFPRTRTAGGKRGELAFRFQGEGTEGIACRLDSEGLRALKEAMQVVRGVSATPFSLTGSLPLVRDLQRQGCDVQITGFGDMQYYHAPNEQARLEDFRQGFAILRELLVRL

SEQ ID NO: 12937 - protein, 381 aa, Myxococcus xanthus
MIPGPVEFEPEVLQALGAPTLGHTDPAFIAVFGRALKRLREVCLAPSAQPFVVSGSGTLAMELAVANLVEPGDAALVVNTGYFSDRMAKILERHGARVTHVRAPPGDVPSLDEVETHLSKGGFKVLSVTHVDTSTGVLAPAEALVRAARKHGVLSVVDGVCATAAETFRQDAWEADVYLTASQKAVGVPPGLALLTVGPRAMEAWRKRKTPVASVYADFAEWLPIMEAYEAGKPAYFATPPVNLVAALDVSLGQILAEGMDARFARHQRMARAFRAAWKAMGLRLLPTSDAVAANALSAVYYPDGVDAALVGGVKGQGVVVAGGLHPDLKTRYFRVGHMNRVGPADVLATVGALERALIAAGHRSEPGAAVAAAQASLIVG

SEQ ID NO: 12938 - protein, 203 aa, Myxococcus xanthus
MYAGYESSAGGGAAWELELRRLAATDDDMARGMFFQGTLDVVGFLGGEGAVARCKGVAGIWEINLLHMYPITRFLRMSSTAARLLAPQLDGFEGVLRRMGTQATVDFVASVFGRELMQAASGKPRLLLQSLGEAYLAAVTYGERYPLWTGETSARFIMRRDFMPAAYHEGVLHGVLEAVGAREVRVHGRQVGLLDSEYELSWK

SEQ ID NO: 12939 - protein, 715 aa, Myxococcus xanthus
MHTNALALLILQLIVIIGLSRLIGRGARWLGQPLVIAEVVAGIVLGPSLLGWLAPDIMNGLFPASSMPVLTMLSQVGLVLFMFLIGLELDPQLLKGRGHASVAISHSSIVVPFALGAGAGALWLYRSLSSPEVPFSSFVLFMGVAMSITAFPVLARILTERGLLQSKVGTVAIACAAVDDVTAWCLLAFVVSIVRASSLAQAALTTVMALGYIAFMLMVVRPFLARLGARVASREGLTQNVVAGTLVLLLASAGVTELIGIHALFGAFLFGAVIPKEGRLAETLAERLEDVAVVLLLPVFFAFSGLRTQIGLLNTAEDWLTCGVIIVLACLGKFGGSAVAARMTGLRWREASAIGILMNTRGLMELIVLNIGLDLGVISPQLFTMMVLMALVTTFITTPLLKWIYPLEEIARERVVVPLPVEPGPPPYSVLMCVSHGQAGPGMATLARSLSGREEGAQLHALHLVSPERASLRPAQQRAPEEDSALMPLLWRAVSLGLSVRPLSFVSAEPAQDICRTAKARRADLVLLGWHKPLFSQTMLGGTVREVMQEASGPVAVLVDRGLSDIKRVLVPFAGSRHDRAALALARRLRQQADAEVTVLHVTSDLGGNGGARAQVEALFPANEGGVTLKEVRSDAPDEAALGEARHGYDLVIVGIGAQWGLEDKVFGLQRERIIRDAPGSLLVVSDASPATAAESTSEAANDGATAVRVLPARS

SEQ ID NO: 12940 - protein, 272 aa, Myxococcus xanthus
MHLGATLRLLRTDAGLSLRDLARRIGVSSAYLSRVENGVDAPPTPERLSAIARELRVPSSLLMDVANRMSPSVAAYLEEVPGAGALFLDIAQRRLSGLQLARVRDFLEAEFPVAQGRRDAPVPPLAPLLAPERVVVQLSCAGWDDVLDVVAERLASSQPGADVARVVGGLKRHREESSCAVGGGVAVPHSFLPGAVPTAALVTLATPLAGDTPDGKPLRVVVAILDAERGNPQLVRLAHLARLAAHGLADRLLGLSQPAQVLSSLEELEALR

SEQ ID NO: 12941 - protein, 152 aa, Myxococcus xanthus
MSSPRFYAFDPRATRIALFVGACVLAVLTAWALADARAEGGVQAMARAGVSAGLMLTFLVSFHRLRPRTGWGVTVDARGVRVARPFSQKELDLHWGQIDHVRRIGRKGSVLALFLKEEGRVLVTRHLFARKAVFDELISALEDRLPPPRFDA

SEQ ID NO: 12942 - protein, 176 aa, Myxococcus xanthus
MLVPLLVAGFFSGAIPQAGETAPDFTAKDSAGNVYTLSEMVKRGPVILAFFPKAFTGGCTRELKAYRDRYADVEKAQGQVLAISMDDAESLTRFKAELKAPFPFIPDPEGKVVSAYDVKMPLLSVPKRYTFVVGEGLKILKVESGNDAINPHGAIVACPLRKPAGADAKTPDSGTK

SEQ ID NO: 12943 - protein, 116 aa, Myxococcus xanthus
MAGSFAEVSVGTSAEAYTYPGAVSDGNLHEQLLFTFGYGVWLGRGGPFRGEAMLYYDHRKDSFAGGIRSRGGGIVGAFGLRGRALLTDDWGVAAEVQGGGALVGRLSLIRALGGER

SEQ ID NO: 12944 - protein, 351 aa, Myxococcus xanthus
MRPAENRAIADSKVGQAQQGGVTLSVADGLATVRELAPGTLVLWGNAPAFTARIDVGAQAPSDWLVTVRNAMPDAVLVAEEEGGAPLAQEALPQALPTVKVWRVALRAGTTARLSVAPPDSESREPFRFLALADVQEALPRVGDIYARMRRDDTARFILFAGDLTESGTRDELTEFQERLEAGSRIPLYATLGNHETFTRDAAEYHALVGRGSQSFVFKGVRFSVVDSSNGTLDPGVEEQLEGWLAASRDGTHVVAMHVPPQDPVGLRGGGFANRGEAAGLVGKMARAGVDLTLYGHIHSYYSFANAGIPAFISGGGGAIPETFDGVGRHYLSVDVSADDGLQQAALVRVD

SEQ ID NO: 12945 - protein, 174 aa, Myxococcus xanthus
MFDSNENDPIPPALRALLELFTTELAEVRFPDMNGEVLDAAAEQVRAQAEAVARAQAALESARQALHESQEALLQKGQRALAYARVFSEENVELSARLDGIHLPRAARKGARADGGALDPASAAQGNDENAPRRRGRPPKARAVAGASLFADGSSPEALAAAAHHTGNGMLSEA

SEQ ID NO: 12946 - protein, 513 aa, Myxococcus xanthus
MRLPASAEPQFFDDLSREVALACDAGDTLTWVDARARNVLAANPGQTLRGLAAQGTEEKVDRLLVQAHDEKVEGWELILCRDQVPTTFAFRARPHDGGVLLVGSLVPEDYGGALERVSTTLSEMSALHRETERQQRELKRRADELARLNNELEESNRGVRSLHAALDTGIGIAPEHHERIFEEFSQVESHLQRKAKGTGLGLPLARRLTELLGGTLTVKSALGQGATFTVTLPRVHMEVTEMTGLTERSEHLDPSRAPVLVLEDDRQTLFLYEKYLARSGFQVLPVRSTDEARRVLERVRPAAMVLDVMLEGETSWGFLADMKNNEATRDIPILVVTVTDREQKARALGADEFWLKPVDEVRLQRKLQAMARTGPVERILIIDDDDVHRYLLTQLLKDMPYVLLEAAGGKEGVQLAREKSPHLIFLDFVLPDITAFDVLDELKADPRTRDVPVILHTSHELKEAERSRLAKETAAILAKHTLSREVAITRIRDALSKAGLGSQALPQEASRRG

SEQ ID NO: 12947 - protein, 234 aa, Myxococcus xanthus
MESVSKSVEARADRLATASQEALYQDPFWAARYGLERAQRFGDEDARFHVRYLVQSLDEHLPSVLEGYARWLRTLLVSRGMCSRHLDRHFAALAAALEAEGWGPGSEPHDYVGAARQALRYQEGPARLLEEEAPELARAATARLTLYIIPEDQPRLEEELQLQLSYVADALAAGKPDLLGDHVRWYAGFWPRRGFGLLAFPSVLGMLKSVLGSRHPEARTLLSEAGVSWEETRS

SEQ ID NO: 12948 - protein, 105 aa, Myxococcus xanthus
MSSDFLEMAGFDVRFLGANVPPEHLARMTNELRPDLVALSVTMTYHLPALREAVAHVRKTLPDVPIAVGGLAFNWAPGLEEELGVNFFGKDARQFVASACRALGV

SEQ ID NO: 12949 - protein, 108 aa, Myxococcus xanthus
MTSPPSHDSQPKPGESAVYIVKDSGVRCFAPPCPTYNAFPVDKPDAEPIPVHELELSAVTKGSDEQTDALIRKTLDGTGLKIQGTLETRPNAGPAGAATVLRASKVEN

SEQ ID NO: 12950 - protein, 410 aa, Myxococcus xanthus
MVPRLARARTLARNFPEVSGEMTLQGGWSQVRSESVLGRESPGRPVPGGLFERAQQVLETFDFSDPRIVAWHFSAEEPMQGRTVLLELRALGQQLRYLCGVRVGDTREEHDEVYSVFGFSFETLHGHIEAGREWFLLKKEHESGEVRFHIEAAWRPGQFPNGWSRLGFAMVAPRYQRAWHRLTHVRVRELALKHPEFVGQLTSHGRLAHSGHALGTAPVQFFAQRAPGRRETQLEEEIEAMNRGHGLRALGLGVLAGMRSMSAPALASRWLTKTQPDSEDRLARTLAHPWTPRVLGLLAVGELVADKLPMAPPRVAAVPLTGRMLSGALAAASVTTERQRGGRLAAAALGALAALASSWAFYSLRRTATKKLGVPDVAVALTEDALLAGLASRLLPVSEHQAGQATLSPV

SEQ ID NO: 12951 - protein, 165 aa, Myxococcus xanthus
MRWVAVRFAEFAPSELCVFERSHPERGGQPLALDDELTVKIQGAGTFAVRVIHQDAQSFTLGTLHGHPEAGRITFGAYRNARGDVIFHIRSRARSGSTFHYLGFVTAGDAMQTNTWTEFVLRAALTAGDGVHGVIHADTTELEDEPPGGDTVHGPTFLARGDGRQ

SEQ ID NO: 12952 - protein, 184 aa, Myxococcus xanthus
MRKLVWSGVMLCGLLAGCASRQETGAAPAEPPPAEAEASAEATAPVPEDTQATETSPAEEGEAKTVVQPLVVTPNPEPKDPINVRSAKVDGGILTLAVMHGGGCAEHTYSLAWDGNLQQGADGTPVANLVLVHNGNNDRCKALLRATPRFDVSSVSQLFGAQFGKTSGTVNLVLSDQAHVRYDF

SEQ ID NO: 12953 - protein, 426 aa, Myxococcus xanthus
MKREVKAGIAGLVFGSMLVGCGVAPEQEAQNEVEEMTAEATSSAEAGLDEHRGSSMPAAVARFGPAVAYGDGKFFAVWTDVRTGGIYGTRVKPDGTVLDPGGIRINISDENGERPAIAFNGKYFFVVWESRDGVDGVRVKPDGTVVGPVFRAIQTGETVGPVRVACSPKICLVTYTVSGDEETVIFFTRVTKDGVVLDTDDESLSAVPNFANDASSTWNNKTKEFLVVWSDEHGQGPENADIYGNRVKEDGTILDGDGFPISQAEGAQTTPDVEWTHKNYQVVWTDDRNGNADIFGARVSKTGMVKDPEGIPISTAEGAQAEPRIAHHNDKSLVVWDDRRDGPHAVWGARWGENGDVWDPSGFPISTGDQPQEYLPDVAYGGGKFFVVYSGQETFDPLEPHFILGTRVTHQAHVKDVPALPLTRQH

SEQ ID NO: 12954 - protein, 365 aa, Myxococcus xanthus
MTADAVGDVWTYALELTRALAPHGVEVTLATMGAPLTSAQWAEARGIPNLTVEEGRFRLEWMEDPWDDVRSAGDWLLALERRVRPDVVHLNGYVHGALPWLHRPLVVGHACRLSWWRAVKGEDAPACHARYREAVTAGLGSAGRVVTPSRDLLDSLQMHYGPLTAAEVIPHGRRADRVPPRSEREPFILGVGSPWDAAKNLTVLDAAAPRLGWPVRLAGDARHPSERKAEPRHLQWMGHLEPHVLAAWMSRASIFVLPARYAPFGLTALEAALSGCALVLGDIPALREVWGDGAACFVPPDDVDALVETLERLREDTGLRTRLALRARAWALTYTPRRMASRYLSAYASLVGTQGVLSPAGTPTH

SEQ ID NO: 12955 - protein, 369 aa, Myxococcus xanthus
MADHLKTFFDARLVERLGASLHAAAPTFPRAAFIREAEKGLDGHELMDRARHIAGALHRALPQDYPEAVEVLLRSLGPRTEATEGGAMASFFYLPHTIFVAEHGLEHFEPSMRAQHVLTQRFTAEFSIRPYLERHTAKTLARLREWTEDPSEHVRRLVSEGTRTRLPWASRLREFQKDPTPVLALLERLKDDPALYVRRSVANNLNDIGKDHPALLVQVATAWMKNATPEREWLVRHALRSSIKRGEPAALAVVGARPPSGIEARVTQLPRRAALGSTVEVHFEVTNRSKQQQTLVVDLAVHFQKANGEARPKVFKVRELLLGPGQAETVSKRVSFAQLSTRKHYAGPHRFEALVNGQGLPLGVVEVSG

SEQ ID NO: 12956 - protein, 129 aa, Myxococcus xanthus
MDGGLAIFGLGLFLLGIANLYTRHSYWLAVSVLLLSVVSMGLAFSESKRLRDVSLGVGVVLLLLTVIALAVGTSWWLPLATFLFAVAYGVLWAEYRFPFFKNVAPGDVPHHAERRFHVHWPWHRRRVTP

SEQ ID NO: 12957 - protein, 903 aa, Myxococcus xanthus
MAVTYRARMTGAAGVTKPCVIKQILPHFVDDADFVEMFIGEARVVASMSHSNIAQIFDFGEVDGQYFIAMELVQGQPLSKVLRRAQRMGMASFPEPLALHVASKLCDGLDYAHRHVGEDGLALGLVHRDVSPDNVLISYEGEVKVIDFGIAKVTSAVEAKTSPGTLKGKYPYFSPEQAQGRQDLDARTDVYAAGVVLYEMVCGKRPYEGEFVTVLPRILVADRLPPSALNPTVSEDMETVISHAMALDREARYQTAKDLSESLVELLYRDNPRFTPTLLSQLMAHLFPEELAAEGRRVEVSPAFQEQLTAWQTGVTEASPQGRARPPSSNAPRGSSPGVRSRPGSDGGRPGSDSGRPGSEGGRRPSASTPGARRPTSSGVRRVTQSQLPRSEGGVRRTYTSERPGPPVPALDEEPSTDAGDAPAPTQAAPRDTPIEVPAAKSKEPTTEAHPVGTWTGKGYRTSVDDARDTLAREEAARVAKGKEKARVVTMSVVYATAALFLVGVFYKLVIARESTFDDMYASTTTLWLASKPAGATVRLNDQVLKGVTPLMVEVKIGEANTLALSLPGHLPWTKRFTPTSNLVEPLTAELKPIAAPPPPVEVAVAAPEDAGAAVVAEGAATPEDAGPSAPEDAGASTEVAVAQDGPEEEDTPQRTMHEVDYPTRVLVLRPQYNAVPLPEYNTASIELNPGTTYSVWTQGSASLAEGRGTASGTLAYLIEGDGPVDSSFGLLGTSTRTIKGARKLHVFALDDGGLDDNSGAIRINVRQSAYVPPRSFTFDAKENAVPLKPEHQMVLRGLNPDSTYLLTVRDDVAELRSGPNGRVRQVLCMERGPAPESVRATHRILQTGKRYQMTGTENLHCTFPDMQVGDNRGAFEVDIVDVTAMSGKERAEALKGSRRSER

SEQ ID NO: 12958 - protein, 390 aa, Myxococcus xanthus
MRALCWNGINDLGVETVGDPRIVNPHDVILQVRMSTTCGSDLHFIDGYIPTMRKGDVIGHEFMGTVVEKGPAVKKVQVGDRVVVPSFIGCGSCWYCQHDLWSLCDNTNPKGELQEPLFGYQTAGIYGYTHTFGGYAGAHAQFVRVPHADNDCFRVPEGVTDEQALFLSDAVPTGYMGADFCDIQPGQTVAVWGCGGVGLMAQKAAFLLGAERVIGIDRFPERLKLAREKVGAETISYEEVDSVLDVLKELTGGRGPDACIDAVGMEAHGTGVGAAYDRAKQAMRLQTDRGQALRQAILACRKGGILSVVGVYGFMDAFPLGAIMNKGLTVRSAQQHGQKYLPRLLEHVVKGELDPSFLATHRFSLEDAPKGYELFKKKQDGCVRAVFLPN

SEQ ID NO: 12959 - protein, 132 aa, Myxococcus xanthus
MGHFADVTSSGESLQHWKVPGVLGKELEWDAEVVEEHPGELLSWRSVGDTALPNEGWVRFRPAPRDWGTAVTLRFVFDPPGGVVGEKAVQLLGAVPAALALKALKRFKSLVETGEIPTTRPNPAAREGGYSS

SEQ ID NO: 12960 - protein, 459 aa, Myxococcus xanthus
MKRLFASLLTLSALSLTSACGDDDNTPNNPNPPPTDTTENVSANITQDTTWKAGVTYTLKNYIFVESGTLTIEPGTRILGDQGSALIITRNAKIHAVGTAQAPIVFTSSRPVGSREPGNWGGVVLLGKGRINVAGGENTVEGFFASGNNPLTQYGGGANPNDAHDCGKLNYARIEFAGFELSEDNELNGLTVAGCGSDTDLDYIQVHMGADDGVEFFGGSANLKHAVVTQADDDSLDYDLGYNGKIQFFIAQQNAVVGNFGIEASGNKNDNAATPRSAPEIWNATFIGSGRPSGTSPAQSGMVFNTGAGGKLNNVIVAHFADLAVDVSGTASAALWNAATPELYLRNTFFWNNRGDKVSIPAAPNPTVDAGGNITNPDVSNFNEPERVLASALNNRVVDPQLTDATHLTAPNFMPVAGSPALNPDSAATPPAGFDTSARFVGAVGTTNWLAGWTAFPQD

SEQ ID NO: 12961 - protein, 909 aa, Myxococcus xanthus
MEGISDEAMLAESAVPPPGFTGIYGRVTDEANGEGLIEATVKVVAGAQKQVLTDLDGFYRVALPPGKYDLRVFYDVYQGRRITGVVVTKGKATKLDVALGADEGAVQEVVVEARADRRAEGALLQERKKAAAVSDAISAQEIARTPDSSASDAVKRVVSATVVDGRYVLLRGLGGRYSTTLLNGALLPSTEPDEPSVPLDIFPTSLLANLNVVKSYTPDLPGTFAGGTLLIETNSYPSEFELKPRISLAGDSETTFRERNSQAQGGFGENLGFPSGSRQLPNAIPRDSGLGMSGESSDVLEQQYRSFPNIWQARRTTALPNMGLGVSMGDTLRFGNSRLGYLASANYGHRDGVQEGTFARVDRDETGALNARDAARSTQGFETASLSGLGSVGFQLDRDNELTWFGLYTRGTDTRTFTARGSNIVRGESYESTRLQFVSRQLFFNQLRGFHRLGLLGDAELDWQANLSRVDRDEPDTRDTLYSDNLSAPSGTPTFPNQPNSGERFFAELGETSTGGSVNVTVPLSAVRLKVGGLTQVSFRDFGARRFRYLLGTTPVDRTLPPEQLFAPENLGTGIRVRENTRPDDAYDAYLGIFAGYASADVQPTDALRLVGGLRVESSTQQLTLKDPFTGASGTENRSEYMNLLPAFNAIYALTPTVNVRAGYSYTLARPTFRELAPFIYFDFVRRRNVSGNPDLLQTRIHNIDARVEWFAGENEVLAASAFYKRFQDPIERVIRNPESGDLSFENAAGANTYGLELEARASLARLTETLKAVRVGANLTLIQSDVDLGDPNVGGAQTNRNRPLQGQVPYVINLNVGYSRPESGTELTVLYNVYGRRISEVGVQGLPDIYEVPFHRVDISLTQQLGSAQLKLTAANLLNSSVTLRQESVDVQTYKPGVAFSASLGWSL

SEQ ID NO: 12962 - protein, 126 aa, Myxococcus xanthus
MNVTPLVDVVLVLLIIFMVVTPLMTKQMWMTVPAKGDDQEAPPPPPDAKPPVVLTVDKSGVLRINREEVPRDQVVARLQRMLNARPDKIVFFDASDDVPYGAAMDVLDLARGGDITVGVLPDKLAD

SEQ ID NO: 12963 - protein, 124 aa, Myxococcus xanthus
MNVTPLVDVVLVLLIIFMVVTPQIESGAAVELPTATNPDKENKELTPTTVSLSATGAFFLDRKELKRDALMAELKAVRAKDPDSPVVLKADRGVRYSEVRGLFKAMQELGFPGINLQVVDKQKN

SEQ ID NO: 12964 - protein, 250 aa, Myxococcus xanthus
MNFNLRDIYNHMGVFALGIAWTLILFAVASLAVFFERLFVFFRSRSISKQFASRAGPLLTQHQHEALVKEAEATKGSHLAMLLGGGMKHFLAKSRVPAGKLGPVELTRRELVRINERVSADVRRGMSVLATVGSVAPFVGLLGTVVGIIEAFSGIAKEGSGGLGAVSAGIAEALVVTALGLLVAIPAVLMFNFLSTRADSLQLSLDAARSEFMDYLEDLGPQKPVATNGAAVATGPELAARKESRDVHPA

SEQ ID NO: 12965 - protein, 139 aa, Myxococcus xanthus
PSRALIINADDLGYDPAVTRGILRSMREGVVSSATFMVNTPFSEAAAREARGLSIGLHLNLARGAPVWSGFPRELLGEDGGFVEARAGSLPADAVEAESFAQLARLAGLLGLPATHVDVHKHLHLHAGVLEGLGPGGAK

SEQ ID NO: 12966 - protein, 172 aa, Myxococcus xanthus
DLVQVSLRGTGIRLADGATNVMPVPQHRVKQDEPLLPTERRENMEAVHRVWQVSYRHIRHSLERGWYQGWDLHPGQLPVRYAAVYAFFLEGLDAASRRLNAFMEKAAQATLVGDVFDDAATGQGLLNFFLRGLSCGALTQDEVLAAGLTLEELRSRSFRDIVASRRARATSG

SEQ ID NO: 12967 - protein, 297 aa, Myxococcus xanthus
MAPTEVTVVADAPVMFVDVDYEVVASGDSVSAGRLKLMVSASPELPLLCAHDEPGYARTFHRVTTGLAATLKVPGPARTPARTKALRVLKLDGRLAGFDWRTEQRLEGGSRRTEVSTSLLLPGATNGPHAEDRTITTVTDEEGRLKEQRHAHAEDGRLTLQVTLRREREPQPPTRAAPETAYRYEGRQGSRALKGTFTSKRGLATEDTVHDTVRDVLRPGGPAEAVLDVYRPADVPSAPTELVLRRVPSAGPRALTLTTGDATEEARAAESGTLEWTKRALPEGQLTSELIHGSPPP

SEQ ID NO: 12968 - protein, 253 aa, Myxococcus xanthus
MLKGAFKKPTLSFKTARLADASLSDATINLVYELNNPNGFGLNLAEVDYAFFVEGKQVVAGKPRSGLALKANGKSELVFPANVKFADIVPVLETFLKQDKAAFKAQGTLGVKTPLGVLSFPLAKEGTFEVPKVPQVSFQAPRIKDITLTGATVEFPLSITNRNSFPLPVAGITGALKVAGADVGTLSTGNLGKLDGSGTKQVTLPLTISFARAANAALALRSGGNAQVRLDGKLTSESQSVPLSLNQLVNFVK

SEQ ID NO: 12969 - protein, 130 aa, Myxococcus xanthus
MRRILFKSKIHRATVTQADLDYEGSVTIDRDLLRAADIVENEKVAVWNITQGTRLETYALEGEAGSGVICINGAAAHLNKPGDLVILATFAEVEEAEVANWKPTVVFVDKDNRVVPGQTKEIPGPQRRSA

SEQ ID NO: 12970 - protein, 147 aa, Myxococcus xanthus
MRRSWVSAGALSLVLTGCTGTGAFRPDPNNDDPLYGVIPVVKAPPQNRCAALGTSSARGSCDDALYLATEYTRRLSVGDEICLEGGYGEDPGSACKARAAIIDTSPNQVKLEVRGPKPDSRWFNVEMRHAWYEEGALVDLYLSERGY

SEQ ID NO: 12971 - protein, 210 aa, Myxococcus xanthus
MGLYDSVAERLAFMKKMTPAELKKLGSARLSDIVLQEVARSRVRITTLEKRYPQAAPRELAQRIVDEKKNLASMVGGVSGVFGLVALPADLLFMAYLQIILLTDVATLYKVNLKTERARGEMLDLFGYANGLGPLPRAGPKVLGKLAAMLLEKGGMQTLGRAMPLVAAPVTAYFNNQHIQMVGEQAVRFYEGFDKAHAKAKAQRKKASGA

SEQ ID NO: 12972 - protein, 152 aa, Myxococcus xanthus
MEVQAVWWLKAESLLPVNVLAERLGGIAPPRLSRLLDRLEAAQLVQRERSVRHDRRRVRVRLTEQGRALAEQADAVVQERMARLLLPLEGEQRSALMDLLEGWVEALGGKNRAPELTTEGGETDAPVADELEPAAAPRRTHTELMAITANAA

SEQ ID NO: 12973 - protein, 211 aa, Myxococcus xanthus
MGFAGLALACAVANWLHRPVELPYQAAEPEASTPLAQAPTPRPRSVAPGPSTPVAPAQPDARPITRPTSASEAERSARSRRTPPAQRLRLVTALRGTHPSPEARRDAVLAELTASGESHEPWTAQARAALAKWHAQVEADVLPVQAEPPRCFAAGCVARVTFPDSDSFQESFRRTADLRLGEGTTHMQLPPERRASGEVVAAWLVLRPATP

SEQ ID NO: 12974 - protein, 201 aa, Myxococcus xanthus
MKLEFPFKQSLLATSVAVLLVGCGTAVEEESPVAPEAAELESSEDALFSMLPACEEPEELEHVVEHACYHAEYGPFEPVTAAALGAPVLVDVSQAHTAYQVTLPQRSPFNYAGRVSFLPDESGEFAFILSRQRGLRIFEAATGTEVARECRYTVPTEVCSSLKTAYIADLEADTEYHLEFRSILPSNAAFTLIVEEAGHHH

SEQ ID NO: 12975 - protein, 215 aa, Myxococcus xanthus
MKHLMRPTLRVLFLTACAAAAVACGGDDDPAPIEPGDSCEPNGHIHREPSGDWCHCNKGYVAADDGLACVPDPNHVPGDGFDFGDDGEHACWHVTNGPFVTVNATTARHPRVDDFHTYYTVKLLPENSQYVGTFSYKAFATGNFVVYLSSPDVPVTLTETAISTTVPQAGAQATGGFCDGLKHMVGYELTDRVQYTLQLGPTSLPELNMVIEHVQ

SEQ ID NO: 12976 - protein, 237 aa, Myxococcus xanthus
MEGLTRLSTLADTEGFLAVYPRGLSTSEINHQGTDGPYRGWNAGACCGPAWTAKVDDVGFVDTLLADLDTRVCVDTRRTFATGLSNGGFFSYQLACRRASRFAAIAPVAGMEGATPCNPSRPVPVLHMHGTADPVIRYQGGNNLGIFGGAYPSAEESVRRWAERNGCTGPTVETYQQGDSTCTAATGCSPESATASLCTVQGGQHTWPGFTDFNHGGTPHLDATREAWKFFQARPRP

SEQ ID NO: 12977 - protein, 144 aa, Myxococcus xanthus
MDDTGQDFTSEQEQPLEATCASVDNTAMTTHACAHASNPGDNVNVNGVTGAPDISTQHKHYTVTLSGSGTGKVTYIPVARASAGSTVESVAFYATQNVTITAVDKSVTPNVTLTALVSTNGITEDTCTLHHARVFDSRSATPTS

SEQ ID NO: 12978 - protein, 56 aa, Myxococcus xanthus
MVPEYLYDNRGRYYRDADGDGYGANSPLYRFACEAPAGYVTQRFDCDDTNPAIFNC

SEQ ID NO: 12979 - protein, 321 aa, Myxococcus xanthus
MRTVATTTLLATCALLALAGCDNDDPVPPTPDAGTRPDAGTEPDAGTQPDAGSVQGPTVIGSTPSEGETNVLPVELFKADATTTGVRKLVTLTFDTPMDTTAADVTLVDRTTPANAPRTLTGTWTEDGLTLSVAIPRPESDLPPLEEETAYTLELGALRGAEGHAVDTSHAGLGDGRLDFTTGRRDGTTEHACAHALLESPVPVTASASPTIYPATDTSHEFYGLTLPASGTSFLGYTEVVSGESRDEPVILYLNHPIPVAVHDTTEGEDAIATALEPARPVCLPAITHTLKFTAPGGDRFLRLTFGPTERETFTFVFERY

SEQ ID NO: 12980 - protein, 771 aa, Myxococcus xanthus
MTPGASNIRSDAERRGTSASCPTGMWKSPTATGGGAWEAPRTVVEKNGGCCATLPGVLTSENPTSHISPSFARTRNGPPAHPPLSGRADSPDSTSGFPWLRESDAGAPPGAPEAPVTMTVENAPQRETHAFQAEINQLLSLVINSLYSHKEIFLRELVSNASDALDKLRFRAITEPELLADEPALELRLIPDEAKGTLTIEDTGIGMSHDELVKNLGTIAHSGSREFIEALAQKGQQKDMQLIGQFGVGFYSAYLVADRVEVVSRAAGQGQSAWRWTSEAKGSFTVEPAERAARGTSITLHLKEDQKEFLGEWRLRSLITQYSDYVGHPIKLQVSKTTGTGDEAKTETSLEVVNKASALWQRSKSEITDEQYQEFYKHLTHDWEAPLAWTHFKADGNTQFTGLLFVPKQPPFDLDAQQQRGVRLFVKRVFIMDRCEELVPQWLRFVRGVIDSDDLPLNVSRELLQDSQVVRAIRKHVVKKSVDLLEKLAKDKPDDYLTFWKAFGTVLKEGLATEAEQKDKLGGLLRYESSREEGLTSLADYVGRMKEGQEAIYYVYGESRKAVADSPHLEALKQRGFEVLYMTDPVDEWAAQGLREFQGKPLVSALQADLKLQSTDEQKKEQEQHAEGLKTLTSKMKDVLQESVREVRVSDRLTDSPVCLVVPEGGSPAYLERLLQQRGRGAGMPRVKRILEVNPKHPVIEHLKAVHDRDPAAAQVAEWIELLHDQALLTEGSTIADPNRFARRMTGLLTQVAALAAAPAPAQTPASATAS

SEQ ID NO: 12981 - protein, 372 aa, Myxococcus xanthus
MGQLDTAVQQAQQGQYAEAASLMDRALQLSPAPEVRTHAEDVRRIITTQGRAQADRYLHEGNFIAAHELAQLVLSLDASASAWAQNIAAEYEHFITEEVERLSREGDAARAQRDWGRAQQSYGAALSLRQGGRAAPLEAYVRHMALADQRIAGRDWNGAADAYHVALRTGQDDGYANHQLERVQLRPYRVVLRSVLVTPGRPDGRAWVGASNDIFTRLANRLTQTARQRGMTDLVKDLAMSIPHENRPRLRIEVHHPDGMHLTTQGRDGIYTAYDAEFVAVANAFDDRRVGFQVYMDGPNGSELLGSVDVPMRELVEHREVSLEGRSVIALMLSTGGDGRQPGPYAGMAHVLPPPPPGTPPPGRGHAATPIP

SEQ ID NO: 12982 - protein, 340 aa, Myxococcus xanthus
MLVPAGLYLLLADTPDTRSGWGVPMATDIAFAVGILTLLGSRVPPALRVLLLALAVIDDLGAIIVIAVFYSSGVAITGLLVAALGIVGVFAMQRFGVRSKWAYIVPAFVAWAGVYSAGIHPTIAGVIIGLITPVRTWLGPEGFVTGARTELEHIAQAQPGELSSHHLSETLRRVDAARREAMSPSESLIATLHPWVAFGIMPVFALANAGVPISSEPLDAASWTVALATATGLLVGKPLGVIGACWLALRLRLATLPKGLGMRELLVLGSTAGIGFTMALFIAQLAFTETKLLAAGKLGVLAASGAAAVVALVLGRWLLTTSARPGAARSVDEAERSTAL

SEQ ID NO: 12983 - protein, 140 aa, Myxococcus xanthus
MPEVERRYRVTQERAIIGESLAGYFIVETFFLQPELFGTYLALSPSLWWNAESLVKGAGEWFAARPDLRAGLYVSSANETGDIVPAVARLQDVLRTSAPAGLKWEVEPRPDLRHDNIYRESSPSVLRKWLPPVVAAERAP

SEQ ID NO: 12984 - protein, 341 aa, Myxococcus xanthus
MLIVMRPDATAQDIERVNDEIRRRGWQPHAIPGGTRTAVGITGNPGAVEPEPFRVLPGVADAVAISQPFKLVSREVKPDDTQLRIGDLTIGGSAFHVIAGPCSVESREQILSTAHAVKKAGATMLRGGAFKPRTSPYEFQGLKGDGLALLAEARQETGLLVTTEVKDTATLQAVADTTDILQIGARNMQNFSLLEAVGDLRKPVMLKRGMSATIKELLMAAEYIVARGNTQVILCERGIRTFETMTRNTLDLNAVPMLKALSHLPVFVDPSHGIGVRKAVPAMMRAATAVGADGIIVEVHPDPPRAKSDGAQSLDFSEFEKSMNEVRAIAQAMGREVVRLG

SEQ ID NO: 12985 - protein, 677 aa, Myxococcus xanthus
MAEVYLGRRIEDDGSRGPSVAVKRLMPHLASDRRVVQMFLNEARITAQVRHPNVVTIIELGMEGTEPFIAMELLEGRSFAELRQEAAEHGHRVPLGITLRVLVEACRGLDAAHRAVDEAGRPLRIVHRDFTPDNIHVGVNGAVKVIDFGIAKADALGSGTEPGILKGKFFYMSPEMIAGKPVDHRADLFAAGVMLYEQLCGRRPFTGLSADEVLGRIAEGRPKPPTAFDPSVPTALELVCLTALAREPAARFDSLEDFIAAIESIGGAAEMATPEQLAAYVDSLFPPDRDPKRLALRRARLADPSHGSTPAPHTRPILGVVDAPTAWPQVSRTTNPDAATVAGATRKAPTGTAASTAQDEHAPSRRRSRMVPLIAGVLALGAVGAGATWFLTRPAAPPAERLARAESASTADAKAAALEGLASDDRASAEELSRAGALLLEAGAHAQALALADGFVARFPKDIEAHLIAARAATELRLGKRAERALEEATALAPKDLRPPLALAELRERQGDIPGALAALATVHARKPGSSEVTPRYGLLLSQSGRLDEAASVLSAWTRSHDDAASLAELGFVRFRQQRVDEAATLLKRAIRKAPKLAVAHYYLGAVLFRQGDTAGAERAYVEADRLSPEDPRALASRCQLHAHTGNTAGVTEVKRALSERFPTRAEALAAECVAVK

SEQ ID NO: 12986 - protein, 338 aa, Myxococcus xanthus
MTLKEALGKVVGRRDLTREEMTRIMGLMLAGEASPAQVGALATALKMKGETEDEILGAAEAMRACAAKLSPRADVVLDTCGTGGDGAHTFNISTAVAFVAAGAGVTVAKHGNRAVSSRCGSADVLAALGVSMERPHERVARDIDEHGVGFLFAPSHHGALRHVAQARRDMGFHSVFNLLGPLTNPAGARYQLLGTFDGKRVEQTARVLGRLGSRRAWVVHGHDGLDEISPCSATQVAELREDGTVHTFTVSPQDAGLDVVPREAIAGGDAEENAQRLRALLDGERSGLRTAVLLNAAAALVVVGLAADLRDGVRKAEQAIDSGAARNKLSALIEGGLS

SEQ ID NO: 12987 - protein, 262 aa, Myxococcus xanthus
MSTTGTLDRIMARKRQELEARPPMAPRPRPTPRDFAQGLVTHRSGRRVSVIAEVKRKSPSGGDFPHADVVAVARAYEAAGASAISVLTDGPDFGGSLEDLVAVRAAVSLPVLRKDFLVAAREVEESAQWGADAVLLIADALEDGELREMVATAKAVGVAALVEAHTEAHAERALAAGAKLVGINNRNLATLKTDTGTALRVMPNLRSRARVLVAESGLKSLADLVAAQEAGADAVLVGESLLREPDPGHALRRLLGVKDAAP

SEQ ID NO: 12988 - protein, 212 aa, Myxococcus xanthus
MSVRVKVCGVTRLSDAVAAWEAGVDALGLNFYPKSPRYLDLPTAAALARTRPPLGTVLGVFVNAAPDTIRETVRACGLTAVQLHGDEPPEACSGYGVPVIKALRVTGPEDVVRARTYVGVGDVAGLLLDGAAPGYGGGGVGFDWSLVAGLAGSGVPVLVAGGLRPSNVAEAVRATRPYGVDVASGVESAPGIKDVEAVRAFVRAAKSINLWE

SEQ ID NO: 12989 - protein, 401 aa, Myxococcus xanthus
MTTETAAGRFGRYGGRYVPETLVPALQELEEAYATASADPAFGEEVARVLREYVGRPTTLTPARRLTEAWGGANVWLKREDLAHTGAHKINNTVGQVLLAKRMGKKRIIAETGAGQHGVATATACALFGLPCEVYMGALDVERQALNVFRMRALGAVVRPVESGSRTLKDAMNEAMRTWVSQVSDTHYVIGSAAGPHPYPTVVRDFQTVIGRELRTQAQAAFGGLPDAIIACVGGGSNAIGVLHPFIGDASVRLVGVEAGGHGLDTKQHGASLTLGTEGVLHGSRSLVLQDEDGQIQEAHSISAGLDYPGVGPELAHLAKTGRMEVRIATDDEALAAFYEVARLEGILPALETSHAFARGRELARELGAGKHLVINCSGRGDKDVATISARGVPPPVGVKA

SEQ ID NO: 12990 - protein, 162 aa, Myxococcus xanthus
MTYVNLIMAMGEARYAKLARERGVSGTILPDLPPEESASLRATFDAEGMDLIPLCAPTTPPARAQAIAKDGRGFVYCVSVSGVTGMRAELPPDLSQRLDLVRKAATVPVVAGFGISTAEQARMLSAHADGVVVGSALVRAAHTEGLEAAKALCADIKRGLRR

SEQ ID NO: 12991 - protein, 1416 aa, Myxococcus xanthus
MDGTLSWPDPSLPPPTDQVLLATLEVSALAAGHCETRAFTGSATLPGPQTDGIYYLGAITDVHQTLVELDEANNTAVTALGIGNRPDLVVTELRGPTSVTDSGTVASTLKVCNQGTNVSDDTIVELYLSTNGTLSLPTTGGPPPTNQASQGTVEVPELLPAHCAIRHASFPVILPPGATPGQPLYLGAIADTPEFSTELNEDNNVFVGDLVAMGAGPDLVVTSVHAPTSIQSGDLLGASVRVCNHGTLPANPSSLELYLSVDGNVTVPGSGSPPPPGQERVGQTDVPLLNPGICITRNVQGAATFPAGAPVDGALFLAAIIDSTQDIPELREDNNAFTQGLIGAGARPDLVVTAVRAPASVAPSASWAPVSVTVCNEGTVAASAVPVDIYLSMVPTLDSPAMGGLLHGTQFKVGGFGLSSVEAGRCVTREEPITLDRPLGAPPQLQAFYVGAIVDPRSNIVELREDNNAFVGEQMGLGNGPDLAITSVKGPASSMPGDVPVTARICNQGTVASQNTQVEFYLAAHAFLNAPIQGGSPYNADPHTAFSIGMHQVPSLDAGECRTISTLATAMSFPAEYIDKAFNLGAIIDPYAQDNELREDNNTFVGDFMGLGHRPDLVVTAIDAPASVRDSILFATTLTVCNQGTYSSEPTMAQVYLSTEPHLVLPDWSGHGTPLPWSQTPVGDVSIPTLHVGHCFTGQVTGAAYIPPGSHGEAIYLGAIIDANDSIEELREENNAFVRGRIGVGSKADLVVTAINAPTSARIHSAFTATVTVCNQGTDYASSSDLELHFSTLPTLEMPRWFGSGSPLPVTQAPIGNISVPHLDAGHCISQSIQASTELPPDALFAQPLYLGAIINGWGNVDELREDNNTFVSGIIGVGDGPDLVITAVQAPPNVGPFATFHPTVTVCNQGTEPSNSTLVEFHLSTEEALVMPRWSGPGNPLPPTQQPIGELSVPLLNPGRCFTGSAVATLTLPPATSPDQKLYLGALVDGMQSQEELREDNNIFMSGRMGVGHASDLVITSLTGPASVEANTAFTATVTVCNQGTSESYPTELEVHLSTDASMAMPEWYGPGIPIPASQVYAGEFGVPALGIDDCITLQVPSWSNLPVLAQPEQPLYLGAAINPDLLAGELREDNNTFVGDIMGVGAGPDLIVTAVQAPVSVERNGNFTASVTVCNQGTQASGSVQLDLYFSTRAQVVMPQWNAPGFPYPRTQALIGAWNVQPLNPGQCTTEPVLAWVELPEEAEPHHPLYLGAIIDSNQAQAELREDNNIFVSGLMGVGNQPDLVVTSVSGPNSVRTGTTFTATVQVCNHGTAPTNGSMDVALYLSSNNTLEFPYQSWPGVPPDSQSQIGVMTVQSLHAGQCVTRNTQVTVNTPPDSGPTGFFYLGALVDPWQNLEELREDNNVLADRFIAVMP

SEQ ID NO: 12992 - protein, 209 aa, Myxococcus xanthus
MSAAVFTRDGELFLYGTSGPDTHRVSGFHAVDVTTGNLTRLLTRPVPQLANGAMCGVYSWGSPRPQPTTRDRGFFGASESALLECLAYGPISLGALGEVSTLPGALGILWANPAIAANNTRRTALESLKVRTAREALTAVCNERVFNTRAPALSALENPASLEPGRVEELRQRLERHNHSGKRTAIPLRKRIFAVDPLRAMERAEEPRF

SEQ ID NO: 12993 - protein, 147 aa, Myxococcus xanthus
MRALGDPVLDAFEIRLQGQDAAQYEKVLLGMGQVEVTSFGEPVRFEPSPNARAMDLSDADHAHLLGRFFLPRNVKQVDITVRLDDVGAFKEDSLAGLINAQAGTIQFSTTRSALEQRSRVVIHLHLKDSLFDGRGGKTLLPATYIAH

SEQ ID NO: 12994 - protein, 160 aa, Myxococcus xanthus
MGRLLGAPLKAWRFDTVYTSPLSRAADTCALAGYGDYAQLREDLMEWDYGDYEGRTGAEIRAERPDWTIWKNGVPNGETAAQVATRVDSVISDALRTDGDVLIFAHGHLLRVLAARWLGLPPWEGRLFLLSTASISVLGHDGDRRRPAIVSWNDTTHLRA

SEQ ID NO: 12995 - protein, 328 aa, Myxococcus xanthus
MTVTPQGLYCVPGGFHVDPWRPVDRALITHAHGDHARSGSHRYLGARAGKGLLHRRLGADATIDTLDYGERLRINGVTVSFHPAGHVLGSAQLRVEHGGETWVVSGDYKRAPDPTCTPFEVVPCHTFITEATFGLPIFRWDATEQVAEDILRWWDTNRALGRAAVLFCYALGKAQRLLAELAKLTDRTVFVHGALHSLVDVYRNAGVRMLPTHRVSEVEKGTSFAGALVLAPPSASGTTWMRRFGEHETGFASGWMRVRGNRRRRGFDRGFVLSDHADWPDLLRTVKDTRAERVLVTHGYAEPLAHYLREQGVDAAPLATPFEGEAED

SEQ ID NO: 12996 - protein, 275 aa, Myxococcus xanthus
MAVRMPALVGWGMGLLAVHSTRHAHPLTVHGSPAEPRTRGGQRRPSASMGGLPHRAPSLHDTRWMERRGPIQAPPHPSARLSRYPPSPPGRRTPEGSCWEHERPSMEILRATPSEHTLLRNLYPLYLHDLSEFGVDYAMDEQGRWRPDFLPTWLIPAPEVHPLLLRWEGRVVGFAFVGQSPFSYMTPGRDFRMSEFFILRNERRIGLGRLAARAVFDLFPGIWELSQLPRNRPAIAFWRRVIDEYTGGAFEDTFIDGCPAQVFDSRQRVAPAQRR

SEQ ID NO: 12997 - protein, 398 aa, Myxococcus xanthus
MPRRELFLLNKMLTGELRVGVSSTLVVRAVAQVAGLPAPSVAHRLMGTWTPSPTFFRQLVSQDVSDSDSSRPYPFYLASPLEQPPGDLGDRAEWQVEWKWDGIRGQLIHRKGSVHLWSRGEELITERFPEIADAAAALPEGTVLDGEVLAYADGRPLPFAQLQRRIGRQKLTPKVLAEAPAAYLAYDMLELGGEDLRSQPLRVRRAKLEALLEDVPRLPVSPVVQAATWEDLATARGEARERNVEGFMLKRLESPYLTGRKRGDWWKWKIDPFTVDAVLLYAHPGHGRRSSLYTDYTFAVWNGTELQPVTKAYSGLTDAEIGRLDRWIRAHTREKYGPVRSVEPEQVFELHFEGIQSSPRHKSGVALRFPRIARWRTDKKPQDADTLDSLKELLHASG

SEQ ID NO: 12998 - protein, 103 aa, Myxococcus xanthus
AAAKDALLRREVEARTPPDKPLDVLAQHLVTCALGGGFTPDALRDEVRTAAAFAGLTDEEFAWTLSLVREGSPTLRAYPEFRRVVEHEGRCVVADARVARMHR

SEQ ID NO: 12999 - protein, 192 aa, Myxococcus xanthus
MMVAGGPPALTVVAPVEGDGLVNVTMKSNGLLTFGSLEAGGKRFRLDGGVGGMDYTQGYLARHTAWRWAFASGRLADGTPVGINLVEGFNEGNADANENALWLGDKLYPLARARFEYDAKDLMAPWRLATVDGAVDLRFQPLHVHREDRNLRLVVSHFAQPVGFFNGTVRVGSRTLELSNVPGVTEDQDMLW

SEQ ID NO: 13000 - protein, 353 aa, Myxococcus xanthus
MVMFNLLASWYRQDRPLALPVVGREHAPSLMAFLERYGAQLEAAPEDYESRIRAGSLDAVLVVPDDYAESYSAGRTAEVQLVVDSSRQSARQSVLRARRLLEAYAHMLGNQRLYARGVSPDLAIPVRVQEADLSTPERTAAGLLNMVPLFLVIAAFAGGMQVASDAMAGERERGSLEPLLLNPAPRRAVVTGKWLATVVMAVAAVLITLVGYMLVVRRVPLEDLGVKARFDAPAALGMAAAVLPLALAASAVQVWVSTYARSFKEAQTYLSLLMVVPMLPGMVLALSPLQPKMWMFAVPVLGQEVLAGEVMRGEPLGALPFLIAGASSILLTVLSLAVTARLLSQERIVFGRG

SEQ ID NO: 13001 - protein, 245 aa, Myxococcus xanthus
MIEARNLHKRFGKKVTAVEDVSFTAEDGVITGLLGPNGAGKTTTMRMLYTLVRPDRGTALVDGVDVVQRPQEARRALGVLPDARGLYPRLTAREHARYYGELHGLSGAALDKRVDELLDLLDMRDIADRRTEGFSQGQRVKVALARALVHGPRNVLLDEPTNGLDVMSTRSVRTLLRRLKDEGRCVVFSSHVMQEVAALCDRIVVVAHGRVVADGTPDALRASTGKDSLEEAFVATIGTDQGLMQ

SEQ ID NO: 13002 - protein, 387 aa, Myxococcus xanthus
MAVERIRRKRDIVLVDQRGTGDSNPLNCKTDSPEEGLSARLEEGKAAEEVRKCREGWDADVRHYTTPVAMDDLDEVREALGYEKLNLWGVSYGTRAALVYMRQHPERVRTAILDGVAPMGLYLPLFAPRDAQQALDRLLANCEADAACTQAYPNLRPRTEALLTTLETTPARTQVAHPRTGVLEEVVLSRRAFLAQLFAQLYSPEMSSLVPLMLDRATQGDWSPFVALSVGLSENLGRTVSHGLYFAVVCAEDAPFYDEAALVRESQGTWFGPTMGREVLSVCADWPRGSLPQGYREPVVSSVPTLLLSGELDPVTPPAWAEEAKRTLSNSLHVVVPGVGHNTIGADCARTLMLDLLTQGSVEGLSSACGTNLTRPPFFTSFAGPVP

SEQ ID NO: 13003 - protein, 434 aa, Myxococcus xanthus
MLVPVAPLYRVVAWAADGTFWLGDVVPEEGATTGIVEAVLSARAPTGVRVRLAGARPEHGPFSLRVVRGVSRDARDAERASELLPVIRHAAPDIASALADGTALPLPVGKSLELLPLPTDPAVGLVLRSAAGRESAWVEVPLREGRVEPAVLDVGSLFPDGVGEAVTLRGKLELEGTFRPPEGARLLGPGDVEIPLAQDGRFVVSGLPSWEPSRFRVEVASPVSRRPVAATEQAFDFRPEPGVRDAEVTWRVKAYRWLVLRMDGAMRAQIEARTQKPYPVFVLQRWHHEKQWELASSGAYIQEEDGMAVSILEPGRYRLLVSFSVHEVYASTAADMGEDRVDGTVTFQVDMEGNDCEVLVTDGRKPVFGARVTASSDVSSLPPAWGLTDAQGRWRLGRVRPFGLHLEVEAEGYAPWTGEVAEACRRGGEVRVQL

SEQ ID NO: 13004 - protein, 287 aa, Myxococcus xanthus
MGFPSFLLRVVVLAVLAVPTWAQAGSYLRVVSWNLRHEGWTAEQTYREDAEQIWRQYGANSNSNNGCDLVFLQEVMNASVVPAIVAELNAVSGVKWRYAQTPLIGRSSYKEIYAVLYREDTVSLLSSSVYEDTGDTFEREPQIVRVRHTPTGADYTFINWHTVWGNPSDRDAEVKQIGAVFKSVQDASRTDQDVILVGDHNMACTTASWANLVALSPTVECKLNVATTINLSGGYVNAYDHFWMQPEYVTEFSSAGRDYIGNTRDFVTRLADHAPIYLTLYSTSDTD

SEQ ID NO: 13005 - protein, 337 aa, Myxococcus xanthus
MMSVPTLLIGLLPTYETAGYAAPLALLLLRAVQGAAVGGEVPGAWVFVSEHVPTRRVGLACGTLTAGLTFGILLGSLVATAVNSLLGPEQVNAYGWRAPFLIGGVFGFLAVFLRRWLAETPVFEELRRRKALVRELPLKAVLRGHGGTVVMSMLLTWVLTAGIVVVILMTPTLMQTLHAITATQALVASSVATLSLTFGCVAYGLLADRVGVGPSLGLGCALMLSATYALYLGASSPEALVPLSALAGFCVGVVGVVPTSIVRAFPAAVRFSGLSFSYNMAYAIFGGLTPLVVTLMMKASPLAPAHYVAAVSVMGVGIALHLLRAGRGAALHPATER

SEQ ID NO: 13006 - protein, 103 aa, Myxococcus xanthus
MTAIEALEPGRVLAFQAHDLQSLEASHPCWAQLARRVAERHYILKERREQEFLDLSAEERLERFWQEHPHLHGRVPQRDVAAYLGITEVALSRIVSRRRKRAE

SEQ ID NO: 13007 - protein, 376 aa, Myxococcus xanthus
SQGVMGESAMLRHVPYELVSGGEVLAYAGLGIACGLLAFTFVQLLHGVEHYFHGHGKDRLSSWLGSKPLPLRAGLGGLCTGILAFASPTVWGSGHDYINLAALGRLPFLFLITACLLKLVATALTIGSGGSGGTFFPAALIGAMAGGAFGTLVHFFFPESTGPSGAYALVGMGGAVAALTRGPLTGMMMLYELSGNHDIILPLMVTCTIASALCHYLTERKTPKVQSDTDLLEATPVRSLMAHLTPVPAGTPLRALTDLLLTSEAGTLPVLDTVGRIYGTVQVEQLREVWRDESVYPLLVASDLARKLPALSPDANLSHALHVMDQEDVDALPVSVPVGSPTCGLLTRAAVRRFLFAQHAQAHASGNYPVSPTEAS

SEQ ID NO: 13008 - protein, 208 aa, Myxococcus xanthus
MVLGPIYIFENASPLEPTASAPRVLQRLGQWLLPTAHAHDGHFFSGGTVLGEWDREVVFDLLEEAGEVRELGRSPGIAGLARSFSLLLQPPSRALGAEGAALGGRSMILEGTASRQETHVPFRMALDFPPPVELQRVDFVPIAAELDEGGRFVVEVQPHRWFDGAHFDRVTVPEGGGVVDLTPDTQVYRALTLNVRRYTAFAGTWEPA

SEQ ID NO: 13009 - protein, 654 aa, Myxococcus xanthus
MLLAPGVMLANHGGEGHAESIYIRGFDAGEGKDVELRLNGVPLNEVSHAHGHGYADTYFIIPELVESLRVTEGPYDPSQGDFGVAGTVEYQLGLARRGLTASLSTGSYAARRLSLLWGPPEASEATFVGLLLRQGHGFGPNRSYANAGIMAQVELRVGDESRLRLFGTSYGSRFASPGVVRETDVVDSRMPCAPDSDSQFFCSYDPNQGGAGQRHILSAELQSRLKRGGRFVQQGYVILRQTRIRDNFTGFLLDTTPPDGERQRGDNTEGYYRGSTMGLRGRYTPGLTLLGQPQPLELGYVARYDDVRTRSRRLRDSGGVPYATVFDNQVRTTNLGAYASLRAAPVSWLTLRGGVRLDTFLFGVDDHNRPTEDRDGPRLPDESLEAYGFFASPRASAEIRLTPRLTWLTSAGLGARSSDAAALSDAELAPYARVASGETGLGWRLDGPLALEARGAFFATRVSQDFVFDETVGRNQPVGASQRLGAFVSARGTLRDQVDIQASLAWARATLPVSGASAWKLWDGTVMPYIPELLGRVDASLRGTTLVAGQQVDWNVALGHSAIGPRPLPLDRYSAPIFLFDVGTRARWKAVEVGLSVENLLDTRWRESEFNYVSNFRGPDAPPSLMATRHFTAGAPRTFMGTLTLHLDLQEDSP

SEQ ID NO: 13010 - protein, 431 aa, Myxococcus xanthus
MTTLLQRQTTSLIDAAERVRAAAELEFTLLLLQYAHEVEGIGPTDIGPPVGVDALVREVPERLAHVEMYTETEAERGLVAASRASVEAYLNAPEPDRRRRLAQAVDATRAVMDSSIARARMARDEATAVRRTGRLLGTLLAVSVLTGVVLFLAIAQTSIYRPLVAIRRALSAFKSGRRESRVARAGPPELQEIGAEFNDMAETVASQDARQLQFLAGVAHDLRTPLNALKLSAQMLLRAKTAPPPEKVRDSLVRISNQVDRLERMVGDLLDRTRIEAGNLELRLEECDLRALVEEVVELHRPSSEHHRLEYSVPDSPVPWRCDSTRLSQVLTNLVSNAIKYSPEGGVVSLRLESSERDVSVSVTDEGVGIPPDDLGTLFEPFKRSRTAAKDIPGVGLGLSVSRRIARAHGGDIEVESVVGTGSTFRLRLPR

SEQ ID NO: 13011 - protein, 139 aa, Myxococcus xanthus
MKVSRPRKLFLNLPVADLKRSVDFFTKLGFEFNKDFTDEHATCMVVGEDAFVMLLTHTRFKDFIKKPLHDATQSTAGTYALSANSREDVDEMVKTALANGGSPAADAMDMGFMYGGSFYDPDGHHWEVAWMDPNQMPPQ

SEQ ID NO: 13012 - protein, 325 aa, Myxococcus xanthus
MKDLPDSGKQAFGFEAHRSALMGHCYRMLGSVSEADDAVQETMVRAWRARDRFEGRASPRTWLYSIATRVCLDALSASGRRARPMELGPAYSIDGPLTPLPANSWIEPIPDALAVPSDVDPSEQASLRQSIRLAFLAALQHLPPKQRAVLLLAEVLGWPATEIAETLETSVASVNSALQRARVTVSDLRLEDSEFRVPQSDAQVALLNRYVDAFERYDMDAFTAILHEEVTLSMPPYTLWLQGHASIRGWFLGRGAVCRDSRLVRTEACGSPAYGQYHASSDGGPFKPWSLIVLELSGGRIAAMTHFLDTEALFPRFGLPQELPR

SEQ ID NO: 13013 - protein, 197 aa, Myxococcus xanthus
MRAPVADVWGHRVRLADGELIGARAVVVATDPASAVELLPGMVPPVMNRVTCLYFAAPEPPVEGPWLLLNGEGRGRVNNVAVMSEVSPAYAPRGQALVSVSVVGATPDLATLQAEVLAELTDWFGPAVSAWRHLRTYAIPLALPAQPPEVLEPPRRPVRLSPGLFVCGDHRDNASIDGALVSGRRAAEAVLRELERE

SEQ ID NO: 13014 - protein, 37 aa, Myxococcus xanthus
MALRHRERPVVGVQFHPESVLTPEGPALVRNFLEGRL

SEQ ID NO: 13015 - protein, 374 aa, Myxococcus xanthus
MGYNCFSWLEPSVPDRHPSDISFPDSEWLVCEDFVTHDTRTGTLKATAIARPSLHGSVAAALKDAEGRAQAMADRLLKPLPPEAYAPEPRMRGDAAPTACWDRAGYESAVAQAQEYIRAGDIFQVVLARRFESRGAPPPLSLYRALRRVNPSPYLFLVELGEARALVGASPELLVQVRDGDVVVRPIAGTRRRGASEAEDLALEKELLADEKELAEHIMLVDLGRNDVGRVAAPGSVRVEDMMLIERYSHVMHIVSQVRGKLDAKYDALDALASTFPAGTVSGAPKIRAMQIIDELEVQRRGPYSGAVGYLSFCGTLDVAIALRTFFVDGDRTMWTSGAGVVADSVPSKEADETEAKAGAMAAALRLAREGGGR

SEQ ID NO: 13016 - protein, 406 aa, Myxococcus xanthus
CSKAASALRQWMEDGREKYGIAYQKFICTSADNLGYYAPWRLAPTLRFKPWQTLYRQLDGFFHDDRVTYALAYPSKYLGLHPTTCSSVFSVIPFLELAFGVWHVEGGFRELSRGMMRCARDLGATFRMGTPVEKVRVDAGRAVGVKLVGGEVLDADAVVVNADLAYAARSLIPAEAREGSRLTDAALERAKYSCSTFMAYYGLDTVYADLPHHLIYLSESARRTDRDALEDRHVDLEDPPFYVCNPGVTDPSGAPAGHSTLYVLVPTPNTGRPVDWVKTEQALRERIPAMLEKVGLKGVREHIREERYFTAETWRDDFNVFRGAVFNLSHTWLQLGPLRPKVKNRDIEGLYFVGGGTHPGSGLLTIMESANIAADYLTREAGKGPLPGWPYVPPLEPESPVQARAG

SEQ ID NO: 13017 - protein, 284 aa, Myxococcus xanthus
MPFFIPFAVGGLVLTALGLGVRKVLTETGVTTPGDARLAEARERHRGAVAALRADRLQVRDGVATHGALQARVHVEVLVPFGALLERLERWGHVQEAELLEPEALEALRALLRESPSRATRRNWPLLGAGAEVPAALESVLAWLDRGWLDEDSPPVVLDGTPLYAVISARAILAGSAPEEGARALDEASALLARTTAFLGALRVRLTALEQRVAGLHGRASAQLAYLDAASFEAGGEEPRERLTRLAVLVGQLAVLLRTPVLNSEGRLTPMLAARAEDDAPSNG

SEQ ID NO: 13018 - protein, 167 aa, Myxococcus xanthus
MAKTKLLKQGDAVPDITLTGAGGQSVRLRDLVGQKVLVVYFYPKDDSPGCTAQACGLRDQYEDFVAAGAEVVGISGDSVGSHEGFAAKHRLPFKLLSDARGEAREAFGVSSSFLGLLPGRVTFVVDRSGIVRDSFESQIRVGEHVRRALELVRALAQEGGAPASAAK

SEQ ID NO: 13019 - protein, 63 aa, Myxococcus xanthus
MGEWTDKAKGKVKEVAGVASGDRELEAEGKRDSAKGAIKGKIEDAKRAIKDAVDSDKPRRGEP

SEQ ID NO: 13020 - protein, 439 aa, Myxococcus xanthus
MLHRESISSPKDWMAGAQASAQLFEEKPVLGGQMVSSRHNNLITAGTQLDTALRNLGKPLFAGLHARYQGGWAWMKVLIEQAESDWRHSPARGLHGIDLWGGPDQEPAAHYLKLGEKPIVPCGGGQWGDYNGDGAPDYLGVDPARWNHDVLRPLLIADNMNVDHATIDLCGEGSWQLYSEVFTGLGGLYNRTYHLVSTVYVRYTYWDTATNAWKSERVFTHRFTGGESLGVFVREQDRPTYNPNNTRNPQEWMAKRWGHVSQNIASFDYAGANDFRAAVRTRMVDVLKEQQRQFYGSIATRMGQAGDALQVQAKRMTGTRLLWQSYAALALPLSLDHDEHLRGLLYGEDAVLSGHDTPQDVEVTPVLNDVMDMYALFSATASPPAHNILADLHPAVTSRADRLKAAIDASLDAQAEAGGPEASAWVESTLLRLRLSVPQ

SEQ ID NO: 13021 - protein, 357 aa, Myxococcus xanthus
MTPGAARPSTERRSDRLPPGGCKVPPSPLHAYSQGESGGREGGMEMRPSQLSRTAVPLLPPGLARGQRGVSRLVLGTDFSLRSEFALARALRLPLAHGSVFCVLHVAPVLDGQEGPGGTLSGARCLRKAVSSVCRRLRNRVDIDVREELGRGDPVEVASAVARMSGAELVVLGRPHVTYPVRALAEDSTVRRMVRHLGVSVLVVVPHPVRPYGRPLVAVDFSRESRRALELTLRLCPAPALVDVLHVVDTAAQEAELRRAHAPAERWLLLRQEREYQARVALGRFLAPYREAGRELEVRVRCGEPAEEGILAEALERGSDLLALAMSAVEARTPLTEQVLARAGCDVLVSRHLSPAS

SEQ ID NO: 13022 - protein, 523 aa, Myxococcus xanthus
MLGSAVVDRGLTLTRELLRANLGNLLNERILQKALALELRHFEDSATYDKMQNARREANSRPLSLVTQAFSIVRNTITLGTFAALLVALSPWSVVVLVAASVPAFIAEARLAMAGFRLYSWRAPEGRKLNYLEWILTRDSHVKEVKLFGLGPLVLGRYRTLFQKFFAEDRALAFRRMAWGLGLGVLSLGAFYGCYLLVAGRAASGTITVGDMVLYLSVFRQGQAAFQGILTSVGSMYEDALFMSNLFAYLDIPTGGEATRVLPPLSPPRGHDSAIELRDVSFRYPGKDAWALKNVSLSLKPGQKLALVGENGAGKSTLVKLLLRLYEPVDGDIFYGGVNLKDMDVEDLRNRFGAVFQDFVRYQFNVAENIGLGHVPALEDRGRIEKAAEEGGASGVITALPQQYDTMLGGWFEKGQELSAGQWQKLAVARAFMRDDAEVLILDEPTASIDAEAEHALFERFQALAADRIAIVISHRFSTVRMADQIAVLHNGQVDELGSHDELMAKDGRYAHLFRLQARGYQD

SEQ ID NO: 13023 - protein, 648 aa, Myxococcus xanthus
MKKADSLLDEMPPQLDQAIPLLREVVAAEPEHLLGLHSLSWCLDPTRSMEPHRWEQELKAEHWRLRDRILELTRGTKPGGALTLAHRARSLALSQWAEDLVRRKPTVAQLDEVEAALNEANSLRELVNHQRGRRGLEAWHALTQGKPEQGYRELLAKVEESPGMCAQGVMDDDDSLNFQGLEGAYSDEGFLAWLRKQKPAARPAGKKGKDLDAGLLLAAGLDAKPFFGPGFEGNSRMGRVLALVALGADLKARDSSKHSVLHLAAMVDDAALVKELLRLGVAADVVDSNKSTPLHVAAEHGSVSCIAALAKGGVPVDALDTSGRTALFEARQADVAQALIDAGANPNAGKGWTPLHQHARFKERGPVIEVLLKAGADVSLKNGSGQTPAQEALEHKNASLAQLMGAKASSGKAGALDVQPLLDALARQRKTLLKAWYFEDKNVDGVEQVLKGLALQGATSWDQLAASLQGELPWTAMAVVQLARDVLPAEEKAPRLSKLPRFVRGDLVVKGDVHVDGPLLVTGDLTVEGVLRNAGMEGMLVVGGTLRATGVDTDGEVVVGEDLEAQVVWGHGNDASLRVGRVLKADVVIADDHDIQAKVKAKHHYENGEFDASDAVLKKVFVAKAFAKSELDRDKLFNVLRKVGAVLV

SEQ ID NO: 13024 - protein, 390 aa, Myxococcus xanthus
MVEQGDGGGPLPAWVEALDSDDWVYGTWEGEKRQMRLYRSLKDMLDVLVPPAEVESFGERTFARAMNAVLQGALSGVQADEEDEEAAESGEAPLGAAAEAEAVEEAEQLEEAELADEEAAEVAVEEAEVRELAYEYDDGRPSSRYEDGAGSRKARAQAQQIPLAIGGAGVLFPKSASSRVQGVKKAAAEPAPTKARPTKARPAKKAAIEAASAELPTGAAEAISEPEAAPKTATAKAPAQTGVAKTSSATTKRATKAPNQKRTEKKPATAKRATKAPAQKGAATKAATAKAPARKAAAKKSVTAKAPARKGAAKKALAQKGGAKRAGVPTSAAKKATAQKSAAKKATAQKSAAKKSSVKKAAAQKSGAKKSAAKKGSAQKPAAKKGARGR

SEQ ID NO: 13025 - protein, 294 aa, Myxococcus xanthus
MASLRDIRKRIRSVKNTRQITKAMKMVSAAKLRKAQDGILAARPYATMLDQIIADLSARAGDESLSHPLLTARPVKRVELVLLTSDRGLAGGFNSNVIRRANRFLYENTNLESIRLSTVGRKGNDFFRNRGQNIRKDFGGLYQRLNYRAAADVAEELVASYLNGEVDAVHIVYNEFVTAISQTVKVAQLLPLQTLGTPDQASTAGSTSLVDFKYEPDRQSVLDRLVPQAVNIKLYRALLESVASEHGARMSAMENATSNATDMIGNLTLTYNRTRQAVITKELMEIVSGAEALK

SEQ ID NO: 13026 - protein, 265 aa, Myxococcus xanthus
MRQRLWLFLGLVCCVTGCGFETVSSGYGGIGFDSFGSGTQREPYGEGFHLLRPGKSLIVYDLRVQEMKDGLSVLSNNGLDLKVDASVRYRVDPAKLFELHTQTGPRYADILIAPVVRSEARKVFGRYAPEEIYSSKREQIEQEIFEEVTRSLEGKHVVVEAILVRDVTLPSAIRDAISDKLAEEQRSQKMRFTLDKERQEAERKQIEAEGIARYQDIVRKGLTEEYLRFKGIEATERLAQSQNAKVVLVGSPNSGLPLVYQPDGK

SEQ ID NO: 13027 - protein, 405 aa, Myxococcus xanthus
MAVTNTGAPIQVPVGKATLGRILNVTGEPVDEMGPVKAQEYWSIHRAPPPFTEQDVRVQMFETGIKVIDLLAPYTRGGKIGLFGGAGVGKTVLLQELIRNVAVERGGFSVFAGVGERTREGNDLYHEMQDTKVIQTDNLEASQAVLVYGQMNEPPGARARVALSALTMAEYFRDVEGRDVLLFVDNIFRFTQAGSEVSALLGRIPSAVGYQPTLATEMGGLQERITSTTKGSITSVQAIYVPADDLTDPAPATAFAHLDATTVLNRSIAELAIFPAVDPLDSTSRILDPAVIGAEHYGVARKVQGILQRYKELQDIIAILGMDELSEDDKLVVARARKIQRFLSQPFFVAKVFTGKDGRYVKLQDTIQGFKEIAEGKHDDIPEGAFYMTGSIDEVVENARKLAAS

SEQ ID NO: 13028 - protein, 179 aa, Myxococcus xanthus
MFLAPSSALAEERRGRARVSANGLYSVRMVEAAQDQCRLEVTQESGPVWTLKECLGTVDDLYFVSNDGERVWVVWPLVEKGKAVAEPRTKKSKAKKPKGPPAWARVVVAAQYGRDGQRLQEKRLTEWLNTRQLSEVRQLTHHFKWLEGTLGIPGKGPRLTDAGVVELEPVGGTTRQLTF

SEQ ID NO: 13029 - protein, 37 aa, Myxococcus xanthus
MFPDENFFDEVVLNMGLLIALKVVGVVMLLVTYAHPS

SEQ ID NO: 13030 - protein, 136 aa, Myxococcus xanthus
MANLTGEIVTPEKRILSVQADEAIVPGGRGLFGVRPGHTPFLSLMEPGALTLIESGRRESYFVAGGFVEVGNDKVLVLADAAEPVTGIDVEGARRRMAEAQERMKGMSSEDARFELEQATVRREAARIGAANTARA

SEQ ID NO: 13031 - protein, 126 aa, Myxococcus xanthus
MSVTAEKSVYEQLGGEPAMAAAVEVFYRKVLADDHISHFFEDVDMERQAAKQKAFLTMVTGGPVHYSGKDMRAGHAPLVKRGLNDSHFDAVAGHLKATLEELGVAAPLVARVMTIAESARADVLGR

SEQ ID NO: 13032 - protein, 332 aa, Myxococcus xanthus
MAKVKHESDWYPLESGESVLDALLRQGVSIPNACRAGACQSCLMRAVAGTVPEAAQVGLKDTLRAQGYFLACACRPPEGTQLEVTGAEALRIPARIQALSLLSTSVLRVRLVTDSPLAYHAGQYISLVREDGLARSYSLASLPHEDALELHVRLQPGGAMSGWLAHDAQPGDRLQVQGPAGSCFYVPGRPEQPLLLAGTGTGLAPLYGIVRDALAAGHTGPIWLFHGARTPEGLYLTSELRALAEQHPQFLYRPGVLEGGSRDVAEGALDVLIRAECPKPLGWRAWLCGDGPLVLSLRKKLFLAGLSLKDLHTDAFLPSVPSGQRTSDAGAR

SEQ ID NO: 13033 - protein, 119 aa, Myxococcus xanthus
MADAYGISKHHLVRVVQTLAGQGVVDARAGRSGGVVLARAPADIQVGSVLRAAEPDFHLVECFDRERNACPIAPACGLKGVLDEAREAFLAVLDRYTLADLLRRSRPNLQDYFLPTSEP

SEQ ID NO: 13034 - protein, 85 aa, Myxococcus xanthus
MSGTLELFHRIADAPSAQARRYIVDYALEDRVRFRNVAFDEAEADWRKHGGHTTPALWDGTHLHQGAQAVMARLQAVVNLGRDDA

SEQ ID NO: 13035 - protein, 161 aa, Myxococcus xanthus
MEAEPLTPAAFCEELALSAAVHDKGLAEEVRHLPRLLTWDTARALTQLRKVGVPPSELKGVDGLPPHVVPVLLTSLFAILKVPHDFREAVALTLRCGGEADVAAALTGALLGAHLGTRAIPARLRKQVLYSENLVDTADRLFRAHQVRETLATALSHRRRR

SEQ ID NO: 13036 - protein, 150 aa, Myxococcus xanthus
MGAHVWSAESSQEAHVVDLESERLERSQLETLSTAELIRHALAETRLLVRAEVMHAKKELREELKAARTAGILLGAGAVLALTALAVLFVALGLALPMAQALGVLVVGVVLLAIAGVLLFVGRKRVPKKPLPHTQERLKMDYQLTRETLQ

SEQ ID NO: 13037 - protein, 173 aa, Myxococcus xanthus
MNGNDRDAGEPSAIERQHEDHRIARGMGDRKQVEETADRIRDELMLTLAELDRRRERALDVRYHARQHRAELMAAGAALLTAVGLGVGYAVYRARNRDEILRRKRRKALARAWEHPDRVASSAERRPLGAELGRKLVLIFASTLATAVARNAVMTLVPARRAPASAQIVYKNQ

SEQ ID NO: 13038 - protein, 445 aa, Myxococcus xanthus
MTDLLYARAQMGLSLAFHIVFAAAGVALPVLMVLSDWKGRRTGDADYQKLSQKLAKGTAILFAVGAVSGTVLSFELGLLWPEFMGQYGEVIGLPFSLEGVAFFTEAIFLGIYLYGRERVSPGMHMSSGVMVAVSGAASAFFVTLVNTFMNHPSGFTPSASGPMDVQPLVAMFSPGWQYQTAHVLLSCYQASAFAMAGIHAFVLLRHPGVAFHRKALSVALPLACVTALLQPVVGDLSAKHVAKAQPVKLAAMEGQFETERGAPLRLGGLPNVETGEVPYAVDIPKGLSILAFADPDAEVKGLNAFPRDEWPPVAKVHVAFQIMVGTGSAMALLALVTLGWRWRKKAWPHGRKMMWAWLLSGPLGVVAMEAGWLVTEWGRQPWILRGVMRTADAVTPVPHLAAPFWTFTVVYLFLGVTVVLLLVRQVAGTLPTRDSGPLGGEANAN

SEQ ID NO: 13039 - protein, 339 aa, Myxococcus xanthus
MPTDAILGFAVAGTFVLYALFGGADFGGGVWDLLASGPRKAEQRALIARAIGPVWEVNHIWLIVGLVLLFAGFPRAFAVLSVALHVPLTLLLLGIVFRGAAFTFRAYDTRGDAVQRQWGLVFSGASVIAPVLLGMCVGAVVSGTIRVEGRVVVSGFFASWLAPFSWAVGALALSLFAFLAAAYLTHEAHEPTLREDFRRRAMGAGVAVFVAALAVLLLAREGAPRVWEGLLRSPFALALHAGTAVAAVASFALLWTRRFQWVRVAAAVQAGLIVLGWAASQYPYLVVPDVTLHGAAASPGAQRLLLVALGVGTAVVVPSLVLLFRVFRPAPTPGAGSEV

SEQ ID NO: 13040 - protein, 224 aa, Myxococcus xanthus
MWRHTASVRRDCAAEDGHGFVTQNTGLRAFRARYRGPMFNSSGRRWGIAALSLGMLGSACAARQDAAPSAEAAQETPAMATTLTCTLSGPARVRAGEPVELVFELSNPTVQSLRVLGWHTPLEGVRNKIFDVSRDGDSLEYRGPMAKRGPPTADSYVALSPGTSVEGRVDIARFYDLQAPGTYRIAFRGPLMDVAREGEPVPAPNGGFRPAEVPCPVVEVTVTP

SEQ ID NO: 13041 - protein, 199 aa, Myxococcus xanthus
MPDGTPIVAARDGTVRLSRGDSTKGGCDEKFAPHANYVVISHGDGLETQYLHFSAVVVKPGDVVKEGQLIGFSGSTGWACGAHLHFKVARESGKGWNNPSVPARIAGYGDPVRDTRVAAPLCKDNGTEALMASNGGTHTPGQPVVSISPERQQALRGLPPGAQSILDGLSQPPAQGGQGLNEARTSGGTRTASGSSETR

SEQ ID NO: 13042 - protein, 298 aa, Myxococcus xanthus
MDLFLMSPPGRTWALRGRSNFRSREAPPVDARQARREWLALARDIEARGGTVVALPSPSELLTGMPYAAECGQVVARQGAAPLFVLPRVMSAHRQAEREHWAPLARSLGMEVVDPGVGIWEAHGDVATFDGVTLLFWGGRTTLDGLEAAARYFPGEVLRIQVREPAFHGNMAVLPLPAVDRLMVCPDVMAPESHALLRERFGEHRLLLVTEAEIRRYATNGLPVGRDVLAPSVVPDSVRERLEALGLRVVSLTMRELCEKGGGSSRCLVSRAEVDAATLNIPDAFRLSAIARDIDADG

SEQ ID NO: 13043 - protein, 266 aa, Myxococcus xanthus
MGDADTLPRQAEAFLAAHPGASLVALGSGEHAGSLDLSPLGVPVTFLPAERNADLAMQYLALNQLAFGGIGVPRWVLSDLYLLPGAIGLLRCPARMLAAPVRERLGLADEDPAIGAAYYAAPSVTPGLVIGVSLLSVLPGTGASPWVKLLTLQMLRARRLRGVAQWDNPSVRVHSRLGPLRLVGRVPGGHEYGERSFVYESELTDRTRLGDAMVRRLSLTPSLRVSATDLSALSALLDRAEAGEVLHLVPPGLDAGQVLVREGPLG

SEQ ID NO: 13044 - protein, 537 aa, Myxococcus xanthus
MPGVLQLAQGVYAVVARNRRQAAGVDRWLFGRAVVPHEYRWVRWAFLRLLGGTFLIAFTSLGRQVRGLYGTQGLRPVAERLAAERREEASALARWRRIPSLFWLDASDATLVRGCWKGQVLSLALLFNVAPRFSVSLLWALYLSYVAVGREFLSFQWDVLLLEMGLLAALTAPGGLRPGLGRDEPSALDVFLFRLLVFRLYFGSGLSKLQSGDRTWRELSACEHYYETAPLPTRGGWYAHHLPRRLQRASTGAVLWLETVVPFLAFGPRRLRQFAFWSLSGLQTAISATGNYGFFNVQAWVLGVWLLDDAALRRVLPLKDGPPAQPRPWWRTGVSALVVSPLLVLGASEVLRRFEGWQRYRPERVGAMLTWLESQARPLRSVNPYGLFSVMTVQRPEIIVEGSDDGVQWKEYSFHYKVGDPARPPRQVAPHQPRLDWQMWFAALGSPPGWFVAFLARLLEGSPDVLGLLAGNPFPDRPPRMVRAVLYDYRMTDAAERRRTGIWWRRERLGLYVPPLSLAPGPRPRGRIPALQWHAGA

SEQ ID NO: 13045 - protein, 249 aa, Myxococcus xanthus
MKLEPLETKYLRTPGQTVKLAYEVFDAEGQPMSDPKLRWTSSAPDVAQVQEGLLTVRKSGKTTIGATGGKVRAALPLELTILNSLDVRAPGADFLEVGRVIKLRVVARNEQGSSLQDAMPTFRSSDEMVARVEDGQLVAVRPGKATLSATLGHLSRHIAVQVVPADFARLGLNLTHHAFQRRGQSVQLQARAFNRSGVVLDTVPLEFFTSDSAVVSVSPEGRVTAVGSGRAVVSVVAGRRRSAAEFVVP

SEQ ID NO: 13046 - protein, 381 aa, Myxococcus xanthus
MKAYVLSDASLARHADRFVWLEVNTDLTSNAAFQEKYPVEFWPTLYVIDPRQEKALLRFAGSATVAQLEKLFEDGERAYKGGVTGAEALLARGDALYAEGRSAEAAETLVEALAEAPADWSRRGRAVESLLTAMYGAKQHEACAHKALEELPKTPRSLSWANGALLGMYCVLSLPEDHAAGAELRGGLEAKVAEALAPPAIEMSADDRSGLYEVRVQAREVAKDTAAVKALSEEWLAFLEGEAAKAPNPQARTVFDSHRMLAAMKLETPARAIPALEQSEKDLPQDYNPPARLSTLYRLVGRLDDALAASDRALARVQGARRLSVLSGRADILVARQDTASAVKTLEEAITFAKSLPASQVSPRTVAGLEKKLSGLQASAR

SEQ ID NO: 13047 - protein, 35 aa, Myxococcus xanthus
MERVGELARAEPLLEEERRAFLAAPSQEGTATVAH

SEQ ID NO: 13048 - protein, 928 aa, Myxococcus xanthus
MRWLRLLALVFALPVHADDALSARVQALEQAGVVLRGAAAADADLVTEVEAGLEALPPAMRRPPGGPLELVLHPEAAPLGLGDGSPARPDWTEGRARFHLYQYAPSEERRATLRLSRLTEAEVERLWRRRAVVHAVMQRWDDAKGWSGTPAWRRLSGWMKPFERPLVWKEEVRLRYAGAFSRAMGQRSASLDWVTFAEELLVPVESLRADALPVDDHVRCQEFSKARALTEQLEASGLGTLPPRGDCPAFEAWAELESLSHFEVLLVASTGRQPESLFGHLLLRPVWHEGEVPRGPTFERVVQLVALTGMESKGLGYVVKGMTGAYDTVFLTGTMGDLSHEALELEQRSIRRFRLRLKPGEEARMLERVWELERRGYMGYYFFTDNCASALVFLLNGALEGGRQLRPPGTLWVLPTATLDTLARVQVEEPGGETSSLLEHIPDAFESTGDRAVRARSAQQDALDALAGHVGADELARLRGVHARLESPEPQVRAPAYDDLPGVVAALMHSAKTASRDTVRAHLHAYVAHAVRVERAAVDRADGERLRIERERMLAMKVSVAGSARAGTAERQRVFENEDALQRRLAVLDRATLLKDALASAERRPPTPEELRTLVWAERTEATFHRATDVQGTLNDGLLATVDPVAFLHEDRRRKVAAETAWAEGALRESGAGRVMVALGVDFPEGAAARPLVGLRTAGMAEALGDARLHGFQPSSELRVLDGELFLLPRWGVPKVVASDLTLLGYRTLLRELPQFRDSFWDSLGWGAEARVASSDARLLRYRASVQAEALMVLDEDARFSRFTTVGVGGLAAVHWNRDVLTPAAGPRLSLAHRMGLFGSGANAVRLEAAYAPTWRVGDTHFTHEAGAALQLEVWLGRAGPFGVLLTPRAQVQWEGAISPTPHWEALSPSTWLAGSAERRLALGFEVR

SEQ ID NO: 13049 - protein, 157 aa, Myxococcus xanthus
MSFRRKLLTLALVSSSLLAACVVQRPFYRDVVQPAGSSVAAGTLVDLIVLDSDTNQPVKGAKVIWGEDSRSRESYVTDEDGRVSFDVTPALLKENPLVEVVLPRGVRSYRLQVVPATDVAAPEEAEASAAPATPEAPAVPEETPATEAPAAAPDTSN

SEQ ID NO: 13050 - protein, 152 aa, Myxococcus xanthus
MPVRPRASSGEKRYITPEGYRALQEELAAAQGPDPKAGEFTELEAGVRRKERERRVQELAAVLEDVRVVEPDASQAGRVFFGAWVELEDEDGGPVRYRIVGPDESDVKAGRLSVESPLARALLGKEVGESVVVDRPRGPVEYTVTAVDYAAS

SEQ ID NO: 13051 - protein, 113 aa, Myxococcus xanthus
MIRKARLLSEAAVWAGAWLRRMRMRAMFRWFQALDLKITNALPDPARCTFQRWAMARANAHHADVVVTGHTHLGLRVEHGSKLFLNSGTCSEGQFSFLSLDTRAASYSLHTTW

SEQ ID NO: 13052 - protein, 130 aa, Myxococcus xanthus
MMFLGSTAAHAKDDNEKSRFSQQHRHDGRGGNFGVHVDARRHPGPAPLPPPHARGRYELQTVNRWVQGRYEQVWVPEVCRERNNRRSRVTRCTGGFYEQRWVPARYEPVQEWVWVTYAPGRVHVASAGRR

SEQ ID NO: 13053 - protein, 241 aa, Myxococcus xanthus
MATAFITGAGIRIGSAVARALGRSGYDLALHANRSLEPLEALADELRGLGRRVTLHAADLSRPEAVDSLAAQVREAWPALDVVVHNAGLFERTDFAAISRDQYRTMMAVNLDAPFFLTQALLPALRAGKDPLVVHLTDVGGERPVSHYAHYSVSKAGLIMLTRALAVELAPHIRVNAVSPGTVAFPEDFDAEARDAVLRRIPMGREGNVEDIARTVVFLAREAPYITGQVIAVDGGRSAQL

SEQ ID NO: 13054 - protein, 93 aa, Myxococcus xanthus
MEESELVLGSGLLLQFKPVARGMAFHWPRGFLHRYDNPSSTEQTVLCVDRPGFIPSDEVETEPPPEGLLPVTGHSYYPLDEPAAPGSLAEHQP

SEQ ID NO: 13055 - protein, 259 aa, Myxococcus xanthus
MSEVGTRKVLVTGGGTGIGRAVAEALLRAGGQVVVSGRRVEVLESLTTAWPGQAFALPCDLASLEAREGLLRRAAGLLGGLDGFVHSAGQVVHQPPGHIGEDALRAQLEVNLIAPLRLGEQALEVLEPGGAQVFIASTLATRPVVTSAVYSAAKAGLLQVMKVLALVGAARGVRASAVLPGVVETDMVREVRLAPGAGPLSEPEYARRQEAQLAGLRALHPLGRLGRPEDVAEAVRYLLGASWISGSELVLDGGLLLRE

SEQ ID NO: 13056 - protein, 249 aa, Myxococcus xanthus
MLLDRRLQLFVVLVGVFVTSLVVGDIISVKLFEAKVGPVVAVMSIGILPFPVTFLLTDILNEFYGKRAARFVTWVGFFMAIFAVVVIAMAVQVPWAPLTRAPDFSGTVEGSFNNVFAGSQRFLVASMMAYLVGQFCDIAIFNGLKRLTRNRFLWVRATGSTLVSQLLDTVVVQYVAWTGVLPNSTILGIIYTSYVVKLLVAVGLTPFIYLGHAFVERKLGIAPLVLGENGEPIAPPAPPVTQEEQPRAA

SEQ ID NO: 13057 - protein, 301 aa, Myxococcus xanthus
  unsure (1)..(301): unsure at all Xaa locations
MVDVRGAYWSIEGLTIDVAGNASFAVLFRGVGAHHGVLRGSTLKNGTAGAGVNVCEKASDVLIEGNTISHFNRNGDDSHGVIVQTTARNVVVRGNDIHHNSGDAVQCIGPEGGATISGTPFDNLLVEDNELHENRENGVDVKTCTRVTLRGNIIWGHKMSSTSRGEGVVVHLSAKDVTLEDNVFYNNGRAISIGGVRQGSPPTNIVIRRNLVRDGLGGGEEGSGIRVDTTSNVKVHHNTVWNMPGPCLTFGHGDTGASASLDVRNNVFSGCXVXVRGGPGRSGAVVDANLYXRNSGSALSG

SEQ ID NO: 13058 - protein, 556 aa, Myxococcus xanthus
MQLLDLSGAREFKIFLGIITPVVLGLCAVVQPLVVMPWLMKRALSAQGTTRVERLIRIPSSIAFVEMMVSWTLGGILFNGGAVLLLDRPASVVMVGVAVAVSAGLFSSPLAYMLFERVMMPTVLDAYQRAPSTKPAGEGFATRQLWLLPAMVVSALLITCLASIVTLHLRLERGMGTLAADLAAQGDTAAAERVQATVRPLEAELVQPVVVLGGYAALGSILTAAWAARRLARGARAVGASLEALVEGRATPPQWVSSDEVGDLAASTWQLYQRLQEMPRSLRASAGDLADAGQRLSQASSQQNQTLSRQAAALHQARATAQEIQQASHVTHSRATSILQVAERAAAVGKLGEESLAGTEKGLTVIRDIAAGLHEQMLDLEQRAREVGRVSEVVKSLADQSHMLAINAAIEATRAGEHGKGFGVVARQMRDLADQSVRATNQVRGLLESMATATQHATAMSDQGAAGVAEALEPLRHSGERLRELAGLSKESAAAVRQITEAVSQQHAGVDQLFAAVRELDELTTDTLRHLDTTQQAASAVSHATGQVSQLAERYV

SEQ ID NO: 13059 - protein, 52 aa, Myxococcus xanthus
MRGIITGREVVANLGLIYREFGTGCVLRCLWVMLSGKTTTFLEVACPPVAKR

SEQ ID NO: 13060 - protein, 288 aa, Myxococcus xanthus
MHDLMPFEPYDIDPNDPRAPPQETWDALSSEERQRIVDSLPSEFPVSEANPPEGDFHFEAKTRAREVLGSFFSRIGRKVYLGSELPVYYPGESMFAPDVMAVVDVEPHARMRWVVSAEGKGLDFALEVHVAGERRKDLERNVERFARLGIREYFVFDRGRLRLSGWRLDEGRRVYRPILPQHGLYPSEVLGLDLQVDDERLRFYLGGAALPEAPELIARLEHMVERVEASRAELVQQLAEESRLRAEESRLRAEESRLLELETQRREDAERQLAEARAEIARLRGERA

SEQ ID NO: 13061 - protein, 114 aa, Myxococcus xanthus
MAHPVSYEGTAENFDQLVLEPKGELVVVDFWGDGCPNCEIYAAAEPALLAELGDAPMRVVKVNAYQYEDLAKRFGLFGIPTFLLFREGKLIGKMSQYYGKEYWLGVVRDHLPQA

SEQ ID NO: 13062 - protein, 295 aa, Myxococcus xanthus
MSRVLTKPGPVTVAVLTLLVAMASIQTGASLAKQVFPVLGAAGATALRVFFAALILAAVFRPWRQRLTRKDLRAVAIYGAALGGMNLTFYLALERIPLGIAVAIEFTGPLALAIFSTRRALDFVWALLAVAGILLILPLSETSRSLDWMGVFWALVAATCWALYILFGQRAGGTVHGGTAASLGMCVAALLVMPFGVAHAGMKLLDVSLLPIILCVAVLSSALPYSLEMYALKALPTRTFGILMSLEPALAAVSGLLLLDERLSLVQWAAIGCIILASVGSSATSRKPVEAVAAS

SEQ ID NO: 13063 - protein, 270 aa, Myxococcus xanthus
MFRRLTEALRVLTRRSPISGPGPTPGAPRQMLLSDVAADGRPRTKKPAARRSPPRTTRLARYFDLHDDFRIPGRPELSDPVAVDVRRKLDSVWLFTSGARVRSVGKLRLAVTPPGLPLDFSLAGAGLTPVVSARVASVFRELAPDDVQLLPVEVEDRDEPHFILVATRLVRCIDDRACEEVIHYTAEDGLPERVGHYRNVRGLRVDPTKTNGARVFRTWGWPVSLIVSEGIKEALEHAGIAGARFAEVTKPPRKPRRKKTAAKKSRPKRR

SEQ ID NO: 13064 - protein, 71 aa, Myxococcus xanthus
MNPDTGEDEINISDQDLAATPPLEEEPDFRDILPDEIHEFRRGDEEEEPLELTAQPGYRIRPIDFDKLPQG

SEQ ID NO: 13065 - protein, 111 aa, Myxococcus xanthus
MRRYLVEHGVPESAILGDEAGLSTYDSCLRAATVFGAKRAVLVTQRFHLTRALFIANSVGIDAWGVAADEGRSTPWRYQVRETLSRVLALAMVMLEVEPAYPSGRTVLPER

SEQ ID NO: 13066 - protein, 78 aa, Myxococcus xanthus
MDGHRVLTTRKASEALAQVPVIILSAGMAEMNPRDWAVYASSYNVAAFLKKPVEPRRLLEAIERFAPKPAGSQAGTFP

SEQ ID NO: 13067 - protein, 564 aa, Myxococcus xanthus
MDSSYTLILVDGKRVNSLEAVFRHNDFDIGLIPTEGIERIEVVRGAMSSLYGSEALGGVINIITKPIAPKWTGGIDLKAQTPTVGANGEELRSSVFLSGPLIEDTLSMKLTGGFNHRQAWNGARNPGSPVLNADGAPVTREDGSVVNHGDLATLEGRNDHNGRLSLNWTPTAQQTITAEYGRAYQNRIGEYYIGGSYGDADAVVHRNDAVLGHKGKWDWGNSEVRGYWEGLESGVDGLTQDNIVAEANATAYLGINTLTVGGEARWIDLKSDEFTSGGASVHQQALYAQDELALMDKLTLLLGARLDNHENFGLHFTPRAYAVYSPINHLTLKAGVGTGFKAPTLRQMSTESLVTSCRGRCGIIGNPDLDPEKSTNFEVSANWTMTSWALSATVFQNNIRNLIDTPRGTGVEPVGTDPGTGLPLYVPRNVNRARLRGVEATASKAFGNVVRLSANYTFLESRDLENDVQLAYRPKHTLNGQIDLTPVDKLKAFVRGQYIGTQLSGTEEVEAYALFDAGASYDISKNFGVNAGVLNLANTRTEDEEGYVFQERGRTLYAGVNARF

SEQ ID NO: 13068 - protein, 121 aa, Myxococcus xanthus
MVIAEAAGPLVDQGYDEPEPTAMTTLIVQYTVEGKGTGHDVEKRVAVEELLTDALGWTGNGEVEGGELQAQQLRVYCRVMDADAGVRTAVEALDSEDLLEGATLLIARDDEEPRAVWPTQA

SEQ ID NO: 13069 - protein, 256 aa, Myxococcus xanthus
MDLELRGKTALITGSSRGIGRAIASVLAREGVRVCLSARGAEALEATAAQLRAGGADVATVVTDVATQAGAVEAVEAAVRAFGRLDILVNNVGGSGGAGAFHSATAEQWTSVLDRNLLSAVWCSQRAVEAMRQQGGGCIVHINSIFGREYATSAPYTTAKAGITALTKEMAVDLAQYRIRVNGVAPGSILFPGGSWDKRQKADPEKVARLVRDELPWGRFGAPEEVADVVAFLCSERARWVTGATLPVDGGQGRAF

SEQ ID NO: 13070 - protein, 529 aa, Myxococcus xanthus
MTERELWERYQRYLCVVPALDFTLDVSRMRFPADYLERMRPRLEEAFGAMEALEKGAVANPDEKRKVGHYWLRAPELAPEPALQKEITDTVAAIHAFAKNVHEGRVKPQKAQRFTHMLIVGIGGSALGPQLVADALGTAKDPMQVSFFDNTDPDGFDRVLAQLGERLSETLTLVISKSGGTKETRNGMLEAERGYSARGLDFSKHAVAVTGAGSELDNHAKKQGWLRAFPMWDWVGGRTSVTSAVGLLPARLQGLDIDALLKGARDMDAATRERDALKNPAALLALMWHYAGDGRGHKDMVILPYKDRLLLMSRYLQQLVMESLGKETDLDGQVVNQGIAVYGNKGSTDQHAYVQQLREGVLNFFATFIEVLKDRDGGSQEVEPGVTSGDYLLGFLLGTRRALYEKDRESLTLTVPDVSARTLGALIALYERAVGFYATLVHINAYHQPGVEAGKKAAGVVLELQRKLTTRLREARAEARTAEQLAADIGMPDEVETVFKVLQHLAANPDRGVTRTPGATPTQARFQAK

SEQ ID NO: 13071 - protein, 301 aa, Myxococcus xanthus
MDAAHIPDLITPAIPVFTLTVIAEALWVKKQRDEGRPMVGHTWKDTIASISMGLGNVAINVLWKGVAFAGYLALYHLTPLRMGTGVLAWVLIFFADDLCYYAFHRVHHESRIFWASHVVHHSSQHYNLSTALRQTWTPPTSFVFWAPLALLGFHPVMIVVQQSVSLLYQYWIHTEAIGRLPRPLEWVLNTPSHHRVHHASNPRYLDKNYAGILIIWDRLFGTFEPEGEKPVYGLTKNLETFNPVRIAFHEFAAITRDAAKPGSLKQRLSYVFRNPAWKPDAPEAPQPPGVQPPPEAARPSV

SEQ ID NO: 13072 - protein, 412 aa, Myxococcus xanthus
MHRGSVAEASQVEFLTEFARRRSLVFILNFADELSPESRDTLKAQVRRVASEQYGLAQEDVPVFAISALSAKDGRDVSGEFGALLFHLRGLATQAVAARVRKTNAMGALEEVHTRVEAALKETDAMLSRTRAALDSGMEKAAEGLRADFDARLRLAHGHLAAEVRRQAGGRFWGPAAWGLRLSLWGASGLGAAALVGRSSLPAGLAVAAASTVVDVVRGHTRARAAESAVVEPFEDDFSAQAAARTALAEARSVARASGLEPALLGVPDVDTLLEEVRVARAGAWRYTATTGVAEAVAGWWRTARWLVLPLINLPLLALLGHVGYRVVRAYVEGPLLPLDYFVNAGALFMLLAGAGALLASASLAGAARRAGTTGRARFVESLAALGGRLGETVEDALRPGREAAKGLLALR

SEQ ID NO: 13073 - protein, 217 aa, Myxococcus xanthus
MSEPKGKAKRTSELVPGVHHWTLSDDRIGGARSDAYAVVDTDGAVVLIDPLPIDEEALRKLGNISAIVLTAGNHQRSAWRLRKAFKVPVWAPEGAQTLEEQPDFFYVAGDTLPGGLISFHTPGPTEAMYTLWMQQHPRAVAFISDLLTHEDGETPEFIPSEYQDEPLRTRHSVQRILDHLPVETLCFSHGAPILRDGSRALRLALEEDMESPAAPAP

SEQ ID NO: 13074 - protein, 234 aa, Myxococcus xanthus
  unsure (1)..(234): unsure at all Xaa locations
AQLYLASIDGPDGFSKSCVIKRVLPEYASLESFSRMFADEAKVAALLTHPNIVQVFDFGRVDGQYYLAMEWIQGHSLDRLLRQALRSGRVVGTRVAVDVGLAVADALAYAHAKTLPDGTPLMLVHRDVTPGNVLVSRDGIIKLADFGIVKSAVNAERTVAGVVKGKYPYMSPEQITSQELDHRSDLYSLGIVLYEAATGRRLFKRDTLEATIMAASQANVPAPSEGTPXFPRGA

SEQ ID NO: 13075 - protein, 543 aa, Myxococcus xanthus
MKPSHLFLIVALGLSTTATAQPDARFNVQLFRPSGAPQDLVVVQQSRPLSHLSVSAGPYLSYSLNPLSLIPEGGDLSKINLVGNRLQLDVMATIGLFDWAEVGVDMPLILAQGGANLEVIGTEGSVESFVLGDLQLTGKVAIPGLRRPAEGKGWGGAVTLNVSFPTGAQDAFAGDGEMTWAPGLVLDYRFENGILLALNGGFWKRPDRVFSGVSVGDMMPFGVGAEVPILRGSGVTAVGMVHGAVGLQKQPDEPRQIPAEALFGLRWYSSTGLTFTFGGGMGCGCSIASPSLSFFTSILWIPAKTREWEALERFKEPPEPPPPPIDPDGDGVIGESDACPDVAGPVANMGCPDTDKDGDGVVDRLDRCPDQPAGSRGKDGCPLARRDGNRIVILEQLNFATDQDIILSESFPILEEVARVMNENTEADRVHVEGHTDSRASDAYNLDLSRRRAASVMRFLVESGVAAERLCSQGFGRSRPLADNATEEGMALNRRVDFTIQPPSDGPRPPCPEDAEDKKRKRPTKKAPATPKAKSKAPAAPKP

SEQ ID NO: 13076 - protein, 71 aa, Myxococcus xanthus
MATDGITVLRADGCIVGYNIFVRHPETLASQPSVVGGARRRTFEVLCAALGTELTAAFIRSQDGDVSCKRV

SEQ ID NO: 13077 - protein, 580 aa, Myxococcus xanthus
MRDPYTLRTCLASALDALPAPERFPDASDAELARRLAERLRRDLLPRLGSADSPLLLVAIAGPNNVGKSTLFNSLVGAALSPARPEGGLTKQCLAAAHSETWTGPLKDFLTRRYDIVPVASGDAAPVDQAGPPGRLYLTLSDAVPRGLLVMDTPDFDSVYRDNRERAEALLVTVDVLAFVVSRQTYQNAALVDFLRAAVGHGRPYLLVYNEATREEVARGHLDKLAEDVGHPALARYLAPHQPDVEAGLKPLATEPLDGKPALGALLGQAEHARELKARALEASLADARAEMEAVSRAASEAAREPDRLRKRLRHELDVVGAHAALKAVPADVLIDAFRDELDARSQFHKWVRLPFRGLATALTFVTRKVRESFTAPEAPGADTPTHAVDETLKDGVRRLVDAFAPEVAAWRADAQTRTKLEEAFGPVTLAKLEEPLGFEPLHAHAADRATLYAYCRELVSAELQGDMREEILQTLTTLVYSVPSGAAAAVTVATGGMGHDAVVWAGTLLSTPLMERFVDLLGAQVRARVTKKWADAHGATLSRALEARYFSDILKQLDGLASDWNQTAARLDEARAGLS

SEQ ID NO: 13078 - protein, 389 aa, Myxococcus xanthus
MNKTSSIQAALARAAEAAAEAPRSVPAEDHVWRRRLVIGDPQADLDQVLAILAHHGLLTGEGWLRSDVQLISVGDHFDWGKPAERESAAASGLALVAWLAAHPATQAVMLLGNHDLARVGELAGFTDARFAEAQAEADRIYQGGATDEAAEQAFLARWPEVPSAELVARDFGNFRAVQRTWVEHLLRVKRFRVAHAAAPDLLVLHAGVTQEDLDVTRLPPAQREDANQVAAALNAALDAAVAGWTRGPLVIPGLHHPGDAAHGEGTGIFFQRPSLLPEDAERVRGTPRRRFDPRRLPTGLTQVVGHTRDKRSRAMLGMPPTGARDGVLRHLITDGTRVDYAHGAPHPPAPGTAMLVFTDGAMRECQAPDYELFDLDTRAAATAPRPEDR

SEQ ID NO: 13079 - protein, 212 aa, Myxococcus xanthus
MQWLRTLVCDGPVLLGWVGLARAEPFTEREQRLLQALTPALQRRLTMETRLRESGLMSTALQVAMEALGRAAWIVSSSGRVVHANNAGRARLERHDPELMESLRRGAQGIPCSGPLTMTPLLTTGLPPHYLAIDTGTASSAAARVQALSARWSLTARESEVLTHIIQGETNKSIAGRLGCAERTVEVHVTHLLSKAQVESRSALIARFFQSS

SEQ ID NO: 13080 - protein, 62 aa, Myxococcus xanthus
MPWGVGTALAIWALVGLGTGAISAWLGWAALALGMAYLALGMLHFLSRVVPPGRLPRFLHVP

SEQ ID NO: 13081 - protein, 174 aa, Myxococcus xanthus
MPERILTQDPEKALAGPKPRYEYVRREIPADLTFKPDTINPVHNRFIVSTLVMAFISLALFFLPMFNGLLAGTFGGFHARRLPRALGAAALSAVAVPAALAFFLFIGSATQGHIFYGLGFWGYTALYVIGIFIGAVTGAISHPFWTSYKIGEPAPVSAPRTQVPDAAPPSRPTT

SEQ ID NO: 13082 - protein, 224 aa, Myxococcus xanthus
MTGQTQLIGKQGQALAGYLSEAPKGDAPGAVVLIHEYWGLNGHTRDVADRLAREGFTVFAVDLYEGRVTKDASEANAMLKAMAWDKATADLRAAVEALRARKPGTKVAIMGFCMGGALTLLAAANEPGLDAAVPFYGIPPEEAADVSRIRAPVLGHYANNDEWCSPERVDALEKRLKGGGVPMEIHRYDAQHAFFNDTRPEVYSPDNAAKAWQRTVDFLHAKLG

SEQ ID NO: 13083 - protein, 238 aa, Myxococcus xanthus
MFHRKGPTLRELAAQALTSVEHGYDLLAPKFEYTPFRTPDAVLEAAIAQLGAPGSVDSALDVCCGTGAAMRFLRPLARERVVGFDLSQGMLDEARQQLAQAPGTAALEFIQGDALALPFDGAFDVVTSFGAFGHILEEDEPRLVKGIARALRPGGRFLFVTAHPPSKLRPGYWMAKGFNAAMRARNALWNPPFVMYYLTFLVPRARALLETEGFTVEVRDGLMPEPFSVLSTVIATRR

SEQ ID NO: 13084 - protein, 302 aa, Myxococcus xanthus
MNASSDTEAMGVQVREGTVRLRDGRRLAYVESGDLSGLPVFFIHGNPGSRHMRHPDDRLTHALGVRLITPDRPGYGLSDYQPGRTLLDFPNDLEQLANALRVGRFALFGVSAGGPYVAASAWKLGERITRAALVSGAAPLARPGAMEGVNRDYRNAYAMAAWPEWLLHPLMAMHDRQVRANPSRALAGLRSQASADDRAVLADPRIAAQVQGWRYEATRKGVAGIRREAHILAQPWNVPLEEIRTEVDLWYWEGDSIVPPQMGRYLANRIPRAVPRFFPGGGHFSIFSHWTDILTPLVRQGS

SEQ ID NO: 13085 - protein, 39 aa, Myxococcus xanthus
SAPPAALPFGVLLRVFLRSLFLQASWNPKGMQNLRLAYA

SEQ ID NO: 13086 - protein, 308 aa, Myxococcus xanthus
MRLLRYAAPRRRHRTPILFVYSLINRWYILDFLPGRSLIEHLTREGYDVYAIDWGVPGQDEERLTWDDLLGGLIQTAVRWTLRVSKSRDLTLYGYCMGGTMALAYTSLYPEGVRNLVAQATPVDFSKGGLYTLWTSANHFDVDSLVDAYGNVPTPVLESGFLMAAPVQRLTRWLEVCRRIDDPEFVTTFLAMERWGADPVPFPGEVYRQYIKDCYQQNLFPQGLMEVGGERVDLRRIQCAILNVIAEHDTIALPAMSEPLPSLVSSKDCETRRYPVGHIGLSASSKGATKVWPSISAWIGARSKPMEP

SEQ ID NO: 13087 - protein, 85 aa, Myxococcus xanthus
MRQGFNARIRRNGLVEGALRTLRLPTTSEVENLRDQLRRMNDQVEALGTQLELVVDLLHRQEGAEPEPESPEPPPKERAPSKRRR

SEQ ID NO: 13088 - protein, 62 aa, Myxococcus xanthus
MTLYAREGVNHLWFADPRIQLLEVYRREGNPWQRLDAYTGSAHVDAEPFEARKLILGSLWER

SEQ ID NO: 13089 - protein, 249 aa, Myxococcus xanthus
MNVLITGATAGFGLAIARRFIQDGARVIASGRRTERLEALRAELGERVLPLTLDITDREAVERAIRSLPAEFAEVDVLVNNAGLALGLDLAQSARVEDWDTMVDTNVKGLLYCTHAVLPGMVARNRGHVVNMGSVAAEWPYPGGNVYGATKAFVHQFSLNLRADLHGTAVRVTDIEPGLVGGTEFSNVRFKGDDTRAASVYANTQALTPEDIADAVHWVATRPAHVNINVMSLMPVSQSFGPLPVKRQG

SEQ ID NO: 13090 - protein, 71 aa, Myxococcus xanthus
MDFSDIKEAFEPLRLKLDHYYLNEVEGLENPTSENLSRWIWKRLRPGLPLLSRVVVRETCTSGCIYQGEDD

SEQ ID NO: 13091 - protein, 536 aa, Myxococcus xanthus
ALRASIWSDVLHTNHAGIHDHFFDLGGHSLLATRVVSRIREAFGVELPIAALFEAPTIATLSERVQVLQAQQAGEAPPPPLQPSSRDGELPLSFAQQRLWFLCQMEPDSPFYNMPAVIRLTGALDPDTVQRCLEALIRRHESLRTTFRMNGHTPVQVIHPPAEPKVETVDLRGLPLERREVKARRLSDEKARRPFDLTRGPFCRMGLIQLDDQEHLLLLTLHHIIADGWSLSVLVREVVELYAALSAGQPPPLAALPVQYADYARWQREWLSGPVLERQLDYWKQRLAGAPPNLDLPTDRPRPPVQSFRGATHQGVLLPVDAAKALQALCRKESVTPFMAVMAAFQALMHRYAGETDIVVGTDIANRNRSGTEGLIGFFVNQLVIRGDLSGDPSFRALLAQTRRVALDAYAHQDLPFEELVKALNPERDLSYSPLFQVMFDLVRADRTMADAFPDLRARPLQPELLTSPFDLSLWVAESPTGYTLALRYGTELFEPTTARRLMGHYVRLLQHALEAPDTAVSALELLPASEREHRR

SEQ ID NO: 13092 - protein, 270 aa, Myxococcus xanthus
SDGQPTEGLTADEELTRMARELRATGLTLSAIGVGTDFNEDLMQAFAEYGAGAYGFLEDAAQLSTLFQKDLQQAGTTVARGVTMTFTLPPGTSLGEVLGYRASQSGNQVHVSLPDFSAGQLERVVVRLNVTGDSVGRTARVLDLKLAYTDLIRDAEVANEASLSAVVTNRREEVLARQDREATVYAARARSAVNMQKSAEALSEGRKDEAKLYLQRTQAALRRSQRGVRQRRGGGGPGRTAGGDVRVRQRGGPTGPALAREEEQGEGAQH

SEQ ID NO: 13093 - protein, 167 aa, Myxococcus xanthus
LNRPTRVILAALLAASFTAGCNKEKAPATAPAAQQAAGEPAPDTVVATFGDGQKITYKELSERLQEPLANLEKQKSQLLKRGLDGMVTEKLVDAEAKKRGLSQEAYLKAEIDDKVPAPTEERIKEVYDGAAGQLPEGSTSEQMKPQIVEFLTQHPKQERAQTLIPRP

SEQ ID NO: 13094 - protein, 276 aa, Myxococcus xanthus
QSGPGLQTAARAGTRPEDAARAYLGQVADLYRLKREDVSAAPLQSVHQTGKGAVIVTFRQAVEGVEVFRSEVKVVMTQALSPVAVTGYLAPSELTLAARQRTGANAFQRSAADAVAAAYSDQSGTPLGPHAFIAVDSRGGYTLFDFEPGVRTVMPGQLVVPARAKKVFFTLPDGLRPAWYVEVNAGPKSSKDSDYTSYVISAVDGAVLFRNDLRAHAAEQTYRYTVWAETAAPYRPFDGPQGSAGSPFPRQELDGYDAPLDVPPNVVELHLEHGKQ

SEQ ID NO: 13095 - protein, 210 aa, Myxococcus xanthus
MMSRPLVAATVMGALLDDVASGLAIGMLLELFFLGTANLGAALPENDTLAATGTSAAAATLSAATGAGSTPAIWSLAVLLFIGLGRVGRKGDRLLEGYTARLARVALASAEAGNITRAMRQNLWGMWPHFAVYGSLTALCALLGFFIEPLLQALPPVVVRGLAWAWPAMASVAAAIAAQGSHARRAPLFAGLGAAVVTASVVCVILLEGR

SEQ ID NO: 13096 - protein, 290 aa, Myxococcus xanthus
RVGVQPFADKTFRASKPESKVHEAPPSMWMGPALLGAAGLMLGLVPWAIQPLLAMAAVDIGGSQAGGLELSLWHGVTPALGLSVGSLVIGGSLFALRQPVLKGLRALNLSNHGPERFYQASLSGLLKLSSSMTRVLQNGSLHQYIVVTLATFGGLLALAVFLRLGEWPRGVSKYVLSHEVVVLVGILAAAVLAVVSRSALTSILALGALGLAEALLYVFFGAPDLAMTQIVVQTLTVILFALDFSRFPVQPHEHRFPWCPPSLPLSVGGFISWIILRVAGRPSHVRLTYL

SEQ ID NO: 13097 - protein, 238 aa, Myxococcus xanthus
QLDFSRSPFHVNTRLTKWPARKTPRRAGVSSFGIGGTNAHVVLEEAPPFEPSGPARDTQLLVLAARTPSALDAMSDRLARHLEAHPELPLADAAFTLQVGRRAFTHRRALTCRGRDDALAALRGHRPREVSSGSAADGEQAVAFLFPGQGAQYVNMGRELHEQEPVFRQALDRCARLLLPHLDLDVRQLLHPSEARREEAEALLRRTAFTQPALFAVEFALAQLWESWGIRPQQTGRG

SEQ ID NO: 13098 - protein, 166 aa, Myxococcus xanthus
MSARQALTNPPEFLEFEAPSTRLELFREVARQSVIEAGQAAQALVLFPVSHQGELLAAPGFDPKMDLFQAPDAGAPLELVFESGGERWPDDRREGLQGLSEREAAELVARTLLAHWGIAPNSAVQVDRASGAPYAVAYVDGILRINPAFLYLAAAYGPSSLPASLQ

SEQ ID NO: 13099 - protein, 113 aa, Myxococcus xanthus
MARILVIDDHDTLREGMAVTLTRAGHTVSAVRSGQDGLAAYRKAPFDLVVTDLKMDGMDGIEVTKSLKALDAGAVVMVVTAFGTIETAVQAMQQGAYDFITKPFPPEVLRAKL

SEQ ID NO: 13100 - protein, 102 aa, Myxococcus xanthus
MEATALREAREETGCRVSLHPAAPQPLDVDIHTIPARRDEPEHHHLDVRFLVVAENPDALVHDPAESFGVRWLTWDEAMTHADEVPLRRMLAKARRVVASAP

SEQ ID NO: 13101 - protein, 527 aa, Myxococcus xanthus
YASTLNGNEPFLADHQVNGNRVLPAVAYLEMARAAVVHRTGATSTGDIRLSNVVWSQPIVVNGVNREIHLTLDGASEGGGAFSFEVQTAGAGQGSRAVLHSQGQAQRMALPRPQRVDLGALRAACGREVVAGGTLYTNYQRLGLQYGPAHQSVREVYVGDGQVLAEVVLPDGVAESDAYILHPSVLDGALQAIMCLHPGGDRGELPFALKELQVFSACARPTWAWIRRSPDNEAPSGRREGMTQRYDLDLCDDQGRVAVVLRGFSTRPVLTAPVRESADTLVGDVLVAPVWETAVIEPEVATPSATQHVLAVGATDEIAAGLAIRCGRVERLVIDEGDSIERIRDRLRGLDRIDHVVWVAPEEPLAFNEVAPRQSKGVLSLFRLVKALLSAGHGSSRLEWTVVTYRAQSTGRGDEVDPTHAAVHGLIGSMAKEYGHWKVRLVDLPDAGAWRDAALWDLPFDAQGNAVVYRQGQWHRQKLLPVDWDAFAASTPSVYRDGGVYVVIGGADGLGGVWTEFMIRKHRAGVY

SEQ ID NO: 13102 - protein, 275 aa, Myxococcus xanthus
VFEGATLRGRFYLDMHPRDDKYKHAAQFTLTSGKSGRRLPEGVLVCNFPRPGAEPALLQHSDVETFFHEFGHLLHHIFGGHTRWAGVSGVRTEWDFVEAPSQMLEEWARDTASLQTFAKHYQTNEPIPADVVERMRRAEEFGKGLWVRQQMFYAALSLELYRRKPEGVDAVTLVRELQGKFTPFPYVEGTYFHLSFGHLDGYSSNYYTYMWSLVIAKDLFTVFQQKGMLSPEPAQAYRRAVLEPGGSDDAARLVNAFLGRDYDFRAYEEWLNQAA

SEQ ID NO: 13103 - protein, 428 aa, Myxococcus xanthus
SKEAAAKASPTVELLYQRALARGGSGNRAGQRADMMTVALRFPTHPYGNEAMAWLTEGSTPPVKLGYTERTTRADRFLDAGATQRGLDELATLDKVKLDKEQAARVALLRARAWFALGRTEDAEKALALARKGPAAVAAQADLLVARRALKSDDNAKARTLMAALDKKYPSQPAGDEGAFFAGWLDLQAGRFADAVQAFTAFETRYPRSRRRDEGMWFRALAHLRQEEYAKARAALDAFLTAYPKSNMGPQARYWMARSRELDGAKADTLGPAYEAVITSAPASFYALMANERLKALSLKTPAHFPQPPQVLQLPRPPELELAVELTRAGLFRDATEEVEAHAARLRSADQALPFAHALLGLGEYGHAHAVAARHLWGRAFGARAPEALAPFYPRAFATAVEGAATQHQVDPYLVWAIMRRESACRPV

SEQ ID NO: 13104 - protein, 373 aa, Myxococcus xanthus
  unsure (1)..(373): unsure at all Xaa locations
VSLVLLIACVNLANLQLARAAARNRELVVRAALGXXPGRLARQMLTESLLLSVAGGGLGVLLAMAVMPGLLSLAPDTSGLLPGDGGLAGAQVGIDGTVLGFSLAASLLTGLLFGLLPAWQASRTDLQMALREGSQRATLGPGGGRTRAFLVVGQVALAVMLLVGAALLIRGFSALQRVQPGFDPHGVHVLRLSLPEGRYGTLQALERFETQVVERVRSLPGVEAVGFATSLPMDRGPSMSFSIEGKYTGDDNGPGAGWGQYRPVTPDYFGVMRIGLVRGRLLAENDVAGTEPVVVINETAARRFWPGEDPLGQRIRVAHSVPSLRDVVPRVVVGVVRDVREDGLNDEAPPVLYLPPGQMSQGVASMIVRMIPH

SEQ ID NO: 13105 - protein, 70 aa, Myxococcus xanthus
TRQNIRQWLIRERNFSGQGTPPPIPDDVRVDLAAKYVAAYEHITGTTLTLEPGDVKTRIERNLREKGYLK

SEQ ID NO: 13106 - protein, 264 aa, Myxococcus xanthus
HARDVIAVGKISGAVGTFAHLPPAVVEHVCRKLGLKPAPASSQVVQRDRHAEFFTALALLGSSIEKFAVEIRHLQRTEVREAEEPFTAGQKGSSAMPHKRNPILSENLTGLARLLRGYAVSAMEDVALWHERDISHSSVERVIGPDATILADFMLIRFARLMEDLRVYPEQMKKNLDLLGGVVNSQRLLLELARKGMDRQAAYVIVQRNAMKLYEEGLDFRQALLADEDLRKMMTPEEISDCFSSGYHTRHMDDVFQRVFGRSA

SEQ ID NO: 13107 - protein, 200 aa, Myxococcus xanthus
  unsure (1)..(200): unsure at all Xaa locations
ANPPXVVGVDXVMGGHLHVVLNPPQLLTDPAGRKVVLAHSGAFAKYVGRLELVVKMPEVLGTGEGGEIISQDYRVFPMDALWCDDAMRRFRHDNSVFWEEGQFLRDERVRQAIQACKNQEDRMTTHLLQPYILGMDFNFQLTSIFSYAPRDVQRRNNSTGGDSPLGNIAADSMRKRRRVEAEMALTNSLGIRDNLYAALE

SEQ ID NO: 13108 - protein, 187 aa, Myxococcus xanthus
PRTIQRWRKPATAQDGRFGPHTRPANRLSELERRRILAVANSEEFRDVSSKQIVPRLADRGEYVASEASFYRVLREAGQLAHRGCAKAPRARARARARARARARARAEHLATGPNQVWSWDITYLKGPVKGAFLYLYLVVDVFSRRIMGFEVHEEESSEHAAALIRRCWQEAGCPKGLCCIRTTVAR

SEQ ID NO: 13109 - protein, 58 aa, Myxococcus xanthus
ERMTGGGFVLNGAGEVAGMTQLMEWGLIETPILLTNTMAVGAVSDGVARYLVDRYPGA

SEQ ID NO: 13110 - protein, 93 aa, Myxococcus xanthus
ALKLTPGWSDLVLIAQGAGMDYRGLIGEIMAPAIPRYKEREARRAASEHPASVLRKSVPLEEGTPAAAQPVAATAPAPASPAPEPSPRMDAKA

SEQ ID NO: 13111 - protein, 481 aa, Myxococcus xanthus
SSIPARIAYFLNLQGPALAVDTACSSSLIAIHLACQGLWRRETNMALAGGVHLNSTPTFYVLSSRGGMLSRKGRCGTFSDEADGFVPGEGVGVVVLKRLSDAIADGDHVRGVIRGTGVNQDGTTNGLTAPSGKSQERLEREVYERFGVNPEDIQMVEAHGTGTRLGDPIEFDALTKSFGAYTRKRGYCALGSIKTNLGHTATAAGVAGIIKVLLSMQHRKIPASLHCNATNPAIDLERSPFFVNTQTRGWDVEPGKPRCAAVSSFGFSGTNGHVILEEAPFQERRISGQAPGYLIALSAHTAAQLKALVERLAAHLKLERIDCDDISKTLLLGRRHLAHRLACVVRDERELSAALETWLAKGRAPGVHVSEVNENTRREQAEFRRYGNACIQQCAEGAPTAEYLEKLAVIADLHLQGYTLELEGLFRAGRSRRIPLPSYPFARESYWVAGETPLAERQPPPAPQRLHPMLHRKPGPDRMGT

SEQ ID NO: 13112 - protein, 145 aa, Myxococcus xanthus
VPPLSVKSGANLGGKVELVGATVEPGRLTPGDQAKVALYFKVLQPMDDDYLIFVHVEDADGRAERINVDHKPAGGMLPTSQWKPGETVKDEFPVYVPPGSTARALNIWLGFWEPRTDSRLRILNPNAVRNDGKDRILLGQVPVAR

SEQ ID NO: 13113 - protein, 75 aa, Myxococcus xanthus
DGLPSKPVVTVAKPTARPEDVGIPQSRPSSRLRKALGFTVNFVLAAALVAVLGTVGRVYLNEGRLDVSALSVDSL

SEQ ID NO: 13114 - protein, 238 aa, Myxococcus xanthus
GSRIALSAPWPFSPGYSLRCASGRDRVLTACKMQAVCDRSPPMSLVLYGHPFSSYTQKVLIALYENGTPFEFRCIGPETPQHSAEWSRRWPLRKFPLLVDGERDIAETSIIIEYLQLAHPGPVRLLPADPMAALDVRFLDRFFDLHVMNAAQHAVDGALTGDSVKRQEGLALAVKKLEVAYAWLEGQLAGRTWAAPGEDFTLADCAAAPSLFYADWTHRISDAFPVLRAYRSRLLARP

SEQ ID NO: 13115 - protein, 136 aa, Myxococcus xanthus
MTRDVVTLKETQNLAKADELLRLHRIRHLPVVRQEKLVGLITHRDLLRAAATHATDPAAQPLWAADIMTRDVQTVRPDTPLRRAVTLMLEHKYGCLPVVDEGGVLQGILTEADLVRYAQHLIGEQDRRELAAEFNA

SEQ ID NO: 13116 - protein, 33 aa, Myxococcus xanthus
RLSGGRPRRLVLLVMAGVAFLSMWMSNVTAALQ

SEQ ID NO: 13117 - protein, 431 aa, Myxococcus xanthus
LSRRFGGRPDVVGQTLMVDDQLHTVVGVLPAGFRFAPDVEAWKPLVLGTDESAGGVWLRVVGRLREGVSAEQARTEMTALGAALVREPGFTEEPAGVRLVPLHTQVVEGSQARLWLLAGVVALVLLVACANVANLLLARASAREREVSVRAALGAGRGRLVRQFLVESGMLALVGGAAGLVLAMWGMDLLRALMPPQFVDAEALRLQPHVLGIALVLSVVTSLLFGLVPALRVSRADARGALGGLRGGAGATRGEGGRVVLVVAQVALALIPLVGAGLMLRTVHALSVVPLGFNPQGVTVVDLSLPSAKYRDETVQRALFSSVLERVRALPGVTSAGMSSTVPLWGRNGLAPVLLPGEAASQADSRELVHFRTTSDGYFNTLGIPLKEGRTIEAWNGPGTAPVVVVNETFAPRYFPGRSAVGQRVQLGARL

SEQ ID NO: 13118 - protein, 188 aa, Myxococcus xanthus
LYSNPGAPMVRLPLKGVSRQSCLVASPSFVDFGPIRYDCAAAPRKTYVANRCSSPVTVTGADIGNGTSHQFSLVMPMTAPVTLGPGAGFELEIGYARNVHGQHFSPLYLRTPNEPSPLLVPLLAETNHEGIQVDRYTQGTDSQLDVLFVVSNTTTMQQYQDRLKEAIPQWLQAAQTNGVDVRVGVTST

SEQ ID NO: 13119 - protein, 261 aa, Myxococcus xanthus
PMWRVNTMPWKQLEMRTRANRWCILLTLGGLASVSGCRTAEPSMEATVPTARAATETFRVEASRLASNLRLPAELVADQTVDVYAKVNSYVKHLRVDIGDVVKKGDLLVTLEAPEIEAQLASARARWAAMEALHVASKASYERTVRTSATEGAVAHDAVDQARAKEQADAAQVVAAKAHYDELLAMRSYLVMRAPFDGVVTERNVELGTYVGPSGRGSHKPMLVVRAVQKLRLHVSIPEAYSPYVHLDETVKFTVRSLPGR

SEQ ID NO: 13120 - protein, 134 aa, Myxococcus xanthus
RSGSDPATGLHDRRGLLLRLEQEVARSRRYHRALSLAVLRPDRPVEPVPSNIADVMRKRVRHPDAISHLGGGVFAVVLPECQAEAARAVISRMLPDVEKATDTEYRSAVADVSQDSDSVEKLLEKLGAPAPEET

SEQ ID NO: 13121 - protein, 185 aa, Myxococcus xanthus
MQDSDLEPLREEPVYLAQVERITTLPDPHPTSSSELKTLFVEDQSDRQRPLDGVDAWKRVAERDAQRRERVKALLAEGALKEGADFLSAGFIFQHGNTPEDYAMARQMGAEAAKRGHPRGLWLAAAAWDRWLMNANLPQRFGTQYRFNPESKEMTLHPVDPNVTDEERARWGFPPLAEIPTVLQR

SEQ ID NO: 13122 - protein, 211 aa, Myxococcus xanthus
REAIDAGSTDEGRYASSASYTNYLQSRLKHHAGDHRGAVDALRLALATDDGNPLLLTRLGEEYARLGDLTRAERELRRAVLRAPAYYPAHVLLGRVLTESKRFARARLHLRRAVTLKPREPEAYLVLTQLHLEMGAPDEAVKVVDALALALPGEASGYQRLGLALAERGDTARAERLLVEAATRAPGDVDVLTALAQLYEDTGRPVQAEEF

SEQ ID NO: 13123 - protein, 70 aa, Myxococcus xanthus
SASIDYSHAEKLRLELAEPLFNPLLKKWVGKGELDYEVYLKTPTLLSLQAPDGERVAHDELMFQVVQQAL

SEQ ID NO: 13124 - protein, 136 aa, Myxococcus xanthus
MSEEKARVLVVDDDPDLLDLVQRSLSAYGFEVLTHTSALGVSNLVRSVEPDFVLIDVNFPALKGDKVVNLARQYALPKTKFILYSASDESKLRSLALASGADGYISKSVQGEELAQRLRAFHLKPRPPTPTPAPTS

SEQ ID NO: 13125 - protein, 188 aa, Myxococcus xanthus
ARLSRGAVEQTLLRAVDAVFALPDVLVVMVLQLAGQSLSDAGAGGGLGPFGLMVVSLALVGWAGPARMFRNRLATLESQEYVAASRALGGGGLHLLRVHLWPALRPFALAVFLSRLPAAILTESTVSFFGIARMEPMSLGRYLGTSYAALIYEGGGRVVLPAWALLVLLVLGASLASQALSGPPRRVT

SEQ ID NO: 13126 - protein, 153 aa, Myxococcus xanthus
MSLTPSEELATFTELDTREREERTDLLKLEPARAAVLVVEDDPSHREILVEMLAGWGYEPLPVGSAEEAEFAVRNKRMDAAIVDVFLPGRSGATLMSRLRERFPQSVLIGVSALSDAAMARKCKGLGADLFIGKPLDPQRLAEALQSRHTSWH

SEQ ID NO: 13127 - protein, 88 aa, Myxococcus xanthus
LEHSESGSMGLVINRGAPLTLGELARGQNLGIAAGRKEHSVYLGGPVEPQRGFVLHDDTEQREKHSVLPGLFLSVTLDALGPLLTKSH

SEQ ID NO: 13128 - protein, 345 aa, Myxococcus xanthus
NRGVSLAVLASARTEDDHHADLGCSIQGPTARPVRRAFFPLKRHVATLGREGALHDAEALLRWLEDTPRYAALCMGKQRRMGRRVLRPDVLFPVATRHRPRVLHLRQEELGLDVPVRASEWPAVADFFAALARGATRAELRAFAALPVLAELVADLGQAGWLVRHEAPVEVPSPGALFVGHNTVLVAGREGRVLVDPYFRPEGAVDAPGYPPMQPRDVGRVDAVVITHSHGDHFHLGSLLQLPRDTRIFVPAVARESLFSTDCALRLAQLGFTRVEPLCWGESRQVGDVTVRALPFYGEQPTDGEGPYPDLFNEGNAWLVRAPGFSAAFFADSGHDVRGDMAAVC

SEQ ID NO: 13129 - protein, 437 aa, Myxococcus xanthus
VDGQAVPEAVRAEVEAQRLRLIEACADEDATVLEKFVDGRLEDITAEDLERALRSGALARTLVPVLCGSAFKKKGVQMLLDAIVNYLPAPSDMPAVEGFVPGKEERVSRPVSDSGPPCALAFKLMSDKAVGGIVFLRVYSGTLRAGTVLLNPATGRRERVGRLMFMHANRREEVAEVHAGDICAALGLKGVRTGDTLCDPAEPVVLESLGVMEPVVQLAVEARSPAELTKLEDGLHRLAAEDPSLRVGVDPEIGQVLLSGMGELHLEVVVDRLRTEHGVEARVGQPKVAWRDTLRRQVRQEYRHVRQSGGPGQYAYVVLDVGPAPRGAGLVFTDDTRGGTIPKELVPAIEKGVAGAMARGVRDGVPLVDVEVRLLDGDTHVRDSTPQAFAVAGSLALQAAAHRAGVQQLEPVMEVEVTTPEEYLGEVLGDLAARRCR

SEQ ID NO: 13130 - protein, 200 aa, Myxococcus xanthus
MQAADGALTPYLEQVRVALRTGQVQRGTMVLGSDRGPRYFDYVLSPALGAGGEVLAVMSSLRDVTESRSAEEFREQFIGMLGHDLRNPLNALSMSAQQLRRKGGLDERQGMLTERILTSAERMDRMIRQLLDFARSRLGGGIPVVRSSCDVFEVVRRTVDELRASHPGRVVELESKGDGLGKWDFDRLEQAVGNLVANAP

SEQ ID NO: 13131 - protein, 236 aa, Myxococcus xanthus
SMGTEQPFSGRLRVSSTVRGWGHTVGEEGVDALRLREARMDLAVAYAPLPWLFLSATLPLQAREVRHVSLARDRGWGIGDVEVAAKVFLFQDKAFSADHLFSALGGVKLPTAPVLRGPDGAQLALDSQLGSGSVDPLAGLAYQHFRGSWSFLASATSFFPTRGIQGFRAGASLRTTLAAQYQPSARWALRLGFDNRLEAPADSKGEHQGHTDSERHEHTGGFIGYASPDVIFSPAC

SEQ ID NO: 13132 - protein, 306 aa, Myxococcus xanthus
MYEKIVLVTRRTRMAGLVERFNTKKQAKFYVEHAGQDFDEFTREDETYRCNVDSLRESLSFGLPVQQVDRSLVPTFLFTGKEVVVVAGQDGLVANVAKYVGEQPLVGVNPDPERFDGVLLPHSVSGARGAVRRVLEGKAAFKRVTLAEARLDDGQRLLAFNDLFIGARSHVSARYRLRTGDQEESQSSSGVVVSTGAGATGWLSSIFNLARGVTAHAGGVPCAPVRLGWEDPQLIFVVREPFASRHSGASLVMGDVTEERELVLESRMASEGVIFSDGVEEDFLRFGAGATARIRPARQRAMLVAG

SEQ ID NO: 13133 - protein, 41 aa, Myxococcus xanthus
GVLAPIGRLLFSAIFITSGLNHFFQLEALMGVAQASGVPEP

SEQ ID NO: 13134 - protein, 92 aa, Myxococcus xanthus
SGPGGQHRNTTASGVRLTHAPTELSVSATERRSQVQNKGVALERLREGLKVLTFVPKVRRATKPTAGSKRRRLEGKKRTSEKKALRNSKSGW

SEQ ID NO: 13135 - protein, 31 aa, Myxococcus xanthus
MVQGLSLGVSEVLVWRQGSRQPLSVRVEVAK

SEQ ID NO: 13136 - protein, 78 aa, Myxococcus xanthus
TLLEVSIVLAIIAVLAALAYAGYAQLSARAGPQNAAADLSGALAEARARAVDRQADVWLIIYPDINHEGQGRAGHGAC

SEQ ID NO: 13137 - protein, 196 aa, Myxococcus xanthus
IEGERERVDRFDGTTRVRLAVARAGVSPGPLAPVRFRMNLSLRGDPPPLLPGQRVRAETKLQPDAPPSNPGEKDFGAARRRQGVAFTGGMDARRLMVLSPAPAWRVSLEDTRTRLAAAVHAVSPSTDAAALFLTLAAGQRAALDDSWEEAFSRAGLAHVLSVSGLHVAALALMTLAVLRRLVVRTGERWRMLDALE

SEQ ID NO: 13138 - protein, 88 aa, Myxococcus xanthus
QDYVARELPALVEQHFPATDARGIFGHSMGGHGALVTALRHPGRYRSVSAFSPIVAPSQVPWGQKAFTAYLGDNRAAWAAWDALRAHE

SEQ ID NO: 13139 - protein, 290 aa, Myxococcus xanthus
PGDHVIPLYTAECGQCLFCKSGKTNLCVAVRPTQGKGVMPDGTTRFSYNGKPVYHYMGCSTFSEYTVVAEVSLARINPNANPEQVCLLGCGVTTGLGAVKNTARVQEGDSVAVFGLGGIGLAVIQGAQMAKAGRIIAIDTNPAKFELAKAFGATDFVNPKDHDRPIQQVIVEMTGWGVDHSFECIGNVGVMRAAIECSHRGWGQSIIIGVAGAGQEISTRPFQLVTGRTWKGTAFGGVKGRSELPGMVEDAMAGKIQLAPFVTHTRSLTDINEAFDLMHEGKSIRTVVRY

SEQ ID NO: 13140 - protein, 386 aa, Myxococcus xanthus
PLPSPRQVRSDIPVALDSIIQRALALQKDSRFESAHALGDALAGFLYSSTPRFSPMSVAYLLRELYRPDLEALGMNAPVPASFAEEMSIWREAPPLPAPTQHGVPALDVEPDYRTEESGPVEVDDAEKEAPAPRATRVGLFAEGSRSSQWVAGVGLVMAAVLAVVAVTRVGADVLAAAKEEVRAPGPPVAQRIIPPALPPGPPVAAPSKPPAAEEAPSRASEAMVENADDDEVSGNADTPDDAAEVAAERSAVARPVSGVRSGKVVPAAGKVARGQTRQAQAALLGAAGNALAVSPVTVGPAHRVLTAGRALQREGKYTDARNSARECARLEPGNAECYLLLGAVEVKLGRIEEGARNYHRFLELAPSDHPLASTVLRILQEYEAR

SEQ ID NO: 13141 - protein, 131 aa, Myxococcus xanthus
ATGELLAVKLWNEWGRAIAASRGLTALDLSARVPLIRAKKAVTRVLVSLTSSPQGGLGAELQVRFEKKTPVELEFMGTTYVASKELVVAEGAGTQQGGRVKLASNAMKLTLWATGMARIIPSVLEKSPFMG

SEQ ID NO: 13142 - protein, 96 aa, Myxococcus xanthus
MDNQHSRQVLIDYARRTGKPLVHGAVNADGTFGLVRWDERFTPDAEDAQGQATCEGGAHLPLLGLLSATLARAIQDFVKHGTRRDSLVNLSSVLSQ

SEQ ID NO: 13143 - protein, 321 aa, Myxococcus xanthus
MVIGYMKAAPTTYVMQFEAGKVVREGAGLSFFYWKPSATLVSVPLSSADVPFVFNEVTRDFQAVTLQGQLTWRVTDPRRLASLLDYSLGPTGRYHSDDPEKLEERLVQVAQVRARSVVQGLTLREVLVRSDAIEQQVLAALAVAEPVKALGVEVMAFSLLSVKPAPEMARALEAEAREALQRNADEAIYARRNAAVEQERRIKESELATELAVEARQRQIREAKMAADIAVEEQRAELMTRWSDNERQAADARAYALEKTLAPVRGVDWKTLMATSASGGDPALNIALAFREMAENAQRIGELNVSPDLLHSLVGAAGRER

SEQ ID NO: 13144 - protein, 81 aa, Myxococcus xanthus
MRILFCGVGTIGSTASVLCCNLEASLVFVVFGRVESKILLAQAYVKPSVGNNKAEALKLQLLNLHGVKAESHGVRLTRGNA

SEQ ID NO: 13145 - protein, 18 aa, Myxococcus xanthus
MSANVPVKLHAPVPNTDI

SEQ ID NO: 13146 - protein, 283 aa, Myxococcus xanthus
CPLDARAGLFAKEDFLYHALSIGAENGGVDMATLSVDRLAAWAPLLRDAAPRTLLLVGRSRGQEALAAVGVPDLASLRGRRLGVYPYGSSHYFALWLLSRVGLRITDVRWVELPTTLDAGRALREGRADAVVGLWGDVELAARDRGGAVLATTADAPHLVATVLVARGDFAARYPDAVRRVLRGLLDAGQSVLKDPTAGARMLGEVAPYLGDPIEAIRSAPPATLADNRAFFGLSGEAPVTYDELFQSAAALFQKLKQGPPVPPAEDTKDLGALKYVSEARGP

SEQ ID NO: 13147 - protein, 148 aa, Myxococcus xanthus
MTGEPLPMLVALGLEGLYLGVMSSMKRFQRAVRANTLDDPEAARKALDALQADLAPSQREHYQQLVGLKEKILANYRKLPGGKVLEADSEPRLDALLTSFLRLISTLNQYRTYLNSSDREHLQREVAELEVDVAGETNPRLKDVKQSP

SEQ ID NO: 13148 - protein, 374 aa, Myxococcus xanthus
NGGVNLSAGLLGFRQELVVRGTLPVADAPESMEVLLGVRVPMPAGTEVYAMGGPGFGSTPGTPSFRVLAGLTFGTPASTPNACVEGQPHDPARCPDFDLDGDGIKNAADHCPTVEGLSELNGCPDGDDDGDGLPNLADRCPKEAENFNGFEDQDGCPDDPDTDGDGISDAKDQCPDQAEDKDGFQDEDGCPDPDNDNDGVLDTADRCPNEAGPKENRGCPDKDTDGDGIVDRLDNCPTEPGPAKNHGCKEKQLAQIGENRIQLLEAVYFENNKDIIIARSNKLLDTVANILIAHPEVEKVRVEGHTDNRGNPDYNLDLSQRRADAVVRYLVSKGVARERLDAKGFGPTQPIADNNTTQGRAKNRRVEFKIVGDA

SEQ ID NO: 13149 - protein, 419 aa, Myxococcus xanthus
GSVSRHQLLLGVHLPRTGNGRTNLQVFGILSHLRLRNNFTGFRVDERGDGLEQTNNATTLGARAEHRRSVTAFGRPVALELGLGARRDSVEQTQRRYRESDGTFFSDEIDAAFTQTDVWGWAEARMPLGRWSFRLGGRADALGVEVFDALAFRDPRYYDGQGYSRSAFGVHLGAKAGVEYALGDDADAWRLFASYGDGFRSPQARSLSEGERAPFVSIRGAELGSRKDGEHWALQLSLFGSQVDNDFFFDHTVGTTVYTGQTLRSGVSAALQARPLQGLVTSVSATFAHAYVRASDTLLPYFAPFVARADVGWDGPLTWTGFGGSTLSLGTGLTFIGPRPLPFSERSATVFLADAHVAIRRGELGLRLEVSNLLDARWRDGEFVYGSRFDPAAAASLVPARHFTAGSPRMASLSLEVHL

SEQ ID NO: 13150 - protein, 157 aa, Myxococcus xanthus
MAYENIRLEQEGAIATLFIDRPKALNALNTKTLQELESALKSLPADVRVLIVTGGGEKAFVAGADIAEMAALTDAQAQEFGALGHRVMAALEALPIPTIAAVNGFALGGGSELALACDFIYASEKAKLGLPEVGLGVIPGFGGTQRLTRVVGRARAK

SEQ ID NO: 13151 - protein, 212 aa, Myxococcus xanthus
LLTVTKVTDAKDVDFAVEAVTESEGLKRGIFLDLDEIVRPGGVLATNTSSIPITRIAAYTKRPESVIGMHFMNPVPVMQLVEIIRGAATSDETYATTRVLAEKMGKTTVVSKDYPGFIVNRILIPMLNEACFAVMEGLGSVEDIDTAMKLGTNQPMGPLQLADFIGLDTVLYIAEVLHKGLGDPKYRPSPLLRQYVEAGWYGKKNGRGFYKY

SEQ ID NO: 13152 - protein, 345 aa, Myxococcus xanthus
PHVEGIEGSMHPELVRRFHEPIRDEAARRYGLSPEQLTELTAFENFVYEAENDDGEGLILRISHSTRRTIDYTLGEVEFVRYLAAARIPIASPILSESGQFVERIEDREPGSYFVATAFERAPGIVFDDAPPLKERYWKPPLFRELGRLFARLHNRAQTYAPSSPRLKRQEWHEYDVVDIDRFAPPEEKLVRERTAAIIARLNQLPRTPESYGLIHADLHMHNFCFAEGKITAFDFDNCEYAWFVKDIAVLLFYIARGEAREARDEAAASFLGPFLEGYRELRRMDREWLAAVPDLLALQRSMNYALFHQYRDPAVLDESTLDRWGRFRRDIEADTPVLQIDFNV

SEQ ID NO: 13153 - protein, 163 aa, Myxococcus xanthus
KGGRVVALGETGLHTGGEEEEEAFLEQLALARSLKLRVVVHTPTTDKERHTRRILTLLRQSGLLPSRALVDHANARTVRTILEVGHWAGLTLHPEALKAERAVVLVRRLGSERLMLNSDAGDGAGDILGLARAANLLTKANLSARIVRRVTHENAARFFQVGD

SEQ ID NO: 13154 - protein, 51 aa, Myxococcus xanthus
RTDVSLNPHVYAALAALDLSGQDTATQRWVDLVLRNFRRAGVNWHEATFIA

SEQ ID NO: 13155 - protein, 32 aa, Myxococcus xanthus
NFELTDIQSEIQRMTREFAAKELIPNARKWDE

SEQ ID NO: 13156 - protein, 79 aa, Myxococcus xanthus
VLPAHGLLAHCRAVAEKIVKNSPLAISKAKQVIEAGADQDLRAANDIERKAFGDLFGSEDQREGMKAFLEKRPATFTGK

SEQ ID NO: 13157 - protein, 423 aa, Myxococcus xanthus
YGARPGQPAAAGRNVPPAAAQATPQAGQGQEGATGGPVTLSQIIPDERTNKLIIVASPAAFERIQDIVGQIDIPTSGGGRINVYYLENANAEELASTLQSLAQGTGNAPRGRTPVPARPPGAPGGPTTTQAAELFSGEVKISADKGSNSLVIVASSADYKNIVQVIQQLDKPRRQVFVEAVIMEVNLDRNARLGMNLHSGFSLSTSNGDQVPGLIGTNTSGQGLPPSLSLTSLASYGGFLAGIQGPVIPALEKLGIPAFGVVLHAMQQSSDVNVLSTPHILTSDNEEAEITVGQNVPFQSGFNPTSLGSLGAGVGGGAGALGGGLLGGLGGLGSLYAPITRQNVELKLTVKPQINESDYIRLVINQQTEEIASTDPVLGPTTSRRSAKTTVIARDQETLVIGGIMQDRTLESVSKVPLLGDIP

SEQ ID NO: 13158 - protein, 161 aa, Myxococcus xanthus
TVRENLAFGLTLRKFPAAEIASRVQEVAGMLELNQLLERKPKALSGGQRQRVAMGRAIVRRPKVFLFDEPLSNLDTALRVQMRGELARLHRRLGATMIYVTHDQVEAMTLATRVAVFNGGLLQQVGPPLELYNRPANQFVAGFLGSPSMNFLEARREGAQF

SEQ ID NO: 13159 - protein, 278 aa, Myxococcus xanthus
MPVTVEQLGPHDAEALRGLLSKDPVHNLYLLGLLEEFGIAPRGRVPFAFYGRFDSQVLTAAVFVGGDGGLVVPSASDAGATSVIADALSSRLTLRSTVGDKSSVDALLRSLAPGKPRLSRTQRLFSVSADDLGPFTNPLLRLAKEEDLPRLLPLAQGYVREVHERDPLAEDPRGYEARVIQRVRQRRTYVLEENGALVFKVDIGSRSQYGAELEGLYTLPAERKKGHALLCLGQISRHLLSSLPRLTLRIDERDESTARIARKVGYLAGRTWRLVLVE

SEQ ID NO: 13160 - protein, 92 aa, Myxococcus xanthus
ALRRDVSGRPAWVKADRDRVDRLPAFLRFDVRLSKSWVYDTFSLEAYLDMLNVTLRRETLGFEYEGGNGFPLRKDAVGFPIALPILGVKGRY

SEQ ID NO: 13161 - protein, 372 aa, Myxococcus xanthus
SQDGIPTMVPLQGGGIPFSRGATVASRVALTSPRISDEAPHRQAKAVSDTPAVLLVDDHVSNLVSLEAILEPLGIRMDKACSGEQALRFLLREDYAVILLDVRMVGLSGFETAALIKQRERTRNVPIIFLTAYGRDDAELVTGYATGAVDFLQKPFPPEVLRSKVSVFVELFRAQQQVRRQSELLRQKEAEARDAALRAAGYIDRLRDFTARLSEAATVPQVCRALFEQGLVAAGAKAGTVNLLDAEGEALEVVDAIGYPESVLSRWRRIPMTAAMPLVESLREQQAIWVGSPEEWSARYPLMDTRGLHEAALALPLLVKGRALGAIGLSFARTRTFTEMDRAFFTALAHACAQALDRVHLTAEERRAHSVA

SEQ ID NO: 13162 - protein, 203 aa, Myxococcus xanthus
MEARWLHTLSLMEFIGARKISRTVADRHPTLEVLGHLADETRHAFAFKRLSAEVAGAEITTFLCPEAAGRYFQALDHELATWATSFTGAPDVYLHYLLTTTAIERRAMVLYPLYKAASRQPAVREELGRVVTEEQSHRLTIEDACVERLTAVGATLDAALALEERLFAAFIGELEATVARESGAQAAFVPAPGEDVAARSQQG

SEQ ID NO: 13163 - protein, 339 aa, Myxococcus xanthus
RPRTNTRCSSRAREFSPGPGSWCRPDAGAPRAEPSGERMKTVDVESLKERMTGFIRSLQDDICGGLERLDGSTRFREDSWTRPGGGGGRSRVLEDGAVLEKAGVNTSVVYGELEEQFAQKLQGEGRHFWAGGISLVLHPRNPHVPTVHANYRFIQQGGKAWFGGGADLTPYYLYEEDAAHFHRVHQAACDKHDAGYYPRFKSACDKYFYLRHREETRGVGGIFFENMGGELEKEFAFVQDCGRAFLDAYLPIAERRKDTPATEGQRFWQEVRRGRYVEFNLVYDRGTVFGLETRGRTESILMSLPPQVRWRYDYHPEPGTPEARLVEVLRQPRDWARGG

SEQ ID NO: 13164 - protein, 289 aa, Myxococcus xanthus
YLGVVPGTNYKTNPNAMESIAKDTIFTNVALTADGDVWWQGKHAEVPHELTDWQGRPCKKGSAQKAAHPNSRFTAPMSNNPALSPKANDPTGVPISAVIFGGRRSNTVPLVLQAFNWTHGVFLGATMGSETTAAATGKVGVVRRDPMAMLPFCGYHMGDYLQHWLDMQKHIAQLPKIFQVNWFRQDKNGKFMWPGFGENMRVLEWIVNRVHGRVPTQETLLGWVPRADQGLNLNGLDLASDVVAEVTSIKEDEWKSELKSQEVFFEQLGTKAPDALMLQRKLLMARLDH

SEQ ID NO: 13165 - protein, 91 aa, Myxococcus xanthus
RLAFVLSVILALAPPVAFAQRGKNAAALIKDGERLYQGGKYREAADALKKAHEAQPHPRLIYNIAISLENAGELREAVTWYQQYVGATDGT

SEQ ID NO: 13166 - protein, 465 aa, Myxococcus xanthus
WLHTSHAFHSAMMEPALAPFAARLADVPLRAPKTPFVSNLTGRWISAAEATDPGYWVRHLREPVRFSDGLKCLFERHAPHLLEAGPGRTLTTLALRHPDRPAGSVAVCSLRPPKEEGSDTTFVQQALGRLWVAGVEVNWDGFHAGGRRHRVPLPAYPFERQHYLLGVQAAARQATTAEAASVAPLARHERPGIATPFVAPGTVLERRVAGIWEESLGFSPIGRHDSFFELGGHSLLATRIVSRLQEEFGVTLPVGKLFESPTVADIAARIEALEPTTNRADIPRRMPREGMRDLSFAQQRLWTLEQLTPGTSAYHLPQALRLRGPLDVSALQESFQQLVRRHEALRTRFPATEGRPFQEVLTSAPVTVRTLALDTLPVSDREAALEQLLSEEAEQPFDLARGPLMRVALARLAPDEHVLSVTLHHIIADGGSLRVLTRELAALYTALRRGHDADLPELPIQYADY

SEQ ID NO: 13167 - protein, 239 aa, Myxococcus xanthus
LYVAWTDGELTPEEIRAMGSAARAQPWLDLRANTVLARWLDPLVPPSPGELAQVREHIRRTAERLSHSEHNNLAELGARLAQVGNGDEGLPAPMPELTRALAQLEESLGVSGSEAVRALVPAASPSRAEQGTPTSFDPEALRAVLDRTYPETRAQVRQWLADPAYRYTDTRDTVKYRDQVLAWLKAMADHGLGRIAFPSGNETSADLGAFVTAFETLAYFDLSLVIKAGVHFGLFGASI

SEQ ID NO: 13168 - protein, 72 aa, Myxococcus xanthus
QELEALIPKPGALGFSGSVERARHEMHGPFSLPPGPEAFSFALYQSTGVGLIPGHALELLENGAVFERMLAD

SEQ ID NO: 13169 - protein, 299 aa, Myxococcus xanthus
KLAETAPIPAPEALPAAPLSLDEVRRITQLLEAISEDRFLLAGLPEEDRIAFLSAAGRVLHPDRDTKSRMAKALRRDRKKTKREHDRAIRATTEIRTLRRSAIFTVPALPPPPPSEPGPERILEQPRRCYVCKAEYRKLHYFYDAMCIECADYNYAKRTQRADLNGKVALITGARVKIGFQASLMLLRSGARVIATTRFPNDAAKRYVQEPDFADWAHRLHIHGLDLRHAPSVELFAKYIEQTHERLDILINNAAQTVRRPPGFYGHLLPGEMRRADDLPAAARALLAGHDACVSTVQP

SEQ ID NO: 13170 - protein, 665 aa, Myxococcus xanthus
AREATFHLRVEEQAARTPDAPAVSLESQVLTYAQLNAKANQLAAQLRTMGVGPEVRVGLCLERTPDAIVAVLAVLKAGGAFVPIDPAAPAQRKSFVLKDCNASVLLTLQHLADAWKPQVRNLLCLDTEASKLASLPTRNAVVNVLGENLAYVIYTSGSTGTPKGVMVQHRSLLAMHAGTTEAFQATGATRQRISLNAPFHFDGALEPLVHLADGHCLCLVPEETRKDPEAMLAWVGQQRVDVLDCTPAQLTLLLQAGLLEQTHVPSRIVCAGEAMAPSLWKQLASTERTTAFNAYGPTESTVCATTASVRNSTAPVPVIGRPIQGTRAYVLDARQRVAPAGIAGELYLSGDGLARGYQGQPQLTAERFIPDAFSGTPGARLYRTGDKARWRHDGTLEYLGRLDFQVKLRGFRIELGEIEAVLRTHDQVQEAVVLVREDVPGDKRLVAYVVVVVTPEAPVTAELLRQHAQERLPEYMVPSAFVLMGTLPLTPTGKVDRKALPVPDVSNLAVKRDVEPPATPLEAQLAEVWKELLRVPTVGRRDTFFELGGHSLLATQLVARIRATFDVDLNLRTFFAAPTVAALAERLSSASSGPRLPALTRARGDGALPLSFAQQRLWFLDQLQPGNASYNMPTALRLSGALDVAALQRAVDEIVRRHESLLEST

SEQ ID NO: 13171 - protein, 185 aa, Myxococcus xanthus
  unsure (1)..(185): unsure at all Xaa locations
CSKADAVEGRGGIVAEHPEVSEPEEARAACASVSAVTAEHPAVARNVAVTGGVASLTPPMDGAPMAQPDAGAAEHVRHRHRERAVVGDRWIARVLRVGAVVSGGMFVLSLGLEAMPQSERVHVAIDLLRKGAASLLLVTPVARLAVAGTLLGLRGEWRYMAMAVGVLGLLAIAVGAGIQAXEERV

SEQ ID NO: 13172 - protein, 502 aa, Myxococcus xanthus
SSQADTQPCPFFCPPDAGQPRRPWWLGNALPTCARAPVNALLLAALLSHAPSFLLAQAGPGTDAGVEPPAARAPALSSETPEPPRFPVSDPLLKPIPPADMQVATWDEALQLLRQRSTRLYTALAQVEAAAGVQRIALAALLPTLTGTVSVQYNVLNPDATPLLGGGGGGGGVGGGIGGDVGGAQSPGLTRPPFLGLLNATQPLFNLPSIIALGTAREARRTANLSLAETRRQLTSALAQSLVLVAAQERMAEVNRVNLRTALERLALTERRFELGAGTRLDVVRVQQDTETARNLVVLGDETLRKARETLGLVLGIPRGVGLVRGVQLETLLQHSRRDCQQLESLDRRADIAVARSRRTLAERQVSEVKARYAPTLALTSTTLALTVEEGFVTVPVWNIGASLVLPFWDGGAREGQLRQTRAGVEVAKQGLVELERTASVEVLQAPRAVEVADAAARIAGRGRALAEENDRLTRRSFEVGTGTSLELIQTASDLRQRSCCF

SEQ ID NO: 13173 - protein, 188 aa, Myxococcus xanthus
RKVTLPEPPRPPVVRKQVAATGAAKGGPEGAPVTIVEFNDFQCPFCSRANPALAQVQQEYGDKVRIVFRHFPLDFHKEAPKASEASLCAGDQGKFWEMHDLLFANQQALGVDSLKKYAADLQLDTAKFNACLDSGEKGAIVQKDLAEGKQAGVSGTPAFFINGILLSGAQPFEEFKSIIDAELNAPKK

SEQ ID NO: 13174 - protein, 184 aa, Myxococcus xanthus
  unsure (1)..(184): unsure at all Xaa locations
VLLQEPPGFAGFLAGSLRTLSVEEVFAHVLSGIRSGLLAVQHATGRRTVSFRDGQVVFATSTERWERLGAALLRLGLLTQAQLTQALSRVTPSRRIGQVLTSEGLVSEANLYSAMTYVVREVVLXLFELEDGSFVFVEGPAPMADVVKLPERTRDLVLTGIKRAELVSRLRRRFPDDTRVTLGS

SEQ ID NO: 13175 - protein, 232 aa, Myxococcus xanthus
CALKPRILVVDDNQELLSLLTQLFEEAGYEVIGASRGKQAVELAKAQPPAAAVLDILLPDMMGYHLADALRKDNPQLPLLFITGVFKGGKHAVEARTKYQAAGYFEKPFEAQKLLEAMTKVLPPEKPAAAAASLQDAFEVELDIDVEEEGPQDAMELTGRIKVTGGGNITAEIRGANLTASPMQKVPATQVRPPTPGRPPDPPPAGAPGSRRGEIRDNLPSLLTAFYLSRET

SEQ ID NO: 13176 - protein, 237 aa, Myxococcus xanthus
MRSFAGFFVSSIEDPELILEQNVRDLNDQVPKMNESIAMVRANVTLLEKENAKYQDDVRSLTAKVKAAIQAGRDDLAAQYASKLQIEKDALARNEQQLATARQAYEKALSVKKAFMREKERKTQEAMNAIREARRAKWQAKVADTMESFTVAGIDSTHDEMLRKVQEKSAINEARMQMALESVDHTAASIEEEAEKIQANELVKQFKMEMGLVSSPAPVSEVGSGPEKTIGKKVGVE

SEQ ID NO: 13177 - protein, 87 aa, Myxococcus xanthus
RLHRGPGLFLFLFLCVLGASYALASRMGYLDRLQERYFPSTREAVRLSPGDFPAGVAAPVADVASVPLRPVLIGFSPRGASAGLLVA

SEQ ID NO: 13178 - protein, 168 aa, Myxococcus xanthus
DAQRRSVVGAGAAVRLVGAALFLAISTTLWLAGGRDWGVYPPALGLYASVAGVLFMLRQRRVARGLGAVQSLVDVGLVYWIQSTTLLVSPFPAGVAGFSLGLFALVVALSGLGMRGTVVYGTALLSAVAQAALMRQASVGWGAVAIAVVALVLVAVVSHYGTGRLRNL

SEQ ID NO: 13179 - protein, 47 aa, Myxococcus xanthus
LSRFLEMHGFTVYSASDALQALDVLERNQVSMVITDYVMPHRTLEPR

SEQ ID NO: 13180 - protein, 180 aa, Myxococcus xanthus
EALDAAAEAFETGDFEAALAAADRGLAQAPDSVDALHLRAAALVELGRLEEAGRAFGAALRVSPDDLEVLLGTADCLICRAGEDREAVEEGLGFCAKGKRLAQKAGDVELLYEFLLLEGMGLNQVGECRAALASLDAALGHMPRSVDAQLERGIALFELCRFDDAKGAFDKVLKDTPDEA

SEQ ID NO: 13181 - protein, 179 aa, Myxococcus xanthus
MVAHLRGNDAREDISRLLPEPEASRVLASQNRPNALLREHDRELATLLREKHLTDITWSELRTHVHGLMNVLSACERIRFTPLPFTYTVLLHRTAYLFCLLLPFGLAEALGWFTPWLAAMIAYTFFGLDRLSDELEEPFGTEPNDLSLLAMARSVEMNLMEALGEPQPEPLKPRDFVLP

SEQ ID NO: 13182 - protein, 111 aa, Myxococcus xanthus
ASEGGSVRHVIVVGAGPGGLSAAINLAGQGFRVTVVEKDAVPGGRMKGLTLGASGEYAVDTGPSILQLPGVLEQIFRRAGRRLEDYVKLLPLDVNTRVHFWDGTHLDTTPA

SEQ ID NO: 13183 - protein, 51 aa, Myxococcus xanthus
LNPLNARTQQGLGFDMLTEPNRRAAMLRALGTRRQAATHKVRLIQGWEDAA

SEQ ID NO: 13184 - protein, 137 aa, Myxococcus xanthus
PVKLSLATRIFLGYAVVLGTFGLVSLFSVTELHRNRLEIRLVSQGYLQLSQDAAELETFHATQEKDTERLIQEGNVEIRRAFIRLARTYNSPLMTQRLAAAQAKAHEVLASAPDSEGPFIRGLEDRFGELQARSLEH

SEQ ID NO: 13185 - protein, 365 aa, Myxococcus xanthus
LAGLPEVRRIRSTLQLGVTQLTVEFEPDADYFRSRQYVVERVAQAQSELPPGTDAPLVSSLTGRLNEVFEFTLEAEPGAAELMTLRDLAEFEVKNRLLAVPGVAGVERLGGYLRQFQVQLDPDQMVARGITLNQVEHALEGANLNASGGFVVQGPMEWTVRAVGRAESVEDLRDTVVAVRDSTPVLLGDVADIREAPAVRRGIAHRLKGEVVSCRVIKQFGADTQQVTAGIRVAIQELKQGLPPGVQLRIVYDQSVLVDSALGGVSRAILLGAVLVVLVLFLLLGDWRAALIVTLTLPLSLALAGVLLKFAGIGINTMTLGGLAIAVGLLVDAAIIVTENIVHRLREAKGKASRRDVALAASMEM

SEQ ID NO: 13186 - protein, 223 aa, Myxococcus xanthus
GADALMSDAGDGSLPFPVFKPEERVCGNCKLFSPQSVDERRGWVGACRLHSWRGNFPPSAPICDKYTPRGSAAPSAVAPARERTARSVAPVVVRRRADPNDVVDLEGLSMTREELMDIFREASGLLDAPPLANKWEGGTMRLVPANTELQPKDLPIDSLFHKVVMVRDRLRVLEQKLNAHPKLSDAEKVEMQSYITRVYGSLTSFNVLFKEKADQFVGSKSED

SEQ ID NO: 13187 - protein, 167 aa, Myxococcus xanthus
MHACALPPLSELYTEHRPRALAIARRIVGDTADAEDVVQDVFARLARRAPGYGGRAAWSTWLHRVMVNSSINWLRARKRRDRLSHDVQEPLSPEALAVGAEMERHFGEAMEDINEQQRQVLYLREVRGLSYPEIARLLRIPEGTVKSTLHRARQRTLSLMEERGQQP

SEQ ID NO: 13188 - protein, 449 aa, Myxococcus xanthus
RVGSTAREGGATVARSIAGFGGIRESIVGSAGVMKKMGRRAEEIGDIVQTINLIADRTNLLSLNASIEAARAGEHGRGFAVVAEEIRALADRAAAASADVAKIVRGLQTTAREAATASGEGVRAADEGAALAGDAERALSTILKGVEDLGSNVREVSRASSEQVQATQALVQGTAKVSEQGRAIATSAAEQAQAAQALAQGGAEMRRMSRQTMQATSEQARALRDVVRSNGQLAEAVQKVSRAVQEQAVAAADLAKGTSQMRQLVQGVSGVVTTQSRDVAGVGTLVQEAAASTQRTLVGLAEQATAAQEVTRAMEETRKQVAQSARGMTEQARALKQSETASRQVAKLAASVTRAAEEQSKALSGLVREADEVRRVARQTSRALDEQTEALGALTASASRQATGVAVVARASAEATAVMEGLAKSVEEIRLRARDITTATAQQARATLE

SEQ ID NO: 13189 - protein, 394 aa, Myxococcus xanthus
SSAPGASPFPHQARCSERARGACSRRARHSSAGCCVRRASGRRHPAARCRVRASRRHPVARCRVRAARSHSVARRRVRAARRHSVARRRVRAARSHSAPWRPRVHGCHPAAGRRTAHSAAIPLPGAPASTGAIPLPGAAPAHAAAIPLPGAAPARAIPLPGAPEAFSAAPHAAAIPLPGAAAPQPAAIPLPGGAPEADPFAFDMGEPAQAAAIPLPGSAPEADPFAFDMGEPAQAAAIPLPEADPFAFDMSEPEQAASVPLPGSAPEADPFGFDMSEPEQAAAIPLPEADPFAFDMSSPAEAAAAMPQADGPSGMDAFGDDFGEPVRDTREVTRVVSIPLPSDAYREPPSAPASGYGVNEPAGTARDFDFETVEAPVEDAAQGYGVNAPAGTAR

SEQ ID NO: 13190 - protein, 189 aa, Myxococcus xanthus
SHDSEISSIDDAIRDIQEGKFVIVADDEDRENEGDLIMAAEKVTPEHLAFMVRHTSGIVCMPMLAERLDELRLPQMVSDNTESHRTAFTVSVDYRHDTHTGVSAADRAKTIRALVDPSSKADDFLRPGHIFPLRYREGGVLRRAGHTEATVDLSRLDGLSASGILCELVKDDGTMMRMPDLKVFAREHK

SEQ ID NO: 13191 - protein, 214 aa, Myxococcus xanthus
ALKFQLLKKTVEARSTKYDQTVDVSINLGVDPKHADQMVRGAVVLPHGTGATVRVAVFAKGEKATDATNAGADVVGAEDLQKRIEEGFLDFDTVIATPDMMGVVGRLGKVLGPRGLMPNPKVGTVTMDVAKAIRDAKGGKVDFRAEKAGIVHAKLGKSSFEVEKLEANFNALVDLVMKLKPAAAKGVYLQGIAISSSMGPGIKLDTMEIKTRHG

SEQ ID NO: 13192 - protein, 132 aa, Myxococcus xanthus
MMTHVLRNPRFVYRFDAAASLLMGVALLLLAPTLTQLAGWRLPSTFLFGVGLFLLPWSAFNLWVGLKQPVLGAALVHLLVDAAWVVGSVLLVVMHAQELTPLGTALLAGQAFAVAGVLALKAVGLTSLRTAA

SEQ ID NO: 13193 - protein, 39 aa, Myxococcus xanthus
IKELHEKFSRTTSAVVAEFTKVDVETVTKLRKKFREGHV

SEQ ID NO: 13194 - protein, 63 aa, Myxococcus xanthus
SPLWGIGLTAGVSGGEAYLHDGRARNLAEAILWHGGEGQAARNNFANMNSTDRNALLTFLRSL

SEQ ID NO: 13195 - protein, 447 aa, Myxococcus xanthus
GEGIIGGVLKRRAPVRMNSPNGLKGVTHYEGSGPAVQALLAVPILEASGLVRGVLVADRLANEPFSDQDEKLLSTIAGEVLRSIEVERVMSYIRKTRDEKDRFFRAIEELNRAGSPDQVFVAVLESTRQLAGLDFCAVTLVSEVDGKRMHRVVRMSGVTAQGQALSGQSFEDNNGLVANVVRYGAPLPGRDIKAMDRQIIFDDETQIRGLGALKIFPLVAGDRILGTLVAGSRKKAAFEQDVLRMIEVIAIQAAQAVLRAQLYEQMERMATTDGLTGLYNHRTFQAKADEVLAQSRRYQRKFSLILTDVDHFKSVNDTYGHPTGDQVLKGVARIIKTMARDTDIVARYGGEEFVIIMPETDAKGAFTISERIREPVKPEVFQTKMGPLRITMSLGIATFPDSAMENHQLIDLADQCLYHSKRNGRNQSVTVDIMQGGRKQLKAANAS

SEQ ID NO: 13196 - protein, 366 aa, Myxococcus xanthus
QSTGAAPQRPETGATPAAGQGATRPLVVSPAAGPGAAPPIAGPGATPPMAGPGATAARPPVAGPGATAPRPAGTAPAAGPGATAPRPVGTAPAAGPGATAARPPVAGPSAQPRPPPSLSAQGAQRPAAPAAAATPANAPGAEEIPALRQLTMAMKQQNHFQRLGLTEQTNSSAVKIAYFRLAKLYHPDTLPQGAPPELEKLKAEVFAYIGDAYRTLSDDSSRASYIEELKSGGSGDGVDVNGILMAEELFQKSCILVKARKFPDAVKMLDEAIKLNPEEAEFYAWRGYARFFTAADKKAAQPEAFREIQNAIRRNERCAPAHYFLGVIAKLSGDGHGALKHFKRTVELQPDHIDAQREVRIASQKK

SEQ ID NO: 13197 - protein, 123 aa, Myxococcus xanthus
LYRRRLQGPFARGGEDVAARQGCLQCHTIDGTPHIGPTWLGLYGRDEPLASGGSVRVDVAYLTESMMDPLAKVVAGYAPVMPSFHGRLSAGEVGALVEFIKSLQPELPEPPSSQEPTYGPLPR

SEQ ID NO: 13198 - protein, 455 aa, Myxococcus xanthus
APSHAESPVAAPSYLDAERGLWSWLTTRDHKRIGVMFLGVLLLMFLLGGVFALALRVELLTPGETVMGRLAYNRAFTVHGVVMGWLFLIPSIPTGFGNFLLPLMIGARDVAFPRINLASLYLYVLRAEMTLWGVFHGGVDTGWTFYTPYSTATGREVMPVLLGVFVVGFSTIITGINFITTVHTLRAPGVTWMKVPLFVWAIYGTSIIQVLATPVLGMVLVLVALERVAGAGLFDPSRGGDPLLFQHLFWFYSHPAVYIMVLPGMGVISETVCAFSRKRPFSYRVIVWSTVGISFVGFLTWGHHMFVSGQSTFGAGAFSVLSMLVAIFTAMKIFTWLGTMYRGSLWVSTPFTYVLGFIFLLFFGGMSGVAVAVTSADLHWHDTYFVVAHFHFIMVGASLMAFLAALHYWFPKMCGRMYPEGMGIGTAVLIIFGFIATFLPQFLLGNLGMPRRFRA

SEQ ID NO: 13199 - protein, 174 aa, Myxococcus xanthus
MPRPYSFDHYQVPKTLPAPKRSLRRQDKARLAHSKAHPEAMESHEGVHYGKRFAETEELYIAHQMEAQMEELARPEPDAKFSHGPEFKAARGTSKGKARTTSAPVVGGTAPIGALPPTREQPPRGRLPEIREEAQHQFQALRGGLGDAVKAVSRLILLPVTLVRMAAGRILPLS

SEQ ID NO: 13200 - protein, 107 aa, Myxococcus xanthus
LGLHMAFGPNVVRNGRRYGNAILSRMTIVKSRNYDLSVGRREPRGALRCDLDIGGGLQLHVFSLHLGLRLGERRMQEALLLSSDILRDAARKDPLVVCGKFNYWGPI

SEQ ID NO: 13201 - protein, 53 aa, Myxococcus xanthus
VQCAQKAEALQAPLKRGDVELRFQEGQWKAYDAAKAHLSKGRKSEALAQLNDC

SEQ ID NO: 13202 - protein, 151 aa, Myxococcus xanthus
DEHIRWYVNGIPTPLGGTHQSGLRSSVVKSVRNYIETHGIAPKGVTLTAEDIREGITAILSTYVVEPQFQGQTKGRLNNPEVSGQVDGVLRPALEKWLNDNKSIAESVVARIVLAARAREASRAASQAVSRKTAVSHRLNLPGKLADCSSR

SEQ ID NO: 13203 - protein, 297 aa, Myxococcus xanthus
MDVEVTAALSVRDGVEFAVRHLVVLMGFVLGLAVDVSAVKHAMRLPAYARGLPLILLGVPLLALLVVNLLPLPPIAAGILLLMAVSPGVPSVAVAAYRQRGDLSLTVALSLTLSLAAIVCLPLSLRLLSEFFPAVFKAPTTVQLLERVMLPFLVPLAAGWALRAWRPMLARRLLRPMLWLFKAVFVVAILLLLFISGPRLRDVDGWMVLGMLVMTLGSAILGHVAGAPRPEDRTALALAAVFGNPSIALAVATASYQDLRLTPFLAVYLVLRTLALLPYLLWNKHHLRHGVPHPGRT

SEQ ID NO: 13204 - protein, 399 aa, Myxococcus xanthus
RGATLIEGMAAAAILAMGISGVFGGLIFASQQNAAANRLSQASAIASQVRSGIQLQGRARLFADVGPLSSARCAGAAETLELAGGLATLPDACVVDLDAFETAAGDPLLRVVPGYSPGGERALPPRPRLDAGAGHRLGRGGGVLPQRRPAPLRQAVRRALQPGGERRGGGAVNAPRTHARRGFTLIELLVGITVSSVVLLAVAGTIIAVNNIFQSNTVSKTAVEGSRVGSDFLNRTLRYAGYGLDPAIAFDFGTMGLPEARKDNYTQEVEDWGNFVTDDLAFRYRDPMFLRRGQLDGTGAEPFQLELEPAATFGQPLRQGQAMLIACPGGQDYFLGRLTADVAADGTSATLNTALAAGLPGDVPKSCMTDTGRMPFVMLVHEKRLRVEAYGGRPYLVVK

SEQ ID NO: 13205 - protein, 129 aa, Myxococcus xanthus
LSFGTFSPPLDIQLSADQGRLMDAMYMDRYSQRTVRFGASGNLAWTGIFEGLAPTACSFCSGAPRRGAIVFRGDGSARFVDGAGQPVIPAGNGAVNRAASLALLSTDGQREYLFAVSAPVGFVDMRVNR

SEQ ID NO: 13206 - protein, 84 aa, Myxococcus xanthus
CALYRDGDRKSKTRDYAMLLLAHSYQEVGQYDKALEVARDAAGAYLNSPYQSQFRGRIATVKRLKNPESAAPPAPAQATSQPGQ

SEQ ID NO: 13207 - protein, 126 aa, Myxococcus xanthus
MTPEKLPPAPVALTFRECLDGARALWADLESGREKLVNVSPAKSVDQEWMRFRTAWLQKLRVRESECALDSRERAPLREVFRRLVRVQDLYAIHAVQYAGEVGGEVDALHDALNTAGRNPGAGRLP

SEQ ID NO: 13208 - protein, 182 aa, Myxococcus xanthus
SGSHPGPLRLQSVQVPRPGAVLPHVVCPDRRFIRGLILQTDNASPALGVRVLADPVAQVPGWPRPPAGSESLGTTDDTGAFRLGLDPGIYRVDFIPTENLPRVSRVITVLPGDDASEQVLATFPLQRGRTVRGMVTEAGAPSPYASVRFYRVADLGGRPSPVLLSQTVSDHLGRYTALLPVR

SEQ ID NO: 13209 - protein, 105 aa, Myxococcus xanthus
MGTVKEVKQAALVLETSDKKQQEVMTDPGTRYEKSGVAVTASDLKPGERAVVHGMKMNNGQVHAQLVKFGKPPAKGTGKDQGGTGETEPAPTPPTQGKRHEHSGH

SEQ ID NO: 13210 - protein, 196 aa, Myxococcus xanthus
GTTTHVERLAAALRAEGHSVLTTREPSDGPVGTMIRQALTGRLGLPGGAGPLAPETLALLFAADRTDHLTARVLPALAAGQIVLCDRYVLSSLAYQGASLPMEWVEAVNACAVSPDLTLFVGVAPEVAARRRKARGGAAELFEADEAQRRIAKQYVAAIRRREKHERIVHIDGEQGIEAVTAASLVEIRKLLARKR

SEQ ID NO: 13211 - protein, 471 aa, Myxococcus xanthus
TATYRLTGKVEGGELAELYQGLELPGIPVVVKLFHPRTSDPAYAHDLAETTRLLQPVRHPGILHVVDLGVIRQRLAVVREDVDGFTLGTALQRLHSKDVVLPPTVALHIIIQLLEALHQAHEAGVVHGAITPGNVVLSHDGLPAVCDFGALRALMAVPQLRKSFGHRGRGTYRAPEVTRGEPHSAQSDIYSLGAIAYELLTQREPVVPGSGGVSTRRSEALPPPSRVDRRINSRLDPLILRALEPTPQRRFRSCGEFATSLRNQLAASGGMPSADDVRRFVRELFPNEMSLVSSGPPPFKEPFTLEPISGAEMDDLRAEELEKSVVQRAPYSRALTEDEANAETQQASEPAFEEYRPELYERDVADAATRVRAPSRASASDSTSAPGEDTGPAPAGPLEQGWEAPPGAAPPKPRRQPSSVGGGSGHTRIGRNPRLKVVEDFSAPEPAADDEGSISVFAPGRRGARIRRAPI

SEQ ID NO: 13212 - protein, 120 aa, Myxococcus xanthus
  unsure (1)..(120): unsure at all Xaa locations
MDSRVAQLVTALLAEPSAAEPGWTRERLEPVVRRVVDRGIFSLDDVRVYVQLAESLGDDFESQRRHAWMRSWLDDASVSDPVARLHRVVRERRRREDVAAQNQRKEAGXXLRHAPPXEGR

SEQ ID NO: 13213 - protein, 171 aa, Myxococcus xanthus
TPVDRTCKSPSARRDARSGYTLHGQRFDDPYAWMEQLDAPETQAWISEQEALTQSVLHALPGREALREAVTRSARHARRSPPIAAGPGGREFLWQAEARDDKLKLLLRRHEGAPLETLLDPNTWASNEVLVFAVPSPDGAFVAFGKAVGSAHGALIHVLEVSTGRLLPDRP

SEQ ID NO: 13214 - protein, 351 aa, Myxococcus xanthus
MRANVFQAVNRFGIEEVERPRAGAGEAVIRMTMTTVCGTDLHIVRGEYPVRPGLVIGHEPVGVIEELGPGVTDYRPGQRVLVGAITPCGQCRACLSSHLSQCGHGAGYEALGGWRMGNTQDGAQAEYIRIPAAQANLAPIPDGLTDEQVILLSDIASTGFSGAEAGSVRIGDAVVVFAQGPIGLCASIGARLMGASLVVGVDGDEARMKMAQRMGVDVVLDHRQQDVVAEVKRLTGGGADVAIEALGTQQTFESALRCLRPAGTLSSLGVYSGKLQLPYDAFSAGLGDYRIVTTLCPGGKERMRRLMDLVHHKRVDLSPLITHRFKLADIQEAYALFGERRDGVFKVAIQP

SEQ ID NO: 13215 - protein, 150 aa, Myxococcus xanthus
METGQASAAREAMPRWEHLTRGSQRVVRGQGRSLEEAFEQAAVALCALVVDPASVEVREEVELVCEATAPERLLADWLRAIVHKMAARRLCFRCFAVRMDGTRLFGHAFGEPLDRERHPFARDVRGVSLVDTRVSQGADGLWTAECEVEL

SEQ ID NO: 13216 - protein, 237 aa, Myxococcus xanthus
RQGGTDDMWQEGNTDPDIREVQVQVGDVVLGGSLGIPDGARGLVIFAHGSGSSRFSPRNRAVARALRAQGLATLLFDLLSEVEEVKDARTGELRFDIPFLARRLAAVTEWAQRQPALAVLRMGYFGSSTGAAAALVAAALHPDLIHAVVSRGGRPDLAGPVLPRVQAPTLLLVGGQDVGVLELNEASLARMEGLKGIHIIPGATHLFEEPGALEQVARQAAAWFLRFLGGVGAEARA

SEQ ID NO: 13217 - protein, 43 aa, Myxococcus xanthus
SMAELVREYPPKRQREEALKDGREPQRPALIGLEQSAAKLRRA

SEQ ID NO: 13218 - protein, 287 aa, Myxococcus xanthus
MDAVVNGESDLEDLARLRTVPWPEAPAGTVGSVIVSGAAGKKVRLFKRVRGNFISGGFPDTVFLSTAEIRRGVVLAIEGRDIVRDPEEWDGFADVVLTIGRNNPHDPVFTDTVRMRVAPVVLFHHMTPAWNVFVSKPAASIEANQFRQALGGVLADSGERMVYSEFAVDDLWAQDYFEPAYMSMPAPEGRQHVMKVNYRAPHVYNTDANAPLRAAGRIAFWLRGPDTAAIQQYQQGMSMASQTLNSFGNTEVIPPYEKDGVTYPLGRLFRGRGPDSRPDYQPDPSFL

SEQ ID NO: 13219 - protein, 547 aa, Myxococcus xanthus
MAAKEIFFHQSAREAILRGVRTLSDAVAVTLGPKGRNVVIEKSFGSPTITKDGVTVAKEIDLENKFENMGAQMVKEVASKTSDKAGDGTTTATVLARAIYEEGLKLVAAGHSPMDLKRGIDKAVEVVVGELKSLSKPTADKKAITQVGTISANGDETIGAIIADAMEKVGKEGVITVEEAKGLETTLDVVEGMQFDRGYVSPYFVTNRERMEAVLEDPYILISEKKVSSMQDMIPLLEQVARSGKPLIIIADDIEGEALATLVVNKIRGVLNVCAVKAPGFGDRRKEMLQDIAVLTGGTVVSEDLGHKFETLTLTDLGRAKRVTVDKDNTTVVDGVGTKAAIEGRIKLIRTQIDSVTSDYDREKLQERLAKLVGGVAVINVGAATETEMKEKKARVEDALHATRAAVEEGIVPGGGVAYLRALPALEKLKPGGEQDFGVAIIRRALQEPLRKIASNAGVEGAVVINKVREGTGAFGYNARTEVYEDLEKAGVIDPTKVERTALQNAASVASLLLTTEAMVAERPKGKAKGGGAGAGMPDYGGDDMDY

SEQ ID NO: 13220 - protein, 218 aa, Myxococcus xanthus
MRVLLTDDHQLVRAGLRALLESLGGVTVLAECGDGHEALTLTDKLQPDVLLLDLSLPGLNGIEVARRVPKLSPSTRILILSMHTSAEYVAQALRAGVAGYLVKDSAVEELKVALESVWQGRTYLSPAISQTVVEGFLRITDDERPAANPLDRLTSRQREILQLISEGNGTRAIAERLQVSVKTVEAHRTQLMERLAIYDVPSLVRLAVRYGLVPGESS

SEQ ID NO: 13221 - protein, 27 aa, Myxococcus xanthus
LSGLRDGTQVVLRNGEESLRVTTNDSF

SEQ ID NO: 13222 - protein, 298 aa, Myxococcus xanthus
RLKPGDTFIFAGKKLEFSRIQDMTAYVRPAKTKVTQTPRWGGSRLPLSGSLAAAVRRTLDTARHGDVTSDELAAAWPVLDAQARLSRIPAADILLAETCQTRDGHHLFLYPFEGRLVHEGLAALLALRLTRLRKATFTLSVNDYGLELLTPTPFPFEEALHPALFTRERLEADVLESVNVGELSKRQFRDIARIAGLVLPGLPGARKSSRQVQASASLLHDVFIKYDPDNLLLVQARREVLEQQFEEGRLERTLERLQAAPVERIHVRRPTPLGFPLVVERISASLSSESLLERVERL

SEQ ID NO: 13223 - protein, 214 aa, Myxococcus xanthus
LRDRLVEVVQRSLHQSSGTSTSVGEVLVVDDDSATRELVSRNLRRAGFSTSEARSGEDALLKARVSPPALVVLDLMMPNLDGFEVLRRLRAEKLQVPVVVLTGKTLSAEEEALLRDGFAGFVKKGGHALEDVIAQAKGLLLSQRAASAGKLARILYVEDSAQNRDIVRRYLNGHFEVIEAEDGEHGLERAIRDAPDLILMDLSLPRLDGWEVTR

SEQ ID NO: 13224 - protein, 468 aa, Myxococcus xanthus
NRLFLRAEEFASSRPEVTRVFSVVGGFGSGAVNTGMMFVSLKPPDERMPQAEFQQILRKEFNSYPGLRAVVQDQSQSGFTAQRGFPVEFSVRGSEWEQLVEASQEMREKLQASGKVVDVDTDYQLGMPELRITPDRGRAADLGVPIQSVATTINALVGGVRVGKYSTGGRRIDVRMRLLADQRSRPEDLSTLKVRTASGALVPLSSLVTQEERPALQAITRRDRERAISVYANVAPSSNQEEALATVERLAKELPGGVRVVAGGASVAFRDSMSSLFFALFLGIGVAYMVLGAQFNSFLHPVTVLTILPLSVAGAAFALFATGTTLNIFSMIGLLLLMGIVKKNSIILVDYALQERERGADAMQAMLRAGPVRLRPILMTSTATMMAAVPAALALGAGSETRAPMSIAVLGGLSVSTVLSLLVVPAFYVVADRMKTRLGERFGKKDDETHESPQHPEHGDAPRPAAHG

SEQ ID NO: 13225 - protein, 198 aa, Myxococcus xanthus
LRGPLLKPLLQLAVPTTLVLIAQSLVGVAENWYASFLGTEALAGVSLVFPVVMLMTMMSNGGIGSGVASAVARALGANRREDANALVWHAVVLALAIGLVFSVLAWMTGPALYTALGGRAGALDAALQYSNYVFAGSIPFWLVNLLAAALRGAGEVRVPALVTLVGAAVFLVVTPGVIFGFGPVPPMGLAGAWLAMTF

SEQ ID NO: 13226 - protein, 43 aa, Myxococcus xanthus
VELVALSAVAGEHLLVIGPPGTAKSEAVRRTARVLGGSYFDTS

SEQ ID NO: 13227 - protein, 45 aa, Myxococcus xanthus
LDPVLASMGGPEERVVLIGSSLGGLTAARVPEQDARVCALVLFRA

SEQ ID NO: 13228 - protein, 53 aa, Myxococcus xanthus
MAFRVGVDGWFSDRWGVSVSTGFQFCDVKLTSNALNQCAKLMQSVIAGPVLRI

SEQ ID NO: 13229 - protein, 263 aa, Myxococcus xanthus
MVTCDFKGGIGTSSRKLPEVLGGYTLGVLVMSNFGKMHNLRVGGMPVGEVLAEKFKGTPKRGQTYGSIIAVVATDAPLLSHQINRLCKRVALGIGRVGSYAAHGSGEIVVGFSTANIIPRRTQKMVYKLKLLLDQRLDPLYEAVMEATEEAILNAMCMATSMTGANGNHCPALPLGEVRRFLDAYKPIFASVKKRPQQSSAPAAKERPSNEDREGDVTVSTARPTQVRSAEGIPFPTRPAPDDTGEPGGPEGSSSGSPPGSDS

SEQ ID NO: 13230 - protein, 39 aa, Myxococcus xanthus
MARSKSKHRRVQMKIKQAWKKRAKKNKAEAKAAAESKKK

SEQ ID NO: 13231 - protein, 160 aa, Myxococcus xanthus
TQVRTSGRFAPFFAGLLLLTTGGCGGEAPRCTECPAVEGRYRLQFDTGAGVPPECALLGVEVPTGEVLDIARSGENLTSRLAGVPVRGTITTQGTFLMTGTGVPSANRTDTLTLTGSYLAPLTDGGTASINGVLTGSYVRASDTGGQRCNVNSPFSATRD

SEQ ID NO: 13232 - protein, 133 aa, Myxococcus xanthus
TGLAGALLAVVVAAASGSALVPVSGGNALTLPAQRHIVRIETGSSRPPTWLVAIQHGGVDGKGLVLYRSEDALRTLRRVGDIQPNAAHTDRAELLAVGMDVALVYSYEGPQLAASSQHDVYFQWWRYQPGADT

SEQ ID NO: 13233 - protein, 275 aa, Myxococcus xanthus
WVTLCYRGKERHASQAEMTYWRAFAAEKLREDPEMSPVALKYAITDTLRAKMTGTDSASPANIERFIEDAIGWVSMCYEGKERHASPAEMAHWRAFATAKLAENPKMTPEELRHAITDAIRAQALGLDTLSPANIDGFIMEAIGWVSLCYLGASRAPTDEEMQSWRAFSAEKRRENPDITPEELKYAIRDAVRNELTGMSKPAELNIERFIREAYEFMFHAYRGMPANMKRDPTPRELHEWQQFARARLREEPKLSSEELNSYLLDSLRTALANQ

SEQ ID NO: 13234 - protein, 243 aa, Myxococcus xanthus
MIGPLLKEWRTLRGKSQLALSLEAQVSARHLSFLESGRSGASQELVLRLAEALGLGLRDRNALLVAAGFAPQFGERGWHSAELAEVRRAAGLILASHEPYPAIVVDSSSTVLEANAGALAMMGQPREALGQVNLMDLVFVPGPVRSAIGNWEEIAGYLLHRLREGARMRGPRSPVASVLAHVLAQPGVEALTALRPANAGSVLVPLTFTRDGATTHWYTTLTSFGAPQDALVEEITIEQFHPM

SEQ ID NO: 13235 - protein, 323 aa, Myxococcus xanthus
KTRLWLLLVPALVAAGCGPIDEADEPVIDELTGQVLLEATTKYDMHRLLEDTDITGGQWITTAQVQAFLQQNNSFLANYRDPAFSNKTAAALIVERSKAFGISPLYMLARIQVESSLIQSGNSNNLAKATGCGCPDTSGCDAQYVGFGKQIDCSAKKLRGYLTDLDAGRATISGWRVGVTKSTSDPCSVRPANKATAALYTYTPWVGAYALQCGRTNVGGSSLVSVVYHRYESAYAWGSASGCYSETADTTVPELGCVQSSSDAMWRQCQSGAFTAGSTTKPTNCTASYGWCSSATLGRSVPPRTCVQSTGDQQWHQCGAVEL

SEQ ID NO: 13236 - protein, 215 aa, Myxococcus xanthus
TIPLCSTVNNLYESLYLPLSTAQFRVMGSDRIRSIAVQAVSDTAMDDAMAEIDQKLRREHRLRPEQPADFNIRDQASLLNTMQETTQTFSLLLAGIAAISLLVGGIGIMNIMLVSVTERTREIGLRKALGATGTDIMLQFLVESLVLCLAGGTLGLLLGMGGAAMLQRMAGWTVVVAPEAIIVAIAFSATVGVFFGIWPARRAASLAPIESLRYE

SEQ ID NO: 13237 - protein, 78 aa, Myxococcus xanthus
AQRVLSDASNEGEALVSGGRIVFCALILTRFLALGGAHAEGGAAAAWLQLPLLLGSIAASVMALWAARRRMFGAKLLV

SEQ ID NO: 13238 - protein, 230 aa, Myxococcus xanthus
MRAQKTIRPPLTSASPSFEASDSTRCAICSSASGRGLSGIHGKLPWVGRVRHLLVVEDATRLARAIEEALRSRVERCTHAASLAAARQVLQCDAPDAVILDVSLPDGDSIELLAPLCELEPLPHVIAISGTATAEQAFQLAQEGVRAFLPKPLDLARLESVWLETLARPPDLVTALRASAGRVPLHGFESLVRDTLVDEALAKSEGSVRGAAKLLRISRQLLQHILGGRK

SEQ ID NO: 13239 - protein, 73 aa, Myxococcus xanthus
ESLLELAEGTLRINRVVRRVEDTSSGAVLEERTIAENRRRLLNPEARKRTCLTCGETACHARVEVPRSEVRAP

SEQ ID NO: 13240 - protein, 349 aa, Myxococcus xanthus
MNLVLAPEPAPWLSHLASLLTREAEVLAPWALPRLPDWGPLPTRLRQAWTRRTLPVPEGFRVWGLPGWGAVEAGMRVAARSTAATLQARFTLRKRWAQAASALLPASVETVLAPALGAREVFAMARRRGARCVLVEDLPSLRALHADLDAAAARHPEEAFLRNHRASAEDVARQDAERVLADEIWVRGELALERLRLAGHAPEKLRRLHFPSDRESPPAPRLPQGHGPHVALLAGPALARGGLREALAVLDERPQWNLWVRPAEGTDPRHLNHPRVRRVTAQVQRTLQQVDVVLAPAWCESHLGELAQAPEQGIPIIATDRAAGFWPCRAIPRGDVPALIAELDALTAR

SEQ ID NO: 13241 - protein, 112 aa, Myxococcus xanthus
AYVRSPYVTGQQRPIEQPIEFDHRHHAGDEQIDCRYCHWSVEESPSAGIPSTTVCMSCHAQVWNKSPYLTEVRKAFFSDQPIPWVRVHNLPDFVYFNHSIHVAKGVGCATCH

SEQ ID NO: 13242 - protein, 277 aa, Myxococcus xanthus
SVARAEGGTLFIDEIDKLSLKAQAGLLHLLESRSYRPLGEGTGERQADVRFIIGTNADLHAEVRAGRFREDLYYRVNVLPVRMPALQERQDEIPLWAQYMVNRRHRERSPDGHARLMKEAERLLVGSPWPGNLRQLDNIVRRAYTLAMVEHADASGELVLHEKHVARALDYEQAPGARPLPEALRAAAQAFVAEARRRNAPLDLDLADAFRGMVLGLAIRQVGRDEGFKLLGRESLVKNRNHHKALKRELEKVDSLYKALGEEGSPFSDLLSEVEAV

SEQ ID NO: 13243 - protein, 138 aa, Myxococcus xanthus
TYFCGESRADTFACVETRLHAERIREVAEDAPHLLVAHAYARCVLDVFSGHRRARRITDAFELAEGQGTTFYGTVPEAGLAAFRVRFHSRIDGLELAEDETREVVQEARMAFRLHALVCDELARGATGIAAGPHADAR

SEQ ID NO: 13244 - protein, 430 aa, Myxococcus xanthus
MDANHLLELVKRYQDNKAFISNEETAKIALVVPFIRSLGYDPSVPREVRLEYAADFVQGDGKKLPDRMDFAIFDQTGTKPLIVIETKPLGTDLKSRAQQLARYLAQLPELHFGIITDGCHYLFFGDLENPNVMDPEPFFTFSLEDTKSDWVKVAKFLSKFSREAFNATTLITDAENSRYRQGMIDKLASALKAPGEHEAFLKWLTEDIYKGKRTTAVMERLADVAKEAIEPTLLRVMGDDFLNKLKERIQRLNEGAEPAVAQEGANVVKPDSARPFEADGRAAPDEKGRAAVETTETELEFFGVVRDICVKNGAAAEDILYRDTASYFNVSFKRPTKWFARFFSNGKRKSIVTWVPVDEARAIAAGFEVEAAPAGLGTSRVFIESVPQVWALKALVTRSLELSKTVRDESPSPDAATHEDGKPALKVITG

SEQ ID NO: 13245 - protein, 132 aa, Myxococcus xanthus
LIQYPGTNIAPVYSTPGVPVVFRPQAMQDIEDWLVTHGERVMFIYGDLDPWTAAAFPLGNAQDSFVFTAPGGNHGSTFNWLPTTLRDQAQDIVRRWAGVPSLKHAPVPLPEADTVEFGPHLPPRRLQPPPAP

SEQ ID NO: 13246 - protein, 252 aa, Myxococcus xanthus
LLHKHLTPELKSRLERLTTRNGWTLRKTIQSGLDHGDSQMGVYAGDSESYALFSPLLHPIIRDHSGHDLSGHTSDFSLDGLPQGDLDPTGEFILSTRVRVGRNLARYAFPPAIGARDRAALEAEVVQVLSGLRGHLTGKYHPLASLSEAERLELVHHHVLLQQSDRFLDSAGVNRDWPRNRGMFHSADMRFIVWVGEEDALRIISMQPGSGLAQTYLRLQTGLEQFDGQVDFAQDSRVGFLTGCPTNLGTRM

SEQ ID NO: 13247 - protein, 181 aa, Myxococcus xanthus
SLGSLALVLHAHLPFVRHPEHEDFLEEDWLYEAISETYLPLLQVFDGLAEDGVPFRLAMTLSPTLVSMLRDELLMSRYARRLDLLCELGAREVHRTRDDATFGPIARFYRDHFESLRRAFHDRYKRDLVAAFRRLQDEGYLDILTCNATHGFVPLMQQVPKTVNAQVTVAANHYRQHFGRV

SEQ ID NO: 13248 - protein, 430 aa, Myxococcus xanthus
SVADVLATNGDTHLGGDNIDLRIMDWLITEFKKDTGLDVSKDKMVLQRLKEAAEKAKIELSAAMETDINLPFLTADATGPKHLNVKLTRAKFEAMIDDLIERSLEPCRKCLKDAGVEPKDLNEIVLVGGTTRIPKVQEAVKRLFGKEPNRSVNPDEVVAVGAAVQAGVLSGEVKDILLLDVTPLSLGVETLGGVMTKLIERNTTIPTRKSETFSTAADGQTQVEIHVLQGEREMAGDNRSLGRFHLTGMPPAPRGVPQIEVTFDIDANGILNVSAKDKATGKEQKVTITHSSGLAKDEVEKMVADARSNEAADKGRRELVEMKNQAESQSYAAEKLLKENKDKLSADTAKALEDAVAELNKVRDGQDKDAIKTALDALQAASYKAAEEMYRATGGAPGAEGAPGAGPSAAPGSQASAKKDDVVDAEFRQS

SEQ ID NO: 13249 - protein, 374 aa, Myxococcus xanthus
IHAPHPVAVDRVDFSGIQDESHREAEALKRVTADARRPFDLTQGPLLRVTLLKLAPSEHVLLLCMHHIISDGWSMGVLVREVTSLYGAFHAGQPVSLPELPVQYADYAVWQRGWLQGDALNQQFSFWKEQLAGAPHALELPTDKPRPAFLSTRGASVPVQLSLAHSQGVETLAQKEGVTPFMVLLAAYHMLLNRYSAQDDVLVGSPIAGRHHAQTESLIGFFVNTLVLRARFGRELTFRQLLAQVRDTTLGAYEYQDLPVERLVEELQVERDPSRTPLFQTLFTLQNAPIPELVLPGLTVRPADGEDTGVALFELSLDLFRGADGFSGTLNYSTDLYEEATAQRLASHYQRLLEGVLARPDERVAALPMMPSLI

SEQ ID NO: 13250 - protein, 252 aa, Myxococcus xanthus
MRCPLRVCVGASNALPEDESLAAFADRFLARIFVEPVPDPRLEELLAGGASLWGDADAQVTSLESLDVVAQVAREADLSGVRPHLAHALRTLRTAGVALSDRRAVKVQKLIAAAAALAGRRTPGTADLWPLVYAVPTKEAQALARDVLRDVLAGTENPALPAAALEASAGPLARARRIASAGQALLAERPVDGNGEALAAWRLKLEGVAREMDAGFAPESLPDDLKVLRAEVAGVLASGASGLESSETEVAV

SEQ ID NO: 13251 - protein, 91 aa, Myxococcus xanthus
LYVSRFAALVPRACAVRVDALDEHGQPVTVQARGWYARILQHELDHLDGTLYVDRMETRSFTTAENHRRYQAGRSTEELRAELGLPVPDKG

SEQ ID NO: 13252 - protein, 66 aa, Myxococcus xanthus
EVHTVPMLPGDVRPLGQGLFVRAFRTHHPVPSLGYQFFRRVAKLRLEHQSLPPQEIARRRQAGEAL

SEQ ID NO: 13253 - protein, 191 aa, Myxococcus xanthus
MDETRDERPLLGQDVRIVAPPLQSGPHMETSSLQEVVAPEGICYGCGTKNPHGLHIQSYWDEDGIHVVARHTPDARYSGWPELVYGGLIAMLVDCHSNWTAMAYHYRAEGRSPGSSPAIECVTGSLGVKFIKPTPMGVPLTLRARVEGEVGRKSRVLCEVFAGETLTAVGDSIFVRVDTAQLKAAAHGREG

SEQ ID NO: 13254 - protein, 63 aa, Myxococcus xanthus
MLAIAGAVLLWSGLKARDSLAERATELITGRNTDRTTLYLAGGGAALVGGILMVLAGGGRRRR

SEQ ID NO: 13255 - protein, 632 aa, Myxococcus xanthus
MHESFTHVLGEDALMDALRACWASAYGERVVAYRKAEGLTEEPAIAVVVQAMVDAARAGVMFTADPSSGDTGRIVIEAAWGLGEVVVGGQVEPDTYSVSKKEPCVREVRVGDKSVRLVRNAEGHTQRETLSPEQAHERVLSDVAVLELARLGLRVEQHYGAPQDIEWAEERGRLFLVQTRPITTLGKSAVPPPEEGHAGKALVQGLGASPGVAAGRVRVLASPAEGRQLQPGEVLVAEMTSPDWVPTMRRAAAIVTDRGGMTCHAAIVSRELRKPCVVGTRTATRTLRDSEAVTVDGSMGEVREGQEAPRPRAVEVPATASTVGTAPVLATRLYVNLALPAQAREAAALPVEGVGLLRAEFMLTEALGGVHPRKLIAEGRRGEFVERMAGALLQTTRAFHPRPVVYRTTDFRTNEFRGLEGGAEFEPEESNPMIGFRGAYRYLREPDVFNLELEVLARVREQTPNLQVMLPFVRTLWELEACLELIARSPLGRQRGLKTWVMAEVPSIVYRLHDYAKCGIDGVSIGSNDLTQLMLGVDRDSESCAELFDEADAAVLAAIGDIIRGCEEAGLTSSLCGQAPSNRPDFAEHLVRAGITSISVDPAAVLATQRVIAAAEQRLLLAASKRATLQGC

SEQ ID NO: 13256 - protein, 172 aa, Myxococcus xanthus
MAYLNPTPANKAEIYGPLASMYMTGGTTEDSHKYFSEALKLQPKDEASLGWIAEIYSQRDGARSMGAPIIKESLEKSLSYYDQVIAINPNSANTYLNKRVVMGRLMEFERQQKEMALSEAAENAKNKEVVAEATARADEHQKRMDEYQVQFAEMTKKFGEAQKAAKAAAPAQ

SEQ ID NO: 13257 - protein, 236 aa, Myxococcus xanthus
MSILDPQTGKQPPQVALSDKPRHLCIPQGDTDPIWVDVSDGQNLLLNTKTAADLPAIEPPPSCAPFKWGPRMCPPQLVRRSPIPCERPRDLPDVPGFSAQHVYKLNDLNVVLGERSPGSRVPMAAVFQQGQKVPLWHGNVADMDPKMVKERVVEVLAFSEDALVMVYELKEGGAQLIRRDMRTGSVSWDVPIPNSKSGSGASDIKLHGGRVYVPHWVWLDVFDAKTGNLIGTLGKW

SEQ ID NO: 13258 - protein, 119 aa, Myxococcus xanthus
DTRHVVERALVREARPEDDAVVGELLVDAFLTQYAKKLPEVVYGDQRKRELRDVPSRRKAATVLVAELDGQVVGHRSLFKARAPGYEVWVANADDFGGPGPPPGSLPMGTGGWAPAPFL

SEQ ID NO: 13259 - protein, 330 aa, Myxococcus xanthus
RAAQMLRASGQPPRMFAWVLAIVILALALQFVSCVPDSEPGLPWRRGTRRCGHTLRKDDRAWRGGSSPSFSFWPWWRRQCGERRAPRKGPRSSRSAAPPVTRWAQGDRVGPDLHGVMERRDEAWVTRFITSPGAVIDEGDPVANALLKQFNGIRMPDQQLAPEELGALYAFFRDCTKKGEGGCKPSPAAKMGTDATSEEVARGRRLFEGTEALAKGGPACFGCHDVRGLGVAGGGTLGPNLTFAFARMGERGMRPLLAKLDTPMMAALYAKAPLEEEEQYALKAYLADVSRDGSKPRTDRDFFYLGLVGMLAVLGFMGVAFNAHTKRGQP

SEQ ID NO: 13260 - protein, 534 aa, Myxococcus xanthus
METTSVLGASFSSDEKRVLYSSNETGVFNVFSVPVTGGKPTQLTRSTQDASIAVAYFPTDDRVLFTRDSGGNELVHLYVRTLDGQEKDLTPGDEHRASFFGWSQDGAAFYVLTNERDARFQDLYRYDAKTYARTLLYAGDSEHVPGALSPDEKWLALEKSRTLSDSDVYLYEFATQQRRHLTAHEGSVSWKAATFDPASSALYLLTNEGSEFIRVERHVLATRKRELVEQVEWDVLSTVFSRRGAWRITRVNEDGRTTLRVHDVKAGRRVSLPGIPEGAISGVSLSRGEKRMAFHVDGDRSPGNLYVYDFETKKLTRLTDTLGRALDTQHLVESERVRFKSFDGLEIPALLYKPHQATAKQRAPAIVFVHGGPGGQSSKGYSSFFQFLVHHGYVVLAVNNRGSEGYGKSFFAADDQQHGKAPLQDCVEAKKYLAALPYVDGARVGILGPSYGGYMVLAALAFHPDVFAVGVDAFGISDWLSALRELPPHKEALREALYQELGNPQTQEAMLREISPLFHAEKIRRPLLVIQGAT

SEQ ID NO: 13261 - protein, 268 aa, Myxococcus xanthus
MAKVKGVKDLRAEKLTGLPQLRITVNRAAVARVGLTPGDVIHAVKVGMVGQEFAQVWKGQRRYDLLLRLADHRRGDATAIRGLLVDGHDGTRIPLSQLATIEETFGAGSIRREAGSRRIAVEASVAGRDLGSTAAEVRERLASELKLPTGYFLDMGGRVESQQRAAQAMTVAIAVALLAVFILLYLALGSLAESLVIIATLPDAFVGGILALLIAGETWNVSSLVGLIGLFGIAVQNGLVLVAQTKLLMQHGKPFDEAIREASIVRVR

SEQ ID NO: 13262 - protein, 95 aa, Myxococcus xanthus
MTYREAVNLGFNQCRSRGYECRLKDADRKGRDVWRVKFHASTRRAKGHLHLDFDAYSRSLLRVDDKVKARRHDWDDDDRRGRGRGKKKGHARRDD

SEQ ID NO: 13263 - protein, 277 aa, Myxococcus xanthus
YRCQRAAEGPPFGDRFASQGSRGNALAPLLAKLQAVKLPTGLGELLRQRRREAALVAGAVVLLGAGAAWLSQRNDAGTRAFALLEDGKLNEALALMDAATDEEKELPSLRRARVAANHAKGHHISERTALSHLKEEELEDVEPLILDGLAEDYGKEPLTVLGNALARFPKDRLRAHYEDLAEEAYSLRQWGALRYLEFVKAADGVNLVRAYSEALNSPDCDIRTQAANRLAGLGDADAIPAMERVTSLPKAKGLLGSKDCGHEAAATAIKSLKQKSD

SEQ ID NO: 13264 - protein, 176 aa, Myxococcus xanthus
ALWPWAALRGAGFPAQDALRLAAPTAASAADTWLASGVETPGDALRTVFDSDLLGISAALRSLAGESHLSEALLWQNRHAYKTGVEPLAALPATARNSKARQRERLVASYVQRYSTKNDTIGFFGPVGWARLTPSNEGLRWTPGQRLVSRRAVYFETWCLDALSAALARDAFLGRC

SEQ ID NO: 13265 - protein, 49 aa, Myxococcus xanthus
LDAVDLSAMARGELSLRYAIAYQQGTPVALCPCFITRSKTIYTPYSLEL

SEQ ID NO: 13266 - protein, 231 aa, Myxococcus xanthus
MVSGAVWDALVERLDLTGLRLVIPDMRGSGQSGRPDGGFSLESLAHDVLAVADAVDARRFTLVGHSMGGQLVKWVAAEVPARVEGLVLLNTVPAAGLPLPPDAAGLFRTSADSREKKQTILGLACKQLSPEALEALVKDSMGVSPAAIEHVFDAWTAGGFADKLASITAPTLVLATDDAFLPAAFLREAVVSRIRGARLSYLPGPGHYPQVERPAETAALVSAFLAGSQPA

SEQ ID NO: 13267 - protein, 117 aa, Myxococcus xanthus
MSIEATSPQDTERWLCAGLCLIRHEDLTADALTSAVPWLLATLAESPALPPPAFIADLGRLVAGVPLAPSAPVPDTQPRLRAAVRAYDDHVLARLAAEPHLEAVSTALARLPETLRP

SEQ ID NO: 13268 - protein, 123 aa, Myxococcus xanthus
MIIDGVEEVTARARSLTSLTPDQLSEQLPIILGEELPQWLAHFERLLKSNGSGDGFFVGPSVTVADTSVFGFLELLVDNGLQDLLESTYPGLFGFFERMKQRPNLARHLASSKRHPAVQLLNG

SEQ ID NO: 13269 - protein, 562 aa, Myxococcus xanthus
DGVHPGELMSLVANPQIAPLDQVEPFTPPAVTALVAKALAVDPSQRFQTAEEFRGRLQACLMEIDSSAGPESVSRFMRELFSADFQSERRLLASLKEVPRLSTAEVRALASMPDDPLAPKMAHAMLPAKTIRLDGPVEPLSFFPTPRSREGGGPVTDGETRPGVPMDESTRPGVPIEALEDEARTRGARQDTAPSVEVGPEAFVRGGGVSPSSAPIPRAPALTREVQMTSMPPEAVPPGVAAARALLPSHMRPTELAMPSLGGPSSPEDASVQVESTAAKAESLRGKAFEASPSVIASVGAPTPAVPLRGSQGTVNSRPPPPGAEPRAPGAVLPRSGVVVMPAVNVPAPAPMPRTSALESMPAVEVSEGAAGDEDAASEREGAFGSAPPAEAAFSELHPSGPMPRTASMVMAAVQPPPPGSTPSRAMSAVGSPDEAAAPRSRSSAGMPAVGAQAGVSTRAISSVEVAALDARDEASSDPVSSVDMSSEGGTPPRRVSSAGMAAVSPAQAGMTPSRDMSSLGTPAPPKGATPSRAIPRCPCIGRDGFPLRARGGRARRGRHPR

SEQ ID NO: 13270 - protein, 215 aa, Myxococcus xanthus
  unsure (1)..(215): unsure at all Xaa locations
LGAKRVKTQQVPVLFDPQVAASFVSDVAGAADGNAVYQKASLLASLLGKRLAGAHVTLVDDGLMPRGLATAPFDGEGVPTRRTPIIEQGVLKSFLYDAFTARKAKARTTGNASRSYNGLPSIGTSNLYLEAGTKSPEELLREVDSGFYVTALLGHGTDPVTGELSAGANGLWIEKGELTHPVQEVTVAGSLLQMLKDLDGVGSDLQFRXGAVGRV

SEQ ID NO: 13271 - protein, 80 aa, Myxococcus xanthus
ESEQEKNKVPAIVVSADKKSVQVIREVDNGLATVECQLPAVVTTDLRLNQPRYASLPGIMKAKSKPIEELTPGKLSVDVT

SEQ ID NO: 13272 - protein, 205 aa, Myxococcus xanthus
GKKHKGITCFVVEGRPEGLSVSKHENKMGQRASETVSLTFEDVRVPVANRIGEEGQGFAIAMATLDNSRPLTAMFSVGIARAALEHSMEYSTQRRTFGKPIIEHQAIQFMIADMAMNTHAARMLTYESAWLLDEGKRNSLQSSYAKCFAADMAMKVATDAVQVYGGYGYIKEYPVEKLMRDAKLIQVYEGTSQVQRLVIARELFK

SEQ ID NO: 13273 - protein, 104 aa, Myxococcus xanthus
PAFPWLMVGFGRPAARKQLRVHPTRLAAAGLLVALFSGVPSMMEGRPFLSGIWGRLPVPGTDGLKVGTPQLFDLGIYLVVLGTAMCFILGMARGEDTTAPEMGG

SEQ ID NO: 13274 - protein, 119 aa, Myxococcus xanthus
MELFLAITVGGLFAAGFYCLMLHSIVRIALGLVLLGSATNLLIFTINGLQRGFAPLVPEGQEALTPPFADPVPQAFILTAIVINFGLLALLLVLVHRAAQETGTDDTRALRTELKDSQR

SEQ ID NO: 13275 - protein, 349 aa, Myxococcus xanthus
TPSTLLSLPMILCLGAAAAGLLAPSRAWPRRWLALMTMVSLAVVGAMLLVTVRREGIQSMQVGGWAAPFGITLVADLLSALLVLVTGVMGLTVVSYSAATLPASKEAGAYYPLVLVLVGGVCGAFLTGDLFNLFVWIEVMLGALFVLLALEARQEQLEAPIKYLPVSLMGSVVLLCAVGLLYGAAGTLNLADLAVTVPGLGTPNLMTAVSMFFLVAFALKAGAFPLFFWLPASYHTPPAAVTTLFSALLTKVGVYALARVFTLVFTQDSQLTSTLLLVMGGLTMVTGVLGAVAQYDMRRLLSFHIISQIGYLIAALGLLTRSALTALIAFLIHYIFAKSALFLVSGATA

SEQ ID NO: 13276 - protein, 197 aa, Myxococcus xanthus
MKRGWGWAGALFVAGWVWTGCGSGDGATGTEGMDVPPSEFPQAPEGDAGTPDSGTLDSGTPDEPDAGEPDSGTPDDDGGTPDSGTPDDDGGTPDGGPVEVPLPTPSAANWEFFGREAGGPRFIHGVSADASGNIWVAGGEEALFLMKKGERTFRRYTMAESMRPYEYMPDGSAPPGPKYLKVISVAGAWNDTVFVGY

SEQ ID NO: 13277 - protein, 44 aa, Myxococcus xanthus
PGDGALHCENNWDSNVPDPERYKNGDADRVSLRADGTLDVVQCP

SEQ ID NO: 13278 - protein, 369 aa, Myxococcus xanthus
MGFTAGSPVSPALARRVLERPPTELLQAGYTALRESGTSAALDRMTEGYEALASAARRAHALLGDAESFTLENLEHLQGKAQRMALEQAVEAAEALSRTLPPKLRARPVSTAPLPMALEDEAAFPQGGFSSVSNVGSLENLVTSELVYMEDEPNLDLFDVRYVEGELLYYTRDESISVRRRRVITFVLPPDLVDARVKDAGVRWQRVVVSMGLLLCLVRRLSLWLGSEELHFRAVFLHAHDGAVPLEAERGLCELLLREWRARGTAEVLTASTLDEVLTDAEARAKRARVDLVLLDASSQVERMSHPGASRVERHVLDLSGPSPRVRTIRDKREDLDSRKSEAPMGAALNNDPWEAWVGVTLELAQGLL

SEQ ID NO: 13279 - protein, 91 aa, Myxococcus xanthus
PLSLVAQEPDLLFYTRQAAEHGGPVLVLGAANGRVVWALAGDGYDAVGVDPSGVMIRSAEERRNSEPEDVSRRARLMVTDLRSLRLDERFP

SEQ ID NO: 13280 - protein, 289 aa, Myxococcus xanthus
SRPQVLASRLFLRVLYEGTRGLRGVGLGVLGRALMTLSPRQQTADWIDAIIDTLVRCYSREASLPRATARGTYFDLLRWLLHMTSDFAVITDLDPAPASPAPPSPAHAGDAELAAEAAFIEEHHIQVRSIVTVAPPSKAWPPTLFKVLHALTAFNPPQRLRRTRELHELWTSKHQVLRPTDNDGIVNSVSQVWPDEARSYLLQGDHADVIGHFSAQCPPSQASVAATTFRQYDLLNSPAGFDQRRFIRLWKDIGRFTASQQHREATAPRPRGGARIHHIGSAPPHRADS

SEQ ID NO: 13281 - protein, 75 aa, Myxococcus xanthus
MPFPNTNNETLTSVVAFGAKSVYVTAYNGRIYRYDGTQWQIIFENTNLRFNDIAGTSPADLWVAGSNGQILHWPQ

SEQ ID NO: 13282 - protein, 182 aa, Myxococcus xanthus
SAVGGTQALEQLQAPVHGRAVGLVPVDSPDVLRVDVAEVVGGAVELLSVTRRLRGVRVSLELPEDPVPANVSHRRLQQVLLLLLAHAADASNGQGVRVMVDSADDFGDLPPRFQVQVAGASLSSRELQAVFLSPMLVGPLHRKLARARELTESMGGTLEVASSAAAGITVTVELPAPGMSSW

SEQ ID NO: 13283 - protein, 61 aa, Myxococcus xanthus
MAPPSSGEKISLQSGKLSVPDNPIIPFIKVDGPVPYIWGASQTVFHPRVHKAYKGKNKFAW

SEQ ID NO: 13284 - protein, 173 aa, Myxococcus xanthus
RARSGCALVWLGLAGCGGLPGETVEAREVAAQACPAGVASRVKVVVPPGSGSSVNGPYPESLVDVQGQLYFATNFFDGSAVLWRSNGTEAGTTWVKKLDAQAVPIGQTGFAGNLGLFLLRDGPNTEVWKTDGTSGGTVRLETFGKFVNLLGALNTSVYLYSMNPSTKRLRIEI

SEQ ID NO: 13285 - protein, 265 aa, Myxococcus xanthus
GFDIRKTFNSARANVQKVAKDVQKTVEDNKGLIKGATAVATQSAKAFGYGKDAFQQIKNIKNGAEGLLTGANRAFVSNPTYAAGEFKGLTKLGAGMKAAARYAGIPGAVMSGATAVKDIRQAIRTGSKDDIITATRSSLDATKAGLSAATGGIVGGKVMGGVLGGTVFKDKLEAGKKAVDAFKKALPNASDDVLKAVKDTATKGIFEGGTAKGVGRAVKSAAAETAKATSTLAQGLTGSGTRQAAKAALKTAGKEAGEAALKQGA

SEQ ID NO: 13286 - protein, 86 aa, Myxococcus xanthus
MGDVARQLHVSPRTLQRRLAEHATSFQDEVDAVRRELAFDYLRDAHLGVSEVAFLLGYSELSTFDRAFKRWTGMTPRVWRERPEAG

SEQ ID NO: 13287 - protein, 163 aa, Myxococcus xanthus
MLKPHVVALFDEYYSSHQHPTNRLTHKIAIPLIVLHIVAMLDWVHLMAVPAIPGGSLTLGMVVLALAAVWYLRADVKLGIIVVLFMAACFPVGRMMPTWSVVVMAAFAWLVQLAGHSVWEKKSPSFLTNLVHALVGPLFFVAVLLGDYVLKPQQQAATTPVRA

SEQ ID NO: 13288 - protein, 67 aa, Myxococcus xanthus
TSFADKLRVWLPLHENGVSRAVHFVGAYMFIFALLVPLSFVRLPVGDAALTAAHVLLLAVVLYAVSL

SEQ ID NO: 13289 - protein, 451 aa, Myxococcus xanthus
MPRYEFKEGSSSKFWEINLSGSSFTARWGRIGTDGQEKTQTFGSPAEAQKEHDKLVREKEKKGYVLADKSDDDDSEGGGGEEPASNPELEAAILKDPDNVDAYLVYSDWLQGQGDPRGELIAIQHAASQASGTEASDLKRKATAHIKKYQTLLLGELAAGVKSEELSLEWHLGFIRSARVGQKEYDSDFNVPEMAGALLKHPSARFIRGLTIGMASFDGENEYGETVQALVEAGGSKTIQELFIGDFEYPDDTEISWTHLTDISALLKVLPDLRKLRLRGGELELGAIDLPELREFTVETGGLPLAAVKSIANAKWPKLERLEVWFGSDNYGAEGGVEDIQPILDGKGLPNLKQLGLRNSEFTDALAQALPTAKVLPQLETLDISMGTLSDEGARALADKAAAFAHLKQLDVTENTLTDEGQSLLPKAIPHANVGNQRDYEEEYRYSAVGE

SEQ ID NO: 13290 - protein, 132 aa, Myxococcus xanthus
MRPCSVGGSGLSPYGSMSSSRHHTTTLTLTRFVENERLPLDNNRSESALRKAALGRKNFLFVGHEAAGENLAGLYALVATCEANQVNPEEYLADVLLRVQTHPNSRIGELLPHEWKRRRVAEPPNAALQPSP

SEQ ID NO: 13291 - protein, 288 aa, Myxococcus xanthus
VDRSASMSFPAKVGGRSRSEEVAAFLERAAPRLAELQDRFTVELYGFDPELAPATPETLMTPARAGTTDLLSAVRAAAGAGQGSRKLSGVLLFSDGADNTELKAGVVGRARAALADLNVPVSTFTVGQETLKDVAVEGLKVDDFAFVRNSLTVEVEIHGRGFAGQDIPVVLSQEGKTVASKVVRMESADDVKPVAFTFTPDQTGRFVYTVTVPTFPGEAVADNNTRSFTLKVIRDRVRVLLVVGRPSWDERYLRGLLRQDANVDLVSFYILRTLSDDPGVVNDQSHLS

SEQ ID NO: 13292 - protein, 353 aa, Myxococcus xanthus
DTAPQVAVKALHELLGLKPDHLPSLKALARASDQARDRAGAVRAYRRLAALARDPAEAADAHVHLARLCAQTEDDIAGARLHCEAALRLAPDHPDALLLLGELCHRGGEHLRALKALDRLREVAMGRHELDRVGHADLMAGRVWDEGLKQPENALLRFREAVSLLPGEPEPLFAAARVAEGLGRLQEALAGYQQALELAGPAPRSEGVRHAAHASHHALARLYRTRLGDPARAREHLESALALDPRDAVALEELIPYFRATGRSQELAEALEKAAALQDAPGKRAAAWAEAGELYRGKLQQPEKAERLLLLALEADGDHRPALESLLALAEARRDGALLTRCLSSLARLATDP

SEQ ID NO: 13293 - protein, 158 aa, Myxococcus xanthus
AALTADLPADAPTEASSSARPSRASAAAGSAPAPREPAAPRSELEEDLALYSAEDTLALATRHEAAVRTVPAIGASFSQQQLRSLGARTVADVLDVVPGLSVSRDVQGFHRTAIRGLRNDAEVLFLLNGHRLNSFFDGKALMNLPVESLERVEVISGL

SEQ ID NO: 13294 - protein, 36 aa, Myxococcus xanthus
ALECVEGRHQTTVNAWRAGRITERSCLTNLCSRLEW

SEQ ID NO: 13295 - protein, 137 aa, Myxococcus xanthus
KGWTLFPHLVVRTTGFPFDWLERLGCPEAARAARQLASARRELEALKAQGPRVKRPSRAVLSALKAGRPVDIEGMESPELFAEWNDRARAAQEAEATFHAAMKQESLAVEDALRALRQEPRFLEAVASSSPPVARDL

SEQ ID NO: 13296 - protein, 433 aa, Myxococcus xanthus
PAPVLSQLKPNIPQDVSDLVLRALVKDPARRTPSAAAMREEIEAVMAHHRLNSSPAAVAQFFRDTLGDRLVEFAPSAVGGTGSHPRPVPSGSGSGNIGSGEMAAPTDGRTPSRGSVPMAGSRPGMGGSGGIPRPGPPVPPPPPPRPVGVASAAVRPPAPPPEDDSFPGISVSEDDANDRTEVVPLNLGAPPPRTEAPPRPAPAPRASQPQPAMPAPPPRPSGPVPGLGHGAHASAARPAQPPPPRPVAPASRVPAPAPAEKPADKQPPWKLLGIVGGGVLVLPVVAVVMTRDGGSNFVNVGPGEHVYVGGLRHEAGTEVHDPSGGPLLISTAVEGKLRRFGTTQQREGIDVRTLADASPEPGTTGLLSVTGAAPGCEVHVGGALLPGGTPLLKARIEAGRELEVLVRCPSGVSKLWVMAVPGQQIEVKSQPRN

SEQ ID NO: 13297 - protein, 282 aa, Myxococcus xanthus
SARVRRGHGRCRRAAAVAAGGPGAAEDASAPSSVRAENDKSEPERARTPRPASVKTSAKKPAVPVEPAVVYATPAKVLPIQSANGRYYVDRSIIGRGFLPGVEMDVLGPLKNGKREVLGRARVVRPGRGVVMRPTRAFIELDDRALAASGDLFVAAPGRDDAPADASATEESQAQAAEPDKGEEVETVVAAAPAKRTLRGHASVQGGVGGFLDPGVEVQNRESIDWTDCYVVKDIRKAAWLGVVKAGERKTASRFRHNPNFDVGSGYLGVICKEGELRVKAR

SEQ ID NO: 13298 - protein, 171 aa, Myxococcus xanthus
MPLAMALAWLTASAVGGLTGRTFWRQVAGVKLVHAEHTPGLLRGLARAFTTPLDLLLNGVLMRRPLDTLLGLHAEPVAPGAGPRLKGVALQLPWLAVLAGAVWLLVTPTKAEMLQYLGRTLTGWHCCHGTREVTWQCRTSLDRAVRNARGGDAEVKALVADCPVAGARLGP

SEQ ID NO: 13299 - protein, 62 aa, Myxococcus xanthus
ELETVAFGGGFVLTPPLTALGTWGLGELAFGESHHSDRAYLGALGGADLGTLLGVIVHEALV

SEQ ID NO: 13300 - protein, 449 aa, Myxococcus xanthus
MPRFEYTEGTSSKFWEIERKDTVVTTRWGRIGTEGQEKTQKFKQTYEALQAYQKQVLEKTKKGYTRIKPKDTAPAAKTNPELEAAILQAPESDDGYLVYADWLQGQGDPRGELMALQHAQRQAQGAESSSLKRKVAALYKKHQGTLLGVGLTSMLGEKALTLEWHLGFIRGARVAAPGFDSDADFDVVETLTMLLRSPSARFLQELTLGLPDNDGDNEYGDLIKVVTRLAPKTLQRLFIGDFVFPDESEISWVKLGNLAPLLKALPHLTTLRLRGGEVRLGPVELPELRRFTMESGGLPRPAVQSIASAKWPKLEQLEVWFGSEEYGGRSRPSDIQSILDATGLPNLKHLGLCNAAFSDELATVLPKAKVLKQLESLDLSKGTLMDTDAEVLAANAAVFKHLKKLDVSQNQLTRKGVKLLASLCPDVAAGNQRDIYDDDEGGRYVAVGE

SEQ ID NO: 13301 - protein, 213 aa, Myxococcus xanthus
NIRVEGPAVREMQVAFAQNWQEAGGDFLPATDFPEPRYAGDARAGFVASTDNRFLSDARRMTLLTIAAAQERLWIANSYFIPSDAISDMLLEKVKQGVDVRVLVPGRHHDVGPVNAAQRASYARLLEGGVRIWEYELSMMHSKTMLVDDSLSVVGSTNMDPLALTTLEECSVVVEDVALAAQLAASFEKDLRHSREIHWSGWKRRGLLQKLGE

SEQ ID NO: 13302 - protein, 368 aa, Myxococcus xanthus
GRPAAHGAGNPVQGRSQACLRVPLARTEFTFAAMPLVFLPDAETLFLWGPDRLPRELAGLPETGDRASALLVTPEGLRECEGHGLPLAATVERLAVVQTSEAESFPGSIALWTLASKLALELVARERVVPTLLRRGERIEARWAAALSATEDAGRVAALARSMPPGAHAVPAGARPGRAVWAPDALLRAFLDATVDAFVRAARGAPSLPARRAASWDERWREALTGARRDFAPEGFAERSVVDELTRWSEPALGARDKLRACFRLEPPTEEREPFVLSFHLQSPDDPSLLVPAADVWKTRGRSLEKLGRAFRDPQESLLEALGRAARLFPPLALVLESPRPQALLLEPDTAWTFLSEGARVLSDAGFG

SEQ ID NO: 13303 - protein, 107 aa, Myxococcus xanthus
LKKARHRTMDAWTLEGSRITDPDTLSRLREMLANKSPLIIEHRFYRETRAPHRFICDDADVLDEYLQESRPGDSFCVWSYKSLCRGDNLLLQGKMPDAQGRTPGGVA

SEQ ID NO: 13304 - protein, 95 aa, Myxococcus xanthus
ATAVSLDARLTRENGQSRAVKVLRVQDGTPAHEAGLQVDDLLLAINQRPVNSVDDLQRLMALATEDEVTLDLLRKGGGRKTAQARTRPRMEPVAA

SEQ ID NO: 13305 - protein, 304 aa, Myxococcus xanthus
PGSPPGRPRSSTSPGSTSTRTQAAVARHPANNDDTPAAGGCARAGLAPVLDVAGMQANALYLSNDSGKALVAYDAVLEVEPLHEEALYARAALLFETKGDDVAALKKAGEGFEAVATTYPDSFRAPMAKRMVALVEETVKAGGRKQLLASRAEDRRIRLSQAPAAAAPDAPRPLSQEMVDAVKGTERTPELEQGLAKLVDEGEELLAKGQYQEALANYTRVVPFQPENGRAKAGMAWALVSLERPMAVRVWGVAVQTDPLSVETLGDTLKAKGDDKGAKALWEKLATDAPDYPNKASLQAKLGK

SEQ ID NO: 13306 - protein, 196 aa, Myxococcus xanthus
SPLAPGAYVVLDIGAIAEACPMGLVPTASTAALHAIGDALAMTVLRSRPFGTEDYALLHPGGKLGRSVQRVFELMRTGNANPLVRDTSPLSAVVGVMTKTPGRPGAACVVDKAGKLVGIFTDGDLRRRVEAGLTDFTVPVRELMGKNPRCVTPETLVLAAATQMRELRVDQLPVVDVEGRAVGLLDVQDLLAAKFV

SEQ ID NO: 13307 - protein, 131 aa, Myxococcus xanthus
RYLKAREAEGLRFDVIEFADFRGWAFAALQEKHLGLAFAQTTLSVRLHSSYGTLMHHEPNTLEVENLGRYEIERKSLLDADLVVGHLPCIAEFNRRFYGFDDAWMRKVRVEFPPVVMESPAESSRPFDVPA

SEQ ID NO: 13308 - protein, 86 aa, Myxococcus xanthus
MTALEGLTHGVACLTGPLTLGALDEHPFQRLVQVAGTGSLGQIRSALERVVGLRERSPEEYAQMLEDYTQTLCAQAINHYLEFAQP

SEQ ID NO: 13309 - protein, 312 aa, Myxococcus xanthus
  unsure (1)..(312): unsure at all Xaa locations
ALAPAQMPVTXSGIPIGPDAPHGYIPEKVGVIVGSGIGGISSLEEQHRKGLEKGFDRLSPFFIIQMIINMAPGLISMRYNCKGPNWAPVSACATSAHAIGEAWKSIRLGETDAVIAGGAEAAITPLGLGGFSVMKALSTRNDDPAGASRPFDKDRDGFVMGEGAGILVLEEMEAAKKRGANILAEVVGYGANSDAYHVTQPAPEGEGAARCMRLALQSAGMNPEDVGYINAHGTSTPFNDANETKAIKTVFGDHARKIAVSSTKSMTGHMLGAAGGFEGVVSALALARNILPPTINQTTPDAGLRPGLRAQA

SEQ ID NO: 13310 - protein, 149 aa, Myxococcus xanthus
LVHAGVDRYALADRVLLLPTSMAEQLEARYARMWAHVRRLLVDVRRYEQALLLRGFEEEVEDRWAQRLPWHVPEEEPAAEPEEGLHTAVPALESRWLAALVDVHEGTPSHEALDTVLTCLEDDGRFRCEAALALTRWRVWPSRVQGPRV

SEQ ID NO: 13311 - protein, 377 aa, Myxococcus xanthus
MGAPPFILIGNPENRRVTLFQDALARQGLPSAHVVPWRELLASPGLLANLPDSEALVRIDSTGENWDVEKALLKRGYADAVGQGCSVLTPEQVDRLPVDRGRILSPRQHHLGFLRVLAELESIFAAHPRWHILQKPSAIADLFDKRITSRRYAALGVPVPEPLDGVTDVESLRERMREDDCREVFVKVSCGSSASCLAIYRRGRSADTLTTTIEVAKTGWYNSLKVRRIEAPAQVDEILTYLLGEGSQVERSIPKARLGGDYFDCRVLMVRGEPAFTVVRQSMRPITNLHLGGWRGDLDDFHVAVPPNELANAMQSCRTVARAHDCLHVGIDLMYEEHFTGHRVLEANAFGDLLPNLRRDGLTVYEWEIQEALRQLP

SEQ ID NO: 13312 - protein, 610 aa, Myxococcus xanthus
PRIQGDAFQRAANTVIDLAQAWKKHPALVEEWVRIQDTVFGPCAILPEPDPRLDEGVSAQQQARRRDERAYQEAASRFYCDDYPGALSSFQKLAASQESPYRALAAYLVARTHVRQALMEKKGEYHFESREDAVFLSRLSEADRVLDDVLASPELRSVHAPARGLRSLVRYRLRPKTWHCELLSHVLEPGTGTALASELGDLDLMLREASTCEGLPAPAEALQAWLNAMKDTPYSAAPDAERRAQYDGALARWKKTAHLPWLVAALSKATPDAPGVPELLAASAKVAPTSPAGLMVAYHAARLLHGRGEVEAARARLATVPAELTRDLPSTDNLLREERLAVARDLDEAMREAFNIIADYEMTSSYSEPYTTPLAERPRFFSPRAVAMLEPRLTAKRMGELAAGDILPPALRRQLMWTAFARATVAGDDATIQAVAKRLAETEPKAKAELLALVGKPTPEERQFEAQLLLMGLPVVSARLYPGEDRLANTHPNLSLTMDISYQRNWWCGPKPDASVPSVHFEDTPDAPDAAREWKALQDAGNSVPYFARVAMAWAQAHPEDPRSPIALFRAVRASKRGCGQATREARDAFRYLHKHYGKTSWAKRTPYVY

SEQ ID NO: 13313 - protein, 141 aa, Myxococcus xanthus
LGIGGGIVLVPALVLGFDIPVEQAIPASLMCVVASSCSAAAGYVHKHLSDIRLGLSLELATVMGAIAGGMVAAMVAPAMVAVVFGLFTLYVALQMLLLRSPRQEPAAMDDYAPANYPLGISGSFVAGGLSSLLGVGGGPLK

SEQ ID NO: 13314 - protein, 263 aa, Myxococcus xanthus
YARFGAALPDLPLCEGIRGGLAAFLPERELPHFARLYHERAPVGFGLKMAELVASGALVGTEPGLAVLAGYFTHLCLDRRLYPVVDRLVVRHRRRGERALEAHRDIEWAQTLFYLRELHGMELLGTPRVREKCQVVKSLGFPWRGIGGGLYELVRLSSQERVGQAPSKSEVDGWVRGLYVSGLFLSSPMGRARALPAYARLSFQELYRNDTFDFAAEVEGTLDTARSVLRRLHGYMARGTFTPRTRARFLEAFPEGTLGARAA

SEQ ID NO: 13315 - protein, 462 aa, Myxococcus xanthus
ADQRGQILKVGTADEVQKGLDTSVQIVQLAPGQVLMPGFFDPHLHFMPTLLQSTLGTHDLAPCLPPPYRVDPSVDCKARSEVLGALSAMALEGTSAVGGNAFVLGMNLDPSRQVFDNTKGCGVGGPSPFTAQPKFYIEACVSKDRPVIILDQSGHLGYVNQKAFDVVCGVQNANANTCTIPDSVKSGGGDWVTDSAKNFVGLLQEPSAFGPFLTALQKNLPVAQVFSDPVKFAETGGADVERVIRGLRDAGVTTIADGGLQSVAQINAVKRFTELPGFPFRITGVVVAEAAKTAKLKPTAPACEPKAGNDCALPKWLGAGGIKVWVDGSTQGCTAKLEAPYHYLAGGHCSGDGEGRADYDNVQALTEDLSELWTQGDWRFQLHANGNGANNWAIDALSRLQQTKTNTRPVLLIHNTVGRPAISKRIGDLRNGAGVMDTKPVPTLDVQVTHLIGHVAYWGDAF

SEQ ID NO: 13316 - protein, 397 aa, Myxococcus xanthus
MEPLFTPEQLAEIHAFHRPYYIRAAVGPFANLALMLLMLGVLVQPLHRLAVAAAAGLERRLGFLRTAPVSRAFFHAMDRLWGKPGWGAAVLFALFTDLFVSLVYLPVDVWFSYTLEHRHGMSTQTPATFAYDMVKAQLLAAFALSALVIGMFGLARKLRQWWLVLGVPVALLLLVSGALDPYRSRLFFNQKALPEGPLRTRIVDLMEQADITFADVLVEETSVASRRLQAYFAGQGPTRTIVLNDIILKELSEDEVLAAVAHEAGHVNESKWPARIASSLMLVALLFALDRLLRLSASRGWFGATHFADIRNLPLISLLFFLLVLTAKPISGAFSREREREADRYALRLTKYVYAFRRIMVKAAWVNKMDPEPPRWVVLKGMSHPPIDERIGSLPTP

SEQ ID NO: 13317 - protein, 119 aa, Myxococcus xanthus
YLRSIGVGTGYWAPAAGTQIGSLYENLYEHMVNSPAPAELDASEAEIYRQELRKKIRVLLTKSINIYERTLETAERIGSQSTFVDRTRESLAKVKALLLADAEGEPASAAPSSGGEPHT

SEQ ID NO: 13318 - protein, 421 aa, Myxococcus xanthus
LGVHCDVCGQALLSCSARETALHTLAFFEQQQGFLTPRATVSTDAEGRFRFEQLAGVSFSVWARAPGLGVALRERAAPGDPVELYLPPLRTLVGQVVDDAGRPLAGAHVHGVSRRAPLAFESTSGADGRFTLTGLGEGPFYVLATAEGYLPAVGAQVEAGPQPVRLKLTPARTLEVRVTRNGSPAAALVRLRADHLSRELRTDGTPVRFTGLYPDQLVVTAEAKGLASVPRVLTLDERVTQVTLALEEAGSLLVTVVDEDGQPVPQPELLLRMPTGEVVRQERGGTGALVTLGPLAVGNYVLTGQAEGFRDAQLPAKVTPGETALELEMERATVISGQVLDVYGRPAPGVSVLVQPTGASTLADAEGRFIAQVPTPGLYELHAHHSEWGGGQLKVTAPATDVQLALEPRASLEVTVSADVS

SEQ ID NO: 13319 - protein, 294 aa, Myxococcus xanthus
MKLTVLYRGPLSSCNYGCEYCPFGKWKHTDEELAKDRADLERFVAWVEARTQDTVSVFFTPWGEALIWPWYQEALARLSHLPHVERLAIQTNLSCKLDWVAGVRADKLGIWATYHPEWTKRHRFVAQCAKLTELGVRHSVGVVGFLRFTEEAEALRAELPADTYLWINAVKDGQEEPYTAEDVARFTRLDPLFPVNNTRHPSLGRACRGGESVISVDGEGTARRCHFIEEAIGNIYAPDFDSALRPRPCAKQTCGCHIGYVHLEYLELDRVFGSGILERVPATPLWKAGLGGPP

SEQ ID NO: 13320 - protein, 94 aa, Myxococcus xanthus
GGSFELESVAYALDGAPVYTQVDEEGHTDLGKRELFEVFNGRIVPGQHQLAVRLVYRGNGYGVFSYLEGYKFKVQSSYTFSAEPGKTSTVPLEH

SEQ ID NO: 13321 - protein, 195 aa, Myxococcus xanthus
MSFINYSSREINCKIVYYGPGLCGKTTNLQYIYNKTAAETKGKLISLSTETDRTLFFDFLPLSLGEIRGFKTRFHLYTVPGQVFYDASRKLILKGVDGVVFVADSQIERMEANMESLENLRINLAEQGYDLNKIPYVIQYNKRDLPNAVTVEEMRKALNHRNIPEYQAVAPTGVGVFDTLKAVAKLVLTELKKGG

SEQ ID NO: 13322 - protein, 66 aa, Myxococcus xanthus
IVGSRVVLVVIFDNRTSLGLVRLRIKKASDELTKIFESLVKKTDSPGAGSPFAEISDDDIDNLFSE

SEQ ID NO: 13323 - protein, 122 aa, Myxococcus xanthus
GMMAALALALAAVGIYGVLSYLVSQRTREMGVRLALGATRGDVVRLVLRQGLGSVAGGVVLGCAGALALTRVVSGFVHGVSALDPLSFVAAPLVLLGVGLVATWVPALRASRVDPIIALKYD

SEQ ID NO: 13324 - protein, 162 aa, Myxococcus xanthus
MGTVFGVLGLVAVVAGWTSMEQLIDAGRRELAYRVLLVFLGVPAIMGGLLCWWLAPRKTRRLVRSVESDERTPMLMSVERKVFGSGSDEIVHFVATLYSLSAHHLVLRDVRLRHGNNCLAYPYDEGVSKVPVDVYGRPGEGPVVIDAGWGFLLPSNRTYPWF

SEQ ID NO: 13325 - protein, 84 aa, Myxococcus xanthus
GQYLVWRVVGQGLRMAVAGVLLGLVGAAVFARSLSSVLYGVSAFDIVTFAAVPVLLAAVALLASWLPARRVTRVPLHEALRSDD

SEQ ID NO: 13326 - protein, 283 aa, Myxococcus xanthus
GAAAERLVVGVRVARRWRLSGVRACAEGRATDRASVYGEAPMSPPDSPPLVELRDVTKAYAEGDTTREVLSGVRLSLRRGEFVVLLGRSGSGKSTLLNLISGIDLASQGEVRVDGRDLGRMNERERTLLRRERIGFIFQAFNLLPTLTVEENVRLPLELNGQGGAEASVRARALLDQVGLGTRASSFPDRLSGGEQQRVAVARALAHEPPLLLADEPTGNLDEATGRQVLDLLEALTQKGNTCALVVTHEPGLVARAHRVLTMEGGRLVEVEHTPIRAMKEAL

SEQ ID NO: 13327 - protein, 109 aa, Myxococcus xanthus
MTTNVISLDDAHFQREVLESSEPVLVDFTATWCPPCRALALVLDAIAADFRGRLKVTSLNVDDNPESAMRYGVRAVPALLLFKEGKVVRQMLGAQPRAKLEQELRTHLG

SEQ ID NO: 13328 - protein, 309 aa, Myxococcus xanthus
APPLLDDMLLFTKVVPTGGIPARAERLGLRKSTVSRRLAALEERLGVRLIERNTRGLRLTEVGRDYHAHCARLVAEAREVNRALGESRVTPQGTLRIATLSLLGELLTPLIAELLLRNPLLRVEVSLAEAHVDLISEEYDVALRTGPLADSAMVARRLGRLRTGYYASPAYLARQGAPRTSAELQGHACVVLAAPGTDEVWFFGEGRGAKSLPVTGRLRVPSVRAGQAAARAGLGVVRLPASLVAEDVRGGLLVPVLETETPPGIPVFAVYPSRRQLPLKVRAFLALLSERGAALPWDDATEPPSSRSR

SEQ ID NO: 13329 - protein, 477 aa, Myxococcus xanthus
RFHARMHIPLVRVDLTGAPEHREAEAMQLAREDAAKPFDLVKGPVVRTTLVRLDERLHILLGNIHHIVSDTLSISIFIHELFQCYAAFQQGRPSPLLPLPVQYADFGAWQRKVVAEGRLPDQESWWRQQLAAMPRQLGIATDRPRPPTSPLTSVRMPVSFSAALSREVAGFGKREGYTSYMMVLAAWQALLHRYSGQTDIIVGTPIGNRTRPELLPLIGYVAHSAAFRTSFADDPTFLELLARVRQEVNDVQLRPDVPFEHLVEALIPGKDIGRGRLTDTIVVFHTTAGGAAAALELTGVRGTMMEVPDAPVQWGATLSDLSLVLGDDSGRIGGALEYATELFDEATARRIVEHLQVLLGSALARPSERISRLPLATDADRSAWPAPLPRSVSTPVPTRLSQRAARQPGATAVLQGATSWTWSDLAQRARNVAARLRALGVQPGEPVAVCLKPSPTKLAVLWGVLEAGGAVVPWAPL

SEQ ID NO: 13330 - protein, 432 aa, Myxococcus xanthus
MLEGSPYVAYLYGYPHKTAYRPFTPALPLESVWAEERRDALFLYIHVPFCEMRCGFCNLFTAAGPKQDVVDGYLGALVRETKRVKEALGTASFARAAIGGGTPTLLDVAGLNTVFDMAEGVMGADMKNIPVSVEVSPETVDAQKLQVLRSRGTDRVSMGIQSFIEAEVAAVKRPQKTAQVEAALDLIRSTGFPTLNLDLIYGMEGQTEESFLYSLRTALRYSPEEIYLYPLYVRPLTFLGKKARAWDDLRLSLYRVGRDFLLSEGYTQVSMRMFRARHAPDAGGPVYRCQEDGMVGLGCGARSYTGQVHYSSEYAVGSREVRSIISSYSERSEASFGEVGYGFRLDSAERRRRYMLLSLLADGVDLAVYRQRFCSDALEDFPELEELEAHGLARKNGGVVQLTAAGVERSDMIGPWLHSDQVQAMMKEYAWR

SEQ ID NO: 13331 - protein, 87 aa, Myxococcus xanthus
MQLQIQMDEDVANGQYVNMALVNHSDTEFTLDFIYVQPQQPKARVRSRIITNPKHMKRLVAAMQDNIQRYEAKFGPIAIPEEDGGMH

SEQ ID NO: 13332 - protein, 27 aa, Myxococcus xanthus
EADKRYTLGVDEVLPNVALLNGRGTML

SEQ ID NO: 13333 - protein, 91 aa, Myxococcus xanthus
VLILDDFGLEPLGAPERKELLEVLEDRYQLASTVVTSQLEPKDWHAVIGDATLADAILDRLVHNAHRIKLGGESIRYVETNLTKGRKQAKG

SEQ ID NO: 13334 - protein, 282 aa, Myxococcus xanthus
LLGGRKHFEDKISRPISEGRQHAAEGLRRRIRPFVLRRLKRDVAPELPPRIESVMHVQMDERERSVYHAVMAATRKQVVALLNEGGSVLKALEALLRLRQAACHPALVPGQRANTSSKVETLVDALETAVSEGHKALVFSQWTSLLDLIEPRLKAAGIGFGRLDGTTANRGEVTERFQSQEGEPVLLMSLKAGGTGLNLTAADHVFLVDPWWNPAAEAQAADRAHRIGQERTVMVYRLVSQGTVEERILGLQEKKRAIFEAALSEAAAATAITREDLLELFS

SEQ ID NO: 13335 - protein, 222 aa, Myxococcus xanthus
LPESADARPQAAATLHALIQQEWQYQLEHSPTYASVQGDRRWNGRWDDLSLEAIAADHQHNLQVLAKLKTVDRKALSAADQLNYDLFRRDYETWVEEHRFKTYLMPVNHMGGIPEGIKQPPGVQTAYQLADNLRFETVKDYEDWVARLQGFGTYVDQVLALLREGLREKRIHPQVVLQRIPPQVAKQLVADPADSGFFAPFRRFPKGIASAEQQRLSAAGRA

SEQ ID NO: 13336 - protein, 185 aa, Myxococcus xanthus
EFSTTVTPAYTGDRAVSLRYTTDGTTWTYCDKDGSNVGGYTLGQQHALTVGNHAEIEYCKLQHPFEIAVDAIDGARTVYGRLYHGGVTPGGGQGAGVVAELGYGPASSDPGISGWTWVAASYNGDSGGDDEYAANLPEGVPVGTSYTYRYSYNGGPYCFGDWQPGGEPGGSANGVSPNTLGTVIP

SEQ ID NO: 13337 - protein, 471 aa, Myxococcus xanthus
FALGGHSLLATQVVVRVRAQLNTEISLRTLFDAPTVARLAERIESQVQLADAPGVPALVPLERGPSADEGLAASFAQQRLWFLEQLHPGQAAYNLPAALRLTGPLDVEALRRTFLEVVRRHEAVRTTFVTREGQPAQRIHPAPAEWPLPEEDLRGLEPIARDAAVQARMAEEAHRAFDLEKGPLLRTVLLRTGADAHVLLLCMHHIVSDGWSMGVLVREVAALYEALSQGHEAALPALSVQYADYAAWQRRVLEGPALAPQLDWWRSRLEGAPTLELPTDHARPAVRTLRGATHAFTMPPSLVAGLERVGQEQGATLFMVLMAGWQALLARYSGQTDFCVGTPLAHRTRPELEGLIGFFVNTLALRANVDGDPRFDDLVARVREESLAAFANQDVPFDRLVEALGGQRDLSRTPLFQAAFVLQNAPMQPPTLPGMVVDVLRTGTDTARFDVTLLLVERGGRLEGELEYSLD

SEQ ID NO: 13338 - protein, 280 aa, Myxococcus xanthus
LTQGEVLRVAVSVSEARTFRWYVYRMGHYGGTGARELARGGPVAGVRQGDCPADRSTGLVACRWAPTLEIPVGEHWVRGVYVVKLVREDNHQRYVPFFVRDANPRAEVAVLIPTATWAAYNTWGGTSLYDDRDRVMREHGVSRAFRVSYDRPNYRGHGSGHLLTDDLSLVQWLESQDLDVGYFTDEDLDASYDLLAGAKAFFMSGHDEYWSPRIREHADRAVAEGRSLLNLGANNAYWQIQMEPSQDGAPRRIIACYKGHANDPYTGAQRTVKFRERVVG

SEQ ID NO: 13339 - protein, 51 aa, Myxococcus xanthus
DAFFGTLLAGAVPVPLYPPVRLGRLDEYHRATSRMLHVTGSVMVLTDVRVR

SEQ ID NO: 13340 - protein, 85 aa, Myxococcus xanthus
MTEIHRIVTEELEWKGAVEPSQDLVRDLQLDSLGLTVLAVGLENRFRIRLSEEDAQGVRTVGDLAKLVAQRVAAPVEPRPEEALP

SEQ ID NO: 13341 - protein, 269 aa, Myxococcus xanthus
MDMNAVIGTHDLLFITLDTLRYDVAEALAAQGRTPNLSALLPGGRWEQRHSPASFTYAAHHAFFAGFLPTPATPGLHPRLFSMRFEGSETTASDTCVLDAPDLVTGLAGRGYHTICIGGVGFFNKRNPLGNVLPGLFAESHWSPELGVTDPRSTEHQVTLAVQRLEALPREQRVFLFINVSALHQPNRHYVPGATQDSRESHAAALAYVDSQLPPLFAALRRRGPAFCIVCSDHGTTYGEDGFTGHRLAHPVVWTVPYAELLLPRETAP

SEQ ID NO: 13342 - protein, 98 aa, Myxococcus xanthus
AIATLGDRWNSRIIVVPGLAPVTGGPYRFLRHPNYVAVVLELACVPLIHGAWWTALVFSVGNAALLYVRIRAEEAALGEVYAQAFSHRPRFIPEVPRG

SEQ ID NO: 13343 - protein, 183 aa, Myxococcus xanthus
MRKLKYHVATSVDGFIAHEDDTYGAFMQDRLIKDSEHVADYVASLATYATVLMGRRTYDGGLKVGVTDPYPNMDTYVFSRTMKESPNPRVKLVSDDAVGEVRRLKAQEGGDIYLSGGGAFAGLLLAEGLVDEVLLKMNPLILGSGILLASSLKQVVDLDLKSTKVYANGVVLLRYAVMPRPQA

SEQ ID NO: 13344 - protein, 183 aa, Myxococcus xanthus
QQNVNQQVGMDGGDEDFAAMFEASLNERGGDGILKEGEIVKGTVVQVTKDFAIVDIGYKSEGQVPISEFTNPRGEVSVQAGDPVEVLLESRENDTGMVVLSKEKADKMRIWDEISAACERDEIVKGTIVGRVKGGLSVDIGVKAFLPGSQVDIRPVRNLDQYISKEFEFKVIKFNKKRGNIVL

SEQ ID NO: 13345 - protein, 99 aa, Myxococcus xanthus
MLADMQTQLEAAELLTLRAASMKEKGQPFSREASMAKLFASEMSNKVADKAVQLHGGYGYIDEFPVERFFRDARVQTIYEGTSEVQRMVIARESFKLLG

SEQ ID NO: 13346 - protein, 170 aa, Myxococcus xanthus
MFVRTALMMSAALLLGGCEVASEIGKPCALVRKATPEESAANNNSATMPILEREIAAQQDFISFGSVNCEDLICVRDQDYPRALNEDGSLNENAPAMGYCSKPCVEGGSSCEVTDTDDVNPDLPRRMSCRPMLLDQDTLDALRSADEAFYRRTFGENNSPFFCAGALIPD

SEQ ID NO: 13347 - protein, 34 aa, Myxococcus xanthus
SGYKLAQAKQAGRHLIGLLNDQYRLAIIHYRVGR

SEQ ID NO: 13348 - protein, 219 aa, Myxococcus xanthus
MKLSTYLDEVGASSSLPLESDLDELADTMLGKRPEDINHLVGPSLLRAVPSLREDVRFPDYAPRWLNRLTESSVWIAPRGTFAQLHRDRAHNLYAQLSGQKRWQLYAPHQARRLQPAPLDWAADLSGVDLEVGAARRMTASGLRPDYDFILEPGDLLFLPVNWWHRVHTVSPSIAFNLWWWDIPSAVRVGPVAARIALGMKLQEAYSSLHRRSPASEQR

SEQ ID NO: 13349 - protein, 78 aa, Myxococcus xanthus
SESGTGVLRFAIIWGSQTVSKLGSALTSFALGLWVYGLTSSVTDFALISVLTILPGVLVAPIVGVLVDRWDLRNAMRL

SEQ ID NO: 13350 - protein, 144 aa, Myxococcus xanthus
MASRLPLLVQEDAGVCDWVASVARCRPVAVVSNGSARVQRTKLARAGLAEVLPDVFLSGEVGASKPDARIFEAALAHVGRSPEEVLHVGDDPARDVVGAARLGMATCWVSHGRPWPSALPPPMFTVECIPSRIDDIAGVLTRWT

SEQ ID NO: 13351 - protein, 247 aa, Myxococcus xanthus
LNLVCFPDELPLKVLSKILAGGQSKADEAGIPILGGHSIRDPEPKFGMAVTGVVHPKKVLTNAGAKPGDVLFLTKPLGSGIATTAIKRGVASKQLAKRALGVMTTLNRAAGEVFASGKFKVNALTDVTGYGLLGHLLEMMTAAKARATLDLERIPLIAEVPALAEDGVVPGGTKSNLAHVHKKVRFPEALPECIQWVLADAQTNGGLLASVPARQALKALKALEAAGVDAALIGEVQAGKPGIDVVG

SEQ ID NO: 13352 - protein, 156 aa, Myxococcus xanthus
MRARTEGVETYFLSASASGDAALAVADRENAEAPMSRATRTDSTLAFILQDLARTEAHADSSRLAYAIHPRLVRGTRAVNRGVQQAPFFVLSGVECPAVLVEVGYISHPVEGPRLGRPEYQEKLAEAITEGVLAFLKETRRRDAARGTEVAGPVSP

SEQ ID NO: 13353 - protein, 304 aa, Myxococcus xanthus
KAPCAFAGLISAQRLLSTPDAATDGQVHLSGLLMVAGGAALSGELVYGLFLIVFGVLASIALALGVVESAVPEGEPVPVRAVMGPLATGVGFAVVGAVAFFILFPRLNWNMIGPSASPGLGVATAGFSNTVRLGGAGTIKGNPRIVLRATLTPDPEKETLDAYWVGRTYDVFDGMEWSNARATSNGSEFMTTLRPGQENLVHQHVELMPAYGARTLVALETPSRLGNAVANTQVGSRRTQIHELGGGEVRFRDSGISYSYEAYSLPPGASGDDVQDLPPEEQDALLSLPEGPGTSASARQPRGC

SEQ ID NO: 13354 - protein, 162 aa, Myxococcus xanthus
MRARLATGFFGGERVTGGYVVRAGDAHAWTHVLVPGRGFITVDATPPAHRASQSPRLLEQLINFYEIVESQWRDVVLDYNFRDQLTVVRSLTRSHEVPKKDEPASRAPPPRAFGAALLAAAAAYTAWRLLTQFLSRERPLEATRFVDAVEAQLAFARIHASR

SEQ ID NO: 13355 - protein, 302 aa, Myxococcus xanthus
  unsure (1)..(302): unsure at all Xaa locations
ATAPCLPACPQRLLDFVQAPDHDCRARQPGHMDSTTAERPRRRWARIIAGVVFTILVVLPALALVAAVVVLRNLDSPWLKQPIVSEVKAATGLQVDYQVAQVELLSGLKLGGLVVLTPAPFHTAAPELLRVGTLEAHWSPRALVTGPIRIERVVVRDVALALVADDSGATSLTGLTGPEAPEPPPVEAPVSASQQVANLLGAPLPVGHVDVTGVSLSYVRVQRGEVAERWSLGGLAARVEAKQHDGEWKVFANLGQAGAPLPLELRHEGAATPPXLAELAFALSLEAGASAARAQVDLDVTL

SEQ ID NO: 13356 - protein, 504 aa, Myxococcus xanthus
TSLALAGGVNVMFRPEIFVAMSKGKFLSADGYSKSFDTRADGYGRGEGAGIVVLKRLSDAVRDQDRVYAVIRGTGVIQDGHSESMTAPSSRAQEALIRRVCASAALDPTEIHAFEAHGTGTAVGDPAELGGLGAVSKREDGQGPWVGSLKANIGHLEAAAGVAGLIKASLCLQHRQLPPQANLRNLNPAIPFDTLGIRIPRALETLAPRKDEPLRMGVNSFGYGGTNAHCVIEQAPSAASQARADATPAPLLLPLSARSPEALRALAQSYAEMLATPAPASLPDICFSAATRRAHHEHRLALLATEDVADLTARLESFASGNPAELGASGRTLQAADARPVFVFTGMGPQWWAMGRELYAQDALFRATLDRCDALFQRLAGWSLLEQMLADEQSSNMARTDIAQPANTFLQIGLLEMWRRAGITPAAVIGHSAGEVASAYAAGRFTLEQAMLVICEGSRMQARAGGQGKMAAVGLSEEGARAAIQKQKDLVSISAIVGPSARFL

SEQ ID NO: 13357 - protein, 177 aa, Myxococcus xanthus
TTSPVEYVNEPLRVLVGTLPEDLQGHVYVAGPSVHAGSPALASDGLVLRLDFQVGGARFTSATMRTPSHYARQQVDAGATARGPLTRLLNRFRKTTLADVSLTLGPQETPNTAPFLVEGERMLLVTTDAGRPWAIHPKTLKAYTPLGYLREWNRALPTPWAFPLLQSTAHPAFGPLR

SEQ ID NO: 13358 - protein, 36 aa, Myxococcus xanthus
MAEKKTDKVKRLTELSHCAGCAAKLRASDLAQVLGG

SEQ ID NO: 13359 - protein, 178 aa, Myxococcus xanthus
MTGKIDEIPLPDLLQMFHTSKKNGVLVVQRSDQEGRIYLRQGRVYYAVIGENHNLGPQKSFNRIITWEEGDFELRPAENQEFMVELDSSTEALLMDALRQLDEIKRLQPSLPTADTALALASPLTPPLKELAPELLDVLQLVHNYGTLNAVMDHADADDVVTAEAVVQLLKRDYIRAA

SEQ ID NO: 13360 - protein, 103 aa, Myxococcus xanthus
MDTQKTYALKFISGKYQGGEFPLKADKQIVIGRSSELDMVLGEDMVSRKHARISFSDGSITIEDLGSTNGTFVNGEKVKQSRLKEGDRILIGTSILKLVHQGA

SEQ ID NO: 13361 - protein, 224 aa, Myxococcus xanthus
MGGHSMKRGQPDYRAVASLARELARRGFFMVSGGGPGAMEATHVGVWFARRTEAELDAGLALLAQAPSYTDREWLSRAFDVRRAFPLGEDDLPYCTSLGIPTWHYGHEPPNPFATHIAKYFANSVREDGLLTVAKGGIIYSPGSAGTIQEVFQDACQNHYNSVGVISPMIFLGTEFWTRTRPVYPLVHQLAQGYDYARYLMLTDSQEEVVWALEAFDREAHLSP

SEQ ID NO: 13362 - protein, 240 aa, Myxococcus xanthus
MDEPLKQLLTLGRGYFEKKQYAQAEQYLAKIVEQNPTFADVFNMLGIIYHDQGQFARAQRAFESALKLNPAYTEAALNLAVIYNDMGKYAEAKEVYQAALSQQKSGPDELDPYVEKKIANMYGEIGDVFASSGVWAKAIEEYRRALALCPQFVDIRLKLGNALRDAGDNAAALIEYEQVIAQNPAFIPGHIQYGVALYSAGRRAEAVHVWEDVLVRSPGNKSAQMYLNLVKDPGKAEQAG

SEQ ID NO: 13363 - protein, 111 aa, Myxococcus xanthus
TTAAPRLQAVVWALESRRRALQAADAESLGRLAGPGTPGVGGPEWEQLRQVRARGYQAEAWYVRLERDDAVVTEHWRLQGALPARPVDTRGQRQLSLSLSGDEFLFSPSLM

SEQ ID NO: 13364 - protein, 284 aa, Myxococcus xanthus
QNELIREEETKYGLMAGAGWDILETLRVEAGGGYFQKGLVPGLATLGVEAPVNAAGVSGQIVYHVGVPVGTSVDFRLYKNDPDIYQRFFAPEQYPGGLSYTVSLEGSYLSQTLEKPNDFGATKPQGATAVALQARAKYDLLRVSLLGLYRSLSFIQFEVPGFPPFQDFPEGTELKPEMFLAVGADYHLPKLHFTPGFIIGVQQPASFRSPTPVLGGNNPPENLIGTRTVVVRDVNQLSILPETCGRGGAACKAEPIYSAKATFRWDLSDSVAAVGEVYYTYDTI

SEQ ID NO: 13365 - protein, 32 aa, Myxococcus xanthus
KRDFEAKGNAAPYMDALLTIGTESPDEQICRA

SEQ ID NO: 13366 - protein, 292 aa, Myxococcus xanthus
MDPGFDHPSEAYRDLLNVVGDEVGQVMTPVPNPQDPRSLVTIGLGDGAALTVLWPRVPEDPFLTGTRSDPNSNSIVAKLTYGKTAFLFTGDAEPDTEATLLRKPIDLTSTVLKVAHHGGRHSSTADFLAAVKPQAAVISVGAKNDYGHPTSAVLERLRAVKATVFRTDQDGEVVATSDGNVVSLRAEKRGGASELVPGGVKPGSVALGPITRGTRRTSTPRGRGAASAPAEAPGTDSTQRDTDAPRYFSLKGSKVFHKESCRTLKRSKSDRTAYSSRAEAMRERRPAEDCHP

SEQ ID NO: 13367 - protein, 50 aa, Myxococcus xanthus
SDSEDLFHFVEDIANQARRRLEAWKEGQTPGARAPASGPSTARVAMDTVR

SEQ ID NO: 13368 - protein, 62 aa, Myxococcus xanthus
LKENPGLGFHTTGEERAEEFRAILADGHVAAYIRRNRGRDIAGACGQLANRGETQAGTDSTT

SEQ ID NO: 13369 - protein, 86 aa, Myxococcus xanthus
MAVVLRLARAGVKKKPYYHVVATDSRNPRDGKFIEAVGAYDPNQEPPKVEFNEERLNYWLKTGATPSETVADLIKVAGKAKPAPAV

SEQ ID NO: 13370 - protein, 400 aa, Myxococcus xanthus
QGAKTVLVSGSGKNSPAVIALDITHPDDAWYPLPLWEFDLRSSNIEHAFSTAKVTTPEVQLPDNSGTNHAPSIGRLVWGSEAEGKWTAVVGTSQVPSSPGRAGALYLIDMKTGQPLNYGSSPAGAMAGIITLDTGSGIAAETALVDLDRDGNYDVMYVPTTAGNVYRVNLDQVNPNAPLGQKVKVCKIASAPVTLSDHDDAAKGQDPVYQQIHSNLGVRIVRNSGSPVVRFYFGTGDNPDEFSDGPENKNAYRYHLLGYEDTDPSGTRACALLDPLWVQQLDPGQAVWGGVTLADDKVYATTAVGAAADVCNLSQDESGRFYESGLLPDGNSAPAMTSASLGGHGVSAPVVHDNHLFIPTATGEVKVQGSGKWGNGNANGGAARSKVLIYAPSPDGRMPQ

SEQ ID NO: 13371 - protein, 140 aa, Myxococcus xanthus
MSFEYDALNDVVTAYFTDCVLVSEADVLRWRKEVEEHLSKYPPKVDLLINLDGLVVKFTAGRVFGKERREVLERYTHRSYRFGGDEMTRMFVLTSGAINGAAVNHYATRDEALAALQAEREALRKRGFSPFGGGFAGSKV

SEQ ID NO: 13372 - protein, 145 aa, Myxococcus xanthus
MDVVPEELVLAGKKVDPEDARRSAELVAEVIVSSKLNALEGHSLGSIQTWRNSDEEKVQEMRRLLVSGLGALPDAVTEGIYAAHLVAAGVTAALAAEADVRRIFDRMIRLLKQMHDRNPSWGPLFIRHRSDVAPHFLYPYPRHRV

SEQ ID NO: 13373 - protein, 87 aa, Myxococcus xanthus
MAILLMGVGAAMLVVTQTSYSNRRSLSATQAQLIAEQAMENITLLGCSVQPPCGNLEGLDESYVLFQTSAGALSNVRPADPTVIGRE

SEQ ID NO: 13374 - protein, 472 aa, Myxococcus xanthus
IKQVPKLFGVKEGDGNFFERLWFLVTHLGSTHLVTLLVGAGSLIMLLALDRVSKRLPAALVVLALSIVVTALLGLDARGVSVVGKVQAGLVPPQVPDVGLGDLLRLLPGASGIALVAFAEAIGPARMLAARHGYEVDANRELVGLGAANMGAGLFQGFSIGCSLSKSAANDAAGARTEVSAMLAAGFTLLVALFLTPLFRLLPEATLGAIVVVAVSGMMDVREMRRLHRMRRADFLGALVALVGVLALDVLPGLLVAVGVSLFLTVYRASVPRLSELGRVPGTLAFGDVRHAPRPLTVPGMLILRPNEGIFFANATALRDEVMTRVRHAGPSLHAVLLDMEVTADLDVPGADMLAALHDDLARRRVTLMLTRVMAPTGRMLERTGVTAKVGAEHLYAQVLDAVVEHLARASAATPEAQGLVRDGLRRLRMLVEEASTTLDADEGADRERLQTLGRRLGRAESALGEERPGPH

SEQ ID NO: 13375 - protein, 202 aa, Myxococcus xanthus
  unsure (1)..(202): unsure at all Xaa locations
VIQGGEVGWFASDDRLSXASCEVAEALLLRAIHTDRWRDEDADVALGVRQLVDVPVKALSPGINDPYTVVEALDQLTFLMCELSQMRLGPRVVPDSSGRPRVFLRAPSLRDYLDLVTDQTLRYGATEPAVVLRLLRLAGAVGQHARQAETRRTARETLHRVLAATEQGQKDASWLAGIRRYAESLEQALEGKPLPPLPAIGF

SEQ ID NO: 13376 - protein, 177 aa, Myxococcus xanthus
SKPKTQPKKPKKPDAIVQPKEIPKEVPKEVEPSEEPPAEEEASEEVVEGGVEGGVVGGVVGGVVGGVIGGVVGGQLGGTGTDVLPFGAGMTRPEKLSGPQPEYSREALEARVQGTMIVKCIVTVEGRVENCRIIKPLPHMDRAVLDALASSRYKPVTFQGRPVQVDYTFTLNFKLPR

SEQ ID NO: 13377 - protein, 210 aa, Myxococcus xanthus
MIIFTLGIMSIASLVVLAERMIVFRKTRSDSRNFAAKMGAILAKGDLNTAANTNLGKDVGHLGRVINSGLTAYRISPNNKDVAVESVARALERQAQREVQSMKRGLGLLATVGSTAPFVGLLGTTMGIVNAFQLMAQAGSGGLGTISAGIAEALITTAFGLLVAIPAVMAYNFLQGWVDARSVDISESSNEFLDVVARHLGGGAQSSNAA

SEQ ID NO: 13378 - protein, 120 aa, Myxococcus xanthus
SAGPKGSVKSDINVTPLVDVVLVLLIIFMVVTPMLQRGKSVELPKATEIEKEGKGKEADPLILSITPDKKVFVENDQVDEKGLQEKLTAEIEKDPGKKILLKGDNALSVGDVRKGAGRGP

SEQ ID NO: 13379 - protein, 145 aa, Myxococcus xanthus
KDPWWTFGIDWYLAGGDVQVLALRPGLEKRFSLTRNVTLGVSAFGSAAEVSLPTGQIGQVQPGEPGYTPIGGNNFYEGRMRKWAFGAGGLAAIQVKLSRYVHARVHGGYTRYFEQADGLQPAPDAAAFTVSLDGPFAGALLGLDL

SEQ ID NO: 13380 - protein, 255 aa, Myxococcus xanthus
TAFHDDGQTVTVRLSDGSSVTGDALVGADGLRSVVRGALLGDAPLRYSGYTSWRGVCPDVPSATPGLVSETWGRGARFGVVPIGFGQTYWFATQNAPAGEQDAPGETRARLQSLFGGWHAPIADLIAATDEANIIRTDIHDRPPASRWSRGRVTLLGDAAHPMTPNMGQGGCQAIEDAVVLAELLAGEGPVDAALAAYEQRRLGRANSFVTRSWSLGRVAQWESSAGRFIRNALFQLVPQGFAARQVRALVRDAE

SEQ ID NO: 13381 - protein, 367 aa, Myxococcus xanthus
RNLSSVGGTKLGISKTGVPRHPSSEIRSVHAPRHCALVREFRCCPCFCLGFVGADAGDAVGAGAAHAADACGPLPAHLRAGPLLRPQGRDGDGGGRVVARIPVQQDPDAEAGPIGLGEAGRHLAILGSCASALMSPKDGQHFYLACGARGQWLRPEPMARATDLLWGLAKAEFTGRRSATGHTLLSLPDGTPFFRLEVDYNVLSAAAFTRLFGEARVDMRREPRRDDGMQRTPEEWAKLRQNPYSKPLALRDWRPDGESLSATLGPVTAEMCKGHFALHPVMPVAVVASGMTRVATTLLRRLEGAPWARCMAKDVRLKADTLAYAGQTVTFGAVRSAHDGDAHTFTCQASVGERVVAELDVTYIRVD

SEQ ID NO: 13382 - protein, 241 aa, Myxococcus xanthus
GVCICPFARGGHCRGLHGRARRRTIRCGLVSRGGSRPGSAPRGERRRPTVSNKGELEARLAPVHPGDSVRGLFFKSVFSFVHQQAGLAALKTVRQGALGAAYTDLLTYPARDFLTLLYRAADALEPLLGPEDAVFHACGEKDVTRFSTGPGMLIFGIISRGDPQKLFAGAQMGYGAAVSYGSRDYVPTGPTSGTLHMRRDMLPPAYHEGILTGALKVLGLQGTARATPRGIDSADYDIQWA

SEQ ID NO: 13383 - protein, 309 aa, Myxococcus xanthus
MDGREVLRFEGMCDASGAVALGGSLFVVGDDEDNILRVYDARRGGPPVQSVDLSPDLELPAAKKKPPEADIEAATGLGSLSFWLTSHGRKSSGKKAPSRLRFFATKETDAGPRLVGRPYTQLLDDMLAAPQLARFGLDGAETKAPKAPGGLNIEGMTAMADGRTILVGFRSPVPDGKALLVPLLNPVALVEEGARAQLGEPVQLDLGGLGIRSLSWWRGRYVIISGGTAGEGTSRLFTWRGGEDAPVAVESVDLAGLNPEAFFTPEDTEEILLLSDDGAAPVDGVECKRLKDPSRKRFRGVWVRLPESP

SEQ ID NO: 13384 - protein, 57 aa, Myxococcus xanthus
DYQQLAKRIVQRAKRKGARQAEAFLEVGRQSSVRVHQGQIEDLTQSTSKGVGVPVVL

SEQ ID NO: 13385 - protein, 509 aa, Myxococcus xanthus
CRLSHTPSSSLRESRNMPRASAPSKRALSLKLAPPVARRPTPVALLPQPLVERLLAVAMERGGDFAEVYVERTLTTAVRLEESRIKSAQTGLVQGVGVRVISGGKVGYAFSDDWDESALLRAASTAVMIAQGGGAERSFPVRRAAVPSHYHVSPPLMDVEVSLKTGLLMRADKAARAFDARVKQVNGGYVDQTRRIAVANTHGRYTEDTQDLCRISVMVVAQGTGGERRTGMYGGGGRVPFSHWDTFSPEDVAREAARQAVATLGAVDCVAGPQTVVLAPGWSGILLHEAVGHGLEADFIRKGTSLFAGKLGEKVASDLVTIIDDGTVSSGRGSINIDDEGNPGERKVLIENGVLKGYLYDSLNAQLMGQRSTGSGRRESFKHLPMPRMTNTFLAPGDHAPEDILKEVKRGLYCATFGGGQVDITNGNFVFEVSEAYQIEDGKLGRPVKNATLIGVGPEALKNVSRVGCDPMPDPGMGICGKNGQSMPVGVGLPTVRIDNITVGGTKVA

SEQ ID NO: 13386 - protein, 145 aa, Myxococcus xanthus
DAFRDALMGAAVGFLSFRMMEYVGWKVFQREALGAGDKYLVAMLGAFLTWRALLGVLLFASMQGAVVGILMLLSTGRAGPRTENTQDEPAGDAPPLTMTWEFTQPGLPLWKRLLLVPVCLLVQPIPDAPLYQEGGLEHWERERDS

SEQ ID NO: 13387 - protein, 260 aa, Myxococcus xanthus
RGDSVMGAFAAMAWNGFREARRNRVTVLVAAFALLLLLATTLVTEVTVSTFDRVVTDFGLGVMSLLLVFLSVYLSSGLISREIERRTIFLMVSKPLSRTRFLLARLAGNMLTLGVLLVAMTLLFWVQLALHRSPITQPQLAALGGLYLELFVLTSAGFLMSTFASQLVSALVTTGLYFAGHLCSDIYNLGAASKVELIQWVSKATYYALPNLERLNFRPRATYGIEVTAVELGSATLYALGWGALFCVLAAIVFERRDFR

SEQ ID NO: 13388 - protein, 92 aa, Myxococcus xanthus
MVLDAPLCVGLMDAYPPSVLSRVDGFHAAASVDFTVHFFHDLPRPGLREDAHFLRTGRSRQAAEGYSEDFQQLWTQEGELLAQCRQLVAVLG

SEQ ID NO: 13389 - protein, 179 aa, Myxococcus xanthus
  unsure (1)..(179): unsure at all Xaa locations
FPPSGLTXYENVRVLLLGQDPYHGPGQAHGLAFSVKPGVAPPPSLVNMFKELESDVGVPRPKDGSLIPWARQGVLLLNAVLTVRQAKPNSHAGHGWEDFTDAVIRAVSAKDDPVVFLLWGRYAQKKKKLIDSKRHVVIEGTHPSPLSASNGFFGSRPFSAVNEALESHGRPPIDWRLSA

SEQ ID NO: 13390 - protein, 439 aa, Myxococcus xanthus
  unsure (1)..(439): unsure at all Xaa locations
KEAGAQTPXVAGXRCRPWHAVELFRHNHLHGFLVLGGVFLVVTGCEALYADMGHFGRKPIQLAWFSMVLPALMLNYLGQGALLLRDASAARNPFFLLAPSWLLYPLVALATVAGVIASQALIAGVFSLTRQAMQLGYSPRMEVVHTSAEEMGQIYLPGLNWALLVGVVALVLGFRSSSALASAYGIAVSTAMVITTLMAYVVARELWGVRRWVAIPVVGLFLSVELAFFGANAVKVADGGWFPLLMAVVVFTLMTTWKRGRDILAAKLRASSIPLKVLLGSFGDHPPVRVPGTAIFMTGNAEGTPPALLHNLKHNKVLHEQVVLLTILSEELPHVPHSERVEVEPLEQGFVRVVARYGFMENPGIPDVLKRCREKGLQFQLMGTSFFLGRETLIPTKRPGMAVWREALFAWMSRNARSATAYFRIPPNRVVELGAQVEL

SEQ ID NO: 13391 - protein, 254 aa, Myxococcus xanthus
MQLAIPHAPRQVRLTQVPGAVGRVVRGVLLGLVAVAFLGTGAGWAGRYFVEEQGFAARAEEVEGLVVASRLPPLDARDGAEATLEVLYTFAEAEHSVSGIRTFAEYAEGLGRGARVTLLVDPAMPDRPREAGFARSRAMRVGLLPWGIGLGVLVAVGYFAWEMRRLWRSEVDPLRLGALVWLTPDGPLLEARSEVSFPAHYFRQDVKHAVRARVRPGRAPVRNGEKVLAAVVPRQPGWARVIDQDLAGVLGWLR

SEQ ID NO: 13392 - protein, 218 aa, Myxococcus xanthus
KVGFIGLGNMGLPMAASLAAAGHELTVWNRTESKAAPLKEKGARVARSPAEAARGAEVVFSMLADDAAVTSAVFGQDGLLAGLAPGAVHVSSSTLSVALSERLAEAHASAGQRYLAAPVFGRPTAAASKQLWVVAAGPKQDMDRCRPLLETLGRGLTVLGDRAPAANVVKLSGNFLIASMMEALAESFALTRKSGIEPKVFLEVFQSVFARAPIFEGY

SEQ ID NO: 13393 - protein, 502 aa, Myxococcus xanthus
ASRNLGAPTFRHEGAPRRMAQAPAAQSNKFPPQIPFIIGNEACERFSFYGMRNILTVFLIDYLLRTQIPDNALREAEAKSLMHTFMAGVYFFPLIGGYLADRFFGKYRIILGLSLVYCLGHACLAIFENNVTGFFTGLALIAIGSGGIKPCVAAMVGDQFNESNSHLVKKVFAIFYWTINFGSFFASLFIPLLLKHFGPSVAFGIPGVLMFIATFIFWAGRHKYVRVPATGANPHSFFKVVASALRNRGQGGGWLDGAKREHPEEAVDGVKAVFRVSALLLPFVPFFWMLFDQKASTWVVQARSMDPQVGPFTFQASQMQFINPLLVMILIPFLTAVVYPAFQRFGWELTPLRRMPLGLVVGALSFIIAGIFQVTMEGGTTLNIAWQILPYIVLTLGEILMSTTGLEFAYTQAPREMKGTIQSVWLVTNTLANAAVAITAKLNVFTGSGQFFFYAGFALVAAVGMALVARRYVVRDYYQTSAPIPTEERSAAGVTPGSAKSA

SEQ ID NO: 13394 - protein, 150 aa, Myxococcus xanthus
  unsure (1)..(150): unsure at all Xaa locations
IPVKMSMGLLFLSAGFLFMLGASSESASTGKPXAWWVVMAYLLHTMGELCLSPVGLSMVTKVAPARIVSAMMGVWFLANAAANKLAGVFGGYSEKLGEFSVFLYISVGTGIAGVLLLVVSPILKRMMHGTDEVKPAAPTSAQQGGSVAAA

SEQ ID NO: 13395 - protein, 163 aa, Myxococcus xanthus
AHDHDHDHDHGPHGHHHHDHGPHGHHGHDHDHTHHHHDHHHHHPHGHDHGPAEEHKARAPVHVSTFIVTCSDSRDAARDESGQVLREGLEAAGHGIAGTLVVKDDPEAIRGALDSAREAGARAVLFTGGTGIGRRDCTVETLRPLFEKELPGFGELLRMLSYR

SEQ ID NO: 13396 - protein, 105 aa, Myxococcus xanthus
MTKIKLGPADFAEREMRGYEVGKRNVCIAKIHGRYKGLDDWCNHAGCLLSGGRIEDNMVVCPCHEVGFDMDTGRNATSPGVCDDQPTVQVAVEDGSLVIDWPDTP

SEQ ID NO: 13397 - protein, 355 aa, Myxococcus xanthus
EIIRQQNEDLDRLAQELAVAKRNEEERAREAEAAARLKSEFLANFSHEIRTPLNGIIGYCDLLMREEGQRLTAHGRRDLNVVKTNAKTLLALINDILDLSKIESGRVEVVTEQVDVQELAEECLATVKEYLKGKDVALTTNIDPSARMLRSDALKLRQIMLNLLSNAAKFTDAGEVALSLVPAGSEVIMTVEDTGVGIPSDELPFIFEKFRQVDGSTTRKVGGTGLGLAIVRELSRVLGGNVTVTSTLGRGTTFTVRLPTTLETPDNGGGPHLERGVPVSEVAQHVGTMAQPGSTVLVVDDDPLIQQLVAGQLEPAGFKVVVAEDGIAALKRARELRPQAILLDIHLPKLDGWSV

SEQ ID NO: 13398 - protein, 113 aa, Myxococcus xanthus
MQAQLMALMSVSQGTSVISENIFENRFMHVPELHRLGADITIQGPTAVVKGVKGLSGAPVMATDLRASASLILAGLRAEGRTDVSRVYHLDRGYERLERKLSALGADIRREKA

SEQ ID NO: 13399 - protein, 599 aa, Myxococcus xanthus
MHSRLVIVLPVLLLLVPSAVGAAKRDEAEEAYQGARKVYYALKDDAARRKLRHHWLNVVARFESVAARFPKSDRAPDALFTAAEMLQELSRISFVEDDLKASITDYTKLLEGYPKHRLSDDGALALAKIHVHRLDQPESARKVLTETLAVNSKGDRAREMRELLASLPSPKAPPPPPRKAAPVVAKSDSSASGKTSTAGKATAMADSGKSSASVDASAKGSVSSKAVASAETSASGKGSAPDDTSSAGTSDTSKAVASTDTSKDAQPAPAVEASGPAERPSSSLVAAIEKMAREPSPRIPQKEPSAPVKEDAREGSLDAAVAAAMASKPAAAEPPRPITRPVDDKVAQARLKAVAKQSRSMELTLAEQLGLKVRRVVIDPGHGGHDTGAIGKGGTREKDVALSISLKLAEELREKGLEVVLTRDDDRFIRLEDRAKYANAEHGDLFISVHCNAAEKRTLRGIETYTLNTSADRYSIRLAARENASSEKGISDLQFILADLATKANTEESTRLATQVQRSLVGGLSRKYKGIRDLGHKEALFYVLLGVKMPAILVETSFLSNPDEEARLKSNVYQTEVAKAIAHGVEEFLGDRRRVAKVD

SEQ ID NO: 13400 - protein, 129 aa, Myxococcus xanthus
MDCPSCNVEMSDLEGDDQTLRKCGDCGGLWIDVADLNRVLLHNNLPGLESQGGKVDAEALTGQCPECQVDLVRVDGGDRQHPLHYDTCESCGGIFLESEFQDATDVKVAVEEIIAFFRHFGAKRKMAAL

SEQ ID NO: 13401 - protein, 199 aa, Myxococcus xanthus
RPRTACTPPRPMAAARARKLTLTGIKEARSVRVEDKRGLQVVPLKPGLRGARFTLEVSERFPGAKDDAPVCVTDIVFYAGGKALNGTWLAPKLRYNGRLAPLLGTWFGGLKGAPHRFLSFYLDGTYSLTEEPLEGEVSTTVSGAYTLSGEKLSLDVPPHGRVTVRFPRGDSEGTRPPDASLAFDGPVAEAWGEEFRSQR

SEQ ID NO: 13402 - protein, 201 aa, Myxococcus xanthus
  unsure (1)..(201): unsure at all Xaa locations
RGGLAFDPGGARRGGPQGTRGHPGLHFVRLSAAEGHRHFLERALPARWLADAALRTRALRRFLEAGPALREMGLMYQLLALLRRTRPDGRFVHPLTVVDLPATGHALALAALPQRVLSLMPGGPIGRDVREGLDFLQDAARTAMVLASLPEPLPVSEALTVAAELRRLELPLSAAVLNRMPEDPFTPESRARLHRMLAXHG

SEQ ID NO: 13403 - protein, 137 aa, Myxococcus xanthus
STDIEVCPVQLPGRENQLREPPLRALPDVIAPLVDVLAKHTDKPYALLGHSMGALLAYQLTRALRERGLPAPLHLFVASYRAPHTLQAHTPATATHDIDASEARRLGESRAVSGEMAEELLTLMRATMLADTAVCEV

SEQ ID NO: 13404 - protein, 407 aa, Myxococcus xanthus
TPVLVTEDAVADTLPVSQALVLCLDSEWERAAGRESDAPLESVSSAEDLAYLIYTSGSTGRPKGVLVEHRGVVNYLHWARKAYAVDDGAGAPVHSSLAFDLTVTSLLLPLTAGRPVTLVPEEDGVEGLATALRTSADFSLVKLTPAHLQMLAAQLPPEARAGHTRAFVIGGEALTSATVEPWRQHAPSTRLINEYGPTETVVGCCVHTVEADTPVEGAVPIGRPIANTRLYVLDAALRPVPAGVPGELYIGGEGVARGYWRRPELTAERFVPDPFSSVPGARMYRTGDRVRLRPSDVLEYLGRVDFQVKVRGHRVEPGEVEAALIELPGVASAVVVLREDGPGPPAGGLRHRPRRDARDGAPARITGTAAALTHGAICAPWSGSTCVKGKSTCGPASTSCARCPRGV

SEQ ID NO: 13405 - protein, 430 aa, Myxococcus xanthus
ITSLAPLVHAVKGAVVNVKVRARPRRSAAMQRLPPGMAERFGLPPGFGGEGNGPARQGAGSGFIIDASGIVLTNNHVVEDADQVRVKLDDGRAFDAEVMGRDPLTDVALLKLKGAPGNLPAVPLGDSDALRVGDAVMAIGNPFGLASSVSAGILSARARDIQAGPYDEFLQTDAAINPGNSGGPLFNMQGEVVGMNTAIVGGATGIGFAVPSKLIQALLPQLKETGVVRRGWLGLAVQDLTPDLARALGLEAMKGAVVAGVNRGSPGERAGLREEDVITSVNGKPVESAGGLTRAVALLQPDSRVKVNLLRGGKAQSLDVTLGTRPAQNGEQEVLPRNASASAPRRLGVQLSDARDGGAQVVAVEPGSPAERGGLVPGMVLVQVGDQKIASVSDAAQALTAAKPGAALLLRVRMPGSESTLLRAVEVPER

SEQ ID NO: 13406 - protein, 70 aa, Myxococcus xanthus
MRNTASADYLAYGLNQDVTRLIGWGNTAGSGLPFLGTGLPVPVLVYGTVPRGQNVPSGTYNDTVVATITF

SEQ ID NO: 13407 - protein, 675 aa, Myxococcus xanthus
MTLRARLLLAQAPLALALLLVGVVTVVTLSQLGRSGPRVLQDNYRSVLAAQEMMAQLERMDSGALFIIAGERQRGLTQQAAQRARLESQLRVQEGNVTEPAEDAATLRLRTSWRRYQEAYDGFLAQSSPEGAREAYFGVLEPAFQEVTGAARAILDLNQDAMVRKSEALQRQSARVNTVMVAAVMVAFVVGLFASQSLTHRALRPVSVLSQAVRRLGEGDYAARAVVEGQDEIAQVGRDFNAMAEALQQYRRSSLGELLQAQAASQAAIDSLPDPVVVFGADGGLLNVNRAAEDVLRLSLEAGGDMLGQVVPEARAVLERVREHVLTGRGAYQPRGYEEAVRAPLPDGDRWLLARGSPVHGESGEVVGATVILQDVTRLRRFDELKNDLVATVAHEFRTPLTSLRMALHLVTEGVVGPVTEKQADLLFAAREDSERLQGIVDDLLDLSRIQAGQLQLEIRRVPAEELVDAALDAQRMAAEERGVQVSKQVGLDVEPVDVDPERLGLVLGNLVGNAVKHTPPGGEVEVHVWQESHGVRFEVRDTGEGIALEQQARIFEKFYRAPGAPAGGAGLGLSIAKDIVQAHGGDIGVVSTPGQGSTFLVTLPRGKGRPRACDAKSSSASRHPRGVRASVRAAGLKADSTLEYWRYRVSICAPVKAGPRRDEALQTLHVQASV

SEQ ID NO: 13408 - protein, 678 aa, Myxococcus xanthus
QAKQYPMAPGRTGIPERREYKVVPDHLGRGRELVDVSKNKERGQRKRTSGDTQSVSKQELTDMVWGRVTIPIRGKKRKPTKKGAKTQITQMAEEKKVIKLQEGISVSDLGQRMGVRSAELIKKLMGLGKMATANQLVDADTAEMIAGDYGWKIDRVGFEVEDYLPEVETRPEDERPRPPVVAIMGHVDHGKTSLLDAIRKASVAQGEAGGITQHIGAYSITTARGDVTFLDTPGHEAFTSMRARGADVTDIVVLVVASDDGVMPQTVEAIKHAKAAEVPIVVAINKMDLPTANLDRVKKDLATHELVPEEWGGDTIMVPVSAKTKENLELLLENLALQAEVLELASNPLRPSVGAIIEAKLDRGRGPVATVLVQEGTLKLGDAVVTGSHYGRVRAMTNSRGEQVKEVKPGYCAEVVGLSGVPGAGDAINVVADEKAAKQIAEHRNMKERQTELSKVSRESLEQLFAKTKAGGGPKELRVVIKADVQGSAEAVKQAVQKLSTHKVKVEVVHCRVGAITEGDVMRAAASKGVVLGFNVNPESGAEAAAKAQEVVLKSYSIIYELIDGVRTEMEGLLEPIRTERKLGRAEVRNTFNVPRVGTIAGAAVLDGVMKRGAIVRLMRENKQLFSGKMASLRRFKDDVKEVAQGFECGIGIESFNDLKPGDIIEAYEIVETRQSLT

SEQ ID NO: 13409 - protein, 346 aa, Myxococcus xanthus
MTGWTLISEPARLALWVGIVFVSVLLHELGHALAFRRYGCPARIELHGMGGTTQTHDAAHLTHQQSAFVSFAGPGIGFLAGGLIWGLSQLVPLGEPGGLADQGVRQFLWVNIGWGLFNLLPMQPLDGGHLLADLVRARSGYRHERGVLGVGIATAVVVLGLAIWSKQLWMGMLAMVLGVMNLEQLRRTPKRRPAERRFALPRLVRKPEAAPAGAISIEQLMDELRGTPRPPGAADADDDLEGPHDPALVGEMLLDNGLPELAVGSLQSAFTQAPLARTGHALVLALLHTGRLQELASLLDSSHARQLSEDTLALISEHAGTVSEAPLTERITALRHGRTTGTDEPR

SEQ ID NO: 13410 - protein, 123 aa, Myxococcus xanthus
MPPPALTLVAPTPSRRADPVRVAVEQLARSLPARTDAAVLLDLLEDDLREGLDALGEVEAHFTDLLDTLRTEAVTPAALVESGDDLRVLQQLDSLHDAVVRLRKRLSQAASMNRLAHAPVRSR

SEQ ID NO: 13411 - protein, 74 aa, Myxococcus xanthus
CSKDDYKTRLLGSGTASGRGEEGRITVLRSVIMDPWITEDLQGRPFLDTIIEELRAAVMDALNEMRGTSSKCSR

SEQ ID NO: 13412 - protein, 211 aa, Myxococcus xanthus
CDTSNGGGRSVYIKGNLFRDYAHEVGHVLGLGHGNRRDSTTGKQVRSADSSTYMGKFASDNYNLPQLHWLGWTQKEELVKVNSAIDNGGSIDVTLRPVGANAHSTSSLPLGAVWEVPDTEQRLFIAVPKARTNSSNEIEGGTVFVYRGSRAVGCTGICLGTLQLARFSAKSNNEHEATGIFVKPVAYTSHFIQEDGKRIEVFSSVTLRIRR

SEQ ID NO: 13413 - protein, 347 aa, Myxococcus xanthus
TRRSRAEDFLELVERGRRGRLKLYIGFAAGVGKTYRMLEEAHALKRRGVDVVLGFVESHDRADTQALVEGLEVVPRKQYSYRDVTVEEMDLDAVLARKPQVAVVDELAHTNLPVCRHRKRYQDVQALLDAGINVIGAFNVQHLESLNDLVERATGVAVRETLPDSFLKAADQVVNLDLAVEDLHERLRTGKIYAKDKVPRALERFFTEENLATLRELALREVAESLDRATARPPPGEGDEGSQRSAAWGRVLVALSSYPRHAATLMRRGSRMAGRLNTDWFVVYVETPREAPHLIDAEAQRHLLTNIEKAKELGAEVVRLRARDPVEGILDFARSHGVGHIIVGRSH

SEQ ID NO: 13414 - protein, 310 aa, Myxococcus xanthus
HPPGALHGRVPADCAAQRDGVVLPVQRGAVGRHLQRAHHHPAHPPGAEGCPLPPVGRRGPAAAQPAAVRRGRRHRSLRGHQGHRRAARRRGSGVKGLIPMFSTFLTALRTCVVTMVLTGLLYPLAVTGLAQLLFPGEANGSWVKDGRGRVVGSALIGQGFTRAGYFHPRPSAAGAGYDGAASSGSNLGPTSLKLKERAAAELERLRRENPDAAGPVPAELVTTSASGLDPHLSPETARWQAARVARARGVALERVLDVVDARVEGRTFGVLGEPRVNVLLLNLALDRRFGPLPDAAPGVGGRASPGQGAP

SEQ ID NO: 13415 - protein, 227 aa, Myxococcus xanthus
MPLEQLVAALRERGVETLVDGAHGPGMLPLSLRTLGAGYYTGNCHKWMCAPKGAAFLHVRRDLQSAIKPLSVSHGHNSRRTDRSRFRLDFDWTGTHDPSAVLCVPEVIRFMGGLLPGGWPEVMASNRAKVLAAQNLLCARLGTQPTCPEDMVGSMATVTLPDGFPEVPQPPLYVDPLHLRLFDEYRIEAQITPWPRPPHRHVRLSAQLYNTPADYQALGDALEALLR

SEQ ID NO: 13416 - protein, 180 aa, Myxococcus xanthus
MSLAPTQDLFFFPSMLTLEPGESRPIRVGSSSAPQDTERSFRIVVEELPPLQPSTPTTGLNVLTRISVPVFVAPKKKTVQGQIAEAVLRESKFHVRVQNPGTVNFFIRNLRVRGLDAKGKRLVEKEEPGWYVLAGDAQVYAMEIAGKVCRKVRTVEVEMETDQGVLRQTSPVESPAPCAR

SEQ ID NO: 13417 - protein, 40 aa, Myxococcus xanthus
MSFVGGDQAEANGVVGYVLKSDLEHYNPKKSQSGKLSIEI

SEQ ID NO: 13418 - protein, 47 aa, Myxococcus xanthus
DRALLDFRRAGVDRDDATRAKVKSLNEELLKLGQQFSKNIAEDVRKA

SEQ ID NO: 13419 - protein, 71 aa, Myxococcus xanthus
MPDGPFHLVLCRNVAFTYFAPPLQREVLSRLVARLVPGGLLVIGGHESLPEGDFGLTRAAGPLPVFARTDV

SEQ ID NO: 13420 - protein, 498 aa, Myxococcus xanthus
GRPCSLASLCGNNVVDSGEACDSNVPGSNCTATCDLALCGNGVFNNRAHPSYAQEVCDDGNRYEGDGCNRLCEVEPGFACTGSPSRCVRAGVTVFNTGVDENNRRLEVGPDPHWFYSGTTTGAATGPRAASDWPQEIQTARFMEAPLGAPVCVYQDFMVPSTTNVSQFRLRLATFNDNDFASARVNGQNFTPTVVNQPAGMPWQKNIFREFGANAPWRTGLNRIELCNENAESEPNAFRYLFVDAYDDRCGDGAVSLREECDDGNVTNGDGCSATCGIEAGYGCTGQPSTCAQTCGNGTLNPGEQCDDGNATTGDGCNASCRVESGYACPTPGEACVPTCGNGTLNPGEQCDDGNAYDSDGCSSACRIERGYECQGAPSTCAPLCGNGRMDAGELCDDGNTTLGDGCSNACTLELGYACPAPGQACVFTCGNGNVDPGEQCDDGNLNPTDGCSTECRVEDGYACSTPETGPSVCVESCGNGALEENEACDDGNTTAGV

SEQ ID NO: 13421 - protein, 164 aa, Myxococcus xanthus
RCVPVAVAPSNKRGAGARISAAAPSDATSAKEAEVLRRYEAGDLAAARDLAQAEKLTALHGQLIRFETAEAQAKKALAQRDFPEAIAQLTLAISVDDALAHGWSKHGPPLRKQLSRLHVQVGTEHAAAGRVSEARAAFEQALKHDTGNREAREQLGRLTGASAP

SEQ ID NO: 13422 - protein, 177 aa, Myxococcus xanthus
MAIAVGLVLLGMQWKDLSYFLSPSVPLTLGAEGAYRFEALVSNRYAQVHGVPTVRGAYERADGALYVLVGLRDSPFVVRRPALPGEQWTDGRPPPQPDQRPFAVRGRLLAQADARRYRDALALMERMGELQPRDGRLWLLIEGERPGTDRGLLLVCLALVTFVVLNAMLLVRGLKRR

SEQ ID NO: 13423 - protein, 116 aa, Myxococcus xanthus
MIPINKVGSVGLREIISEEDVKQVYSILKEKDISVDSTTWNRRYREYMEKIKTGSVFEIAEVLRDLYLLKGDKDLSFGERKMLDTARSLLIKELSLAKDCSEDEIESDLKKIFNLA

SEQ ID NO: 13424 - protein, 412 aa, Myxococcus xanthus
AEVWRGKQFGASGFERLVAIKRILPNIAEDDEFISMFIDEAKISVQLTHANVASIYELGNILGSYFISMEYIPGKDMRAIFDRCRKKGEPAPVPLVAFCVSKMCEGLDYAHRKKDGMGREMNIVHRDISPQNVLISYEGEVKVIDFGIAKAAGKATKTQAGILKGKFGYMSPEQIRGLPLDRRSDVFAIGVCLYEMLTGERLFVGDSDFSVLEKVRKAEVPSPTTYNRRIPETLERIVLKALAKDVDERYQYASELGDDLQRFLITSDTIFSRKDLAQYMKSTFAEDVEREKQRLLDYADIKPPDGMQAALEAASFNSPIMPSAPPPAPVPVVQPVAPQPRMTGSMPTVSPGGVRRSPTLAALPRLTAATAAPPPDEDEGGATQLVSSDHEFADTPEPTTQPGAASGVLESF

SEQ ID NO: 13425 - protein, 82 aa, Myxococcus xanthus
MLITEGNDIGVPLDLVLRANLAKSGVYIEGMVGPWLVFGRGDTFRAHAAFGFGLQGKAASIGLEVGYLEPNPTIGLRIGYKF

SEQ ID NO: 13426 - protein, 58 aa, Myxococcus xanthus
DDELSESIDLATEKLMEQPRARWAKPMRKNLLALEAETELRCRVPASKGDGNGAAHDA

SEQ ID NO: 13427 - protein, 723 aa, Myxococcus xanthus
MLRGSDVLLPAATLEAHGVDLVALGGRQEVIEGKTYIAARSLEPEGRCTLNERTVSLSCELPASAFGQTRINLGPQAPSDYSVRGSPSGFINYAAHARNTSLTFFGEAGASVGRGLLTTQARWRPGSVPLRGLTQLSLDFPKHMVRAIAGESTGFGGVLGGGAVVAGFHLMRTFELNPYFVRNPMQDFAGDVATPSTLEVYVNNHLVKRTELPPGPFRLENLTVPRGEGNTRYVIRDAFGRASEVNTSYYLSGQQLSPGVVDYRLSAGIERESVNLYNFDFGRPLLLGNFRMGLTSWLTPGVRLELAPNVVSTGAMQLIQLPFGQLELSQAISRSERRTGLAAGIVYGLQRRWVGGSVFGRGMNASYTHTSLKLDDDHPTLETGGSLFLALGESVSVGGQAMLSRYQRDGWTTWLGATTSARLTDWSTLSFSASRSNSERGGSAIEGMVYLNAIFDSRTTGTVGHSQALRGKGTTSVDIARSVPMEGGLGYQVQGRVGAVDQAMARADFDSNVGRVSAGAEWVEGRMAGMAEVAGGLVLIGGRVRPTRAVDQGYALVRVKGVEGVGVRLNNHEIGRTDASGELVVTRLQAYNANRLSLADHQVPLDVYIPSTEQVVATYQRGGVVLDFKTQTIRAYRGKVTIDSAEDTRWLSYGEIRAEKDGEKWSSPIGWNGEFELVGLPEGRLPATVVYPKGRCATSLEVPSLEGKVIDLGTVRCVHDEAK

SEQ ID NO: 13428 - protein, 112 aa, Myxococcus xanthus
QGLTKADAAKRWGAAQIKEWRRSFDVPPPNGESLEMTAERVLPFYERAIAGDLRLGKNVLVVAHGNSNRSLVMKLDNLTGEQVVGLELATGVPLIYEMSPDGEVLSKRTASP

SEQ ID NO: 13429 - protein, 222 aa, Myxococcus xanthus
MKALITSLALLFALPSLDAHAQAEMRRPPSPPPGQQMPQPHHPHQPNYPPQHSGSQVVVDRRELNERLDRLEKLLKEAEQRMNRQERNKFRNAKETLNSVQDLVNRAPLLATVLPPPAPMPPPQPVVRPISDSELRRIHSSISLQTFAEDKMRVLVSAAQHHYFLVSQVGQLLGNFQFTQDKLAVVRELKPYILDPQNSHTLYSHFSFSSDKKRLDDILSQR

SEQ ID NO: 13430 - protein, 176 aa, Myxococcus xanthus
SKALEDRAVAKGRDGEFVSASLFLRAANFFLTFVDGSHHAKEMVLFQTMVAHRLPLAPGLLAQVSGEHGTGSEHAVAMLCAAEAMLRGGETDPARMLDAADDWLRLYRGHTAVEEAQVFPMARRLLPAGILDRMRTRFARIEASHGSLADAADAMERAFTPPPAGRLFPRGPVCSF

SEQ ID NO: 13431 - protein, 885 aa, Myxococcus xanthus
ARMPPGSMTAVACAEEKVRPLLTGALSLAAVNGPDRCVVSGPSGDVEALEHELSARGVGVLRLPARHAFHSAAVEPVMAELRRVVAGLRLSAPQRPYISSVTGTWIRPEEATDPDYWLRQMRAPVRFGDGLETLKADGCDVFLEVGPDQALTALARLGLRGHRGRAVASLPRAGSVLDAHAALMEALGTVWAQGLAIDWQRVYAHESRQKVALPTYPFQRQTFRTPLPTSVVARPETSAAVAERPAEAGGTPHLEAPAEQAGAHTDVERKVLAIWRERLGRTDFGIHDDFLELGGNSLMAAQLLTRLREAFPVSLPLSDVFDAPTVAGISARIQARLGTPGTASTEPVLPPLVRIPRGGALPLSVVQERICALEQALPGNAALNMYVVLRLHGALDVALLERGLEAVALRHEALRTSYPRGEGAPSVCIAPELKLPLSAEPLDPAAWQPRVHDEVARPFDLEHGPVARARLWRLAPEEHLLAVTVHHVVCDTWSLVVLAKELGDHYTAFMQGRPVALSTLPVQYVDYAAWQQQALKSGAFASQVAAWRGRLAAFPRPLELPVDRPKGDGPALRGQCLRVGFSRALSASVQAFAQREGVTPFMVLLASWKALLSRWTGRDDVVVGTPIGNRSRPELEPLIGYVAHSVPLRTDLSGDPPFKELVARVREVMMDAYAHPDVPYESLVREIEPAKDTGRGRVFDSMFVLHSRFNLNLELPGLRMSLAELENGPPEFGTVLSDLSVGLGEYEHGFSGTVDYAEERFERDTVERMVAHWTALLEAAVAEPGLSLSALPLEHARASQALASEPEASASVVTPIAALLRARAMADASQVAMTAPDGRGVTWGELQGAVGRLAAVLSDRGVGPDALVAVCLEPSVERVVAQWAV

SEQ ID NO: 13432 - protein, 176 aa, Myxococcus xanthus
SKRFNGAREKLTQVDRKNVLRDHALMDAMVEKERRQVLDGFTTQRGAAGRVAWALGLSPSELQRLVSMLSLTEDVEALRERFRREALATPHLTHRLDLLGREKYLTDLGIQKKFADTLRKELERLVGDVLHDAGDLHELADAVARKHGAPSELVFRAFERLGLADGLRKQLLAGSR

SEQ ID NO: 13433 - protein, 398 aa, Myxococcus xanthus
MVPRSRRRLYRPAPDIRNREDPLSIHVEALFGKLRELAGVAHETAAGLLHGDPVSDRGRSVVGQEPLRTRSWLAPLRDHLRSDSLVFRHALRVGLVATAALVVTRALGIRDAHWVSLTVIAILQPYSAITEERALQRVGGTLLGACLAAVIATRVHSPSALLAVIVLLTAVSVSLLPINFGAFQVLLTPDYLLLATLSSGDWSLAGQRALGVLVACALALTGAWLLWPMPERRRFPEAAATALRADGEYLREVISRRSGTRPEVGAARRTFSLALLDAEASFERLTAEYHGPPQQLESGMAVITYARRFATVVTALGMERPEAEVPDQLKQLAHQAGRALDELADALTDRRVPPPLPPLKVSCKTDDPVFGALLERVPRQLGMLHGAVSRLSSGSVLR

SEQ ID NO: 13434 - protein, 59 aa, Myxococcus xanthus
MRRFPDGALLVIEPWRARSFPVLKDLIGDRSALDRIIGAGGFIWVPTGAAPEASTPSVL

SEQ ID NO: 13435 - protein, 66 aa, Myxococcus xanthus
RREDAYQREGHTARTLVREPDLRIVLIVMKAGARMAEHRASETVSVHALSGHVRLRLPDRTVELPF

SEQ ID NO: 13436 - protein, 90 aa, Myxococcus xanthus
MAGPGAQRLEYNLYVDATRLIVWGNGTSGTGRYGPVVPLFGVEVTVPIFGRMLAGQAIPAGGLCGHRGDYGAFLRARSLCPWSTASRCPP

SEQ ID NO: 13437 - protein, 445 aa, Myxococcus xanthus
ANDFVITKVRFKRQDDFAPAPRTCAGGAPCFSEDVPGACTPEDGPEPTIAYSLAVDCRVCRPHPDTGQMECVANPNSPTWFPVHFPDTSPPTQEVELDIMAMGFTGSQLCWKVDITSPNEQCRPIIDDVEVGYQAIRAGSYSRASPSALANVIVWGVNETPGSAWGRGGAWPGSGMPAPGIRAYDGQKDFTLRGRLYFRSLYDPEEPSVTRAVQRWDAGRVMALSFGTNGHRDDPLQRKLYTMGASGGRSTITDEMSDTSSNSLLFPDALCDEERNGRYLYDLNNDGKCGTPSSESDEKRITGVTNDRNFLREWLYGWEDRHAPGTRDDRRPWALGGINMSTVAISLPPYLDTWANNARASERDLYRRNFLEPLADRPTVAFVGTMNGYLHAFDAGEFRNSTHDPCNSKTQARGYFETTTCNQNQINSRDYGSGPGALRLSAANA

SEQ ID NO: 13438 - protein, 277 aa, Myxococcus xanthus
CALREPAAEPAAAANAGKVRFKLMSQPSGARVFYRGKERGVTPFTLEIPSGQDGSVTVELTFALEGYQMETVVTGGTGEVVLSQKLQKRRGGAGGSRHVEVASVSADETAEEVEPVATPGGMSAPVMLAPTASPATELPVAAAVGGATAAAADAAPAKGSATGLALPVLPTAAVASARGDVLPYNEDMPRPEMVDQGKDIIYTREAMAAKSSGVMIVRCTITQQGRVEKCRIIKSVAHMERAVLDALTSRTYKPIVYKGYPVNVDYTFSMRLVAPRR

SEQ ID NO: 13439 - protein, 220 aa, Myxococcus xanthus
  unsure (1)..(220): unsure at all Xaa locations
CGFAASSSWGTSPASRALRASLWIARYHLGFVSMQDAVARAIAQLAGTPARPLQERTAVFYEEQVRPLYRPGAWAVLDAHRRAGERLVLLTSSTGYLSELVARELGLDAVLCNRFEVDGAGLHTGRALGTICFGEGKRVCAEAYVREAGVALSACAFYTDSYSDLSVMEVVGRPVXVHPDHRLRRHARKRGWPVVDWGVPPGGDVPAVPPAPPVVPSTGP

SEQ ID NO: 13440 - protein, 105 aa, Myxococcus xanthus
LTAMRVRGTARNAEGVERRFDALTSLPKPIQGVRFEKSLGMEAGRVRIAVKLGTWLGRIDFATATDLDADGVYTFPADSQAQNALVRGVEDTTAYVVTWVEGAAQ

SEQ ID NO: 13441 - protein, 266 aa, Myxococcus xanthus
MACSDGAGTVTFTTYGEDYIEKEIPAAVGGEDGIVDGWTVRFSKFLVVLGEVKVGNHDETAIEMMQARVFDVHKPGPVVVETFRDVPAQEWDHVSFAIAPNTNAVAGNADAADVTRMKDGGYSVYMEGRATKGEQTKRFAWGFTTNTVYEHCESPGLGAGVTVPKDGEETVQLTIHGDHLFFDDLQSPDAQMRFDALAAADSMGIAGPDGEVTLEELAAVDLTELPAGQYGTGGVGNVQTLRDFVTALTRNLGHYRGEGECEPRAR

SEQ ID NO: 13442 - protein, 396 aa, Myxococcus xanthus
VVAAPSDGPGANPLGFARRVVSVTEVDDTLVVETEAVALQDIVTGEMQFTFDYSEVQTVDISKLDLDWAARHLYVDANIMSPRAEGNPDDEPLPEAEEEGDPALPGDPFLGSIWNAITAVGDALGGAAKAVAAAAVDVWKAVTVEGITTGVEIKPEIKNNYSSALFKLEYEKSFNEAGKTPIKLSLKGTGNSSVDYSFNPGVQVGVKVPPILGGSQSTSMWLNVDSKSRLKLDVEAILNAKIESADGLTGKKLQDKLAERTKFAEDVLAQAKQKYLGHPDMRPAGGWKRNILVTKPAVQTIFAGPVPVVLTQTLQVDLECGFEAKAGVKANVSFEHNTTFKFEARYENGEVTTTPAQFEKKKNTDITVTGEGSLVVVCGLIPRINVYVYDALGMNA

SEQ ID NO: 13443 - protein, 454 aa, Myxococcus xanthus
APDTYVASAETYGAPSRTWTPVIAPDVRGGAVAVALPTGEVLLAGGTAATTAERYEDVLAPPAWRPVVSAPETLYQTCPTVIEGQGFRGISGASSGSYLDSPTDFPLVRLRAAEGGRLWTLPATDMSTTRATVRVPAEAPPGPYALSVFANAIPGGRMVTVRANTAPTADAVRIATMTGVPQDITLTATDPDADQTLTWTIVTPPQHGTLSGTPPNLRYTPNPGYVGADSFTYRVSDCGLDSNEPSVDIEVEATQPLAITCPEDTTIEATGPDGAPGNWPPATVTPGAGGPATLTYSPAEGSTLPLGTTTVTATAEDASGTQVTCTFQVEVRDTTPPALTCPADIRTTSDDASGTTVTFELPEATDGVSTPSVTSSPASGSTFRHGNNTVTVTATDAAGNEARCTFQVTVQATVISIAGGGCQASGGGAASSLAILVVLASWSGLRRRSRHASH

SEQ ID NO: 13444 - protein, 104 aa, Myxococcus xanthus
LMAGYERGILLLKGSDGQERSILDYRVSGWLAGAWSPTDRLELSARLPVIIHQGGNGADTLVGVSAPDAFGLGTPELGARYALLRREDSAPLFLSLGLDVGTPV

SEQ ID NO: 13445 - protein, 110 aa, Myxococcus xanthus
MAKGIARSELYRKWLAHKLINDLPRVARNRWDDFEPDDVLRHVGLTTYKPARAGLGGLGIFLLGVAAGGVAALLLAPKTGTELRTTVKDKATAYMNKQNVNMGQERTANA

SEQ ID NO: 13446 - protein, 97 aa, Myxococcus xanthus
MSQDSRLLEKIAQVEKGGAQKYHAKNAEAGKLFARERIRLLVDEGSFVEDAKLANNLDPDLPSDGVVIGVGKVSGRTVAIRANDSTVKADSWGVRTV

SEQ ID NO: 13447 - protein, 446 aa, Myxococcus xanthus
MLVRRLREVTRLPIHLHMHDTSGNGIASYLEAIEQGVHVVDVALGSMAGLTSQPSLNALVSALRGHPRETGLANARLQPLANYWEDVREYYAPFEAGLKSTTSEVYYHEIPGGQYSNLRPQVAELGLLGRWNDVKDAFALVNVLVGDIPKVTPSSKMVGDFAIFLLKNDLTVRASTLAEAASLTRQRLIEQAPRLDFPTSVVGYFRGELGQPPNGFPEDLRAAVLKGLPRVEGRPSASLPPLDLDALQRELSAKTGHALTRVDAISSALYPRVIAGYLEDLGRYEDVSILDTPNYFYGMEVGQEVWVDLEPGKTLVISLSAVGEPDEEGVRTVYFALNGHTRTVHVRDRSRAATVETRRQADRANPSHVAASMPGTVIALHAKSGDAVEAGAPLVTLEAMKMETVVRAPRAGTVEEVVPALTVSVQGGHLLAVLQGQRDRALRKAP

SEQ ID NO: 13448 - protein, 104 aa, Myxococcus xanthus
RAKDLILTAGRINAAEAFSVGLANRLAPEGHLLPVAYGLAESVVENAPIAVATAKHAIDEGTGLELDDALALELRKYEEILKTEDRLEGLRAFAEKRAPVYKGR

SEQ ID NO: 13449 - protein, 455 aa, Myxococcus xanthus
SLLAACGRLALDEAVDIVLQVADVLAYAHARQVIHRDLKPENIMVRQGMRGWHVKVLDFGIARITDGATRLTVQGAVAGTPRYMSPEQAMGLDVDARADVYAVGIVLFELLTGQQPFDGNSVSEIMQKQVHQPMPRLAQVAADLQYPTVDAVIQKATAKRREERYATMEAFASDLVNALPTLTSRRAVSGINPAITGGGLEPARPATLLFGTEGSEATLVRAAPAEAAPVTGSAPIPLTQPAAPSGLRVGSEGFNKTAHAASPYAAPKRSKSSAVVGLGIAGVLLLGGVGLVALRGGSRDDVKEGTLVPVGSPAQPASPVAPPAKEAGASPHATSGTVETAPDDVATRQLKVLAAGQAIDIGNDFNEGRLDSAMKRLAQARSLGLDAVEPELAALAGKVEDASKRMARARALENDGNCETAITLYRALKRDHPQLVEAQRGIRRCQDMLPPEVSD

SEQ ID NO: 13450 - protein, 175 aa, Myxococcus xanthus
MGDSAAVDGYARIHLEHLKPSPPIPGAPTSLTDYTSSMPDVAPAQAYAYFVRHPSAVFEAAGIRVRPATAALVDGAKLFLEEKGFPPVWAPITVRLEPGANTLHITTLDGHPLRGTNRFVFAEDGAGGTQVRQYSAFQGSSPATSVGMTLMDPIERQHDIWRAVHAHLHDTLRPR

SEQ ID NO: 13451 - protein, 136 aa, Myxococcus xanthus
MAPVLRTTPPGHDVILYDGHCRLCGGAARQLQRLLGGTGTRLRSFREDGVLAAFPGVTADRCERALQLVLPDGAVVEGLEAIVLALGRRPLGRLLRVYYVPGLRQLLDALYRVVARHRFRIAGRQCPDGACVVHFK

SEQ ID NO: 13452 - protein, 92 aa, Myxococcus xanthus
AESTVQTDLIGPVDFKVLTETGRTEYLTDEGMLGSEHAFLDEVFDGRDMLLRSILNVLHERELKHGRRVTTGRIECVVMTSNRYLSEVLARF

SEQ ID NO: 13453 - protein, 135 aa, Myxococcus xanthus
MGEWAVKDPIVSDLVTTTARAMYNHNTTRGIRFNMFAGAKGTVYSGLLPGQDDDAVSYHSTGGVSGSAGGAYCNPSDWFCNDLTTGTTACEGGRAKWTNHFVKFRDDGESHGHGANGKWEGIVGKVRADMVTNAK

SEQ ID NO: 13454 - protein, 69 aa, Myxococcus xanthus
  unsure (1)..(69): unsure at all Xaa locations
PVALHIFGQXARILRQQTETIRRFGTEAYASTKIDVFGPGILRLLRAAEREKPGAVGDAVHETRLKMRT

SEQ ID NO: 13455 - protein, 156 aa, Myxococcus xanthus
FLAGVAGLMVACGGDSGNRGLPDPASEPPDNGSLPDAGLPTNGTDGGTSPYAGTGPGPPDGGEPDGGPPPQSNLCEPTAGEPRWVLEGEPVSATVTCTTGHAAPDTRFVVDNLPPGARFYAATGTLSWTPGKDQAAVRHLTLREESTGETGTLKVG

SEQ ID NO: 13456 - protein, 78 aa, Myxococcus xanthus
WQREWRVPGLLRFTEYDVAALFLPEELHDTAREFFTWAVREKAGPGYFCPCLDPLWKSDQIAEALAKHASDSVRLKAG

SEQ ID NO: 13457 - protein, 92 aa, Myxococcus xanthus
MAEAFSEEFTRAGSTLSLHVDGPLLGEWDSLRLEQVLVNLLSNAVKYGGGQPVEVSLASEGPSSVLAVKNQGIGISEDGMARLFRKFERSVS

SEQ ID NO: 13458 - protein, 468 aa, Myxococcus xanthus
MSTAALPADFLQAITEGFPADFLTREPGELQEYGRDWTRVYAPAPAAVALPRTTDEVARLLALCHQHHIAVVPSGGRTGLAGGAVAARGELVLSLQRMTRMGPVDLLGNTVRVQAGAVTEAVHHHCAEHGLTWPVDFASKGSSTVGGNIATNAGGVKVIRYGLTRQWVLGLQVVTAQGEVLELNGALEKNNTGTDLRQLFIGSEGTLGVITEATLKLTQLPGKQDVFLFAVPDVAAVLRLFRDARRQNAFSISAYEFFTDRCMARLGRHRKLRPPFETPSECYVLLEAEAKDAAAVEGWLGSLFERELVTDGVQAQGAAQAAELWALREGISESLSATGLPHKNDISLPVAGLEAFCAELEALFSARYPGWEICLFGHIGDGNLHVNVMKPDAMDKAEFLAHTKQADPTMFALVQKHGGSISAEHGVGLLKKDYLGYSRAPAELALLRTLKRALDPRGILNPGKVVDA

SEQ ID NO: 13459 - protein, 245 aa, Myxococcus xanthus
KMARQTPLNAAHRKLGARMVDFAGWDMPVQYSSVIGEHEAVRTGVGLFDVSHMGEVEFSGPGALDTVNALISNDLARVADGQAVYAGLLDERGTFVDDVVAYRFSPERIFICVNSSNREKDVAWMKAHAKGVAPVDRSDDYAQIAVQGPKATGLVQRLTKTDLSKIGTYRFAEGEVAGAKCLISRTGYTGEDGFELYSAAGDAVALWDALLTEGQQDGVKPCGLGARDSLRTEMKYALYGNDIDV

SEQ ID NO: 13460 - protein, 162 aa, Myxococcus xanthus
KIRNRLNPSDPCFSFEFFPPRTDEGEANLLKALEDLATLQPGFVSVTEGAGGSTRAKTVELVLRIKQEAGIEAMAHLTCGGHSPAELRTVLERLSAAKVDNVLVLRGDPPKGQTVFEPAPGGFRYASEMVRFIREEDFNFCLGGACYPEGHVETPSRDDDLR

SEQ ID NO: 13461 - protein, 29 aa, Myxococcus xanthus
VTERIGDTFVKQLLLAFLDDPKIATALQG

SEQ ID NO: 13462 - protein, 313 aa, Myxococcus xanthus
QPDEAVEGLIPRHFRHAFERRARLVDDPRFCRVVNDDGDGLPGLIVDRYDTHFVVQTLTRAMDARHEELTRALVEVAGAGAVLLRNDTLRRKALGLPTQRPHVLYGTPPRWCRLLEMGARFTVDLTYGQGTGYAYDQREVRRFVARMAQGSRVLDASCNVGGLFVHAGVHGARHILAFDADADAADLARENAEANGLLGRVMVETGKPLQVLRAVRDTFDLVLLDTPAVATGEEFVELLRHALRRTRHGGWLMVTGYHPPLPQDGFDDLVATACEGEARIATRLARPGLPPDHPTLAGSHGAEHLHAMALEVS

SEQ ID NO: 13463 - protein, 245 aa, Myxococcus xanthus
LYRLGTVGYYHHAPQMLRLESSSVASYAAVDLTGVYDLNAEWAHREAEVGNPHAGRVVRETLFVRPLDTLIVFDRLESARDDASVAKTFLIHFPEQPVLMGNTWSANSGGQQLRVSTLVPANPVRRIVDERGPVRGDGTYPYPVGQFRGEIETHGQVVSHFLNVVQAKDVADSSALQLTLDETATAYSVTLSHPTRGSAVVRFEKGIESTGGSFGYAASGAVTPAPLRAGVQAMTVTPSGPVWGP

SEQ ID NO: 13464 - protein, 83 aa, Myxococcus xanthus
EFQLTDAQRALQDAARKFAREVVRPKAAHYDETATFPLDLLTTAWELGLLNMAIPAEYGGVGLSHLDQTIVAEELSWGCAGVA

SEQ ID NO: 13465 - protein, 223 aa, Myxococcus xanthus
MKFFIDSADVEEIRKAHAMGCVDGVTTNPSLLAKVGRGLEETIREICSIVDGPISAECVSMEADELIKEGRSLAKIHDNVVVKIPMGVEGMKATKALTAEGIRTNVTLCFSANQALLCAKAGATYVSPFVGRLDDISQDGMELISHILEIYRNYEHFNTQVLVASVRNPVHVLQAARLGADVATLPYNVITQLANHPLTDAGIKKFLADWEKVPKAAKPPAAK

SEQ ID NO: 13466 - protein, 128 aa, Myxococcus xanthus
ARPSRSAAKKPRLRALPGRPAQPPAVLPDAEATLAYARSVLEAEARAILGVTERLGDDFLRAVQLVRDCRGQVIVTGMGKAGHIGQKLSATLASTGIRSVYLHPAEAVHGDLGRVGRGDVILALFNSG

SEQ ID NO: 13467 - protein, 115 aa, Myxococcus xanthus
SRHTRIERYRNIGIMAHIDAGKTTLTERVLFFTGRIHSVGEVHDGATEMDWLPQEKQRGITITSAATTAFWQPRQGMGAGVPHRINVLDTPGHVDFTIEVERSLRVLDGAVAVFD

SEQ ID NO: 13468 - protein, 367 aa, Myxococcus xanthus
MLASPLPSLVSSLLLSQAPSPEPSPDAEAPGLLSRLEVEGGVDVYFGYNTNRPADGASFIPGTGTTARRDNEVSINLASLGVSLAPEPVGFKVLLGFGTGIEVLHQAEPEGPAIGPEVWRHLQQATVSYATGPLTLEAGVYPSHIGLESFQSRLNWNYTRSWMGELSPYYQSGLKSTWAFDDAWSAQLHLLNGWQTIGENNRGKALGTQVAYAGPRLSTALNTFVGEEGDGGLRLFVDAVATWKVTHAFALAATADVGRQARSGQSAALWYAAGFNARVQLSDVVAVAARVEAYRDEDGLITGAVQTLAGGTLTLELKPAEHLVLKMEARRDTCTADVFTGRATGGDGAPMLEDAETLGVLSAVAWF

SEQ ID NO: 13469 - protein, 129 aa, Myxococcus xanthus
MNTKLYVLGAVLGAAPGLLPVVSAPPVASTQESRQDSRGTSRKGRGGPAKGASAPVHPAGVTPPPEAKDALETQGAVPDEGRTRGGGQSKAPRHPCEAITIIQVPCDAEQEACEYTYWHCPEVVNPLRA

SEQ ID NO: 13470 - protein, 139 aa, Myxococcus xanthus
ATLAGGRPQGLEQSRSDVAANLELLRVARRVHLLMVHELQSHGETPRSQDAWRAALQKSGASEVRVYTRAFLPVHPQVAWLLSESAVPDPLVPGQLAVHVTPDGVGFSVRLVGLHQGQPALLKDDLGATLVLRGLYNPD

SEQ ID NO: 13471 - protein, 57 aa, Myxococcus xanthus
MLEYSLLNWILVVALIIGASVKVRWSEDRQSNVIDLFMEAYQIYYDSFYFVLNLPFP

SEQ ID NO: 13472 - protein, 177 aa, Myxococcus xanthus
MRMLVAREGDEIRYDAISRLYIGTGFGQPQEYSDEALQHVLKQQEADAKKAQSAPPEKQAPLPKGVKPTTRSGKESRLMTLAGTVAAVPVEVVMKNTVIKRMWLSREIPLLNLAKIEIPGIGHAMEVAEYGIDAKPRMRIPAPDAPKIKLEYADAILDDLPGDADDGHGHDTSEDTP

SEQ ID NO: 13473 - protein, 151 aa, Myxococcus xanthus
ALRVGFTALRDLWVRPPKKPAPGLVALEGALYSQDLATRDDPGGSQSRTTLVTGELTKVQQQVNAELERRGYAPVRQSALKMGGGTQLTMEHARKGEQVVTTLSPTDEGVTAVVQMWIGSDRPDAVPNDDAVRQSREAYERDQAQKKEGAK

SEQ ID NO: 13474 - protein, 245 aa, Myxococcus xanthus
MAFSGKAALVTGGTRGIGAAIVRHLAKGGADVAFTYANSGDKAATLVGELKALGRRAVAIQADNGDPDAVRGAVDRAASELGRLDILVNNAGIFPSGPFEKVTLEELDRTLAIHVRGVFVASQAALAHMPQGGRIISIGSCFAQRVPYGGVTLYSMSKSALIGLTKGLAREVGERGITVNVIDPGSTDTDMNPATGPAVAAELALMSLKHYAQPEDIAATVGHLASASGRFITGTSIAVDGGFSA

SEQ ID NO: 13475 - protein, 213 aa, Myxococcus xanthus
RVADAKVFQAKAAEAITAAGGAEAKPTTRGGVTTVHVDRDMGGSMGYALKGKEVCAFGAIERGGADLLKESVRLVGKAPARDARLGKVPGVAFVVSGNTVVGLDGTANALQVDGVTTKLQLPVFQARGTSPYAAMNSEGLLSSRASISPMGVFQTVDTMRSTLQVLCPTCPKEQMVSMAKAVTKQLTGHMLVNMDHVQVRGSLRAMSTRFFTV

SEQ ID NO: 13476 - protein, 89 aa, Myxococcus xanthus
MKTKKDLAVDFINTIRTMEPSALNALIVKEAGEELAQFFLNYSANLISKDPSRVLENTSSLMLMGYLIRTYEEKNTQSTQGTFQSYAFA

SEQ ID NO: 13477 - protein, 242 aa, Myxococcus xanthus
MLIDMHAHSHLSKGCELDPRAVLERAALFGLDGVAFTETNTQDGCDELFEIGAKSKLKVFVGLELVTDRGQYLCFFPKPELAPEPVQMWGSNREKPWSAAECLPKVKALGAAIVAARPYDRDSQNPAMDFIRSLGVLSAVEGYNARVKQTSNDLAVEAAAALKLPCVGGSDARGSLDEVGRGATLFKRPVQTQAELVAELQKGDFWPVMAGDLPRLTRPGEAQAARKSGGGGRGGGGKRRRR

SEQ ID NO: 13478 - protein, 61 aa, Myxococcus xanthus
FTGVKVLSATKAKEREELGENVTRWLKSNSDLEIVDRVVCQSSDSEFPCSTLVLFYKHGKS

SEQ ID NO: 13479 - protein, 45 aa, Myxococcus xanthus
MIETIEQGAPKTPFMKPGDTIDIEMTDAEGRSVFGRISQKVVKVP

SEQ ID NO: 13480 - protein, 485 aa, Myxococcus xanthus
EELLRDWVYHSAFALNFGIGDSDGSLVAIWPPLGVAAQPMAGANFADRSYFRDVRSKRKPVVSGVFAGRGSVTGPVMVAVSPLLRQQRFEGFTLVAINLPRMRPVAQERLAPGQRALLVDPDGNVAFDTGATPGPEPQSLKGTALGELLSTLPATGTRTYDTEPQAPPLRRTLEARHLATAPLLQPGWRVLVEHPMRDMDFSVIGTYSALMATLALTLVLAIPITRLLTRMLSRPVEAVSQAAGRMAAGERDVRAFGTRHRAGAIEVEKLGLAFDEMAARLQRHLEEVERVSQAKAAFFSIASHELKTPLATLKLRLQRLRPDTVRQQDLVLMDRQVDRLARLVNQLLDVSELASGRLSLAQVPLELSALVRRVSERRAASAPQHPLKLSLERVDGWWDEPRLEQVVYNLVDNAIRYSPEGGPVEVVLRREGNDALLEVKDRGVGLGPRGGEELFSRALRGSTLSTISRVEGLGVGLYLSREIIT

SEQ ID NO: 13481 - protein, 177 aa, Myxococcus xanthus
CSKLSVREAMEHFGAHRDIMRVLQTLHDVGLGYIRLGQPSPTLSGGEAQRIKLARELARVATGRTLYILDEPTTGLHFEDIRKLLSVLNRLVEAGNSVLVIEHNLDVIKSADWLIDLGPEGGAGGGRILAAGTPEQVAEVEGSHTGRYLGHVLTKARRARVGVRVDDPVPVKKGARG

SEQ ID NO: 13482 - protein, 118 aa, Myxococcus xanthus
MRWKVNNETRQRLLADRADKATSFLQRFKGLMGRRSLEVGQGLHIVPCNSIHTFFMRIPIDVLFLDAQGRIVKQMPALPPWRATSVYFQSRSVLELPAGVLAASGTQEGDVLSFEPVP

SEQ ID NO: 13483 - protein, 242 aa, Myxococcus xanthus
MKRNHNEDNFLMLPEEFLFCVADGMGGHSSGEIASRIAVDELGEFYKLTSKDQDCTWPFKMDKTRNYDENRLATGVKLANARIFEKACSESKYKGMGTTIVTVHFSQSAVYVGHVGDSRVYYFRGGALKQVTEDHSLLNDYLKAKKLSPEEIENFPHKNVIVRALGMKENVQVDVSRVEPQEDDVFLLCSDGLSGMVTDAQMQEILQRTPELEKACSQLIDMANAAGGNDNVTCVLARYHAA

SEQ ID NO: 13484 - protein, 79 aa, Myxococcus xanthus
LEPLARPLHLVLVSPQIPPNTGNVARLCAVTGCRLILVEPLGFSIDDRQLKRAGLDYWDKVFLRLYPTYAAYAADYPDA

SEQ ID NO: 13485 - protein, 113 aa, Myxococcus xanthus
VQHVLAGHVRLEWLGTYSPLAGTVRGASGTWAHAEARLDGTAEGPVYLGRASAVAAGAAVGPGVSLEPGAKVAAGARLSRATVFEDTEVSSGESLSEVLAWGAHRIAAPLKGR

SEQ ID NO: 13486 - protein, 289 aa, Myxococcus xanthus
AQNGKKKIGLIGGGQIGGNLALLAVQKSLGDVVLYDIPAAEGLVKGKALDINQLAAVDGYDCRVKGTTDWKDVAGSDVIIITAGMPRKPGMSREDLLEINLKIMTDVAGNIKQHAPNAFVINVANPLDAMVFALHKIAGLPKHMVAGMAGVLDTSRFKCFVAEALGCSIRDVEALVLGGHGDDMVPLVRHRTVGGVPLTELIAKDKLDAIIKRTREGGPELVGLYKTGSAYFGPAACAIAMAESFLQDRKRVLPAAALLEGQYGINGYFFGVPVQIGAGGVEKIHTVEL

SEQ ID NO: 13487 - protein, 242 aa, Myxococcus xanthus
ALKIKPVSHEGSDRLIRAAIQYAVDHKRKSVTLVHKGNIMKFTEGAFRKWGYELAAREFGDKVYTWDQWEATKAAKGEDAANAEQKAALAAGKILIKDSIADITLQQVLTRPDEFDVIATLNLNGDYLSDALAAQVGGIGIAPGGNINYVTGHAVFEATHGTAPKYADQDKVNPGSVILSGEMMFRHLGWYEAADLMIQGMDRAIASKTVTYDFARLMKQEGQSGVSEVKCSEFGQAIIKNM

SEQ ID NO: 13488 - protein, 116 aa, Myxococcus xanthus
MLAEMVNSGIQPLQNLSVMQHVKQSLNADDKAWSAYWNTRGLEALEAAVQSTMGRFCVGDAVSLADVCLVPQLYGARRFGVDLAPYPTLLRIEAECQALPAFQAAQADRQPDAVPA

SEQ ID NO: 13489 - protein, 57 aa, Myxococcus xanthus
VLSGHALLGGAPNPVTSIQGVAVQAVLEAGIRAQERGGAHGLDLSEAERAGFDAGAA

SEQ ID NO: 13490 - protein, 382 aa, Myxococcus xanthus
MEVLGDPDVSNLSGALERLAELLTDWGPAPGLRFDVKAFSEHVGNELARLSENTEQDAASARRELLVGTVRALGTPAFLEALGAALMSKMSTPGLSAEDRRAIGVGTLLASASKRMGKARPEDIPVLDVVFDVQFREWSARHKELSQKYQALVKGLEEESLSDEAKAALQQARGGDVGALLKYVQEDPELAERIAREAKERAARVEAWLRASTTPAVFSPEEELWLTCALWDPMQALKALPTGTEPSVRRDAVTALMRAVKGALDEDFLVGLLDRLREKAKDAAADDATHTAYMDAAIAFEAEPARMTLAALLTARKEAEGRSPEEMVALADLKALTAWTPEAFEPYRELLLSMGLPAAAARIERCQSWLKEHPVTLRTEQA

SEQ ID NO: 13491 - protein, 156 aa, Myxococcus xanthus
HGKCLTLGIELMLAADITVASEDATFEQIEIDRGIFPFGGGTARWVRTMGWGNAMQYLLTGDALDVREAHRLGLVQRVVSREALMETAMGLAARIASKPPLAIKATIESARTAVLEGERAAAAKLLPAIQQLATTEDVQEALSAHFERRPATFRGR

SEQ ID NO: 13492 - protein, 108 aa, Myxococcus xanthus
PMKYLVYVKDRISGPQPQDPIALNRAVRDWVGARLQDGTFDCAYYVLPKMGLCILNADSHESLLTLLRAWPSFAFQEFEIHMLADVRHGIDNNFERLQKAQGQSESAA

SEQ ID NO: 13493 - protein, 271 aa, Myxococcus xanthus
MPLDNRRAFYERIEANNKPVILTDAMKGWPAAERWTFDYFATKYRDVSVPVEWLQYNAKDTGGVERVGRVRKMSMQEYVDTLKAKGGETPGYLIGNDLFRTLPELHQDVRFDDYAVQRKLTEQLFFMGPRGTFTQLHLDRAHNLHAVMVGRKQWQLYSPKRDAELSPAKLSHPWSVVSAHDLTPHGGKADQLPGGLVPDYDFVLEAGEILYLPYGWWHRVYTVEDAIATNYWWWTWSMLARLGPKLIPSIALSAVGRIRKQQKLGREYREQ

SEQ ID NO: 13494 - protein, 178 aa, Myxococcus xanthus
QHSSTAPAHDVLDDKRNLALLWEHVTSPALSEAEQELVRRNVPWSCRVERTHVERDGARYLIPELLASQRESLVLKPGRDYGGESVLVGGTTSAADWDTAVRKALDVGGWVAQERVHPTPLHTLGPEGTVVPYIAVWGLFVLGETYGGHFLRMCPMRRGTGVVNVAQGAIVGALIELE

SEQ ID NO: 13495 - protein, 146 aa, Myxococcus xanthus
MEDEVVRRRGWLSREEFVDLLGATNLIPGPNSTELAIHIGHRRAGWPGLLVAGACFILPAFFMVAVIAWAYTRFGTLPKVDAVLHGVKAVIIAVVAQALWGLLRTVVRTPLAASVGAAAVAAAFMGGNELLLLLLSGLALLPWRAC

SEQ ID NO: 13496 - protein, 129 aa, Myxococcus xanthus
MQYRVGAWRPTADLALNIQPMAFLERRLNIGSNLAYTSRGISEFNGFVGYQHFVNAWVVPYGRLMMGTATRASRDPGFNVGAEVGTRLALGYFGHVNVAAGMYRASGNYMSVGVGLNGLFVLLMLLHAP

SEQ ID NO: 13497 - protein, 295 aa, Myxococcus xanthus
TNGTLMARWRGQQAVLSPSVSARAAGGLHAWTMDDTPSLLPRLHLFEFTDQTWVPDALRDLVTDYLHTISTRLGIFDAATEILARGLNAAQGPELVDLGSGGRGPLPRLRQLLAEKHGIDARVVLTDKFPNAQAAERARAEGVQYLERSVDALQVPAGLRGMRTLFNALHHFRPDEARAVLEDAQARGVPIAAFETVRRTPPAILSMLLVPLLVLLFTPMVKPLTPLRLLLTYVVPVAPLVIFWDGLVSALRTHQPDELRRMTEALAREGYTWEVGEAKAPGKAAITYVLGRPTR

SEQ ID NO: 13498 - protein, 86 aa, Myxococcus xanthus
YEEEFTKINAVCDRLTKDANAKVVFLVDKNGQLISSAGQTQNIDTTSLASLTAGNVAAMGGLNQADWGERVPQPVPRGGQGLAVHV

SEQ ID NO: 13499 - protein, 139 aa, Myxococcus xanthus
QGLQLEARGELPVSLSVRDATGARAEATGFSAGGALLVPLRRAERWTGTLVLDFEHVQDTVTLEDGTQSRQRLRRMGAALELAWHGGVRTTRQVPVPVVVPGSVRFHVLDGRTGAPLPGARVMVEGEAHVADAQGLVEV

SEQ ID NO: 13500 - protein, 261 aa, Myxococcus xanthus
MPRTVTATRYVTPLREGGSLPAIIEADDAGLYVVKFRGAGQGAKALVAELIAGELARELGLRVPELVLVELDPALGRNEPDSEIRELLKASAGLNLALDYLPASVTFDPVADPAPTAAEASGIVAFDAYITNVDRTPRNPNMLTWHRNLWLIDHGASLYFHHSWDDWEARSQGRFAPIKDHVLLPWATALTEAGKHLGARITREVVERIVGAIPEAWLTSTESPFPTAEAHRAAYTTWLLRRLEAVPAFIEEADRARAQLV

SEQ ID NO: 13501 - protein, 79 aa, Myxococcus xanthus
MIRGHLESFRRVCEGGKGSGPIGQLSQKERWHWVVAPRSTIIQTGPVHSGLCTEPQAALEHLLDTVVRMKRATPSPGGR

SEQ ID NO: 13502 - protein, 54 aa, Myxococcus xanthus
MGPVTIRVEEEVLRAIGMTLAEALQQLGTPLEALSNEDAGPLAMSTLAGGGWKQ

SEQ ID NO: 13503 - protein, 162 aa, Myxococcus xanthus
MVRTAVIFGGLAFALLVPAGLVVQKEHVLRSGTPVLLELAPVDPRSLIQGDYMVLDYAISRERDANPVTTAKDGNMVLRLDANGVGSFVRFDTPDTPLAPGELKLRYRLRKERFRLGAEAFFFQEGHADRYEGARYGELRVADSGSSVLVGLRDAQRQPLGR

SEQ ID NO: 13504 - protein, 197 aa, Myxococcus xanthus
VGGFALDLLILGCAALMYFLFLEQARLRRGTPGELVGPVAFALACAIPGVLLARGMRDVARHLFDTVSALPDAVLTLGLTVLTLYTAWRVLRELALEPTGVAGAAVFAALTLVAVLTPHTPAVITAVGMLVLGFHRRSNVLLGLAVAYLLASGSWYYYDLGLTLLAKSLALMGSGLVFLGLRSFLLRRFPAPASEVR

SEQ ID NO: 13505 - protein, 196 aa, Myxococcus xanthus
APEQARNATDARSDVYSLGIVLFQMLMGRPPFIARDHIELIFAHYKEAPPTFQQVRPDLHIPPEIEAVVRRCLEKDPARRYQTMDELLEGLREASMSAGGNSGIFKRPGGATTTGPYPSPTLFSNVGNNTESGDTLAVDISVEVPRDVKRARQRTLLTGGLGGLVVAGLIAGGAENFMSNKEAAPPAPAPQAEAPA

SEQ ID NO: 13506 - protein, 344 aa, Myxococcus xanthus
GTNRQTWLALTLTVVGLLAGCSPGASPTEEDADGDGVADAADCAPGDANRWRILEGHADDDRDGVGAGALREVCAGEQLPEGWSQQSGDCAPGDATRWREQAGLYPDQDNDGATGEGPVTACVGDTLEGYREQPGAPDCDDNAPRFAASTQLWPDADFDGIGNGEPISHCAGKDLPRGYAAVDGDCAPDDRARSTWRDYTHRDADGDGFTVPEEGRVCSGMTLPAGYALEARGLDCDDTNAAWWQKRTVYADVDGDGFGSGDPVMRCTGRTAPPGYALDSVDCAPEDATRWQWRSYAHRDSDGDGDTVPEQGVTCSGAALPPGYAQWPTGHDCNDRDATVMVTW

SEQ ID NO: 13507 - protein, 207 aa, Myxococcus xanthus
MSSIAHQHGFLPETLWNLPENAVLHAKQRQRHVLYPGDTITLPPRRARDEEARAGRLYRVRRKGIPDMLRLRFLDVDEEPRVGLPFLLRLRTFSGESVRDVRGELDGDGYVQATIPPDADLGELILGTGPDRETYQLELGHVDPLGTFPGLQDRLANLGYFSCCEQDSEHHPVTRQALERLQLAYGLKPTGKLDGASRELLKALHLS

SEQ ID NO: 13508 - protein, 433 aa, Myxococcus xanthus
DGVESKGIHVTAGADISVYGLNRLLQTTDAFLGLPTASLGTDYVVQAYPNVNVVNGSQFSVVATEDATEVTITPASVVGNHAAGVPFHVALNKGQAYQLRSTGAAPSDVSGTLVHATRPVAVFGGHQCANIPDGTTIACDYLVEQLPPTSTWGRRFVTVPLATRLGGDTFRFAAARDGTQVSLNGAVVAQLQRGQVFQTNIQGSASITANEPILVTQYSNGSGFDGIPSDPFMMLVPPFEQFAAQYTVTTPSSGFRSNFANIVVPNDVVAEVMLDGALIPASQFQAIGTSGFSGAQLPVALGAHRLSAPQPFGVMLYGFDAYDSYGYPGGMALAPVAEVSKLTLSPREGVAVVGDLYCVTATVQDAADRPLAGVRVDFASSGVNSALASVNTTADGQAEFCFEGTAPGEDAVTASIGSVTDQVRVTWTKPNAP

SEQ ID NO: 13509 - protein, 260 aa, Myxococcus xanthus
AQEPLHIASEFPAPSVEDWRRLVDKDLKGKPFTALQSQLEGGLSLQPLYTQQDAAVAPPGVAPYVRGTQALGLTEGGWLVCQEYSEPDVTQAAEAIRTDLDRGGWGVWLHLGDTHGVRVPDAEALRRLLAHAPLDTTPVHLEPESDPLAAAQRLLHVAEQTGVSRAALKGSLGVDPLGILARTGSLPMGLDATLSQAAPLVTSLREAAPGLRVLLVSTRAYADAGATSVHELSWAIDTGVAYLRGLERAGVFPDARGALR

SEQ ID NO: 13510 - protein, 141 aa, Myxococcus xanthus
AQRKESHAAEAAAVAWFYIRGHVGVPGNERVDAIAVAYSKGRDAGLYTGPLHGYGVAVHDLPEDMSLPPEKPKEQREAAAKAYSYLSQVGSSVKRHASWAACERRVKGVSGARFKKTKSALDEAKVLEDWGFKGQDVPSED

SEQ ID NO: 13511 - protein, 392 aa, Myxococcus xanthus
MAPFDLLASLAMDIYLPVVPAMPGILNTSPAIVQLTLSLYMAVLGLGQMVFGPVSDRIGRRRVLLTGALLFAVTSFLLAGASDAAMFVGLRLVQAMGASAALVATFATVRDVYAERPESATLYSLFSAMLAFVPALGPIAGALLMQRWGWRAIFITLGVLATAALLQALPRWHETRPAQGLQSRPAFRHILRSATFWTYTLGFSAAMGSFFVFFSTAPRVLIGQAGFSELGFSLAFATAALAMILTTRFAKRFVGSWGLAGSLTRGMGMLLLGAGLLTAGQLLATRSFWTLVAPMWLIAAGIVFSVSVTANGALQAFGDVAGTAVALYFCIQSLIVGVLGTLMVVLLDGDREWPLVGYASLMAGVTLTALQRLQRRQRVLTKPAMAESPDAP

SEQ ID NO: 13512 - protein, 306 aa, Myxococcus xanthus
PYLPHLRHHRHGADPREGIRPAPRAGGGPDGRGAAGRLSAHARSACVAAIQRRRLGCGRMWPPCGPRSMTGPHTPQPEFSAVATKRQSKSTEKASSKKSPAVQAEKLVSIPADVVLAPQVEAPRQPTGKDQSRGRSASSGVKELSWKEFDRAVQQLAGSIQETFEPQVVVGVAHGGVFVGGALAGALGCPFFPVRISRRSRDRGSAAPRTSKSPQLAGEMPAELKGRRVLIVDDVASSGDTLELATALAREAGAKKVATACLMTKPGGFSPDYSALSTASLMVFPWDYEPSTGDARFDEDPDKAGA

SEQ ID NO: 13513 - protein, 123 aa, Myxococcus xanthus
LMYVDNEDGKSLTGIDASTLDVARTYPLGFTPAMAATAPNGDLWVTDTDNGKVIFFAAGTTTRQGELATGAGAHGIAFSADGATSFITNQTAGTLSIVDVASRTVRKTLTVGTQPNGLVFRKN

SEQ ID NO: 13514 - protein, 466 aa, Myxococcus xanthus
LDVATVHQLARRQLVARAIAAHLWRLAAAQPLVLLVDDAHTLDPTALDALELATLSGEGAPLCVVLAGRHRLLGLRPYLGERARDAEQRELPPLPEHDARELLRQWLRPVDLIAEGVLRELVDRCGGSPLRMLETVRALRGAGAIRTRPDGGGYLAADALNGLAPDRPGADERLAERSLSGLPPGMRAPLQIAALLGDDVRLEELTATLAHLETDADLDLSLDPGVAMERLARAGMLEPRGPRRWLFEHTTLREAFTALLPPPLKRRICTAALRALPATPTARRARLAESAGDSLQATALHWNLAESARHAHRLLEAERHYSAALSLVPRTEEAVRLELLSGRGRVRYRLQRIDDAVEDLRAARLLAEAHRDGVREADLLLEEATALDWQDDAMGSTALLEQALHCLKDAVPPELAARHALAQARVFVRREDITGAVPALERAVESARSGDPSPSSRACTSAKQLL

SEQ ID NO: 13515 - protein, 299 aa, Myxococcus xanthus
TFFDSLAADVRFALRTFRRSPGFVAAAVMCLALGIGANAVIFSVVHGVLLRPLPYAEPERLVSLVEVRPQGYGGPVSWPTFWAWRQHSPAFEQMAAFTGGGVTLQAQDAPERLQALRGTADFFTVHGVPPLLGRTFALDEDLPGQAPVAVLSERLWRARFGADPAVLGRSVSLDGLAHTVIGVMPASFDASTDVWLPLVAPPDAAARTRSTVLTLRARLAPGVSLASAEAQLKQVAANSAAAQAESHRDRSARVIPLDESQTQSWRAPLQVLLGAVALVLLIACTNVANLLLARAGTRR

SEQ ID NO: 13516 - protein, 150 aa, Myxococcus xanthus
ALTGCGEDDTYTYDVTLDAETLAQVPTECSELVEPAQGPAVGLDAQQRWTIRRGEMDSMFLEVPDIDFQTPNNAYVINGDGEPDVLMGSVGADGGYQFIHIQTRLDEEHKLSALGNEHAFRIAIHNKDLDDTIQGTVWVRNEHVERDYRA

SEQ ID NO: 13517 - protein, 253 aa, Myxococcus xanthus
AKDFEAAAAATLRRLQAVAQEAVASSRYAARGRVLRGIVHLRPGEAYRSLAALEVGAAEITDASVGTPFFTSATAWRAVVEHRCAVSIDVNVGTVQPHAPNAPVTGDPSLAGFNSHESRQRFLGRHATHVCVLPLRTPGGDIEGMISLEADCLAAMGQDFVWLEAGDRLQLLADVAAPYLARLPQRPVARPEVDEFLPVVGRSMAELLPILRVFALQDETILISGATGAGKSRLARWCHERSNRRGKPFETLD

SEQ ID NO: 13518 - protein, 412 aa, Myxococcus xanthus
ESGPRRLPAVPPARRTQRQEEGLELIASENFVSPAVMEAVGSVLTNKYAEGYPGKRYYGGCEVVDVAENLAIARAKDLFGADAVNVQAHSGSQANMGAFMALMKPGDTMLSLDLNSGGHLTHGATFNFSGKLYKVVHYGLTRDTETIDFAQVESLAKEHKPKVIVVGASAYPRTLDFAKFREIADAVGAAMLVDMAHIAGLVAAGVHPSPVPVADIVTSTTHKTLRGPRGGLVLSREPYAKAINSQIFPGIQGGPLMHVIAGKAVAFKEALSPEFKAYQRQIVANAKALAEALQRAGLRLTSGGTDNHLMLVDLRPKKLTGKVAEEVLDKAGITVNKNMIPFDPEKPMTTSGVRVGTPAITTRGMREAEMAVVGRLIGEALDAAQDDAALARIKGQVKELSQGFPLYASRLK

SEQ ID NO: 13519 - protein, 48 aa, Myxococcus xanthus
KGELVTGLREYHEGDEVRVTYGDGPGGLVAHRVDGMPGPGAEPPRQQE

SEQ ID NO: 13520 - protein, 174 aa, Myxococcus xanthus
EQNAKRMEKVIAALTSAGIARRDIQTRNYSVYPEYAPPLPNQTEPKLKGYRVSNLVSVHVKDLSRVGNLLDQALAAGANRVDSVRFGLSRQEAVQGEALRQTVARARKSAEVLAASLNVKLGAVLDASTVTEPPQLYPARFAMAEVADARAMATPIQPEEQTVQAKVTLIFAIE

SEQ ID NO: 13521 - protein, 115 aa, Myxococcus xanthus
MACLDTSIRGTYVSSVVRFLRTQLPRESADLKERELRARAERGIDAAARHGITARWDVARFIACQLCLGEHFDTDPAHAWPQAVLARPYLTPSRKMDWIERHYLRPRRGRSPTVP

SEQ ID NO: 13522 - protein, 93 aa, Myxococcus xanthus
PEFKVDARGPIEIWTIDGESRRNAISRAMLKELGELVTRVSSSRDVRAVVITGAGDKAFCAGADLKERATMAEDEVRAFLDGLRRTFRAIEKI

SEQ ID NO: 13523 - protein, 290 aa, Myxococcus xanthus
MATPLRSISHRLSRWAPWLPAIAYVALLLPLEALGRGGGGEHYSRPSSGNGGGRGGGDGDGVALWVVYQLFSLVFRYPKVMLPLLCIGGIVYWLYRRNLHPDATTRKALEQREAYQRTQVSQRDVQGWVNALKLKDPAFELEPMLDKTKWLFMELQQAWFLRDMTPVRPFLSDATFQRFGVQLELMRAQGVRDAITDFEVLDLQLIGLDQSQWFDSIHVRVHARMRDTDVPVSFSDAQATEAARKVPSEAFTEVWTFVRKPGAQTRIGADLFQGKCPNCGAPFNGGADNR

SEQ ID NO: 13524 - protein, 331 aa, Myxococcus xanthus
AYSDRPVPLDGSVAEVLAGAVGDASARCADLGLVTPPSLDGDAKALSLVTSIDLLVGARDVEAWSRGEYELVMGDVHDTALVWGWALQFHEARGRVESAMVRALGALSRPVPLVTVLASRRTGLLPSEFPGPVVELGGVSARASAWRLPLDDLFVESDGTRARLVSKRLGSEVCLYNGELDSLVHTAFSLPRIRPLRVSLGEHTPRLTLGGVVVQREQWRLSQAEREALLAGRDDSARLRAAVSVWSERGMPDCVFAKFKDERKPVLVDVRSPPLLRVFLNLLEQKEEVILSEMLPSPDQLWLRSASGGRHTVELRCTLMWGSESAAGARE

SEQ ID NO: 13525 - protein, 366 aa, Myxococcus xanthus
MRLLVLPPHRDVTLVPEAPEGWQCVDVARDFCRRVFAHDAVEAAAAARERAPATAQTMRELLLLRAAQSLHARADSSVSTRLRALGAVLSAISGPPDGVHLRLDDVELEGGTTERSADVLRSLDQLASYREDLTLAAARFAEAERVRLWLERDLQLPAAAWLARACPEQVPLEVAGPFAWAHRAVLAQLSVFQRANFVDAAPLRWRVSPGLDEAVSTSRVWLSEALDVRATPPDTVRALTGGAEAWAGHVSLDSLLHPDRAGGRAAARVARPWGFFAPWTATPGSTPWVRASPERRWLRALAGFGTRGSTSWRSGGSARPASTKRTSTRRSLCWTRSRCSTRSRECVPSTGRGCLPKVAARCCGQT

SEQ ID NO: 13526 - protein, 48 aa, Myxococcus xanthus
MDARLAPKLAGLVRPMEVASVLGAVPQAQREKLVDTLVARSVLTRVNG

SEQ ID NO: 13527 - protein, 202 aa, Myxococcus xanthus
SEPWTLGEVFVLRHAGFPFDWLESLGMSQAVLDDVARLLEAEDALVDAVRAEKGASGAQALLDALSQGREPRIDARLGPSCQDAWARYQERRESVQAGYTAERKTLRRQLRERAADPAIQEAVFLSSPAMFDNVWVRYLRGGERPDTSDACRVERQVYTNLQSFCTKNETTSFFGPISYGERTTEDGYDVRTVPSAQHEAAV

SEQ ID NO: 13528 - protein, 406 aa, Myxococcus xanthus
ALMLFASAGMSLLAMSNELITLFVNIEVLSLSTYALTSYLRRGTRPSEAGFKYFILGAFSSAVLLYGAALLYGATGTTHLTAMAGPLSTAMSSQPGLVYAGIILVITGFAFKVAAVPFHMWTPDVYEGAPTPVTALMSVGVKAAAFAAMVRVFFMVGKGVDPQMLLGLFSVLAFLTMVAGNLLAIPQRNVKRMLAYSSIAHAGYLLVGVAALFVTGPGEQFRLLGASALTGGTPLGLARAEALRGILYYLLAYTFSAVGAFAIVSVLERREDEEKGTAWDLERFSGLAQRKPGWAFAMAAFMLSLGGIPPTIGFMSKLLIFQAAVDAGLIGLTIVGVLSSAVGIYYYLRVVVYMFMRPVPEGAQALEKSWSTELALVLSTAAVVILGIIPGPIMGWLEQASSIFGQ

SEQ ID NO: 13529 - protein, 82 aa, Myxococcus xanthus
CALQLGMMDLRPGPSLFPFFAVSPGHARTLLEEAFGQLEEGASSLNVTVAEDAPLVHLFRDAGAQTRLETLELRGLLVDAAP

SEQ ID NO: 13530 - protein, 225 aa, Myxococcus xanthus
GAKRYLFTFGLAAGLVSALLLGGMLRAVSGAPLPNATWAVVLLATPALYLAGGYLAWFRWAAQRRQVRRQVMARLAEGDLTTTVGPRYEGHEDVRRLILSLRRALAQVQRVTANLHRTSTDVSGQARMLLEAARRQGGAVERTLEAVSGMGGSLQVAGKRVHQLEVFAVDTTGALLEMTERLEQVVDSLAQVNTFAHNTTSLMQAMAERMANIAASGDELGRLRA

SEQ ID NO: 13531 - protein, 191 aa, Myxococcus xanthus
MEALEVGDSRFTVAAPGERLRAPPELFADGLPVEGARGALSLEPPLDVPARPAGLTPWNAAAARALAAEVHAAFPEKTPGGADWSEDGEGEAGGCLAHALRFAAGARARGVKVALVHGLLVVDGGPARPHAWVRVALSKGGTLDLDPTSLDEVSPQTHLPIALAEAQGPALEAGARWLSLLRGAHRVVRRP

SEQ ID NO: 13532 - protein, 545 aa, Myxococcus xanthus
MRIPRTDARRKLLGALLCTFSVAACGPAQEGEPAGSGSTEQPVVYGNDDRMDVYAHPDATLRQYAMQASAVMVDPYEIDDSDPNNVVFDSPTLGEYVNLCAGQRFIDDPSPGYCSGTLIDDDLLLTAGHCVETAADCRDFKWAFNFYRPDANSVQTMTTQDIFSCKEIVVRRDNTSSGRTLDYAIIRLDRSAAPRFTPAPIRPGNAAMAVGANVAVIGSGSGIPLKIDSGGSVRNGRASTLDYFVATTDTFGGNSGSAVYDMSSHTIAGILVRGTTDYVYQGSCRVVNQCAETGCSGEDITYIRPAIEAFCATNTSVRLCNTTPPPPTSFDFTASNTQNATVNTTRHTVELTAGQSITVGTCGLTGASATGDTWLRVNGPSGIEVASNDDGCATGRGSNVTFTAGAAGNYEIIAGCYGNTSCSGTVAWTIGTATPPANSGTFNYSSVNSDSARQNTTNENVTLTAGQSLSFGTCNVTGASGTGDSFIRLYNAAGTQVKFNDDGAGCGSLSHATYTVPAGAGGTYQIRAGCYGNTSCSGTVGWTVQ

SEQ ID NO: 13533 - protein, 735 aa, Myxococcus xanthus
APRRGLEKRGSLPYKGARMKRFRLPRRLTLPALLMAAACGESDSIPIRTCDVTLTYAPQQSVAGTVRVMGEWNNFAALSQPMTDRGDGVFTLRLDGLEPRAYGYRFVVGDKQEMDPENPYSRWVRAEEYSRVIVPDCRQPVLELNRFTVTPEGSLDVAVSYLDGTDKAGPAVDGMVLSLDGTPRPDAYDAASGRFILNVQGLEQGKHHVKVVAKDSQGREAESLYLPFWVEPERFRWDSGLMYFAFTDRFHNGRLENDAPVADVDPIANYLGGDFAGITQKLEEGYFDALGIRTLWISPVDQNPEGRFIGTGGKYYTGYHGYWPSKPRETQHRFGSLEELRTLTAAAHKRGIRVIADLVLNHVHEEHPYWANHARDGWFNTAASCVCGTQDCDWEAKRLTCKFTDYLPDFNWRSSDFVDQFAADTLWWLEQADFDGFRMDAVKHMEQVAGRTLRGKLKEITAMTGTEFYLVGETYVFTDGRPQIARYISPRELDGQFDFPLYWPVREAFADGKGLQRVDDAVRANEEAYVPGTLNSPFLGNHDVARFISQAAGQLHEGGSDPFGPNRPSTVVTDPAALEKMKYGFAFVLTQPGVPLVYYGDEVGLPGAADPDNRRFMRFGSTLAPLERELLDFVRKLGQARRAHEALQTGARRTLRVENDLYVFQRDLPNGKGALVAINRSAVERSLVLELMGSLAASSGTYVDIFSGQTLQLTGTETVLVVPPRGVAVYVPHQE

SEQ ID NO: 13534 - protein, 425 aa, Myxococcus xanthus
PAADEGGLRPRLREAHVRVALWALTLLLVACKVEPRPRPPGVLFVSVEQQSTWVRNFNPLFAGAGARWPTRAGVYECLEIFSPAVGQWTPWLATGHAWSEDRRTLRFTLRPGVRWSDGRPFTADDVAFTFQLLEQHAALDAGGVWRFVEDVRAEDAHTVAFQFSRVYIPGFAELAQQPIVPRHVWEKVADPVTFTNPQPVATGPFTEVTVFRNQVYELGRNPYYWQPGKPAVSALRFLAFPTNDQANLALVEGEVDWAGNFVPAVDRTFVARDPAHHGRWFPLYGSTVFLYPNTTLPPLDDVRVRKALSMALDRERLVEIAMYGYTRPADATALNDAYATWRDADAAQGAWVKHDLEAAKRLLDEAGLKEGPDGLRRKADGQPLALDIEVVGGWSDWVRAGQVVARDLRKLGVQAQLRTYEFGAW

SEQ ID NO: 13535 - protein, 237 aa, Myxococcus xanthus
AKGVLGNDPFKRGAAPRPTESSTPGGEEKAAAAETVTKKKPGPGGTAPAKAGGKAAAAKSRKHEGKKTSGKAKGGKAAGGMKGAAAAARPPAQASGPRAPAPQAERTEAADAALSPREPAPSQQARTPQAPQTSAHGADDAVRPLREPAVSAPLTLDSQAPGPVNDAGVPTPKQRDVDLALAEALAADVAEAAATAAVDAALGAEAGPDAEVERLMATEFATELAEAAVEEALERGA

SEQ ID NO: 13536 - protein, 313 aa, Myxococcus xanthus
RDGCASRVTGASGDYGRLLLSRLDQDPDVESILVLDVVRPEGDKVEFHRVDLTRYDAESELTDALTERPVDALYHLAFLFGPIRNGSLAHELEVIGTMNVLTAAGRSRLPRLVVPSLTAVYGARGNNPAMLREDSALQGCPHSRFVTDKVEVEGQVRAFRERHPEMRVLVLRFAPVLGPSVDNPATRFLKNPVVPTLMGFDPLWQGLHEDDAARALHLALRADASGEFNIVGRGVMPISGLIQQAGARPLPLPGPLFRAGLHTLDAVGAGTLPVALLDYIHYSWVADGERAESALGFIPLHHVRDAAAALKRS

SEQ ID NO: 13537 - protein, 551 aa, Myxococcus xanthus
SAGINTYKTDLREIFFTLFEQFGFGQVAGQAPFDAWGPDEAKAVLSETYRFAREVLGPLNSVGDREGCRVENGAVFTPTGFKDAWKKLYEQGFKTVGVSPEHGGQGSPMMLQVTVEELLSGANSAFNMYPGLAFGAAEVVAECGTPEQQKQFVERMLNGTWGGTMCLTEPHAGSDVGAAKSTARRNGDGTYNIRGTKIFISGGDHDMGDNIIHLVLARIDGASPGTKGLSLFIVPKLRINADGSSGQPNDVGVGSIEHKMGINGSATCVINFGESDNCVGELVGTVEHVGMSQMFKMMNGARIAVGIQGIGLASAAYYNALDYAKDRKQGSHFTKWKDPTAPRAAIIEHPDVRRMLLDIKAHVEGIRSLIIKLAMHLDKARQLAGKDDDAATYHKGQVELLTPLVKAYSSEQAFRLCAQAIQIYGGAGYIQDYPVEQYTRDSKIFSIYEGTTHIQAMDLVGRKMGQAGGMHFQQFMGDVGSFIEAHREHAVYGEAVKSLAAAQEALMASAMVVFGWSQDGSKFPLIPLSANRFLDMMSQFARGWLLPLEHI

SEQ ID NO: 13538 - protein, 96 aa, Myxococcus xanthus
MARLYREDAVRGTDRLMRVIYDGLPVLHDPLTTLLTPLLQSVSEARMRAGYMRRVELGSLTPHEDGRPVRVLEVGVGSGANLPLLRDGLPPGLDGL

SEQ ID NO: 13539 - protein, 379 aa, Myxococcus xanthus
RMRCVAGRLLMRLLDAFIYAHQALPVLWSGLRALNLCEPAGASPELARGYTSMAVVAGTLPIRSVAETWSRRALEVAERVGNPADLAFVLCRNAVYGAYVARWAEAEAWLERAMGIVDSVGDVRLAEECRALLTVVSCYQGKFARGLPLMEWLEHSARRRGALQTEHWALHYQAHIHLRLGDYAKARAALTQTLAWTEAQGGQTDRIIVEGTLALLRLREGDAEGARAAADQALARMSSGKPVAHFVYFGVMTVAEVLLTLLERGTDASLVASAKAARREAEVFAKVFPFGEAAARLWRGQEAWLDNDATRAFEAWRRCVAVASRKGQSFEEAHARVALARHLPLEDPARWVHQQRAVELFTRLGMRDEQARAEALARS

SEQ ID NO: 13540 - protein, 446 aa, Myxococcus xanthus
SIHHLAVDAVSWRVLLMDLETACHQLGQGQPVALPPKTTSFQAWARRLDSFAASTELEHEADYWLSQGEDTAPLPVDTTDGDNTLASARTLTVALDAEETRLLLQEVPTAWRARIDEVLLTALAQALSTWTGQRRLRVQLEGHGREDLFDGVDLSRTVGWFTSAYPVTLELPRDGSVGDELRAVRDSLRQVPRKGLGYGLVRYLRQDEQGTRLRAQPEAPVAFNYLGQLDSALPTSSLLAPADEPFGAQQGALGQRRQVLEVNAHVLGGKLEVSFTYSEALHQRTTVGALAQGYVHALRALVDQRRGEDAARFSPVDFPLAKVTQATLNGLMQSYPEMEDLYPLSPMQQGMLFHAMLDPDSGMYFERAAWTLDTDLDREALREAWQQVMARYPILRTSFVGEELEAPLQLVNRRSVLPWDEQDWIHLSEPEQQTRLSAWMDPGRAP

SEQ ID NO: 13541 - protein, 274 aa, Myxococcus xanthus
MFKNCIARAAILATTAVLATGCGSDVPEESLEADALGTRSDALESIQFWHDFRAYSGVSDECNGFNVSEGRGLGQWTSQVRLDTDSRPQGCWQKFGIYDPYGELSGLSLTVSFFGQGNPTSNGQCDNPGTYVVPVGPVLNWAGPWGIDTTDAYGGCVQTFSISGRSDVALDVRFDADRHNGQCLNAGMHTVTSSNAVTLTLDMDNRFGGCYQTFRLRKMTCGDNICEAGETCPADCNQCGDGICNGSENRFTCPEDCSPVIPGECAIFCPPEFP

SEQ ID NO: 13542 - protein, 100 aa, Myxococcus xanthus
FTSSAIPAEAAQLVGQRSINSVPYVCDIVKLIVKDHSGADFESITPEARLIEDLGMDYLDHIEFVMDLEDTFVIEIPDEEAEKIITVGDACDYVIKNLPD

SEQ ID NO: 13543 - protein, 573 aa, Myxococcus xanthus
MSFIGWSQILLFFALVLAVTKPLGAYLFRVLEGDTRPLPRVLGPLERLLLRLCGAADRHEQTWVAYASSLLAFSLFSVLIVYGLQRVQHLLPLNPQGLGAVGPELAFNTAVSFTANTNWQSYAGESTLSYLTQMVALAWQNFVSAAAGIGVALALARGFTRRPGPDGQKTLGNFWVDVMNATLYVLLPLSLLYALFLVSQGVLQNFAPYAQVVTLEGASQTLAQGPVASQEAIKTLGTNGGGFFNANSAHPFENPTPFTNLVQMLSIFAIPAALTYTYGKMAGDTRQGWALLSAMSVLFLVGVAAVYAAESQANPALSVAGQVAQAGNMEGKEVRYGIAASSLFAAVTTAASCGAVNAMHDSFTPLGGLVPMVNMQLGEVVFGGVGAGLYGILVMVVLSVFIAGLMVGRTPEYLGKKIEAREMKLAMLYVLVFPLFTLGFSGLAAVLPQGVSSLNNAGPHGLSEILYAYTSGTANNGSAFAGLNANTPFWNITLGVAMLGGRFLMMVPALAIAGSMVGKKVVPAGPGTFPTHGVLFTGLLVSVIVIVGALTFFPALSLSPIVEHFLAGAGKRY

SEQ ID NO: 13544 - protein, 125 aa, Myxococcus xanthus
MPFQITVHSQDRILEVVYPPQVTTADLAEYLADVKKAINDLAGEWSALVDQSQLRVMPSDVVTAMASLNAFAQLHGMKRSARVVSDAPSGLQAWRMTKRAMLSIPTRTFETRGEALQWLRDPDAD

SEQ ID NO: 13545 - protein, 612 aa, Myxococcus xanthus
PSRDGAPPRGGELLVALDGDRRQLARNPSEPPRVGSLPEHLAYVIYTSGSTGTPKGVLVPHQGLCNTLGTIIRAHDVRPGRRVLQAAALGFDASVLEVLSTLVAGAELHLAPRESLLPGAPLRGLLESRGITTVTLTPSSLSQLEPEGLPLLETVISAGEACSPELARRWKPGRRLLNGYGPTEASVCATLSTELDVERPDIGRPVANMRAYVLDGRGQPVPPGVPGELYLGGPGVARGYLGRPELTAERFVPDAFSGEAGARLYRTGDRVRFLADGRLEYLGRTDFQVKLRGFRIELGEVEAVLRQYPDVRDAVALVREDTQGARRLVGYVVQAAELDASALRSFMKERLPDHLVPAAFVALDALPLSPSGKVDRAALPAPDAARGGNAKVFTEPRTEAEKALAALWTQVLGVERVSLHDNFFELGGDSILGIQIVSRAKALGLELEPAMLFERQTLVELAAAAGTAKAGTAEQGLVEGPVPLTPMQRIFFDEWALPQPHHYNLAAVLEVRRPVDAALLEEALRALVSHHDALRLRFTRAPEGWRQSIAGVPERVPVRRVDLSSVLEAEQGAALESVGAEVHQSLDLGEGKLMRPALFERGAGRSSRRPAL

SEQ ID NO: 13546 - protein, 154 aa, Myxococcus xanthus
EPEAAYTKLGNLFTGCMKGRTMYVVPYAMGPIGSPFTKLGVELTDSIYVVLNMRIMARMGKQALDMLGDSDDFNRGLHSTGDVDPDRRYICHFPQDNTIWSFGSGYGGNVLLGKKCLALRIGSYLGREEGWMAEHMLILGVTSPKGETTYVAAV

SEQ ID NO: 13547 - protein, 596 aa, Myxococcus xanthus
TIAIVLGVVVVALVLFSFDTLPIEVSSLVVVCLLALTGVLTPVQAFEGFSNDTVIFIFTLLAMTQGLASTGVVQLVGQRLAFFARFGHQTFVMAMMVAVAAFSSVISNTVTTAAFLPVAIGAAQRAKVPKSKVLLPLAYASMLGGMVFLYGTSTNLVMSAAMQRLGMPGIGVAELAPVGLPLAIVGILGVVLLAPWLLPAREGRGAMEDWTLRDYLTEAVLPPDSRYVGKELGDISEGLGLRVIGIIRDGEALSAVPGYRLRGDERLLIEGNREAILRVKDLRGIQIRPDVRLSDEELHDKDSILIEASVPPDSPLVGRSLKETLFVERYGLVALALHRKPAIQRVTKLQLLGRTFGERSLSMLPLSVGDVLLLRGARDRVDELARAGNLTVLSGHEYQPPRYGKALLAVVLFLGALAAGSLDVVPLSVAGLTGMLLMIATGCVDPRTAFRVDWRVVLLIGSMMALGLAMEVSGAGAFVGDRVAALGALGGPRMVMVVLMVLTIVLSAPMSNQAAALVVLPVAINAAQQLGVDARPFAMAVTLAASCSFITPLEPSCVLVYGPGHYRFTDFFRLGTPLTAVLVVLLTVAVPWAWPL

SEQ ID NO: 13548 - protein, 139 aa, Myxococcus xanthus
MDIATQVASRATCDRKHVGAVIVRGRTILSTGYNGAIRGLPHCDDVGHMMENGHCVATVHAEANAIIQAATNGVSIDGATIYTTASPCWPCFKLIANAGLVRIVFGEFYRDPRIFEYAARLKLDLVGLGDAARPPASGV

SEQ ID NO: 13549 - protein, 245 aa, Myxococcus xanthus
RMTRKEQVRRILPHNVRLQLASQGRVLSTASGVVVGAERDANGATVAWVVTNAHAVAMDGMEAPELRVLVDRRAESLEHRGEVVAMGEVPDLDLALVRVPGLDLPAVELADDAELELGEDVVVAASPFGRALSLSGGMLSQVEWDKASQRPKMVKTDAPIGYGASGGGIFSLTTGRLLAIVEGYRTAKVDFEVQEENYSFDVPMPGETFAAPSAKVRHFLQAKGFGRLLARKPATEGGLAHSAGR

SEQ ID NO: 13550 - protein, 87 aa, Myxococcus xanthus
PFLTALAMSGCADKDPNSFPVLEKDAVFVVNGGSNSLSVIDVERQEVTSTLRLKDMTYPHHISLSPDRSLLVVAVPGMDLSGGHGGG

SEQ ID NO: 13551 - protein, 310 aa, Myxococcus xanthus
WPERASQLDITVLITGETGTGKELVARPIHHDGPRKDRPFIAVNCGALPSELIESELFGHARGAFTGAVETKAGLFEAASGGTIFLDEIGELPLSVQVKLNRTLQDKEVRRVGDAVARCIDARVITATHRDLKAEVTAGRFREDLYYRLNVFPVHLPSLRERREDIPLLAMHFVQKAAKTYRQPVDGLEPDALRALTGYTWPGNVRQLENAIERAVAITTGSRVGPDALPPEVTGGQQGALPVDHLVKMPFREAVDLARDRASRDYLIALLREFGGNVTRAAERAGMERESLHRLLKRFGLRSDDFKESP

SEQ ID NO: 13552 - protein, 147 aa, Myxococcus xanthus
YVPEDVLADLREKVPAATSVSLLPAHDLYVSSHGGPAWVTDPKHHGIEVPTWGSAKGGTLGEAAHIFVRPVLDAERLVGLWEFDPKADDVVFHTFEPLAPKRRKAVQALAEDTATFLREDFSLARSFSLDNEDSVQKRADFVKSLGE

SEQ ID NO: 13553 - protein, 54 aa, Myxococcus xanthus
MPVAGSVTLDAVNDDLAAGRFVYRYRDGSELTCTFNVPVAGAGRWLFGRGLRRR

SEQ ID NO: 13554 - protein, 44 aa, Myxococcus xanthus
MSICAGTLESPTGIREKAHIYLGSKGDYYDITPGLVEYDTFPGK

SEQ ID NO: 13555 - protein, 142 aa, Myxococcus xanthus
KADVAKGFVLDGFPRTPGQADALDKMLGRLGKQLSAVISLEVPHAKLVERGSGRRVCPVDGSVYHVYQSPPKRAGYCDKCNTGLVQRPDDMPEVIEKRLQKYDSETAPLKAFYEKKGLLKSVDGVGTPEGIYEEIKAAAGKA

SEQ ID NO: 13556 - protein, 159 aa, Myxococcus xanthus
MNNKNPSSSAATLPEGPRLSLALVTKDAPAALDFYTRAFGAREKYRLTEPSGRVGHAEMDLGGVTLMLADEYPEYDILSPQSRGGTTCSLNLRVDDVDAAAQRAIDAGATLERPIQDEFYGERSAHLRDPFGHRWALNARIENVSPEEMQRRFTRMLQG

SEQ ID NO: 13557 - protein, 42 aa, Myxococcus xanthus
MQELRESGVTTGGPDGYSAQDRQQFAGALDRELTRLVKTEPK

SEQ ID NO: 13558 - protein, 60 aa, Myxococcus xanthus
LSAGVTPGQDVLWVSEGGAQPPEELASRFTTVEGPVEFFGDFRGRRLHTFQVWRLRARKP

SEQ ID NO: 13559 - protein, 343 aa, Myxococcus xanthus
MNRSRRLVVEALGCGLLVVALEGAHHGAEHLGVSATDGRLFMSLGAGAVLACLAYVLQPLTGAHFNPALTFADALEDGTPWRDVPLYVLAQVGGAVAGRWVAHVMCHEPMLVGASEPTASLAQFVTELVSTFGLLVMVRGCVRNRPTAIPLVVAGYLAATVWFTDSRALANPALILARAFSTRPSAMHSMDVESIIAAQLLGAALAVLLFRWLQRTPRMKQARVWPIVFECSRPEVAQQAVGIFNHLASPQRARATTQWHAGDDTDLPPLIVRLVLAGEPTEPSHPDGVSWQLRVPADAVTTEEPRLRAELRAPIRQLLRNRGWLRLHAVGDAAREGPSGPRP

SEQ ID NO: 13560 - protein, 71 aa, Myxococcus xanthus
ARGWLQHGEVVHYPTHADLDEEHAEGFYRQLDAPYETDAGAAEIEQGLTLGGHLFLGLYDALFRARHRRLD

SEQ ID NO: 13561 - protein, 328 aa, Myxococcus xanthus
ALTDAIHLARQVDLRRCEQEEAPRLLQESVPALRNAVLAGAQAMGSVRAHYEEDEDPPGFVANTRRQRIADLAFMARLDLGERLERLGMMTATEAPWNIIAMCGSARRRLFKCAAAVERALCAHEGLTPRLEGLLTQELERSLKVRQAYVLFRRGLLTRAEPTAPWLAPVLRRAAVCFSELTGREIYEDLRIEDRTELRRLQAAVLDWLRGQDGHDAVSGRRLWQDVAVFAELLTQVNLRPELREHDQALLGSLLLSLELDPSLSAERLAELAHPLLGVDDVLDDCIENPTAVERAEWRETLERLATGLLGEHGAVPLPEQEALAAPR

SEQ ID NO: 13562 - protein, 413 aa, Myxococcus xanthus
ETRRLFAAEPPVVRRELRTGASGTKSGVPQTRQRTGALSGKVVYLSPGHGFTRSAPLNRWATQRPNTWAVVEDLISAEVLNQYLLPMLTGAGATVVPLREPDLNGHMSIVDDGQAGYSEDGDVFESSAQPGWGTPPTPMGNAVEPFSLGTTRVMASARSATASATWTPEIPAEGSYHVYVSYAADPTRAPDAHYVVKHAGGESHFRVNQRRHGGTWVLLGRFYFKAGQHPDSGAVVALNDTAEGGTLSLDAVRFGGGSGVIGDAAMAPLARPRYEESARYHVQFSGAPFTVYAPTGANALTNERNADVTARPRFAAWLHEEGEDAVYVAWHTNASTTGNVSGTEAYVYGPNPVDGTLNFTGFPGSDVLARALLDELAQDMRREVDPSWRVRNLRSANLGEVNPTHNNDMPSVL

SEQ ID NO: 13563 - protein, 590 aa, Myxococcus xanthus
PCVPLSLPVLLVATFLAAAPSSSEASSDAPAQGLASAIDNYEDALIDEALARHGRVLEPAPEGKILEEVLVATEDVVAEIDPFPDFLNIFHARTRDDVVRREVLLQVGAPYSDVLAQESARNLRGLRLFSMVRLVAVKGRTPDSVALMAVTKDIWSLRLNSDFAAVGSLLQYLKLQGTEQNFLGRGKRIAVDFVLRQDTLSLGQSYTDPRVLGSRWSLSESIAVIQGRETGKTEGSRGNLAVSRPLYSLSTPWSASASVSWNVETNRVYRGASIWQLPFPGGPAVPYVYRTEEVVGGLSYTRSMGTRYKWNVGGTVGAYHYAYGAPLASGLSPEQSEWFNRNYLPRAEDAGYVGLSLRAFDARYEVLRDVDSYVLAEDFQMGHWVAATLRYAPPVFGEQSHFVEGGLALRYRLRLGDSLTTASLSGAVRRPLGPGGAWTNRRWAAELIEVSPKVLGGRFVARGLLDVNIDDLFDRIHLLGGANGLRGAGADAYSGRRLLLFNLEYRSRPIVVKTVHLGGVLFWDSGSAFNDRPAMVHTVGMGLRLLFPQFNVLPFRVDFGYVLNDARPPVGSRFSFAGGQMTDVRPNFMV

SEQ ID NO: 13564 - protein, 513 aa, Myxococcus xanthus
MLRGERALRVRQVIATGQGIEGGDPLFDVRPVWMASPQTVAQIFPRRPIFDVVIFDESSQCRLEEALPVLTRAHRVVIAGDPKQLPPTRFFESAVVQNAEQEAESEQGLFEEQQSEVEDLLSAALNLDIDQCYLDVHYRSQNADLIAFSNDHFYDKRLQAIPAHPSHSVPHAPLRLLPVGGTYEKRTNLVEARAVGSLVKELLSRPQPPSIGIACFNLTQRDTINDVLDEMAASDASFAARLAEARVRRGSGSFEGLFVKNLENVQGDERDHLIISTTYGPDRHGRFYRRFGPLGSAGGGRRLNVLVTRAREQIHLVTSIPRESYQSAPPVEAGRQPNGGWLLFAYLRFAEALESAYAQDAQREPEDTVSEASRPAETAEVFVRPTDAGSAFAQALAGHLATQHRVSSEVHWGNDGFCVDVALRHPTRPGDVTVGVLCDGTRYPKAADRVEWDLFRTGVLEGQGWQLVRMWTPSFFRDPEGATTQVLQAAGDKLMREPSASPQAAMSARGVVH

SEQ ID NO: 13565 - protein, 63 aa, Myxococcus xanthus
AREGVGHVWFVDPQARTLEVFRLSGGRWLELGTWSDDERVRAEPFEAVELELGVLWLPEANAK

SEQ ID NO: 13566 - protein, 59 aa, Myxococcus xanthus
MEPLPNAMFRVVLDNGHKVLAHISGKMRMHFIRILPGDKVKVELSPYDLTRGRITYRAK

SEQ ID NO: 13567 - protein, 226 aa, Myxococcus xanthus
LYRAAHERWVRPRFKPKASGREFDVAPTEDNPVIIAGFGRVGQVVGRLLRAKRIGFTAIDASPEQIDFMKRFGSQVFYGDASRLDLLRAARADKAKVFVLAIDDIEASLRTARAVQQHFPHLTLFARARNRVHAYELLDMGIERVMRETFLDSLEMGAGVLQELGLTYSESRRAQERMMEHDERLLRETARFHRDEQKLVELADKARKELESLFEKDEAEHPDRTA

SEQ ID NO: 13568 - protein, 182 aa, Myxococcus xanthus
ARLLGGAARLQDDVRRVCPELLELSRHLHFEQPVSEQPSVRYEHAWPEAETCLDVRVRPVEGGLLVHCRDITEERKGREALRRNGEVFRAILEGTTDAVYTKDLDGRFTMMNAAGAKAVGYRAEDVVGRTDLELFDPAVARTNAANDREVFAFGRTVTYEDAQPGVDGPRVWLSTKGVLRDV

SEQ ID NO: 13569 - protein, 413 aa, Myxococcus xanthus
MKKRLGDILLERGVVDALQLHSALAYQRKWGVPLGQVVVDQRFSTTQQVLEALAFQAGMQTVDLDVQPPDASLTWLIPERVAEAHRVVPLKLEGQGGRDSVLVVAIAAPASLASLDAVKSVSGKPRVVAKLASDASIRRAIGQLYRGETGEAVPRRPGMESFSLPEADESMPMVLGGSMAELTNMEAPGGEDGLPLLSSLEEVVVQAQAVPAEMRRLVQAIRAMPEPLAAVAQPLPLEAGRPEQAATPATTEGLHLTHVSRPGSTKAPFSARAMQRTAGTRNHVPSALPVLTAAQPVPMAQVLVYGWGEEATTGLVRVMSQAGLRAQVASTEELLAANAAQVVVAPLPAMESLPRPVHAQVLVAGKMPEQDLPRAQAVGARGFLAAPVDPDLLLRAVRRLARPAGDADLKRAS

SEQ ID NO: 13570 - protein, 89 aa, Myxococcus xanthus
MLDLLVDGDRPVNSIAENFEMSRPAVSQHLRVLLDAGLVTEQRHGRERRYRLVPERLEPVRDWIAHYQRFWDDYFSRLRWHLEKGDKQQ

SEQ ID NO: 13571 - protein, 66 aa, Myxococcus xanthus
CLGEWVELLREKAGGVPGLGGVGEGLAGLVLEPASLQPYLHFRRGRYTRNLIYRDARLEVLLNSLE

SEQ ID NO: 13572 - protein, 121 aa, Myxococcus xanthus
TLRRLGGGLLGAVLLLTSVSGCTRRVPPVDDNPAPVPEPTATTTVYVAERIRTLDPAKPQVQALAVKDGKVLATGTKDEVLAAAGKDARVVDLGSATVVPGLTDAHGHLAGLGRGLVTVDL

SEQ ID NO: 13573 - protein, 234 aa, Myxococcus xanthus
MRMSKTKQQTLGLTMGAVLALTACGTEPMEPSQAPVETDAVEGVDAQAADAKPVDIIALEKQLQESSLAPPAQCNDPSCEGGGGGGEPDPDWPYYTLFWRANLLSLKCITTSDIDGNDEAWLEAEVTGDNQSEVIWNDDYMTPNKRVEWSPLNSYPPPLQFTTQTVGAGGKLVALWDKSMHIFDVQEQIGWTTLRGQTGTFTSILEGHGGKYELTYQVESTGCSPRSQPCPTNL

SEQ ID NO: 13574 - protein, 173 aa, Myxococcus xanthus
PITSMFLHGGWGHLLGNCLFFWVFGNNVEDSMGRLRFVVFYLLCGLAAAAAHLLVDPGSPVPTVGASGAISGVMGAYLLLYPRVRVNMLFIIVIFIRVFPVPAWAVLLWWFGVQLFSGLPQLNTVSAEASGGVAFWAHIGGFVAGMALIKLFQNTRYTNQRTSMRHRLHPNHP

SEQ ID NO: 13575 - protein, 138 aa, Myxococcus xanthus
KSRITVAWSTVASLLAVLPGTAAHAHAGLPETSNVTLRRGHPQDFFSGTTFGAVISRDSGKTWRWVCPDAMGYGGWRPEAYLWRETGDILAATGSALLHSPDEGCSWRTHPFFKSTWVTGAGGPTPPDEPRLSMPVTL

SEQ ID NO: 13576 - protein, 36 aa, Myxococcus xanthus
KSLATSEKYGLARHVAHQAYYSLVSREFEWELMPLA

SEQ ID NO: 13577 - protein, 127 aa, Myxococcus xanthus
MARIAGIDLPPNKRAVISLQYIYGIGNKSAQDIIAAAGIDPTTRTKDLTEEQARKIREIIEASYKVEGDLRREVTMNIKRLMDLGCYRGLRHRKGLPVRGQRTHTNARTRKGPKRGIVRAKPAAPAR

SEQ ID NO: 13578 - protein, 454 aa, Myxococcus xanthus
ARVGQGASQKAEAQARTGRDLSESVVRLSAALEELRSANVVLTKADASIREEVAQVREDARRVIRIGDGLTRTVDQLGHEAEGLEAEVYHFKLPTPHSGGTLRVGMHQAASLRNRQAVDPLFSVENQVSELTSCVFSTLVRREDGGLEPDLAERWDADPSARRYRFYLRRGVTFHDGTLLTASDVKRHLERLLDPALRSPDRSLLEDVEGAPEYAAGMARDVSGLEVLDDHTLEIRLREPKAFFLQLMALTATAVARTDANGRLVGTGPFRLLALEPEHVVLERNPSYWRPGGPMVDRLEFLLAGSRKEAVALLRQGAVDLVSFLDTEHVELPGLEAFQLAASTTPSTAFVVLNHREAPFDDVRVRRALRAGMDIPAMVSQFHPGARVARSLTPPELMDDADMGPAPVPDVALAERLLREAGLRRLRLTLHRPTGNDHSAEGRGASSARCFRPG

SEQ ID NO: 13579 - protein, 225 aa, Myxococcus xanthus
MSGGGARYERYEREQFEPEQFLLDVRKEKIDRVVSHRTRNFTVVLDRLEDSFNMAAVLRTCESMGVQEVHIIINPEAPFVPNSRVAQGCDKWLDVKLYRTFAECREHLKSRGFSLYASAIQEGATSLYTLRFDGKMALVFGNERRGVSEDVLAGVDGTFWVPMKGFSQSLNISAAASACISRAIAWRDEHLGQSGDLSPEDAQALRERFYVLAIKQRKRLFKKAP

SEQ ID NO: 13580 - protein, 184 aa, Myxococcus xanthus
LRDRGIRVYPVSCATGEGMQPLMDSVAEVLFTGRTEKLHVEIPAKAARAGKAKTKAAEKKALARNAGAAAATKSATKKSAAAKKAVTKKAPARKAGAVAKTSAARKAGTAAAKKAPARKSGTAPVKKAAAKKAPARKSGTAPAKKSAVKKASARKSGSSGKAAAKKASAATKRAPARKSGGGRS

SEQ ID NO: 13581 - protein, 192 aa, Myxococcus xanthus
INYGRADAAAPTGVTLRWSGPEVLTGRNTFAASWLVQGLVRAIAFDPEVAAWLVLRRKAFAEVPSRKTLPAPESAEALLPRLVEAVDGTRTLAGLASSLGVAPGMAREAARMGCEKGLLTHQLEVPAATHHPVDDLAERVAGLPCSAARRHVEGLSALLALMAGYGAADAAGKMALQAAFAKRANEQWGVAP

SEQ ID NO: 13582 - protein, 852 aa, Myxococcus xanthus
  unsure (1)..(852): unsure at all Xaa locations
RGSRVTLSMPLAPSPAKPLLASPGGGKSGRPPARKDVEDTEPRDSAQIRVGRYHILDTLGAGGMGAVYSAYDPELHRRVAIKLLHPDANPAARSDGSSRLLREAQAMARLSHPNVVSVYDAGTFAGRVFIAMERVDGLSLRHWLRAEHRTWREVLDIFRQAGRGLAAAHAAGLVHRDFKPANVLVSKDGRAQVTDFGLARTTADLDAAEAGRGTTPALPRLAPEDLLQTALTEAGLVMGTPAYMPPEQHEDGRIDARGDQFSFCASLYEALYGQLPFNGKRPEDYLEEARAGRVRPPPRGSRVPTWVLRAVTRGLSPAPEARFPSMGVLLDALGADPLAAWRRRGAVAAASMLLNSVVAVTWLLVGSQRDGPCPDAEARLTGVWDTARRAEIQKAFAATGKVHASAAFERVATTLDGFARDWTRMHREACEATRVQGHQSDHELALRMACLDRRHSALVALTGVLAQTDAEALNAAPDAAQRLPPIAACADVDALWRGLSEPEGQRQQVEALRARVDRATALVDAGRYPQAQEEAKAVLSEARQLGYGPVLAEALELEGRLGLVAGDDARAAAALRESLFTAQAHRHDHLAARASARLVTAVSSDPTLESWTVEQARASIQRAGGASELEALLQTSLGRNAFLRGQYAQAVEAFGRSATLREQELGPEHLLTLESLRNQAAALSRTPETERAMGLLHRVLETTERVLGPDHPQTAMAANAMGYHLVIVRRFEEALPYLQRAIHLEEQSLGHDSATLSYPLNNLAEALEALGRNAEARPLRERALAVDLKAYGPEHPETATDLALLGALALREGKPRDAMDYARRSIAAYEAFQKDHLDTXAPLTTLGPALHA

SEQ ID NO: 13583 - protein, 196 aa, Myxococcus xanthus
MPRSRSLFAALTFGLGAFHGGCIAYNDSCQPLVEDPDAVVGYLADDVLLDKVYTRHDNNALGQLVADALLHAEDDSTRPAVLGVVNGGSLRQEGLCVTRTELRQGPLTDGVLHELILFENLVVTVDLTEKELVDMLELSVGALYLEGQSIASPSGAFLHVSEGSSLRVDCGQPKGSRVRELTVGGVPVTLPAREDA

SEQ ID NO: 13584 - protein, 591 aa, Myxococcus xanthus
RGPGSALYGAGAFLGVVNIVTDTSDGVRTAVSVGGYPGQDDRLAVTGNGHISAGHTAGNLRVFADIDVWSQAGDSTVIENDGLDDESRSQGLRDVTDPAGRTRDERFLFNAGAGVTYAMGDAGRLGASARFLTERRSALVGLFDTVGEDSKLGWNVFLADLTWERSFGPDVTLRARAAYDQQSTDRFFQITPHDFSAGTGANRLFEEGMQEQTRVSVRSLTGSVDADVALGAYNRLSLGAVVDQQSLGEYDYVTNYTLDAQVRPDGLTRPEGLVDLTSGAASRRLNVGLFAQDQWTVVNALTLTFGVRMDATQLPTVDASGAINGTRFVPTLNPRVGLVFAATDALVLKALYGRAFRAPTLQELVERIPDTEYNQGRFEGNPRLQPATVDTFELGADLIQSAGDARVRLRANAYVALFGSPIVPVDTSGNIVPLRNRELGVRVYGVEGEARLEASKRAYAWLNASISRAEDLELPAQSRLLTDTPQARFNAGVTMPIGAYVNFDVVVRTGAERRNNSRSVLELIRRYKIPSYSLITAQLRTEPILEHFEVALVAHNLFDNDLRDDVPRPDRVPGLLPREGMSGFLTVRAHY

SEQ ID NO: 13585 - protein, 228 aa, Myxococcus xanthus
ALKAHHLPASGEAGSGEVRAAPAARGGRRAALGEQPVRMMEATTRRYSWRRELWLLMAAGCAASGCLIPQDDTLLDAVPDFMNRPPRIIDSLVAPQQRFISDFGADGCDLTFEVAVEDPDVDDRIVVHWYVDYNPQDPRGPYRQYELASTREPRRSDRGTLLISLASANNPLSTPGPHLVEALVTDAELVDRVVRPRPVQLPDGTTINNPGFVVTYSWVVNTVQGDCR

SEQ ID NO: 13586 - protein, 588 aa, Myxococcus xanthus
VDSAQAPFHRHFSIQKCASTFRRPSSVGAGLPACRVGFTAGARMKVVLRFGALAVGAVLITGGVGEAAETQARKGGKKPAAASASKTSGASSKAGGKKKSAKAQVDRKAEEKAPPPGVAPEDVRQGPARVQPASAKFAELPRIPDAKRDALADKKRDEAIAAFKRLIPKLRDGNPQKAEMLYRLSELYWEKSKYLYQLEMTRFLAAEKEYDAAVARGEKVEPPKKNHADSERYRTETMGIYEDILRAYPDYPQRDEVLFSMGYNYYELGRREDAVARYEELIRDFPKSQFVPDAYIQLGNHYFENNKLIPAKENYEKARDSGVPKIYGYAVYKLSWCDYNTGDYELGLKKLHEVVDYAAKSPELGDLRTEALNDLTVFYVQLDQPKEAIAYFKEKAPAQRVGRLLAKTAAGLVDAGHFDSAILAYRTLVDDEPMGANAPEYQQAIVRAHEGLRQRQLVRKEMKRMVDLYSPGGGWWKANEGKTAVLRNAFNVTEEAMRVMVTEYHQEAQKTRQVETYRLARDIYKQYVDAFASNANPDFVADSAFNLRFFYAEILWALEEWEAARGRVRRGGGLQDSGPRHRARGHQQ

SEQ ID NO: 13587 - protein, 65 aa, Myxococcus xanthus
MPRAAGCFAAVGLRPDLLPVDSRASNTPLRRMSWLPRSGALNLSTDALRELAGRAVYRVRGWTAP

SEQ ID NO: 13588 - protein, 146 aa, Myxococcus xanthus
MADEINTSAAASTGAEGEAPAAKKSKRKGKKNILNGVVHIQSTFNNTIITITDVSGNVISWSSAGARGFKGSRKSTPFAAQVAAGDAAAKAMEHGLKNVSVFVKGPGAGRESALRALAAAGLKINLIRDVTPIPHNGCRQPKRRRV

SEQ ID NO: 13589 - protein, 299 aa, Myxococcus xanthus
VKVDAVLGGHDHEALEDRSTGTPIFKVAADAVDLGRLTLDVDAATATVRQVTWQTLPVTRQVPEDAAFNAAMQPYAALFNQLSEHVGRSPVPLEARAAMVRTQETNLGSFVADAFRAAARADVALVNAGALRADAVLPAGGVTRRDLHAILPYADELVVLEVKGDTLRAALENGVSLSREDSRPGRFPQVSGLEFTFDSDRPAGQRVLGVKVGGRPLDKAATYRLATLSFLASGKDGYDMLRNQPSTPARVTGNSPLDVLAEAFRTGTPSPHAQADGRISRLGTGALAPDARQPPAPLK

SEQ ID NO: 13590 - protein, 149 aa, Myxococcus xanthus
TTVEIIFLGVYFSLLCVLGVYGSHRYRMAFLYYRHKFKLPTPKGALESLPKVTIQLPIFNEMYVVERLVESVCRIDYPRDLLEIQVLDDSTDETCGIARACVERQRQKGHDIVYIHRVNRQGFKAGALENGLKLAKGQFVPVLDGLRAR

SEQ ID NO: 13591 - protein, 454 aa, Myxococcus xanthus
MLSTPAFAAAPASAPTKEAPPAAAAPKPFKVPVRTEFTLDNGLEVSLLPYGDMPKVAIQLAIDTGNIHEKATETWLADLTGKLLSEGTTTRSAEQLAQAAAQLGGSLNIGTTMDQTYVGLEVLSESAPDAVALIADVIQNPAFPPAEVERVKGDLVREMAIYKSRPGTLADERLLQSLYGDHPYGRYFPPEAQLKGYTPEAVRAHYDANIGAARARLYVVGRFEPAPVEKAIRDAFTGWKAGAARLRNVPKQKVAKAVQFIDRPGSVQSTVRVAVKGLPPSSPDYVKQTVMNTLLGGYFSSRITANIREAKGYTYSPYSDVSTHLEDAYWVQNADVTTAVTGESLKEILKEVATLRKTPPPADELSAVQSYLAGSFLLQNSSRSGIIYQLRFVDLHGLPDSYLQNYVQSVMAVTPEQVQQLAAKMLTREAMTFIVVGDQKLVAPQLKVVSPALK

SEQ ID NO: 13592 - protein, 268 aa, Myxococcus xanthus
LLGAMEPATCAPHFRAKVHGTYALDRALAGRSLDFVLLVSSNATVLGGLGLGAYAAANAFLDAFAAARSRTGGPRWLSTNWDGWPVDAAEGAKAVQTSIDQFAMTPDEAVEAFRRVVEAPLEGQVLVSTGNLDARVAQWVRREGAGAKKDAGGTLHSRPALGTEYVAPTDEVERALVRVWQEQLGLEQLGIHDNFFDLGGNSLLWLKIVGRMKRELGRDVPLTSVFEAPTVATLAKKLGQGPAPAETTAFESSQSRGAQRRERRSRRE

SEQ ID NO: 13593 - protein, 103 aa, Myxococcus xanthus
NLARNPRVLESFEPVQVNIGNGGDFLATRVSYKLNLRGASHTVQSACSTSLVAVHQACQSLLNGECDMALAGGASVNVGFFNGYRHAEGGMASPDGHCRPFDA

SEQ ID NO: 13594 - protein, 103 aa, Myxococcus xanthus
AAFQSLQQHDLPKLYAAEAAGAASGASPAGASSAKPAEPVDVKLAQAMATALKALPREAVDRFLQKFAVQRIRDIPASKGELARAFVDSLVAEYSAESVANVD

SEQ ID NO: 13595 - protein, 135 aa, Myxococcus xanthus
PVCSKDEEGLDFRQALLADEDLRKMMTPEEISDCFSSGYHTRQEPAFYFRRRAHDPDDKWVLGQRIPGQRSVADGEQVLDLLARHPSTARHVASKLARRFVSDTPPPALVERVAKVFLDSGGDLPTVYRALFLSL

SEQ ID NO: 13596 - protein, 528 aa, Myxococcus xanthus
NSRLLAERLKHQVESAGLATRLFRASDYPVRELAKEKLLCVVISTQGDGDPPDDARGFSEFILGKRAPRMEGLRYAVLGLGDSSYPRFCEVGRRLDARFAELGASRLLERADCDVDFEPVAKGWLDQAYTLAREALTPQATVTATVVPLREPHATPAFTKEAPYTAEVLLNQRITARGALKDVRHLELSLAGSGLEYAPGDALGVWPHNPPELVASFLSELRLDGEAAVTREGRTLPLARWLSDELEITRLNRPFLERQATLSGSAALHEVLEPGRTEAFRALLAGHQVIDVLRAHKATWDATELVQSLRRLTPRLYSIASSPKRVGEEAHLTVAVVDYTVFDLRHFGAASYHLATRTGGTDTFRIFIEPNEHFQLPQDCHTDVLMTGPGTSEAPFRAFVHERAETGAKGRNWLFFGEQHFRTQFLYQTEWQEALKKQTLHRLSLAFSRDRAQKVYVQHRLRESGRDVYEWLEGGAHLYVCGDAQRMAPDVHEALVDVVSTHGGKSREDAHAWLESLREQRRYLRDVY

SEQ ID NO: 13597 - protein, 190 aa, Myxococcus xanthus
MYLKGDRCYTDKCAIERRPYPPGQHGQGRVKFSGYGVQLREKQKVKRMYGLLENQFRGYYHRASAAKGKTGDNLLQQLELRLDNVVFRMGFADTRNEARQLVRHGHFQVNGRKVNIPSFAVKPGTAVEVVEKSRKVLRISEALETVDRRGIPQWISLDKKAFKGTVTTVPNREDLTMPISEQLIVELYSK

SEQ ID NO: 13598 - protein, 370 aa, Myxococcus xanthus
SHQPKPLSEVEHIKTQSRLLRGSLAESLEDPVTGGLATPDTNLIKFHGSYQQDDRDVREERRQQKLEPDYSFMLRTRLPGGVCTPAQWLVMDALAREHANHTLRITTRQAFQLHGVIKDDLRPTIARINEAMMDTLAACGDVNRNVLCNPNPVDSRVHETVYQWAVRISEHLLPKTRAYYEVWLGKEKVAGGEDEPIYGATYLPRKFKAAVAVPPLNDVDVFAQDLGFIAIIEGDALVGFNVSVGGGMGATHGDAATYPRLADVVGFIPPEQTLAVAEEVVKIHRDFGDRTNRKHARLKYVLEERGVPWFTAELEKRLGFPLQPARPFVFEHNGNRFGWTEGHDGRWHLTLHLNSGRVADRPGAPNLTGL

SEQ ID NO: 13599 - protein, 377 aa, Myxococcus xanthus
GGDAMKWRIASVAFLLGALSSGLTWLSVQPVLLRLLDALRRWVPEGSAEEATLARVQGLLPWVLGLDLVALTVLTYVVLDLMVGRPLRRTEAVVEQFGRLDWEAHLVPTQGGTLVSRIQRALQRMAEALREEQALTRAQMASLRASHAQLARTQTELVASERMATVGRLAAGVAHEVGNPLAGILGYVALARVKADTPELKDFLERIDHEVQRIDRIIRGLLDLGRPGVTSLGPVEVGPVVETCVRLVRASPELSGVTVTLDLEPGALARTDAGPLSQIVINLLLNAAQAMGGQGRVRVATRQAAGEVRLLVEDDGTGIPEDVMPRLFEPFFTTKGREGTGLGLAVSQRLAQVMGGRLEAENIPSGGARFTVCLPVP

SEQ ID NO: 13600 - protein, 123 aa, Myxococcus xanthus
PLFRTILVADDEPSIRHILTLVLTGHGYHVRAVADGEDALKELAARDYHVLLCDVRMPKNDGLVVLREGLDSHPALTAVVMSAYRSQEQALHAVASGEFDYVQKPFKPDDIVFVLRKAEEREL

SEQ ID NO: 13601 - protein, 303 aa, Myxococcus xanthus
MSLVIRTRDPGKVPDELLAHIQTALGGQRPDGEEFVDELQRVVCARQLASGFFHRWRYPDVQGVPQDPELIVRWFARRQEFNRELRERLKRPAEHLDSPGLLVRAAIRAHQSPPYDGELPTWRAMSWPSWAEMHKHVVHVTEAVWLSDFIVRDAAKWALRKGQPGIVWVEFPELGQRIAKAAGVPFYGGGPEASATIIRESGKRSIVASLRAHGTGKNLTMFSRMLFVNPPADGAAWEQAIGRCHRQGQLADEVEVELYQHTDELVGAFQKARDFARFIEQTEGTPQKICLASYDKGASSSQQ

SEQ ID NO: 13602 - protein, 385 aa, Myxococcus xanthus
MAQVPPGTLVVLAPTHRSYFDFLLTSYLCFQHPELGISMPHIAAAEEFGRIPVVGPILKDSQAFFIKRGVGREVPELGEELRRLTEKNASLMFFVEGQRSRARLMLPPKRGMLRALQNTKRQFVVLPVAISYDRLPEEASLSEELSGKPRPKMTLTGVLSWLTKLTRGQVQLGRVHLSCGAPLALNPDTDVRAMSHTLMAELQRHTTVSSFHLRTFLAENPIPGVDEAWLREAIERRGGRVLDSDLPVPSSLSPALAHSLRNQWQHWFAGDVLARQPGNPALEDHLSRYRWCATPLAELSDARVDAVVKALFEPVVRDYQEATKVRAPDELKAVAVTHRPHLDGVVQALVSRDIVKPAGDNFEWGPNAAELSQFHEACAWRGVQP

SEQ ID NO: 13603 - protein, 246 aa, Myxococcus xanthus
MVRFNIDSSLAMVRAAKALDARLVLVSTSGTVGCFSHPTIEADEHSLYAEALVGRWPYYLSKILAEQQSRKLAKQLGVEMTVVRPPVLLGPGDTLGRSTTNVARVLNGRLPFIPTGGIAFTDVRDVAHALAVLAKKSDWRDTYHLSGTTLPLRTFFERVGEVAGIRVNRPGVPTLVVDGLAKLGAHVPLKKLPDPVVLEMSTCHWGFKTLWSHEELDYRPRSHRQTLSDTVAWLREAQARQTPLAG

SEQ ID NO: 13604 - protein, 84 aa, Myxococcus xanthus
APAHFNFFFWKDHCVHVWASAEVPRGFTRVGHRPPLVVEDVNSYSGWPSGSALYSQRRWEAIPQAQRDAFKQMVAAPDQQVLFT

SEQ ID NO: 13605 - protein, 559 aa, Myxococcus xanthus
LTAHARDAAGNFTTWAPILVTVANAVVDTTPPEVQVTAPVAGEAVSGPFTVRMSASDNVGVTRVHVELDGVQVGSPDMAAPWSVTLDTEALQPYGLRQLTAVARDAAGNVTVSAPVSVNVSAPPPDVTPPQVQIVAPESGVTVGGTLQVRVDAHDNVRIAGVQLQVNGQDFGREDLSYPYWINVSTTLLGDGTFPMTAVARDRAGNRTTSAPVMLTIANGPPVVLDIPVAHPRVWFTADRLARAQAYFAQNPYTPVANVQAPEQAIDAAMHSLLTGTPASCRAAIDWAVRTEIPISENTVSSDPARWYGEAAILTYDWCFAHLLPAERTLLINRWNVAIESLNDNPWGGIGMEGNNYYTGYFRNSLLWAIASWHENQPFANELLQYAMKSRWAFSLRPYLDGPAAGGAPHEGSTYGRRTFGYMTVPFTTLGLYGHDMWNQTDYFMASVFWSIYSTTPGPSRRGQFQLFETFPFNDDERWLNRWNPSNTAQTLLGSYFAPLIGEWSDQPIAGYAKRFLELTGHPIDDRLIRYVYSDTLAAVPSRDLAELPLDYHAPGLGI

SEQ ID NO: 13606 - protein, 484 aa, Myxococcus xanthus
GEVYLGEQVSLGRKVAIKVLHHDLHAQAGMAERFKREARLLSAVEHPAVVRIVDFGESGDHACLVMEFVEGESLYDVLTPGPMPPGRALPLLQQLAEGLAAIHDKGIIHRDLKPENVFISKSARGEQARLLDFGIARLVEPDAASSVSQIGVVLGTPEYLSPEQAVGAKVDTRSDLYSFGVLTYRVLSGRLPFDGPLPRNFLSQHASAAPLPLDRAAPTLSRYVGLLSLVMRLLEKDASKRPQSAHELADALAAAHSALSAFTPGLGTPAYVPQPGSGATPSSGTSVFGTGSASGSSSGPTGTAAFAGVAPAPQASSGTAAFGVASSSGSASGALPAASPHTGTASFGLKSSGGVAAVTGGNASVVKPQNLTVMLTDIQGFTERTSRQTHEENARMLETHDKLLMPLVKEHDGRLVQKRGDALLVVFRSPTAGVLCGMAMQDRLWRHNQTVPEVDRLNVRVCLHAGEVLATPDSVLGEPMEVID

SEQ ID NO: 13607 - protein, 118 aa, Myxococcus xanthus
GALALVPDVEVRGATGFSTRVLPALCQLAAVSRGYKMPTLDTARLSAAEVSSTGLRLRFSAGGLPPPSPPDEELLLALEGARAFADAEGLIAQGRLADARQAYLQAGDAQDAHPVAAE

SEQ ID NO: 13608 - protein, 340 aa, Myxococcus xanthus
MADTFVAKNWRDLIKPRRMEVDQDSATPTYGKFVAEPLERGFGTTLGNSLRRVLLSSLQGAAITTVKIEGVDHEFTTIPEVSEDVTDVVLNLKEVLLRMHTNETKTLRIEAEGPKEVKAGDIITDPDTEILNPGHHICTISEGGKLRMELTCRRGRGYTPANVNKVAGSPIGTIPIDSLFSPIRKVNYQVTNARVGQVTDFDKLSLEVWTDGSVSPQDAVAYAAKIIKEQLTVFVNFDETEEPVVAEAPKEEAKLNENLFRSVDELELSVRSANCLQQANIKSIGDLVQRTEAEMLKTKNFGRKSLKEIKEILAEMGLSLGMKLENWPPKQAPAPAQPKA

SEQ ID NO: 13609 - protein, 38 aa, Myxococcus xanthus
VTVQPLGVETAGGTWAPVLLARVARWYRDSRGVRRQNQ

SEQ ID NO: 13610 - protein, 43 aa, Myxococcus xanthus
SQDSAQGAVDSVDGVSRMFRPDTKCCTYSPSLPNYLVGALLSD

SEQ ID NO: 13611 - protein, 267 aa, Myxococcus xanthus
MGRLGGALGLALQAKRWPVRIHSRTDEGRERAEALGLKTAAPADLKRARVILLCVPDAAVPAVAQALSTTLPRTAALVHTAGALSLDALGTAKGRSRGSFHPLCAVSSPRDSLVGSTVAVSTPSRTLREVLRHMAADAGLRVIEVPEAHRAAYHAGAVLSAGGLVSLADAAVAALGAAGIPPTDALAALLPLMHSALRGLETRGLAGGLTGPIVRGDSGVVAAHLEALPADVAPLYRLLSRRALGLAGDRLEPTSRAALERLLKPSG

SEQ ID NO: 13612 - protein, 39 aa, Myxococcus xanthus
RKLTTESLELYYPAQLRGAALRMACGWRAAWPASRSCRV

SEQ ID NO: 13613 - protein, 422 aa, Myxococcus xanthus
MQVAAALEQATGKPVDLLKAPWVEIEPAIAQLTGGQFQVNKPEHQTLALGLAGAFALRLIQEHQAFWFPNRDSPEGATLGFPEAIIMLSPFGAVMDSLGQGKLARLEDLAADIRRSLGQARFGGSPAQALGGQAPKLTPVDYQRLFDPGFLQFVVLDPKKAATALETKPDGLARDVRNALGRTQPPLPPEARQQFEGQIVQSLQRLDTTKSLIDQAERAPRLAELMAHLFGTIGGTGSAPEDFWHDLVLPLLFIGTPASFPPLDEEELEMFRQGADPLPLFVDLVPHAHKAPDEGLLGAFEMSDIGLVHPGFGRVGALRLIRINASRIQPLLEQFDPAKTAETLQRFSEYVAKAAGKPATESPQGKEMLQAALTLLSDLKRSVTQVQGGELSLRRLTEAEAASEQALAVVRKALQGSIILTA

SEQ ID NO: 13614 - protein, 633 aa, Myxococcus xanthus
NTKRDGAPSQDTPSSFALPVVTDRPAARSDVVGEALEHAAANASPSEPGYGQTYWRSLEEKLGTPDYLEATRPEFPVGADLAPTGFARREFMHLLGASLALAGATACSTRPVDERILPYTKTPPELVPGNPLHYASGMTLAGHTSGLLITAREGRPVKIEGNPDHPVNQGAAGPWEQAFLLSLYDPSRARVLRQGKSPRALRVLREELVNAASKAAANDGGSRVRFLSEPGNSPLTGDLRSRILKKLPNARFHSYTAQTHDTQDEATRALFGGQPVSAVYDFAQADIVLSLDADFLESRPENLGYARQFANRRDPNNGPLNRLYVAEARFSITGGMADHRLRVKSQDVLAVAAAVAQAVGGPAASMAGAAANKASLKSDHNAWVQAVVADLRAAQPGRTLVVAGERQPAAVHALAHAINAALGNTGTTVKYVQSSIAEQEGLSQVRALVEDITAGRVDTLVITSWNPVFSVPADTGLKELLDPATNPNRGNLTVLYTGLYEDETSQYADWFVPATHPLETWSDGRSFDGTVAIAQPLIQPLYNGVPESELLAMFLDEPYRPAYQMLRDYWQAQSEGQANFEAHWESWVSDGAIPGTQAAPAQGAPDFGAASSLVTGYTAPATGELEINFVYDY

SEQ ID NO: 13615 - protein, 710 aa, Myxococcus xanthus
QADQRGRVLVAADKEAGDALMERLTSSGYQCASAEKESGLAQVADTLQPEVVLLAVTAKRAAEMLESLRKVDRLQRLPVLVDLGRARSAEAFKRLAVDDWIRSADEVVPRLEAALRAGRLRDREERIRLRMGMLLEITQAATSSLELEEILRIAVDKVGRVTGTDRCSVVLVEGSHARTAKVVATQEDPSLVQLDIEVMRYPELRRALETRESVVIEEAQRDPLMAEVRTNILPLGVKSILVQPLICQGDLLGALFLRVSRADASFGRDEQEFAQAVAGVLANSIRNARLHTAVKKKREDLEEAYVQRYQELNEANRRLKELNRLKDEIIAVCSHDLRAPLQVLLGHGRLLQEGPLEPQQRQSSEAMIRQGKKILGLVESLLEKGKGEAARLSIEPRVLDVAQLCRDAVNELEILAADRGVSLRADCPDSLMLIGDEVKLHEVLQNLITNAIHHARQDGEVVVSTQRLGRPDGDAAKVCVQDDGVGIPPDELHLVFDRYRHGGKGGTGLGLAICKEFVELHGGEIWAESPPDTGCIFVFTLPLAQEAPRNPRPPPAAASTPQEQPRVLVVQDEPDIAAVLSQVLRSKYRVQVAPDGAEGLARANAQRPDLVVMYVFLPNLTGLDLAMALKSSSDTARIPVILLSAHQGVTEKVRSLNVGAVHYMSKPFNASAAAQPQRVRPQAAPRSAGASGEGEEQRLAAALRQRPRLG

SEQ ID NO: 13616 - protein, 166 aa, Myxococcus xanthus
RARAASSLSVDKVCPHRFRLPVAPGVAASRLGREPDWDVTLAAWRRLCGGNAVVEGAGGLFVPLDSKHDVIDLIATLRLPVLLVARAGLGTLNHAALSLQALAARRIPVRAVLLSRGTSAKDVSERDNRRLLESRHGVPVLGPVPYLPDARRRHAAFRRALRPLLP

SEQ ID NO: 13617 - protein, 92 aa, Myxococcus xanthus
MADIIDLTFLADVRRFYKKLIDQRGLSYFLQKEGPRLFHIEPSKVELVLRTALRTRDPQLPRPHDKAIEHCRKEVRRDLIRRVANAMLQTGL

SEQ ID NO: 13618 - protein, 101 aa, Myxococcus xanthus
LTFALSGLSKSAGLPGLKLAWTHVGGPAALRDEALARLDWVGDTYLPVGTLVQRVLPALLAHAPRFQAAVLERVRGNRQRLLAARPRDANWDVVPAEGGWI

SEQ ID NO: 13619 - protein, 120 aa, Myxococcus xanthus
MLNNMVTSLLEHQAIRTTLPKAKEARKIAERIITLGKRGGLANVRLAARTVKDRDVLQKVFGEYKDRYASRPGGYTRIVRLGFRRGDAAEMALLELVDRPEKAAPVDTEAAAPAEETKAE

SEQ ID NO: 13620 - protein, 136 aa, Myxococcus xanthus
SRRTRGQRQYLISSMGLDQVSYFVSQRFVDEKMAGALKEVVTQREQVDALAKDEQRLQEERNQLFRDQERIRSNIESLKSGASQRELADRFVSKLNEQEDRLEAIASELEKLAKQRQEAQKALNRRIQALSYTADL

SEQ ID NO: 13621 - protein, 82 aa, Myxococcus xanthus
MVLGMARRMWRSYCDQGELLHQEENGTGMLLLRQFTYQTPVALHEMAGGFRAYLECSSAKNPRVEIVAPDKDGTLRWRIVSG

SEQ ID NO: 13622 - protein, 434 aa, Myxococcus xanthus
SSAFQGEWLLGRGWDQNDWPEKAFPSRADLDKRFPLRPVALSRVDGHALWVNGEALRRAGITRDTKDPAGGRILRGEGGEPTGILVDNAMELVESVLPPATDAQHAAQLTAALQRGAQVGLTGVHDAGMDLRTFRLLQRWDKGGKLPLRVYAMADGQTGDRETYLKDGPYEGRMLTMRAVKLTLDGALGSRGAALHQDYSDEPGHRGLLLLSPEEYEARVRAFMARGFQVCTHAIGDRANTVVLDVLARAAEATGTLQSGRHRVEHAQIMRPEDIERLGRSGFIASVQPTHATSDMPWAEARVGAERIRGAYAWQRLKASGAVLALGSDFPVERPNVLAGLYAARTRQDVRGLPEGGWYGEQRLSGQEALEGFTVGAAHASFAEARRGRLQPGMDADFVALSVDPVDGPVTALPGAEVRLTVVAGVEVYRAFQR

SEQ ID NO: 13623 - protein, 408 aa, Myxococcus xanthus
LVFYAPGQSWPAPGPHAPTVNSPSHSISQDAGERERSHEAMGAVRNGLQLGGSLLATYAIAMGVRFLLPAHLGPESFGRFNYADSFSAVFFIATHLGLEMYIRKEVSRRPEHASDFFGSTLLLRLGLTAVLMGAMALVMAHFDEPPEVRQLVYVFALAQSLIIINASVAALLHAKGKVAGLSVSNIVTKLVWGGGLLAVAVAGLPLPWLAVPLVASEAVKLGVGWYLAREHMGLTFKVDVPATLKVLKASLPFFITGAALAANGRLDVMILGMVSSHEEVGWYGAAWNIAGLTFFLNPVFGWVLMPLASRAAERSEAELTNLTRRSLEGTLAVTVPMMMLIVLGAPLWVGLMGGAFFQWAIPVRLISVLFELDIAHHSARPASCHHAWTVVGDSNQGQCQRGPDRCSQ

SEQ ID NO: 13624 - protein, 78 aa, Myxococcus xanthus
MRGLVSTLESISGREEAKVARPLLGSAAGLLRRTSDRLENETTEELLADAQTQVRERPGLFIAGCVAAGFVLGRLIKS

SEQ ID NO: 13625 - protein, 177 aa, Myxococcus xanthus
AVAAFSSLLIGTLNVLTRKQPSTARVLEPVAAILSSAVAALAASLMGPLSAQVATLAGLIVLLPGLSLTVAINELATRNLISGTSRLTAAALVFLQLGFGVALGSRLSVVLPEPPVAPLPPALPDWTQLPMLLVAIFAVCVLFRARPRDWGWIAGACTFAFGGARLGSLLLGAQLGA

SEQ ID NO: 13626 - protein, 81 aa, Myxococcus xanthus
MPRAQAEAAIREGRVTLDGRVEHEPFAPVRPEMEVRVDGLVRNLEAPVLTLMFHKPAGLVVHGSDAEGVGTVFECLRERLT

SEQ ID NO: 13627 - protein, 732 aa, Myxococcus xanthus
MNDFRDAHLLHSYEDAGTRTVTHYGQLPLWNPWACGGQYTLGSPQTRVASPTLLVSALMGARPAEPLLLWAFLVLGMEGFFHYARRRVGSALGALAAAPLFGLAGFTALSWSIGWLNFAGFLLLPWLLWGTRRAAEGHLRGAAVVAGTFAVLLGFGGTYPVPMGALFVALEAGRTLYGLRGTPRRKSALWALGATAVFTLGACAFRLWPLVETMRSAPRIMAGTPGNSAEALARMLLQMPASSGYSDPGNFFLAPAVLALIPLAAWAWRRALYPAVLAALCVWMAAGYSAVPSLFGALRLLPVFGTLRYPERFLVPAGLFLAELVALGLAVLLVRVWRVPAARTATSWWPTAAVVACVVITVGWGFQVRAFDRLSRWSQMVPAPGPVPEEAERPFAQARGNRWAQGYFLALNRGSIACGEAWPVPMSERLRGDLPQEEYLEDASAGTARRVEWTPNRVTVDVTATRPTVLLVNQNWHPGWKSSEGEVVSQDGLLGVRVAEGTHHVVLRFLPRSGLGGALVSALAWLGLGFVAWRLRGRLGPAAIGVACVPLVTWGVLLATSPEPLARAVPLNADGSPMRVAALPPTAKPVDARFDVPVELVGAEIPSAPDAEGLLHLVLYWRVTGPVPRSAGIFVHFPGPPGSKRKNADHPVLGGTYFFAEAPRDTLLRDAFSVSTKDWDAGERKVLVGLWHAGGDGSRIGGRGADDKPLTSSHVEVGTLAVPPKAQSEEKP

SEQ ID NO: 13628 - protein, 141 aa, Myxococcus xanthus
MADEKHCPGPVKEGQPTCADASTLALATGDHWNGPAISSFFLGTPTAEVMGRMGYAASALGNHELAFGKEAFLKNPRRGWLPVPRRQPQGEGPGAGGRPVHAGVPDFRAPRPQDWRGGPGVREDSPHRHAGPRGWPGSDGL

SEQ ID NO: 13629 - protein, 117 aa, Myxococcus xanthus
PGRADGLEVTGYEEALTTAIPEARKAGADVVVVLADECVTDLQPAVAKHPEWKVALVAGGRCAQPVELKDGATSFVSLDRGFGKYLRAHVTFDPAKPEGEKLTGLDTKVVEVSGGAP

SEQ ID NO: 13630 - protein, 57 aa, Myxococcus xanthus
MERDIPTRYLQRLNALYEEWFEGYRLSPVLVLPTDKLDYLTNLVDRVDLFRQIEKHL

SEQ ID NO: 13631 - protein, 281 aa, Myxococcus xanthus
SLPFHIGGALLGDPVARRQYIRVGFLQSIAALALALSCMTSGTEAAESASKRESRAEARAKAARIREVAEALVDQHDKKEAAAATRRAKEVEAQTIQRLQEIDAQVARRKQAAAQRAGEGTPSGPEVQPEPTAVVPSLSGAGDESPESASTGEAEDVAGATPDAQKPSPIPADTPDARLEQRIRDVEAAAQGADAGTSLAKAITALVMEATKDLDSEAPASSAKERTDATEDAPHTAEDTQAPVHEKSTWTVKGLSVWGLAFWAALFAALQLAQWVVILRG

SEQ ID NO: 13632 - protein, 90 aa, Myxococcus xanthus
LPPHPGGHEADLERFSDRPHLSSVAGRGHEDQRRMLERGLGKVKAAPDRLERLKALLHRESAMLSLVDQVNEETKEIIRRMWDAQKDEGY

SEQ ID NO: 13633 - protein, 158 aa, Myxococcus xanthus
MAALDPDDPKDEAKLDTLLQRWADGKATLRDVRGYSDEELYAIAKTAYYFFYQGRVSEARTLFQGLYAVNPTDAYFAKALGVVEMAAGNGQGALAAFDVAAKLTPHDPSVYVGRAEVKLAMGQKPQALEDLRRAAAMQPGDDPVVRKAAAMISALSRR

SEQ ID NO: 13634 - protein, 160 aa, Myxococcus xanthus
PPEAPPELVAKRERLVTELENQAKSATGTLQQVMRKMSALLGNTKPGASLSFQLYQDVKDAFTRHLNEATKTPALATMPPVLVESVEWMQAYLNARGFSTDEAAASAPAATAAPAAAAKAPVGPGGAKDAFETSSNKHASLTGDVPPPPAAPPDVKAEQN

SEQ ID NO: 13635 - protein, 819 aa, Myxococcus xanthus
LKTAAPPGGTEGAQTCAGGGPQNATCYTEAIEEPEGEPEQEPPEPAPTESQEAASSVSPDAEERDNCPIEEAISEQAPSSTEAAAPAQSTLDSNASTPESAGASAEGAPTGDATAAPSSEASGGNGGATAEDAANEAARTPLDEAIDTTEVQRWDAVAAHGSASASLANAGAGAISLRGGVQFVPAPGATSADDARRVDANSRADAFFLQAANRIEDAVLLTRDDVPARIGALAETYKSAISASMEEQKAAISASVEQARVAATAQAEGARQQVLSEHSTTVSTIHSETDSAIESLRAAYDSGLMLVDEQESTTLDSVNSLYAQARIAHEALGPTVGDECVQLGEEYAEEYEDCKINKKDRFFAGYLTDRRAEAQMKAARETAKGYRKSLVDTATKQAGEAMKGRQLDRCGVIAAARRARETLDTQYEQLVAALESSRTQALTQAETTRDSMMASVDSAFIAELARLDRHEHDQRQSVNDTGYLQQVLIELAAFASATSIQSAVTGAIDTLVQALTGVRDLFSTQSAPEGEQLERILGQAMGGLEGGLDGLVSQVEHGAAGALERVDGVGNQGLEAMLRLGQSSEEATAALVDSFTASMGALAAGATTSFGQQRDAFTTQAQQVASDGATGLETVATGFQTTCTTILTHVESALVDSADALEQSLRDSKAQLDCDIPVQAQEAASKEQPAWKGVLAVVLIIAIVIVVALVVGPAVIQRGGCAAERAGRHRGSRDHWNHSGWCHCRRGDVGRHPGPQQLGVGRAPHGGRGQGRAPGCDWRRVRRGRGRPHPERRQERGPSVRGQHRRRCGAGSRHPAHHG

SEQ ID NO: 13636 - protein, 639 aa, Myxococcus xanthus
SKEEKRPRKRQKKPTPKAQNPKEKEKEASSDNEDEDEDEASSDNEDEDEGGPAPLRGPSPDFEYYSSDDDETPLGPIETSNQGTYTARKEFEATVAFLRAVQDLFENLSNHYQVCQATAELLKIPQGPIHQFTEKALFHTIKNKQKIAGQNRGYEFRISTPAQWMALAKLLRNAQYRPCDIIVELWPKAARNRMCIRGGNSLISPYTGMARTWPSLALELHQTALMLGLEVCARVLKQEVRPKGIERIGHQLLAAIMLRAYRGQGAEVFDFLVGNLGLGSKDMERLEEFISEFFALSFGVESERLFLTHLETLLHLENIANGFKFSLNPKIRCSRGGTPGVVGQHLFNFLNVFSGIREIGGENQHVYIPARLEKTPHGKEKDVAKYQGFVLEKEIQQALRFKDMHGRGKSKRSRGKSMVAGGAGFFHLKPFLGGQNKKGNPYRDFTTRTVIEGVWNQLRPVAPEEDRGQLHADRLEFMACIRIYNTLANFLRRSTQSITRGYWDQRFRFYGGNTRMDAEWLVGWISSLLLGRRSYDYVSTIWSQSLPMLGSTLAFPDVVQQLVERAFPQLMGGKRLTLDPSHTYQRHGFCSGMRVLEAEQLMRTLLSAGWVLQERKYGDEWLGNEHMEELFLHHLAEAS

SEQ ID NO: 13637 - protein, 333 aa, Myxococcus xanthus
MKRWQAKQAGRGHLELAEVAIPAPGAGEVLIRVSAVSLNYREKLMLDGGGYLTAHQPFTPASDMAGVVVAAGAGVQRFKEGARVIANFQTDWVDGPVPRGTVRSLGGNAPGVLAEYVVMPEQWLVASPETLDDVQASTLPCAGLTAWTSLVELGGLRPGHTVVTQGTGGVSLFAVQLAAAMGAEVIVLSGDEDKLARVKALGAAHGIHRRHTPEWHTAVLELTRGAGADHILELVGGDNLGRSVKALASDGRVSLIGVFEGFESRFPVQPLFMSSGVIQGIFVGHRRGLENLVRAVDRLALKPVVDTVYSLDALPTALEHLDRGPFGKLVITA

SEQ ID NO: 13638 - protein, 204 aa, Myxococcus xanthus
MFGRHCAAPLLRELVLQHPGLELEIAFSDRMVDLVEEGYDLALRVAPLADHAGLTARRLGVQTMSVCAAPGYLKRHGRPKTLEDLGEHDAVVYGRNGVNKPWRFPDGQGGEQRIAVQARLRFDDVETIMDAAVQGAGLAWLPRWLIAEHLSSGRLVEVLETQRPYGNEIYAVWPQSKHLTSKVRAAIDLLVARIPERLADTHSR

SEQ ID NO: 13639 - protein, 77 aa, Myxococcus xanthus
SEEVPARELPADVKVSVCTRNQRQPVENGVACLYFFPQGYTEKAYVYVQQGDNVWTLDVSPLTGKVQIVAEALEVPR

SEQ ID NO: 13640 - protein, 390 aa, Myxococcus xanthus
MEVYLLATEQEGPAPLDALRTSFANDEVEFTPDADGEGFTLRADGSEVLVRLTRGSEGLPRFRKEVFSGSPDAFERLGRAKAYYHLSVEPGGAQPTLPVFEALWAVRTLLEHVQGVLVDLTAFKLHEPDDVAEITELDFDIRDHVHLHPVEATEGDTPLWVHSHGMEKFGARPLEIFHLAEKDLLAVESFLHELCTDLAFGQGPALRTQVGTSEGQVFTLVPSEEARANLLGVPLDTFEGHEGLFLTVVSPLGRHNTSQLLEPYRERFEKEPEEQTQAMRREAQLVLPSFLARFQRKGLMEPLTFLVRAPFDTHPEGNTVTENLWLEVMGRDEGSVVGKLVDGAVHTTEWRKGAHVEVAETQVNALAISREGRALDERELRELLNAERPM

SEQ ID NO: 13641 - protein, 408 aa, Myxococcus xanthus
GSVAYGNGYAFAQDHVCILADQILKVRGERARFLGMGPGSTYAGSDFAYRSLGLHARATERISTQPATLQAMLKGYAAGFNRYIEETPKEQLPAPCTGARWVRPISDVDLLAYAYSVALTGSSYQVALALAAATPPDVTATTLGTPDRDHVKVQRPELHQVGSNGWAIGRDRSATGHGMVVANPHFPWEGELKLWESHLTVPGELDIYGVGLLGVPAILIGFNNDVAWTHTFSSGQRMTLYGLRLVPGKPTSYYYDNEEREMTWKDVTILVLLDNGTLVNVTRRMYSSHYGPIISIPDTAEWTEQSVLTYRDANLENDTLLAQFLGMNQARSLDDFKAVYAREQGIPWVNTMAADRAGNTWYTDATPTPNLSQAALTTWNIARQGADLATTAIWQQMGLVLLDGSNSQ

SEQ ID NO: 13642 - protein, 283 aa, Myxococcus xanthus
MKRTLVSAALAASSLAFLACDLDQLTSDHVMVGTLLSTPEVEVSASALAGYDAGTFSPDGGDVLALPAQTAAIVFFGSKTGENSQPSGLAGADITVQPVGGEATALADEGSGNYRRTSVGASNFTYQPGATYQFIANRGGTRYVGQVDDAPMKETIAALHPPEGFLRIDASTPLSFDRPAPPANTDRTLGFVTVVPLSAEGAQGEPTYTNLPSTPVQFLQLVGLPGPYREARVTIPGTAFPQREQTYLVIFHAVRMGGAESGNLFLGSALLAGTAEVGVVRTR

SEQ ID NO: 13643 - protein, 339 aa, Myxococcus xanthus
ARGPGRGQGPPFAPATAAGGGLPVWSRLESSPVSETTQGGMVKHAGASEGVSPDAALARLRALETLESGYEAWLELQVEHAASRLRFREERERLEQQGSFLLGAVRAAGLTPSSGAEPALVTPPAAPGDFLRDAEDKLTQARDALARRETESEAKHAEAFAEIRATLKDRVQRYLSASRPSLTLLLRRVGTERAILHLERVSGDTPVLLCFLFAARIPSRYGFLLDDATEDVSLPPAPLYADAGVAADEVRPDAVGLESRVRGAGEVVPLKGFLPVFVSRPSGGEDFFRLLQRGVVLEVEVADGTAFRNVLSREESERFAGHLLRLKLEGRIGLDIEVG

SEQ ID NO: 13644 - protein, 477 aa, Myxococcus xanthus
RELLALERETAPARMAELVASLLRTLHSVKGAARAASATRVETACHRMEELLEQVRDAGAGTPDVYELCFTTVDALDDAGRRLAAREDLAGSPLESLLPQLERAAGRRAGAPAPTSAAPPPSPPPMLTDAVPSPPAAAASVEPHPSGGASAGAEALPVRVSAQKLDALLARSGELRVATLRLEGRADALESVREALAQAREAVLGTPGEQALLRAETELARVTLELAADRRTLGGVATGLDDEVRRARTLSFEEGCEGLERAARDVARSLGRQVRLEIHGGALELDRSLLQGLREPLLHLVRNAVAHGLEGPEERQRLGKPAEGRLLLTARLKGSRVEVTVDDDGRGLDLGALREQARARGLRVPESDEEAARLVFLAGLSTATKVTQVAGRGVGLDVVRMHVEGLRGSVEVTTQQGQGTRFILDVPLTLSTLRVLLVSAGGQTLALASESVARLVRLAPHEVRDVEDRPAWASVEL

SEQ ID NO: 13645 - protein, 201 aa, Myxococcus xanthus
MLRKLPVLLVGVLGLASSAGAQEARRPPEHRSPTPAWAPRGVLLGVSAQDGLVASQTKVQWQFTFYQDRKDAFALLLEGSLSWGLAFPDAEEGKPQNAVRSFYQHSPQVGVGYRNHLPGQVHWGFQVTGGPVFYGADFDGGLEKDRRVAGLIEGRVHLGYQFGDIAGGLAVGYAEAFGYKRRSLGRFFVGGPMVGLFVDWR

SEQ ID NO: 13646 - protein, 170 aa, Myxococcus xanthus
MPEPLSAHVSRYLRNREVFERNLPAALLVFTPATEEDSGGDGEEYRLKTVTNAGNPTLGASGPLVFPVVKSRTNAFGRGITVGRTGNNDVVLDDGSVSRFHAWFSQEEGHAGFLLTDAGSKNGSWAGGVRLVPRKAVPVADGARLRFGQVEVGFYTTSGFMRMLAVRMAP

SEQ ID NO: 13647 - protein, 401 aa, Myxococcus xanthus
MLVDAALGLYVVADGMGGHSAGEVASNRATEVVKQHISANRHLLKDLGINPTPDSRSAAAALVEVSVQRACADIYRTAMSDATKRGMGTTFVCLAVGGNKGVIGHVGDSRVYLVRHGQCHRLTEDHTLVAAQLKAGTITKDQAANSQYRNVITRAVGIQESVQVDTLIVDLVPGDMFILCSDGLHGYVEDEEVLPLIAGIAPADLPKRFIDVANERGGKDNITAVVVKVAGEGSSVSEESSEAQSRMEALRKIPLFRHLTYKEQTAVLSIATTRTYPAGREIVVEGQPGEELFVVIRGRVAIEKNGVEIAELRAGGHFGEMGLIDNAPRSATVRATEPTRTMVISRPDLMGLMKRESILAVKMLWSFVQVLSDRLRATNSELSEARQELAVAQAIAPFAEE

SEQ ID NO: 13648 - protein, 126 aa, Myxococcus xanthus
MARAVGGDVVVKFLGEVVELRHELRATQGDIEGMAMGMESMRAGMATMRSNMAAMQSNMDSMMGNMETMMSTVESMIVGLRSVSGRMSRMEAHAGRMARLLTSMADSTQERFERVEKRLDDLEDKL

SEQ ID NO: 13649 - protein, 67 aa, Myxococcus xanthus
MPVVTVRAGNKQRPGRFDVLVRKTTEKVSDLLEESDRVLVVYEQGCASLYYERERDVPHPPAVNRPS

SEQ ID NO: 13650 - protein, 568 aa, Myxococcus xanthus
VDSLRKLHPRDVARNPVMFVVWAGSLLTTVLVVKDLVAPRPDAAPLGFTVQVTLWLWFTVLFANFAEAVAEGRGKAQAGALRKMRKETTARRWKDGREERVPAPDLRKGDEVICEAGDLIPGDGEVVEGIASVDESAITGESAPVIRESGGDRSAVTGGTKVLSDRIRVRISANPGDSFLDRMIGLVEGAARQKTPNEVALHILLVGLTLIFLLACVTLVPLALYSGVPLSGTAVVALLVCLIPTTIGGLLSAIGIAGMDRLLRKNVLAMSGRAVEAAGDVDTLLLDKTGTITLGNRMATELLPMPGVRMEELAEAAQLASLADETPEGRSIVTLVKDTYKMRPRELQAHHATFVPFTAQTRMSGCDLVDPHPRSIRKGAVDAIVTYVRSQGGAVPDELAQASGRIGDAGGTPLAVADGARLLGIIHLKDVVKGGIKERFDRFRAMGIRTVMITGDNPRTAAAIAREAGVDDFLAEATPEAKLALIRTEQGRGKLVAMTGDGTNDAPALAQADVGVAMNTGTQAAKEAGNMVDLDSNPTKLLEVVEVGKQLLMTRGTLTTFSIANDVV

SEQ ID NO: 13651 - protein, 386 aa, Myxococcus xanthus
MPRALAQAALERKELVQTDDVLCAPLVASGGMPFGVLYVTRAEPKFSEGEGQLLAALGRLGGEAYTTVRSRVDAEPPVAALSGTSRPLRALLELARRVAASAAPVVIHGEPGVGKALLARFVHARSPRALGPFIVVDCREPADAVEEALFGRASAPGQPPVVSALLRADGGSLVLLHVESLARPASERLARALARRSAPARQGGEEPVDVRVLATAPASVSLLAARGDVEASLARALSGFELDAPPIRERRADVLPLLEQFAARAARRIRKEPPTLSPEARRLLTEYGWPQNLRELELVGERLGLLYAASRVGALQLPPEFQEGGDEGAKTLQGRVARLERDAIAEALREASGKKVRAAALLGISRPTLDKKIEEYGLAVERGRRE

SEQ ID NO: 13652 - protein, 827 aa, Myxococcus xanthus
PMIGCRPPNLNACANQLAHKLPAHGVGPEARVGLSLPRSLELLVPVLGVLKTGGAYVPLDPDYPAERTAYVMPDAGVAVLLTQSSVRGRLPAGQVRSILFDEVRAELAALPSTPPPRPVLSTRLAYVLYTSGSTGRPKGVMVTHQNVLNFLQSMRREPGLRPEDVVLALTSLSFDIAGLELFLPLAVGARVVIAPQAWQRDGALLAAGLTRCGASVLQATPATWQMLLQAGLPAGLGLRAFCGGEAMSRPLARALGEVAGSVWNLYGPTETTIWSAVERLQDEEADPSLGHAIDNTELYVLDTGGRPVPVGVAGELFIGGEGVARGYLGQPALTAERFVPDPFSARLGARLYRTGDLVRWREGGGLEFLGRIDHQVKVRGHRIELAEIETTLAGHPAVEQAVVVARVHAAEDVRLVAYFIPRTGQDGRNVQALRQWLSERLPGPMVPTVFVPLACFPLTPNGKVDRRALPAPDWGAAPRGAGAFVPPRSATERAVAELWRELLGGSAVSGVFDSFFTVGGHSLLAVRFAMRARTTFRVELSLQALLEQPTIAGMAAVIDAALERSPVPRGEAEVDPMADAVLPPGLEPRGTLPARPRPPRHLLLTGATGFVGAFLLKELLDRLPARIHCLIRAAGREEAGARLERKLRAYGLWEERFRERIEPVPGDLAEPGLGLSSAQLEALAGRVDAIYHCGAVVSFLYPYREMRAPNVQATQALLELACRGRPKVFHHVSTLSVFPPHLRQGGGLLAEDDAIEGATGFRTGYAQSKWVAERLVAQARSRGMQVAIYRLGNVTGHSHTGVWNTPYFVTRSLKSFIQLGSMPVLDG

SEQ ID NO: 13653 - protein, 175 aa, Myxococcus xanthus
VDSGVGRVHDYSPWNEPRSPMHARGEAYGRFLVEHLKPLVDRTYRTRPEPQWTGAMGSSLGGLISLYLGCRYPEVFGRIGALSPTVTWGANQLFGAWSAHSRRWTRIYLDAGAHEYTDASGVPVYYGESTRAFYEHLKHLGYADHELALVLDPHGGHHERDWQRRLPSAMRWLLG

SEQ ID NO: 13654 - protein, 190 aa, Myxococcus xanthus
MKHRGTVPLEQRLVYVQVVEGLLEHGLRGSVSPRLKHRLRQAGIDLDRPLLPGYPVLLWGKCLDVIVEETLPGLPREEAFRQLAERHVQGYGRTVVGRAVYGVMRLLGPRRMVQRLPQTLRATDNYTEVELTEQGPTTYAMRMNSRVDAPGYAEALFESLLRLGGAESPRVARIHEDADSTTYQLTWTER

SEQ ID NO: 13655 - protein, 123 aa, Myxococcus xanthus
RLPDGRFMVLEANLRPPGGFMVDMMNYTCDIDVYRLWARVVTGDPVADFRFTPRYHVCHSARRKSRRYRHPHADVEKKLGTSLILHRELPSIYHSLLGEEMYLTRHADMDALRDTVRFIQDKA

SEQ ID NO: 13656 - protein, 57 aa, Myxococcus xanthus
ARGIAVTPTHEVYVVGNTYGSLDGTTTPVSSDIFLLKLNILGAQQWVRQIDAGELDD

SEQ ID NO: 13657 - protein, 116 aa, Myxococcus xanthus
RLVRYTAAVHGGSSALQFVVPIQVAERFTLEKFNIPSGNYSCSYRVRGHGTIRHRSYSSAGWSPATDFLTVDSDEWQPVFFRITGNVRDWRLFFYPSRSEADRDHLQVDDVVCTKD

SEQ ID NO: 13658 - protein, 47 aa, Myxococcus xanthus
AAAAGIRVFSTGGIGGVHRGASEHFDISQDIAALARFPVAVVCAGAK

SEQ ID NO: 13659 - protein, 329 aa, Myxococcus xanthus
AHESFESPETARLMNEGFINIKVDREERPDLDQIYQGVVQLMGQGGGWPLTVFLTPDLKPFYGGTYFPPQDRYGRPGFPRLLMALRDAWENKQDEVQRQSGQFEEGLGELATYGLEAAPAVLTAADVVGMGQRMAKQVDAVHGGFGGAPKFPNPMNFALMLRAWRRGGGAPLKDAVFLTLERMALGGIYDQLGGGFHRYSVDERWLVPHFEKMLYDNAQLLHLYAQAQQVEPRQLWRKVVEETVAYVRREMTDAGGGFYAAQDADSEGEEGKFFVWRPEEVRAALPEAQAELVLRHFGIKPGGNFEHGATVLEVVVPVSELARERGVSH

SEQ ID NO: 13660 - protein, 202 aa, Myxococcus xanthus
LCGVGTVAAVWRLARDVHGDAATAWRAAALWSVVPAGALAGVWPTPDSPLLLFWTLALWALWRERWVLAGLAGGCALLSKYPAVLLGVAFLIATVRARRLPWGAWRTATLAGAFFAPVVFWNADHDWVGFAFQLSHGLGRDWRSGWSTFGEFLAGQLALGGPVLFPLALVYGVRGPREHFLLRMAACVPLLFFGYASLRARA

SEQ ID NO: 13661 - protein, 153 aa, Myxococcus xanthus
IRTLFDLHLLRDPDLFQLTLNIPAGMEEIPVPPLVLLPLAENAVKHGPAAGHRGPLSLDVTARGHEVEVAIENPGPSRGPYEDRLVLTIRDQRLLKHSGGGCDIHGADEMDDHMVINTVLMDAQLMQWVFQTDRFEYSPLTTIQYWNFRFSRL

SEQ ID NO: 13662 - protein, 343 aa, Myxococcus xanthus
MPVLAPDLHFSALVPPEGLAPDLGALTPRMPLHRALAGFLSPLEQPALAADLVKLAPDAFHATSFSLPLFWNGRLVATLHDANHLALADQYTPAQSIYYRVVVGPRAKRATALVTVSEFSRDELAKHLKLSPYRLQVIHNGVDARFQPPTQAEAAAFRERYELPARYVAAVGNAKRFKNLALLKDFAGELPVPVVLLAGKGAVAHELGLHENVVDLEELPEDQMPLFYGAASALLLPSRYEGFGLPALEAMGAGCPVLASDTTALPEVVGNAALRLSPDDAAAWREATLRVLRDDVLSRELVELGRERVARFTWDDCARRTLAVYRRVLEAPAPGGSRGTPRR

SEQ ID NO: 13663 - protein, 377 aa, Myxococcus xanthus
  unsure (1)..(377): unsure at all Xaa locations
VRAYVGASGVLCLWQAASPAVALLTGAAVSXPRGARYGQVLDSVAGAAAACIGAVGVPWLLLAGVLAGGWLLAALLGVFQNRVRWSVELPSFLKLNLGRLHENFGTEESPRYAAGGFFSHRLRFAHGAIAALGPALSVLGSADQARRRILAGAVVMGMLISIYNAFARAALGAALLVSVVALLLLVQGSARKMGLALLFALVAVVSMSPAWRTRMEKALGNIYGGEREHAMAVGWSLVREYPLTGVGFGNHKPAALATQDETGITDLLATDSHNLWLTVWAETGLVGLLLMLAMHGLLGRALIRRYRQGSIAATGALLSWVGFHILALVHYLPFHSSVYLSFSLIWGLGLCEGSERLRGREARQGHLEMEGAPGPTP

SEQ ID NO: 13664 - protein, 840 aa, Myxococcus xanthus
APHTLLAALLGEKAQARLVVKPPPPEARPRKGSAQARAARAQDDDATGTDADDLLDAAPTAAHALDENHVPSRDVASDAALPLAPPQGPSRHARPDNAPPPDEAPAPSRAEEEQQDLLRKLATIVEDARTFEQDTGAHVLHVGFPLLHLPPGAKDKRGFGTRRILAPIAFIPVRLTLKKGRVPSVELEGAEAGVDRVAPNTALLAWLEQQTGQRLGDLFADEAGEDPWRELNELVAAVCKAMELPAPAPFTPETLLAAIPRGDDAQPQAAILPSAVLGLYPLSNQSLVDDMRALMDGEPISGPLESFLRVDVSLGLPPGHGGGEPNLEGLKRTGEERLVTLADPCQARAVRLARSSRGLVIHGPPGTGKSQTIANAIGDHLARGERVLLVCDKRTALDVVKHRLDHLGLGHLCAVVHDAQRDQRDLYMGIREQLDTLPETRTDAAVAKELARIDTELQSLHDELTAADRALSERPDGGTAPSFHELVGQWFSVEAPAALTPAVSSLAHARLGDVTPHEREVREVLERGGKEGYPENPWREALGGELATYLATPLATYRERLSAIDSAARDADALVSPDVPVFGADPQAEGAARGAFAEKLAPLLESARPDVLARWGSATPDAVQAARIQLDGLATQRQVLAEGPLDAELALVHREQPQALSVLATAMAALGSYLDIARKWYAFFYFARKAGARRVLQQFGLTLSILAAERVTRFFTGVKARALLTEYHRTTLVPGDTATLTDDSLSQTLRTHAALFELLQELERTPLLASCRDAVRAALTADAEARAALLAGLRLSAARGDAVARLEARLTEAGLFSASWLDSRSRGLRSGERLASVTPA

SEQ ID NO: 13665 - protein, 524 aa, Myxococcus xanthus
LERLVSPDPKLRPRSADEVIAELCAATGEPVPPESAATRESFLQAARYVGRVEEQARLSTVLESAMVGRGGAWLVGGESGVGKSRLLEELRALALVKGAVVLRGQGVAAGGSPYQEWRPVLRWLAILTTLSEREASILKPLVPDIEALLGHPVADPAEVGADMVQARLLQVVEDVFARLTQPVVVVLEDLHWAGDESLLLLSRLATRALTLRLLLIGSFRDDEAPSLPSALPGLSLLRLPRLDAREVSILSESMVGAPGARPHLVDLLLRETEGNPFFLVEVVRALAEEAGGLDRLGDMALPERVFAGGVRRLVQRRLEKVPVPSRELLQVAAIVGRQVDVPLLQQAAPDVDVEHWLTDCAAAAVLDVADGRWRFAHDKLREGVLDDLPVDARPALHRRAALAMEAAHGQRAEWTAALTYHWGMAGDALREARYALRAGEDALRVGACREALPFLTRALIRVTEVGGDAMTLGHLEALLAETRFQLGELQSFREHAERALRHFGWPVPSSRMGWALGTFGAGLL

SEQ ID NO: 13666 - protein, 87 aa, Myxococcus xanthus
MAKGGQTPPAPGSAEAHAAWARKEAGDVAGARRDAERILAGNPSAEDRAEAEELLRCTTTPRALYGFALLAATVFVLLLVLAIVRYA

SEQ ID NO: 13667 - protein, 210 aa, Myxococcus xanthus
MLPMWAGIVCCVAGVTLLVAGGGKLFRVLAGPIGAVLGLLWTPVLVMKLGLPDVAKMSTIAAAVLMALGFLLPTAITFLGVGVPLGLVAGQIAGQQDFLLGFAPGFIIGGLAGAMLQRPVAVMVASAVGAWMFVIGALAALHQVGGVVQAVASKPWGVIIAAGLFAVAGAVYQLAVRPSPEEADKLRAERERLKVRQAEQHALEKRWGVK

SEQ ID NO: 13668 - protein, 90 aa, Myxococcus xanthus
SVIGRRDMNAPSLDALRRRAARGGKENVDLKASGFFKENTKVRVELRGQPVQVGRTYHWRIERRGSLLRWFVDGELMLELDDPFPPVEVL

SEQ ID NO: 13669 - protein, 182 aa, Myxococcus xanthus
MSAARAEPLVKDKPDGPLGKRLAGDASNHLLNGVSILKELVADFRRSDRFFKYKASIIAGWLVMTVTSLAIACPGSTVRKGDMDARLVLSDRLDRPSVTIWNESKEPWYDVTLTVNGQYQAAVLTVAPGEFITITPKQLMGSSGAAPADLRFQSIQMRSRDDSADLTADLNAAWERIHKPQQ

SEQ ID NO: 13670 - protein, 115 aa, Myxococcus xanthus
MARVLPQSPLAEVPSKHVVFKSFFLLDAAPGRVLNKPQLMGCNLGKRAAVLYSQNDLAGAWSRNESGDYEFDVSPGGEPQRELAVRLGINVCMYALCLDYKDDAVHLPLILNKRR

SEQ ID NO: 13671 - protein, 403 aa, Myxococcus xanthus
SRYVDIEDLARARGVDPAKYTAGLGAREMAVTDPGEDTVALAATAAARLIRQQDVDPSRIGMLVVGTETGIDHSKPVASHVQGLLKLPRTMRTYDTQHACYGGTAGLMAAVEWIASGAGAGKVAVVVCSDIARYGLNTAGEPTQGGGAVALLVSEQPDLLAMDVGLNGVCSMDVYDFWRPVGRREALVDGHYSITCYLEALSGAYRGWREKALAAGLVRWSDALPGEQLARIAYHVPFCKMARKAHTQLRLCDLEDAADAAASTPESREAQAKSAASYDAQVATSLGLNSRIGNVYTASLYLALAGLLQHEAGALAGQRIGLLSYGSGCAAEFYSGTVGEKAAERMAKADLEAVLARRERVSIEEYERLMKLPADAPEAVAPSPGAFRLTEIRDHRRQYAEGN

SEQ ID NO: 13672 - protein, 151 aa, Myxococcus xanthus
MLGAPRGWDPFERMQELLGFDLGRMLGPQGTREGGFVPDFEVKETQDAFIFKADVPGVEEKDLEITLAENRLTISGKREEERRDEGDRYYAYERNYGSFSRTFTLPRGVNADNVQADFKSGVLNVRIPKKSEEQPKRIKVGGSERSEKAKA

SEQ ID NO: 13673 - protein, 171 aa, Myxococcus xanthus
  unsure (1)..(171): unsure at all Xaa locations
MMRRALPLPFLATLLLLASACATTGAAPAEADILQLVSDQTEAWNRQDAVAWSKDFAPDAXFINIVGTVFEGRDEIQERHAGIFATIFKGSQSQVTVRKVQFIQEDLAIVDTTHEVTGHPGLPPGVQDTEPGLLRTQMRYVMKHVNGQWQIMAGQNTDVKPRPQAAAPQTP

SEQ ID NO: 13674 - protein, 391 aa, Myxococcus xanthus
VLPTFGLAAATWLWTREASRPISILITDFGTGVRIVVPASALVAMTLAARQGILIKGAQYLERLAQADTIVFDKTGTLTLGVPEVVDVIPVRGWDAREVLSLSAAAELRQSHPVAEAVRRHAQTQGVEVPQPEAGLEEFVLGRGVCAQVNGRRVCVGSARWMQQQGVDVTDAGSALARSVPRDVATLWVTVDGALAGCISYVETLRPESAGVVQSLKENGRRRIVLLSGDSPSRVAEVASRLGVDEAIAELLPEDKATQVRTLRRQGRIVAMVGDGINDAPALALADVGISLRGATDVALETADVVLLRGSLDDLLLAFDAGRDTLARVHLGLGLVLVPNAVAMVLAALGWLPPVAAAVVNNGSTVVAGFAALAPLFRQARAAQREDSTTH

SEQ ID NO: 13675 - protein, 127 aa, Myxococcus xanthus
LLMALIPVVLGVGFWTLAKGEEKTFRIVTPQGFKSMRGGMTTEQVRAVLGRPITLERDTNGAECYRYGQPNFVNPQFLIYSVCYEDGKLRDVKTHQYSAWNVDPATGTFAAPGEEPADAAPVPAQEG

SEQ ID NO: 13676 - protein, 371 aa, Myxococcus xanthus
LSSGGGGTPNVCAAPSCRPYTCGLLGKDCGTVPNGCGGFLECGTCTAPESCGATGVPNVCAASASVCVDRNLGSVLPVMVKGSTAHAGDDHQSSCGGSGAPDRGFLWTAPKSALFTFDTAKSATRSLVSVRSGGCGGAELACAKDGISYGGGARVSVPLVQGQTVLVVVDSASLDRFSAGYFELHIDELRASEAGSCFDGMDNDGDRWVDCADTDCHDAPGCSGRGCAHHDLGSALPVTFHGETAGSGDGFQGTCGALLQQDRAHLWTAPRAGTYVFDTAPSEWGNALYVLTGCRGTELGCASNANGSPQGSPAVKVTLAQGQTVLVVVDGMANPDQDTPIRYTLHISEDAATETGRCADGADNDADSNCQ

SEQ ID NO: 13677 - protein, 113 aa, Myxococcus xanthus
MLHSTIEARWGSPKASRVVGDEKIEHAEQEHQEMTKLLGDIVRMRDDMNAVKAKVGALEKVVKRHIADEEKNILPQVARNITEKDLGMSCKDLVREASRIRREEMRDWGGASL

SEQ ID NO: 13678 - protein, 325 aa, Myxococcus xanthus
MGIGGIIGGAADAARRAAEAAKRAAEAAAKKAAEAAAKKTAEAAATATKTTEQIASVAKKHTQDVFERHEAPGDSGRDVKQKDRETVGDFFEDLRTKAGDALKDTAQKVGEELGKATDVLANGLDQLGQAIQDAPAQNPVQDFAQDLAGGILQGAAGVVRDSAKTVGAAKDALNFNTQVEQLKPGESVSVGLNAEVDVYAVGITGKGDLTVSRSAEEGGGYTVSASGDVGAGIIGKMGGKGAADASASVFGTAGGTVEYKFDTLEEAQRAAGIIAANAAVSGASGQNPLLGLGLNFVLGDPRSELAGLRDNVSAVEFELGAEGNP

SEQ ID NO: 13679 - protein, 135 aa, Myxococcus xanthus
MADGFSRLVTQHLQLARMELAEDVKATGLDVAMIVAFVPFILVGYGFVCAALAAWLSTWLGWAGALAGIGLLNLVGGAGGAMWAVNRLKARRMMDDTSQELSLSMAALTNAAPSASVNALQGTNREIFKEPPHGR

SEQ ID NO: 13680 - protein, 243 aa, Myxococcus xanthus
MEQIADPFSGFPKAAEAKLEEGMRYLKDLDAPQHAILAFEEILLDYPDVAVVHALLGLAYQRLDDAGRAVDEFKQAIERAPRDGKNHFYLGELYLARQRPDAARVSFEKAVALHPLLETAWFHLGDIHLERRDLTAARESFTVATALAPEAVAMRGKLALVYQLEGDFAAAERELRRVVEKDPENMEFSLRLGLLYTEQAMKASRPEARKTAASEAERWLMKVLETQPENAVASRALQQLKAQ

SEQ ID NO: 13681 - protein, 73 aa, Myxococcus xanthus
MAGSNGQPKAYSPRSSADLRAEIERTRAELATSVSALREEVAVAADWRQWVSRNPYACVGAAFVVGLWLGSRD

SEQ ID NO: 13682 - protein, 66 aa, Myxococcus xanthus
MEMNPQQMADRARELQDRVVPQIDEARQNIVDLNNRVVSFIRANPGTCLLGAVAVGFLVGRIASRR

SEQ ID NO: 13683 - protein, 144 aa, Myxococcus xanthus
MTTFPGASGNGTPQDPQGGGFGQRVDHIGSDAQQLWSDARGAVTDLGQTLDLRGRVERNPYGMMAAAVGVGYLLGGGLFTPLTARILRLGVRLAALPLVKDELLGMAESAFQGYQTGRGMAGPGPQGSAAANATSAGTPRPPTY

SEQ ID NO: 13684 - protein, 78 aa, Myxococcus xanthus
VNFNNLKKLDKDDLLHLVGLETRRDTVDTLLPVVGAFAGASSWARAWACCWRPSRATSCAMTSVSACTAARSTCPTRS

SEQ ID NO: 13685 - protein, 238 aa, Myxococcus xanthus
MLESPGIQYHGRNPDYVLRGLLRCGLCGEAMTPGSTRKGEREYRYYRCVTRDKQGKEGCRAAPLPAAALEDFVVAQLREVSVGDGFAAQVHARLTARLEEKHQALRAERAQLPRDLAKRAGESAKWVDSLSKLEGPARRLVEEKLTAAEEEVAGMRKRLAEVERALDAIEGERVEAAWVAQALGNFDAVWDALTSTNRGRLLRALVGRVVVNEATGKVDVHMAHVGEAAVTGREEVAA

SEQ ID NO: 13686 - protein, 91 aa, Myxococcus xanthus
MLALAHHVESAIGRGLVASAADVAGQLGFTRARVTHLLDLLLLAPDIQEEVLFLEAVEGEEPLSERGLRAIAHSGTWEEQREQWREVKASF

SEQ ID NO: 13687 - protein, 185 aa, Myxococcus xanthus
MQNDMKGIIQAAVAEAVEKTMSRQLELQERQLELLGKIAQFLGIESGSAHAASAPKRAPVPSPASKRIPAPAPTSTPKRTPSVSVRKYVRPEAAPKPTRAGPAPQKSRGRPRAAGRTATAAAPSASPSPEAPVSFAVGQEVRYKQGRGAFTAKVKAVDEKAKTVTAERVSDGKQVVRPFDKVTPA

SEQ ID NO: 13688 - protein, 165 aa, Myxococcus xanthus
  unsure (1)..(165): unsure at all Xaa locations
ADLRGFLYGRLLGQPPAFFERRHSGELLARFTADVPLVEFSVTQALTSYVKDGLQIIALLVTCFLIDKTLFLFTFVVVPVTVLPINRFARSLKKVATRSQERLGSLTALTAEQLQNLPVVQAFRGQPRALEAFEVEADKYLGEMRRSLFLRGAVSXTVELLGIAV

SEQ ID NO: 13689 - protein, 138 aa, Myxococcus xanthus
MSAAAGQKRDYYEVLGVQKSVSAQELKSAFRKVALQYHPDRNPGNSDAEEKFKEASEAYEVLSDPERRAKYDRFGHAGNPFDGFGGAGGGFQGVNINDIFGEIFGDIFGGGRGGRRTSSRGADLRYNLEITFEEAAFA

SEQ ID NO: 13690 - protein, 116 aa, Myxococcus xanthus
MAEYFRTIGYTDIKARLPGFMPPPILSGTIEDHRPDFTCRQSDSARTPIILEIVTPHMVDEPTAENRWSLLASAAKLYNAELHFVVPKWAATGAVDPGLKRRLARMELTANRVWTV

SEQ ID NO: 13691 - protein, 264 aa, Myxococcus xanthus
MRKLFCIFVAGVWTLFCFPLAILAMLLTLNPSRSVWVARELWSPVLLWAGGAKLEVIGQENVDPNRPTIYVANHQSTIDIPAHFLAVPIPFRYVAKTQLKWVPLIGWYLALAGHVFINRSNRSKAIASLNAAAAKIRGGTSIFLYPEGTRSTDGRVLPFKKGPFALALKARVPVCPVTIEGSGDLMPKSTWNITPGPIRVKIGKPIDTTTLAENDREGLARAVRAVIIADSLSLGGKGGDVDDAVAAAGAEGVRDARARALSSP

SEQ ID NO: 13692 - protein, 202 aa, Myxococcus xanthus
EDEWLWGWDPTPGIVSVWAEPDGRAFVWRRVPKTGELLREDVRFRPWLLLASLEDLAHLGPRLRPESDGPARYRVTWQELEGPGALRYLVRGDDGRALTSAVLEGASRRLGQPVSHLKELGANTVLALPPEEQYLTMSGRTYFRDLAFDALRRMQFDLETTGLDPAHHRVFLVALRGPDGATETLEAQGDDDSAEAGPALPP

SEQ ID NO: 13693 - protein, 268 aa, Myxococcus xanthus
DATRKLSAEGMEATLQVLESFAREARELGAEGIAVSATSAARDAENGAEFLAAAKARANVTVEIISGAMEAELSFAAVHSDFASDAAGPLLVLDIGGGSTEFIYGNRGGHVDFRHSFDVGAVRMTERFVGADPMTSEDRARVEAHLRDTFRALPAPPPGAALVGVAGTVTTLYAVQHAIHPYVAEQVHGGTLSVGQLSALADRLCAMPLEARRALPGMQPKRADVIPAGALILLESVKALGLDACRVSDRGLRWGLLAHRFGAGATSS

SEQ ID NO: 13694 - protein, 232 aa, Myxococcus xanthus
MAFFMPEPQRGAMDGPDAQAKLPFMVGLKGLARNSAFWAVTAGYTLMTFSIGGLGFWMPTYLVRERGLAQDSSGFIFGAITAVAGLLGTVAGGWLGDKLDRKREGGGLWMSGIGLMLAAPCMYLAVSLKAVGPTFAAIALAQFLIFLNSGPINAAIVNCVPPAFRAFAMGLNVLCIHLLGDAISPTLIGTIADASSLHTAIAVNALPVLLGGFALLLGARLFREAVPLARQG

SEQ ID NO: 13695 - protein, 439 aa, Myxococcus xanthus
RSTDSVRAVVALCLRLFYRVKVNAPALEPDGPVLFVGNHPNGLIDPALVFILTRRKVTFLAKAPLFRMPVIGWLLKGLDALPVYRKQDDPAKMGGNEGTLEAAKGALVQGRAITIFPEGKSHSEPGLAELKTGAARIAVSAAKAGAPVRIVPVGLTYAEKHVFRSEVLIDVGPAIDVQDFLPADAAAEPDAVRALTERIASGLRAVTLNLEQWADLPLAQLAEQLFAFKQGGALDAERLRLWARGVQMFRAQEPERFESLRAQLAGFRHRMALVQATGLEDLALVYRPGNVVPFVVKNVLALALGLPLFALGLGLFWLPYQLPRLASRNAELDVQATVKFLTAFVVALVWWGVLTAAAAVWGSALLSVAVFLAVPPLALFTLYFAERWESLQRDIRVFFTLGNRARLKRLLLADGERLALEMERLADEYRPRLDAAAQP

SEQ ID NO: 13696 - protein, 364 aa, Myxococcus xanthus
LVRYALWRRIFCGEGWARIGPEVRLPGPVRPRTIKDDLLQRVVEQPLPEAPLPESQTERLAIRYSFPNWLVQRLAQVYPEDVLEGLLASLDEEPSLHFRVRPPGTRDAVLAALKEEGVNAEPVAAAPDAVRVTDSSHRVFETRMMKSGRLQVQDVGSQLISELCRPREGSLEGFTVADVCAGAGGKTLALADFVGPQGRVLAGDRSRRRLAEARERVRHFSLRQVAFPHPLPLSDADVLLIDAPCSGTGSLAREPDQKWKLTAQEIAKYQATQSELLDEVSRQAKPGALIVYATCSVMPEEDEAVVEAFLAKHPDFTLEPVEDVLGAERAALAAQGPYLKALPPKVPGGGFFAARLRRTGAGPG

SEQ ID NO: 13697 - protein, 497 aa, Myxococcus xanthus
  unsure (1)..(497): unsure at all Xaa locations
TYRLDDTAQXNLLSDYWGDVESVQGVYPKVRFQYLVDMPQARPLYWNKSKLTGVASAQETLDAGRVLYRWNAKHVAKVVPEPGMPGWAEVAQNLHVSTYQTWEQVGRYWWGLVRDQLQPNAELRQTVDQVLQGVDRKNELAVVRAIYNFVVTNTRYVALEFGIHGFKPYRVDRVLARRFGDCKDKASLIHSMLQVAGVESRLVLLRMRNLGSIGEEPASLAAFNHAIAYVPKFDLYLDGTAEFHGANELPSADRVANVLVVEPNGKSTFLTTPEAKAADNATRMSLDVTLRADGGAEITGSSSVGGQHAPDYRRAYRPEATRKSTFERAWAQSFPGLTVHEVKLSDTTRLDDNVALDFKMSIPRYSEVLPNGMRFLPFGTGRTYQQAYASLAQRRFDLVMSSPWTNGFLLRYALPAGWTVAELPQAVEETTKFGHIKLSYRLEGGKLVAEGEVALTTARVSADDYPAFREFLGRVDRAFGRRVFIQNAANRTASSTP

SEQ ID NO: 13698 - protein, 725 aa, Myxococcus xanthus
DSLLREYLSLFFSDPKGQARNAAQYLRDVMDHFGTTTVPHPTGTIRRFQVFDVPGSDRDDRVAGQEEVQNAIYRLLGNFVRAGRINKLILLHGPNGSAKSTLVNALKAGMEAYSRLPQGALYRLAWVFPSEKLIKGSIGFGERDSASGEMTTFAHLDAESIDLRMPCELRDHPLFAVPPGERRRLLETALKKKGLGNGDGESGDFILSDYVRDGELCSKCRRIYTALLNSYGGDWLKVMRHVQVERFYVSRRYQVGTVTVEPQMSVDAVVQQLTADRTQLNVPAPLHSTVLFEPHGPLVHANRGLIEYSDLLKRPLEAFKYLLGFSETGEVPLEPFVLQLDEVLIASANEKHLNAFKELPDFASFKGRIELVRVPYLRRYRTEQQIYDAQITSTTVGKHVAPHATEVAAMWAVLTRLKKPIPDRYPQDVKELIDQVTPVEKLHLYEEGAPPDRLSLANTKELRKLREDLFTESDAYPNYEGRSGASAREIKTALFNAAQNTDYKCLNALAVLEELSAICKDKSVYEFLLQEVVDGYHDHDAFVRLAEAEYLDRVDSEVRESMGLVSEGQYRELVERYIQTISHWVRGEKMRNRVTGVMEAPEEQRMVEVEVIIMPRGEDAADFRRGLIASIGAHRLDNPDAVMDYGRIFPDMFKRLRDHYFEERKRVLRKNKENVLKYLSEDRNQLTAREQTQVQSTLKTMAERYGYCESCAKDAILFLMKKRYA

SEQ ID NO: 13699 - protein, 140 aa, Myxococcus xanthus
MDRVVEAAKLAHIHDDIMAMPMQYDTPLTDRGLSMSGGQRQRLALARALVRRPAILLLDEATSALDATTEAHVQQALASLKCTRVVIAHRLSTVRNADTILVMEAGQVVEVGRHQELLERQGTYAALVNAQREERAVATG

SEQ ID NO: 13700 - protein, 484 aa, Myxococcus xanthus
MNLHDYSRFDAVGLAELVRRKEVTPEELLRVAVEAIHAVNPALNAVIDTREGDASEALKQGIPEGPFRGVPFLIKDIGLHAAGVPTDMGSRMAQGTVFPHDSALMARYRRAGLVLLGRTNAPEFGNNATTEPVLHGPTRNPWDVKRSPGGSSGGSAAAVAAGIVPVAHGNDGGGSLRIPAALCGVFGLKPTRGRNSLGPDAGDFIFGMGIEHVLSRSVRDSAAMLDATQGPEVGDPYFAPPPQRPYLEEVGRAPGRLRIALMTEAPMGSPASAECVEAARAAARLCTELGHDVVEAAPEHDGQLLHEAVCTVWSATMASLVGMLGQFSGRDPGPELLEATTWAAVRHGRELKATDLQRALGVFNLVSRQVGAFFQQYDVLLSPTVAAPPFPLGLLDANAPRTAREWYDHAFGHCPFTALFNVTGQPAMSVPLHWSAEGLPIGVQFAGRYAAEATLFQLAGQLEQARPWAQRTPPVHVTRPAESP

SEQ ID NO: 13701 - protein, 208 aa, Myxococcus xanthus
AVTMGQLKVHTQLAAEGDPCTGPTLCQPGLVCEGRPGDGSSPYGRCVDASYFPGYGEVCSRFVACQTPKSVCIGLASGSVEGYCAPAWMGSSFTEYSDLRLQSTNPLVTAPLVAVGLATVPMDINVELDIVHTAPHRLVLTLEDPGGETALLWDGPNEGTPPSRIVVTRGIPRDGAVNGRWKLHIANPSGVGSGTLRSWTLKLTSRYD

SEQ ID NO: 13702 - protein, 254 aa, Myxococcus xanthus
MSLRFTIAALAMGALLLGVEGWKPLPRPVFLKLLGLGLVGNTVYQVCFIVGLANTSVANSGMLTAVTPVLVATLGAVFGVDRLTRPLIAALALGVVGMLLVLGGRGASEHGASLIGDGLIVGASLCWAIYTVGIRTVGPEVSALRITAISMLTGAPGVVLVGVPELLRLETENIRAGAWAGVVYSALVPLVLAYFTWGRTVQKVGSSRAGLYNTGIPVVAALTAWAVRGEQPTWMQVLGAGLVLSGVLLSRRKS

SEQ ID NO: 13703 - protein, 598 aa, Myxococcus xanthus
RIEGIAYDAEYWCDNIREPTLFAKAAGQMLKDGYRLCIELGPHPVLLASIKECCAEARVEGRVLTSLRRQEPEHKTFTKAVAELYVAGIPIDWSGLYPQGSRYTQLPTYPWQREKHWHESEEALTDRRGSDEHSLLGPRVSAPLPTWERGLNARFLPCLQDHRVRGSLVVPGATYVELALAVRRAMGLSEPHALEEVRFENALVVTGHDEPVVRTTYDEAAQTVTIYSRPRDNRTAWTRHATARIRRNVHTPPETQARVSELAIHAEAPLDTEALYRMLATRGLEYGPSLRGIRTLRRNEKELLAEIVLPEAEVARITADSQMLLDPVWLDPCLQAMVSWLPEDDARLYLPMGCRSIQLSTPPVAHAPLWCHARIRARTAHKLECDITLLDGDGRVCAKLTGVECAALADREESVPRPAFYDWTYTHAFEATAEELPAKSQGTWLVFADQGGIGAELTRELQRTGIQDLVLVTRGETFVRESNHRFQIRPGNAEDVRSLVEAVGRVRIQHVAYLAGLDARPGVESNDVQALLDVVLALAPGDGASLRIVTRDAQRAAPGDGLGALSATPLIGFARVVPAEFPHLRTRSIDLPKSASAS

SEQ ID NO: 13704 - protein, 27 aa, Myxococcus xanthus
GVILRLGRFVGAVEPGPHFRMPFGWSA

SEQ ID NO: 13705 - protein, 213 aa, Myxococcus xanthus
MPGFTAYSGLFTIGRPQPGETVVVAAASGPVGATVGQLARIKGARAVGIAGGPEKCAYVRDELGFDAVVDHHAPDFAERLKEACPKGVDVYFENVGGAVWDAVFPLLNPFARVPVCGLIAWYNSTGPFEGPNRLPLVMRDVLSKSLTLRGFIQTEFVSQLPDFYRDMSAWVREGRVRYREDIVNGLDHAPEAFVGLLEGRNFGKLVVKVDETA

SEQ ID NO: 13706 - protein, 68 aa, Myxococcus xanthus
  unsure (1)..(68): unsure at all Xaa locations
SRTASXPLHHFMEHATPAVAAVPGVGGLLGALVPSLMNAVAGVIAGGLIVLLVTGATRAFQSVRAKPS

SEQ ID NO: 13707 - protein, 70 aa, Myxococcus xanthus
LKAFHRIGFEPDGKVHFQYQVVVQESPVGEPEVSCIARGDFDGDGLNSLYRVRLDANGMTTPIEVEREGE

SEQ ID NO: 13708 - protein, 247 aa, Myxococcus xanthus
MGGQERAPVKSVAELVPPGLEDTPGQEALGQRFGSDAALLASHLSPPQVPGSERATRLWAFYTAYATAAARHPPQPEARQAFREALEGQGFGELRDARTGEDGVTRGLWVMEARTPAEARTRAAEVRLDPPPEVRHSEEAAARPAEQPLVQAAGARAATALHGPVMPALRPRDEASSSEDAQQDGDTQRRRGTNRRLGARMLWNVLHRFRAGPDDGAVAEGQWDRVTFGALLVLLAIALAVAALVSL

SEQ ID NO: 13709 - protein, 167 aa, Myxococcus xanthus
MLKDKEEAMDVSQEAFVKVYKYLDHFKGDSSFYTWLYRITVNICIDVIRKRGGGGEVVEFDESQSVDLSEARIGALGSRLGTNPQKSALRRELAEKIQEALATVPEKHRAILLLREIEGMSYDDLARTLDIPKGTVMSRLFHARAKVQKILSEYLELDEAKSGVGSD

SEQ ID NO: 13710 - protein, 182 aa, Myxococcus xanthus
RAVLEEKLKLDGVRWDEFVLKDNVGNLLRGRFRALRGQVGYKLPAILESRVHAPVEAEEVLFGDDAEADAFIYSLFADLVAGRVDERVLSQVLEAGGVYPDDALRVREAWKKIPVGDPVRRIFIHLDRLTPPAHFTPYGPRVVPIFNYFQAALVLLADAHLTAPEVLKIAVEMVQTAGHNII

SEQ ID NO: 13711 - protein, 283 aa, Myxococcus xanthus
RISVQHAADFIGMDEKPGEALARKPNASVAVAARLVAEGEAQALVSAGNTGAGVLACARHFQLIPGVRRAALATVYPTRSVRGAKGDPFSLILDVGATVEATADDLVTFAVMGSAYARIISQNERPKVALLSNGIEPQKGPPRVVEAHARLSEMKDIHFIGNVEGIDIPKGTADVIVTDGFVGNVCLKMLEGVHDTVVELAQYAYKESLRWRAGLAMLSSGIQRIKDITDWNQYGGAPILGFDKIFIKAHGRSKSWAIANAGKVAAKVVSNNLGAAIREGLKK

SEQ ID NO: 13712 - protein, 189 aa, Myxococcus xanthus
SAPLSWKAAFTTLLLSSVPAAAQGSAAAPKPATAAPAQQGVTLPKATTVTLKNGAKLQLVERKELPLVSFSAWVRGGALGDPAGKEGLAALTGELLQKGAGGRDARQFAEAVDGVGGELQVAANLEALVISGQFMSRDTGLMVELLTDMLTRPRFDAKELEKVSARKASEIAAAKDGDPRMLSGAHIQA

SEQ ID NO: 13713 - protein, 420 aa, Myxococcus xanthus
MDRKSLSRAALSAALVTALSAALSLAEESPILKPVEKPAPAKTATPAAQAKPAPNQKPAQPAPSQQQQVPAAARPEIEVVFVLDTTGSMSGLLEGAKRKIYSIASRIAQGRPTPHLKVGLVAYRDVGDDYVTKRFDLSDDLDTVFANLRKFEAGGGGDTPEHVGRGLGEAVSKLSWSKNREVMKAIFLVGDAPPAQRNDDWDFKHWAKKAREKHIVVNTVRCGGDAETEASWRFVAKLTDGTFDSIDQGGGMVAVATPYDAELAKVNAELATKTLYTGRREVQAENMARAASMGALAPEAAAERISYMKKTRGGGAAGAPASSAPKAVGGAVDLVEAPSALDGVKADELPTELKGMSKEAQVAKVRALSEEKKALEKKAETLAAEREAWLTKNAPEKEDAFDANVMKGVKAQAARYNIAY

SEQ ID NO: 13714 - protein, 291 aa, Myxococcus xanthus
MGALMEQVQATAFVAHPYQFPVIGWPSDIESWRIEDLQRYYKTYYAPNNATLIFTGAVTPAEIFALAEKYLEPIPSQPAPEPVRTKEPEQQGERRIVVKKQAQAPLIQLAYHGISGKDADVEALTLLLSILTNGDSSRLHRRLVEEERAALRVNTHFSPGFDPSLVWVYADLPPGADVAKVEGLLTEELARVVKDGVSDAELKKARNITLSQFWRSLETNNGRGRALGAAETFRGDYRQLFDAPDRYERVTRDDVRKVAARIFNSQRRTVGWLVPADAQAATPDSRKEASR

SEQ ID NO: 13715 - protein, 221 aa, Myxococcus xanthus
MDPTRIFVVEDQPQLLKNLVKVLATFPELEVVGTSQEGEAAVEDIVQLRPQLVLLDLELPGINGIQVTQRVKRRAPEVEILILTSFDDETKVYEAIQAGASGYLVKRVGPEKIRSGIQEVMEGGTVLEPIIAKRFWNYFQSVQAKSTQAEKKLENPWALTPLEFEVLRYVAKGLSNAEVGHVMTLERRTVRTHLSHIYRKMGVNSHVEAVVMALRAGVVDL

SEQ ID NO: 13716 - protein, 174 aa, Myxococcus xanthus
LSVAQHRYGRRLGIAAAIAGVGLVTFLVAAWQLGGDSAPAPEEAPREAKAEAAPVGPPPAMPIAPPVPVPVRPPPPAPEAASRGGEEDAAPEPKPPPKSQRAYLTITTNVPATVYVDGERLSRRTPLNRYPVKVGTRRIKLVSVATGEPKELDLRITRGQHLKVLVDSFTSPRR

SEQ ID NO: 13717 - protein, 84 aa, Myxococcus xanthus
VVPAEGGWSSVVRIPRAPGEEATCLALLDAGVRVQPGYFYDFGGGAFLVLSLLPQPEDFARRRRGARADVGALRPRHVTPWAAR

SEQ ID NO: 13718 - protein, 304 aa, Myxococcus xanthus
MLELRHFKLIAAVADTGSLAAASRQLHLTSSALSHQLRDAEERLGVQLFQRRQRRLLLTGAGEKLLLSARRVLSEVAQAEAVCRAHPQDDLLRLSTGCYTVYGWLPPILGRWQAEHPRVELRIVLEATRQPLGALLNGELDLALTTDVPPQARLAQTALFEDELMLVVPEDHALARRGHVTAEDLVREHLLTYAAPREQLDVFTRVLWPAGIEPHRVSPVPLTEALIELVRGGIGVTALPQWMLPSQHPGLQTVRLTPQGIRRRWSAVTRASRQRPAPLTYFIQLLRERFSRHGKAGPRAASRR

SEQ ID NO: 13719 - protein, 720 aa, Myxococcus xanthus
MPKRGGGGRGVTQKPSNRDVLPAGAESKDTELFFNRELSWMAFNDRVLQLAESPEIPLLERLKFIAIYARNLDEFFMIRVARLHEQIRGGVARLVPDGASPSDTLDKLHDGILKQTRRHGDAFEKVLRPALAEKGLRILSARNLDAEQRAQVDQRFKEQIFPVLTPLAIGLGRHFPYISNLSLSLAVLLRDPDADEESVARVKVPKELLPRFLPLKGNVFVPLEEIIAQHLGDLFPGMEVLSWGTFRVTRDADFTVSEDAEDLLKAVETELRERRFGDVIRMEVQAGMSPKLLEPLVEAMGLEARQVYEEHGLVGLNDLQSIAFAPGFPELKDPPWVPVTQARLRTDADAPDGGTVMSSMRRGDLLVHHPYESFATSVERFVTEAVADPDVLAIKQTVYRTSDSSPLVPALITATERGKQAVCMVELKARFDERTNIRWANALEEAGVHVVYGIPSLKTHAKAILIVRREGDKVRHYVHIGTGNYNPKTARLYTDMGLFTTDPDIGADVADVFNYLTGFGRPKSFRKLLVAPLTMRQGLLAEIKRTVAAHTAERPARIQMKMNALVDPGIIHALYEASRAGVKVELNVRGICCLRPGVPGVSENIRVVSVLGRFLEHSRIYIFERGPELRCFIGSADLMPRNLDHRVEILAPVEDASLAAQVKDSLERCMADTTSAWELTADGGWRRRLPRAGDEKRWAQGEMMERAQRMAQFQGGRPLP

SEQ ID NO: 13720 - protein, 38 aa, Myxococcus xanthus
MLAVDDTTEAARHAAREGWIQWREVREVEAHRREDAAR

SEQ ID NO: 13721 - protein, 92 aa, Myxococcus xanthus
MAYDGELVKMENGRWARFQRCQVYRPGVEDAGETMLLIAVELDERYQRQLDEAADSLAQYRYQGVPVQVRFDSGSQGITLQPEQTVSAPAVH

SEQ ID NO: 13722 - protein, 70 aa, Myxococcus xanthus
MPLYFREGVANMWIIDPVRQSLEVYRRGTTSWVRSQLFTGNVTVNAEPFEVLPLDLGLLWTPRMEGTVQQ

SEQ ID NO: 13723 - protein, 99 aa, Myxococcus xanthus
AVVVLVATLLVGDAFAATFGVTPSGASAVFYVDTNAWADIHYVRNNQGQLNYRMGIVNGRNQYTVTGLSAGETIDYSFTYWDESCNCARDTAWTRYTHF

SEQ ID NO: 13724 - protein, 186 aa, Myxococcus xanthus
MAHLRRMRLRAGEPDAFVRVAELRAGDSVLDCTLGLAQDAMVASLAVGPSGRVVGLERSLALGAVAGEGLRRYALGEDSGLIEVVHADAREYLKTLPSRAFDVVFFDPMFAKPRKSQPAFDMLRRFAEHAPLTQETLEEARRVARRWVVVKGAKYTDDLRKLGLEDEPGSRFTDVIWGRVGPFVEP

SEQ ID NO: 13725 - protein, 164 aa, Myxococcus xanthus
MGATGLKVSVNRRRKVVRLAYVAPFTEGRQGAHWYAAHHALPRLLSRATNAAVQAYVYDPDEGEQVIAYGNGRRVGGERVVYEDVELPVPLDQMDDAAFKHMQERWPVGHLAYVFGLTRKELLRLPRVAPGHELALEGRDAEGAAVLEALLPTCQVTLPESDAL

SEQ ID NO: 13726 - protein, 176 aa, Myxococcus xanthus
MANFYEARSLRMEQELPRIPGAPALDPKILEVYYAALEPMREPRAVLLGLLAVACAFVSVSAARMLSPENLHRDALSRVLSRAAIIAAGLRTIDGAQMSVAKQRLFAALAEPMSKMPEFPPDITVEASREILSAMGVGSAIFGTVVVAGTFALLGQYFRSQRVREAMAVQDGPQEE

SEQ ID NO: 13727 - protein, 104 aa, Myxococcus xanthus
MSSGDEKRGETFVMRGEARSASEESISFSTFIVGLGTAVLIHLGGAPNPETGQTEKDLPLARQNLDLLSMLRAKTRGNLTAEEEKLFDGLLADLRLRYVEATKR

SEQ ID NO: 13728 - protein, 125 aa, Myxococcus xanthus
MADSADPKYLDKRTAERYVRSGQLDEAEYERHLQGLPDVAEKSVPVETLMLDDADDFDDEEDDFEDEGDDTSDDSDEAETSAAAESTDGDTAEADDAESDDEAESDDEAATASNETSDDEGPVSA

SEQ ID NO: 13729 - protein, 575 aa, Myxococcus xanthus
MDTTGLKERAEAWRQADPDPSTAAELAALLAKADWAELEDRFSQDLEFGTAGLRGVLGAGPNRMNRAVIRRTTAGLARYLKEQVPDVATRGVVVGRDARNLSAELAEDTAAVLAAEGIPAHVFPEPVPTPLVAFAALHLNAAAAVMVTASHNPPEYNGYKVYWGNGAQIIPPHDTGIASAIARVEPANRVPLLTPADARAKGLWRDLPAAIGDAYVRAILGLRVVGKGSESLSIVYTAMHGVGGDWAVRALREAGFPRVTPVAEQQQPDGRFPTVRFPNPEEPGAMDLATATAERVKADVVLANDPDADRLAVMARDADGSLRLLTGNEVGVLLGHYVLTQGAKQGKPHVVTTIVSSAQLGDIARSLGAACDEVLTGFKWIANRALEREQAEGTRFVFGYEEALGYTVGTVTRDKDGVGSALVMADLAAWCQARGTTVLGYLEEIQRAHGLYVGAQRNFTFPGAAGAQVIRGIMDAFRASPPKDIGGDAVRAVSDYKKGERGLPPSNVVALELESGGRVTLRPSGTEPKIKYYFELKETLADGEPLAQARARAESRLARFIDAFLGLARERGQPA

SEQ ID NO: 13730 - protein, 81 aa, Myxococcus xanthus
MMQAIASNRNRNMDGVLARVLKALGKLRDDPDAFGECEECGDEIPLGRLRAMPYAEFCVTCQGNKDGPKGRATRSKLTDYT

SEQ ID NO: 13731 - protein, 125 aa, Myxococcus xanthus
MATNATETFAASANIFLVILPPPVAQPDFSVTIEPRQLDLFAGQNEKVRITVTRAEGFTGPVTVALESPTRRISMPTVTIPADQTFVEPYIDTDRGMTRVPVAASITATSEDGRQASTGTTINVR

SEQ ID NO: 13732 - protein, 170 aa, Myxococcus xanthus
AGSSTVPIAVVGFPLGASLPSAKAFEARESIRAGAREIDMVLNVGALKAHDYALVHQDIAAVVEASRPVPVKVILETALLTDEEKVIACSLSKAAGAAFVKTSTGFGPGGATEADVALMRRVVGDTVGVKASGGIRSAEDAMKMLRAGANRVGASASVAIVSGQTSSAKY

SEQ ID NO: 13733 - protein, 120 aa, Myxococcus xanthus
GSVDDLEHILRNTAVDEVYIAGNTLKQGESMQAAIKLAERFGVPFALPAHSFRLDRARPVERRAVADGFLHFAAVSPKPHQMAMKRLFDICVSAANAVGAAAAVGHGGAGGEVHLQGHLF

SEQ ID NO: 13734 - protein, 127 aa, Myxococcus xanthus
ALKSVHAAAVLDANGHLLAAHEDVGRHNAVDKVVGTLVLAGTVRGPRAPRLPLTRQPVVLAVSGRVSFEIIQKAAMARIPIVAGVSAASSLAVDLALRSGMTLAAFVRNERFNVYTGLERLVAGVTS

SEQ ID NO: 13735 - protein, 899 aa, Myxococcus xanthus
PKALSLIEKLTLRSGGDFAPAIEQIEAMAGEVKDRTAQVDLWLRVGTLRLGRMNDADGALAAFEKAVAADPSRADAASLAAEQLLEKGRAPEAVAVLERYLGTVKDRSTQAGMRLRLADLFLTQLKDADAAREHLEAALKLDPTQALAAFQLARLLAEDDELEAVVPLLDLALLAPRPRPERVAFCEALALMFEEKDDARGAFEVLSRALELDPGRPLLLGTVVEHAEKAQVQPALALALQRAAEAAPVAEVAATIWRQLAQLLQGPLADPSRAEAAWREVLARAPGDAAAVEAVKSLQAAAALADDPKARLEADVARREAAGAAPEDLEPLARQLVQLAPEDAAGVQRLQALCVALSKFDEAAALAGRLAGLAETQLERNEWTARQAKLYAERLGRQEDATDLFLGLLSENVSTGVVVGGLERLAAAGIRTAEVTEALAAHYGRSGDHQRQVAALQQQLEVTTEPTARKRLFSLLASIHEKQLADSRAAFDVQVRALREDAKDEGTRAEALRLARDLSAHAELGRVLRTLASESEDPAVAVPLLLEAASLAEEGALAAEAIAALEAGVTRAPESNAVLQRLVRLYGRAGRSADAEGLLRKRIQGARGQERLELLLQLVDLNSELGRDAQAAEALQSALSHGAEEGRHLPRLAELYEKAGRTRELGDTLARMIALAESAGDADRVARLKLRRAHLLQESQDGSAEAVQSFADILLQRPTDPDALAALEAMLASGSAREAAARVLVPAFERTKDHRKLVATLDVLAEVAKDDAARVQALRHAAQVHLTHLRQPELAFAALARALRLAPGDAGLRSSARQAAEDADSLDSYAEIIAELAEEGDVGSARLALLRELAEVQEKKLDDKAGAVKALRDLLAIEPGNLDCLRALQRLHRAGEEWA

SEQ ID NO: 13736 - protein, 245 aa, Myxococcus xanthus
MHPVLARFLAADAARETLLKQQSGGDLSVEEQAFTDAASANPKHKSVLLGVGGRTLSTDAQASLVLLAAHAAVRALDQDATLAEPTKKAREALAEEGASPEETDAFLASILLEEAFGYEQDVDAFDSEYVKEALGEVPALASLTKEAVDALFLTFVKAAANDAERKVREGMARALFDIAWSEGPAPINPEHMEAVLDAEVVDRPEEEQEAKVQATAQLLQALSKEGLIGPIRLSRLRALLGEDDA

SEQ ID NO: 13737 - protein, 258 aa, Myxococcus xanthus
MRSAVAFLSAFLLFGTGCASLTQGQAGEPDYAAVADENLRLGSEALENKDFFRAQKYFEYVRTKFPYQEAAREAELKLADVDFEREAFPEAKEQYQSFIKLHPTHAKVDYAAFRSAMTHVRAYPSEFFALPPSREKDQGEIRSALVAMEEFLRQYPQSQYVAEAKTQREDARRRLASHELYAAQFYQKRERWKAVAQRLEGLLRRYPGTEYEEEALFDLHDAYVKLNDTEKAQDTLRQVLRRLPGTPAAERAQRMLGS

SEQ ID NO: 13738 - protein, 145 aa, Myxococcus xanthus
MRGRSRRELEQALARKGFTEAVCEAALARVKAWGYLDDERFARERATLLLGRGRLGPEAVAHRLRAHGLEEGTAQQAISEASDAVSFDALATARAVLEKRGLLGRPLGARERARAGRLLDSRGFSEDVIYQLLGEASLDPSGPEE

SEQ ID NO: 13739 - protein, 1039 aa, Myxococcus xanthus
TFTVTDKVGNASALRSSSFTVDTTAPEHAIDSGPAVVTNVATADFVFSSNESPVTYECSLNGAPFTECPAQAQFGPLPDGDYTLTVRAVDAADNEDPTPAEYTWTVDATPPVVVITTPANNSVLDVPVVTYSGTTEAGSTVTVVVDGVPVGTVVADPSGNWSLPVSDTLSEGPHSVSVTAEDEAGNTSTTVTHTFIVDAEPPETTFTSTPPALSNSDSATFDFDSDESPVTYECSLDGAAYVPCSDPATFTGLDDGEHTLAVRAVDEDGNEDPTPASYTWTVDTSAPDTLIISGPPLTEAPGTATFDFDSDESPVTYECSLDGAAYVPCSDPVTFTGLAEGSHTLSVRAVDEAGNVDGTPAIYNWSVAVDTDGDGLTDAEEVVLGTDPENPDTDGDGLPDGIEVNTAGTDPLDDDSDDDGILDGNEDANHNGIVDEGETDPNNWDTDGDLLSDGLELGLAEPQGANTDMTRFVADSDPTTTTDPLNPDTDGGSVRDGIEDANRNGRVDPGETDPLNPADDVDSDGDGIDDATEIAWGLDPNDADSDDDGVPDGIDGITDTDGDGLIDALDPDSDNDGILDGTEMGVTLESAPADTDRTSPNFRPDADPSTTTDPKNPDTDGDGLLDGEEDANHDGRVDSTETDPNNPDTDADGLTDGVEVRGSNPTNPLNPDTDGDGLLDGAEDANRNGSFDNGETDPNNADTDGGGVNDGEEVTGGTNPLDRNDHFVIYGRGCSTSGADTFPPVALLVLGLPLLGRFRRSAGRAGGAPVAAAVLALAVLMVSRPAVAQVPTLSASQSIDVQQYKPGPSSKDILGVQSAQVHSHLGWNVGVSVNYADKPLNFMDPRSGRFITALVRSQVGVDLMGSVGLFDRFELGVLLPVTLQRSQAAPMVDPSFAQGVGSGGIGDLRLVPKARLLEEGSFGLALTVPVVLPTGGGSDFLGGSGVGVQPRLVAEYGERFRVAANVGVDFREKQQLRNLNLGNAVSYGVGAELPFTVSEVPLALAATLVGAVNLEQQDTEERPLELLAALKYRALGGLR

SEQ ID NO: 13740 - protein, 99 aa, Myxococcus xanthus
GQCSTAALLGLLFAQSCSGLYLAVALRWGSAWYVHLVVPYLRSVLAFQPDASLLAQAPFIVQFHTLFGMVVLALALFIRARPEPITAPLLVTPREETAR

SEQ ID NO: 13741 - protein, 132 aa, Myxococcus xanthus
MNCHTQVKTDSPEIQKVAAAVAENKPLAWVRIHRLPDHAYFNHASHVGAGLDCQTCHGPVQEMVRVEQKEPMTMGWCLDCHRDTAAKQVSAPPPSAPRAGELLALSSGAPAPEPLKAPRILQPPTDCSSCHR

SEQ ID NO: 13742 - protein, 279 aa, Myxococcus xanthus
MEKYRLLREALLERGVLTPESLTESTPCPRQDLARVHTPRYLDALSQGTLTDAEQRRLGFPWSPELMRRFSAAVAGTLDAARAALQDGIGGNLSGGTHHGFPDHGEGFCVFNDIAVAIRVLQASRDIRRAVVVDLDVHQGNGTAAVFTGDDSVFTFSMHGENNFPFRKQPSHLDVGLPDGTGDAAYLDALALHLPEVLDSAGACILFFQAGVDPLTEDALGRLSLTHAGLRARDRLVLEAARQRGIPAVLTLGGGYAKPLSATIDAHVGTYEVARALFR

SEQ ID NO: 13743 - protein, 544 aa, Myxococcus xanthus
SDPLPKYWQSLAERAGDLGALAQTQDEFAEPLPVGVAATPPDANSRRDFFKLMGLSAAAAMVACQRAPVQEIIPYVARPDEVTPGLALWYASTCNGCSARCGLLLKTRDGRPIKVEGNDEHPVSRGGVCAVGQASVLSLYDASRARYPTRGATRVSWTDLDADVTQALRKATEAGKGIRVVLPWHLGPTAEAAVKRFLAAYPTARTVRDEALGELSAIADAHRVTHGVHAVPDYRFDKAAVIASFGADFLGTWVSPVAFTRQYAESRDAARRRTMSRHFQVEPVMTLTGAAADRRFVVAPSDVALVLADLVRRLAVKAGREVPGLGSLPPPALDEAARVELADSLWAQRQDALVVAGGDDVATQVLANVANALLGNEGHTVSLADGTALDADALSLGTLLTELRAGSVGAVLFMGANPVYSDPRGAELAALLKDVPLTLSTSDRRDETAVHVGLHAPESTALESWGDAEVRRGVVSLRQPAVAPLHETRSGVESLLQWAGAPQPHYDFLRARWEAEVFPQASGLGQGFIAFWDDALRRGVLRAL

SEQ ID NO: 13744 - protein, 510 aa, Myxococcus xanthus
GKLTYLINQDHNVSFALNGTPTSTGGLGKLSVNPQSGGLRGVLATRRGDFGLTETKANTTSLALKYAGAFADKKVLVDANLGWFHQTASTLPGDGSNLGDRTGLAGYSRMVYTTPRALTLFEALPEGQEGACGSTPEEQLLRCPVTGYGVGGPGFMSDQTLDRYQANAKATYLLNALGTHVFKAGVDVELLSFDQVKAYGGGVFFQEGSNYGVAGQGPAVHDARRYGYQTGPDSAVTQFTQVAKTTSTTVGGFLQDSWSIANRVTLNLGVRYDVQALYGGNGDLSLLLGNQWSPRIGAIVDPFANGRAKVFVNFARYYEQVPLNLMDRAFPGENRISARRSLAEPGQGTATSCDPSSFESQQATCNTDSNLLAIPESSRNVNRFYTGGTVGGTPVDPDIKAQSSDEIVVGAEYEVLANTRLGASYTHKDMNSVIEDMSRDDGNTYFLGNPGSGFAGEFPTPVRNYDNVTVYLNRTFADGWLAQANYTWSRLYGNYPGLFRPETGQLDPNI

SEQ ID NO: 13745 - protein, 493 aa, Myxococcus xanthus
ARGSNFVDRPKGNFVDRPTGLPQGTPSALPASAFTFGSGHVAVRPFAASAARAPVTLTASATPSAKVNDLQTTTSTVSFDQDVKLDSLKLNLDLAHTFKGDLVVKLTSPSGKTETLHNRKGGSADNIKGSFDLAAFKGESTKGTWTLSVEDKARRDTGTLKSWSLDAAGQTTGTGPIEEPKPQLSGPPVIAVFDGGVDFKHSDLDDAMWVNPNEVAGDGIDNDGNGVKDDIYGYNVGYNSGDVMRGSGTDHGTHVAGIIAAEDNGEGNTGVAAGKAKIMSLGGLYNGADLLTNFERGVDYMVKMKTEHGVNIRAVNASFGNEYRDAASVKRWTDAVQKLADADILLVAATANGYGSNLNDVADMPANIDLPNVITVASMDKKNDKLADFSSYGDKVVELAAVGEDVLSTVPGGGWEEMSGTSMATPTVAGAAALMFAENPNLTAAQVRDLLVQTVEVDSDLKGKVSTSGKLDIEAAVAAAKATLEDDTAVAGR

SEQ ID NO: 13746 - protein, 149 aa, Myxococcus xanthus
MDDPLSLDRQICFPLYAAARAMTQAYAPLLSRLGLTYPQYLVLLVLWETDGETVKGMGERLYLDSGTLTPLLKRMESQGLVRRERSAEDARSVRIYLTSEGRALRRKATSIPEAMACKLGLTLEEATRLRRDVQRLFEVLSQSHVDSAK

SEQ ID NO: 13747 - protein, 145 aa, Myxococcus xanthus
MAPVAISPLYSTSATAHGGRNGRVKSEDGVLDLPLAMPKELGGAGGAVTNPEQLFAAGYSACFESALRLVARMQGKNLGNDAGVRATVTIGKTPDGGFGLAVELQGILPGIPNDEAQKLMAAAHEVCPYSKATRGNIDVKVSVAG

SEQ ID NO: 13748 - protein, 428 aa, Myxococcus xanthus
LCAALALGTSCKSVEPHTTPSEDTTAPPEVSTQEPVTETKSETETATEAPTRRGNSPWLRARVGDRVAYSFSANRKAMGRQQPGTVPEAAVAGVVTLEVVAVELPWVWVTLYFTEDGGAPSRRPMLARPLVVPVRADESRALEVPREGKQSTEQLTAAGRHWEAKRYLNDKRMMDGPLENRLYAATPGPLYLTNGLLDASTTLAGFGMGGGSQLTLVEARQGQEGGTGLPPTLARPWGPGTWFDMRMETEGTTSVLRTCQAAERGFILRQQVTPPTSGAACPDFAQAEAVPLEEAVLARIWESLDARQWPPAPEGLAPAKRETLTVGTHRVPVLQFETAQPQANNVRVQAYAADPWEDALAGLAHEGPLPARCSTTSRPVVAARRSRPGACGCRASRRRRLVSRHARACRTARACSGFLSRRPMTWPP

SEQ ID NO: 13749 - protein, 452 aa, Myxococcus xanthus
NDVLKSLTVLDLSGGSVSAVSYDSTKPLEQLLAEATIRIPEDGSLTALLGQIKGARVRVRVGGAQVEGSIIGLDSLAVASGETSLMRPFLSLLVGASLRTFDILDVSELEFLDEAVRKDLEFYLATVLSSYKKDSKRMAILTSGQGERELFVSYVVESPVWKTSYRILLDEGEPPLLQGWALVDNTGDEDWVDVKLSLIAGLPVSFVHDLYNPRYMKRPVVEVTTEAAAAPVIPEESFGSAGDMMMEQEMAAPMMSAMPAAAPMAAPRRSRAEKAMVGGPGRGGPSRREAMETSAAVTTLTKEVGDLFEYGVDRPVTVHRNQSALVPILHKPFEGKRVLLYNRATREKNPMACIELKNTTGLTLEGGPVTVSEDERYVGEAMLDTMKPNDRRFVPYAVELGCVVSIEDRTEDGPVFRVAVNSGMLVAEYFHVRRTMYLSRNKGQRAQVLYVE

SEQ ID NO: 13750 - protein, 530 aa, Myxococcus xanthus
TMTDCGAACLAMVLAYHGRHMGLDAVREVTGPGRDGASAKALKAAAQKLGLRVRAISVDLDRLPFLPPATILHWRFTHYVVFERLGRGWVEVVDPDQGRRRVSMEQFSQCFTGVALLLEPSENFQPGHTRRGPYRYLVPLVKRQAGTLVKVLALSAVLQVLTLAVPLLTGMVVDRVVPRQDYSLMGVLSAALAGVLLFELLTSVVRGQLLVELRTRLDSQMTQGLLDHLVSLAYPFFQLRPAGDLLTRLGSQQAIRELLSTGLLSSALDGALVLLYLGLLLVADASLGLLVVGLGLLQVLVFALPRARQRSHLSRSLDMGVRSQSYLMAMLSGMQTLKAFGVEDRMVGSYSNLYVDLLNVELERGRLSAWLDALTGTLRRVSPLVLLCVGAWRVLDGAMSLGQMLSINALATALLVPLSNLLGTGGQLQFLSTYLERINDVLDTPPERDAAHRGRAPTLRGAITLEDVRFRYNPHSAWVVQGVSVSVEPGQMVALVGRSGAGKSTLAHLLLGLYLPTSGHVRYDGAELGE

SEQ ID NO: 13751 - protein, 71 aa, Myxococcus xanthus
MQPPTDGRPSIFRKEALAHYQRVVQDEGDLLRIGGQWTRWTFALLFVFGLALAMGVLAWPALIAPEGNVPP

SEQ ID NO: 13752 - protein, 69 aa, Myxococcus xanthus
MSKKEHILRAWRDPEYFNSLSSEERAALPANPAAELELSDEVLESISGADSCEQFGSYYCTPCPPYVCM

SEQ ID NO: 13753 - protein, 71 aa, Myxococcus xanthus
MEGPLGARTLTPTLRPVLEALHHVLAGGEVSVQLLQRGNADIVNELNLRAERATEESSSLGTGGDILSATV

SEQ ID NO: 13754 - protein, 261 aa, Myxococcus xanthus
MPIAELNGQGIYFEDSGGNGRPIILGHGFLMDHRMFDAQVAALAPEFRVIRWDARGFGQTRWDGKPFTPWDSAADCVALLDHLGIERAVVGGMSQGGYSALRVALKHPERVRALVLLSTRGTNDDAPTRAAYQQSADIWETQGPIDPLVQGLAQAIIGDTRYFDTWLPRWRQIPGGHFANAIRSLIDRDDISGRLTEIRCPAIVFHGLEDHGMPPVHGEHLHQTLPGSVRFVPVPGAAHAANMTHPEAVNPALLEFLRAHA

SEQ ID NO: 13755 - protein, 71 aa, Myxococcus xanthus
MSQKKDHILRAWRDPEYFNSLSSEERAALPANPAAELELGDDLLEVITGGDFCLPGQSSAQCTPCPPRHCL

SEQ ID NO: 13756 - protein, 124 aa, Myxococcus xanthus
ALDSTLARGFGRNHGLCHGDLGNADFLLEAAATLGDSKLQERTNAVAGGILRGISEHGYLFGLQGSTETPGMMVGLAGIAYGLARLAMPERLPSLLTVAPPRIVRGEGLGTPDGRPSSRNQELS

SEQ ID NO: 13757 - protein, 58 aa, Myxococcus xanthus
WLVTDPVQAQDQLIHFMKNLSMAGGALFIVYFGSGPFSLRRKKAEGLGSGRLGVPLRP

SEQ ID NO: 13758 - protein, 184 aa, Myxococcus xanthus
STVPLGMAIIDRELRFVAANPAYLFVFVSKLDELLGRSVFEAFPDDPSDPNNANLRQLRESFLRVLAKRAPDILALIPYRVPELTNQGVVPTYRYWSATHIPLLDASGEVAYILQHTMDVTELQRLQEAVQSVTGATGTRKPPPSQLEAGVFQRALQVQEANQNLDQERRHLRRLFEQAPGFMC

SEQ ID NO: 13759 - protein, 78 aa, Myxococcus xanthus
MEDYLPWDLKLPPGDRPGGECLYRRESYDVTAAPYEGGIILVSISLDPDACERKGAPYDMGARYAIDSKTWRILAVQR

SEQ ID NO: 13760 - protein, 150 aa, Myxococcus xanthus
MKLPGATDRDYGQEYCGLIYSRGDGIYRVSHPSPLGRWQLRREATKKSCFPVRKVIDPEARSLSILADYHSHPWHPSPLSEPDRRAANQLWLIKIQFDSACHIQKLIPHLDDVDRPGEVYSRRGKQWVRIGLIKPADKPFGFITPVGRED

SEQ ID NO: 13761 - protein, 236 aa, Myxococcus xanthus
MHAEHDGLRIAQLSDVHVGQATSALRIRRAVEAVNEEKPDLVFLTGDYVTHSPKPLPRVRELLAGIEGPVYVVLGNHDHWVNAPYLRESFERMGYTVLQNEHRQVHVKGAPVTVLGVDDGLTGRDDVEATFRGAPVSGTRLVLAHTPPTAEKLPAHAGLVQFSGHTHGGQFVVRGLTEALFRRAGQPYIRGHYHVNGNQLYVNRGLGFGFGGPYLRRGSEPEVAFFTLRQAAVSAG

SEQ ID NO: 13762 - protein, 306 aa, Myxococcus xanthus
GFRMEDLDDPELRIPYAALDGLLERAAELSGDANLGLHIARVDVVDLDDPATFVVLTCATLREAMERGCRYQRVWGDGERFLMEETERGVRMRFTPVGAPRPAHRHLVDAALVQFATGVRAFTGVDVRPLVVRFTHTAPADLREHEALFGCPLEFGAPFNAIEFSHEDAQRPFIHGNALLNAMFQRQAQRALERLPDVSTTTERVRQQVRRELAGGDFSFVAVARALRQPPRTLQRRLAGEGQSYAAIVEALRRELSESYLQRRMSIAEVSFLLGYADPVAFHRAFKRWWGVSPEGFRRERLQAPR

SEQ ID NO: 13763 - protein, 731 aa, Myxococcus xanthus
  unsure (1)..(731): unsure at all Xaa locations
ALKTAARKVPGVVKVLMAEDIPGMNDTGPIRHDEPLLADREVLFHGQIVALVVGESVEACRAGARAVEVEYEPLPAILTVEDAVARSSYHTEPHVIRRGDVDAALDSSPHRLSGTLAIGGQEHFYLETQAAFAERGDDGDITVVSSTQHPSEVQAIISHVLHLPRSRVVVQSPRMGGGFGGKETQGNAPAAFVALAAWHTGRSVRWMLDRDVDMAVTGKRHPFHTAYEVGFDDQGRLLALRVQLVSNGGWSLDLSESILDRALFHLDNAYYVPALAYSGRVAKTHLVSNTAFRGFGGPQGMLVTEEVLARVARAVGLPADEVRERNLYRGTGETNTTHYGQELEDERILRVWEELKKSSEFERRQRDVAAFNAQSPFIKRGLAITPMKFGISFTATFLNQAGALVHVYRDGSVMVSHGGTEMGQGLHTKVLGVVMRELGVTVDAVRMAKTATDKVPNTSATAASSGSDLNGAAVRVACVTLRERLAPVAVRLMSDRHGRSVTPDALLFSDGKVGLRGEPELSLSFADVVEAAYLSRVGLSSTGYYQTPGIGYDKAKGRGRPFLYFSYSAXVCEVEVDRHTGIKRVLRVDLLEDVGDSLNPAVDRGQIEGGFVQGLGWLTGEELRWDANGRLLTHSASTYAVPAFSDAPIDFRVRLLERAHQHNTIHGSKAVGEPPLMLAMSAREALREAVAAFGQAGGDVELASPATHEALFLAIQKRLARAAAEGGREAA

SEQ ID NO: 13764 - protein, 201 aa, Myxococcus xanthus
MRLLFRITPVLLGLALAACSGIRVNTNYDPTAVERIDDFRRYAWLPQPQGKDARVYNDIIDVRVRMAVDQELKARGYQRVDMSEDPDFLVGWQGAINTKVSVDTVDSFYGYPWGPYWSPWSSFYGPYGYPYGMGGPRTYVREYDVGTLILDGVDAREQRLVWRGTAQAELHRNLSPDALQKKINDAVHKMLSRFPPRPEAS

SEQ ID NO: 13765 - protein, 551 aa, Myxococcus xanthus
MSRPAVPGFFRHLWLLWGLRFDIGLNQGPGRSRLLAVAAFAASSAPGLFLGLTFFALMRLRPIAESDVWPYFILNLLCFVTFSVWVTWPLLSAGVDDHSELSRYAAFPISPFRLLIASTVASLFEPRALVFYAPLTGAALGFASVYVLYMPWLAVVLYVLFALLCAAWSRVALYAVINVLRAKHSAEIMGGGLALFLLGASFIPPIDTSWLTAVGEAGVDALDMSLIINAAVALGRVPPGLFGDALAQLAWHRPRAAMFEAAALLFFAGVGMAVAYALLMRFHRQAGRAGGSSKDSGDSNPFATTRTRYTTLVTREALDLWRNPRARLLASVPFILAILLKLLSGRDLFVFLLGGSADAWLMGGLCIYGAVVIASTFSQNTFAYDGQGFAAFLAAPLDLADVLRAKNQVQGAAALGMAAMVALFYRVYFGFGTGLDMLCAMAAVGAVVPMLLAAGNFLSLYFPVKFHASLKRRDKVPLTASMLGILAASAGCMPFGWALKLAGKEGPTWHTAAMILLAAALNVALYRGVLPLALRLLERRREVVLQAVTRE

SEQ ID NO: 13766 - protein, 168 aa, Myxococcus xanthus
MEGMMDLHHFPFAHRRYVPPGYTRLDPYEVHVDAGAIRTVGWLRKETRPPGTGFRFAIDVGYPGVLHLRFTPRLVAAVVCTPVDAEHTWIAARFHQQYVRLPGLRWLAARLAIAFEFRFIQPDDYRMVRSSLPRSGALTHGTLIRADRAIVAWHELHRAALGDTPGAS

SEQ ID NO: 13767 - protein, 102 aa, Myxococcus xanthus
MSQARTHPKLQAAWLRFEGPLVAWFQRVLADGRALGAVRGDVPESLLLTSLMGIGQVTDGWLLEQWAHSGVPALQRGAEQVFSLFEDLLVPRPVGPPPAKRR

SEQ ID NO: 13768 - protein, 93 aa, Myxococcus xanthus
RNLFPWRAGPSIIWRMPPPSWTSPVPRNVQRRVRALVFVTVFLDLVGFGLIIPLLPFYVESMGGTATTAGVLLALFSFAQLVASPVWGGCRPG

SEQ ID NO: 13769 - protein, 113 aa, Myxococcus xanthus
DEAAIEAKGVAPLKPELERIAAIGQRKQLATVLGATLRADVDALNMGDVTTDRLFGLWVAEDLNEPSRYAPYLLQGGLWLPDRDYYLVDNPRFTELRKSYQAHIASMLRWPAS

SEQ ID NO: 13770 - protein, 572 aa, Myxococcus xanthus
LAWLEQQRVDVLDCTPAQLTLLLQAGLLERAHVPSRILCAGEAMDPSLWSRLANTERTTAFNAYGPTESTVYATYARVQHSPSPVPVIGKPLAGTRAFVLDARQQLAPLGTAGELYLAGDGLARGYLGQPGLTAERFVPHPFASTPGERLYRTGDKARWRHDGTLEYLGRLDFQVKLRGFRIELGEIEAALRAHEAVQDAVVLAREDVPGDKRLVAYIVGGSATVEALRQHLQQRLPEYMVPPAFVSLPALPLNPSGKVDRKALPSPTLADTRSQEAHVAPRDGLELRLVRTWEQLLGVEPISVRSSFFELGGHSLLAVRLVAALRESLGRPLPLSALFQAPTVEQLAALLRREDAGPTSSLVPFDAGRSGTEVPFFCVHPVGGNVLAYAELARLLGPERPFYGLQAQGLDGSTPPLGTVEEMAAAYVEAIRTVQPAGPYLLGGWSVGGVIAYEMARQLRERGDTVALLALIDAYTPAVLNAAEPEPDAAQVVSAFASDLLGIGFTDLATPDASLSPEAQVEALWEAGQRAGALPPGMEPAHLRALLQVFEANLWAGRRYQPPALNPGRVLR

SEQ ID NO: 13771 - protein, 624 aa, Myxococcus xanthus
MSGASRSLKVDGKVLEGISRGPLPASRKVYVPGVLHPDLRVPLREISQTPTRLGHGPDAKETANPPVHVYDSSGPYTDPAAELDLRQGLPALRESWILGRNDTEALSGVSSEYGRAREADPRLAGLRFAHRRSPRVAKSGANVTQLHYARKGIITPEMEYVALRENLQVEASLAAQHPGQSWGAAIPRVITPEFVRDEIARGRAIIPANINHPELEPMIIGRNFLVKINANIGNSAVTSSIEEEVEKMVWSIRWGADTVMDLSTGRNIHETREWILRNAPVPIGTVPIYQALEKVGGKAEDLTWELYRDTLIEQCEQGVDYFTIHAGVLLRYVPWTAKRLTGIVSRGGSIMAKWCLAHHRENCLSTQFEEICEIMKAYDVSFSLGDGLRPGSIADANDAAHFGELETLGELTQIAWKHDVQVMIEGPGHVPMHLIQENMTKQLAVCGEAPFYTLGPLTTDIAPGYDHFTSGIGAAMIGWFGTAMLCYVTPKEHLGLPDRDDVKEGVITYKIAAHAADLAKGHPGAQARDNALSKARFEFRWEDQFNLSLDPERARAFHDETLPAEGAKVAHFCSMCGPQFCSMKITQEVRDFAAKQGVSDDTALQSALDEKSAEFKKAGSQLYR

SEQ ID NO: 13772 - protein, 105 aa, Myxococcus xanthus
GLLAHMGTILANFVGLGFAVPLVLMLTKGKESSFVRAHAVESLNFQITVFIAAFVSAITVCIGIGAVLLPIVGIVAIVFAIIAGLKANEGQLYKYPVNIRLGEVV

SEQ ID NO: 13773 - protein, 108 aa, Myxococcus xanthus
HWALAGSGLKAGDTLWMANGYEVDQLVSNGSSPEGLEVLAESPLLSLQGAFGFGHMVLRKQGSAYVFSSGGIDFVRTLASEDMADPRAARIVANVLYKALGRPVPDTL

SEQ ID NO: 13774 - protein, 145 aa, Myxococcus xanthus
MRGALKRNMPLLGICGGMQLLNVILGGTLYQDIGREVEGAREHEQKHDRTHPQHPVDVKSGTLLAEAVGYGQLMVNSTHHQSVRGVGKDVTITAVAPDGVVEAIESSVHTFAVGVQWHPEYMSTTIPVHVGLYKAFVQKAREHRR

SEQ ID NO: 13775 - protein, 59 aa, Myxococcus xanthus
MVPARAQLEAAQRALEDTGAWWVVDPVVRTSRGEPLTRLSARAYLSLAGPARGAHAEPG

SEQ ID NO: 13776 - protein, 195 aa, Myxococcus xanthus
MEVKRRVGVVPEELSLFERLTGRQYLTFCARMYGLDGDEAAARATELLELTELTYKAGALVAEYSKGMRRRLAIAAALIHAPELVLLDEPFEGIDVLAAGVIRELLRELSRRGVTLLLTTHVLEIAERLATHAGIIRGGRMLDQGPVGSLLSRYECPSLEAVFEKLISVPASRNARLSFYGEAPASVTPLRQETA

SEQ ID NO: 13777 - protein, 60 aa, Myxococcus xanthus
MFIHRETSDEAGPDGHSAQQFNTVIPVELIIAKQRNGPIGSIDLVFLAEYTRFESRSRSE

SEQ ID NO: 13778 - protein, 360 aa, Myxococcus xanthus
MLSASGQDRSPSIRAVGRALPPHYASQEELIAAFRELWATRHFNLERLEDLHRAVQVGGRHLALPLEAYPPLLTFQQRNDAWIRSATELGETVVRKALDAAELTPGEVDHVFFVTVTGIATPSIDARLANRMRFREDFKRTPLFGLGCVAGAAGVARAADYLRGFPEHTAVVIAVELCSLTLQREDLSIPNIIASGLFGDGAACAVLRGAAAPGARGPRVVASRSVFYPDTERIMGWDVVDTGFKVVLSAKVPGLVKDHIRGNVDGFLAQHGLKRGDIRHWVAHTGGPKVLEAFEEALELAPSALERSWASLREVGNLSSASVLFVLGETLESVRAQPGEWGVMMAMGPGFGAEMVLLRW

SEQ ID NO: 13779 - protein, 44 aa, Myxococcus xanthus
VTSTHALFLGFMAALVVERLVELVLSKRNAARAFARGGVETLEH

SEQ ID NO: 13780 - protein, 142 aa, Myxococcus xanthus
MKVPVTATGRPLDFSTAGISATPIVHVKVATRLSELAPDDVQFIPVDVEGQPDQYLILVATKLIRCIDPNASREVRYWKPEHGQPERVGEYRSVAGLRIDPGLVGSAKLFRTWGWDIALIVSEDLKVAIEQEQTTGARFTEV

SEQ ID NO: 13781 - protein, 56 aa, Myxococcus xanthus
DTFGYDGLHIDWEPVEAADKPNLLALVKELRAAKPNMLLTFPIGWLNSNFASDALV

SEQ ID NO: 13782 - protein, 31 aa, Myxococcus xanthus
MVLVYGLVVAPVLHAVVEHGDGGHHHSHAHL

SEQ ID NO: 13783 - protein, 72 aa, Myxococcus xanthus
ACGSEQEPKACPGTEGASQLPTVVSAARSEAALTDDGGDDVIIAFRQRVFASAQANTDAFANEVTRAAGQGS

SEQ ID NO: 13784 - protein, 125 aa, Myxococcus xanthus
MSHILVVDDDASHRTLICDALEEMGYPTVQAANGREALDLLEGDMPSAVLLDLRMPVMSGWGLLDALKKMPRARGLPIIIISGYGFEWEAELVGAAGYISKPVDLDKVRMTVQQIAGPPEMSLVH

SEQ ID NO: 13785 - protein, 428 aa, Myxococcus xanthus
MLYDALSLFRNVKGYRRLNARQVHAAEPGLRTDHLKGGARYYDAATDDARLTLANAVGASEAGAVVLNHASVKALVLEQGQAHGATVVDHLTGEEVTVRARALVNATGPWSDEIRRLDAPNGASPAVRGSKGVHLAVPRERINHRDAFTLLSPKDGRVMFVLPADNFTIIGTTETSTRAHPAEVRASESDVAYLLESANAFFPEARLTRADVVSAWAGIRPLVASGYHGTQADAGSASREHAIDVSPSGVLAISGGKLTTYRVMARDVVDAVERRLGQPRRRSPTDVLPLPGGDIRALDAEFAAARTEVGDDATAVHLVRAYGSRWRRVWALTREDAALSRPLAEGLPYRAAEAAWGVTHELVHTLSDLLIRRLKVAFETRDQGQAAARVAAEVMAPRLGWDAAETQRQLDVYAADALRLFGVDPAEA

SEQ ID NO: 13786 - protein, 1093 aa, Myxococcus xanthus
DWYYNAGFDEASGNAQMQNFGRGGIEGDPLRVEGQDYNGRNNANMATPADGISPRMQMYVFDGMPLLQVTAPASLARAYVNGDSRFGAQEYTLDGPVQVLAPTGRTLGCTPFEAGTFAGHVALLDRGACDFVTKALNAQDAGAIAVLVANTNAGEGPLSMSGDDARVTVPVASISRETADLWKAEVAANASTVQVRLHRSKDLDRDGTLDNTIIAHEWGHYISNRLIGNASGLTNNQGRSMGEGWADVHALLMVVREGDDYARGAYAVGGYVSGGGGGDGYYYGVRRAPYATAPTLASSRNALTFRHIENGNPLPTSHPLAYGQAGLGNSAVHSSGEVWASMLWECYVSLLQAHPFQEAQDRMKHYLVAGYKATPVSPTFLEARDALLAVTAASDPADYQRFLQAFAKRGAGMGAKAPDRDSMDHVGVVESFAAGNFIEVTSLRLDDALEGCDKDGVLDVGETGLLRVSVRNVGSGSLGAFSGTVSTTSSTATLEFPSGNTLTFSSMGRGGTATATLPVRLAAAQPNAHAGLRITFDEPSLPASASSTTFDPRVNYDEVPGAAAEDDFEGALSSWTSSTWLNPYGEADWKVQGPEGGRYMHAPNPAVQADLFLISPWMKVNETGAFSFSFRYRHSFESDIYPGGSIFPYYDGAVLEFTHDGLQWYDIAAMGVASIYSIDPTDGSPGYIEQGPNPLMYRNAWVGQNVTQENGKTVRFPEWSTAELRLADMFAGKNVQFRFRIGTDTAVGAYGFDLDDVRFTNVERMPFSGRVDEQGDGATCNQRPVANAGRDVGSPSAPVYERVRNPETGALELVRHTLDGTASYDPEGQPLTYHWTQVSGPAVTLVNADTATPSFTADVPDDSILTFQLVVRDGLETSAAHQVRAWVLNVNRAPTAVVTAPAEVAEFSSEPVTLDARASSDPDGELISYKWAQTSGPAVALKAGSSATPSFKVPEVAVDTQFTFTLVVNHCRDQSKTATVTVMVRNVDRAPVADAGSEQVVDPLATASLSATAGGPGRGCPHLYVASGGGPRGGAAGSRHGHPVVHRPRGAGGDGAALRGHRQRERAVQRPDDGDGDGAARQQGAPGPSAAGG

SEQ ID NO: 13787 - protein, 141 aa, Myxococcus xanthus
MTATVTVRHANKAPQALPRLVGDARSGAQVTLDASASSDPDGDALTFGWKQVAGPSVTLSASEGAQVTFRAPEVKQAVTLHFELTATDARGGASTAVLGVTVQPSSSGSSGGCSSTGGSSPGLLLSLFGLLVGAVRTRRRA

SEQ ID NO: 13788 - protein, 134 aa, Myxococcus xanthus
MRALDFREDEDDETVGSIVIRRNCVERPVTPEELERLFQQKADVDHVAVLHSERLEALVLRRATATKGAAQVAPLIVEDRMALTTLARLAMERAPEALYDPVVVTDAQKRFLGTVTMQQLIRRITELLERRTPA

SEQ ID NO: 13789 - protein, 259 aa, Myxococcus xanthus
ALRATPALLGAGVAGGILGLFVGLSAVAAHLALSADPVEARVEALLPQLAGDFHALTERALNLYRQCGQSLAMLPREPAREELARTLGKMTRDAAELASEWAGVEAQIEERAQADLQAEREDLERSARASTDAIARRQLELAAASLGEEVERLGGLKQRRERILARLRAEVAQLERARVALLSLRSGQAQLKAAELSALARRFRALSSLQREEAQSMEDVSSMIQGASMHSSPLEVRQAEGEESPASGPASEQPRVGES

SEQ ID NO: 13790 - protein, 144 aa, Myxococcus xanthus
RDKPPAEPPSSEVTPEKTYLRRRELLKNAGLFAGTAVAVAGGLHLLGRKQTRPMERFVPDAGLVEQPVAQAMGPFDTDEPRTPYEDVTTYNNFYEFGFDKNDPARFAHTLKPKPWSVVIDGEVHKPRTVDVEQLTSWFSRRTLE

SEQ ID NO: 13791 - protein, 129 aa, Myxococcus xanthus
MARYTTLPQLGVMAAKFNVLLFLGVSQPHILGYWVLPSVLGTLQLFYFGTYLPHRRPETPDMAPHHARTLPRNHLWALLSCFFFGYHWEHHESPGTPWWRLWRLKDARAREAALTQSTGTLPGQEGTAR

SEQ ID NO: 13792 - protein, 518 aa, Myxococcus xanthus
LRVDLKALPESERRALARIVQASKLMDTLFLRQRWAGNEPLLLDLVQDTTPLGRARLQAFLLDKGPWNSLDEARPFIPGVPAKPASANFYPAGATQAEVEAWVKSLPEAQQKEATGFYTTIRRGTDGRFITVPYSVEYQGELALAAALLREAAALTQQPTLKAFLTSRADAFLSNDYYASEVAWMELDASIEPTIGPYEVYEDEWFNYKAAFEAFVGLRDDAETQKLAKFSGQLQGLENNLPIDPKLRNPKLGALAPIRVINSLFSSGDGNRGVQTAAFNLPNDERVSEKMGSKRVMLKNVQEAKFERVLLPIAKVALTPADQKDVSFDAFFTHILRHEVRPGLGPSNFAVGGKATTVRKELQSASSAIEEAKADISGLWALQRLVDTGVIDKSLERTMYTTFLASAFRSIRFGVDEAHGKGIAVQLNYFLDTGAVKVNADGTFSVVPAKMKKAVISLTKQLMEIQGRGDRKAAEALLAKLGVVRPPVQRVLERLKDVPVDIEPRYVTAEELVRDVKK

SEQ ID NO: 13793 - protein, 210 aa, Myxococcus xanthus
MARALNAYVAEVAREEPRVLGLATVLPGEPDATAVLEEAFDAGLRGVKIHCHVQCFSPDAPHLHEVYAACAKAGRPLVMHAGREPSSPHYNCDTYALCAAERVERVLKDHPTLKLCVPHLGADEFDAYARLLERHDNLWLDTTMALAGYFPVPIPRRALEVRPERIIYGTDFPNIPYAWDRELRTMLGMKLDDAVLAGILGQNALQLYGA

SEQ ID NO: 13794 - protein, 147 aa, Myxococcus xanthus
TPLGWLGLTAARRKLVRGLSGHVLEVGTGTGLALPGYPDTVTAVTAIDVDEAALARAQRRRPDARLLYASVESLPFPTASFDAVVSSLVFCSVEAPAQALTEIFRVLRPGGALRMLEHVRAPSPALATVQDLLTPAWMRVSGRCRLD

SEQ ID NO: 13795 - protein, 55 aa, Myxococcus xanthus
MAYVDARYFGLTPAQYGCIALALYGIWGVLRPQAPGAASSPPPSSPKSPGTVGVR

SEQ ID NO: 13796 - protein, 463 aa, Myxococcus xanthus
DIKQAALRGVDSFGMLCSSKELGLSEESSGLLILPADTRVGTPIAEAVGLDGVVLEVNVTPNRPDALSHLGVAREVSVVTGSALKVPQPKPAESGTPAAEQVKVRVEAPDRCPRYVARVVENVKIGPSPQWMQDRLKAAGVRAINNVVDVTNYVNLEYGQPLHAFDLEKLAGQEIVVRTATRGEKLKTLDGKDRVLDVDDLVIADKDRAQAIAGVMGGGDSEVTEGTRRLVLESANFQGSTVRRSSKRHGLHTEASHRFERGADMDAVVPAIDRAAQLIAELAGGTVAPGRVDVYPAPKPPRKVTLRFARVEQVLGVAVAEKEVRRILEALGFKAVEEGTGQATYEVPRARVDVEREEDLLEEVARIYGYDNIPATLPRGLATLAPEPANAEAERRMRQALAGAGFDEVVNYSFVAPRSLEVLGGAEKPVALLNPLSTEQSVMRTNLLPGLLENLSRSVRHQV

SEQ ID NO: 13797 - protein, 157 aa, Myxococcus xanthus
MSVYTGSFNNMAAGKQVAQDLISKGADVLFHAAGADGIGVIQAVKEARAAGKSVYAIGVDSDQSHVAPDAILTSMMKYSDLAVYQAAKDLVDGTFSAGEQVLGLKENGVGMAEVRVDFPGKAEALQKVEALRQRIISGTIQVPAVPADLASFQAAAP

SEQ ID NO: 13798 - protein, 117 aa, Myxococcus xanthus
LVPTLSVAENVVLGREPTRNGLLDLERAVQDVSATCARFGFQLEPRARVDTLSVGSQQKVEIVKALHRGAQVLILDEPTAVLTPQESDELARVMRGLVAQGHTVVLISHKLKEVLGV

SEQ ID NO: 13799 - protein, 259 aa, Myxococcus xanthus
AAMCMAIFFRGMDSRELGAWARAMLESGEVLDLSDTPGVKVDKHSTGGVGDKVSLSLAPLAAACGVPVPMISGRGLGHTGGTLDKLESIPGFNVNLPTSEYRRLVREVNCCLIGQTAQVAPADKKLYALRDVTATVDCIPLIASSIMSKKLAEGIDALVLDVKVGSGAFMKRDEDARTLAKTMIGLGAEMGKKVVALLTDMDQPLGRKVGNALEVIEAVDMLRGNAPEDYTEVTYALPAEMLVLGKKTAPVEEEREKVR

SEQ ID NO: 13800 - protein, 277 aa, Myxococcus xanthus
QALHSGSDVHSFLNQVCGQAYASIYQPPRERWPAVRDFFRREFPATLRRERGFVGASAVLFILGILLGALVVLWEPRGAELLVPSGVRHYVAQGRMWTDDILSVAPPNSVASGIATNNLTVTIVTFALGLTGGLGTLFLLVNNGVHIGAISALCAREGMLGGLLDFIAAHGPVELSILVIAGGAGLMVGQALIDPGELPRGQALAVRGREAVKLVLGCAPFLALIGVVEGYVSPGDMFPTWLKAGLGLVLGALFWAYLLRAGRTEAEATGAPADSAS

SEQ ID NO: 13801 - protein, 26 aa, Myxococcus xanthus
MDDAALLRGLLGAVRPAPEEIRAIAI

SEQ ID NO: 13802 - protein, 75 aa, Myxococcus xanthus
MKLPGLFRKERTTIQAADAQDHAERLLAESLRMLGQVCAKVADAIEAQRLSRQGYPHNTYLRRTDGDEDDTAKKA

SEQ ID NO: 13803 - protein, 175 aa, Myxococcus xanthus
MKITPLDIRQKRFETALRGFSRREVEAYLELIAGEFEEVVKENIALKEEVKRTQFKVEQHQERERTLQETMVTAQRISEDLKDAAKKEAEIIIADAEHQAEKIVHGAHQRLVQVVEDINELKRQRTQFESQVRSVLDAHQKLLETFKSPTFADRDYARVEDNVAYLSQKKANGDS

SEQ ID NO: 13804 - protein, 164 aa, Myxococcus xanthus
MAALVDGVAHGEPFETAFGKAFRTSLLVEETDWREGLAARYGWLPLTTSSALVWLSASFLCVAAYARRRQQRAAKLAEMAAQDAAEDAALRLLAAQAAQAQAQGTAVSAGDSTWPDWPAGSQGTEAHLEAQDSEAPADSAISDLPGELDDEDGLNGRPPKPTLH

SEQ ID NO: 13805 - protein, 118 aa, Myxococcus xanthus
VLAAPDSDASRGAPTQLDNLVEPFIRELGRTLAGEESSPWSRTRAVLRLSAHRGARSLYDEFAALRRCLVDASEVLGGGDWERERINRAVDEAVDSAVALLPRMKDPRADGPRVPIGL

SEQ ID NO: 13806 - protein, 40 aa, Myxococcus xanthus
MRELNAAYERILRHRQRKRQEALSAGAPVASASVLPARSR

SEQ ID NO: 13807 - protein, 96 aa, Myxococcus xanthus
NTRESLAMGETHEAGWPLSAAQHGIWVGQQFDLTSAIYNAGECIEIRGPLVVEHFESALRQAIDEAEALHARFVPGASGPVQFVQPRASWQLHVAD

SEQ ID NO: 13808 - protein, 299 aa, Myxococcus xanthus
MALPAIAPYPMPGTTDLPKNKVSWTPDPSRAVLLIHDMQRYFVEAFTQGQSPVTELVANIQRLRQHCTALGIPVVYSAQPGGQTPEQRGLLLDFWGGGINGGPDQKRIIDALTPAEGDIQLTKWRYSAFRKTDLMDQMKKLGRDQILISGIYAHIGCLQTASDAFMSDVRPFLIADALGDFSLAHHQLALSYAAQLCAVTTTTQQVLDALGPVSTSSTLTREQVRAEVAELLQESPEALGDDDNLLERGMDSIRLMTLVEKWRAAGAETTFVELAERPTLADWFTLLSLGNTPASRNAA

SEQ ID NO: 13809 - protein, 228 aa, Myxococcus xanthus
MRVKPTLGCTLQQVFGMAEGLVNYTRLDDPEDVIVSTQGRPISPDDEIRVVDEDGEDVAPGETGQLLTRGPYTIRGYYKAEAHNAKAFTDDGFYHTGDVVRVTPQGYLVVEGRAKDQINRGGDKVAAEEVENHLLAHPDVHDAAVVAVPDAFLGERTCAFVIARGTPPAPNVLTAFLRQRGLAAFKIPDRVEFVEAFPKTGVGKVSKKALRDVLAGAPSPTPVSRATR

SEQ ID NO: 13810 - protein, 334 aa, Myxococcus xanthus
PLAVGAVPFDGSVPAQLVVPLSLLLAGPLVFDKDVPVQRPFSASYTVQPVPEPAAYLNGVAQALKLMQSGPLQKVVLSRSLHLNAAAPIDLRQLLRNLAQRNPSGYTFAADLPQQDGTRGAGLRTLIGASPELLVSRSGFQVVANPLAGSAARSADPLEDQERAAALLKSPKDLHEHAVVIDAVAEALRPYCKTLNVPAGPSLVNTATMWHLSSRITGELADPSISSLTLAAAMHPTPAVCGYPTRLAHEAIGSIEPFERGYYTGTVGWCDATGDGQWAVTIRCAEASERTLRIFAGAGIVVGSTPESELAETEAKFRTMLHAMGLGHGAGVQS

SEQ ID NO: 13811 - protein, 224 aa, Myxococcus xanthus
PVRREFLDLFHHRLLSLLYRIESKYRVTSETDTSFSDQWSRRLLALGGFDTYEKALEGTLPTWRLLRIAPLLASRARTSEQLEVALEDVLGDDLEGARVSVRQFVGRWVDIDARARLGHSNHQLGRNMLLGGKAFDRTGKIQIHIRPLPPRAYKRLMQEGDLLPLVREVVALFVRDPLEYDLELGLTEGVQHQFRLSSREPSQLGRDTWLGLSQQTQMSVPVVK

SEQ ID NO: 13812 - protein, 398 aa, Myxococcus xanthus
CSKDWAAYASEDKMVRHQHVAEDFIEQLATATTTRVQDDYTALLERKRRDVPGASHVEPWEQTYLKEQVRAERYRFDSRDLRPYFEYTRVKQGVLDITSRLFGLTYRRVPDAPVWHPDIEAWDIYEGPTRLGRFYLDMHPRPNKYAHPAQWDLATGRAGRTLPEGVLTGNFPRPGAHPALLQHSQVQTFFHEFGHLLHHVLGGRTRWAGLSGSRTERDFVEAPAQVLEEWAWRPESLQTFARHVVTGELLPTETILRMRRADAFGKGLWLRQQLFYAAVSLQLHASDPAGVDTTARVNALQERYMPFPAVDDTYAHLSFVQLDGYYSSAYYAYLWSLVIARDLLTPFLEHGLMDTSTAQRYRDAVLGPGGSRDAADLVRSFLGRDYGFEAYTRWLDDA

SEQ ID NO: 13813 - protein, 250 aa, Myxococcus xanthus
AVPMSSAVPHRYSPPVLTLTAHPRWLESMLESVRDEWNAACWPPLFRATADGQRPPLRHWRRVLSHFFLIVESFPKYMGLSLAKTTYGQRPGDASARRWLLQNLGVEAKHAEWFIDWMRGIGLAPEDVFTQRPLPEVRALHEFLLDTCAHGTLAEGVAASNWAVEGITGVWTREVVEPFRAYAEDGARIDAYSMMWLKVHARYDDQHPEEALEIIKLSTDAGTGEPFRVQAAARKSLQMYAAALHACCND

SEQ ID NO: 13814 - protein, 596 aa, Myxococcus xanthus
MNAEDKVIQEYRGRALKVFMLWVLPVAPIAAYLNGMAMGVAGWSGLIAVAWVLPPIIVGLGIAYPAFVMHVLVNGALRERPEDTPGARLERILRLPWRAAVASSWGACTLGGLWFSLHVCLLWKKDLSLVVVGTLIGICFGVVQGFPISVTLERLLLPLALEEQRKDPTMALKGGGFFWPRQAWFMPVTFIGSSICALVLSGCVVLVKLQGVRNELHNALVAEGAHGSAETLMGMGGMLAGELAFGLAWVGGLLAIPAVTTWMLARRQAHAAGAVGVAIESLSAGRVVSPAWVSTDEMGDLSAGMNAVLVRLRQLPLALNASATRLSGAGRHLRDSHDEHQQSLVRQASALHEAQMTSEEIRRTSLMAVERAEEVLQVARRSEALGQQGESAVERSLNGLADIRRVVDGIQERLTRLAQSTTQIGEITETVKDLADQSHLLAVNAAIEAARSGEQGRGFAVVAREIRGLSDQSIQATRRIRGILQDISTGIRDAAKMGEAGVQTIGTGLDQMRASGDSLRELSRIAQENSTAARQIAAAVTQQDAGFTQIFDAIADLSQLMDATLKRLESTQEATDTLRVVSDDVARMARQFNATG

SEQ ID NO: 13815 - protein, 370 aa, Myxococcus xanthus
RKCPELAPDRLELPRVSAGERAASQVLFTGSDGQRYKTGYAPILYEGRVVGAVGVEASAAFFGPLQRLSRTYAIMGAVALSALAVIALVTARGLARPLRRLMASALRIGRGDLTTPVPPEPTLEIGVLARELEDMRGALESRDRQLKMMLAGVAHEVRNPIGGIALFSGILKEDLQAGAHADAGAHVERIQREVAYLQRIVEDFLAFAREQPLARAPVEAPTLLSVACELMTTEASARDVVVDIDASPAVLEADGSLLTAALVNLVKNAVQASPPGGRVQVSGASKDGHYTIQVRDTGPGVPGTARERIFEPFFTTREKGTGLGLPLAHKIALAHGGALRLDSAPGDTRFILTLPLGGKPGHGVSVTPSR

SEQ ID NO: 13816 - protein, 45 aa, Myxococcus xanthus
DVSAGKKGGKAAKEDLEATVKERIAPRKRAPTEDTLGFARRLSPI

SEQ ID NO: 13817 - protein, 63 aa, Myxococcus xanthus
SSDEKWLVASVKEIEGAVQAALEIAETGLRTYTCAAFLLTSDDRSLKLYDCRSGSERVQRERF

SEQ ID NO: 13818 - protein, 93 aa, Myxococcus xanthus
MTARRKFLLVAVGVAAALSLVSVVDAKGFRRYLSLRQDVESVQARNRSLSAQNEALRNEIAALRKDPAALERAVREELGFVKPGELVFHLESP

SEQ ID NO: 13819 - protein, 171 aa, Myxococcus xanthus
MSRVLLRGAVVALVALAGCRGTRPVDAGYAFLNALALPSVGPTPHDVRALDGKVVLVSFFATWCFPCLAEMPTLEALQKDYGPRGFQVVAVGMDLEGEKVLAPFADHYALRYPVLVANQAMIEGHSAFGAIQGLPTTVLLDRRGRAVAGWHGVESHADMAKAVEKLLAQPE

SEQ ID NO: 13820 - protein, 139 aa, Myxococcus xanthus
MAQHGLKSTRQRSLIIDTFFAVGGHLSVEELWNKVREQDTKVSVATVYRTMKLLSECGLAHARNFGDGQTRYEAAAGRDHHDHLVCTRCGTIIEFENERIEALQDAVARKHGFKVTSHKMELYGLCRDCQRAGSAASEA

SEQ ID NO: 13821 - protein, 181 aa, Myxococcus xanthus
MGYIPVLAPSMGLAWRSRGVPVLDFTKAGWLLPLLTETVAFEAGAPAPSAPPLGSGRARARAYLRRTLRASGLLYGTPADAPSAADVAQPTELQALHAWRGPRPAIFAGFNGHLRDDTMRSGLKRNWAAFAVGGLLGAWVLGCGGSTTEGLESLEQGTAPPPSVSVDLSSVDLRTRLESAP

SEQ ID NO: 13822 - protein, 994 aa, Myxococcus xanthus
LKINPATRANELVFLTTDWERQKAIHYLWQDPATTLWQEETIPLYSSDKVQEVNSYSTRLSFRVNGQPPAARLPLTLTSASYQSLLINGLKYTVDAGASVEVSTNVTGELDIIQQIQDLAVSTFTLTSSAFTDTLRINPASNVYKKLAAVRTGADIPVLPPTLPEGVTADQIASAIAQMMAFQPEQSYPTEVISVVGPTPQAKSGAHMARPPHAFALSFGPQGLLRYHSGAEASQLKRVGDVGEWIVDTVGDVVQFIGNVVDQIGHMLFEVAETVIKITLNVAGRVIKFVIQSFEQLFAFLTALFKALKVGMEKLIGWLGELFGWDDIWATHLVIAKTLTGALDALSKEVQEDSARLKKKMARIIAEQLGFARENFASMKVPASVASMVPSEMAAATQQSHPGINFDTPIASWSSYQTQYSGMLLGGGPVGDLPAPVQKFIDDVLIPTSFVLVKAIEEDWENLKAVFTGEGKTVEHIVTFLQGLAKTIIDTLEILLLGCVDYLLDLVPWVVSLLTEPVNIPFLSGFYTWLTSALGKGEAPPEELSAVNLMSLLVAVPYTYLYKLANDGQAPILWGSAGPLDEHDAGGHGRGREQEGGQHRGTALFGDWRGNRFDCWLARIADGLRASQRGCGTAERSAWQVPAGLQPDHGGDCRRIQLPHPKLRDAGHCVPDAAPRVGREPPASGLHGASHQLRRGAWHDQGMLRRWHRRHRHQQRHPRLSAQLDLVQRRLLQPGRRHHRRQHGDCGGPARGRGHHHCRHGPVLSGRQSGGSHHRALDEHRQGGSPLLPELGRLSRLQPRVEERHQGVPMALLARGGVGPHVARHPAMLRGEGTKALGAEGRASFVAKPLADLVVRQQPEGAFGDAFQVHAAHGLAVQRAHGKAHRAEHPLHLVVPAFRERHLHRVLVPHVHLRGAGGAIIQRHAPAQRLHPLVARGAEDGGHVPLGQVRVRGRGVGHQLVVVGEEQQARGIHVQAAHGVPRVSSQLRRELGQQ

SEQ ID NO: 13823 - protein, 68 aa, Myxococcus xanthus
RERTRPVVQSGADQVDMLEAVAPGQFVRPRGEDAREGQVLLARCTPLGIPELGLLWAQGRQAVPVFRV

SEQ ID NO: 13824 - protein, 300 aa, Myxococcus xanthus
AREGDLVKVHLGIGAQMLDPDRGLHGQVAGSLGKAGTPSAEVLGVAYSQGFSEQFPPEVMAQADPYLVTVTEEEVPDEHRLDLRAIPLITIDGEDARDFDDAVCVEDRADGWRLVVAIADVTHYVWEGSALNAEALRRATSVYLPDRVLPMLPERLSNGICSLRPDEDRLCMVADMTFDRRGHRRSYDLYPAVMRSVARCTYNEVQDVLDGKDVPHRNAHKPHFERLMSLARALMKMRKERGAIDFDLPEHKVVLDEDGLPARMDKRERKDSHRLIEECMLAANEAVATFFQNEGLPTVY

SEQ ID NO: 13825 - protein, 459 aa, Myxococcus xanthus
MAKPKSGAKKTTPAGKAGAKPAAKKDSAARLDLIKNASKRAAKAATKLAKAASDVTKGAKSAVKKAVQEKATAKKAAPAGKTASAAKAAPPAAKTPKAPPAKAPPAAKSAASAKAAKASAVPAAPPVEKPRPRATKLPPPGEPLTKREMEQLLTAGEGRGVTGEGSLKGRLVVTNDMPHLVVVGRDKRELTFLLQGPDQEVLPAYVDHKVSVSGLIRKTTNHAGVVDVRKYSAKKPDAEVVEAAPAETEARLRYLSPGEVSMVTAAGMGAGIKGFAGVRGNLEMTGEEFVLVVSNGGTRQQVSFIIEGKAAGKALRKHVGYTLQVQGVVDKTSGWGGRIMAENVELRPSEARAVSRDEMELVHIEGEVPTSVDVRLNHGLTVRLPEHPGFTWAIEPTVAKRVGLREANFEPAPEDGPGTREFFFTPRNPGAFDVEFFLAKALSPGLVDRSFKINVTVKP

SEQ ID NO: 13826 - protein, 471 aa, Myxococcus xanthus
MVLTRGVDALEVRVDALLGEHLEAVRRRVDSRFAVLMVGQWLVAIAVAAVLSPFAWQGTSRVVHPHLQVAVVLGGLLSAFPLVLVRLRAGDVVTRHVVAVAQMLWAALFIHLTGGRIETHFYVFGSLAFLAFYRDPAVMATATVTAVLEHCLRGIWWPESIFGVSNPAWWRFLEHAFWMVFVNGVLVIACRETLGEMRRVAVQQVLLEGAYANERVDHEHALARVRREMSSYREQAARVEKLAAVGRMTATVSHELRNPLAAARTANAVVVRHLRKLDVTLADQRLQRFLEIIERELAVCSRISSELLDFARERPLELRPCSLHALMEEVLDVVPGREGVRIQNSVPLSLASPWVDRELLRKVLINLVQNAVEAMPAGRLGRVDVFAEGGNGSAFIIRVSDNGMGIPEAMQERIFEPLFTTKPAGTGLGLSVVASTVRQHGGTLRVESREGEGSVFTLCLPAGCPAAEVAL

SEQ ID NO: 13827 - protein, 108 aa, Myxococcus xanthus
MRTIGARSAQDFLSTVVGRSFLALSGGCPRRLVSNLPSGYSTAVSYGERDVEWVGERQGRLNMFRDFMPHSYHEGVLRAALAAIGARDTHIRGRATGLLDGEYEVSWS

SEQ ID NO: 13828 - protein, 62 aa, Myxococcus xanthus
VRSIAEAVSQQDAGIAELFAALSSMADLADQIVDRMAASEQSAIQLSAASAELSAIVGRYQL

SEQ ID NO: 13829 - protein, 265 aa, Myxococcus xanthus
ASEPGTVDLAALSRALVTAERRTATDWTSAAPSRRAVLEGAWERLLWAGSRLGAAGMADSARTLLQGGETAAPGTVRQEAARALGRLGTPGGTLTLTGQAPAAVLTNEKERAAAADTLRKSLVDPDARVRAAAADALAKLAPERATAWALEVKPFDAVAFGPMGARTSRELLATSEGRRLSVPTLLGAHALEPLKSLATDAKPETRQDAWAALGRLGGDDAAKLLHEAAFDKSQTEELRKAAWRAHKRARRAAERARNRKEGNPS

SEQ ID NO: 13830 - protein, 307 aa, Myxococcus xanthus
MGPGLPVFWVIDMGAATLTLGLTGWTESGWSSAAAFDVLMPRAVPDGLAEQLRNRLRTEGPLPFDTLAANAGAPKESVRAALQLECLRGRILFDVARGQYRPRELMPTPVDAAVIRYGNELEARAHRLLGGDGAPGAGEVKLTKVHDVVGEGIRIHGEVVDREALRSFFPSFTLDLEGRVKDASCGCPHHRRSGLREGPCEHLLALRLAYARRRAEEEALRQTPEGRKLIRAETRSYVRRDAESGLETVYRVSLDGQVVAVEWGPRTGSPRHQRLWFDSDAEARGAYFARLEKLAADGYIDAASALV

SEQ ID NO: 13831 - protein, 179 aa, Myxococcus xanthus
LRLLIVDPESRVPCAPGQVGEIWVSGGSVAQGYWRKPEDSVDIFQAVPVGAEAGPKYLRTGDLGLLLEDGQLIVTGRRKDLIILRGRNLYPQDVESIVERAHRKVRPGCIAAFAIETPEGEALAVVAEVSRDVAEGADPAALGAVADTLRKAIVAELQVQPHTLALLPPGSVMKTSSGI

SEQ ID NO: 13832 - protein, 167 aa, Myxococcus xanthus
ATHWQQLVFEYVAPELQVEMAKGVIEFQQYCIRLIEDRKKNPQEDLTSYLVAVESDGEALTMHELVMAVGASMLSAGHESTTALMANAWKLALQHGLWQRLRDNRDLVPKFLEESSRYDSVSHAMIRTAKEDVELGGVKIPQGSRLLLLFAAGSRDESLCPHSSKLD

SEQ ID NO: 13833 - protein, 385 aa, Myxococcus xanthus
MTGQEHVVRTVANAIKIDRVAHAYLFCGPRGVGKTTAARLLAKALNCEKGPTAQPCGECRACTEIAAGTSVDVAEIDGASNNGVENVREIRENAKYLPQRDRHKIYIIDEVHMLSGAAFNALLKTLEEPPGHVKFIFATTEAHKLPDTMLWRCQRHNFRGIPAARMLQRLQEICKAEGAGISDRSLSLVVRQSEGGMRDALSLLDQVLASCGATPSDEEVADALGAIDRTLVQDFADALVHKDAKRVLERVEEVFNRGLDLKRLAEELAFQLRHLFVTKTLGKAPDELAESEQKALMALAQDAEAAQLTRLFDVVHGCIWDVSRAAQPRLALEMALLKAIQLSPGGSIPELLARVDKLAAGMGEGSAKSNAGAPGGRSSPTNFRA

SEQ ID NO: 13834 - protein, 273 aa, Myxococcus xanthus
ALGLAVVARYPSAIFVLAALVWLAAARRWRLLAFTCAGGLGVAVALGALDWATWGSPFHSFIAYARFNVFSGKAAAQFGADAPSFYVKPLLTAVPLWAWAAVPVGIAALRQHRALSLPLWCAAVYTGVLLATAHKEERFLYPGLVLGVLAAAPPVAAGLVQLARPTGRWGLAGLALAASMTAAAFFPPGDLRADQFRAIVAATRGNARGLLIVNEGLWGSGGYFYLGKRIPWLTCDWPHDGAFERALRDRTFNRTVTFEDRALAELQAGGFEI

SEQ ID NO: 13835 - protein, 648 aa, Myxococcus xanthus
TKGTPAPAGVEQVFEIAFDGAERRPRRATRQQPARGEVEIKVTHVTLTRAAAVQGRRASDTHWPLKVGGVVVAVGEATPGFTSGQVVQALVAQEAPVVGTHVVLRLDRDFVSAGTSQGRLLPFLSAEYALHVHGHIQASERLLVIGDAGGVGTAVIELGRAAGARTGIILDGDTRQVPEGVRVFDRRSPSLPEDILEWTDGAGVDLLVNASCDAEPTITSVLGAFGRFVDAGPLAPAEGLFSTAWPRGAACARVDVAAMLRQRPQEVAARLQSVLGRFQTLPALPSESWPVTRAEEAPAWLAEHSRDQGLARLTLTFADGEPLALAPAADEPLFDANATYLVTGGFGGFGLALARWMVAEGARNLVLTGRKGASTPEAKQLVQDLEAAGARVTAAAADVSSMDDMRALFARIDATHPPLKGVLHTAAVLDDAPMPDLNLERIQRVMSPKAGGAWILHELTQDRPLDLFVLFSSVAALIGNPRQGNYVAANSFLDALAEHRAARGLAAISIHWGVLGEFGMAQDEAVRTYLESLGLNPMAPATVLTALKRVLRLRTPQLGLFDVQWSKLGRAAPHLGKSARTSHLLGSAQGGAQSEAEQLRGHLSGLAPEARQPKLEKFLVERLTTILQIPMERVEPQKPLSLLGVDSL

SEQ ID NO: 13836 - protein, 186 aa, Myxococcus xanthus
MHGEKPFLPREVLIGTPESEVMFSNIRRAMRLTVELNKRTFDDAEEIRTLFSELTGRNVDSTFSLIPPFYTDHGVNIRVGRNVFINQCCTLMDIGGIDIADDVMIGPKVNIITSSHPLEPARRRASAVAKPIVLERNVWIAAAVTILPGVTVGENSVVGAGAVVTEDVAPNSFVAGVPAKLVRHLT

SEQ ID NO: 13837 - protein, 119 aa, Myxococcus xanthus
MPFIVPGTEWAAYYDELAARFGLTIDTLGPDFGIDALLEVIAGSSSLATLVGEHIRLVWPAEYNLRRIPIRNPMLVYPHSLVWRCDNAHPALAKLRAYLDARKDRYRDPKAWSPPWTDR

SEQ ID NO: 13838 - protein, 130 aa, Myxococcus xanthus
MALLNDYQDVLDVAKNVGAKVESREENGKLIIKGTVDYAWDRDRMWDQIKARHSNWQNEVMVMLTVTHETPYGLYTVKSGDTLSKLAKDIYGDMKLYPKIFEANKDQLKDPDKIKVGQVLKLPPKSIANA

SEQ ID NO: 13839 - protein, 190 aa, Myxococcus xanthus
MAERTRAELTGAIRDFDSLFQGRIKLTPEGTVTHEGRTAWRYVVTLAPAAQADASRPLPPTPQAKKGGVDETTVRRANFFAHRLPRSLDGEVLVDSATSVVLKARLDGRMGVPGDKTPEAAELRLTLEAALSEVGKDPRLQPPEDFLPDADKPQGIADALDTFGIQRKKPSDSDSASPESAPEPEDEEGT

SEQ ID NO: 13840 - protein, 95 aa, Myxococcus xanthus
VLEKEAIPGVRVVSGNAATVDFAQVAGAPDVAVAGNLPYHLTSPILFRVLEQRAHVSRAVFTLQKEVVERLAAEPGNRDYGLLTVLLGMHYDAEN

SEQ ID NO: 13841 - protein, 42 aa, Myxococcus xanthus
MFLPPVRLCTDNGAMIAVAGYEAYRRGLRGDFRLAADPAWRM

SEQ ID NO: 13842 - protein, 334 aa, Myxococcus xanthus
PTPRAPLASTVEPSLASSVPAPAVVETQPAEPAATAPATPGEVAPDASAKPTDAGVVTPVKSADAAPVAPATPVSSVQSAERKPAATHTSDAAVANAGRSNRTGLIIGAAVVLIGAVAAVVVGTGSGPSEAPPSKPPVVETQAPVNDDAKQTPPPEQAPPLEEATAKAPEAPPEPPAATPDAGTAIAEAPKPPEATPTEAPTPSEPAVDPEVEFATLVKQARAAVVSQRFRSAAGSYRKALALKPTATEAKAGLGIALVNGFTTDGAYREAAKLLQEVVKEEDSNARAWLSLGMALQFTGKNSQAADAYKQYLLLEPTGSSAEEVRTLLRGLGN

SEQ ID NO: 13843 - protein, 558 aa, Myxococcus xanthus
MPTPVELGPEQALLLSRCDGSASAVSIARELTAGDSPAFASQDEIFTALEQAVGFGVLLWGWEVPLVIRPEVVLRGALMAIEDADARARALAPLERLERARAAVEAAAGTPTALDGAVAELEAVFQEVAGAPPTRAAGQTYASRTLIYEDCERDGALVLGAPVIGRLGAVLELVLTGARWLVGEVTRGTRAGLDALFNRLSEGGAPVSLTALQLAFVQGLKDPASEAELMPVAKAVAEHRRRWRELFALDPEVRRQTRTVDSLRPRVLEAFGEVGPAWRSRWHASPDVMIDAASEEAVRAGDYQLVLGELHLCNSISSLFVEQHPAPEELFALAERCATGVDVVPVFPKSEWSQRTLPCLFPRDSLYYLSGQEPPPQPGARALRVGDMVVERRDGTLEVLDRVSGRRFDLMEFMAVFLEQRCASIFDLALADDYSPRVTVDGVVVARERWSAPASELGFAGLTDPMTQWLEARRWQQGLGIPRFAFFKVATERKPCFVDFDSPLLVEMMAKLVRRTAEESPASRVQFSEMLPDPEHLWLTDAAQRRYTSELRLVCEMS

SEQ ID NO: 13844 - protein, 168 aa, Myxococcus xanthus
MEQRLRVRQPRTLRDFFSNVVDTVRRDVNWEGECNIGILFSPSTLPEAGPAEQVSRFFTAQLQELLQPEGARGEVLLATYGSVESEPGAHLTLRGKRLHAVVEYDARDRLAMAGATYVAQAHGAFEARTVSLLDGPAQGALDDKHSLELFWEHETADELTEANQEVAR

SEQ ID NO: 13845 - protein, 153 aa, Myxococcus xanthus
PHAFYTCLYEAVRGGNVAVHPAAPTPAQAPAVEGMAWELLSAEERYNLLLSLVHRALREAGKDTDLLRGFLDAPPQGLEDAYAGVTLAADGRVDVARLRANLSTGGEAVGRALTLEALDAFVSYALFSARNVLPADVAERLSNTYRTLQGGLA

SEQ ID NO: 13846 - protein, 205 aa, Myxococcus xanthus
MVAIRKWVWGLLALTAACSGARQAVKHAGTGGSGPAPSAEAASEDSRSTTRRYVDEDLGFEIIRPTADWQLDETNERTPEGLAIPVILRHNVSGAQVVLQVAPAVASPTQFAERLTEGLRQHPGFTTTDPAPIPLSDTAVGFDFQVGDGVHGKVAVREGIPGRVLMMLATWPAQAAADVPQSVDALIQGVRPLAGPATAWKVPQR

SEQ ID NO: 13847 - protein, 531 aa, Myxococcus xanthus
MNFSFVSRDATRTSGDLLVIPLFEGELGDSAPSSLSSADGALEGRLRGAATQEGFKGRADQSLVMHTLGRTSSERVLLLGLGNRARFHPEVLRLAAGRAAKTAQRLKVTSVAFALPATESTQDAVRAVVEGVALGVYRFDKYKSSAREEKKGAAKLGKVSLLLPEGTERTRELDAALTLAQRVAEATNWARDLVNEPPNAVTPTVLAEAARQAAKEGGLKATIGGRRDIEKLDMGMFLGVTAGSTEEPRLIHLTYMPKNARDAKQPPLALVGKAVTFDSGGLSLKPTDGMVDMKTDMAGSAAVLGAMKVIAALKPPFPVHAFIGACENMPAGNAYKPGDILTSRLGKTVEITNTDAEGRLVLGDILTWATEHKPAAIIDLATLTGACIVALGNYIVGAFGDHEETVTQVLQAARTAGEEMWRMPISDMQKDALRSEVADMKNSGERWGGSINAAIFLREFVGETPWVHLDIAGPASSPKERGYLSKGGTGVGVRTLVEYVRLRAQTQDTAPAEAAPEAKASKAKPARKRAK

SEQ ID NO: 13848 - protein, 51 aa, Myxococcus xanthus
PTLGTTETLIAALEAAGVDPQRRAETLTPEEFAAIERALGPLTPATSTPAE

SEQ ID NO: 13849 - protein, 214 aa, Myxococcus xanthus
MDYRYIVVEGPIGVGKTSLSNILAERLAGRRILEVVEENPFLSSFYTDRQKFAFQTQIFFLLSRFRQQQELFQQDLFSSMTVSDYLFAKDRIFAHLNLDAHELALYERVFEALGPRVAKPDLVIYLQARLDVLLHRIKKRGREFERKFDPTYLEGLVHSYNNFFFHYTDTPLLVVDTSDIDFVNVEADREDLLATIRKAKPGTQHYVPKASRRG

SEQ ID NO: 13850 - protein, 106 aa, Myxococcus xanthus
MAKSTPDVLPEAGEVTWTRGMGVEACLIACRFILEHTRTRTVVDPFCGHGTVLAVANALGLDAVGVELSRKRARKARNLRAELMDGTLVLSGAHGTGAPVGDDDAL

SEQ ID NO: 13851 - protein, 115 aa, Myxococcus xanthus
MERKVGSSTVTAKEVKAALEKARTLSAEEEKVLRMRHGAGASSTRAPLPRAAGDNQELGDELLLIEMQLMKAMRARAGGKPAATASSKPVAATRARDAAANPTKDKIVRALRKKK

SEQ ID NO: 13852 - protein, 251 aa, Myxococcus xanthus
VIQGHDSTLPVTMDQMVYHTAAVARGARRAHVVADLPFMSYQVSNQEAVRNAGRLVAEGGAGSIKLEGGAEFADTVRAIVRASIPVMGHLGLTPQSVHKMGGYVVQGRGEDQARQILDDALALEQAGAYALVLEGVPMDLARTVTQRLSIPTIGIGAGVDCDGQVLVCYDLLGMNPDFKPKFVKRYANLHGSITEAAGAYFAEVRKGAFPDEEHSFKATKNIRLAPGAPAPAARVEPSAPAEAGEKLGPVF

SEQ ID NO: 13853 - protein, 92 aa, Myxococcus xanthus
MSGRQRAKTVVRLEEARQSTPTQRAPTPPVEPDPLYGVVLLKTAMELKRRQDGTVEDILRGVLARMRIPEAEFFAYLEQQGGLLQALGMRGR

SEQ ID NO: 13854 - protein, 322 aa, Myxococcus xanthus
ALQIVLIVAEQQPDGNLRKATLNAISAGKQLAEKAGGELHIALVGKDPSKVADELKGYGAKAVHLGAAAELEHYLAETYAPAIAALAQELKADYIGMASTAQGKDLLPRVAGRLRAAMATDVMAINGSGADITFTRPMWAGNVFADVKLTTPVKVLTLRATEFPAAAGGQGAAEVKTFSPKVEASKTKFVDFKEVKSARPELTEARVVISGGRGTKGDFKEIEGLADDLGAAVGASRAVCDAGWVPNDLQVGQTGKVVAPALYIAAGISGAIQHLAGMKSSKTIVAINKDPEAPIFQVADYGMVADLFKVLPELRAELAKLK

SEQ ID NO: 13855 - protein, 172 aa, Myxococcus xanthus
MAPRPGWWSRHWRWVLPLGCLGLLASCIGLGVLATYLGFSSLGQSDAHQEAVAIASGDALVQRALGTPIESGLPRRSSVQSRNGVSRAQFSLPLEGPDGKGTLHAQGEKRGDGPWQFSHLIVALSDGTLIDLLRAEPPKRPELPLPAEPPYADEAPEPGEVAPRDAGRDIEL

SEQ ID NO: 13856 - protein, 51 aa, Myxococcus xanthus
MLVASSVLLFVYSVRHRDHEHADRLSLFPLEDDSAAPAPRAPEPPPSASQE

SEQ ID NO: 13857 - protein, 733 aa, Myxococcus xanthus
FRRQPGGAGLTVDPALGKGRMLWRPGAFDVAEFLRGGEGFGYLFGPSRKRPERTSLDLPIRLGICAALSMNVMLFSVSFYVGLTPEDGDVFRLFTRLSLWLSSAVVVVGGWPFFRSALQGLRRGVLHLDLPIALGILLVFGMSLAQARGGRGDLAYFDTLNTFVTLMLVGRWLQQRVLERNRRFLLDDDGAEGLFVRREEGARLATVRAAEVADGDVLVIAPGDLVPVDAVLLDSGARVSTDWITGEPGERAVGQGGALPAGAFNAGREAVRIQAKQAFTDSPLVALLRRAPTAAGGPALHTRFWDRVSRRWVVTVLFVSALGLALWWPAGPDKALEVAVALLVVTCPCAIGIATPLAYELVQARLRRGGFFIRSTDLLDRLPRVRKVLFDKTGTLTLGRLELVDRAAVAGLTAASRDIAFDLVSRSNHPASRCLAAALAREGARFNSEARVSELAGQGLELNREGVRWRLGRADWATEAVDTGHPEREPTDGASCAGGSPASRHSRPSGRVEVLLSGSGLAAGPVLTRDGVPVAFFQLRESVRPDARREVQALQGEGREVWLISGDSHGRVSDMAAALGIPTQHTLSGQRPEDKAEAVAKLDAADTLYLGDGVNDSLAFERALCAGTPAIDRPVMPGKSDFFLLGEGLGAIREALRLSARLRQVVRRLLLLAVSYNVVAVAVCLAGWMTPLRAAVAMPATSLATVLFTVWWLSASRERAAASPTPPLREVPA

SEQ ID NO: 13858 - protein, 958 aa, Myxococcus xanthus
LKRHPLLKLQAGAVLGYVDSRSKAIGDGFVHWEILAPSDPGQLKAFLDFAKDTLGLGDFFKVFEEADQNNFFDPSKGELDALMKLAPKSIHAAGNPEEECLDRFEQTYHHGALKEILRSPRALAFSSDDAPGDAGEPSFPAELVITNYKDALPEGTYWLKLTFEPPLGERYVAYDGKQSRLNVRLPAGARRIFVEPADGPGFLLQVGGGAQDALEQELQHFKRLASVRWRNVVLRHLNEWLPESIVVQVMKHLEIHGQLRMGSQIADIQQPDEAKRLLGRYAEAVGFWAHPEEVPFLGPVGDNGGKKALFAAAPDVDQLPAKGLVDNPHPVTFAWLLMLMVRHGLVRFSELPAWRPSNSKDVLAVGWLPARSDHPAYRVGELLDVGAVVRGSGDDEVELHVLHEGTRCFLASGSCTEGAFFAQVELPGWGACTLDMPGARLVGTATLEVLPPVLLGGRESAEALGSQVVSSARYAPESHKDGTFSWRIPFRENCPKLLRGWVLLSAWAKATKQEGLHPEAPAFDLARVAIPVQGREDSAFNEASGLRVVDGFIQRGALKKLETYVTRHFTYRAFLKAAASKTEPPLAWALVEAVERVQCAYSERQLLALSALAEDGLSIVLTATNARRLKDAAEKVREDGWFTALEDAAKGAIRVRVPAPAEGRHPGELVIRFDASAAFSELRKGMPGTHEVHVKFGAFFPNGGSARDSRLVTADTLGSRCEPVTLDALRSGAKAGALEVWSTEVSEVLHIPSLEAPKVFVTARGIQLSSRLLGGNRTFWENARPIIKVGHSSLDETAARQSVIQNGCVVRTFGFEDAQVQGRILIPTAEVVNKHVLLGHERIDVQPAKGRACTMQRNARLEARSHYHDAFSLKVAVTTEAVPVSRPFRLELASPSLPGDPPGLPLKLKRGSVVYKPERQGQGLTDVEGVLHADVDLNDVEAALEGAREYVLRVVPLE

SEQ ID NO: 13859 - protein, 180 aa, Myxococcus xanthus
WPKARGITILARTAHGQGTGTAVQELAVPTDHRLKGVTADAEMAVLSASEPIRLAELLEFLDARPVRGRTLDCEGSVGGVRRTVITVPLADIHGADALRRELATRFGDAVSWREDLGTVTCVGVGLNADWAPLRRALAAAEELGAHVHAAHTSPLQLTLLVDKAHLKALTARLHRELLGG

SEQ ID NO: 13860 - protein, 310 aa, Myxococcus xanthus
MKRRTFRVEGALVGKAVARAVADELGLPEPGARGLVEVGAVYVAGKRSRDANARLTAGQVVTVVLEEGGQSPLSEAPPAPELRVLYEDADVIAVDKPAGVSAQPTEGRVGDSLVDLVGAKLGRPAGLVHRLDRETSGVTVFGKTAEATSALAAEFREGRARKRYVAATGPGLPPSGTVDLPLSKDPSRPGRWRATRAANGVPALTDFHTLSSGPAFCVVELLPHTGRTHQLRAHLTALGAPILGDARYGGAARAEGVEAPRCLLHAQALELGHPRTGKLLRIEAPVPEDLMRFFLAAGVPAPSGAIRGAE

SEQ ID NO: 13861 - protein, 1070 aa, Myxococcus xanthus
RRQGGPRGRRAGDWPTCRALREELEAQVRLREEAETLTAEVEAQVRRFEDACAEAELRAIDAEARAEAETQAREAAELRAAASTQALQALEARLESEAAGRVVSEARAESESKARQTAERRVESAEDLTAVSEARIDAEARAREAAEARAEVEAQSRLEADTRAQSLSRALEEVETRAELAGRAQAEAEARAEQAARALAESEAQSERIARALADAEARVQAENGADARVESVATALAEAEARAEIESAARVDAEARLASAEAALAEASARAEIEATVRAEADARVESVATALTEADARAEIESAARVDAEARLESIATARAEAEARAEIEAAARAEAEARAEIEATARVEAEARAEAEALARQAAEARAEAETRAREEAEARVTSESDARTGLEAEARANAEARAKKAEARAQQEAELRANAEAQASSEAAARAEAEARAEQGAAVRLEAEAHAERTTAALKEAEARAESAVAALQEAEARAESAVAALQEAEARAESAAAALKDDGARAEISAVALKAAEARAESEAAARQAAEARAESEAVARREAEARAEIAAEARAAADARAEAEVAARSEIEARAEREAKLRAAIEVRAESEASSRTDADTRASRESEARAAAEARAEHEATLRAEAEVLAKAEAQAREKAEAQATAEAERRAEAEARAEREAQARAEAEARAEREAQARAEAESRAEQEAQQRAEAEAQARREGESLAAEKARARTEEEHRVTAAAQAESEAQARHEAEARAEAALKSAEEAEARAEAEAKRRAEAEARVQQSAQAEAEATARAKAEGRHRTALEVRLDAEATQRATLESRLEEESRARSESESRLLAENTRISEELAELRLEHQQSRENLAKEREARESLEQSLEALRTESAEQRARSERERLELEERALRDAEEAAAQARASMLPLEAPPGRPELAVARSGSVTQDGLTKLVLRLCEARMEMRLELKVMNALRVLWLRDGALVGAVSSAQGETLVDRARADGLIDARQEGELRLVRSATTAALLDALRGRGYLRESEAVPLVQRYTEQVFLDALAEPSTLYRLVSEPAPHEVALAAATRPL

SEQ ID NO: 13862 - protein, 311 aa, Myxococcus xanthus
WACPAGTRTTRRSSSRCTWRPPLGRPCWASASSSSPSTWAGRCGMAARRGGTPGAARAMSGSATHRPPSSISMRRLGFPGRPTTTRTLAPTRRWSMRHEASQRPVEPRALHFGDEASRQDAAHLGMWIFLATEVLLFSVLFTAYALYRLTYPGVFQQAPAHMDVFLGTLNTFVLVVSSILVALAVDAIRNGRDFAAAALLALSVLLGIAFLFIKAAEYTKHVHDGALPGAWYAYEAFALPGANLYFTLYWVMTGVHAVHVLVGVGVLVTLALRTLAGEFGARFHTPVELGGMYWHLVDVVWLFLWPLLYLT

SEQ ID NO: 13863 - protein, 121 aa, Myxococcus xanthus
MRGGVRVLAVGAVLLALATLSFGLSRLHLGVWAVPVALGIALCKAVLIAFFFMHLVERPGGPRLVIGTAGVFVGILVGLVLAEAAARACPMLPPGPFPVSRFPGPERIGPPRVEQPWQVLP

SEQ ID NO: 13864 - protein, 75 aa, Myxococcus xanthus
MLGLLAGLTLQAVMPVLVVPWAAPPLERAGPPIAAFLLLHLVFGACLGVLTPVRKALLLLDAKRRGIRTLPVPPY

SEQ ID NO: 13865 - protein, 123 aa, Myxococcus xanthus
MKEIITAVLLVLGALLMLLAGLGLFRMPDLFLRLHGAAKASSLGVGLLMGAAALGLGDVSVVARAALGVTFVFVMTPVATLLIAQAAFRAGIPLWERTHQNDLEEHHPAGGPYEPRLGPDGEE

SEQ ID NO: 13866 - protein, 93 aa, Myxococcus xanthus
MSDWLQTITQGALGAISVSMLFSLHRLLRGPSLTDRVVALDLFSLQTSAVITVYALWMGQPELVDVALVLAVIGSMGTIVIARYLYSAQRGTP

SEQ ID NO: 13867 - protein, 157 aa, Myxococcus xanthus
MTAFLWNLMLALLWAAMLGNVTSENLLTGFIIGFVLLALIDTQHVPSRYGTQAWNVVRLVAGVGWDVLVANVRVAYEIATPKLLTRPAIYRYDMEARTDAEITLLTLIVTFAPGTLALEVSEDRKAIYVHVMFATTREAFCQELRERVEIPLLRALR

SEQ ID NO: 13868 - protein, 109 aa, Myxococcus xanthus
AKLAVIQAALRAENWIIAGTAVVVGLLTLFSMMKIWREAFWKAPPEDQPQEPTRPLSLGDGVLGPCMAMTLFMVVLGLGAEPLLELADAAAGQLLDPEEYVRAVLGGRP

SEQ ID NO: 13869 - protein, 514 aa, Myxococcus xanthus
MATTRSSAAAQPALGEQQPIVTSEEQAPAAAPAKPATHDTVPPPALLDFMMKSWKPRSKKLPPKIKQAEAFKARRRALSKLFPGETLIIPTGHEKVRANDTNFRFRPGSDFYYLTGNLEPDCVLVLQPKEKGGHTDVLFVEPNPGRTDATFFTDRVKGELWEGPRLGVKESQARYGVDQARSLNELPAFLSGLSGAESRPTRLLRGLSPKVDGAVPAPGEKDKGLAQALSEMRLLKDAQELRELQTSIDSTHRGFEDVIRGLKTAKTERYVEGIFNLRARVEGNDVGYRTIAASGAHACILHWHHNDGPLVPGDLLLLDAGVEGQTLYTADITRTLPISGKFSKEQREIYELVLEAQDAAFAEVKPGNDFMEPNRAAMRVLAEGLEALGILEDAEEALKDEHQFYKRYSLHNVSHMLGLDVHDCAQARQETYKYGKLQAGMVLTVEPGLYFQMDDLTVPKRYRGIGVRIEDDVVVTARGCKVLSADIPRKAKDVEAWMKSLWAADKAARKGKKK

SEQ ID NO: 13870 - protein, 231 aa, Myxococcus xanthus
MDRASIFGVMRLIRRWRPDNRYLLRNVAIPGFGVQAALLGLYLVGVIPPLPVAVQFAGIYHQVERVSPGIYHLSSVDSGAWYKPWTWGGPDFLMQPGDKPYYFFRIFAPKHFQSYKVRVRWYFDDPQKGWTTYGNGFMATVSSNGTDGGYRFYATTSNLKPGKWRVVLETEAGHEIHRLNFTAGPDANPGPRVYEVAVSTLKDVKPLALSEWQERAAAAAAKPATAAPKPK

SEQ ID NO: 13871 - protein, 310 aa, Myxococcus xanthus
MFGDAGPEDLLVAVHAETGAVAWKEPVPPVHAPLVVDTEGNVYGGASDVLEQRTELFSYAPDGQLRWRTQRTGVLEPTAVDGGTLMLGRAELVDAATGAPIATLATASAESFYYSLGRSSSTFGRTAMQADRLLVLPDMRCTTEGCPTTTHPGGTFLYGLDPSSGAVRWHRAVGTWPMSPLLTQRGSLLLVDRPVAETCGEHACTGEEAALGSFLRELDQDGNELSACALLGKAPYITPPALHRGRVVLGAWTNWNASNDWTQRMSIRAFDMTAPAEPASSGWVSAGGGNSRSGQTKPTGAAAQARAPGR

SEQ ID NO: 13872 - protein, 304 aa, Myxococcus xanthus
SLKLNLDIEHTYRGDLKVTLTSPSGKSAVVSNRKGGSSDDLTGAFDLSAFKGEPTKGTWTLEVQDAARGDTGTLKSWGLDIAPQTPVTEPEAPEEPEGGLFEGLRDGALLDALQDYSSGKKVVSYNEARRLMFSSLDVNENGNVVCVYTGAEVKGGKIPNNSVMNTEHTWPQSKGATGAAKSDLHHLYPTDSKANSRRSSFPFGEVVNVRWSQNGAKLGTDARGNMVFEPPDAHKGNVARAMFYFSATYNKAIPNDEEATLKAWNKLDTVDAAEIERNRRIATIQGNSNAFVEDSALADRVKDF

SEQ ID NO: 13873 - protein, 341 aa, Myxococcus xanthus
LGRVLNERFRILETLGAGGMGRVYKAVQSPLDRLVALKVLNPQYGEGKDPGFQKRFFLEASVTAKLRHPNTVTVIDYGKTEDGIYYIAMEYLEGLTLGQLLTQMGPLPWPRALNITQQIARSLREAHKVGLIHRDLKPANVMVLNQETDHDVVKVLDFGLVKSFIGDAAPVSQDTSITQAGIILGSPQYMAPEQARNIADPRSDVYSLGVVLYQMLMGRPPFLAAQSIDVIVKHINELPPAFGSLYPNHGIPGEVEALVMKCLAKTPPERYQSMDEVMEAMRRTMSTVGVSGAFSGARFAGAGISGVGGSGPISGPHGSGPHGSGPHGAAGSGPATVALDI

SEQ ID NO: 13874 - protein, 289 aa, Myxococcus xanthus
MNARLSELLSGAPPYPRRVVCLTEETTEVLYRLGTEELVVGVSGFTVRPPQARKKPRVSSFLDANFERILELKPDLVLGFSDLQADIGRELAKRGVPVYLFNQRSLAEILQSVRLTGALVGRPEAAEALATELTANLERHADAAESLPRRPRIFFEEWHEPLISGIRWCSELVELVGGVDVCRESRASQGAQGRIFAPEEVARRDPEGVIASWCGRKAKREKIVARPGWAGVRAVVDDQLYEVKSSLILQPGPAALSDGVDRLAKIVAAVARGEKLPPLRDGELRSAGA

SEQ ID NO: 13875 - protein, 1129 aa, Myxococcus xanthus
LLTHAKVRTRVSLDAARVLHVETVFAQTGDSGRGTSMAPLRASASERVCLEPWTGPRGEQLWAIHTHRTVAELFGRLDADATTKEGVWLAAEEPQVPGTGLEVLWALTRGLRVVLPAERARFTPVGAGAEPARRRLDFSLSFFANDEDSLGGRKYRLLLDAAKFADANGFSAVWTPERHFHAFGGLYPRPAVVGAGVATVTQRLGIRAGSVVLPLHDPILVAEEWAVLDNLSDGRVGVSFASGWHANDFVFAPDRYARRKEVMHRGIEEVRTLWRGGTVRRRNGAGAEVALSLRPRPVQQTLPIWLTAAGNPETFRLAGELGAYVLTNLMGQHLEDLEGKVALYRDAWRQHGHAGRGHVSLMLHAYLGDDPAEVRRRARQPLLDYFRSSVDIAAGFMAGMGLDMDPRSLTPADMDALLAHGVERYVESGGLFGTPDSCGPMVERVQRLDVDEIACLVDFGVEVEATLEGLRHLDALRGRHSPEPGLAVPMPSLREGPGAAEALLALVREAGITHLHCTAALARSMLTLPDAAEALRPVRHVWLEGASEEAAASLVRAMSWRVAHRQQDLGLGTWALAAEPGDASRWDVVDGRGQPVPVGVIGELVVKGAGVPLGLWNAPDSTPVRILAGSTDAARRMATGRRARRKRDGSLELLPALPVPEGRPTPPKVMGARDGVAKKSEAPASITRVPRGRPLPLSFAQQRLWYLDRLEPGNVAYNNAVAFTVSGALDAAALERALNAVVRRHEALRTTFSMDGTEAVQTIAPSLEVSISLEAVEGASAADVARWTREEARRPFDLERGPLLRATLLRLGSTEHVLLITLHHIISDGWSAGVMVHEMARLYEAELTGRPASLPALPVQYADYALWQLEQMRGSALKAEQAWWRDVLADVPVLQLPVDRPRPPLQTHDGEQLPFAVPKSLTDALVAVGRKEGATPFMVLMAAWQVLLHAYTGQDDFAVGTPVAGRDRPEVEPLIGCFINSMALRADLSGDPSFAEVLGRVRRTALDAFAHQEVPFEKLLEVLHAPRDLSHTPVFQTMLILHNTPAAALSLVGLQLRSRPVHAGATKLDLALEVTETPEGLRGSIEYNTGLFDAETIARLSGSLLRLLEAAAGSPEVRLSQLDLAGPPR

SEQ ID NO: 13876 - protein, 160 aa, Myxococcus xanthus
ALKATAGGSSTGIVSAYFTVDGGAPIPVMPDAGGGYVTTQLHLTEGTHVVRLSVVDALGHVTWREQTVSADFTPPVLVILSPTEQETNPDPVVSMVIQEQDASPATVVTQGIVTEDVPAGSNVLRHTVNLVHRDWSLVHVRATDAAGNTTEVVARVYVAP

SEQ ID NO: 13877 - protein, 748 aa, Myxococcus xanthus
MRFSDPNFEDVRTRARTVSALAQVSGAASVAVTGADEPAFATLALASRDFFPAFAVRPVQGRLFAEEEQQEGGAPVVMVSHAFWKRYLGARPLPLPDTLTFEGRAYTVVGVMPESFDYPVGTQLWVPRELVPPLPSRTAHNWRVVGRLADGVDLQAARVELTHIARELEAQYGQDTRMHDIAVEPLQESLVGRVRSTLYLLAGANAFLLLVAGANVTNLLLARAATRARELAIHVALGAGPGALMRRFLMESLLLSLAGGALGAVLAAWGVRALLAAEPGHLPRVDEVGVNATVLLFSLGLSLLLALGLGLLTALRAARQPPGAALAGSGRTHSGGGSAERTRRALVVGQLALALVLLVGAALLGRSLMGLLSLDPGYRTEDVAVLSLVLPPAKDEAQGRHNVQLQEHLLSRLAALPGVRAVGAVSSFPLEGSPAGDGTFIVLNRPDEVGNFEDFGRLAREPERTGSAEYRVASEGYFAALGIPLVRGRLFDARDTVDAPHVAVISESLAKARWPHEDPLGKLIQFGNMDGDLRPFTIVGVVGDVREQGLDDAPRPMFYGGSRQRLRASSRFHLAVHGPMGSAALVTAALPVLRELAPELPSRLSTVEGLLAGSLAPRRFSLLLLGAFGAMALLLSVAGLAAVVSYAVAQRTREFGIRFALGATTEDVLGLVLRQAARLAGLGIVLGVLGALGLSQVLAGLVYGVSTTDPLVFLVVALLLLGVALLASWLPARRASRVDPMTVLRSEA

SEQ ID NO: 13878 - protein, 225 aa, Myxococcus xanthus
MDPQGNAGSGLGIKQDNITGTIYEALLNDRPIQELLHPTELRYLQVVPATPDLTGAEVELVNQDNREFRLRDALRPLAAEYDYIIIDCPPSLGLLTLNALAAADSVLIPLQCEYYALEGLSQLTHTIDLVKQGLNPDLKMEGILLTMFDSRANIAHQVVEEVRGYFKKQVFEVIVPRNVRLSECPSFGKPIILYDIKSKGCESYLALGRELMKRDTPKSPRRRVA

SEQ ID NO: 13879 - protein, 291 aa, Myxococcus xanthus
MQKRALGRGLSALIPQAGATGAGKGEQAPKAGVLKLPIESIHRDKDQPRTYFDEEKLKELSESIKAQGVLQPILVRKDGDGYRIIAGERRWRASQAAGLKEVPAIVRDVTEVQAFELALVENLQRADLNPIEEAEGYKRLVDEFKLTQEQVSVRVGKERSTVANALRLLALPTDVKGMVADGSLSMGHARALLGVPRLPELQNLAKQVADKKLSVRDTERLVQQSRSSGKKDAGKAAPKQSPQVKALVEELQRRLGTKVRLTERSPGKGTIEVDFFSYDDLDRLLKLLRKE

SEQ ID NO: 13880 - protein, 32 aa, Myxococcus xanthus
MDRGVIFEGSLKMENLGTAGARPPPPPGGEKK

SEQ ID NO: 13881 - protein, 157 aa, Myxococcus xanthus
APASLLALTLLGGCKGCGQEDAASGTGEDDGRPSSIRSGVKVPLPDGWSALVAPDESFQAGPPGRPVLRVDLRRGDGEQLPSVDTLVDRVREELKDFELSLDQEEETERYSLLRITLAPKLADGGVGPEAPGFFGARRVGNDLFLCASMPGASLRER

SEQ ID NO: 13882 - protein, 253 aa, Myxococcus xanthus
MTTTSKTVVVTGASRGIGRAVALGFAKAGHDVWALARSTEALESLRQEGGERIRPLAVDVADEAALIAASQRILAEGPPRVLVNNAGITVSAPLAKTRTEDLARVMAVNVTAPFLLCRELMPAMAQAGGGRVINIGSMAAVRGVKYTSAYCASKHALLGLTRALAVEYAKKQVTVNIVNPGWVETDMFAGATSAISASTGRSEEQAREALASMNAMGRIITPEEVAALCLFLASDAAGGITGSAYAIDGGELG

SEQ ID NO: 13883 - protein, 434 aa, Myxococcus xanthus
SVDVNRFAPLAERMRPRTPDEFIGQSHLLGPGRPLRQLIERKAIVSSLFWGPPGVGKTTLARMMATGVDAEFVILSAVSDGIPRIREVVAEAERLRNQYSRRTVLFVDEIHRWAKNVQEQALPHVESGLFVLLGATTENVSFEVRPALVSRCRVFQLKELTVADIQSALTRALGDSKRGLGARNLSVGEGALTLLAKGGVGDVRKALGALELAASLTADGAEITPETAREAVGTSLSRHDKDGDQHYDLLSALQKSCRGSNVQGAVFWAAKLLQTGDVASLWRRLKVIAVEDVGMAMPEAISVVRDCEEAFHAMGMPEGRICVAHAVVLLATAKKSNRAYAALDAALAALQEHPNAEPPLHIRNAPTELMKELGHGKGYQTPWNFKDHYVPGQTYLPAPLERSVFYRPSKEGYEAEIHERMSHWWREDKASRGE

SEQ ID NO: 13884 - protein, 213 aa, Myxococcus xanthus
MAGTGADAKLYAADFRNGRIDVFNSSFTPMPMPGAFADPSLPAGYAPFNIQDIEGTLYVSYAQQDKERTDDVPGAGAGYINAFDMNGQLLRRFASQGALDAPWGMALAPAGFGQFSNHLLVGNFGDGAINAYDPASGAWAGALTRPDGHPVKVDGLWSLHFGTGVQGLPAETLFFTAGPADEEQGLYGRLDMTPVCPQGGLPPWKAPHEPEAQ

SEQ ID NO: 13885 - protein, 341 aa, Myxococcus xanthus
LSSNWWAPLAPPQTLEYGPRETATPAYDAVSRTTVALTRDGFARGVGPDGQVKWKYKTGSRFNAGARVVDGVAYVPGGDGVLYALDAASGEEKWKYVAGEALATVPVVANGLVLVASESDTLFAVKIADGQWAWQYRRDPPTGFTVRGASRPLVREGVAYVGFSDGFVVALSVDDGGVTWERSLSGAGSEFLDVDSSPVMDAAGQLYVASYKSGIFALESESGDLVWNTAVAGMTSLLVSGQVLFAAGDGRVDAYLAETGRLLWSHPLGERAAFAPVFAQGMLLVPTSSSLLFLEPKTGRSRVSWNPGSGITAPPFAAGRQVFVLSNNGYLYSLNMNGIDG

SEQ ID NO: 13886 - protein, 141 aa, Myxococcus xanthus
MVPARRTVRVVAALIPRPEDGRQFLVQQRLPGGSRALLWEFPGGKVEAGETDAAALARECREELDVELAVGRRLWEGQHSYPDLTVELVLFLARIVSGEPRPLGAHALAFHTPAQMQSLPFCEADIPLLDDLVAGRLGALD

SEQ ID NO: 13887 - protein, 215 aa, Myxococcus xanthus
MDALPEAMAARRLWVTFNGSCFDVPVLRDYFGPARFPVPDAHIDLRFVTRRLGMGGGLKEIEGKIGAERPPHMKGVNGYDAVLLWRAYQRRGDVEALRFLVEYNLYDAFQLRTLMDVAYNRGADDLNQDVPRLPVFERGDVLYDVSRIILELGPTERDAADPCSRPGHGAGRLSGLGDCARFTVLAAAVQSRVPDGEHLCVRRVAVWWNDLGRRL

SEQ ID NO: 13888 - protein, 201 aa, Myxococcus xanthus
MPETSLPERDAEVRSLASQLSPDPELARWMDEKDLVRRFTAAVNNIAEGSSPRTVLGFLAPTGAFQVTQVDGTTVIDPASYARYDTVARVIGSIDTQSAASVYRELKPLIDQAHAEIAPPGQTFSSALSAAVQHLLKVPVQEGPVEVVPEGALYAYAAPEFEGLSPAQKHLLRMGPQNMQLIQAKLRELKSSLGLPPVADR

SEQ ID NO: 13889 - protein, 467 aa, Myxococcus xanthus
TLAQFGGFHFVTKLEPSAPVVRDATPAPDARFVPLGSPLRVSFDRPLDPATVNARTVGVEGVTGLVNYESSTNTVVFRPVPPFAPATNYTVTVKDVQTPQGAGLASPHTYTVRTVAPGVRVSAGRPGQPGMPVFATGPRGTLAVWNEDTGTAIQVRAAFDSGSGFGDSVLVGEGRSMTLAPQVSAWGERFVVGWSDRSLAGGAVALFDGTDFSPVTPGISGRLFGVGNHLYAVNGKTFRVHAGTQWSEVFTAANLGSPVFLLQNGDRVLVSSGRNTTLEVSVVFDGVRWLESTVSSSVDAQYIRVGDSFGRAWVSNQGVEFALFNRDTREWGLGELITSEQMTSLRIASDGSTITAVLGDTGGLFAAVRANGAWQAPSLVDNLAVRDIWAVVPHRGNYVALWTGINSATLVRAVSQTGGSWSSTSKAVVASGLSSVLDVRASGDDLLVLMQKNQPSSTAEIWGAALT

SEQ ID NO: 13890 - protein, 319 aa, Myxococcus xanthus
MEPVRVGPAGTKVRVAVDDNGVVVAYLQPSTQTDLMDIWVVSSEAGVVGAPQLLDSVAATDPDLALVHGPSGFMAVWGEWEIRGARSVDGVAWRDLATLIPRVFQEARWYNTRLVTVGESFALSAQRNELYLNMSIHTAGVWQPIAAPVMPSDVYEFVAAGNSVMLMAPFDDEFRYIFHNGIAWSGQNIVKSPADGQGVLAASPSGFRMHTDKSWWRWSGTEWLKEATDVSRPYWGGSLRCDAKGCGLATGGAFNMPVNLALSYAPGTRSFWTGASPAQGDFPVQAGSVTWDFVADTYRVTWRQPVQQGVLALHASTAL

SEQ ID NO: 13891 - protein, 336 aa, Myxococcus xanthus
MEFGIDLGSKFRFHAKGHTVQSPGSLTHLHGLKWTTKFDYVGLTVTLYGVTVIGDAMNSEGLSAGALWMPTSTYPQAAKDPSRGLAPELFVEWAVGNFATVDAVKEALANGDAELWHSDWMSSKIPLHFALHDAKGNSMVVEFTDRQMFLYASTGHDNSPLNMHNPVAVLTNHPTFPDHLENLKNYARLSSRGATPVKLGTGTFAPHGCGSGLFGIPGDSTPPSRFVRAVYLREFSEKPKNAAEARSLALHLLNTVDIPYGTSRDLNEATGKDSLDYTQWVVVKDLTNRTFGVRTYDSLGLQTLDLRTVDFKKADGKTLAVSPVDSQLDANKQLAS

SEQ ID NO: 13892 - protein, 158 aa, Myxococcus xanthus
MKAGTLPEPLPLRSTTETTRPLGARPATGTAPQRVLLVDDSRSIRTLLKIYLMARNFEFLEAESAEEGLKVSEAEPVDLVLTDFHMDGMNGADFAAQIRASANPRLAKVPILMMTGDPNVAEVRALGQKAGISAFVRKPVSCAQLMTLVDTILPLPRK

SEQ ID NO: 13893 - protein, 292 aa, Myxococcus xanthus
MQNLRDKLLKAGLVTEDQAKKVETKPSQAEARRPGLQEGGRSSGNRPPPRRDDNRTPGGPPRGEGGGRPSGGRDAGRREGGGRPGGGFGGAPRHGGGPQHGRPAAAAAERAIPKLPPMPGSKAYQRAESKRQVELDRALRELVLGSQVPVEAGETAFYFMTRKGKLRRLELSPAQAKQLEEGELGVVERPEPAQIEHSLVPSSAAEQMFALSKKSVRFLNRKENPVGFMNDEELKAQQAAEAAGTAPELPDEPEGGSEASAETASEASAETASEGEAAPTEPKASSEEAQNG

SEQ ID NO: 13894 - protein, 287 aa, Myxococcus xanthus
MLRGFIDVDGCGSDAGADCRRSDFNPWYGVTSEPNAGDVGGAAVDATGRPLTVEVVADADGQPQPLTGVAVSFSDTARVVRDRPTFQVVQGDGQLGSSVKQLRLQPLSLHDGAVDQRPEGFAVSYLDADNDGTPDGFWPRVVVRKLADDASNLVDENDLDRDGVPDDTGVDYARADGSQDGVPDVVVLNARLVPDSISAALTDENGNPRMEGAVVPELVVEVRPQALDARVPTNPVPLRELPRGRYAVVLIQPSGQTWRVPNELAPALASGLGLPAVESQAFFLEVP

SEQ ID NO: 13895 - protein, 473 aa, Myxococcus xanthus
KWSRDYASGLPDVTLRGPDPDLGARGARASLSAVYTFAEGRQVGLSGGVNRFTTEIYPPGLLRNYFIDGVNAFAKGDVELGPLKLKTFWNHISSDAGPQYEATGQRSLVTSLNSNLFNAELLFARDFELAGTHQLNIGVEGRLKRVDWGDYLGPLREQVHAAFFVQDEWRIVEPLALVASYRVDRHPLLNLGSPGLAHSPRISALFKPFENHAFRASAASAFREPTFLESYTQLTVPVPGINGVSTLTTGNQQLRPERLTAFELGWRGEAPELGIDLDVAVYQNTVRDLIGLSGVSRLPPGQSYDPGTGSYLLGSSSFQNEDAIYTARGAEAGVTLAPVDGLGLKLSASLQDVTSDRESAAECGPCNQAPQFRLYGGLTYRSRADLEFGVDAAYTSASTWIEREPAAADPTRIELVSNPLRAYTVVNARVGYMAVKDTVTVALVGSHLGGAHSQHPFGNRIERRVYATLTVTP

SEQ ID NO: 13896 - protein, 102 aa, Myxococcus xanthus
AHVLKRLAKAQVLILDDFGLEPLGAPERKELLEVLEDRYQLASTVVTSQLEPKDWHAVIGDATLADAILDRLVHNAHRIKLGGESIRYVETNLTKGRKQAKG

SEQ ID NO: 13897 - protein, 28 aa, Myxococcus xanthus
GLLGEGERKSVEPIAARACPDPERVDAM

SEQ ID NO: 13898 - protein, 118 aa, Myxococcus xanthus
MKHLKVLEQGEVVSERDLTGAEIQRLGPLFEQASRAPAPVVMVPQAGGPDGLAVTLAFEDEESPRVRIAAERLPAQGAGPLYDALLEELDRLLTTELHAWAPRRAHAVLPHQLREEEQ

SEQ ID NO: 13899 - protein, 255 aa, Myxococcus xanthus
MKDDAKATPAELREAATLLLNGAPDDAHALVLEAERRNPLEVETQLLLARICDVERMSRCVSTALSRAETLAPRDARPDLLRAELQEKDGDVVGAAEAMERAHEKAPGDPLVGLRYVHLLSAAKRGEEALAVLQKLEGRLPHARFLVEQGRVHSREGHDAEAVKLFRAAVAEDPKLSMGFFELGLAWHRLGQVDTAEEALRQADRLDRADPKALAALCAIQVEERRIDDARLTRMDLERRFSGQPELIRKSCSIP

SEQ ID NO: 13900 - protein, 100 aa, Myxococcus xanthus
MNVDEHIQRARELLARNQPEMAESALSDAIDAAIAAEDIVLLTRARFALGELLFHQGRDAEAVPYLQAVVRTERVDGAVDVEVKASARMLRQIRGIEPRE

SEQ ID NO: 13901 - protein, 141 aa, Myxococcus xanthus
MTVYSETGESAAFRAIDGQPVSATNETLKLSYRIVPEVIAPDTVRYTIYNGYDLESAAPIEVIEARADGKIHQGLRASFKVSVTTVEDRAMDINPLEAPSDNDKALKCCVTCGGWRYCCTPAAGYCCTVSTACGLGCRVCN

SEQ ID NO: 13902 - protein, 884 aa, Myxococcus xanthus
RRVPVLLRQQRLLRGLAATEARVVCLDADAAALGAEPEVNPGRVTTPDSLAYLIYTSGSTGKPKGVMIDHRNAVAFLQWAQSVFSPESLAGTLASTSICFDLSVFEIFTPLCCGAKVIVAKNALELPELPAAKEVTLVNTVPSAMGALLRGGGVPASVTIVNLAGEALAGALVDSIYALGHVRDVFNLYGPSETTTYSTFTRVNRGETPTIGRPVGNTQVYVLDANREPMPVGVPGEVYIGGHGVARGYLGRTELTAERFVTSPFAGDAGAHLYRTGDLARWLPDGQLEYLGRMDHQVKLRGFRIELGEIGAALQEHPGIRDAVVVVREGPGADKQLVAYVVGRDGKAPEPGALRDHLKSRLPEYMVPFVFVGLEALPLTPNGKVDRAALPAPDRVGSGTAKAHVAPRTPGEATLADIWRQVLGVEQVGVHDHFFELGGHSLLLYRVLVLARAASGADIPLRALLQSPTLEEMARTIEAAKTGSLPVHDVVAELEADAVLEAGLLPGTALPSTSGPARAVLLTGATGFLGAFLLEELCRKTQARIHCLVRSKSEQEGMQRIRKNLESYSLWRDDLASRIVPVRGDIGQPLLGLSEAEFQRLSEEVDAVYHNGALVNFIYPYESMRAANVLGTREILRLCVRTRIKPLHYVSTVSVLPVGRQLPFREDEPLEAAASLVGGYAQSKWVAEKLVREASQRGLPVTIHRPGRVTGHSRTGAWNTDDLVCRTLKGCVQLGSAPSVDALLDVTPVDYVSSAIVDLSLRPESLGQTFHLVNPQFVRADEMWSHMRAFGYGLRVLPYDEWLAELGLAAPSDRELGDLLLFLQQVPPEDRSVGGPRMVVCDSGHTLKALGGTGTSCPTVDATLISTYLSSLVQRGFLAAPAGW

SEQ ID NO: 13903 - protein, 978 aa, Myxococcus xanthus
FDTLFNFIHFHVAGGLSQQKGLRFVDEMLGAAWMELPLGVTFTQDPDTSSLSISISTTGTRHEAERTRELGQYYLRALEAVAAGPGGRYDQAALLPPADRDTLLGAWNATLREVAWEGCLHERFEDRAALSPDSLAVLDDEHSLTYAELNRRANQLAWALRTRGVGPEVRVGLCMERSVDMVVGVLAILKAGGAYVPMDPAYPAQRLAYMVSDSNVGCVLTQQRVADKLAGHKVEVLCVDDAAPTNEPRSESNPPRLSEPEHLAYVIYTSGSTGKPKGVMVQHASVMNLRAALAAAAYAGMDKPLRVSLNASLSFDASVQHLVQLADGHALCVVPQTAREDARIMLAWLEQNDVDVLDCAPSLLRLLLDEGLAAHRPLRVLAGGEALDEALWARLSAHPRIECFNVYGPTECTVDSTLRPVRGASLPPSLGGPLANAQTYVLDAYLQPVPVGVPGELYIGGAGLARGYLNRPELTADRFIPNPFSTASGARLYRTGDRARWLPQGELEFLGRIDFQVKLRGFRIELGEIESALRQHPAVRDTVVLVREDTPGLQRLVAYVVAEPAATVDSGTFRPFLKERLPEHMMPSAFVTLEALPLNTSGKVDRRALPLPEETSPRHEVYVPPRDAYELELARLFEELLGVSPISAKSDFFELGGHSLLAVRLLSMLRARTGRTLPAAALFQTPTVEGLAAFLRREPALWTPLVPIQRSGSRLPFFCVHPVGGTVFCYTELARRLGPDQPFYGLQAQGLEGTLPPLESIDSMAASYVDAIRTLQPQGPYRLGGWSLGAVIAFEMARLLHQRGETVEVLALIEPSSTSLAQGVTTNDDSAAATMFALDLALTAGIASAMTVEGAVSDPQALVERVLQEDREAGVFVPDAGMEHFHALLRVFTANVRALQQHTLGTFPGSLTVLRGSDTELEPSEAEDRGWSRHATQLAVHVVQGDHYTVLRLPGADALARVLTELLARADTTESVSQ

SEQ ID NO: 13904 - protein, 506 aa, Myxococcus xanthus
MDRPLHSVRTRLDDFLAELATLNYRQGAGLALDVSPSQLHAAFPELSSPDTFAAANEALAKAQSKNEPLTVRRIRLVRELVASHVEDALAARHVEAIASLEAQARLMVDDQTYSFGEALGRIPHESARGRRALLERATGEFLWQNRTRYGDRRDAALHTAEQLGAKNYPALRQDVTGIDFAKLAESAATMLARTEDAYRDVLAYVLKKVDPLLRPLPGGEARRHDLQAALQAPWMGGLFRREDAFPAVVRWLGEWGLTPNAGGRIRIDDEARPGKSPRPFVAVVRVPDDIRLVLQPRGGIDGLASLLHEMGHAQHRAHVSDTLPMELRRLGDASVTEAHAAVFERLLLSPEWLKRYLGLPTVAARDTVRLAAFQALALLRRHAAKLTYELSLTQRGASTERADEYADGQRHALFVEPHPGFFLHDVDPQLYVAHYLRSWALETQLTARITEQFNEDYWRNPAAAAWLKGLYARGGTDDAEGLATETSGTPLALPEAGERLVAILNR

SEQ ID NO: 13905 - protein, 237 aa, Myxococcus xanthus
ASWRSRCARSWSTILTGTTCRPAVPRDKSNAPLPGMSARDAAPERHGPGAQKQAPCLDCDGSRCPERGPPVMSPRSALLLVTSWLVIPGQALAADSTELTPEKVAEIRRDEAQALSEVNAEYGNRKSSEMSTAERREAIDKQKAASASVLEKHGVSGKDFARYEARMSPADNARAKAEEQRLAEAAKAAKQPAPAAAPEEVHVQQGFSDQDPVELEATEGAEPSIDVGVPKDAELPQ

SEQ ID NO: 13906 - protein, 132 aa, Myxococcus xanthus
MRQLNSDARIIKELSHLLLRSRVRPYYLHQMDVAEGCEHLRTPIAKGLEIIQQLRGYTTGLAVPHLAVDLPGGGGKVTLQPDYAVEYGAQETVFRNYKGERFTYPEPEETDCTCPYDGVWQERAPRYGYRKG

SEQ ID NO: 13907 - protein, 359 aa, Myxococcus xanthus
MDTSVLPAGLPPEPTAARASLSAEGRKRLFPNATDAEWADWRWQQRHAVRGLEQLERYVPLTSNERAGVQETSALFRIGISPYYLSLIDPEHPFCPVRMQSIPVRAEARIRPGELADPLGEDKTRPEECIVHKYPDRVLFLALDTCSVYCRHCTRRRITQGGVAELSKEQLRRGVDYVRSHPEVRDVLISGGDPFMLSDSRLEELLAPLSEIPHVEMIRIGTRVPVCLPMRVHRRPGENAPALRARLGRHALQSSEGSYARGARGLRPAGGPRRTGGEPGRVECGSSTPTRASSRSCRTCCCAAACGRTTCTRWTSPRAASTCARPSPRGWKSSSSSGATPPASPCRTSRWTCRGAVGR

SEQ ID NO: 13908 - protein, 83 aa, Myxococcus xanthus
MGYMPGFATPRIVCDVPFVGKRWVHQVAEYDRERGISYWTKNYRTGIELNDADALSRKYEYFDPIDQLSEAGQAWWREQQKAA

SEQ ID NO: 13909 - protein, 273 aa, Myxococcus xanthus
  unsure (1)..(273): unsure at all Xaa locations
MERDQRERATMSLLVPPQMLNTMNLEDLWRDPVRRYMLPAYADRLTEWTNHPKASRDSLHEQDMWVVEGLTHRYPTKVLAEMLPTCPQYCGHCTRMDLVGNDVPQVSKHKFGIGPKDRYAQMLDYLRRTPTVRDVVVSGGDIANLPIQQLEPFVSSLMDIPNIRDIRLASKGLMAIPQHFLQDSVLQGLDRLAKKAVERGVDLALHTHVNHAQQLTPLVGKAVRKLLEMGXRDVRNQGVLLRGVNDSPQALLDLYFTCSTTGSSCRTTCTCST

SEQ ID NO: 13910 - protein, 238 aa, Myxococcus xanthus
PPPENKPPVAPPTNTGVVIAAGTTEPAAPAEDPGGDEAPENAPVDNGQTPPPATDPAPAPVQVAAVFKGDDGAEIAVNGERLGRIPDARMANLEVGKTYAFTAKLAGYKPYSGEFKADGSSKQVTVAFEMTKEPQPEPTVANVRPPPQTAPKPPPAPKPPRAPKVMGKFACSTKPAGADIYVDGKKTNRQTPVTLGSPLMLPVGKRKISFKLNGKTTKPVVVDITEDNVAKLVNVPIE

SEQ ID NO: 13911 - protein, 780 aa, Myxococcus xanthus
QVGGARPFQAEYITEVLYDRVGLLWIGTREGLYLHDGQRFRKFQYELGNPASLASNAVRTLHEDAQGRLWVGTMTGGLSLVDRARWSFRHFRHDSSNPASIPHDGVFTLADADDGRLWVGTHRGLALLDPETGVAERIPLQPGGGQEFVMALKHDRTGALWVGTLSRGLFRRGPGATTFEPISSEERGPGSRDIFSLAADPDGGMWVGTRDGLYRVERDEAYLRRARLSPPEVAQKVQLVTELEPDGHGTLWIGSFGGGLLRVDTATGEVREERLPSAGPGYEHRIDEGALTFDAAGNLFIGTFGMGLFYAPFRQETFRTLRGKAGNSASGLTNEDVWAVIPDGDSHLLVGSFGGGVDRVDVRSGQAVPLPGPVLDGVDTRGVLSLLRTRDRELWVGISMGAYRLDPVTGQLLKFYRRTERGASDHPGFVNTLLQDARGHVWLGSGGQGLQRYRPETDDFVAFRHEPSNPRSLSDDFVTVLLEDRRGRFWVGTRSGGLNVCSASEDTVECMRLGADSKLHLSHYYVSTLMEDPSGAIWVGTVGGGLQRVSLDDSGLPVSVDLWTSTDGLIDNNVMAMARAPDGGIWVGTRAGLSRLDVATGAFENYAASDGLPSDAFNPEAVTLLGGRLYWGSSKGLVDLDPSVRPPREPSPPLILTSIEGLESDALPSQPVWDLPGLEVPWRQPFSLEFSLLDYARNGVEYAYRFTAEEPWLALGTRNQLSFHSLPPGEHSLRLRARSPGRDWVEMRPFTLRVAPPLWQRTDVRFGALAGVLLSVVVGL

SEQ ID NO: 13912 - protein, 70 aa, Myxococcus xanthus
RASSPWFTQGSPATTGQLAEIRPGAGSSVPDAFTLLGNRIYFRAVDDTNSFQLWSMPAAFSCPAGLAEAE

SEQ ID NO: 13913 - protein, 218 aa, Myxococcus xanthus
EYADGESFSRLPMPLAPVEAVELLGQTLEAVESAHARGLMHWDLSADNLVLTRDARGERRVKVLDFGASAILSSSLSPEERARGMVVGSPAFIAPEQWSGEVVDGRADVYALGVVGYLLLTGRLPFGIGRAGELAPPEPHVLNPSVPPALSAVLLRALAPRPAERFPDARAFREELARCMDPRARAAEREAALVDDVELLVDIDITLDEDAAPVSCRA

SEQ ID NO: 13914 - protein, 347 aa, Myxococcus xanthus
MAGGSGTRFWPLSRQARPKQFLPLASKLPLITDTSARLKGLASVKDTFIVCGPLHAKAAAKLVKGLPKANLLVEPVARNTAPAIALAAVQVAARDPKGVMVVLPSDHHVADVPGFKRTLADAADLAEAGHIVTLGIKPSRPETGYGYIQVGEALEGGGRKVQAFKEKPDLETARGYMSSGDYLWNGGIFVFRVDVILEAFAKHMPEMKKGLDALRKAAGKRTFGAVLKKVFPKLPSTSIDYGVMEKASNIAVLPGDFGWSDVGSFAAIPEVRPADANGNVVSGNLAVVVDCHSCVVLADKRPLSVVGLTDMVVVDSGDAVLVVPKDKSQDVRKVVEALKARKLTKYL

SEQ ID NO: 13915 - protein, 376 aa, Myxococcus xanthus
VGHPGVQLLLSDHSGLRRAGALAVSHATHGCSSLHTTMPVPAVSVLLPARNAEATVARAVRSLLTGTVRDLRVFAVDDGSTDGTREVLTDLAASDSRVEVLDGRGQGLVAALNLALREATSPYVARMDADDEALPKRLEASLTALEAEPGLAGVGTAVELFRDDKPVSPSLQAYAMWLSGLTSAERLDRERFIESPLCHPSVCLRRDALVAAGGWRDGDFPEDYALWLELLDRGFGLRNLPEVLLRWRDSDGRMTRTDPRYAVKRFMWTKARYLTRGRGPLADGRPCTVWGAGPSGKTLTYFLHQEGVRVRRYVEVHPRKVGTRIHGIPVISPQELGAPGDGHLLVCVGVRWARAEIREDLIGRGWVEGRDFTCAA

SEQ ID NO: 13916 - protein, 174 aa, Myxococcus xanthus
MSAPVLIGYFDSEAQVLDATRAVREAGFVLHDVYTPYAVHGLDDAMGLKPSRLTWVCFGAGLLGCTLALSLQYYTSVVSWPLNVGGKPFNSFPAFIPVTFELTVLFAALATVAAFLARAKLFPGSRRSVLPRVTDDRFAIAVTPREAPSELDAAEDLMRRHGAVATDLLEEVAS

SEQ ID NO: 13917 - protein, 492 aa, Myxococcus xanthus
MSNQHLSPLREPLVTEPRSLGQLTEEICAPMERAPTWKWWVAFGIAVSVLGTGAGIVGYQVATGIGVWGLNKTIGWAFDITNFVFWVGIGHAGTLISAILFLFRQKWRTSINRAAEAMTLFAVMCAALFPVIHMGRPWLAFWVLPYPNDRGSLWVNFRSPLLWDVFAISTYFTVSAVFWYVGLIPDLATVRDRAKAGIRKAVFKVMSLGWTGSNRTWSRYETVYLLLAGLATPLVLSVHTIVSMDFATSVIPGWHTTIFPPYFVAGAVFSGFAMVLTLMIITRVVLGYEHLITLRHLENMTKIIIVTGGLVSLAYATEFFIAWYSGNPYERFAFMNRAFGPYAWAYWIMVTCNVVSPHLFWFKKIRTSPAAIFVLSLVINVGMWFERFVIIVTSLHRDFLPSSWAMYTPTMVEVGTFIGTFGLFFTLFLLFVRVLPIISIGEVKSVLGFARDGHAAQSHPPAKPVAEEPHPVAHRPASPVPLAIATRKDAPV

SEQ ID NO: 13918 - protein, 459 aa, Myxococcus xanthus
VLYLRRGVVTLGAAAAEAPAFREEGLAKALASVARHAAEWELVLYPTVALRDGAPANNAWLQEVADPITKVTWGNPACIAPARAKALGLKDGDVVQVRAGSTTLSVPVLVQAGTHPSVIAVAVGYGRTQAGRVADGIGVNGYPLSAVVDGRARRTVPGVTVQATGEQQPLALTQTHHRLEGRPHVREAELAAFLANPRAGNEVQAGHGGGGHSLSLWSGHEYKGHRWALAVDLSACTGCSACVVSCQAENNIPSVGRDEVLRRRDMHWMRIDRYYQGDEANPQVVHQPMMCQHCENAPCETVCPVLATVHSSEGLNQQVYNRCVGTRYCANNCPTKVRRFNWFDYEHAEPLERMVLNPDVVVRSRGVMEKCSMCVQRIQESKAAANREGRPLRDGDIQTACQQSCPAKAIHFGDVNDPDSQVARLAKDGRAFRLLEELNIGSSITYLTKIRNTGSGSGT

SEQ ID NO: 13919 - protein, 250 aa, Myxococcus xanthus
KTLPSWMLCLCLALAVPAQAQRRSPPSGSAGERKISPQGPGATSAGDANAGPRRTPTCEEARRNARYGIYFDKVEIEKLVQTVADATCRTFILPENVRGKISIIGPENGRVEVNADAFYSAFLAALDANGLAAYQYGRFMKIVDKRSAKQNPIPTIVEEGEPYTTNEQMVTKLFRVQNVEVEPLRGVLQQLVSKDGDTIPYPPDTIIINDVGSNIHRLERIIHQLDTRAANDEMRIIQVQYASAQDVANT

SEQ ID NO: 13920 - protein, 246 aa, Myxococcus xanthus
MAMLDLDRLSRLTGIKLPEPEPEVQEPGGASAEVDPNAAPVKSGLRVKLLGTLVASNPDWSFASIQDMTTQRSQTYMVGNSLQGATVENIERERVIIINGGRREYIDGNPGDGAFVPPSPPVAQANTAPPSDGSGIRATSENEYEVPRAEIDKTLNNLNNVAMQARIVPAFKDGQAVGFKLFSIRPDSIYSKIGVQNGDVIRRINGFDLNSPEKALEVYSKMKDAARIEIEIERNGAPIRKSYNVR

SEQ ID NO: 13921 - protein, 341 aa, Myxococcus xanthus
HEKGAPMAAKSARKSPAAKKAATPRKPRRKKAEPKSRGLSPAEVASDSVEYPTELLEAVREDGGEVLGVYRDPLGGHPVVFSVLPIDKVEPTPYQRDVSEPHVKRLANAMERLDRFLDPVIAVRKDGRYWTPNGNHRLNASRRLGAKAIVALVLPEEDVAYQILALNTEKAHNLKERSLEVIRMYRGLVGAERKGPETAFAHLFEEPAFITLGAAYEQRPRFSAGAYHPFVKAVEDFLDTPLEDALPLREARARRLLELDDAVVSVVDALKERGLQSPYLKNFVVARINFLRFRKDGGKPDFDATVDRMQASARKFNVDKVRREDIGRMGGGPLEPDEESA

SEQ ID NO: 13922 - protein, 103 aa, Myxococcus xanthus
ESSKELVLSYDESETHATLAALTETGTKTEHPADFALDPKRVARGLAQISLTDILADEVLAALFADSSELGPLLARSERITGWMDAAPGGAHRVSLTWPLPPQ

SEQ ID NO: 13923 - protein, 469 aa, Myxococcus xanthus
MMLFLPLGVDNTELERLPRVSITIAAICIVAFFISWVIPSNPLGVGENELRSLLEQSLEHPDLEFPPACAERLLSDSGRRLVRNMHQRVAESDGAESVTNRQQGLNERCEELIAQHDSSLLSRFSLVPARGLAQPGWLTYMFLHLGWMHLLGNLLFFYVTSLLLEDAWGRPLFAGFYVVGGLVAGVAHYAIDPSSESVMVGASGAVAACMGAFCLRFAQRRVRIGYFVWLLKIFRGTFPVPGWVWGGLWFGNEVLNYYLLGNNTGVAVMAHIGGFVFGFAGASLLRVTQLEERVVAPALAAKQGGWVADPRLAEAQEALDKGDRTAARAGFQRLLKTQPDHTDALLSLGRMDLEDGKTQAGTARVERALHTLAGRASTDALWFAMEPLVSLLPHRRAAARLRVEAGTGAGHGRRAAGFVGDDGSPVQRGGRGRGHHRGARAHPRPRSCEWRTTRTSSGQQTTSRAPSRC

SEQ ID NO: 13924 - protein, 512 aa, Myxococcus xanthus
MSDVFDKCRNWKDYRIAKATGLYPYFRAIEASHGATEVEIEGKRVIMVGSNNYLGLSADPRVKEAAIKATEKFGTTSSGSRLLNGTLALHEELEARLAKFLNRESAIVISTGFQTNLALASILGRHDIVFSDRQNHASLVDGIRLSFATERKFRHNDMDHLEQLLSQADPDAGKIIVTDGVFSMEGDICNLPRIVELAKHYNARVMTDDAHAMGVLGTRGRGTSEYFDLEKETDLVMGTFSKSFASLGGVLAGPFEVINYIRHKARSVIFSASMTPGSIAAALKALEIIEAEPERRARLLDIAEKMHNGFRAMGFDTGVSVTPVVPVHIGDQVKCFRFWRALHEAGVFANPVIPPAVEPGHALIRTSYMATHTDAQLDRVLDTFETIGRKLGVIPETRPSVYEPVQIARPGTRILSNRASEKWAAGSNGLLADKGGITLDQLSRMSSREVAGRLFDAVEQLTWRAANLQPEDLRKLGNAPMKLWEKRGELPGLLLEKGAHFFMRNGAHSDRN

SEQ ID NO: 13925 - protein, 208 aa, Myxococcus xanthus
MAHYKDLERAADYLARAKPLLTGEAASAGDRVRELDAEITRVLEENAWKKRDAAPTPTVDAPPAPPRVFPCRIVGMTAMALTVEAANGQRRTMAMTEVLAIAVGMLPVAGPPGTSPRQTVLTDLVLSWGSANEGPRVLRVNVAGLALNHFYPGVAPREAYARFLADMLERTNANALPDASSLKQGQYPRFNSEAELSQHYYGGSAAAA

SEQ ID NO: 13926 - protein, 343 aa, Myxococcus xanthus
SDTLESVPDGIAIVGLAGRFPKARDIEAFWENLRAGVRGISTFTDAELLAAHLPAEHVRHPRYVKARGALEDTAMFDAAFFDFNAREAELTDPQHRLFLESAWEALEDAGYDSRRYPGRIGVFAGASMSTYLLDALRGGAALPEGLLQLAIGNLSDFLSTRLSYKLDLRGPSVSVQTACSTSLVATHLACLHLLAGQCDIALAGGVSARAREVGGYLYQEGGIFSPDGHCRAFDARAQGTVEGSGVGLVVLMRLEDALAEGAHIRAVIRGTAINNDGRQKVGYTAPSIQGQAEVIAMAHRMAGVEARTIDYVEAHGTGTAMGDPIEFTALVQAFGEDALPGAF

SEQ ID NO: 13927 - protein, 78 aa, Myxococcus xanthus
MGVALATVFMGTGCGGMNPGLDDPAGTDEAHGSEVQALTTCEDCHTTYTACIRQALGDPQETQVWIDQRHECALQYCP

SEQ ID NO: 13928 - protein, 649 aa, Myxococcus xanthus
MRDVAFPLRDFRFPSGLRVVVEQDARSPVVAVVAVVGAGGSSDPGGKEGLAHVVEHLAFRSRHAGSPSVWRRLEASGAGFYNASTSLDYTSYETLGPKEALPVLLKLEGQRLAAPLAGVSPEVFAVEREVVRNELRQRNETGYVGQVFSWLNAAAFPGGHPYARPLAGTHESLSALSLSDAQRFARAHYRPDNVTLVIAGDVDLAAVEATLRANLPEAWVGTGAPLALEARLPAQPAAPATTPAQKSVPVFTAAVPTPEVYLSWVLPRGFDESSAVQDFVRATFGQNLLGAVRNDGDIADISTNLIPGTRASLLVVRVRLSRGDDPTRSAGKVLDQVQNAWVQEIQPGSVLGREFDFQATRRQVVTGMVLESEDLMSRTERRALLTHFTQDVRSYTRSQVALMGLGGGKVTDFSYQWLQRDRVRMIVVRPGEVPGAATAAATLSADEEPWTTPAEQVTPSMTAALDSPVQVLKLDNGMEVLLAPRPGLPVVRIGAALGGGSSYGAKSGVADLANWGSFRESWFEGRPSDWGLHSTSSFQRDHLRVGISGTAGNVGNMLAMLAEQLDSTRTSEDVVRFYREQVLPWRQAVDSNPELLAERHLQKALYGTHPFAREATGADLAQVSWTEAEAWLKDVYRPANTVVVIAGEL

SEQ ID NO: 13929 - protein, 130 aa, Myxococcus xanthus
NVSRPVLAGGFWKKKRTQPVKRAKDASLVRWESQPWRRQLRDAAEYEHPVARAALVQALLAEGLTMDADAARFAGTSEDRDCISIAQVLRFADSLVLRMALACTDDHVLQLVHLRRDAEDLAERMIEWAN

SEQ ID NO: 13930 - protein, 308 aa, Myxococcus xanthus
MEARSPEPLRAATALGWLQAGNPVWHEVAVWEARLALPRETLALRAALRALGASALQEELDLGAASAEQLGFVADLAARLARGPLMPYAHEAGDASFRRQVVRYLDRYFGLRLAEEEVFVAPEREQAVYSLLMATCDAGDEVLVSRNLHPLYARALEKAGVRATVTHTSLAEIRRLLSAFDVKMVLLTVEKGERTNLSVLRDIVAEAARRGIWVVLDESAFFNITGGVEPHTLFEFLAREAHAPNLVVLYGLIKNAVWPDLELTLLMPVPQPLRGDLEAAAEVTYSRISTLAQAFYERTFADLLSFRL

SEQ ID NO: 13931 - protein, 202 aa, Myxococcus xanthus
WLFVDHVDETFTSWPAPTPRGWIALVADPALARRILQDAQARGHGDAKLFAGLSWAYSIPAEASIAEVLDNPGLMDASAVAALEIDTQLSILREETGLTDADIIRVPFLFQNASDGVTAYQPATLNLLSLTPTQVIAPDPHGPLLDGEDPFKTRFEEALGAHGIHVHWVDAWAPFHIAQGQVHCATQSARQVPDVKWWEGGR

SEQ ID NO: 13932 - protein, 294 aa, Myxococcus xanthus
MLVSLSAGGTQTPRPGDDWRAGLKTNISRARQENPATFIRFDTAAAQVDALDAKKRGTLAAVSPGLRALGPEALWPMVERLAFPPQETPRLPSRESARLAFKVGLVEATGALRDLRLAPLWKSLLESPDTQPQVLRAVAGALARLETLDAANTLIAASKQKDARGEAAMEALGLCRRLVATRALADALDARPEREVMRRLAKALGDAGSAWAWKTSGVKARSEEGAIRLVAAEALVRAYVDTDGDVRRAVSNALLRVDAPQTPTLIDAARLSAPPAQQAALDALAERLRHNPLR

SEQ ID NO: 13933 - protein, 377 aa, Myxococcus xanthus
MPSDVQVTPVRGEAERMQFIRLPYALYRSDPHWVPPLEMERRDFLDPKKNPFFEYGELELFLARRGPDVVGRIAAIRNPRHMEIHGTKEGFFGLFECVNDAGVARTLLESAATWLRLRGMDAMLGPANLSSNQDWGLLIDGFDTPPAVMMPHNPPYYAALLEACGLTKAKDLYAYELSSSAQPPEKVVRIAEKIRVRDGVVVRPVNMKDLDAEVKRIRDIYNSAWEKNWGFVPFTDAEFDHLAKELKTVVRPDLALMAEVQGEPVAFSLTVPDANQAIRAANGRLTTFGLPIGLVKLALASRRINRLRLIILGIKEGYRRRGLDAILYLDTLRTAKRLGYVGGEISWTLEDNHLVNRAIESMGAQRSKTYRVYTRAL

SEQ ID NO: 13934 - protein, 233 aa, Myxococcus xanthus
MTSSVPALLLVEDDTNLRLALRDNLENQGGYAVEEATCVREAREHLGRRDFQLILLDVMLPDGDGYTLCRALREEGVATPVLMLTARTLEDDVVRGFESGAQDYLGKPYRLRELLARVGALVRRSGAAPVKGLRFAGYRMDLDRRKVESPAGAPVELTRTEFDLLAFLVRERERVLRRDEILDAVWGRDVVVDPHTVDNFVSSLKKKLGWNSTSRFAIQTVRGVGYRMEIEAA

SEQ ID NO: 13935 - protein, 607 aa, Myxococcus xanthus
MLRRLLPTLIALLLGFAGLAWGLGSLQRIFATERDDAQASLDSRREALEQYARASLAQSLRDRLEAARPALEAAALDPLAPATGLYLRERGTQLLPRLALHDTGEDTPAKGRYAGLRAGTERADEAEDPWAERLALIREVDRALSRGDRRASTVALMALLQHRAQYVLASTRDVPGFLVVLESLAERGDPVPQLMHALVRDGLADGRSGRLDGLQRLLLLRRARFTKEDFDFLRERIVALSTKAGVPVADFEARAAELASEPLPLPRTLPGPALVRAGWYLEPRGGNHVRGVAVDSGALLQSLTREMRERGLLEADGQVRLLADAEMLPLADLPLSVDTPEWARAQGALERRYRLKTGMVAACAVLALGIAALAFVAQHRKLRFLELKSDFVATVSHELRTPLASIRLLAETLEWRLAEGTDARDYPARIVREADGLGFLVENLLSFNRIDKGRWVPKLAPVRLDELVAQLRKDLEFWSKVPVELEADVGEFSLRADGQLLRLLLSNLARNACAYNTRSPVRLRIEALSDGRVRFSDNGVGIPQTQWERAFEEFVRLPGQGHDAPGSGLGLALCRRIMRVHGGTLRVAASSPEGTTFELRFPHTVTT

SEQ ID NO: 13936 - protein, 56 aa, Myxococcus xanthus
LTLWEGIGEPLRTPKDVAQLGALIRKAQSLDTRKERFERLMPGGSSDFDDVPSLGN

SEQ ID NO: 13937 - protein, 130 aa, Myxococcus xanthus
MAVAKKHKSGTVLWFATWADTQKVQDLESDPHCSLAFHASEDSATYLSVSGVAEVVRDRRAIHDLWEPGWKPWFPQGPDEGDIALLRFTPEHAEYVHPAGGKLKVLFSTAKALVTKQRPDIAPKNVLDLH

SEQ ID NO: 13938 - protein, 201 aa, Myxococcus xanthus
MEWDVPLIYFYGIEPGAYRPIWPVYISEANPAELSFTVVSAAPDAEVLAPGLHAADPKLLNLERRYATVQMKKRLHQAAFRQHVLRAYSQRCAVCRFPRPELLDAAHILPDRDERGRPEISNGLSLCKLHHGAFDTDLLGIRPDGIIEIAPRLLAERDGPTLEYGLKGFAGKALSILPEAPAHRPRREYLEARYERFRMTG

SEQ ID NO: 13939 - protein, 325 aa, Myxococcus xanthus
SSTAESRDVHLTVNKGRLSVEASHTARQGFMVEVAGLRVSVVGTVFTVERTKDGAAVAVAEGQVRVEAEGQPPRRVGPGERVELHAATHTLNPRKMSKPDLRAIAELRDPVDEVPVSPPRPVSARPAPSQKPEPTDAPTPMTPGAVAAVTPTPREPIGEAPAPEPAPPPANALAPVAAAGSTPTAPPAPVDPNHEFAPYPVPSVNGPRPPAPEPQPTPEAVAKQTPKQREPLIPMALMSKDADERFLGYARLKVNSRKCESFLVGLDEIAQRSPRASHREQARYLRARCFEEKLESHRAKDEYRRYLNDFPRGRYAKEAKTGLLP

SEQ ID NO: 13940 - protein, 49 aa, Myxococcus xanthus
MTLLQGPELPQWAPGRAGRRIRALESVVRELVARGNATEPPQKLPRTGS

SEQ ID NO: 13941 - protein, 156 aa, Myxococcus xanthus
MLGILEGDPARFDTMLRAFEYMVDTQLERQSARTSPNRRRIYFGPWRPPLELRTLAERFEKLVVFYGEANAHPAGGEEIPTELVHAVACRPATGERFEAIIAPEQPLAYSTPLHVELSEDILRAGEPRAEAMKRFEAFLRPDDELAVWTTFALDLL

SEQ ID NO: 13942 - protein, 89 aa, Myxococcus xanthus
MAGALGKGRPAVLPVPQTVSYVVGLGSEAVARLRGTVPILNRDKVREMRCPAWTCSTERANRELGFLPTIPLAQGLAGTLAAYREAGGR

SEQ ID NO: 13943 - protein, 197 aa, Myxococcus xanthus
MAVGRGVFASKGYEATSIEEVAHQAGVSKPIVYEHFGAKEGLYAAIVDREMDDLVTRVSESIASGTPRERFERAVLAFMTYAKEEPAGFAVMTRDSPLAAGRRGLTRVIDDLALRVSDIFKSEFEHAGYNPKVAPIYANALVGMVTQVGQWWAEDGRSFSIDHVARHVAALGWMGLRHLPKEPAASNGRRGAKRRGG

SEQ ID NO: 13944 - protein, 98 aa, Myxococcus xanthus
PASTTSEPAPTACLHCGSPVPSGGAARDFCCVGCEAVHGLLVEQGLTRYYQLAQGKTAPAPEPRKERAFAWLEPLMSRAESTPGPLCALELDVQLESI

SEQ ID NO: 13945 - protein, 33 aa, Myxococcus xanthus
SNFITEETEGFVRKIGLNRPEKRNAMNIALIEQ

SEQ ID NO: 13946 - protein, 169 aa, Myxococcus xanthus
MLGLAENASRIQSVLLIGSQHGWWRHWPLRQGLALAAIWYVALPASVALLGYFPGRAVGSEDLPGGIAKQWARWCRNRHYVSDDNGAPLRPYNDRVRARIRLYSFSDDAIAPEAAARALLDYYPNATREHLHRTPAELGMKRIGHFGWFRSSMPEVVWVEAADWLEQTK

SEQ ID NO: 13947 - protein, 207 aa, Myxococcus xanthus
MERKRRSATGEQSRRAILDAALDCFSRLGWAATTIEDIRKVSGASVGSVYHHFGAKEGIAVALYIDCLRLHQESLRGRLERKHDAEAFVRTIVTHHIAWSREHPEAARYLLRMRREEAVAAAEQEIQSATGDFIREGFSRMKAHAQAGELLPLPPAVYMPLMLGPAQELLRAWANGQVELKAGIEKVLADAAWRCLRPETAPSRKVP

SEQ ID NO: 13948 - protein, 142 aa, Myxococcus xanthus
MDHASIFILIAGTYTPVALLGISGAAGNRLLLLIWAGALAGVLQSLFWIQAPKVVTAALAVAVGWTLVPYFDEARQALTGSNLALILAGGVAYTAGALAYALKRPNLRPGVFGYHELFHALTLVGAGLHFTVVLRLVRAATL

SEQ ID NO: 13949 - protein, 136 aa, Myxococcus xanthus
MAVALVASALELGKRLRPLPGMANLARHVTRWGAKFSWTGRASAMGAVTPLLPCGLLYGVFAVALASGSFGGGALVLSAFALDGLPALLGAQLQAALWKHRPKWMSLLLQRAVPLVAAAVLVYRAVSVNAGGASCH

SEQ ID NO: 13950 - protein, 978 aa, Myxococcus xanthus
APWAPGPQRDEVLVAWNDTAAPYPADTTVHQRFMEQARRTPERVAVTFEGRSLTYAELDARSNQLARHLVSLGLELEARIGVCGSRGLELVIGVLGALKAGGCYVPLDPSWPMKRLEHVSSAARLSAVLTWQSLLPSLKDGPWHVVALDADAADIARQSTEAVPVPVLPDALAFATFTSGSTGTPKGVAIPHRGLLRLSEGTRFLTQSPEEVTLQLSPLAFDVSSVELWGTLLHGGRLVVYPPGTPELDAVARLIIEHKVSWLLLPTSLFGLMQQHQPEALLRVPNLMVGGEALPAPRLRERLAQGGALTNAYGPTECSTMVTRYTLSPGDTVGLSVPIGRPIDNTEVYVLDPALCPVPVGVPGELCLGGPGLARGYLNRPDLTAECFVPHPFSAVPGARLYRTGDRVRWRPDGVLEFLGRLDHQVKVRGFRIELGEIEAVLRAHPFVAEATVVVREDGSGSNRLVAYVVPPQPDVAPLREYLHQHLPDYMLPSAFIGLDAFPLTPTGKVDRKALPAPDLGLGASDFVAPRTELEQQLAALFREALDIERVGLNDDFFLLGGHSLLATQVVTRLRARLGVELPLRTFFEAPTVARLAARLESAPRTGAWLPLEPVSRPASGEATFDVSSAQRRLWFMEQLHPGLAVNHIPAALRLTGRLDVEALRRTFLEVVRRHEAVRTTFVTRGGHPAQRIHPVPSEWPLPVEDLSGLEPIARDAAVQARMGEEAHRAFDLERGPLLRTVLLCTGPDAHVLLLCMHHIISDGWSMGVLVREVGALYEALAQGRESPLPALVVQYADYAAWQRRLLDDPALTPQLDWWRSRLEGAPTLELPTDHARPAVHGAKGATYFFSLPAEQVAGLERVALAHNATLYMVLMAGWQALLARYSGQTDFTVGTTVAARSRPELEGLIGVFVNPLALRCRLDGNPTFSELVTRVREESLGAFAHQEVPFEQLVDALGGERDLSRTPLFQTLFVLMS

SEQ ID NO: 13951 - protein, 256 aa, Myxococcus xanthus
PALALLMAGCDENSARVVGVTPPDGLDYAHEEPWREGTFIPPPGPGGRILVTNSLDDTLSLVELATVGTPDFRELARVPVGLNPVELEGPHHTAVSPAGDFYYVGISNYVPGGGSGPHGAHGTGADDGYCLKLDARNNRLVGSVRVNPNPGDVIISADGSTLYQTHFDTLKISEMARQGRPESDMNANLAIIDARTMTRKAMVEVCPAPHAVRLSADERTAYIACWSDEVAIVDLAEAKPTVARVKVVAAGSGFRD

SEQ ID NO: 13952 - protein, 98 aa, Myxococcus xanthus
MMAWLGNLLLPSAQAHLPPVTGDFYWVQVTVPGRRCPVELLTSNMEWQLDAATWDTLRAASGQDLRVQVTSAYLVQNRLREGPYRLESPRTIRVEDSR

SEQ ID NO: 13953 - protein, 137 aa, Myxococcus xanthus
MDLFGDDGVRRECVCLGRTNVTVEHWEPQPGPRPLLDDARFTSLAEVLEAPDSTPEVRHEAVQRLADERSPRVVAVLLALVARKHSLMALRVLSEWGVVGAREALQRDLAQVRPDNPADLWTLTALERRLQAWAALQ

SEQ ID NO: 13954 - protein, 196 aa, Myxococcus xanthus
MERFNARAQALLFDERRLAPELPPEETTPPGKFPEYYVSDTVPLAPSGWALRVGGLVAHPTVLTLDALQRMPRTDLRIRHHCVEGWTAVASWHGVRLSELARQVGADTRAGYVELRSFDAGYYSSWDRPSAFHPQTILAYGMNGQPLTPGHGAPLRLYSGVKLGYKMVKYLTEVNFLPEPTGGYWEDRGYEWFAGV

SEQ ID NO: 13955 - protein, 307 aa, Myxococcus xanthus
MPHTDRVKQILSWYPSDNPGTLTNLARLLNSGTLAGTGKLVILPVDQGFEHGPARSFGPNPAGYDPDYHINLAIESGCNAYAAPLGFLEAVAGRYAGEIPLILKVNNSDTLAKVANPMSAVTSSVKDAVRLGCTAVGYTIYPGSGARNEQYEDLRDIIAEAKSYGLPTVLWAYPRGNLSKEGETGIDVVAYAAQISAQLGAHVIKVKPPQDHIEQAEAKKAFEKAGIPTKTLADRVREVVRSAFNGKRIVIFSGGEAKGTDALLEEIKQINAGGGFGSIMGRNAFQRPHGESIKLLKDVMAIFAGKA

SEQ ID NO: 13956 - protein, 233 aa, Myxococcus xanthus
ALQPYALTVVAVDPVAVDVVWVRVSAQGYTHLLRSDDGGRTLTPVTVLDDTFINMDLSSDGGTAWVGTLNYFFMGSSTGPLEKQPLPTGNACVLRDGETLYGCGSTWLHDWALARSTDQGRTWEHIFALYEIQGTQLCPRGTPVRDLCPARWPQLAEQLGAPLYPDGGVEEPPPPDAGTPDAGTPDAGQQPPEQRPPEPKSGGCAAAAGPALPLLLLLSSLLPRRRGPRRPHR

SEQ ID NO: 13957 - protein, 49 aa, Myxococcus xanthus
VLDADNQIPDGKLPGKSRQRRTLVMNWWGHRPTDIPAWADTRLYRALAR

SEQ ID NO: 13958 - protein, 43 aa, Myxococcus xanthus
MPSAALRLGRRPACLEIEPEWAERVTHRLRETAREEAQRASAR

SEQ ID NO: 13959 - protein, 70 aa, Myxococcus xanthus
MAAGAALTDAQGNRMRTLPPWQEGPLDAAGSSPIIIVLEEPEAADFGRYTLELWDEGRKRTLKLEGFQAR

SEQ ID NO: 13960 - protein, 376 aa, Myxococcus xanthus
VSLDRPPEGADAEAPRVRMVPDASTSSRPVRSREPSEVAAVLPLNPEPRDVPVADANAPVTPSEPPGVPAVEAPAVPASAAPVAETPAPPAPRSRRRAVMGWGGAALLGVGLVVFGVSRLAMPIAGAPAPAPPVPIEKGSHAVTSRSSNPSEMPLLEAVPSSPDAGAVHDTDAQDEVSAQVASSDAEGEAAHASPLKKRPSPGSALGKAAAVACLSAACASGPQVRDMPPRIQCPTEVLDSMAKLGFHPPKMIGNDLTLSMTPKVSVRPVPVPPDGEPITLYAIDEVRSAWSGRLPKGSRFYGTVYHGKTAIYGWFTEVEYPDGRRIPICANIVDSAAREAVGMEYDPSSTPGRPMMFPGVNLAISQVLGEMGHRR

SEQ ID NO: 13961 - protein, 329 aa, Myxococcus xanthus
MNTDIRALTERVQQESSFVEVLNQETSKVIVGQRYMLERILIGLLCNGHVLLEGVPGLAKTLTVRTVADSLSATFMRIQFTPDLLPADVVGTMIYNQQAANFTVRKGPIFANIVLADEINRAPAKVQSALLEAMAERQVTIGDQSFPLPSPFLVLATQNPIEQEGTYPLPEAQVDRFMLKVKVGYPTRDEEKVIMDRMSGGSSPRAQRVIDLQHLVRARELIHHIYMDEKVKEYILNVVFATREPSKYGLKDLADYIQFGASPRATIALAQAARAHAFLRHRGFVTPEDVKAIAFDVLRHRVAMTYEAEAEDLTPEKIIQRVFDRVEVP

SEQ ID NO: 13962 - protein, 256 aa, Myxococcus xanthus
MAFSEVRQYQPGDEIRIIDWNVTARMDEAYVKVFTEERELTVMLVVDVSASKEFGSRERTKSEVAAEVAAQIAFSAIANNDRVGLVLFSDRVEKVVPPRKGRTHVLRLVSDILTFQPQGRGTDLAAGLNYLTRVAKRKAVTFLISDFQARDYEKPLRLVGRKHDLVPVVVADPMEEAFPRLGLVDMEDPETGERFVVDTSDPRVRGRFARAMQAARDERRKLFKKLELDHVELRAGDDHGKALANFFRARARRMAA

SEQ ID NO: 13963 - protein, 125 aa, Myxococcus xanthus
NRLIPLLAVWLVVAALVVAAPAWAQAPAPAPAPATTEQVEPRNLSVRLEPQQVRIGDPFVYEVVITHPKDHRYELKVPQETGDFEFLDQTRQRQDGPDSATTTFRVRMSAFALSSVAVPALPFDV

SEQ ID NO: 13964 - protein, 296 aa, Myxococcus xanthus
MKAPSVGPVEAALLAQLAPAVVATVHWLPGGGALRVLEAGAGPTVVLLHGRGGAASQWFTYLTVLARSHRVLAVDLPGFGMSSTPEGPLATGEDAAAFFTAPIEALLSQLAPGPVAVVGHSLGGLVALELALRGRVPVERLALVDAMGLGPEMARKARLFFRAGPERLARSLGPWAWAQLMPPPPTPLGERLGALEYELHTRPGASPDAARAFNRLVPVAGPVFHRAEKLDAITAPVLLVWGEHEDTLPVSIAEQAARRLPQARLLRLDAGHSPHQERPERVLPELKAFLAAPQEH

SEQ ID NO: 13965 - protein, 1147 aa, Myxococcus xanthus
TGSIAYNHPLALQLTGALNLPALQRSFDTLVARHEVLRTTFRMEGGAPVQVIHPPSQVPIEVLDLSGEAVAHLREAETLRRVQEEVQRPFDLAKGPVVRGILLKQSAAEHVLVLNMHHIVTDGWSNGVMVREMAAIYGAFRQGQPSPLPPLPFQYADFAAWQRKWLQGQVLEAQLDYWRGMLADAPPYLELPTDKPRPEQPSFQGDNTPIQLPAALSDAVDALALKERATPFMVLLSAFQVLLNRYSGQDDVLVGSPIAGRRHAQTEGLIGFFVNTLVLRARFGQDPTFRELLAQVRDTTLGAYEHQDLPVERLVEDLRPTREEGRTPLFQVMFALQNTPVPELTLPELSLRGFESKHTVSRFELELVLSRATEGYQGGLVYSTDLFDAATIDRMMGNLRELLLGAMAVPDERVSRLPLLSQAERQQSLLAWNDTATPRSPGLCAHHVFEQQAARTPDTVAVSFEGQQLTYRELDARANQLAWHLKASGVGPEVRVGLCVDRSLELVVGILGILKAGGAWLPLDPSYPVERLTLMMRDAAIPVLVTQEHLADELPALGLLVCLDTDWPLIASQPQTPLAVEMSEDNLAYIIFTSGSTGRPKGTLLTHRGLCNTALAAIQAHRVHEKSRVLQFAAFGFDASVCEVFSTLLAGAQLCLAPREAIMPGAPLQGLLTAQEITGVTLTPSVLAQLEPETLPKLESVVSAGEACSPELARRWLKSRRFINAYGPTEATICASVDEALDTDRLGIGRAWANVRLYVLDGQMQPVPVGVPGELFIGGAGVARGYLGRPDLSAERFVPDPFAVEPGGRLYRTGDRVRWLAEGRLEFLGRLDHQVKLRGFRIELGEIEAALAEHPEVQDAAVLVREEAPGRKQLVAYVVADDEEQPPEQDALRRALESRLPEYMVPSAFIMLKAMPLTPSGKVDRKALPSLAQEQVKREHVHVAPRNPVEQTLADIWATVLSRERVSIHDNFFELGGDSIISIQVIARALEAGLHISPRQFFQYQTIAALAPHVGQAQVVESEQGPVTGPVPLTPIQHWFFEWQLPHLHHYNQSLLLGLRQPVAASVLQDALRALVAHHDALRLRFERTPDGWRQESLGLDSTVTLREVDLSGLDEAAQRAALEEKGLRAQAGFRLGEAPLVVAVRF

SEQ ID NO: 13966 - protein, 115 aa, Myxococcus xanthus
AWALPGREVTRFVIATAQALVSGLLIHLTDGRIETHFHIFGSLALLAMYRDARVLFLYSALVAVDHLLRGQYWPLSIFGVESASAWRAWEHIGWVVFENVFLLIGGRGAVKDAPE

SEQ ID NO: 13967 - protein, 1252 aa, Myxococcus xanthus
  unsure (1)..(1252): unsure at all Xaa locations
SSRDDFFELGGHSLLSVQLASRVRERLGVELPVATLFATPTLAALAARIDASPKVSERVESMPQTRPEHIPASLVQERLWYAMQLPEAPPFVVVAALVLDGTLDVVCLETALEAVLERNATLRTTFRLEHGAVFTREHPVTRPVLVQTDLSHLSAAEALDAARAIATRHDREPFAVDQGPLYRFELARLDASGTRHVLVASMSHLVNDGIGMGAFLEELAQAWAGTTPLMHPAARTYADFALWQRSPEHLLEVDAAVASWKAALAHAPSVLDLPLDFPRRAPALNANMRPEPLSLSSEAMTALHALARREGVSPFTAVLALMQLWLHRLSSQPHVVVASPFSGRVLPGAERQVGYFANVLPLCTEVAGTPSFRALLRRAWDVVGHATANQEVPFKRIADAVQPDAPRTAPPLAQALLLLDSPASLSFNGLGTTYLDGESIFPAYDVVLHLIERPEGGTLGFLATDSALFTSATAQHMARAFEQLLTEAVRTPDAPLARLSLLSSQQRAQVLATLDGGPQDIPEGACIHTLFEAQVRRSPHAPAVAHGDSTWSYAELNARANALAARLLSRGIQPEERVGVVMEPSNQGMAALLGILKAGGSYVPLDAGWPEPRKRSVLTRSGVQRLWVDAEALEAHAGLVPDVEVPPQPAHIAEDLEPGPRHVAASQVAYIVFTSGSTGEPKGVMVEHRSVVNHNVALAARFGLRPGDRMLQFAPLRFDAAAEDLYPPLVVGATVVMRSGLVPAHVMTPYLKETDITLISLPPTYIEEWIRQMESHGQRVPARLRLLAPGGDVLKRETYEAWVRVGGGHAPWLNVYGPTECTITSATCDIPGAEGLGTDATFPIGRPISRVRIHLLDEHLEPVLPGLPGRVYIGGAAPARGYLGAPDMTAERFIPDPFATEPGARMYHTGDLARMLPDGRLRFLGRADHQIKIRGFRVELAEIEACLRQFPGVEEAVVLARAGGSGQTQLQAFLQAPAQHVRADALREHVAARLPSYMVPAALVVLEALPINANGKVDRQALPDLSAQPAVPPAQETPGEHLETPFRTTLEMAMERLWREVLGRTDIGAGDDFFQVGGDSILAMRLLSRLEEELGVPVPLATLFQYPVFRETADAVHELLAEGPPRSSVVSLSGKQTPKSAPPFFVFHPADGELHYYRNLTPLLEPGLRCYGVQAPETQSKHGHATFDARIAAYVRDIQAVQPHGPYRFAGYSFGGYPALGVAAALEAQGETVELLALVDALPAVEGPXGSA

SEQ ID NO: 13968 - protein, 211 aa, Myxococcus xanthus
PEDYPDAQALVQTEAELSRLPPLVFADETRQLTARLARVAEGKAILLQGGDCAESFKEFTTDNIRDTYRLLLQMAMVLTFAGNRPVVKVGRIAGQFAKPRSSPMETLGGVTLPSYRGDIINGMEFDAQARTPDPRRLLKAYHQSSATLNLLRAFAQRGYEELAEPQRWPQGGINRLLADRISRIPVVHAGAGCQPRASQRLQSHRLRPWPF

SEQ ID NO: 13969 - protein, 1150 aa, Myxococcus xanthus
PAQPFNLSAGPLLRATLLKLEPSEHVLLLCLHHIVSDGWSLGVLVREVTTFYEAFHNGHPAALPELPVQYADYAVWQRGWLQGETLKAQLGWWKSQLAGAPHALELHTDKPRPAVLRHHGAAVPVQLPQELALMLDALAQREGVTPFMLLLAAFQSVLARHAGQDDVLVGSPIAGRRHAETEPLIGFFVNTLVLRARLTPAMTFRQLLAQVRDTTLGAYEHQDVPFEQLVRAVGVERSPGHAPLVQVMFDLHRTELSAASGFHALGARRVPIETWTCEVDLFLTAIEVGEGFEVYFQYSTDLFEPGTVERLRNHYVQLLSHAVAAPRTSVGELSLLSATEREQVLQGFNATERPFDSEGTIVSLIEAQVARTPDAPAVVAPEGTLTFRELHTRASRLAAHLTAAGAGPEAVVGLCLERSLDAVVSLVAIFISGAGCLPLEASHPPARRAALLRQARARLVVSRPGLFAGVEPGVPLVSPDVRGDVVAVPRPPRAEHLAYLLYTSGSTGEPKGVELTHRNVVHCFAAFDTYYATQPGDCWASSGSLSFDIHLEELLFSITRGARTVLREVGPLGLGRDILGHGITHVVITPSSLATALEEPRAAEAFRSLKVLVTGGEVLPDPLVRQLALTHTRLVNTYGPTETSINVAAEITLPDRPVRLGRPLDRCRLYVLDANGAPVPPGVPGELYIGGTCLGRGYRDRPDLTAERFIPDAFSGREGGRLYRTGDRVRWNGDGSLGFLGRTDFQVKVRGVRVELEEVEAALLRQPGVRQASVVVRGTQRDARLEAFLVLEGTAAGVESRLREGLSRALPEALVPSRFTVLTALPMTTSGKVDRKALAALPIPDIEPEAAPEARPRGAVEELLALLFCQVLGLLQVRREDDFFHIGGHSLAATRLVARVRQAFDVEFPLQAFFTEPTVAGLARELETRRDGAAPLPAPVPRPADAALVLSPTQERLWFVQQLHPGTSAYHLAEAVELDGPLDAAAMEDALRWLVTRHPVLRLAVPARDGLPAPVLCPVPPRVLEVEEAPSAAQWARDAVHASFDLARGPLYRFRLLRTAPEQHVLLLAFHHLVVDGLSLDVLVRELGEAYAAFHQRRTPTLPTPRLEHADIAAWLRTPPARERDEAQLTYWKQKLEGVPRRATADPVEH

SEQ ID NO: 13970 - protein, 257 aa, Myxococcus xanthus
SKAARAQPHLGPQAFAARYANPSVCEAAARRLQGASRDEAWDGLKACIEHTPFTQLNALLGRAWAQDLRVRPEGAKLIARVVAQRGGSVTGELRYLQEKQIPIFSLASAMDRPDTYKGRYVLLRAQVADQRSEGERPTVWLVEQALSSVQTDEVVGYGERIDSVTTYSGDLAGQSVLTGPGRIGGSVSTCERSGRTPRGASWRTSPMRLAARPSAVWRAPTRCWRPGATTSSSRASTVSASRLAARRRMTKRRASRC

SEQ ID NO: 13971 - protein, 184 aa, Myxococcus xanthus
AETWRARLLGAAGVTKSVLIKKVLPEYANDEAFVSMFISEARISATLSHGAIAQVFDFGKVDGQYFLAMELVEGQPLNRILKRALRSGYHSLPVPIAVFIAMEMCRGLHYAHTRSDEKGEPLGIVHRDISPDNVLIGYEGQVKIVDFGIAKARSLRSFNTEPGVVKGKYLFFSPEQARGEAVDV

SEQ ID NO: 13972 - protein, 287 aa, Myxococcus xanthus
MACGGNEGKVTLLLTDAPGDDIRTAVVTISEIYLQGGDGKGGRVVLRDTPATVSLLELANSTSELVSDAVVPNGDYSELRFVITGGYIEVANEDGTSTVFASSADYSGLPAGTQVAGQLHMPSYGTSGLKVKFSEKLTIEGEQKVLLVDFDVGQSFGKEAGNAGKWVMNPVIKSAEVTASGSIRVTADTAATVTLPVVDGHQVTLGDFNAVMTNEAGSSERLALTDEDGDGTYEAVFKFLIPGTFTVHLEPPAFVSASTTPDQPVTVEVGSGRDVANHFTITGATQQ

SEQ ID NO: 13973 - protein, 49 aa, Myxococcus xanthus
MGVDTGINLDRLVEAGEIAQELIGRKLAGKYLQAALGEREKKAARRAQT

SEQ ID NO: 13974 - protein, 235 aa, Myxococcus xanthus
MREDEYEAAAGPGGWNTQQGFYVYRERRLLVAGGWLSLGYATEEHYRLARLKVDISNSTDAEWEIDVKKSRARPPTELEERLRELADAVRKLAREVFVHRGARVRTSGVREIDDAWESVTTRGRLGYRVRREHPLVKFVIERQGSDQKPLKALLRLLEETVPVQRIWLDASEKPEAHAEAFESEPPARVAEVLGELFKALRADGETEESARERILSMRPFAQYAKAINELGSKKR

SEQ ID NO: 13975 - protein, 508 aa, Myxococcus xanthus
GRGRPRQIGVTQPRRIAATSVAARVARELGTELGTDVGYQIRFEDRSSRQTAVKFMTDGVLLAQIHSDPLLRRYDTIVLDEAHERSLTIDFLLGWLKRILPRRPDLKVVVSSATIETERFSQFFGGAPVIQVEGRTFPVDVLYEPPPEDTELADSVADAVANVISLDPDGDVLVFLPGEREIREAENALNARELRGTVVQPLYARLSASEQSRVFATIPQRRVILATNVAETSVTIPGIVYVVDTGVARLSRYESRSGTTRLHIEPVSQASADQRKGRCGRVREGICVRLYDEVSFTTRPAFTDPEIKRTGLAGVILRMKSLGLGDVEDFPFLDPPQPRAIAEGWRVLEELGAIEGKERTLTPLGQQLARFPVDPRIARMILAGAEYGCLDEVLIVAAALNLQDPRERPRESAQKADELHRRFRDEHSDFTGLLKLWAFVREAEGRGTSHLRRVCRDNFLSFLRVREWRDVQRQLEETVRELRIPRKGRGAPARGYVLHQALLTGLLS

SEQ ID NO: 13976 - protein, 276 aa, Myxococcus xanthus
MNRKAVSLGRTAMALTGNAALLDSSYMRDFFCSYFGATLRLGDLKRKVALPSFQLDGHRKSLRTWKAKIFHNTGPDNDSDHNELVVDVLMRSGSPPLSYPVYQGIREQGSGYVDGGIFANNPSLVALAQIINNITRKSRTEKVETLETEPPDLTNILMMSVGNGCMSSYLTPHFCKGVANWGFSKWLLDFHDPMVLVKMMLEAGSDAADYQCRMILRKKYFRLNPVVDQTLSAANLKQVESTVQSLLSTQSTVSQLNRAQTWLGKSGWVSDAAKAA

SEQ ID NO: 13977 - protein, 340 aa, Myxococcus xanthus
MGVESPLFSGPRGVPVGVNDHLSFHEVDVGEELRRGWNGGQGGLAALVDGGPERVNAEEVAMTVEAAHVVMLLRLGEYLHEQQHDLVIVDCPSTRTALQLLNTVPAMSWYARQQQTPTQAGRKARLLAASLHGADASLEVRDRLNAVDALLHDPEVTTLRLVTTADTVAGQEAQRAYTYFSLLGLAVDCVVINRLAPEAADAGSDPMRAQQSHVEKLQRAFSSLLVLKVPHQAMEVVGEKPLEVFAEQLYQGEDPVRLTAPQPALGIRKDAVDAYSLEVRLPFVAKSDVELSRRGAEFVIQVGAVRRNVVLPRMIALLPTSGARMEGDRLIVSFQKERGV

SEQ ID NO: 13978 - protein, 156 aa, Myxococcus xanthus
MSTQDDRYPQGSFGASPEYGARFAELTNALIPGGRGLVQQLFRAKQEALKGVAQILDAQIHELQHIDAAIEDRAKQAHTAPAAGQPNRSGVSFGDVLQKAGDLILAKRPKGTTGSEAGARPSDRRAPPESATSPDSSSPASASSSAPEPLEKISIS

SEQ ID NO: 13979 - protein, 258 aa, Myxococcus xanthus
ESMTPLQRAALAIKTLRARVDGLERARSEPIAVIGMGCRFPGGANDPRAYWELLRGGVDAVSTVPPDRWDVDAYYAADPDAGWKMVVREGGFLNQPIAGFDSEFFGLSPREANYVDPQQRLMLEVSWEALEDAGIAPGSLVGSDTGVYVGFLSSDYGRVPFNAVQTRDLPYMGTGNELSFSAGRVSYVLGLQGPSMVVATACSSALVSAHLACQALRQGECSLALAGGVNVILRPDNNIVLSKMRALAPDGRSKTFDA

SEQ ID NO: 13980 - protein, 193 aa, Myxococcus xanthus
LYDAFAQGQPSPLPVLPLQYGDYASWQRGKLRGDALDAHLEFWRKRLEGAPHELELLTDRPRRSATGRAAQRRALLPVSWVERLESLAQAEGATLFMAVLAGLQVLLSRYTGQKDLLIGASHTNRGRKETKGLVGLFAESLVLRADLSGRPGYRELLRRAKADTEEAFANAHVPFEPLLSALGVEQDPTRAPM

SEQ ID NO: 13981 - protein, 446 aa, Myxococcus xanthus
MYTESLRAFLKPVLPYMDDEAVSEIMINGPTDIWIERKGRLTKVDASFTDEGLLGAARNMAQFVGRMLNEERPRLDARLPDGSRIHVVIPPIARKGTTISIRKFFKEKLTVQSLMKFGSLTPQMARLIEAGIATKLNMLVAGGTGSGKTTLLNIVSSLIPDEERILTIEDSAELQLNQSHVVPFESRPPDKFGKGAVDMGDLLHSALRLRPDRIVVGEVRGGEAFHLMQAMNTGHGGSLATTHANTPTDTLRRIESLCLMSGVELPMVAVRAQVASAINFIICCERLHDGSRKTIALSEVLPLNEKGDYRTQDIFVFTPVTKDEDDHILGYHAPTGIIPNFVSKARAYGFHDLDESFFDPATYGLPPPPTFHAGESYSVRWAPSLKHREQGRPDPDHFKQEWAAFEQRLKQDARDAKAGKAAAAPPPPPAPAVQVQVPASHPTPPP

SEQ ID NO: 13982 - protein, 160 aa, Myxococcus xanthus
MLSLHSDSRGTATLWSPNPDQECNRQDSAPGFTVLWSESAEATALLHAGRAGLARSLAHRLGQAGFPPYDGVDYEGLYAIDSEHPGVFVAREPTHRQIFVLRKPRIPSVIIETHHALDFEEAARWSEQRTLEAFAAAVAQGLVDALAPEAPPQPRTTRPR

SEQ ID NO: 13983 - protein, 242 aa, Myxococcus xanthus
MSFFGELYLRSTLPFLSEAVTAREADYLARAFADVAGPAPVVDLGCGHGRHAARLNAVGPLAGRVIGLKLHALSLAIRRPGFPAIQGDLRALPFREASLAGAYAWYSTLAAFTDAEHNHILREVARVLRPGGRWVFQTVPFERLAASPGAAFRETLPDGSVLEEESCFDASTGRDEGRRTLTSPEGRCLRASYSLRYYPLADWVRLLESTGFSVVWVHGGLAGGPLDAQSTDLIVGAERRHG

SEQ ID NO: 13984 - protein, 36 aa, Myxococcus xanthus
HLVPPDWKDPDTYRNVDWLKLLVRRHGALTVVEPAH

SEQ ID NO: 13985 - protein, 430 aa, Myxococcus xanthus
VKAYVVAPGEEEGALKEYVRQKLPEYMVPSVVVVLEALPLTPNGKVDRKALAATDLQSRVAIESFVAPRTEAEHALAGIFSEVLGVPRVGLHDDFFELGGHSLLATQVVARVRTELGVDMPLRALFEAPTVLRLAVWLQGSDTTGAARDCVALQPEGTGTPVFFVHAVGGAVGPYRALARRMGRERPLYGFQAAGLDGREPPLEQVEALARRYVEAMRERQPEGPYVLGGWSLGGVVAFEMARELERLGQSVALLVLLDSFAPDENAPTREPDAALLLAGMAMDLARTAGVESTLRPEMLSGLTEEEQFTALVEHARQAGWLPPEVEASTLRAWRDVTRANLRALAAYRPGPVRCPVLLLRAKDAQRSRAVEPSHGWARWGLSGLTVEDVPGDHYSVLREPQVETLARRLVEHVGAATGRHEAAGQQREG

SEQ ID NO: 13986 - protein, 77 aa, Myxococcus xanthus
MLPSVHTLLKLCHELHVSADELLGLSANAVNGGARPGEPPTSPQERPEVRRLLRTVRPLEPAKVKLLGLVANALNRR

SEQ ID NO: 13987 - protein, 370 aa, Myxococcus xanthus
AVGRNLLVKLCVAMGVVALPLLVVILGFVLPQLREQLRADRILGLRQAVETAYGVLEVYEARERSGALTRQEAQAQAAALLEQLRYSQVEYFWVNDLDTRLVMHPHLPDMLGKDLKGYRDVRGKPVFVDIVTLARAQGQGSVSYEATRPGSPEAIPKESYVKLFAPWGWVLGTGVYVEDIEREVAAVRQRILLAVGGALALALMAGAYLSRRVVRPVRELAQAAHRVARGDLEARVEVRSTDEVGQLAAAFNTMVTGLREVVAALVDAAGATAADAERIRTSADALSVTTREQSDSLQRAAQTVQGMSARVSQGAEAARTAAKTAADNGQVAREGGAAVGQALRKMAEIVEVVEGSARTVERLQASGRVT

SEQ ID NO: 13988 - protein, 451 aa, Myxococcus xanthus
LKLPDISGYEVCERLRANPQTAAMAVLHTSATFVTSDKKVRGLDGGADAYLTQPFEGAELIATVKSLLRLRHAEQVARQRANALAEMDRRKDEFLAMLGHELRNPLAAIMTAIGILERRPTSDDKEARMRGIIQRQTNHLARLVDDLLDVSRITRDKVELRPGSVDLVPVLRQVLQIVQPMADSRGLGLDVSLPSGPLWLQADATRLEQVFTNLLDNAIKYTDAGGVHLRAEQEGVGGAAQAVVRVKDSGIGIPPEVLPHIFELFAQADTSLERSRGGLGIGLTLVRKLIQLHGGEVTARSNGPGHGSEFVVKLPLDHTMGKSAPARDAVDLRRGRRVLVVEDNSDARQAMRDLLELWGHQVAVAPDGLQGVALAMAQPPELALVDIGLPGLDGYRVAQTLRAQVGNGIRLVAMTGYGSPHGRDQALRAGFDRHLVKPVKPDELDRILSEL

SEQ ID NO: 13989 - protein, 30 aa, Myxococcus xanthus
EGPSPALYVADWGPGIPEELRARIFEPYIT

SEQ ID NO: 13990 - protein, 130 aa, Myxococcus xanthus
MPQTNPFHSLVPRKMTDTELARSIRLNIEAELDAINLYAAHIDATDNEDAKAILQHVMDEEREHAALFWELIARLDPEQAAHAKEAVEKYRLITSGASHEAVEAVGKEGAAPSPADVTPEKRLTVGSLRR

SEQ ID NO: 13991 - protein, 457 aa, Myxococcus xanthus
MARILLVDDEKIARTLYGDYLTAVGHAVTAVGTLQEAKEALAGDRFDAVVTDLILPGGDGMEVLRHVREHHPGVEVVVITGLEKVDPAVRAIKSGAAEYLVKPVAPEALQHAVRRALTTRDLMQENASLRRHVAMLEAGQRIATTLDREKLASATASALQSMASASAVVLLERDSAFALRRHGTSGLSTALEEPLIAELIERLTNERGPRELDGMDAPFPRAISFPALEGDAVLGHAVLFFGGTGAEWAGETASFLVRNWALALRNLGRFAAVEDLAYVDDLTRLFNTRYLHLVVDREVQDALQSQRTFSLLFLDLDHFKSINDTHGHLVGSKVLVEAARVVKGCVRDHDVVARYGGDEYVVVLRNTDSGGALKVAERIRRTMETHNFLAREGLSLKLTTCIGVASFPEHAQDKATLLDLSDRAMYRGKRGSRNVVYMRAKDLKAPPAERRQAHSAS

SEQ ID NO: 13992 - protein, 239 aa, Myxococcus xanthus
MPGANGSSLRGVLEVKDLCALLGGPPEQGPGMVVVLDVSPTLAVRVRSVVEVADVARAPFFLLPPGLADSLAPLSRGAVLHKSRLYLELIAEALPHRVGSMSPAVAARPVHWAEAAPDRALVFESQSRLFGVPLGLVSQVISRGEAFCVLPVPSGPVAGIFPHDQVLWPVCSVPALLGEAPVPESFIVLTELAGRNVGLTATRVLGVMQRFEPDDTAGSFRAPGLSEPVAFLDLQRMFS

SEQ ID NO: 13993 - protein, 420 aa, Myxococcus xanthus
MPKNLLVADDSLTIRKVIGMIFATEDFQVTAVDNGLDAISRTRELRPDVVLADVMMPGKSGYEVCEALKNDPATQGIPVVLLAGTFEAFDENRARAARADDHVTKPFESQVLLDKVKALVGQKSNTMPASAATQVRHAAPQPAAAPAPVAAAAPPGARPAPPPGARPGVPPGPGVPRPPGAGVPPPGARPPGPGMPPGMARPPGPGMPPPGAPGAPRPPGPGMPPGMARPPGPGVPPGARPPGPGMPPGARPGVPPPPGGPAPGLPPRPGMPPGAVARPGVPPPPGGPAPGGFARPPVGAPQPPPGAAPQPAARGRDPFGLGAPAPAAAQPSISIEDSLPDQGDAEEISLDIATPAPVAARPASARAPAADGGEALLREALSKASREVIEKIAWEVVPQLAETIIREELERLIKDRETQH

SEQ ID NO: 13994 - protein, 117 aa, Myxococcus xanthus
MAEALRLPDAYFTELTASYAAKRERLLTGLREAGLTAFAPEGSYFILADITRQGFADDVAFCRHLVSKVGVAAIPPSVFYGPAHRHLGQGLARFAFCKTDAVLDEAVRRLRAGLSPR

SEQ ID NO: 13995 - protein, 491 aa, Myxococcus xanthus
MSVEVPPLARALTGEWVAEARWRVRRPDGTHVLLRASAVPLEHDAGPTAGALLRACEVASAVGLDAVGSARLLAEAGALLGAAFDDEAAPRLLRLLVPALADAAVLYLGQPGGPPRPVTALHAEPERHGLLEEMLRCYPLPPERVLPLFGTGQSERLRVTEAHVEATARDAEHARLLRGLGLRCYLGVPLVARERVIGTLALFRADEARDFSAEELRLAEEVARRTALSVDNAQLLQEAREAVRLRDEFLGIASHELKTPLTPLHLKVQLLQKQVDGMAAHNQPVSAERVSETLEVVQRQVRKLTSLVDNLLDVSRITAGRLRLEVEEMDLASVAAEILYRFAPSASQLKCELELHAPVPVMGRWDRLRLEQVVTNLLSNALKYGAGHPVRVVVKAEGLTARLTVRDGGIGISTEDLPRILQLFYRAVCDRHYGGLGLGLYITRQIVEAFGGTVRATSEPGQGSLFVLELPRGDIPEEWLTAHGAPEPSSS

SEQ ID NO: 13996 - protein, 113 aa, Myxococcus xanthus
QKPHSTPDWTSNEHRYRGVIDSLREVVFQTDLAGTWTFLNPAWTDITGFSVEESLGRSFSDFLHPDDRERDPEPLQKLFAGEVEFVRHEMRYLTRDGSYRWVEVFARLMHDDD

SEQ ID NO: 13997 - protein, 95 aa, Myxococcus xanthus
MSLEAAETHVLLSVRDEGIGIPPENVADLFRPFARASNAQARHFGGLGLGLFICREIVERHGGAIWAESPGPQRGSSFHVRLPRRAEPAASASAA

SEQ ID NO: 13998 - protein, 182 aa, Myxococcus xanthus
VQAGQDVYATLETNQGAIVVRLFSKDAPKTVANFVGLATGEKAWTDPKTGQRVEGKPLYDGVIFHRVIPGFMIQGGDPTGTGRGDPGYRFEDEFQSGRTFDKKGLLAMANAGPGTNGSQFFITTSTPDYLNNRHTIFGEVVSGYDVVEKISNVQRDPRDKPLEPVVIQKIAMSDQAPAGSGN

SEQ ID NO: 13999 - protein, 155 aa, Myxococcus xanthus
MRGEQRDWEQFARDVPPGMPAARRALMSTVDALCAAMKLPYGRIVLGGFSQGGMVSTDVALRLDEPPAGLCILSGTLTSEPEWRPRAQGRTGLPVFQAHGRYDPLLPLGSAERLRDLFVASGLTVDFHAYDMPHAIVTEELEALAAFLAARLGGR

SEQ ID NO: 14000 - protein, 137 aa, Myxococcus xanthus
MFHAKELTVSSRGRGFTDITADVQRAVAESGARQGLCTVFLHHTSASLLLCENADPDVRRDLESFFSRLVKDGDPLFVHDAEGPDDMPAHVRTVLTQNALNIPVKDGRADLGTWQGVYVWEHRTSPHRRRVTVSVVS

SEQ ID NO: 14001 - protein, 648 aa, Myxococcus xanthus
ADVECAAVPPYRVRSMRRWLPLVLLLPGIACTPPPGPEDTSPDASLARVAAPRGAEERGNTPSVSVSASRAAVFDGGAGPGTPGDGVEVRAPHADSNAPGDLPADARRTAADALFAAWQRTAADGGTDGGVDGSAEAALSPPLRTHDDGAAEARDEVPALTIDPALDDLAQSEEEEDTPGGEELPLPEQLTVIPDELHPGEELVLGPDGEPLEDTGLVLEDVDPGLEPVSGADDGGTYAVPFAPDAGSLRVRRSIVVRQEPRQDAPALGTVAQDMRVRWQGETAVRGPDCEAWIQIEPRGWVCERYLEPNFREPRVRELPKLREGELTPGIYARVVGKRVRAYPSLALARARRKGVLLKGSVSVQLRGQVRIRRRTYWRTTDGQYLEARVLREYRPSSYEGVNAEAIAELPPTFAWAQSRTRPFAAVEVRTAPDAKAARETVLPPRTLVAVKELSEDGHWVSIAEDQWVARDDLHVAWFSHAPPQVEPGSRWLDVDLDAQVLVAYEGERPVYATLISSGKQGTDTPEGLFRIWIKFAEADMTGSGTAGNDTYRVATVPWTMFFQDDYALHTAYWHDRFGQPMSHGCVNLSPKDARALYAWAAPQVPVGWSMVHATEDAPGSWIRIRGQARPTGKPRRVAVAATQGGAP

SEQ ID NO: 14002 - protein, 466 aa, Myxococcus xanthus
MSVLAAVVLCAGKGTRMKSEKAKVLHPILGRPLCAYPLKRALELGATSVVPVVGHQAEAVEKAVRGLFPDAPLRFALQREQRGTADAVRSAEEALKGYSGRVLILYGDVPLLRRETLEALLAAHDQAGGKLAMVTTTLEDPTGYGRVIRDGGKVTRIVEHKDCTPEQRAVRECNAGIYSVDADFLWKALAEIKPQNAQGEYYLTDLVEMAAKRGPVGSVEADATETAGVNDRVELAARARVLQQRINEAHMRAGVSLQDPATAYIEEGVTVGPDTEIGPSVTLAAGTVVGKGCTIGQGSVLHASTVADGTVIKPYSVLEEARVGERNVIGPFSRLRPGTELAEDVHLGNFVETKKARIGKGSKANHLTYLGDAVIGSGCNVGAGTITCNYDGVNKHLTELGDGVFIGSDTQLVAPVKVGDGSYVGAGTTVTKNVPPGSLAVSRTPQVTKEGWVATKKARQAKARAG

SEQ ID NO: 14003 - protein, 540 aa, Myxococcus xanthus
MLEKGGNATDAAVAAAFVAAVVGPYHSGVGGGGFALVHDAKSGDTKVLDFREVAPKAATRDMYVKDGKVVPGLSTDGALSVAVPGAVAGYLELLKAHGKLKPAVVLAPAIAAARKGMWVTPRYRTMAEGRLACLSRDAEASRVFLVKNAQGQWEPPPVGQVIPQPDLGRTLSSIAKGGAKAFYAGPVAKAIPTSVQADDGILTQEDLAAYKTRSATPLEGTYRGHRILTMPPPSAGGVAVIQVLTAMEQLRPQGVTFRDAEALHLYAEAVRRAYVDRAKYLGDPAFVDVPLARLVSPGHVADLAGSIDPKKATPSASLLAPKEGVRGSTLTDEPTTLTPEPEKKNTTHISVIDKDGNAVAMTTTVNYGFGSCVVAKGTGVLLNDEMDDFAAQPGVPNAYGLVTGEPNAIAPGKVPLSSMAPTLVFSKEDPRRVMLAVGSPGGSTIPTTVIQVISNVVDHGMDVARAVNEGRVHHQYLPDELWVDKWGLEPATLSVLEAKGHKVRRVEQWGDAEAVYSDPKTGLRFSASDPRNEGAALGQD

SEQ ID NO: 14004 - protein, 226 aa, Myxococcus xanthus
MTHGWLSPVVDTVNPLLKDAQLVAADQRLFGMQAAVVLSRVVPAWLNDILLVCYYGHFIWALVMGLVLYRRPGGAEYDEYLTALGLLFFLNYAAYALVPAVGPRYFLVDAFDGPLQGTLAPLLDSLMRKPLFARDCFPSGHTGATMLVLYYAWRFSRRVFWVMLLPGLGLIAATLVGRFHYATDLLCAVPMVMVVTGLALGVSRAARQREVAKDARSVPVDAIVRP

SEQ ID NO: 14005 - protein, 83 aa, Myxococcus xanthus
MHVGWTDTDPELRAITCSVRGLMDDIRRGLGSGSPCYQRYLRTLLREAAVTLPDAELRDAFARETDPVMAEHLAAAAGGPRGT

SEQ ID NO: 14006 - protein, 216 aa, Myxococcus xanthus
MDVVAQRALHDADPSVRAATLRAMRRTSALERTGDLYERMVRDESPQVRQEAATNLIEDNAHVYAGQYGPAADTAVTAAVASTDPAVTARILDNLSTEKISAESADRITSLLRSDDASVRKAAVNALGGVPAEQMQGARESLLAMYREETDEGVRKALLQSVAQLGFEGAIPDLQRMRAMDPRLAQEADAWIQVLGMGLQEWSLLLREKQRLQQAP

SEQ ID NO: 14007 - protein, 176 aa, Myxococcus xanthus
MRSSTWKNSLAALAALALIPASVTAHTVKGTHTGSVTALTNYSSGTFHGAVDIGAGGRCNYWGAETGVVGSVYWAVTIRTTGVVCNGNGSGNQNEARHAWASGWTFRQWHFIKTADSRSRTCDRCQVGNIGGTGNSTGPHAHLQQDKLGTKDTSWYKGYVSVGTAVTRAKTIGVLD

SEQ ID NO: 14008 - protein, 437 aa, Myxococcus xanthus
MEDSVASYQNTGTGHGIMRVKKSAAGRSPTRQTSMVESPPMRHAPEDWARFASTHWEQSPTRLRLGTPLIPPEQAFQGLVSISAPFRFGTRFGALPDVRFFADTARMRAPGTLLPGEQDADATAYLQRVGRELGAARGFQCFVEQPLMLDYAQWERVRAFVDGVLARVGVPVLPIISDLWLGRFTEPPQGAARREHHARFTAVLHGRLRVRQWTKDAHKARTVEAQAGDVLYAPSHVWQEEASDEGALVLRLWIPVRGSEPLEAVKALAVKLLENQGEADDAVPYLPFPGTRGRTPVPRLAHTASALRAVTHGPDLRQLLRIAWAQRVSASALEPVPPPRAHEPLEEDAYVRKTPPGRVVRMLDSPGQWLWAVNGHAFAGPGPFAAHVLDALAPGVPVRVGALCGLGRGASQREQVRALLETLHALRGIERVPSKEA

SEQ ID NO: 14009 - protein, 190 aa, Myxococcus xanthus
MARIDLQRRFDWDTFVTRYWNQRPVLYQATGINPFMDTDVFDAALGASRGAMEPPTALEARTDVQFTIDQGQPVQLGPWLPRDTDGSLDGYDSRLADALGTRRYALIISLLHSHGFGLWSRERAFFSDLWRRVGLPLSGGITTLFHGNYEHSPVGVHLDRFTTFLLAIRVARLCGMVRVDWPEQCPSPPW

SEQ ID NO: 14010 - protein, 174 aa, Myxococcus xanthus
MLDECGAQYEIVPIDFEKKENKSPEFLKINPAGKLPALVDGDTRLFESAAICLYLAEKFPDAQLAPKPGDKDWGRYLSLMVYSTSQLEPSMGDHLMKLPTGPARGWTDFETVLNVVEGELGQGPYLFGERFTAADVMVGSMFIWMRIFGSQTGRPALEAYIERLLARPKGMKLG

SEQ ID NO: 14011 - protein, 340 aa, Myxococcus xanthus
MSSLPAISELTFDALSSEAHGLRERLNRFRLALGRHFVGKQTLVDLMTVAAVAQEPLLLVGPPGTAKSDLVLKFRDALRIPNEDYFEYLLTRFTEPSEVLGPIDINLLRQGRYIRREGGKLPTARLVFLDEVFKASSAILNALLTVINERKFYQDGAPQPVKLKVLFAATNELPEHAELGALKDRFCLKAACRPVQDRYFLELLDSGLDSQTHREMNQKPWAEGHATLDDVLKAHRYLTLMMGKRETGPDGRELRDRDLFFRDDLLREFRRVVQTLTREDGVFISDRKLVKLYRLLRTRAWIFHGGAVERQDLQLLSYLGETREEIDLLEEKVPRLLGLS

SEQ ID NO: 14012 - protein, 210 aa, Myxococcus xanthus
MLGDALTLAALFGRADHAMTLAARLRKVLTALAPTSPAWGQGILGVSLRGLRRVGLSREAAEMVDAAQERLTGPKTPLTARLGVAAGLSMQGRTAEAVDVFDAAFESLGAAKGGLPERLALMRSLASALAHAPVELALPGLARISEGLPIITDSYNTNSHFCLSVVELADALVQGHVEVAQGTGERARSWLDEDEFLVRRRIHRELEERT

SEQ ID NO: 14013 - protein, 251 aa, Myxococcus xanthus
MTGKLSRALAVVSLLASTSASAQEEAQALESSARDERRGLELTVGVGFQVGAGYVYREGAGLDRQVRDLKLSDAANGGIAFLLEAGYRVNSRWYVGAFGQYSHVLTKTNPYTCPEGYDCSTSQIRFGPHVQYHFAPDASFDPFVGLGVGMVLLNNKVSGPITQPAPGTVEIDSQSRGPEFVNLTLGGKWRLSDSLSFGPYLTGTYARYTTRSGTSTVNIPAVNLTQETPLEQVGDGPYGLLMLGVRGTWNL

SEQ ID NO: 14014 - protein, 515 aa, Myxococcus xanthus
KGSDLREGVVRVLSRDRQRVLGTGFLVTERLVVTCWHVLDTLSDSERDAICLEVLQSHEKATARLRLDASSPTEVADLAVLTLTRPLRGPSTPLPLGSAERSADHRFATFGFPRGFDDTGTWARGTIGYATGDGDFRKLLLHGSDIREGFSGAPLFDEQTRRVVGVVRFKAVASEAREAYATPTEQLLARCPELRASEDCPYRDLASFRESDARFWKGRGRVLDEQLLPLLARLPRFVEVSGPSGSGKSSLLHAGLIPALRDGTFIPGSQHWDVRALRPGLEPFAALDGAGLPAGEGLVARVQAWRAANPEPGKRLVLVIDSLEDVLLRGSSAELAQQQRFLQQLSALADESLPVTCVVALREGFDAVLSERAPRLRTLLGEHRVQVPSVLTPSELRDIIAGPAREVGLRFDPPEVVDSIALAAQEEFRAESGAGARVTVLPLLEVALTQLWQASRDGAMTLEAFNASAGLLGSLARWADSVYEPLKPSERLLANRLLLELVQLGEADSGLEDKG

SEQ ID NO: 14015 - protein, 735 aa, Myxococcus xanthus
MPEVRYVEHRYDVDFFRRNALLLLPIEKLAALRQDLTARVRYERQRANPFFFDLGGTSEPPDFEAIAKKYAPDAPMRATLASADGTEVYLMIKPSGTAGDLGFARRFVDQAMGTGGTLAAQRYPGVTLQATGNFQGRIEEDAVMRGDLSRAGTLSALIAVGLILLATRRVAALAVVGIPVMVGVVLTFAAAQLAIGHLNIVTGFLVAILIGLGIEYGVHLCMRYWEERRAHPAREAIVTAVRGTFSGAVTSAVTNAAAFFVLLLAQFQAFNQFGLLAGLGVLLAVLATYAMGPSLLALAERLRPARVDVAAEATAPQVSQPERAWRRWPTGAIAVLALSVVGFAAFSVSVAPQLGFETDMRKLKGESPASRLDDRVTEQLGQPLNPAIFLVDDVAQAAQVEAVIAEVKQRNGADSAILDSASLNDLLPTDVERREVELAALREAFQGLEDLPAELREDARLQEFQRMLEAKPYGLDALPVEVRRRFEATDGKGTFLLLFPSVSNSDTEELRRWATQIDQVVEGVKARGIDMAVLDSNRIAARIFALVSADGPLILWSAAAVVFVVILVSLRSFKRALLVTGPLFLGMTCLAGGMYLFDVQLNFINAVVLPNLLAIAVDNSVHLFHRYEEEGPGSLGKVVRHTGLAAVVATLSNAAGYGALLVANHQGLRSIGQIALLGVMCTFLGTTVFFPALLALLERWRGRENVVAGKGAVVQSLELGDSGAQAAPPGERKSA

SEQ ID NO: 14016 - protein, 295 aa, Myxococcus xanthus
MNVTLEHARALDALARHGTFTAAAEALRKGHTAVMYALRTLEAQTELTLLDRRGYRTRLTPAGERILEHCRKLLAAERELDAACAEIRAGWEPALRIVFDGIFPAEPLLRVLKELRAEGASTRFHVSAEFLSGVEAAFVREEANLMVTLLPPTVPGLRTYRLPELKAILVAHRGHPLARRRGPLKDEDLAEHLVLTVRGSDPRLQLSTGELEARSTVHLNDFAAKKAAILEGLGFGWLPEYMATRELRRGELKALKLAGDATHAFRPQLHHHSGIPLGRAARRIVQALTETESTS

SEQ ID NO: 14017 - protein, 36 aa, Myxococcus xanthus
DGRTTGMFACDSRGGPTGGDRGEGGQMTAVLPLTGF

SEQ ID NO: 14018 - protein, 272 aa, Myxococcus xanthus
MNVADLVAELGTRANVSAVIFTVALVMCRVMPVLIFSPFLGGEVVPTELKMGIGLTLSIVLYPLIAGSVTSIPLSALPYIALMAKEVFVGFTIAFVVNTLFEAARVAGNLVDTMSGSNNAQLYVPQLGQQVTLFSSFKVQLAVVLFLTLNGHHLVIEALADSLVAVPLDGFPRFHDGPWPFFDLMIRVFADLLRVSLALAAPAMLATFLTDVALGAINRVAPQIQVFFISMSVKPLVSVLLVFLVLGALMDRMQGEMVVMLRTLNQALRLLS

SEQ ID NO: 14019 - protein, 87 aa, Myxococcus xanthus
MNQLTFITQEALFLVLVASAPPVLMSLLVGFIISLFQATTQIQEQTLTFAPKVVAVFGVLALAGPWIGSQLVRFTFHVFDRFPALIK

SEQ ID NO: 14020 - protein, 72 aa, Myxococcus xanthus
AFVVSELKEAFQIGFLLFVPFIVIDMVVANILLALGMHMLSPTTISMPFKLLLFVLVDGWYLIAKGLVVGYL

SEQ ID NO: 14021 - protein, 30 aa, Myxococcus xanthus
DGLQVLAEVARGWPDVPVILLTAHGTVPLA

SEQ ID NO: 14022 - protein, 201 aa, Myxococcus xanthus
MIASLLAATLLAAAPGPLTVVQSGNADVQKAANAPGATAQSLATVVEKFVDFEELAKRALGDKTWAGLQPAQRKEFTETMTGLLRASYAQKALGQAQAQVKYGEEGIDGNEASVGTTVTVKKDAIPVEYRLYRTSATGAWRIYDVITDEVSLVDTYKGQFRKLLADKGFDGLLSTLKSKRTQLEKENATSAQKSAGQTAVP

SEQ ID NO: 14023 - protein, 418 aa, Myxococcus xanthus
MYGAYALFGALALAMLVALGAPTLEAHLLTLRFGLLVSALAIPILGGGFALLGFHVLHSRHPDERARAGLVLLGLTLVVALLMTELAAELGLEVVRLGHVGTLLGLPVMATAALRFGLFGDDPGAPRLALHAAGIAGLGVLAYLAVVRLFVAQAGTLIICTTAVTFALVAATRRGVTAYVSRSERLERLATLGRFSAQMAHDLKNPIAAMKGAAQYLKEEHARGRSWDGQGEFLDLLLEQVERLDRVVDTYQRLARVEPLPKPVDLRRLVEGVLSLQVFASPGKVVIIRELAAGLPPCAGDQDLLANALENLVRNACEAMPGGGTLTVRALRDGADVAMEVEDTGEGMDARTRERAFDDFFTTKASGSGLGLAFVRRVVEAHGGEVLLTSREGRGTVVRMRLPVTDASLGGAGVGEAA

SEQ ID NO: 14024 - protein, 551 aa, Myxococcus xanthus
FLVFPNPGAAQNAQPPRPKPASLESRPPAPPASQDVPDWTLAQARAALKEATKDRDRLIDVALRFGRRTFDYVASFAVLRGGATGLEARGEGMAGEQLTQVSIPLDASSVFRTVAVTRGSYAGPLPPDALTRHYLELFGRQTPRTVFLYPVEVKGRLVAILYGDCGQRPISQRRLSDYILFCQDLPAAFQELILFRKQRVSELRAPDEMELTIDVDLPVAPAPAPAPAVVAGLGWSPFFGRGATGNMGRAAALPPRAQSQEERPPPDFAPLLRRLTGPDAAQRANAMAELARSPEASARVLAQHFPGPTAWSRLPVVELPEADELGPIPGALSRLGRPAAQAVSPLLDSQDADTRYFALLTAGNLPYVELVDGVLRGLFDLEPDISSAARVAAAALKQLPRLDASLRDLRHELSSRDPLRRSLAARALGTLHDRDAIEGLIRLTGGDDEMCAQASAEALREVTRATLGLDPRQWSAWWAENRSRRRADWLVSALRHRELDVRLAAIEELSRALHDTLGYYADAPEAEREQAVRRWESAAVEPANARRLGML

SEQ ID NO: 14025 - protein, 391 aa, Myxococcus xanthus
LSAVRSTGVFTGGDDRRTHRFGLAADGSPAGDHDTSQHGIDLLTESLKAGRPRREAEVREAAALEETEALDFLFQVLSSEKDAEVRRLAVRELADKGRTAARPKLRERLDDSHPMVRKAALDALVALEPESPLSAPRAALGSQHPEVRVLGLELLAKLGGTSPLVPGLIAGQLADNQGAVGLAALDALTQVVPGDGAEPLRTAFERGPSQLKVEVLIRAVAGGLLGHAQLQALVARALDDADPGVRRTAFTVRVMERRALSHALESRDEDFGRGTKEVSRWLVQRARRAQGVAGNPPITDAELQSARDAMPAQGTTGAAITESDLEPLLAAMACRTPDTAVRGARGLAQLGDARALGALLQLSREPDAAIRRVAASSLQALQDARARERLV

SEQ ID NO: 14026 - protein, 344 aa, Myxococcus xanthus
MLDDENADVRAAALDAVVALDADASLASAEAALRSGHEDVRVRGLDRLVKLGAATPGAEPLLGDALEDESGKVRGEAFRTLWAWNEKAPEKALDRALAGRFPDLRHRAVEVLAQRAAEGWALERLKKAVEDRDTSVATAAYDAWVKHVGKEHAEAHLAALATTHAPLREHAAKGAIHAPIEPLRSPLLKRVQDEEVPVAVAALEALDKLGAQRERTPAGRALRGAAAGARARGGAAGSAWRRRHHRADARVHHRQGPGAALPSSLPGAAAHPRRAGPGVTGLAAPADLLRHRAAAARAGRPPGAGRPRARHRRSPGRRRLPAGRAGPRQRGGALLGRGRPVPPG

SEQ ID NO: 14027 - protein, 743 aa, Myxococcus xanthus
KDWPAEEERVKYVVGLAEALSSLQPEQRYAAAQVLLLRDKPLEYFRHAKKVARPSTLDAPWKPETAPTSSPVQAAPAKNWLRRIFSAVKTDAPAASPEASAQAERQHLRRLAFGAYVGLLRQVSTGDDESHRVRRDAVDRVVKLTLEGFAGTPAAVAALLRALEDPHQLVRKAALAGLKELFPAGSDEPLALALASLAPDVARAALDELATRGDAAKPRITAALNSPLTDVRRYAFELLEKLSPPGSLEPLLAALSSEHADLRVGVIERLAGANDSRVTEALGRAMASEHEDLRLRASELLAWRGDDRAVEVLATFLRAENASAAKRATEALARLATPASVAALAARLPAAQDYHERKRLVTALGNTRRPEALEVLARQCQTDAEGVIRSECVTAAMTVAGSDVKKRDVKLAVSFLRQAVKSFDVAVRLEALRHLEHGAEAGQSELLVSLFTDRFPTVSGAAVEAYAKRVIEHGAPAEPLEAVLRGGSRDLMLPAAEGVAFKGGASALRPLMLYARAGEDGQRERALLALGTLGDARALAELETVAAGGTAEAPVEPSMVSAAIEGLGRLAAKLPDGEERRRVEEKVEAAAVEGATLVLQQAGVKGLRAIGGERARVKIEALLGDTSTALLVQLTAAQELGKLKDTAAETALAAALDAPQQELRKEARKALDVLFPTERTRVEFHAVASRYPDICEPAVVYLANEGDPALLVPWLATLDNVTLRLRLRRGLARRGCLPLPEVV

SEQ ID NO: 14028 - protein, 461 aa, Myxococcus xanthus
EESGAPLTGAGSFLDPEIHGERPTWSSAFDVIQARLEAHLDRVAEEVAGRYQLVGLTTCFGQLFANLALSMRIKRRSTGTRIVLGGSTVSERVGPSLLKELDCFDYVIQGEGEQPLLALARGLAAAEDVSGLKGLITRETASVLPRGAPFWEVSDVNNLPIPDYSEYATRAEALNFLWLMTVEGSRGCWWDRAKRTGNPKATCHFCNLNVQWSGYREKGAERLVSEVVALNERYHNNVLFFLDNIIRLKGVDEFAQRLIDTGKDWVIFYEMRANIRPHELLMLWQAGVRFVQFGIESLSESYLKRIGKGTSVITNLQVMKICHELGISNGANLLTDFPGGRPEEVAETCETIQRYALGYEPLSANRFWLGRGATVQVLSQEYGVRNLRNADFYRAGLPEALYERLDLLDLSYDQDGPVADWSHVRALCKQWGAAYSAARASEYRHLLTYLDSGQSMRIFDA

SEQ ID NO: 14029 - protein, 610 aa, Myxococcus xanthus
GLIGGILQPLYTGYPAVLMSPMDFLQQPLRWLQAISRYRGTTSGGPDFAYTLCARKIRPEQREGLDLSSWRVAFNGAEPIRPETLDRFTHAFGPVGFRREMFYPCYGLAEATLIVSGSEVGQAPHVASFDGQALQRGQAIPVEAGHAAAHPLVGSGRNVIDGRLAVVDPETFELRRDGEIGEIWVSGSSVAGGYWGQPEATTRTFQARLRGTGEGPFLRTGDLGFLRDGELFVTGRAKDLIIIRGLNHFPQDIEFTVEKCHPAVRPGSGAAFSVEADGTEQLVVVYEANAQRAESGLDEVISAIRRTVAEQHELMASSVVLIEPGSVPKTSSGKIQRHACRAAFLAGELQVLAHATLDTARTGPLTAAENAPPGIEDSPLWREVAEEVSQVLSLPVAATAGLEELVLDSLSSVELQHRLQLRWGVIVPLPRLLGSRNLAEIAAGVEAARAAGARWQPERPASAEVGDFPLSHGQRALWFMHQLAPDSAAYHIAAALRVLEPLDEGLLRRAVHRLVERHPSLRTTFHAHEGTPFQRVHPEGEAGFRYEDASAWSDDTLRARLREEAALPFELQQGPLLRLRLYRRSETEQVLLVVAHHLIADFWSLGQLTR

SEQ ID NO: 14030 - protein, 452 aa, Myxococcus xanthus
HRLLSARGTTVPEGVLLVLFALCFGWIALSFWTAVAGFLQLAVSKRLPGLRWPTEEESATRLTSRTSVVMPVHNEDPASVFANVQATYESVEATGQLDAFDFYILSDSTRPEAWIAEELAWADLCRRVGGQGRIFYRRRTDNTGKKAGNLQDFCERWGRHYDFTIVLDADSLMDGRTLVTMARLMELNPRAGILQAPPLNVGRSTLFARLQQFAGRVYGPVVAAGAAAWQLGESNYWGHNAIIRTEAFIQHCGLPVLPGQQPFGGHILSHDFVEAALMRRAGYTVWLVTELGGSFEQPPPSLLDYAQRDRRWCQGNLQHLSLVAAGGLHPISRGHFLMGVMSYAASPLWLLFLMSGLIAGLYDGWLSFSNPHLLEDLGPEALAFDTTGAVRLFSVSMAMLFAPKCFGLLLALASSQDSALMGGRVRLMLRVVLESVLATLMAPVMMLLQSRF

SEQ ID NO: 14031 - protein, 583 aa, Myxococcus xanthus
MRRHLDHGVTVALMLAAGVAGAQLTPGSAGTGSSPSTGTGSTPAPSTPGTTQAPETPDLGTPGSDAPTAVPGTGAPGGTRPTPRVGTGGRDLPPSPPGIAPSSIEETPGSSQPGRAISPAPALEPSAEAEQVKEGVTGAPDSEEKPARREPLTLARLVARAREADSRVEEATAELRKFQALYQQARWAWFPKFEITVGAGGPTPEARNDGLGGPPTTEATYKGDLNFGRVGVTMFSTGNAVLPLYTFGKLTALEKAGAQGPVLGAALRERTRNEVGFQAAQAYFGYQLARNGLQQIEEVSKRLEDAAQRIERLLKEDSAQVSAVDSYKVRFFRQIVEARRAEALQGRQFALAAIGLLANVGPEDAVTVVDEDLELEEDVPVPSLEQAMVRAEQSRPELTAVAAGIAAREQEVFIRERSYYPDLGLAGFYDVRFTTSTTRQRTPFAFDPYNDRTGGVGLVMRGTFDIPIKDAQLEQARAELDKLRAQEKQIRAGIRLEVSKVHGELVAAWSRARAFGEAERSARRWVTAAFTAFDLGTGDTRDLVDAFTAYAQASGDKGKSWHDVRVGMAALARVTGAPLAPGE

SEQ ID NO: 14032 - protein, 30 aa, Myxococcus xanthus
MPEQQLVLWPLGERLRRWLRAGQPDMSVSR

SEQ ID NO: 14033 - protein, 296 aa, Myxococcus xanthus
MDGPSITGAYRFTITPGSNTVMEVQATLFSRRTIDNLGVAPLTSMYLFGENDRAKFDDFRPEVHDSDGLLVWTKDGEQLWRPLQNPRQVRTSSFRAETPRAFGLLQRDTAFHNYEDLEAHYERRPSAWVEPVGEWGAGAVRLVEIPTPDETHDNIVAFWVPDAPLTPGTPLRVAYRLHWGARSPWESTGGVVTSTRITSAITPGMPVGEGVTPATRRFILDFSRTARAEDGPVEAVITAAKGQVLRSTIQRHEPCGGWRTTFELEPEGTSEPIELRAFLRRGSETLTETWSYLWIP

SEQ ID NO: 14034 - protein, 608 aa, Myxococcus xanthus
MHDLVIGIDLGTTNSAVATVEDGRPRMIPPRAGGRLTPSTLGVNKAGERVVGVAAQSLGEEHPDSVVWATKRFLGRRYTPELVQEAKALVPYPLVAGPSGDVRVRLAGRVMPVTQVSAMILGELALDAQAHFGRPVTKCVITVPANFDDNQRQATREAASIAGLDVVRLVNEPTAAALAYGLSRGFEGNALVFDLGGGTFDVSILEVKSGVFEVRATGGDPRLGGEDFDQRIVQWLLAQVDDELRHVVSQDAQSLRRLKVAAESAKRELTEKEEASIYVAGLGDHSAPGKRMAELETVLTRSFFETLSEPLSRRCLDVCESVMREAKMDPHAVDVVLLVGGMTRVPLVRRLVADFFGRAPSTDVHPEEAVALGAAVQADELVRQSGQALLLDVAAQSLGVGVMGGRVKRLIPKNTGVPVVARDIFYPGSSGQQEARIPVYQGESEFQDENYKLGEVVLKRLHVAARGEVPLEVVFELSSEAILSVKATDLTSGNMEAVRLEARAGLPQGEAEKLGAEQAHYARSQGVVDAKRAEELFRKLLERGEKLARLLQRSAQENPSPEAQATLGTVQRLLDGGRSALDSGNAAQCATIAKQLTRLLSGRQEPRA

SEQ ID NO: 14035 - protein, 293 aa, Myxococcus xanthus
SPPPNARDTVFVVDDSRTAREVVRLHLTRLGCEAVALEGGEACMAELARRTPALILLDLRMERMQGDEVCRLVKAHAAGRNVPVIMFTSGGEPHEVMHCWRAGADDFLPKPVALGALEAKLAAVRQARERVREGPPRGRRVLLVEGGRFLHTFLGGSLEQEGLHVLYARDMGDAANLAAEHGAQLDGFVVDVSRTPREALALATKLHDAHPRKPLVLLSRAEESQEVLARAQALGGAPLLEKRHMGADELLGCVLGRLVPGHAPLRAAERVPFFTVVEFTTPNGATLSGFSHD

SEQ ID NO: 14036 - protein, 102 aa, Myxococcus xanthus
VNVSIARRYARALLDVASEAGRTDAVAEQLTAFADVIAKNAELTDVLVNPAYTREQRLRVVESVMQAIPGGVEATLANTLRLLVDRNRLGYLADIARLFRDM

SEQ ID NO: 14037 - protein, 338 aa, Myxococcus xanthus
TIFGQAIPEDGATPLHLALRAAAHAEPVLEAPAPRVAAPEGLDVRVSLAEGWTRVVANDVSVDGFFAAWEGALPPLAARLGVELSFAGRTVTCEGDVVRHVTGDEARTWGVAAGAFIHFAEPAPALCQWVAWMLEEGRRPEPRPDGELARLLARAAEAAKDPYVLLGARPDADFEEIRRRASAALRRLEGFRVRPLPSGQRRALEALRGRVESARRTLREPLTRAGFDAVRGTLPGLARCVEAGLPDEEVEPLRHAFLSARPGSEAQARALFTQGHALEVQRALRAALSRYASALALDPLNVSWLRHYQELRQRAQGLTPSMPLVLHEGTMAPAALLP

SEQ ID NO: 14038 - protein, 456 aa, Myxococcus xanthus
MNAHIFREYDIRGLVDKDLTTEVVELLGKGLGTIIRRQGGRSIAVGRDCRESSTRFRDALCAGLTSTGLNVFDVGVVPTPLTYFAANTLPVDGLAMITGSHNPPEYNGFKIGAGKTTFHSHEIQALRKLIEARDFEVSPKPGTVTPYDIITPYNHFVRQTVKVGRKGMRIVIDAGNGTGGAIAVPLFESMGFDVVPLFCEMDATFPNHHPDPTVVENLEDLIAAVKREKAEVGIAYDGDSDRIGVIDDQGNILWGDQLMVLFSRYVLKESPGAAIVGEVKCSYTLYDDIAKRGGKPIMWKAGHSLIKSKMKETQAELAGEMSGHIFFKNRYFGFDDAIYSTARLLEILTHEKATMSELLSDVPKTYASPELRFDTKEEKKFEMVKRATETLRDAGHDIIDVDGVRVTFPDGWGLIRASNTQPILVLRFEANTPERLKEIQALIEGTVEKVKVEVGG

SEQ ID NO: 14039 - protein, 58 aa, Myxococcus xanthus
MQPHLRQVMASVGAHVLPTQVHMARVSDAFTPDGKLKDEARQKEVEGLAAALVSKLKP

SEQ ID NO: 14040 - protein, 137 aa, Myxococcus xanthus
MTYHFTSMDELLHEAFSRFAQRISERFAERIAAATDLDALVSAIVHIVHDDLAAGQDELVLTLELYTLAARQRAFRQITHDWMRRSRAVLERFVDARMAHELDALIEGLFIHVSLDPAPRSRDLTRDAVRRLLSRSP

SEQ ID NO: 14041 - protein, 141 aa, Myxococcus xanthus
LVVFVGSGVGSAIIAGGRLVDGGGGVAGELGHIKVVPGGRRCGCGELGCLEAYAGGHNLIAQTRELLASGGAPEVARLTGGDPARITPVTLEQAAEAGDVAAGEVYARAAQFLALAVANQVTMLNPARLVLGGGVLRHCRS

SEQ ID NO: 14042 - protein, 113 aa, Myxococcus xanthus
AQLQADEMLYIPNRRRLTHDRLDAGNGQQVLHLFYGEVELIFDEPDIAPLGEKLLQVEQFQASDAMAWSDGAPHSWDKIRDLLETLIEQRVLRRVSDAPTGRTAVSFPDRLGE

SEQ ID NO: 14043 - protein, 181 aa, Myxococcus xanthus
MRLAELRVAEVEHRINANLASWLPTIQLVGNVGALKVGLSEPALAESVVGVNLTWALFDGRRVTEYMRLPIQLQRREIQYQLALHTAIGRVQDAVVREENEATSLRSLRAQVQLGQQLLDEARRLFEQGHSDYLTVLTALTNLVGLERASLQAQRLLLNHRVEVYRSLGGTWSRDVTLKRE

SEQ ID NO: 14044 - protein, 853 aa, Myxococcus xanthus
ARLGRPRSARAPGARDASLRRAPGHPRRALSRSRSRPARAAPRRVPAALGRHHTPLCHPRRRAHPGVRSRARDRERSDPRERAAEGAAREQRVAVRRAPSRRPGESHAALGRWALAPLVAFGRPTGGEAGAEAGGDAGRGARRRRFGAGGMTRSHSDLLWPVERLPDALEQLAQRQGYGRAAGEIAPPAAAVEPSRVWMFALGDRLGVELEPITPLYHELPDVLARAAPCILQVRRDGVPSYLVLLGTRRGKLRLLARDATAVSVPTKSAIALLREEQEATVAEVDQLLGGVEMSPRAREHARSQMLLQRLGQAQLRTGWIMRPRRTASRRTLLGDIPSLVAGILVSHTLLSLVLAGSFWLLGRAALQAHLETGWFLGWIAVIACAIPLRMLEVWWQGVFSIRLGTLLKQQLLAGTLKLTPDEVRLDGIGRHFGRVAEAEVVEQLAVGGALLAVLSLVDLILAGVILVLGAGGWPQTMVLVLWVVVAFVLARRHYGVQRAWSSARVEITHDLLERMLGHRTRLAQLPLERWHDGEDVRLSSYSEISKVMDRRTMQLTALLRDGWLVLALLTLLPAFSSGTANASALAVSVGGILLALRAFDEVAVYFQQVSQAAVSFEQIRDLLLAVGRPELESKVPLEMEGGKPTDAAGGTLIEARGVTFRHDARTRPVLENCSFQIAQGDRILLEGPSGGGKSTLVSLLTGLRTPQGGVMLLHALDRATFGSSGWRKRITAAPQFHENHVLSGSFAYNLLLGREWPTSPELRTKAAALCKELGLDELIAKMPAGLEEMIGETGWQLSHGEKSRLYIARTLLQGVELVILDESFASLDPETMRVAQRCVLNHAKALVVVSHP

SEQ ID NO: 14045 - protein, 101 aa, Myxococcus xanthus
RCWQWKSFQALSLDELYDVLALRQEVFVVEQRSIYQDVDGFDRSAEHLLLHTESQGPRLLAGYLRVLPPGVKYPQESSLGRVVTSPRARAPGLGRELVARV

SEQ ID NO: 14046 - protein, 49 aa, Myxococcus xanthus
MVVSIAASLTLSVHVPVSRRGLLVAHSVLGGALCSSFSPEAWSALADSL

SEQ ID NO: 14047 - protein, 209 aa, Myxococcus xanthus
ARMRVARLMRAAHLEGVSRRRWCVTTTRDERARPAPDLVDRNFAAPGPDHLWVADITYIPTHAGFLYLAVVLDAWSRKVVGWAMAGHLKTELVVQALDMAVGQRQPQSVVHHSDQGTQYTSIGFGLRCKEAGVRPSMGSVGDAYDNAMCESFFATLECELLARRRFTSHAEARMAVFRFIEGWYNPLRRHSALDYESPAGYEKKHRAAA

SEQ ID NO: 14048 - protein, 154 aa, Myxococcus xanthus
MKAFNHADAGDVGTAEKFEALKKASRSSTTDIAAKAHGDSNNKAQKRLNQGIKTGAEKTADSAFDAAIEKGAKAAGGKLAKFAGRFVPGANVAVAGFDIATAIATSNSKDASPGKKITAWTTAAGSVLAATNIPVVSQVGAAFSTVSDLVGSFF

SEQ ID NO: 14049 - protein, 194 aa, Myxococcus xanthus
MKAAYQVTLLGESSPELFAALGRGGTLDEVMEYIAGELIAQRDAQYLWDFQDHVMREVARRTHVEVPRSLIDEEIRQRWAEAEYPILVSLGLPHERVREGLDGWLLDDSTRSELEYRLRLALGLRAIAERDHIQSERESAEELFNSLAERAQLSRVELGRLLQSDKNLGRRFDTLTMHTAVVSHILSKADVSRE

SEQ ID NO: 14050 - protein, 179 aa, Myxococcus xanthus
MLGPQGRPYGWYPYQGIPPPEWMRLGNWLAGARHWHFAFAWFLILNGVAYVLYLALSGEWRRRLFLPRRDTRNALDTLAFYLRVRKHAPAQGLYNGLQRLAYTGTLALGLLAVLSGLVLYKPVQFGALTSLLGGYDAARAIHLVILALLALFTVGHITLVLLHPRSLAEMVTGGRKPDA

SEQ ID NO: 14051 - protein, 304 aa, Myxococcus xanthus
MDAITDVAQNSHGLRVQRLHGRSILNSFHAVWSIGAVVGGLMGGLAAGLNVHRGLHLGFSALLFAGVSLMALRYTLPGPEPIVAVEPEPAAAHLDSVPARRQPTGRIWLVIAALVLIAVGGTLVEDAGMTWAAVYLSGTLGATAAVASFGFVALVGAQFVGRMLGDGLVDRFGQRAIARAGGATTALGMSAALLLPSMPGTIAGFALAGFGVATLVPAAMHGADELPGLRPGTGLTVVSWLMRLGFLASPPLVGLVADAVGLRVGLLVVPLAGTIVVLLSGVLATVRATATAPGGQGPSLPQPH

SEQ ID NO: 14052 - protein, 224 aa, Myxococcus xanthus
PLSDPTVWGAALKDPLVPVDVSDGGRFVLVTHRHSDHFDRVAVRQALGDSGTLVCAPDMAAAASASGFRVRSAPLYEPILLNDFTATAVPAADGYGDPQVSWVVSGGGRRIIHCGDTLWHGSWWHIGRQFGPFDAAFLPINGARFGWRKPVSDVHAVLTPEQAVAAALVLGAKLLVPIHYGLAASEDYQEVPDAEALLLAAARTRKVNVELARPGEWLTWRART

SEQ ID NO: 14053 - protein, 52 aa, Myxococcus xanthus
MTSLLYLTKRQTQLPEALPEESFSVGATALLVLASLRLSRRAIKLERQELFD

SEQ ID NO: 14054 - protein, 551 aa, Myxococcus xanthus
TIEKAGLYTRNGTQVPLQGVEVTGELLGGHARVRVRQRYRNEEYQPVEAIYTFPLPSDATLSAFSMTCAGRRIEGVVREREEAFRTYDDAVTAGHGAALLDEERRNVFTAQVGNLLPYEETVVEVEFLQAVTAEEGSVRWMLPTLVAPRYIPGATTGDRTGHGSEEPTAQVPDADRITPPVGNVHYGLRMDLLVDLGREVVVESPSHAITTTREEGTRVRVGFSRGEVSLDRDLVLSLRSPDSSAVFTPLVTHRKGEGGPGTFALTVVPDLLALASAPPKQEVVFVVDVSGSMAGESLPQAQAALRLCLRHLREGDRFNVIAFENRFQSFQPEPVPFTQRTLEEADRWVAALNADGGTELLAPMRAAVQAAPDGVIVLLTDGQVGNEAEILRAVLEARKTARVYSFGIGTNVSDVLLRDMAKQTGGDVEFIHPGERIDDKVVAQFSRALAPRVTELEVHFDGVECAELAPAELPPLVDGVPWTLLGRYASPGTGTVTLRGRSGQEPFSLTVRVDLPAVSDRPAVEKLWAAERIRGWEAAQLVGRRAESMKQ

SEQ ID NO: 14055 - protein, 279 aa, Myxococcus xanthus
MQLTGLFGVFIPVAILFLLFLSGVRIVNEYQNGVVFRLGRFVGLKRAGFRWLIPFVERMVIIDLRIVARDVPPQDVITRDNVSVKVNAVVYFRVIHADKAVLQVEDYLYATSQLAQTTLRSILGQVELDQLLSERERINHEIQQVLDARTDPWGVKVSNVEVKHIDLPAEMQRAIARQAEAERERRAKIIAAEGEHQAAEKLSMAAKVLGRYPATLQLRYLQTLVEITTGGNHTILPIPLDLLRTLSGVKAHMERADDGHEDRRYTEDEEEGPPAGGLS

SEQ ID NO: 14056 - protein, 218 aa, Myxococcus xanthus
AHIVTMEPTLSQRTVHALANPAIVYLLFLVAGLGLVVELSHPGAIAPGLIGVVALVLALVASSALPVRAGAVLLMMAGVALIVAELFVTSGLLGAVGVVLLGLGGLFLVDRFNPEWFVDRSFQVSWTWLVPTTVALGGAAAYVVYRSAQTRRLPQRGGDLGLVGERGTALAPVTPESGEVFVHGERWRATSTAPIRSGAHVVVRGMEGLTLFVDEVPT

SEQ ID NO: 14057 - protein, 242 aa, Myxococcus xanthus
SMPDQPKTDVEKELTDLRREIVEARNLVIKSDNLLKNLHAEVKAVGKRHEDFQKRQWLSSAVAYVLFAVICVGAALMITSARSTSATNEKERLEKTVADLTGQLEKQRADTAAHQSVQQEANKVYKMMTSLPGDERLKGIDALVKLDTSRLSNLERQALNDRAAVLRRETGDAAFEQGKIAFRKNEMDSVISNMERFLAMNPPQDQALDASFYLGTAYNNTRNHEKAVPLLARFVDGDRFRA

SEQ ID NO: 14058 - protein, 274 aa, Myxococcus xanthus
MRGALLRRITSPPADHLPGNRAEPQAPLTPKPPLMLRRLLPLALLLSAPAAAQDYGYGDEDVSTSLDGVGRITIQGGWRITPNKTLYDGWYSRSANQGLPRAREVAGGPTVVAYFAYAISDLLEVGIDLFGTQSRLYLNEPGVDGGPPQARQVDVLGYGALIGLRFQTVIPQLGPHGLVPFAGLLTGPTLASSERKGEELQETTTQTWMGNVGATLRLTPRWGITADYRLAFLRGPVGPSTARVGSFSLGGSWLSLGVTYSFPAEPSRLLPGSL

SEQ ID NO: 14059 - protein, 619 aa, Myxococcus xanthus
MSRIARLSDVLINKIAAGEVVERPASVVKELVENAIDAGAGTVRVELDGGGVDRIIVSDDGHGMGRSDAVACLERHATSKLRELDDLFHIDSMGFRGEAIPAIASVSRFTLHSAAANSEVGTRVSVEGGGPPLVEDAPPRTGTVMTVEDLFFNVPARRKFLRRGDTELKHAEEAVVRLALAYPEVGFFASHEGGTLFSSAACPDDPRERIAAALGSTSHPHLFPVEERRLGVAVTGFAASPEFTFNNARGLYTFVNRRYIRDRGLIGTIQRAYQDFLAAGRQPVVVLHIDVDPRAVDVNVHPQKQEVRFADARGVQEALTAALSRMLRAAPWLGSGVEGAAPQAGQPMDAAHYAHAVERFLTRAQEAAWGGPLPTAMDAPGPGPGAPSLGPLGQGARPGALPFAAAVGQAPAFGQAQPQLNEAPPPGYFGALRPLGMLGGRFHVCEGPGGTLVVMDPHAALERARLTGYLRALESGKPPPAPTLFGTTLELPVAAAKALVEGREALSRLGFDVEPFGGTTVALKTVPPGLEGADARSLLEALARALPPKSATLDTVSLAEAVRVMACHAAKQAGAVPLSDAQFRALLGELDRADFHPTCSHGTVVVLEMPLLELERRAR

SEQ ID NO: 14060 - protein, 802 aa, Myxococcus xanthus
  unsure (1)..(802): unsure at all Xaa locations
MSESQRLVRDGEAAQVAASAASASGDKKEAEEKYRKALALFEQALTAEPGSVAAAAGLGASANALNDWQRTVDRVQPVLTANPSELALAYPVSVAYFKLRRFPEAVPLMERVATADKAEHLIVHYYLASYYLYVQQGDAAATRLKRYLALRPQALAPNDFQIHELLGRAHVLRGDAAAARASFQQAQAGRPESPSVQLGLAQVLELEGRAVEARTLLEGVTTRFPQAGDAREKLARLYLGAGDVAKADTQAQAVMKLGSSPAAHLLLGDVRFAQKNAAAAEAEYRKVLQLQPGLVLGQMAVGKALQAQGRHEEAIQFLEGAVRAGANSLELWANLGSVNRRAGRFQRAVEVHRRVVEMAPRQALGYVLLGADHFATGQWDQAIEDYANALQVEPEHAGAKQWLARALAHRARDRAGTGRLEDAVRDLRRAYDLDRGAPMARRLGASLLETRAYADARKVMEQGVMLPGAAWRDSLLLGYARLATNDAQAALEAFNRAAAQTEEPDEQAEASVGAALAEVELGQVDAAVQRLTAVGPSRAAAQVAGANLPRVLVRRALVRLEAGDADAAERDLDLVDKLGTGNRKELVRLAQFVRGLARAESGRHAEASAAITKALASTQPWAWPNTRALATAFVLYKKGQVPAARKQLTAAAKKPMPGQPKWLTAMTGALHRREASQAYNAGNMRAAEKAFKAALAGNPDDTQVQHNLACVDWRKGRTTDAVETWRRLESSVPVAALNLGIDAQERRKDAGEAVEAWRRYLAGGSGPRMAXVREWKERLQSLHGLAEPAAGAPADATVEETP

SEQ ID NO: 14061 - protein, 297 aa, Myxococcus xanthus
MQLAAGNLSARAGTAQGAGREVVTLGVVFNHMAERIKVLLEDVRAKAQLEREVSLARTVQETLLPGREGVQVGPLRIAGLVVTADACGGDWWFRAALDDRRIVIGIGDVTGHGLSTSLVATSATSGFASAMTLREPSQVNAQMLITALNVTLANVGRGEHQMSSALAVIDVSNGYIDYAAGAHPSPLVFNKRSGQIASLPARGPLLGASVESQFTSRQAQLRPGDVVVWYTDGLTEARDNAGKLYGTQRLAAAVQAHAHLSAEALRDAVLADARAFSAGQPQRDDITVVVAEFSPAA

SEQ ID NO: 14062 - protein, 263 aa, Myxococcus xanthus
MITRKELERSALYQRSKELDLSLEHVMAVLLPVHPQLLGAFTLYRDRRLAFSEKDAAFLTSLTPHLLNAVRNCRDMQTASTGSRLLEELYSRPDAAYVVVAPPSHEVLRSRRAATLLERWFKPSDLHSSGIPLVLMERLGALTRMTPDAQLQNNLWVSLHGDSYRVVRFVELPETEGPRQWALILNEIPLSIPLPETMRMQLTARQVDIARGMLHNWSNEQIASELGLSEDTVKTHVRDIFRRLQVDNRTDFLYQAAHLNKPV

SEQ ID NO: 14063 - protein, 300 aa, Myxococcus xanthus
MAAVLGINLLAATQDVATDGLAVDLLAPAERGWGNGIQVAAYRVGMILGGGVMLAVFDAVGWRPTFLALGTLLLLATVPIALFREPPTAPPPAQSLGLRWWLKRPGAAAWLTLLVVYKAGEALATGMLRTFLVDEGLSLTAIGWLLGGVGFTAGLVGALLGGGLVVRLGRRRALLVFGGIQAGAVLLYALAARGPTSLPLLTLVCGVEYVASGMATAAVFTAMMDACRPDHAATDYTVQASLVVLATGAAAALSGFSAQALGYAGHFTLAALLCAAGTLYAALTFHPPRSLASEAAPEVS

SEQ ID NO: 14064 - protein, 165 aa, Myxococcus xanthus
MTIAVYAGSFDPVTAGHMSVVRQAARLFGHVVVVVAVNPDKESLLSADERVALLREAVAHHPNVTVARTQGLIVDFARDIGASVLLRGVRGAMDAQFETTLAQNNRALAPELSTLFLPAEAHLAEVSSSGLKARVARGEDVSAFCPPAVATKLRERLDLSLRSLP

SEQ ID NO: 14065 - protein, 205 aa, Myxococcus xanthus
MREASESSGVPLDADRVSAVALTHLHADHASGLESLGYFSFFVLQRKLEVLAHPAVADRLWEGNLAAGMECLIERCGEPPNDKHFEDYLRHTPFFTETAVRNGPFLIESRMTYHHVPTTALRIHAGGRCLGYSADTAFDEGLIDWLSKADLIIHETNYGVHTPYEKLAALPAELRARMRLIHYPDDFDTSASVIEPLAQGRRYNV

SEQ ID NO: 14066 - protein, 125 aa, Myxococcus xanthus
TKKTALARREALLALAAVLASGCATSPPSPTPAPPSGTVRLTLLHLADVYQVQAVEEGRGGMARAATLRKQVLRESPHVLTLMGGDTLSPSVESLVEVDGKALKGRHMVDAWNAFGLDYAVLGNP

SEQ ID NO: 14067 - protein, 479 aa, Myxococcus xanthus
MIIYEMHVGTFHDSPGFGPGNWNSAIARLDHVRDLGANMIKVMPAYEFAGDFSWGYNAAFPFAPESAYGHPNDMKRFVDEAHMRGIGVIFDVVHNHYGPSDLPMWCFSGDCLGSGGEYFYNDWRKSTPWGDTRPDYGRPEVRAYIRDSMMNLTHSFRGDGLRWDATKYMRTQNGSDTTAIPDAWRVFRSINREINATQPWKISIAEDFGGGDFITNDATSDTSGGAGFDSQWGGDFVHAIRAAVIASNDSGRDMNSVRNAITQRYSGRHTARVIYSESHDEVANGKARVPEEIWPGNAGSWAAKKRSTLAAGVVFTSPGIPMIFQGQEFLEDGYFQDTDPVDWGKNSTYSGIRTLYRDLIRLRRNWFNNTRGLRGGNVNVHHVNNSGKVIAYHRWESGGPGDDVVIVANFSGTYFPSYNIGFPRGGMWYARFNSDWNGYSGDFGNTASIDTVAYSGAKDGLSHNASFAIGPYSLVIFSQ

SEQ ID NO: 14068 - protein, 964 aa, Myxococcus xanthus
CSKDVPLEKIVEALGVERNLSHAPLFQVMLMLQNTPEGHLSLPGLALEPIDLEIESAKFDLTLSFEPTREGLAGVIEYSTDLFDADRIERMVAHLQVLFADAVAHPEKRLSELALLPEQERGVVAAFTQGRLVAPTRHVPAHRFVEEHAERTPDAIALELGQERLTYGELNRRANRAAHQLIAMGAGPEMLVALAVPRSFEMLIGLLAIWKAGAAYVPLDLSYPKDRLDGILEDSGAALMVSTHAAEQKWRAPQVRTLWLDEPADAAPTGNPDSGVRMENAAYVIYTSGSTGRPKGVILEHRGLANVIEMQRHELGADAGCVMLQFSSISFDVSVWEIVMALTNGGRLVVAPADTLLAGDELAKVLLAHGVTHMVLPPTSYAALPTDREYPALRMLTSAGEALPPEVVHTWARPGVLFVNAYGPTEVSIISTLGHCRQDDPGAPPIGRPALNLEGYALDRHGALLPIGVPGELHIGGVGVARGYLNREELTREKFIPHPFKPDARLYRSGDLVRWRKDGNLEYLGRIDHQVKLRGYRIELGEIEAVLASYPGVAKAVANVHSAGAQGGVKALIAYVVSTQPVDVHALREYARKKLPEFMVPAQFIHLEELPLSSSGKVDKRRLPPPRFEASASETRFVPPRTPTEQTLASLWESLLERRPIGAEDNFFDLGGHSLLAAQVMSRVRRTFGVDVPLSAIFEQPTLTALAAVIAAKEAAPQLPPLVRLTSPGDRPLSFAQERLRFLAELEGQSAAYNIPFAFTLRGSLDEAALRRSLQRVLERHEVLRTNFPLVDGLPVARVADAVLTLTTEDLRHAGAVSLDQRLAEESARPFALDVGPVVRVHLFKRADDEHVLLVAMHHIVSDGWSFGVMMREFSAFYAAEVRGEPLALPDLPIQYTDYAAWQRSWLDGQAREHQLGHWRKALAGAPAELDLPTDRPQDGDQIHPRATEPLALAPDVTQGLTSV

SEQ ID NO: 14069 - protein, 158 aa, Myxococcus xanthus
ALSVQYFHREEFETRTLRALGGAACMGLVAGAVPDLHLTPEYLAIVAAAQACVKPTGVHPLALRLALTVLPALPYFFRAPEPLPVSLAGALAAAMVAWLGHGREQPGQPAAVATSAAAAGLLVPLGLYVQQVLEARFLGRDGLLSALVGFLVVGLFWS

SEQ ID NO: 14070 - protein, 478 aa, Myxococcus xanthus
MNRSLLLVAATGVLAVGALLLGTPPTPPGPPPPAVTDTSHTVRRPEDPPATRTLTLVTSKPEDGALNMAGKLSGAYVQTGPSEAFAWMELKARPAETGQRVPVSLALVLDRSGSMNGQKLADARRAATELVQRLKPEDRLAFIDYGTDVRVQPSRRMTEEAREELLTLISGLQDDGSTNISGALDAAANALRPHMREYRVSRAILLSDGQPTTGIVSEPGLLDQVRQLRRDGITVSALGVGRDYQETLMRGMAEQGGGFSGFIDDSARLAEVFSRELDQATSTVARMVELRLDVPPEVQDVEVMGMASFREGNVLKVPLYDMASAQTVRVMAKLTLNTSRTAGALALLNARVHYVDVARDLPTETALQLTAEVTSDLDRVREYLDKEVRVHAVRAMGTQHMVAAAEEMKRGNKAKASSLLDNARTIFGTSADALSGELADVRRSQAALAGASSAEEAQAESRNLLKKSIKNFGQNNTY

SEQ ID NO: 14071 - protein, 751 aa, Myxococcus xanthus
CAPGVKPEIDNPDLQNVPMEPALRRWTETLSRGDVIEGLVASFPASERELLDPQGILSLLVLPLRVRGVLTGFVGFDNTSEARRWDRLEVDLLSAAAGAISMALERRESERALRERERRFRQLAENASDVLYVYRREAPRGFAYVSRVAHTKLGYGPVAHYADAELWYRRVHEEDRALMEQLLEAPEPFQGAPVVVRFLHPDGRTLWLEHVVAPVTDASGRMVAVEGLARDITERRQAEEALRLSEASFRALLEGVPDAAAIERDNQIVYANAALVATLGFERADQLVGRPLTEFVRDMRSPDAVRAGALTGERRLVRRDGRTRVAEVVSLPLRFDGQPAVVSIARDVTEQRQLQARLTLADRLASVGTLAAGIAHEINNPLAFVLSNLGFLSDEFSRSLPPGDGAAALQARLKGEPDLGEWQEVLQEACEGAERVRQIVRQLKTFSRPDEERVSPLDVHAVLESVAMMAANEIRHRAQLRRDYGDIPPVMANEGKLSQVFLNLVVNAAQAIPEGAAHRHEIRLATRVDGAGRVVVEVADTGVGIAREVIDRIFDPFFTTKPVGVGTGLGLSICHSIISGLGGDITVDSEPERGTLFRVVLPTPETVERAKPSEPDSRQAPRAPRGRVLVVDDEPAVGRVLQRILREHQVDVACSGRQALELLERGLVPDAVLCDVMMPDLTGRDVYEAVRREYAGLERRFVFVSGGAFTSGARDFLASIPNLLLEKPFDEARVRGVVEELVRQRLPAHDA

SEQ ID NO: 14072 - protein, 1439 aa, Myxococcus xanthus
RFTGSRLRSLGRLRDLAREHETTLYTVLVAAFQALLHRYTGQDDLIIGSPASGRTRARLSGLVGYFTNPLPLRARFTPGLRFDTFLQQVRATVLGALEHQDIPFPALVEQLQPKRDPARSPIFQAMLVLQKSHVGADLGLEALALDEAGVVVSLGELDLEAWPLNRGSAQFDLSLALAETREGLCASMEYDTALFKAGTIDRMLGHLRVLLEAVTTAPTLPIDQVPLLTEEERAQLLDWNATAHVYEAPLTLHGLFEAQAARTPEAVALCFESETLTYGELDRRANQLAHHLRGLGVGPEHRVGVCLERSLELVVSLLGVLKAGGAYVPLDPSYPQERLDFMLRDAAVRVLLTQQRLAKVFTEAAVTRVFVDADERAPFQHAESPRRSASWSESLAYVIYTSGSTGRPKGAMNTHAGVRNRLLWMQSEYGLSADDRVLQKTPLSFDVSVWEFFWPLMTGARLVLARPGGHQDPAYLKQLIQDEAITTAHFVPSMMQAFLAESAVEQCASLRRVFSSGEALSPELRDHFVARLPETRLYNLYGPTEAAVDVSAWDCHRSLPSRTVPIGQPVANTALYVLDTRLAPLPVGVPGELYIGGVQVGRGYLGRPDLTAERFVPDGFAREEGMRMYRTGDRARVLPDGSLEYLGRLDHQVKVRGHRIELGEIEATLEQHPAVQQAVVLARTAVGDDVQLVAFISHRGHAPTPATLRDFLAERLPGFMVPSHIGILAELPLGPSGKRDRLALASVQVEASDNGLEWMAPRTPTELTVARIWSDVLKRERIGANDDFFQLGGHSLLATRVVARLRAILGVEVPLHTFFAAPTVAALAERLQSCRSGGPKPPPLHRRSEPGPAPLSFAQERLWLFAQMTGPTAIYNMPSAVRLKGTLDVPALERALGDVVRRHEALRTVPRVEAGAEPVQVVLPAEPLTMPRVDLRAMPEEQREPRAEALAREEAALPFDLDQGPLLRARLLQLEDTHHILLLTLHHSASDGWSMGVFAREVSQLYGAFTRGEPSGLPELPVQYSDYALWQRRWLESGELERQLRYWEQRLDALPRLQLRTDRPRPTVQRHQGRSRRFLLPQPLVEQLEALGRAEGVTLFMVLLGVYNLVLHRYSGQDDIVVGTDVAHRNPPEVEGLIGFFTNQLVLRADLSANPTVRELLARLRQVTLDAYEHQDVPFERLVRALKSERDAGYAPLFQVKLVLQNAPPPLLTLQSLHTHVMDVEGGETARWDLLLDFSPGPEGLWARAEYNTDLFDDATIVRLWEHFLLAARSVPSSLARPIATLPLLLPAEQELLARWNDTATGYPRDATIQALFEAHAAATPDAVALTCEHHQLTYGALNQRANQVAHHLRALGVSAGARVGLCLERSLDMVVALLGILKAGGAYLPLDPTFPPERLGFLVQDARMAALVTRSGLADDLPVQWIPVVSLDEDAAAL

SEQ ID NO: 14073 - protein, 547 aa, Myxococcus xanthus
MKELAAGKENVLKLHAGDALTGTLYFNRAGQIGEADAAMMNTVCFDAFTLGNHEFDKGDTELKRFIDRLHAGQCQTPVISANVQFGAGSALHTSRAAGYVEPFTVVERGGQKIGLVGLTIAGKTKESSSPDADTTFEAEVPAAQRAIDALRAQGINKIIVMSHIGYQLDRTIIPQLSGVDAVIGGDSHTLLGPAAMETFNVGTPAGPYAESLRNRDGETVCLGQAWQYSQVVGEMTLRFDAEGVVTSCGGTPHVLIGNQFSIDGTPVSESDNAAMLASVAVSGFLRVTQPDAAAAQVLAPFQGRIDEYSRTVVATADDELCNRRVPGNTEPGRSSVSCNALGEVHSRGGDIQQLVAQAYLEVANADYGGADITLQSAGGVRRPLQGPVTAADVIEVLPFGNMLFRLDVTGTEVKSMIEDGLHATFREGGTTGPYPYTGGLRFDVNAAHARGQRASNLEVLDQTTGQWNELQPTATYRLFVLSFNATGGDGYVTLANVPAERRSDIGVLDADVLQTYIDRQAERKPGTNLPVLHKVDASLYSTKSFVE

SEQ ID NO: 14074 - protein, 294 aa, Myxococcus xanthus
MDKSQVLLSELQFLVDGTESSLDLGESGNRLVWTGRIAKGATSRFTIRYRARGLNSFVYRLDPALPARDVRVHVAVEGGENYDYPSGVLAASSVNTTADAVTLDWAFQSLESGVNLGVILPSEKTFDALVGTMATRAWVPFLGLLALLAALGLRHRRSLALHETYLLASVYGFFFVLLAYLAAFMNFYAAYAVCAVGLGAAVVVYVRWLFPKERTSVLAALWGATLVVPTGAVILQGYTGLIYTLEILAALLGLMVLSTRAGVRAFLSDLSLPGEPPRAAVAPAASTPVTPEAS

SEQ ID NO: 14075 - protein, 342 aa, Myxococcus xanthus
MEALVKSQLKGRLTADALFVDGHFDVEVLADGRWTQVRLLQLDADTYPATLPSLEEGTVGVVDGYLCLLTRKAGRYVFDVGVSIRSPGAGPERRAQLRFGPHASPVPLALEADTSVFTLTEPLASMGGESHAVYPVQGMLRVGWRAAVARVAQSQKQQVRPPLEPRITEATASWVSTLEGRATLRVSYALSLDREQPLELVLPEGHRLERVTLNAIPVPVESENGPLALKVAPARLGETGGTLEVVLSRELGVFHLSGRLKLALPRVSWPVAELRARAHFPAVFNYRREGGSLEQYESTESVAAGASGLPGKALHFRQFLVAASSPTLELGYSVDISDSYFR

SEQ ID NO: 14076 - protein, 577 aa, Myxococcus xanthus
MSWSATGPSTATCAGSGRSSRARAETSSRRCMALAIGSPSPERRARPRLWLVFAAVGVAGFALTLAGLAFVRVYDNQLIRQTESELIAQGAVVAEVFRERLRATVPEGAYGRERTAPWPFPIPDDTRLRPILPLVRASDASLPPGDTPRPSRVPAEPLSHAAGLQLTPLLEQVRAATLAGIRVVDTEGVVVASSSSALLWTTLADRTEVQRALRGEPVSVLRRRVADPEDTPLASLSRDTGIRVTVALPVLEGDRVWGAVVLTRTPMTFAKATYADRWNLTATGFVLLGAVALMSLAAAALVGRPVRALVKQTRAIAMSDPSGFEPMARPVVAELAELSESLAGMATALRDRNQYIRSFAANVSHEFKTPLASIQGAVELLRDSADAMSPEQRARFLANVDADARRLTRLVQRLLELARADSMTATPAQVELGPLLEGLALRARADGATAIHVTAPPAGLKVSLPQEVLDDVLWQLVTNARQHGGDTVRVDLSVEQAPEADLVRVVVKDRGKGISESNRARIFDAFFTTARERGGTGLGLTIAQSMLRAFHARLELLPSDTGTTFAVVAPVPRLQRK

SEQ ID NO: 14077 - protein, 467 aa, Myxococcus xanthus
MSSIDPTAISRPRSPDIISGYHLDKLVGSGGMGEVHKATQLSLGRTVAVKLLNPELAKDPSFIARFQKEAAALAALSHPHIVSIVDKGKTDTTYYLVMEFVDGPSLRELIREPQLDVMGALRRMLQICRAIEYAHGRGVIHRDLKPENILLDQQAGGIAKVSDFGLASFLEDASPSSRYALTSTHVSMGTLSYMAPEQRVDAKSADARADIFSLGVILYEWLTGEVPLGTFDPPSRRKPGLDSRLDAIVTRCLKPDPEDRYPSVTTLIADLELLVPGSLPSLAPVKLTHLQRVRQGVRKVVRMALQAAAVLLVVAALLRAGPGVAAQRGEARAAAARRRAERGPGPAIAPVHARPAGDRLREAHGVGGSRPGRAVAPGRRTAGGGGGEGHHLPARGGALAVARGPCPRGRGGAGRRHRRAQRPRACGRAAGHLEAPRLRHALRAVAAGPRGRAAATGQHGPLCGAHP

SEQ ID NO: 14078 - protein, 261 aa, Myxococcus xanthus
MPGRLETGSEKRTVSVGHGPDAPSLLVAGRPVEAEEKAIIFPPVEERSQSRVGRARVDVVGLDGDIAVLSARVRADAPPDTWKRRAYVMLYGPSLQAPAAALLLQGSTGRYVALIHDGAGAPLRLEWALGERRGTMLGLASPEGEAALELRVDADGVMQGYVGKGKDQRAIGEPLNLGPGWMEHFGDAPVPAFGCIEGTCRAEGFLYTVRRAPPPGTTAPVPDVPVAKAVVAAVPAKRPAPPPPPKKQPAKAPVKSPPKRR

SEQ ID NO: 14079 - protein, 597 aa, Myxococcus xanthus
RTIRLGFAALALVTALTGCHRSTSTATPRVLETAAEQAQKGTQQARTLAFAGFHALLVAGDALLAQQRFDDAIARDAGDVYALAGQSLMARRAGRPDRALTASLELVARAPTHPLAAVAARHVLDSVGTSRALDDDILLGVERALAAGATGEAAYLMRGARMSVAVVRGDAEARDAAMQQLGGVSEVSLVGPFSPFHVLAWDERTPVSQNGSLAGPLTGAFGPLPVRTVRAPDGRMDLTGEPGQGDLYVQAFDADVTEPGLYVARTVSGTSHQVLMDGAPLMERRAWERATTTVTARAVQLPAGKHRFVVRQIKGGTSGLLTFALLRVDGRPSGVRFSAATGAAPQAWGSKVEFSDETPGVFPTTEGLKTALHEEAGELLAVVLAVRDGLQRDADGARRLMASVDANTPALLWLRAEVASADRTVPSKVARGRATRDLESVLAKDPGNVAALLLRAELFLDEGQPTSAMDMLKTASEVAQPAGHPVFMLRARAALALEVEALAEESLTAALEAQPGLCEALTLQYSLARRRDAAERSDTLAASLNGCPGTVVRQAEHARTRGDVETATKLYSELQSRDPSSISLANTLANLYCPSAA

SEQ ID NO: 14080 - protein, 204 aa, Myxococcus xanthus
YMTDPLCGYSYGNYKMESLESSLVKLSRVKFPRVFHNCDANGNGNVPFFCPNTRAGTWGSCGTDNPNDPDIAERQCNIDCTMGIGQFAGVHCAERNTYNGFGQFVVEMNPTGAASAGLDESVPGRIQTFTASVNADPTIVNWAQSDTFSRDQRVNVSCDKAANVRFGANGTPVALTAQTPLQHTMAAGEGVVYASVQNSAAITP

SEQ ID NO: 14081 - protein, 128 aa, Myxococcus xanthus
RALKNEWDNAGCPANGCENTTCRTNPACCSEVGQDIVIPVSMNAFAIHGLCYMPGSGRPVRPGDLTCMRDFLDDLPALDAAAPGNLRFDFTSGRPRSLIQVEPRTGLANVMDCNPHASTQNQAIECVN

SEQ ID NO: 14082 - protein, 99 aa, Myxococcus xanthus
KNFGLMLFPLTVLLLAGSVEGASPIPGAEAPVSIGQTSDTSSVKDEDGNDIELPKHDAKQTLCIGKCQEPVSKRISGCEGGDRKCQLRCAHTMERCARK

SEQ ID NO: 14083 - protein, 173 aa, Myxococcus xanthus
MQVGVCAGTLVGAWVLGAPVGAWATVSLGVALVAYAAWGLSGARLPVGPVAEARLGPWVGALTGFVTAATGVFVIPAVPYLQALGFEREELIQAMGISFTVSTLALAAGLYVNAAGAGAQLGQSLLMLLPALVGMQVGQWLRQKLSPVLFRACFLVSLMLLGMHMVAREMRVG

SEQ ID NO: 14084 - protein, 966 aa, Myxococcus xanthus
MSDTPPKDKDFKDSVNLPRTDFPMKGNLAQLEPRMLGWWAERGIWGKILEQNADAEPFVLPDGPPYANGHLHAGHALNKVLKDIVVKYRNMSGRRCDFIPGWDTHGLPIEQAVEKRLKDKKIDKRTLARDAFLEACRAYALEFVDIQKAEFQRLGVFGSWEQPYKTLDFTYEAQEIRELATFAKRGMLYRRKKPVYWCLYDQTALAEAEVEYENHTSPSVYVAFQAGAELAERVPSLKGKDVAFVIWTTTPWTLPSNLAVSVNPEFEYVFYQLGTRVICVARELLPKVLAEVKADELAVKHVELPGGEVSAAALVDPSRILAYARGEELEHLTYQHPFYERRGRVILGEHVTLDAGTGLVHTAPGHGQEDYEVGLKYGLDIYNPVRPDGRYDDTVGPALEGRRVFEANPVVIQLLVEKGALLNGATDTVAHTYPHCWRCRNPVILSATYQWFIPMDAPFHGTQTFRQVVLEQVDKVQWVPSWGHSRIRGMLETRPDWTISRQRTWGVPICIAYCEGCEEAVVSPELMERVAAAVEKEGVGVWYRTPVKEFLGADFQCPRCGKGEFRRETDILDVWFDSACMFSAVLEKRQRIPADLFLEGSDQHRGWFHSSMLVAVGTRDMSPYKACLTHGFVVDGQGEKMSKSRGNVVAPDKVIQQYGAEVLRLWVAASDYRNDVRLSDQILKGLSEGYRKIRNTVRYALSNLYDFDPAKHAVPEVELLPLDRWALGRLAEVVARVRKAYEDYEFHLVYATVVDFVAGDLSAVYFDILKDRLYTWRADGQPRRGAQTVLYEVASVLLRLLAPVMSFTAEEAWQTLPGKPAESVFLGGFPVVSAKLDPALAERYAKLFAVRGAVQGVLEAARRDKRIGSSMEARVVLPAEGPARDFLQAHLAELPGLFITSQVELADVKGDAAQTLEVAQAFGEGVRVTAEVLPAHGEKCPRCWTYSEAVGQGGDVCLKCREALAA

SEQ ID NO: 14085 - protein, 466 aa, Myxococcus xanthus
EDPTVIIPEGVNADAILDLSLYSERVLGFEVQRGREPAVGVEGSGLEWIDPGDRERGFSFTLRVASPDGRDAVPLRLDSRETAAELYAANEAALARGSTEPLTVAGARIAPGEDLRRQLTTALRLSEPEPGTAAPSGGDSASSSKPKKSIEAVRVRELAASATGSAQSGIDDPVPWELLRSVMVTGVELKLHQRQGIEWLWRRAREATPGVLLADDMGLGKTLQVACFLTLRRMTLHEQLPPGTRLKPQLVVCPTILLENWRQELERFFVESTWEPFILHGAGLEAVKRDGELNGAFLSRQDLVLTNYETLGAYQRSLLKVDFDVVVFDEAHNLKNPDTLRSRAARALKRSFAVGLTGTPVENELLDVWAIYDALQCRQPRVFGTRAAFREEHQGEEAIETLRQRLDYPSPGCTLLRREKAEALKDLPPKRPQCRKVEMTEEQESQERLIARQMSSRGSFWALSVE

SEQ ID NO: 14086 - protein, 159 aa, Myxococcus xanthus
KGLPPGLDVEVWGVDLSEGMLKHCKRRLRSGDCAGVRLMMADAHALPFPDASFDRVFHVGGIGGYRAPERALAEMARVAKPGTPLVVVDEQMDPAFRPSLFQRAAFRAMTFYSWDPHSPRELLPPGAFDVTEEQVAPFYYCLSFRMPEVDSASADARHG

SEQ ID NO: 14087 - protein, 557 aa, Myxococcus xanthus
PAVASVTNDSDPVELGVKFKTNVSGNVLGVRFYKGAANTGTHVGSLWSANGQRLAFATFTSETATGWQEVTFSTPVAIAANTTYVASYHAPVGSYAFDNGGLASGQDTPPLFALPGSTSGGNGVFTYGAAGSFPINSFGNSNYWVDVVFQATGAPPPTQPPDNTFRIFAPTATPGTATASDTAAIEVGVKFRSDVDGQVTGVRFYKGSGNNGTHVGNLWSATGQPLASATFTNETAVGWQEVTFSSPVAITAGTTYVASYFAPLGGYSFDSNGLATGVDAPPLHALPGATTSGGNGVFAYASTSTFPNGSHQNSNYWVDVVFETYGPPPRPGVHGAGPVLVATAPGNPFTDYLREILEAEGIAAFATTDAGNLGVSVSLDDYKVLVLGEQTLSAAQVTLITHWVTAGGSLIALRPAANLQSLLGLNASQGTQANGYILVNDTQAPGTGITAETMQYHGLADKRTVVTGTRTVATLYSDATSATTFTAVSQRTVGSGTATAFMYELAKSVIYTRQANPACQGQNRCGSSIGPGARPIDMLRSQLVSATSAVMVCAQVG

SEQ ID NO: 14088 - protein, 180 aa, Myxococcus xanthus
GGGIRVPPRTGLGRVQLSAQELLDLLLALALAERLESPLLLSTLKSLRQKLAASFPPEERARVGKLRRRILVGPTSRNVTATWKPPRAAVLRPLQESFFEQHALELTYRSNDVRTVRIVEPHYLLLSWPAWYLLVWDHLRGAVRMLRVDRIESASVQAATFQVRDSKSMLATLGDIFAAL

SEQ ID NO: 14089 - protein, 367 aa, Myxococcus xanthus
MFVALIAFGRLWCVTHQEEAPSPRPGRMAQAGNAPAGAPDPSSAPECRTLERALESALRTPQDTRVLDEARQQLDACRQPPVRACALGVALDARSPLSEGEATPLRGLLASLCEHCPPAANSCARAVGQALLNAAVGPNADVASAKWNLEHAGPGLGGACASLVQLGLAPAAQSDLTVRPPVLALAGELAPHCSQAGFLDDALLRAAAVNLVAPTPALVALAAVPIPPETSAMKPDRIEGTEPSFQAFDRDEDTGVPVGKALKTKRWEADGALRASYAPTLKQLVSVRIRATGPGTVRAIVRTQQGVGLKDPEKDFAFVNPTVCRFTGTGQWEQCPLQVPLRDVDAVSVFPERADTELKELEVHGAR

SEQ ID NO: 14090 - protein, 135 aa, Myxococcus xanthus
KHKDKIVTKGANGIDFLMKKNKVTVVKGHGRIAGKGKVEVTAADGSKQVLEAKNIILATGSVPKSLPNVPVDHKRVLNSDSILQIDRVPKSIIVLGAGAVGCEFASVFNHVGSKTSIVEYMPALLPIEDADISRR

SEQ ID NO: 14091 - protein, 115 aa, Myxococcus xanthus
MQEAAARLNTNLIYVGSVSSKSKVPDANERTVLNQFLMDARRTCVEQAWLIYEGTDLQHNLQRVIISGVLILTRTFDNFLSVAKSGDSIVKDVSAVLKKDAAPLFTLAKERGLVA

SEQ ID NO: 14092 - protein, 202 aa, Myxococcus xanthus
MLDLDALDFAKGNGLVTVVTQDASTGDVLMVAHADREALERTLATGEMHYRSRTRGPWHKGATSGNVQRVVALRADCDGDAVLARVAKAGPACHLGTKTCFGPGRWDALSALDDTLARRAAPAERPDDAPPSYTRRLLEDRNLRLKKLGEEAAELVTACADVDPSRAAEEAADVLYHVLVAVRPLGLSLDDVKAVLARRASR

SEQ ID NO: 14093 - protein, 265 aa, Myxococcus xanthus
SHSEPDMTDSGNLMQPAAEVARIAGDAALGFFRGGIAVDTKSDGSPVTVADRTAESRAREWLEARFPQDGILGEEFGETRPGAKRRWILDPIDGTKTFIRGVPLWGTLVALAEGERILVGAAYFPAVSELLVAAPGRGCFWNDQRAAVSTQAELSQAVVLSTDERFPVYPERGAAWRSLARDAAVDRTWGDCYGYLLVATGRAEVMVDELLSPWDGAALQPIIEEAGGVFTDWTGRRTAFGGNGIATNAAMARVVRERLGAVETR

SEQ ID NO: 14094 - protein, 219 aa, Myxococcus xanthus
MFPLLQRDQPNPVELFQIWLNLPRANKLVEPHFSMMWNHVIPRHVARDAEGRATEVTVVAGSLGDVKAPPPPPKSWAAQAESDVAIWTLKLAPGARWTLPAAARGSNRMLYFFLGSSLRVAGRAIPPSHGIELRADVAVELENGADEAELLMLQGRPIGEPVVQYGPFVMNSRQEIQEAFADYQRTGFGGWPWPANDPVHPPEEGRFARHGDGRIERPA

SEQ ID NO: 14095 - protein, 699 aa, Myxococcus xanthus
MAEFCENGAKAVAEEAMSARATPEFFRRWSVADLALQTDHWLGKQGRLTHPMVLREGATHYEPLSWDEAFALVAEELNALDTPDAASFYTSGRTSNEAAFLYQLFVRQFGTNNLPDCSNMCHESSGSALNETVGIGKGTVTLEDFDQADAIFVIGQNPGTNHPRMLSSLEAAARRGCQIVSINPLPETGLNRFKHPQDVLHLIGPGTALNSLFVQVRINGDAALLQGIAKALFEMEDANPGSVVAKGFIDDKTLGFEAYAAHMRAVKWEDVEEGSGVPRAQVLAAAEILARSERTIFCWAMGLTQHRNGVACIQEIVNLTLLRGAIGKPGAGLCPVRGHSNVQGDRTMGIWEKPPEALLTALSREFGFEPPRHHGMDVVDTLHAMHDGRVKVFFALGGNFLSATPDTEFTAEALRRTRLTVHVSTKLNRSHLVHGRRALILPCLGRTERDVQAGGAQFVTVENSMGVVSSSRGSVAPASEHLLSEPVIVARLATAVLGARSRVPWLSLVEDYDRIREQISRVIPGFDDFNRRVREPGGFALPNGPREGRFTTKSGKAHFTVHALQPIALEPGQLLMMTIRTHDQFNTTVYGLDDRYRGIRNGRRVVLLHPAYMKAQGLAADQLVDLRSHFEGETRLARGFRVVPYNIPRRCAATYFPEANVLVPVNSFAEKSRTPTSKSVVISITPAGEARALPAGAVA

SEQ ID NO: 14096 - protein, 295 aa, Myxococcus xanthus
MARQETMLAALQEVGDVDTAARVRRETEATVTTVLTRILKRHPDALQSLVGDAPCTFDGRALRFHGAVEVDLRQVLGTGAKSVALLEQLRALMPATAADGRDRLAEFIRTRAARLPWREASEVLAERLFSLATSPEGRSGMSGFLACYPGGRKEPDWCARAGLLLSRTLEVGGPPEVVENLCELLARFDAPPVDGLRGALGALVNGDFEASADLGPVRFVLDHCQATLRKGEPGLVLTLLWLEERLFRAAVRKGAPDAFDRRKRALSKLKPGAPGFDQLHWLAEECAELWPRFML

SEQ ID NO: 14097 - protein, 395 aa, Myxococcus xanthus
NNLDPDVAERPEDLVVYGGTGKAARDWPSFDRIVSSLQNLGDDETLLVQSGKPVGIFRTHPDAPRVLIANSNLVGRWANWEHFHELEKKGLMMYGQMTAGSWIYIGTQGILQGTYETLAAAGRFHFGTDDLAGRLILSGGLGGMGGAQPLAATMNNAVFLGVEIDPTRARRRVETRYLDVVAKDLDEALALVKDAQEKRVGRSIAVIGNAASVFRELYRRGIKPDLVTDQTSAHDPLNGYIPTDLSLEAAAELRQRDPETYVRRARESMMMHVQAMNDFQKAGSHVFDYGNNLRGQAELGGMENAFEFPGFVPAYIRPLFCEGMGPFRWVALSGDPEDIRVTDRVVRELFPQKASLQRWLNMAEERVAFQGLPSRICWLGYGERAKAGLAFNELV

SEQ ID NO: 14098 - protein, 84 aa, Myxococcus xanthus
MQSWVDAEDVDIRVRDGVVLLAGVVRSQDERHATEALARDVLGVKEVINDIRIDREDGVVDRPASRSPVQTPGMDASDDDTLHS

SEQ ID NO: 14099 - protein, 1372 aa, Myxococcus xanthus
RELGALGPRPTYLRADAADEGALREAYRKIREQHSAIHGVVHSAIVLRDQSLAAMDEDRFRASLAAKVETSIHMARVFQQEPLDFIVFFSSINSFTKAPGQSNYAAGCTFVDALASHLAQTSRCAVKTLNWGYWGNVGIVATEEYRRRMEQFGIGSLAPAEAMKALETHLCSPLEQVGMLKTTRPAALAGVSTDDRLSVQRGPARASLVASATRGAAARAAGIAETKAAVGLEAERLAAVESLLVDLLAAQLHDMGPGVASSHRHWFTESMAILARRGYVAADGTRFLEGKVPDREQAWARWTQSSAEWRQVPTLRAVVGLLEPALRALPDIITGKRRTTDVMFPGGRMTLVEDLYKHNPVSDFFNQATSAAVADCVAERVRSAPSAGLRVLEIGAGTGSTTASVLAALAPYRTHVAEYCFTDVSKAFLLHAREAYGAAHPFMRFQLFDVSRPLAEQDLEQGAYDIVIASNVIHATTDVRESLRNAKAALAQGGVLALNELTANTLMAHLTFGLLDGWWAFADKASRLLGGPALSPSLWKRALEREGYRSVAFPVEDAHHLGQQIVLAESDGIVRQPRAARTKALAGRGEDARHTVAAPAVASPKSTGLSGGELRTVVRDCLAACVEMAPAAVANDRRFTEYGVDSIIAVKLINAIGQRLGLVLETTLLFDHGTVDELADALVARYGAQLQVSRPLAKKAAPAPQPEVPAALGLTPSAEAPLVCRVLLERPGQADDIKRIMNTAQPLEDREVRVAVRAFSLNFGDLLCIKGLYPTMPPYPFTPGFEASGVVVEIGAAVRSLKPGDAVVAGMGEMLGAHATSIVCSESRVFLKPANLSFEEACALPAVSLTMIDAFKKADLQPGERILIQTATGGTGLIAVQLAQLQGAEIFATAGSAEKLEYLKRLGVHHCINYLEEDFEAAVKQLTHGEGVDVVINTLSGTAIQKGVRCLRPGGRYIELAMTALKSEKSFDLSVLNDNQTFFSLDLRKLASSRPDVIARHQHEFVRLVEEGKLRATIHRTFPFSDVQSAYKALEDRKNIGKIVVTIDSPHLDTQDVSAPAAVGRSTEPLDLGAFTRFQELVRLNGSTEGRPIFWFHASMAGVEVYRALSQEIRRPFLGIQARGWMSQEAPIAGIEAMASYYVDILLAAQPEGPYELGGYSLGGMLAYEVTRQLQERGARVASIVMLDAPDSTHLDVFQFSRRTATFQAVNTALFSSIAHHPERLEQTLIHRDEVEADLDDTALLRQLMGLAQSRGLSKDENQVRFMVEQNARVHAAYDVGRFRLKPLLRPEEVAVFYLRNGSCSFFGNLEPYLTLTPGELTFDGTNYWAEWERFLPRMQILEVASSNHLMLLAEPAVQRVIAGFCARFYGK

SEQ ID NO: 14100 - protein, 150 aa, Myxococcus xanthus
ASKMYSHQGYKFINCGYADMEGDHKAVDFNRPENVYVLWESLYQRVVGQAELSGREVLEVGCGRGGGSEYLMTRLKPRSLTAVDLSDVAIARCKENYRLDGLSFQVGNACALPFEDRRFDVVVNIESSHCYPSQLTFFEEVKRVLKPGGV

SEQ ID NO: 14101 - protein, 72 aa, Myxococcus xanthus
MEALTLSTDQKGTRILARTFFNQLRASGYTPHQVIGIATELLELVTADIKEGDKATAVQAAQEQAPERRPHA

SEQ ID NO: 14102 - protein, 122 aa, Myxococcus xanthus
MGYVVRTPEGELVYPSLLDVERAYVQGLVDAEDEVREETATTWRKAASIPVLARAKPARSGALQRGQVLRVAAVVLLSALALSLVFRDELRLRGIGIVLALVASSLLFQVTTKAFKRTPSGG

SEQ ID NO: 14103 - protein, 531 aa, Myxococcus xanthus
MAYRVNNIGLWLDEPEELLGQRAAEKLGVTRSDLASVRVVRSVLDARKKGSPRYIYTLEVELARGKKPAKLPPDVGETPPPPEALGPVKAPEQWPIIIGTGPAGLFAALGLLERGVRSILLERGREVVSRRKDVAKLMRDGTLDPESNMNFGEGGAGAYTDGKLSTRINHPMVRKVIEAFARYGAPDHILIEGKPHIGSDLLPGAVAKLREELIAGGCEVHFSTRVDDLLYKDGHIAGVKLSDGRTLESNRVILAPGNSARELYERFAADGRVIVEAKPFALGFRAEHPQTLINSIQYGNAAKNPRLPPADYKLAENLEVDGEVRGVFSFCMCPGGIVVPTPTQDGLQCTNGMSNSRRNARYANSGIVVSVSVADFEREGFRGPLAGLEFQRHWESKAYELGGGRFYAPAQTIPDYLAGRVKKDPGGTSYRPGLAHTDLNQLFPARLTESLKQALRTFERKMRGFISEEGKLIGIESRTSSPVRVTRGEDLQSVSMKGLYPAGEGCGYAGGIVSSAVDGLRVAEQIATELS

SEQ ID NO: 14104 - protein, 268 aa, Myxococcus xanthus
VLSSQQQREQCATQTDTKRVGRGIHRVGPYPFTTKGQSVPRVLASPALSPSMNAPPRPPSSFPPRHGSGLLASFGHAWAGLIHTVIYQRNMRVHLIAAVLVGLVGSGIPLGLAEKVTLIFCVLLIFFAEILNSALEHLVDLAVQQFDEKARLAKDAAAAGVLVLALGTVVIFAAILVHNWDTVRTSTDAIIRQVALGLPLTACILVLVLPQRRPAWVDVAAFTAGGVLMALQATQTASSVFSALTAGLLFVAGAAAYQRRREQRAPRA

SEQ ID NO: 14105 - protein, 391 aa, Myxococcus xanthus
MTGLSPAAAPDFVQLRSFHAAGEPAATSPVSSVGTPCATATQPQTCLSELEALAPARGFRDACGFICTDYFLATTRGDVVSAISSLEALKSFLGPIDTAQEAALTAFAAGYAVRCGGLKYGAVKELGDGAFGVVGTKGMACGKGTELTQYALRVSSTGEVVEEERNVLERGADNCSVGRRPGGLRSQGAVACDDVLGQHFAAIAHLEAASIQAFLLLREELAAHGADLALQDAALMSALEEVMHTEVSARLAGRHGATPQAPRVDAAAPRSLFAVALDNAVEGCVRETFGALVARHQSLHAQDAEVRASMARIAEDETRHAELSWKIDAWAQARLSEGEREVLRLAKQRAAAALREEACVPVNPVLVSEAGLPPPEVAVAMVDTLAQELWA

SEQ ID NO: 14106 - protein, 504 aa, Myxococcus xanthus
MSTGSILGIDFGTTNTAAAFFDKAGKLRVVPVTDKSVTLPSVVWFHAADKAIVGHAARRQIIDDPRHTVFGAKRFLGRRFQSEYVTQHKDKYAFGLVEAEDGYTAVTMYGKQTSLTDVAHLIIKQIHTLANHAAGTPFRECVLTVPAHASSRQRAAVRHAAEQAGLQVRAIINEPTAAALYYANLRNPEQTVMVFDLGGGTFDATLLAVQNKVVKVLATGGDAFLGGANFDERIVEMLVNDFQQKHGIDLRGNKVVMQRLVFAAESAKMALSQRDATVLRVPCIAQKDGGFIDFDYTLTRKRLEEMAFQLIERTASACDDVLERAKLKADQIDELVLVGGQTRMPAIRQRFSHFKRMSSDKEVNPELGVAVGAAILGRNLARGITGLADVVPMPISIMVPGGAQHEVIPANTPVPATKSVTMELPMIPGPLSIALFEALDTTTVDRELLGTVRVELDWRTTYKGPTTLELRMGQDFVLSAALVSPQGARHPLAISDMRAPKRSA

SEQ ID NO: 14107 - protein, 129 aa, Myxococcus xanthus
MVGKSAVGLTLIRVVFGLSLALGHGLPKLTGDMSKFAAGVAQLGFPFPTFFAWCATLAEFLGGLLVAVGLFTRPAAAMAGFTMAVALYRHRADPFGRMEMALLYLAVMAGIALIGAGPWSLDAKVRRRA

SEQ ID NO: 14108 - protein, 89 aa, Myxococcus xanthus
MTGIDRSSSSRSSQRESRVSGGDAARGLRNETNRREDARQPEQNKAKGYSVKDGWDSRPAHAAKQSQPAVEAQAVAAEDGVAAATEPES

SEQ ID NO: 14109 - protein, 102 aa, Myxococcus xanthus
MTLLPILVLAAGTYAFRLAGPLLSQRMQVSARVQGLLSLSAIALLTALVATATLTSNGGFSGWARPAGVLAGAVLAWRRLPFVVVVVGAAGVTALLRMAGVG

SEQ ID NO: 14110 - protein, 202 aa, Myxococcus xanthus
MSVFVFAGGSQFMAVGVVAGGGSPVAAVIAGLLLNARHLPFGLVISDVLGRHWLVRLIGTHLMVDESVAFALAQSTPERRKAAYWLCGGALFVAWNVGVLVGALAGTALGSPEAMGLDAAFPAGLLALLLPSLTAPAKPPNAEPGTAEGEVETARAHEARAAAARARWVAGGAALIALATTPILPTGVPVLLSLLALGLVLR

SEQ ID NO: 14111 - protein, 46 aa, Myxococcus xanthus
PDPQESWVLLPLLVPCAEKALNVYQVSRVVNSPANDTPECVERVPA

SEQ ID NO: 14112 - protein, 623 aa, Myxococcus xanthus
MRGQTADVTALRVRESQLNLISRMMHEKLNRCGGFIYHDTEAAALTALDPSVAAKAAKATAVTYSLDNASTVNALQAGVQELAIRWVIDHLSSYATRYYTSTTGVASANWLKGHWESLVPPARSDVTVELFNHASWAQPSVILTITGTTLSEEVVVLGGHLDSTSNGSTAPGADDDASGIATLTEVIRVAMLQNYRPERTVKFMAYAAEEVGLRGSSAIATKYAADAVDVVGVLQLDMTNYNLRSNIDVALVSDRTNAAQNTFVTNLIDTYQPELEWTTTTCGYACSDHASWTSAGFAASMPFEAPLSASNPYIHTVNDTLHNSGGDARHALKFAKLAAAYVAELAKGGVTIDETPPEVAITAPAAGSTVAGVTTVTVSATDASGVNRVEFFVDGELKATDTTAPYAFDWDTAAVPNGSHIVTARAVDLVGVAATSAGVSVTVSNATSTAGFDSVLRAPRCASASNACDSGTLLNGRGGFVGPEVNAPNTIKNSCRDGLSGAHLVDQSNERIVVSTLDGTNFAPGKLVRVDATVFAYNKLNDKLDLFYAADANNPVWQLITTMPVPSKGLHTLSATYTLPEGDAAQAVRAVFRNRGSTAPCVEGNYNDHDDLIFAAQPSALLR

SEQ ID NO: 14113 - protein, 100 aa, Myxococcus xanthus
MRTRSPQASAVLRELLAAIDNAEAPDMRVAPTAVGDVFAGSAGGLGHGEVPRLALTPEAVQAVIDRELQERRDAVALYEKLGKQDEASAVKAQLDVLLAL

SEQ ID NO: 14114 - protein, 149 aa, Myxococcus xanthus
KFARGAFALLAGGVVAVGGGGCAHAPPRVSPELSARLESEPGTWVSGSASGLGRKAVLNNKDFIWGLAFAPQGARVAYSRLGSKSYFLSVWELGSAEPTMLADPAINPYEFDVEGVAFSPDGTRVATAGKDSVVRLFHAATGALVGGAP

SEQ ID NO: 14115 - protein, 339 aa, Myxococcus xanthus
MSRQDGITELGSYVFRNMLTNAAQAEAIADYAMNVKGYKRFALLYPNIPYGVELADAFWDQVVARGGGVRGAERYSHDQTTFTTEAKKLVGRYYLDDRGDYIEGVRDVQGENLDAFRRRKAMEKVKSGVEPIIDFDAIFMPDDWRRVSLVAPALAVEDIVTNACDPRDLERIRKTTGKKELKTVTLFGANQWSSPKGRSGLPELVERGGKFVTCSVFVDGFFVDSQRPATRRFVEQYREAYRAETGRDPGLLEAIGYDSGRMLRQLMEQKDAPRTRAQMRDAMANLKDFDGATGRTSFNAKREAVKQLFLLSIDNKGVTEINVEKERQKAASASGGSGT

SEQ ID NO: 14116 - protein, 86 aa, Myxococcus xanthus
MRYITQIRLEGGALHEHIARLRWKEGNEVGEGSRLELVQWLKAGGDARVQTWPRDVKVEVIDARPPYLRTKANGILTDNLLELPRF

SEQ ID NO: 14117 - protein, 364 aa, Myxococcus xanthus
MDVLPTLRRSLVIALALLLTACPRSTRTPSGGDTGGDLPSGDPFPTRPSVEAKKDPTADAALAQASQTARATPDKKKAAEAYLSVRKAYPATTAGQDALYQAGVLFFESKDFVNARKSFNELLFENPLHSRADDAKHKLAVSAMEVGAYRDAYQTLSSLAERASGAERTQLLNEAARAAEGAGLYGQALQIAVDEAGQAQGAQAQAAAVAKVEALVEGRAGFVDIARVAEGLSPSNPAWPVITFKLARVYYHLRDWTRLEETLNRFLAQAPGHAFAPQARELLARATRRVEARPRTVGVLLPMTGPLPAHWRGGAARHPAGAGRQRRGAGGEGHAGRRQQDGPGHGATGLRRRRHRRVGAPAGG

SEQ ID NO: 14118 - protein, 209 aa, Myxococcus xanthus
PCSASAGSGELRYTQGFFAVSRPCGDCGGTGAVVPDPCTRCKGSGKVPSEEVIEVAIPGGVDNGTRVRLSGMGEPGDRGGPPGDLYVTVIVKEHPLFQREEYEVFCEVPISFTQAALGAKIDVPTLDGKVKMTVPNGTQSGKVFRLKGKGIPHLHSQQRGDQHVRVVVETPTELSSKQRELLEKFAEASGEESHPQSKSFIAKVKELFG

SEQ ID NO: 14119 - protein, 263 aa, Myxococcus xanthus
YVSVLTGGTDCNDNNASIHPAATELCNDVDDNCNGQSDTVELRLGQSCTEGEGCEGVRACGGNGEVLCDMPLAVYAYPDVDQDRHGDRKAAPVAFCTGIPQGYVTGPADDCNDNNASIRPGATELCNGVDDNCNDQIDETFPDLGTACTAAAQCAGVYVCDASGIATTCQPTMFPNNWYLDGDGDGFGVGTAVSSCVPPGTDYATTGGDCNDGNPFTYPGAPELCDALDNNCDGNVEGPEVCPSGGASWAARSVGASDQEGFR

SEQ ID NO: 14120 - protein, 437 aa, Myxococcus xanthus
MEPIVILGAGLAGLSTAHFLNKPWRLIEKSDRVGGLIKTEVIQGCYFDPTGHWLHLRDPEIQALVNTLWLPEQMVRIQRKAGIFTRGVFTRFPYQVNTHGLPPEVVAENLTGYVEAVYGEKGRELREREPRNFEEFILRYMGEGFAKNFMVPYNQKLWTVHPREMSAAWVGRFVPRPNLKEVVDGALGAGSDAVGYNASFLYPREGGIESLARAMLSHLKGGQLSTHTEPTAIDWKARKVTLSDGSVQPYAGLVSSISLPGLVKLLAKGEAGVPDAVQDAAKQLRATTVTYVAVGAKGANRQPWHWIYLPEPEFHTYRIGSPSAVYAPLAPPDTSTFYVEYSHHGELSLAAAEKYAVEDLVRSQMIHAADDVLFAQAREIPHAYVLYDDAYGPAKSEILRFLEHTGIQIAGRYGQWEYSSMEDAILAGRACARILNG

SEQ ID NO: 14121 - protein, 236 aa, Myxococcus xanthus
MAPHLTVVIPVYNEESIIASAAEELRQGLDARGLDYEIIFAENGSRDATPVILEELCASNPRLRWFHSETPNYGVALKAGILKARGTYVICDEIDLCDLTFYDAALPRLERGEADMVVGSKAAKGASDQRPLIRRAATRVHNKLLKVALGFQGTDTHGLKAFRREALLPVIQKCVVDMDVFASEFVIRAWREGLRVMEIPIQLHEKRQPSIHLFKRVPNVLKNVGKLFYVIRVRGT

SEQ ID NO: 14122 - protein, 149 aa, Myxococcus xanthus
MGALSVLGRPSRSVLDTPRVLLAPRVPYRPDPAQPYRRGSGTVLELPMTVTPALRFPLIGTFATTLPRASLHALWRTCRRDTFFNFELHGVDVLDASDGIPPELVRQQRDLRVSATQKMARLREVFGWLKSEREVLTLRDVAGRLSASV

SEQ ID NO: 14123 - protein, 249 aa, Myxococcus xanthus
  unsure (1)..(249): unsure at all Xaa locations
LENVTDRVKKGLREWTDRLANTEQKQRLHGLSRPGNEYGVDPFGFDLDYSLSAVAPLLWLYRNYFRVETFGIENVPAGRVLLVSNHSGQLPMDGAMIGVAMMLDASPSRVIRSMVEKWVSSLPYVSTFMARVGQIVGTPENCRRLLESEEAILVFPEGTRGINKLWPQRYQLQEFGLGFMRLALETNTPIVPVAVIGAEEQAPALMDLKPVAKLLGFPSFPITPTGLPIPLPTKYRIYFXEPLHFSGRP

SEQ ID NO: 14124 - protein, 359 aa, Myxococcus xanthus
MGCGIALRLRQAGVRVVVLERSIPGAEASSAAAGMLAPQMESDGPGAFLELCLRSRGLYPAFAAELRELSGVDVAYRPCGILKVAFNEASLHHLDATVAWQRGMGLRAELLDGAAARALEPRLSAKAVGAAHFPDDHQLDNRLLVRALTMAAARLGAEFRSGYVRGVVQEGGRAVGVDLDGELLRADAVVLAAGSWSALVHGAGVEARAVRPARGQMVQFQTRLPLLDRIVTSEKGYLVPRADGRVIAGSTMELVGFDKQVTAAGLARILDMALELCPELGSAPVTETWAGFRPWTEDKRPYLGEGPVPGLFLATGHFRNGILLAPITAKLVAQAVLGERPAVDLAPFRYDRSPAQPRT

SEQ ID NO: 14125 - protein, 369 aa, Myxococcus xanthus
MALDLAGEEETPLVISDMKMPGKDGLWLLENLRERLPDTSVIMLTGYGDTESAVDCLRRGAVDYLLKPPKLTDLIRAIERALAERRIEMARKRYQKKLERKVRDRTAELFFFLRDIANTNHNTLLVPRVVLDGREHETSDHSQRVVSYTSAIAQDQGGLVQVLQEIALGLQLHHIRKIGEPDAALLKPSKLTPDEWVEMRKHPDIGFQMIQAIPFLDTPASIVLSHQERWDGAGYPRNLQRHEIHIGARIFAVADTLDAMTSDRPYRKGTTFTNAIQEIKRCANTQFDPEVVRAFLDIGEEGLIRIKQEMATKKLQLPQAEQDAHDAEAELARLTDLDDDVDAAVPGHSASDEDEPKSAVVRSVAGNKG

SEQ ID NO: 14126 - protein, 204 aa, Myxococcus xanthus
MTYLRLSITDRCNFRCSYCSPASWGGKRDLLGPEELERITSVFARMGIRRVRLTGGEPLIRPDILDIARRIAAVPGIQHLAITSNASHLERLARPLREAGVTQLNLSLDTLLAETFRRISKQGDFDAVLRGVDAAAGAGYASLKLNVVVMRGVNDEEASALIAYAHARGFTPRFIELMPFGQGTPVPTPELVDRLEASGLPLDL

SEQ ID NO: 14127 - protein, 35 aa, Myxococcus xanthus
MEAVLRTLTDPEDQAAVIFSARATRCIYPGIFRER

SEQ ID NO: 14128 - protein, 286 aa, Myxococcus xanthus
MLLKIALPNKGRLSDEVRELFNDAGLEVRARGERALTASLGGEFEAIFVRAQDIPEFVADGAAHAGVTGWDLVCESGRELDLLMDLEFGRCRLVVAAREEGGFASPEDVKEGMRVASCFPRLTQEFFARRGQRVAVVPVSGAAEIAPHLGIADIVVDLTSTGSTLKMNGLREVGTVLESSARLVACKGNPVDTQQKLDELKQALGSVLAARDKRYLMANVPKDSLIRVREVLPGLNGPTVVDVLDGGDFVAVHAVVPAKTIYRTINALKALGCEGILVTRIERLMA

SEQ ID NO: 14129 - protein, 30 aa, Myxococcus xanthus
PVEDMGAAAQARAKKGDTAGAAACARAALA

SEQ ID NO: 14130 - protein, 44 aa, Myxococcus xanthus
MTLLPGDIVSTGTPSGVGKLSAGDTVEVELEGIGTLVNPVEMEP

SEQ ID NO: 14131 - protein, 271 aa, Myxococcus xanthus
MIRTVITGITGRMGSTLLRLALDSGDLRVVGGTARPGSASVGQDAGVATRLGPVDVTVVDSLERALDAAQADVVIDFTSAELSVAHAKVCAARGVALVVGSTGFTPEASAALAESAKAVPIVAAPNMSVGVNLVIRMAAELARVLGPGFDVEVLEAHHRMKKDAPSGTALRLAEVLTEALGRTQEDLTFARHGQIGARPAREIGVQTLRGGDVVGEHTVYFLGEGERIELTHRATNRDQFAAGALRAARWVAGRAPGLHDMADVLGFQRTS

SEQ ID NO: 14132 - protein, 81 aa, Myxococcus xanthus
MMADLVAAARAGNIAVARDLQVRMNELHRLLFIESNPTPVKWGLHVMGLFGPEVRLPLVQMTEPNAAKLRDTLRQLGLLTG

SEQ ID NO: 14133 - protein, 404 aa, Myxococcus xanthus
VPHAADVPLAAIAESVGTPIYVYSTATLTRHIRVVTEAFGDRPHLICYSVKANSNLAILRLIAERGGGFDIVSGGELARVRHVGGDAGKTVFAGVGKTHEEMEAALAAGILLFNVESAEELEALDAVGRRLGRRAPFALRVNPDVDARTHRYISTGLKTSKFGVPFEEAVALYARAKKMKGLLAAGLDCHIGSQLTQTAPIRAALSKVAGLYSALKEKGHPLAYLDVGGGLGITYLDETPPSPEEYARTVLAAAGATGATLILEPGRALVGNAGVLLTRVLYRKKTPARHFVVVDAGMNDLLRPALYEAHHGLQPLVKRRGKAVEVDVVGPVCESTDVLAKARPLVLPQAGELFAFMSAGAYGMSMSSTYNSRPRPAEVLVDGAAWRVVRERERVEDLWRGERA

SEQ ID NO: 14134 - protein, 95 aa, Myxococcus xanthus
CSKDGKLRLVTGHESDRCFFAETDTGTGIEEKHLPLIFEPSFTTKAPGEGTGLGLSIAYRIVQDHGGSFHVDTEVGEGSCFTVFLPIPLQLERLP

SEQ ID NO: 14135 - protein, 420 aa, Myxococcus xanthus
MDLLRGIKADRPDVEVIMMTAFATVETAVEAVKAGAYDYLTKPFENIDEVSLTVAKAAERKALKDRTRALEEALTVRSQFEDLIGQSTQMRSVFKLVETVSHSTATVLIQGESGTGKELVARAIHYRSARKDKPFVAVNCSALTETLLESELFGHVKGSFTGATGNKKGLFEAADGGTIFLDEIGDVPPATQVRLLRVLQEGEVKRVGANEPVKVDVRVIAATHVDLSRAKEQGKFREDLFYRLNVITIDLPPLRDRPEDVPLLAHHFLKLYASKADKKVTGISPRAMEALTCNRWTGNVRELENVIERAVVLTGNEVIDVEDLPPGFQSAPQPDSTVEVFSLAHLPYAQAKRLAMRAFERRYLSALLEKNNQNVSSAARAAGVDRSNFRRLLKQYEVAGRSMKPRVVSQDHGEALEAAS

SEQ ID NO: 14136 - protein, 224 aa, Myxococcus xanthus
MVVLGGDGTLIYAARLLGGRGVPILGVNLGSLGFMTEVPVEELYPMLEQVLAGRFQVDSRMKLSCRLLRGGRVLIEDEVLNDVVINKGALARIADHETSIDGVPITTYKSDGVILATPTGSTAYSLSAGGPIVHPSVDCTVLSPICSHALTQRSIVVPADRTIRVTLRSETADTYLTIDGQTGHGLQGGDCIEVVRSHNRVNLVRNPKVAYFSILRQKLHWGER

SEQ ID NO: 14137 - protein, 70 aa, Myxococcus xanthus
RAAEAGAVRSFQPGATYDAVIVLGGALDPAATERTGVPEYNAAAERVKRGFELLHEGRARRVLLSGGLLV

SEQ ID NO: 14138 - protein, 233 aa, Myxococcus xanthus
MPPSRREVSCFDTLDTTVHLVVYADAAPVATLRLLLPNPEVADAIGGRLGLELEQKLDLSEVVRPGMVVAETSRFCVLDGWRHSEAVTRLHAGIYEESRRRGVTHWLASANLDTDSREDAMLSCQVAAYRGWMSQRWRVDVPEPVDAPVIPSNPYYTPMERLRAEQGLLDGLRVPRAPTLFARKMGARFISEPLYDASFRRFTLPLIAALDEVPASTLARFNALAQHPLRRAA

SEQ ID NO: 14139 - protein, 268 aa, Myxococcus xanthus
EVRQRVSRSERVLVTTLTKRMAEDLTEYFSDVGVRVRYLHSDIDAIERMAIIRDLRKGEFDVLVGINLLREGLDIPEVSLVAILDADKEGFLRSHVSLIQTIGRAARNVSGRVIMYADNVTDSMKKALEETTRRRDIQRAYNQEHGITPRSVKSNITDLSEHAAYDAGDVGALPMAAEGEDDVLQPKEIKRLIEEFTKDMLAAADEMQFEKAAEYRDRVQLLKDMDLGLKPASRSLLRAPAKAAEAEAPKKGKGRGGGGRSARARSRK

SEQ ID NO: 14140 - protein, 646 aa, Myxococcus xanthus
MDAKLLEKLDALPPEPGVYLMKDRRGQVIYVGKAINLRSRVRSYFNRTGDTRVFVSLLDQLLGDLETVLVSNEKEALLLENELIKKHRPRFNVLLKDDKQFISLRLDRTQPYPRLEVVRKYERDGARYFGPYSSAGAIRETLRVVNRFFRLRTCTDHVLANRKRPCLLHQIGRCPAPCVYPVPQEDYHRSVDEVVMFLEGKAGELVEGLRLRMKRAAQELKFEEAARIRDQLNAIERSLERQKVATTDFKDQDVFAFHREGDRILFYVLWVRQGRLNGGQAFPFGSQEFPDEELIASFVNLYYDQGSFVPEEVLLPLELEDGTGGLEALLTERKGERVRVLVPKRGEKLDLVKMAAKNAEQAFVERRRTKDETDTVLSRLQQRLGLRNFPCRMECFDISHFQGSAIVASQVAVTDGDADKSRYRKYKIKTLEKQDDFASMYEVISRRLKKGLEDNDLPDLLVIDGGKGQLASAHAAMKDVGVESVDVVGLAKSRDLEVFDRDAESARSPERIFVVGRKDPIVLSQNSAEMFMLTRMRDEAHRFAITFQKQVLRKSRVRSALEDIPGVGETRRKQLLRHFGSLKRVGDASIEELAEVVGPAMAERVHAGLHGHPEEDAEDPVREASLDDAHEPVDEKTQGGSPPGAA

SEQ ID NO: 14141 - protein, 172 aa, Myxococcus xanthus
MRLYPKVIPIISREAVQQLMQDGDIEVEPMRVADAEMDLSAIMREYLANEERVNQATREALERRGYDYSKFNQVKREMADVRGFKMGDEGIEYVINQMIEFLLISRNVEEVYSADNGLRQKIFAVMKRHLDVDDEIDKEARSRLKHLQEGTSAFDIEYNKTVEQIRRARGLI

SEQ ID NO: 14142 - protein, 291 aa, Myxococcus xanthus
AGPFTTFVLSGLLAAAPGGFTFEGREASARTEQPDGFFIQGSLPFTDLAESGTGSASLTVEDRVSLPGATFGDKGTLEASFRLGATEYRVELMRPGFPPEQGKGGSGPPPRPPQHAIGGGVLLDVPLYGDSGLGWTAMTRTHAAVAVWGVGSVWRNGQLLTDTAFVHAAALAAGAYADDDTHRLLRQARYDDTELVVLVWNLPPQLEPRGFIQFVFEDVAIDVGGTAVRSRPFVENTGNPPLSWRSLTPVPPSAVVGAPVTASPPPAPSAIGGGGTAGALQDTGAVTRVTV

SEQ ID NO: 14143 - protein, 30 aa, Myxococcus xanthus
SYRGTFKNVSFDRLPDATDGAEFDYHRLIP

SEQ ID NO: 14144 - protein, 319 aa, Myxococcus xanthus
ELTLSGCAAPTFESASATSLTELVLSFSRNISAASITNAPEQFTLTESLTVSAFRVEGKQVFLTTSEQTPGTNYSVTVANTVTDLAGGVVAAEGSTQAFRGFRTPAVLRLTEVQPNAASHQDLVELQVITAGTTNNITVEMDVTTARLLARLPDVDVAAGDIIVVHINAPATVKAETTSKDQFPTSTAAGNYDTAWDFVGESKGTDSAITYSSRVILVKDAAGAIQDAVPFRAAGTPPGAFPGNLQAMQAAGQWSPVDCNGAPCTNTSTPSAGDVSASWAGIPNNADATSNSVRRISATDTNMKEDWAVGAPSWGVPNL

SEQ ID NO: 14145 - protein, 439 aa, Myxococcus xanthus
MVIAQEAGEIDKGLAAGERFLKEYPRSPFELKARYSLAGLYEKVAEYRKAAVMAESLVASYDAAMKADDANGKRKATKAAAKVSVAPGAEDAESKRERVAAERKALLEEAGGWMADAQFNAGVWWEGAGEPQKAVAAYNTYVSRFKDRKDVPQVAFAAALAWEKEKKWSEAARAFGAFAETYGRDSRSSSAQVYQARYHELLAYEHLRNAREQERVQGELVRAWNRLPESARKDAAVLNAYGHARFLSLEPAWKRYVGIRFSRVSTIRRDLAAKQKEIQRLEKEYLAVLSTGSGDWGIAALTRIGLAYADFARNIMDSPDPSGLDEEQLAMYRSELENLALPLEDKAAEALEKALEKAYELGVYSPWTLAAQDQVNRLRPGAYAQVRQVDYRGSDTLVRSDLVRVLEGATATTPAPADSSKPSDDEAQAPTAARGEVLR

SEQ ID NO: 14146 - protein, 499 aa, Myxococcus xanthus
KLFRIDSFQVGAGKTQMTWFRSLLVGSLAFTAACASGPQKKQTAAPEVTPPAAQQPAPEQKPVPPPAQKSGSAQSAFAAALQSYEAGDLDGARKGFEAVVDELPQSLNAQFNLGVIAERQGRPDDARVAYEKVLLLDPAHVPAVVNLGVMYRAQGRLDEAIALFQRALKTPGREYDASLLNSLSITYRVAGKLDESEAAARRVLVRNKDDPGAYKNLAHVAYAREKYRLAELLAGTARKHSENDPALYNLLGMVYLKLDDRARALVQFQKAISLDAKFTPGYLNLGALALSYRDYVGAERSFGKAVELEPGSPDATLYLAWALDGQKGRDPKKGLAAGEAFEKVLATRADLPEAVCGAGWAYASDRAGWQKAIAFLDRCKGLETTTDNDKQMITAKVQGLQNMLKAPPPEAAPATAEGEGDGAPADEAIGGGGAQPAGGAEGVAPGQGSDVAPEGDATGGAGAHPGQGTDAMPADDATGGVGSGAPLAPGGKGTPAGKY

SEQ ID NO: 14147 - protein, 154 aa, Myxococcus xanthus
MTGDERPYGYVSRKQVKQLIGDTLEQDLPVKHVVDELQLTYEPFVLIPDLARRRNCERDWRELLGDRVICLEAPTDTVEVAAGLVGLYEGAFSDLDALAWHLKKQDLSRQRLGAVIRALTPFAATLGRDGIPRPELEDEHLPTNDDNSGYRRLR

SEQ ID NO: 14148 - protein, 249 aa, Myxococcus xanthus
MVHADPVLPKTCFHNELGYTKTFLDVTESIATGLTSTAREQPVAPYYSDVQVMRLGDVPLGFQYTALFGAKAGGSILEVSTTMVRPGAPAQLQFQDTNITEQADISGVLVAKSYSKRVNDTVAANVRLRREQNGSYGVSGQVAAKEVQAQFGGELIGEVGLAARLREGLLKGQGDALEALLWVPPADASAPTKMVIRPREEAGARAATMELGPMSVKVELDAHGFPQRTEIPSGSATVVQERLSQTGEP

SEQ ID NO: 14149 - protein, 40 aa, Myxococcus xanthus
MTDHPSLPAGSEGYALRFLHTSAESVSWLAAGDLVAALKA

SEQ ID NO: 14150 - protein, 102 aa, Myxococcus xanthus
MSPSRTAHLVVELGFGDTSKGTLTDWLVRRHGAGLVVRFNGGAQAGHNVITDDGPHHTFSQFGAGTFVPGVRTHLALTTLLHPLAMRVEVSSPLCQGSCRLG

SEQ ID NO: 14151 - protein, 118 aa, Myxococcus xanthus
MTPPPEEKKPAGPKKWTPEEKLRVLVAAQGLEGEELGALLRREGLHEVQLKEWRQAAAGALSGESTGPLTASQRRRLASSEKRVKELERELRRKEKALAETAALLVLEKKLQAMGWDL

SEQ ID NO: 14152 - protein, 510 aa, Myxococcus xanthus
SCADSAEVDGTVEGARGVRVQRAGLVEQVEQLDLRPGDMGADPTSLAVLNGTVYFAARQDSTGVELWKSDGTETGTVLVKDLAPGTSTSNPRSFLLVNDTVVFVAHGVWKTDGTPEGTVQLFAGTPQGGAGENLLVPMNGAAYFVASGNNGREALWRSDGTVAGTVAVTSLGSWTSSPWLTAVGQRLYFNVYDDATGLELWTSDGTAAGTVRVRDIHPGSGSSAPRNLIGVNGTLYFTANDGANGEELWRSDGTAAGTYCLKDLFTAPHSSSKPEFLTDVNGTLFFVFTINLNTKALWKSDGTTEGTVKVADISGVIMSPFFTAVGSTLYFATSGGSPLANYRLFKSDGTSEGTVPVLGFNGSSAWPVIANLTDVEGTLHFVFNGLQGSELWKTDGTEAGSVRITTFVPAPRDAMISSIVFDAGTLYFSANDGVHGSELWKSDGTAEGTALVRNIQTRGVSSEPRSLTDVDGTLFLLATNGRDGLQLWKSNGTMEGTGRVKLMTFGTPGQ

SEQ ID NO: 14153 - protein, 370 aa, Myxococcus xanthus
MILMFSMYLTELVRAKLKLQEAARYAVWEMTSYALSDFANGKHDDAFEDARREAHKEFVERYKDMDSVEPNGTGGNFIARYTDVTATISNKEIALLESGMLSRPSTSEGGGLAGAILSPLNNGMGWVLNQWGFNNKGWVESEVEMNYENVILPTRYLDKSGGNGGFFKENMMGGRDLGSLRLKSKYSMYANGWHMPDGGDAIVRGRRAGQHTGGSLSQPHGLYRQVDRMVFLGFASTLDSLGIGAILDVVASVLPNFLGTFVVSRNYGVGASQKGDCTGLAQYDAKASSGLHVMHKRSFELTDHERPNCFDTAPFRDEMTYANSNYIKVFNARGEFYMGCKRAMADDPTDPDARPEATENDEQDLKVPCE

SEQ ID NO: 14154 - protein, 671 aa, Myxococcus xanthus
MVLIMSIAVLTTVNIGHTVHERIRLQNTADSASYSMAAMEARAFNFYAYANRTQVSHYVSAMMWQSLLSLIYSAEAFLTDIYGFMRTLNPCAGKTNNLFWKIACPILENVIPYVSAVIKAIGRIMTAYRNYFLRPIQQVITRLNPDRIVGEWIIPAHRVMNGVMYFASQAVMMSASTHVTQTTQTVIDDNDSNISSLASQLATGLYSQCLFSQAHSPHAGGKPLAPNTWKNPFGALDVTKKAAKDPIARAKRSMGGITNATRYACDANGGACPQGFITSRRMGDLLPLPDMLSFMRDFFNGGVDIPGIFEFGKIGQTRMLSTGFPNANAIRAGRGPGQEGRNYIRDWNDNINPWGMTAQGDNIGSDDPYWLKFGPPEIDVGVGKADNPVSCTKNDDYWKCFGDNRKGKGNNNTTKLPYKHMTKTSIWALNDTDSGRHRGGMHWRVNYPSNPERWSGHMRPGGPERDVGLHRSKICVLELAFVCWARTDVFAANVRPVQDGHHRWGGLTPFMHFEPGQLGSVCNPTANASMDDAAKRQADFNQPTAWVALNKEPEQVVNRDNKDGTGTNAPALLNQEGKVKFAFTPDTDGLEMLNNRKKFLGLVEGLNVISRGQTYYHRPGNWAEQPNFFNPYWRPRLASVFQGRNSLPKIGEMMDALPGPLQGIAPKIMTH

SEQ ID NO: 14155 - protein, 301 aa, Myxococcus xanthus
MPLAVFMTLGIIQLTMMQHAKLMTEYPAYQAARAGIVWNGNNERMHDAAIVALLPTMGRTDDIVELGKTFVLHQLYDSGMRMLNFGGGRVPRTVNGSNLFGVIRVDTVSPAYFTPIDSMWKLRSGYNWQELDFDGADSFPEVPSLENHIRKFFNLPEPDDAELVFRKSTRLTIRLRYWYQLRVPFANSIIFYWWFTWNAGMALQGAIDRGTVDPRANMMNRRGNLNPLLAGARGIEHEMGYDSVYPLEMTVLWMLANGSIPIVSNLAGKRYFMPLTATYSMRMQSNFHRKWIMHLNPDWGL

SEQ ID NO: 14156 - protein, 164 aa, Myxococcus xanthus
MAKSNLGVLIFNLHLELMTQQHYLETVRGNNAETLDPLFCNLLKHHWLEEAQHTRLDFLEAQKILAREPDTLDEALTEYAELLQALRGTLNAQLALDLQTLEKAVGRTFTPEEHKHLAESQERSYVWGFIGMGMKAPLFLSRLRALSPIAEQRILELAPTYYCD

SEQ ID NO: 14157 - protein, 27 aa, Myxococcus xanthus
  unsure (1)..(27): unsure at all Xaa locations
ATPHVAGAGXLYLEMHPTVTPAQVMDA

SEQ ID NO: 14158 - protein, 114 aa, Myxococcus xanthus
SRGEYRLGFTGHYEKEPLVLVSGGEQQGVIVSNRVTVHLSGAYAITDWLELGAQVPIVSQWGPDTAALGVATPSTSALGTPWVQARAGILSEQRGGLMDLEPAPRRGPAHWQQL

SEQ ID NO: 14159 - protein, 313 aa, Myxococcus xanthus
MSFLQQALVFLAAAVLAVPLSRRLGLGSVLGYLAAGAVIGPWGLKLISDVEHIFHVAELGVVLLLFVIGLELQPSRLWALRRSVFGLGGAQVLFTGALLASVGLLCSLTWGAAIVTGFGLSLSSTAFALQLLAERNRLTTPYGQLAFGILLFQDLAVVPLLALLPLLGDGGAPSPGPVWLLLLKDVGVLLAVVLSGRYLVRPVFRAVAATHSQELFTATALLLVVGTASVVNAVGLSMALGAFLAGVLLADSEYRHELEADLAPFKGLLMGLFFISVGMSVNLSLILQKPLLVFGLVLGLVALKGAVLYGLGL

SEQ ID NO: 14160 - protein, 34 aa, Myxococcus xanthus
MVASLVHFTWCGNVLRENAFYDPADVHSATTRFL

SEQ ID NO: 14161 - protein, 63 aa, Myxococcus xanthus
MYGAMGAHNHSQANQFTTDCLAYLAAIGCTNVTATGSFASNQAEPLHGKEMRWDVLLSKWVKA

SEQ ID NO: 14162 - protein, 441 aa, Myxococcus xanthus
MELELAARAEVEQAERRRSFLYQAMTTLFTHPPDPQGMYTLLAHLAVPDVADWCLVDALEQGPWVTRVAAACLDPTQQERSGALPTRTELRDDAAVGLLRVLRTGEPELVPAVTDSLLRAAAAEPAHPALLRLLQARSYMIVPLRARGHTLGAVTFVSSGSGRRYGPDDLALAEDLCLRASLAIDNARLVGESRRAARAREDLLAVVSHDLKNPLGVVHLGAALLLRGAGAKPGGESVAKQATRIQDATERMSRLISDLLDWGRLEPGDLLLEWGEHGVVGLLTEALDSIRPLAEAKRLRLSVEFPAAGVRVRCDKVRVLQVLGNLLGNAVKFTTAGGDLMLGARARGGEVSVHVRDTGSGITPDALPHIFDRYWQARDAASRGTGLGLAIAKGLVEAHGGGIQAESTLGEGSVFTFTLPSAGASASHAVHPPLARRATDA

SEQ ID NO: 14163 - protein, 353 aa, Myxococcus xanthus
MKNDPLRILVAEDSPTARRLLVEIVRADPALTVVGEARDGVEAVELAQRLRPSLVTMDIQMPRMDGLEATRRIMTEVPTPVVVVSTLVERDIQTSMAALRAGALAVLQKPLGPESPDFDADSRRLRDTLKAMAEVKVVRRWPDRTAPPAPVPTPPAPPVSPTRPGVVALAASTGGPAALFRLLSELPASFPVPLLVVQHIAIGFSEGLAQWLRTAGPLPVKVAEDGEPLLPGHVYLAPDDRHLGVRGEGRAEVSRAAPVNGFRPSATWMFRSVARAYGPASLAVILTGMGQDGLEGVRELHGAGGRILAQDEQSSVVYGMPGVVVGANLAHEVVALPDLASRLTSVFRGSGGV

SEQ ID NO: 14164 - protein, 231 aa, Myxococcus xanthus
PAWASGDALVPLASLAEVLGLPPGPPRARRGAVVLAAGSARAVVVVDEVLAEQEALVRSLGHRVRRARHVSAAAVLPDGRLSLLLNPVSLVRAAGGRPAASLFPAPATQRTRRRVVLADDSPTTRALEQSILESAGYEVVACVDGADAWERLQSGGADALVLDVEMPRMDGFALTEAVRASPRFSRLPVVLVTARGKPEDKARGLQAGASAYLVKSAFDPTSLLETLRRLL

SEQ ID NO: 14165 - protein, 169 aa, Myxococcus xanthus
KARHPGARVLLMSPRGPTFTQATARELVRHEAGLILVCGRYEGVDERVMAHLDGELSLGDFVLTGGELAAMTVVDAVARLVPGVLGNVDSSVTESFEEGLLEHPQYTRPPVFRGVEVPAALQSGDHARIARWRRWKSLVLTHERRPDLYARVVLSKADQKLLARREEEL

SEQ ID NO: 14166 - protein, 127 aa, Myxococcus xanthus
MRNAAIQHIEAKFLRQDVTVFNTGDSVRVHWKVKEGEKERVQAFEGIVIRKTKGNHRATFTVRKLSFGVGVERVFPLHSPRYEKIEVLSRGDVNRKRLFYLRALKGKAARVDVIEEPKPSKKAASAS

SEQ ID NO: 14167 - protein, 341 aa, Myxococcus xanthus
MGFWAGLGAGVLFLALAVGLGFGVDRTFRYLALLDIPAFGVAAFLALRYVDDLQKATRHGSKENRFDIREKKILEEYEAEAAPLRMAQKALDVEELDGIAPALERRELLAARVAELQDQLHTMESDPDYLAAAAQVQSLKAEAEALNDELTQKGTYVRDVREVEREMGRLKESIALAKAPPPPAAPGPDGSVPVETLEDPSPMLLSQAADVFTTDILSVQAMLKERCVQYLTALTDRRYQSIEWDREGKAFALASGRRVPVGELPAKDLDLYYLALRMTVVEKASARVKRPFLLEDVFTGMEEVKLPLIARMLKHLGTLTQVLHVTSHPGFAQMSDGPVNV

SEQ ID NO: 14168 - protein, 29 aa, Myxococcus xanthus
MFRFDVISVVGRGERATVDHIPGAFDAGM

SEQ ID NO: 14169 - protein, 151 aa, Myxococcus xanthus
AGTLYLVATPIGNLGDVTSRALETLRAVRFIACEDTRHSRVLLDHFGIGGKDLVSLPAFAEGQRAGRILDRIGEGEDCALVTDAGSPAISDPGEKLVAEALERGLTVVPVPGPTALVAALSASGLPTGRFHFLGFLPRKGAERRAMLEEVV

SEQ ID NO: 14170 - protein, 40 aa, Myxococcus xanthus
MPAQKGNRSKKKVANRAKGRKAQLKRRRSRAKKGQSNNKV

SEQ ID NO: 14171 - protein, 178 aa, Myxococcus xanthus
AREKDNIALSDEHNTRGIELADRGWLDEAIKEFKKAIDLDPSSAHAHDNLATVYAEKKLFREALSEYLTALKLEPESATAHYNLACFLSTHAGEMAVEEYKEAIELDPEYPDAHLNLGLTYADQGRVEEAMRELQTAIELDSQDAFPRHELAALMMDEGDYRSAITQLKEVVRLEPDN

SEQ ID NO: 14172 - protein, 135 aa, Myxococcus xanthus
MIDVNIRGVLHGIAAGLPIMQAQRSGQFINLSSIGGHQVVPTAAVYCATKYAVIAISEGLRQEVGGDIRVTVISPGVTTSELADSISDPVAREGMREYRRVAIPPEAIARSIAFAIEQPDDVDVNEIIVRPTAQS

SEQ ID NO: 14173 - protein, 172 aa, Myxococcus xanthus
DKIVIKGGQALHGEVQASGAKNAALPILASALLADGTSTYRNVPALADVATMLKVLRTMGCDAERDSETTDVCRVGVNGHITPEAPYDLVKTMRASVLVLGPLVARFGRARVSMPGGCAIGARPIDQHLKGLKALGADIHLTEGYVEATAKQLKGGTVNFDVITVTGTENVM

SEQ ID NO: 14174 - protein, 293 aa, Myxococcus xanthus
MSSEPWTIRRVLTWTTQHFEKRQVDAPRLTAEILLSHVLKLSRVRLYVDLDRPLSKDELGAYRALIERRMAGEPTQYLTGVREFYNRPFKVDARVLIPRPETELLVEAALRMLPKDAPGRALDVCTGSGCIAISLAAERPQATVIATDLSPDACALARENAQALGVADRVTVLQGDLFTPVPAGERFQVVVSNPPYIASGEIPGLSAEVRREPTLALDGGPDGLVAVRRVVTGARQWLEPGGLLALEIGEDQGPAVLELLRAAGYADARVEKDLERRERMAFGTQPVASEPQG

SEQ ID NO: 14175 - protein, 233 aa, Myxococcus xanthus
MQMYLRYADRRGWKADILDMSPGNAGGVKDATVTLSGDAVFSSMKYESGVHRVQRVPATETQGRIHTSTITVSVMPEAEDVDVQVNPADIEMQVMRSTGSGGQSVNTTDSAVRLIHHPTGIVVKCQQEKSQLKNRTMAMRMLRAKLYDIEQERIRNERDSARRAQVGTGDRSEKIRTYNFPQDRLTDHRIGLTVHNLPGVMAGDVEDVITACRTFYQAEALKAQTAGGPKPSA

SEQ ID NO: 14176 - protein, 169 aa, Myxococcus xanthus
MEQMLREDIAAARAQADIVLPYFHWGREGTYTPEPYQVRLAHVAIDAGAAGVLGAHPHVLQAMELYQGRPVVYSLGNFVFGGNWNPRDKRGALWKGHFGPDGGYLSSEILPLRTDRFPELPFQPVPVTGEAAEAVLRLLAESSEGVERMLPELEPWARPPPSPEVRGRE

SEQ ID NO: 14177 - protein, 166 aa, Myxococcus xanthus
MDPLIQHMVDRFRAAGLFISSSPEALNSPIAEPMLTALDTETLTAYTVIFQKNQDNTVTLILGTSDVSKYTPGGSIQLDWAPVMAGAEQVTRSNLEGSQMAMYAVKATSAEVREFYQVELTRAGFVEDREQPGVFQRGTEQLTIRTQPEGDMLMVGLYRKLGVQPK

SEQ ID NO: 14178 - protein, 255 aa, Myxococcus xanthus
MRYRDFDSRTTTNSAGVITLALTRTDGMQVSCTQGGPTFDPHPVFTSVAYRDGGGISCTAQADLTAFRIPQRVAQRESGGFFQAEHYRMLPIRVCAMGRAQGGNCTGRLTSMLDDWGLTGSGESGSCPIIPDIPAPCPLNLPYWGMASSVYGVSLMVNAFGPDFSASRLAQTVVGGLPLPFFFGAENMFWMSAVGEEAFFGQPLPADSMGGLATMGFKGWPTSPGLLPPGLNWQAIPYPVSYGRRDSCFLGNECP

SEQ ID NO: 14179 - protein, 451 aa, Myxococcus xanthus
MLSTTTRQIAPRGCLTIAMLPYIALLPCCIPYSGCSSFCRCAIQGVRDITRSQNALSRYDRTEIAPQWDQLERPAAQRALRLSQAAQQMFVVGQVVQYGRMMLELNNQSAANDIIDSAGAGSRWAGELRVDGVSTTRREVAPYLGAVAWPNLINGHHVYAAMGSRGHSFVANRGIFPTDDWLVTAGIQRRLTTPDTVMIQGDGSTYWARTPLHGTYLGTTDTYSIADDHGLAFVTFARGRSPCPTQTFGIGVAESLLIASDSSDPRDRHRWSPRLGTGDLEPAQTRHNMGTCYGRNRMGCPSVWPMFVDYNGVKVMDKDDNWGQPKNFAVIQRDYAVRGTQADPWNLLFRFRFGGTDSGFDNSGLVLGPAGGGLNISRQTAVSTGLAYYHRREHWREPPNLLNPYWRATLVPATVDSSGAEDFVDELNGAGVGWAAEAYEALRAQGYRGGP

SEQ ID NO: 14180 - protein, 466 aa, Myxococcus xanthus
MKSAVDLQGNPLSDISLAAMRRWLLEADVLGYLPQIAATESEGRLWTYYGFGVRRIDAFVRANGYAALDDATLLTDDLDAIVALREFMAAAPPLIDGRRRLVEQLRAFAAERDALDQGRPLTAHELFSLWYLKAVPGAYMAQRLQLADVDEATVRRIAKLSAVGLQMFDDGVDLQADLDRGRLWLSAEELELLGLSMTPPATLATTAGERIIRLRKAICLEYFLAVYDEASRIASPESRKRAQSFAEAWLSFLQQDYLKLYTPGDPKPWDSVQRVLKALPGSETVKLPVLHSLFSLISALPLPPVDVEACRRELQQLGGCPRALAPEVALDAMGVCEAEGDAANFDVPGPEASVLERVLLASPSKHTAADFARRCRESTEGSPSNLRDPNLSEVFASGIKLAERSARNSVTARENFLQQLRPGSKRAPVVDAELAERFSRDGADWLALGIEALAATARGVRDVCRK

SEQ ID NO: 14181 - protein, 28 aa, Myxococcus xanthus
MNVMEKATVPAATTAMNLTCRRIYCSPY

SEQ ID NO: 14182 - protein, 308 aa, Myxococcus xanthus
MPVTGGITSLFHGTYEHSPVGVHLDRFTTFMFALRGRKRMRFWHKRPWSEDVSTILDYQPYLASSFVAEVEPGDILYWPSTYYHVGESAGAGVASSLNVGIPITEHHVIYSVDDLLRGMLDETSLADQEWKQTRLARVSASPLARGALSKNGVLATELPRALTEAVRAFRDVSHPKEARRHIQSTWLKRLTSGGFEPVPPPTREKPLRDSHHVRVDPSFPVLFERDSATRWICSANGHALRGAGGGRAIEIFFRKLNSGAAVSVEELLSPFGTRRAARHDSEVIAATREGMRGVLKKLHAVRAITLSA

SEQ ID NO: 14183 - protein, 246 aa, Myxococcus xanthus
MKRLLLCALSLAVVVGCSGAPPEQSIAQEGFKVLQHDATTLEATYGSGGAVVRMLAVETQANVVEVTYDFGDPVIGFHIDFNQGVGQFMPSGSPLDAAHSHLLASLMEGLARELPEEGRTRVEDAAERQTSFMQIVPVGEVLTAYEYVSERGWTHISCSCGRQYIGSGYYRTAGMGCGCTGGSGNGCKGRCGQGCGVTSLPRCVGTTAYTQDCAKHDYGLGSFAAASDDYSFARNNCSCSGVGSCS

SEQ ID NO: 14184 - protein, 317 aa, Myxococcus xanthus
QLHVEQPFMFDFALWSALRDFLRGLLERVGVPVLPMATDLLLGRFSRGPYGIAKRPHHSLVTLVLQGRLRVRLWKKLWGSPPNETEDFDRHLDKATTLEAGPGELLYSPSRYWQLEEAQGDCMAVRVWIPVKGSRPTDAAKDVLVGLLEARHAHDERVPYHPYPWRRPRRGAQATIPSVEQAADTLHALTREEDVQQVLRLIWARRVSACALEPVPPPDQAPPLSDPDRVRKTPTVDIIRMKDPSGLWIWAVNGHAFPGPNEALGQRLINALSSEAPPCVGELCKLARPGPQREASRATLAALLRLRGIHVITGAEA

SEQ ID NO: 14185 - protein, 98 aa, Myxococcus xanthus
PVAASRPVVRIPALLFSVAVVGGLIGFSWEHAVYRGSDSHQEWSPPELGTEVETSSRGWVRTPAEEAILQRALVHFPPYPNATRSEPLAADYLGPGAP

SEQ ID NO: 14186 - protein, 353 aa, Myxococcus xanthus
MLVIVPVFLYSLFLFDLLRHMLDSQETSLSTAWDYTVLDYEKEPESVATEDGGTTTEAFSGFEMAQAYSRYMYCDHESGIDSYGPGKGPECSANPDSEDHHTDVVAHACWLNPGARQVYCTLDAQAVGAYGVSLHQSFMDTFGRGGLIRCSARLGVQNYLLPESFLPEFSEVKLAKEKQERANGIHRNATGENLPEGHARGDNVYLLPWEQIAILTDTWALTEHADVRPGTAGGRGMHERVTQLYQNEDNSGFTDMSSASERLVNQAINSGLLHDSLRLESQSYRTPGDDPRNPSLAIKPDQSGDGAVEEIEQQGGRQGYFSNEWQDWGRNNNQRTYEARGNWYLGCARSESC

SEQ ID NO: 14187 - protein, 486 aa, Myxococcus xanthus
MVTLSFNLAHALRQKMGLQQHSDALAYSMAVLEARSLNYYAVSNRAIAASYVAMNSIHAYMVAASVTGSMMRASEANFKEFARREKIMCGCKGCYEHCLHAIEATKIATEFANAGREYDQKVRALESSFNAAIRGLDVMVDNLHASQREAHSQTLQAIQDGRSHGLSLLADYTAPDVGALPQAVGGLNANEFNCAVDGMNCRGSVENASPEALARVMTEISNATRSGWPAARKTAARGVAKPPYLHDDVIRDLRDIAQKKPYTVTSHEGTAKSVQDKGQVNDGGKKGGNQGTTVAAREEGAIRNTWEHQLTSTTDYEAEVWSDANGGDHTPGGAHSGSHNFEGINANALSGCARSGNCFMKFRANPSSGRDWGQPRVYSYLTRRLRVGDPSRAPWELNASAQIQLDHGAQGTATLTLAAQDGVALSKALVYYHRFGANGWREAPNLFSPYWRAKLHPISSDEAAEVLEAAGNTDASRLARVPGVSL

SEQ ID NO: 14188 - protein, 260 aa, Myxococcus xanthus
MGSIRERNQSGQAAVEAAIVLPLFVFLILGILQLGLMHQARLLTKYAAYKAVRAGSLNSAKVEEMEKAALAVLMPMLSVPGQKGAYIPPVGSAAEFQAKWRDVSGNQIPGTSLKHAQVTVCGPTRSDAGGGGPELDFDDPRNTAPTGWKESHRTKLRVQVTFNYRMIIPFADWVIYESTRGRELQKELRMYRKPTDPKNQGDKPDRTESLLEQAAAQKIYITPIRATYTMRMQSNFFLNRAALPGSNECVFPFSYKGKAP

SEQ ID NO: 14189 - protein, 320 aa, Myxococcus xanthus
SKDARLFQALRLRPTFGELMERTGFDTEVVLRRLYALCLLEVAGFVEDVDAKAARLSAGKGTAPAAPAPEPVAPPVAAPAPQGTPFSDEDEAARNALVSAFMSHRSKDPFALLDVPEDVQPVPLRKAFLALADRYAPLRFHTPELREKAEVLLAAHAKAFGALSDAEQNLLWRKRRAAHREKDRGTRPTTAEQFRIRTDLLDATTQFEEAKFRLAARNHAGAFEYFEYACDIDPKPLYQAYRAYARYLMKPEAHGRLAQQELQEVLRQEPTLEEGWAFLGEVAQGEGQWGQAEDAFRRAFKLNPKNRRYVELIQEIVRRR

SEQ ID NO: 14190 - protein, 600 aa, Myxococcus xanthus
ARNGSRIPMVEASEGTAQITLEVPGGVSATLEAGQRRRAHAGGSGQHCHARPARRHRPGRDHGVRHRQSGGGERRSGHGQRGDVVLLGRREVRHAADQLGDGRDVHARGGQRMVSHPVKLRGLVFDGATGAPLAAQRGAPAFIERQDQEFVQAIFGELRSEEGRKALAGTLISDGTLNPQGLKLLQPVHGVFNVALLEACCDVFGEPRVEATRIESAGLVIRRVGAGNTREAWVRRDGKVAGWVTLDGEEQEREPDPGRREGPAGPGPADVRRELLRLMRATSRDQETVTSLFIAPPDACAAAKRTVLYGLLQVASGEAPEGASSTAPAFDDAQVRSLLSPYFAAGKTVDWTGLEGLSVTYQDVAQRRLPQAKHDKLALFIDFLRGLVAVFDAFQVPALMTAMNRVQLDYGNGQKRPAGTALSGLADVLVQGKTGTVVLPRSWTHPNASEAAQVLQAAKAATAPRMRDLIPPERRFERRGSRYVARAFVRIHREDGCPPAIVWSEESAPFTIAAWHERGKRPPVLIPLPSLKDLSAFKPNVTFQVPPGMNELLNKNSPKDFPRRLQPVPPRVRASGGSVGSTFPSSPSAPSSSSTSSCRC

SEQ ID NO: 14191 - protein, 133 aa, Myxococcus xanthus
MSPKPPDRRPPVGFPLRLVPDERGELAFPSLEASVRQSIEVILRTRPGEQLMRQGFGAGLERMVGQPNTVSTRRRIQELVQRALTEWEPRLELIRVDVLELADLPAQVRVEIVYRLRRTGDVQQLGLAMDLGG

SEQ ID NO: 14192 - protein, 132 aa, Myxococcus xanthus
EVPALSELLGARGRLPHVWEVTGTPAADGLPVYHRLTVVADSTQELSRRGVVRLLLPSDLGAPVNDVRADARAGLGDRPPRLDDPRVAARLVTWLRLRPSGKPERFALGWVDINAVEVDQRETTGGRLIGQS

SEQ ID NO: 14193 - protein, 463 aa, Myxococcus xanthus
GGEVCGMLQVLRAPGKPFDERDLRLLGTLSELLVTLLEQRRLRAESSRQLAETRLLLDLARTTSGVLETSSILDVAADFLVRLLDVSNCYILLYDEGARLLRGAAASIAHRDYFRTVVLPLHGDGLTARVARERRPIAVEDVSSADGGFNPELAHRFDEKALLALPLTSREELIGVVVVDDTRGPRAFGPELIELAEATCGQLALSIANARLYESLWASYAELAATRAEMVKRERLAALGELSAIVAHEVRNPLGVIFNAVASLRRLLVPGGDAAMLLDILGEESDRLNRIVGDLLDYTRPRDPVLQQEDLGRVLQDSLEAARMQGGGADRSIRIQSDVEPGLPPVPMDRRLIRQALVNVAVNAIQSMPQGGLVQVRARREAHAGREQLRIDVVDQGPGIPAELLHRVFEPFFTTKAQGTGLGLAVVRRILEEHRGEIAVDSIPGRGTTFTFRLPFSQPPSFP

SEQ ID NO: 14194 - protein, 121 aa, Myxococcus xanthus
MEGRWVSYFEDGVKQFEGDYRGGLKQGLWTLYYQEGQNNREELHSPGSGPVKWTAWRSDGSKWAEGTLAGHRSQGAYSEWHPHGALAVQGQYEKGEKTGEWKYWDVAGVATDVPQGDFDSE

SEQ ID NO: 14195 - protein, 461 aa, Myxococcus xanthus
MRATTALLLRAENYTVFEAATGEEALAQLASGSIDLLLTDLKMEPMDGLTLLRRALEVAPRLQVIMMTAFGSIESAVEAMRLGAYDYVTKPFKESELRYRVERALERARLQRDVDNLTTDFNQRHGLSALVGRSAAMRELTTRLMRVAQSDATVLIQGESGTGKELVARALHAHSRRKARSFVPVNCAAISESLLESELFGHAKGAFTGAVKSRRGLFEEADGGTLFIDEVTETSPTFQSKLLRALQEGEVRRVGESTALRVDVRIVAATNRDIELEVRDKRFRQDLYYRLNVVALRVPPLRERLEDVPALAEHFLERANARSPNPKRLSAAAVSHLMSYGFPGNVRELENLVEQAAALAEGDELLPEDFPVRQGRMTPAHGTPSVAFLDGQGGALGRNASAGPTLAQVVEEAERHAITQALERHGVDLARVADELGVSSTTLWRKMKRLNLRPPSELARE

SEQ ID NO: 14196 - protein, 26 aa, Myxococcus xanthus
IPGKLAASAASDSHRLLGLIDPQAPA

SEQ ID NO: 14197 - protein, 98 aa, Myxococcus xanthus
MTSVASSSCAPSSSQAFTVLIPRGLQAAVEGLAAETRQELLAELFRLAALARQEESQLLPEFPYTLRLDVAGCQVSVELDPSRSRLTLVGLLRPQPLE

SEQ ID NO: 14198 - protein, 98 aa, Myxococcus xanthus
MSRRAGYAESWDLTYLVEQLRELIGHDLRLGSALSDELEDVLGSLVQRNQRLRVLQRMVTAERAPEDLAALRGALEEMDRELMTRLPALLEQLRLALA

SEQ ID NO: 14199 - protein, 570 aa, Myxococcus xanthus
MCPDSGVPAEGFPIDFYRGERIGKYEVVTQLSVGGMAELFLGFTSGPGGFRKYVVIKRVLPDARDNAQFERMFLDEARITAAFNHPNIAQVFDLGREDDGLYLAMEFIAGQNLNQITGACLRRQEQLPLGFTLSVARDVCMALHYAHTYTAPSGAPSPVIHRDVAQKNIMVTYDGVVKLLDFGIAKAKDSLERTNVGTVKGTTGYMSPEQVRGDTLDGRSDLFSVGVMMHELITGARLFAGKNERDEMMKILEAPVPWPSHVAPHVPEEVSKVVMRALERSREKRFANGRDMARAIEAAAGKLLLDAHDRAALMQDWFAERMSATRVMLESADGTTNGVMLDSAKRALRSDDGPYLPERKDIPTPSNGVAGMPRKPSRKVPAAAAPRKASAAVEGTPQPPESKASNVLWGLVLMGILVGGGYAAWHLSKVLNETVDEKDASALRTLPQHDPNLPVYLGPGSGPPTDAGNTETPAKVSGGEDAEGSRSKEAASARPVKGRGKLTLLVLPEAEVFRGKKRVGRTPMFNVAMPAGEHDLTIVGPDGKKRMLSVPISAGETTQFRLKLAEIPER

SEQ ID NO: 14200 - protein, 322 aa, Myxococcus xanthus
MAPLTIGFLMDPLETVRVDHDSTFALMLEAQKRGHQVRYFEQGWLRFNGTCAEARMRHVTVRRELGRHFDILDEAPRPVSSLDVLFMRKDPPVDAEFLHATQLVELCGTGRPPVFINEPAGLRDANEKLFSLRYPDLMPDTRVTSELPVLLDFIARNAAGTILKPVDGFAGKGILFLSATDRNARSAVDMLTRGGREAVMAQAYIPESRQGDKRILLVDGEPVGGVLRVPSDDNHRGNMAAGGVPQKAVLTPRDLEICERLKPELVKRGLRLVGIDVLGTYLTEVNVTSPTGLVEANQLDDVCVEAKVLDVAERLVAERAAR

SEQ ID NO: 14201 - protein, 41 aa, Myxococcus xanthus
EGAGWSAAADVYKFYVVYPQQQGGNNMTSCFNWFEPGDFSR

SEQ ID NO: 14202 - protein, 78 aa, Myxococcus xanthus
LGWGAAACRDTPSLSGAEGRLRLSARRVDFPHAYPGTRREAEVRVVNGGRAPLDVTWTDVTAPFSLEAALPVRVLAGE

SEQ ID NO: 14203 - protein, 597 aa, Myxococcus xanthus
CSKAGPAVVSSSEATSNPQDSEAGATGTDASAPGPETLGTPGASSGATDSAPVTAPDGHEAPSMGTEPPPPEDPLAQGIPTPGDLKRLDFRGGEPRVPVRLMEGRNEVTFSPRGRMRLRFGGPDEKMLDAAAGTRWTVRVTQGSPAVLSARVQLAEFRMADRAGLQAALESWREKGLAVRAQVLGSVYGIAGKVIDNRRTLLLVDEVLTPEAAGHKQAELLRSHGVQTTLFEEVRTPSKAILEVRDEAGVVVGLAQDRLDAETPDGAGFDVRQVEYGVGYDFHGFEDRTFRGALQLVVDRSGRLAVVNVVPLEDLLKGLVPAEIFARAHSEALKAQAVTARGEVLAKVGIKHLADPYLLCSEQHCAVYRGRTGEAASTTAAVEATRGEGLFSEDGRLVDSVYSAVCGGHTEDNDVVWGGPPDPSLRGRPDVIGPVGAHPLPASLERWLTTANLPAACRLSSFAQPSKFRWEKRFTAEQVDTRLKRLGVGRVQALALTDRGVSGRAAVLTVSGDKGATQVRGELNIRRLFGMLNSSMAVVEAERDAGGRLTGWLFRGGGWGHGVGMCQTGAIGRAEAGQRYQDILRHYFNGAEVAPIY

SEQ ID NO: 14204 - protein, 242 aa, Myxococcus xanthus
MAGNNGMGNDDRPVSQGGQKPAFEIPDARKKNEVAMKTDPTSPGPGMTVNNQNESDEVVGNSKRLNIQPGTGGEEAGSTVRAGAPGLASLTPSRAVMDKVLGAAPNDHLQDAEEGDGTLLNTREWKYASFFNRVKQSVGMHWNPNEQLRRRDPTGGIYTGRDRYTLLQITLDERGQVTDIQVEKSSGLDFLDFEAVSSFKRAQPFPNPPPGLLSDDAKVKFQFGFFMEMGGGPKMRLFRQPN

SEQ ID NO: 14205 - protein, 174 aa, Myxococcus xanthus
MSCGGDSGGPVFIEQDGVERLVGVTSFGDLSCTTGTNSRVDVHADFIQVAIEDASRGAPVRTLVDPDVDACAQWCRAHADCPVGMACVARADGTRSCAVAGLEAGHFGPACTGAQGEHPCVKAGSACRLWLPCSEPRDATAPGGCAAAGGGNPGLIPLVLLAWSWGRGRRAKGG

SEQ ID NO: 14206 - protein, 241 aa, Myxococcus xanthus
LSQSAAVTADGLHSFIDGGSNVLGLVAMGVASRPADEDHPYGHGKFEALASLGIGAMIGVGMLELGRMALDSVLNDKHPQVTGTMAAVMAFTLVVNMVVTRVERYYGRKYKSSLLLADASHTMSDVYVTLAVLSSLLLVWLGYPRADGLIALAVMVFVAWVAYGIVRQAVGILSDTARLDPDEVKRHTLAVPGVRSCRDVRSRGMEESVYVDLKIEVDPQLTTAQAHEVADRVERTLQGAY

SEQ ID NO: 14207 - protein, 122 aa, Myxococcus xanthus
MNRQFVESFHANIAEDPEAHGREARAYLRAMVSSPANSEQIRGLRALIGSMMVEPDLRERWNCSWQDDLQLKSGEVSPQDINSIICRLATDGLWFADLLEDQGIRPEVRAAVIRRLEELTRE

SEQ ID NO: 14208 - protein, 95 aa, Myxococcus xanthus
MFVKARVVLGEVAGALLVPQQAVLHDAQGQAQVFIVREDNTAEARNVRAGRIVSGRYLVEEGLSAGERVVVEGQDRLAPGQQVTPVEWQHAPASR

SEQ ID NO: 14209 - protein, 934 aa, Myxococcus xanthus
NDSVVSLIERGLSGVKNILYFESSSDTSGIAQIVVTFAPGTDPDLAQVDIQNRLKTVESRLPQMVRQLGLQVETTTTNFLLFSTLVSSDGRYDEAELGDFLSRNVVEDLRRVPGVGRVQLFTPARALRVWLDPERLISHGISVDEVAAAIRAQNAEASPGRLGDMPAVPGQRVTTPLMLQGQLLDVADFERVIIRANPDGSNVLLKELAKVELGPQSYASSTRQNGKNAATFGVQLAPGANALDTSERIRERMADLSRAFPAGVEYTIPYDAAPFVRVSIQKVVQTFFEAMLLVFAVMYLFLQSVRYTLIPAIVAPIALLGTFAVMLASGFSINVLTMFGMVLAIGIIVDDAIVVVENVERLMAEEGLSPLEATKKAMKEITGAVIGITLVLTSVFIPMAFATGSVGTIYRQFSLAMAVSILFSAFLALTLTPALCATLLRPVEPGHAGKRRGFFGGFNRLLERVTGRYANWTRAIVGRLGRAFFAYAVVVAMVALAFWRLPGAFFPEEDQGFLNVSVQLPSDATAERTNSVLGELEAFLSEREGIQDVLTIQGFGFFGSGANAGLMFVMMRDWDERQGETAAGEVAAANARFASPREGMVINVLPPAVDGLGNSAGFAMRLEDRAGHGPQALNDAMNHVLRRASDSPVIAFPYQEGLPDGSTVRIQVDRERAAALGVSFAEINSVISTALGSTYVNDFPNKGYMQQIILQARAESRMQVEDVLKLPVRNARGQMVPLSSVAEPVWERGPMQLVRYNGYPAVRIAGAAAPGFSSGDAMAEMERIAGELPPGFAVEWTGLSYQERLSGSEAPILLALSMLVVFLVLAALYESWSIPLSVMLVVPLGLIGALAAVMSRGLMNDIFFKVGLITIIGLSAKNAILIVEFAKQLEEQGRSPLQAAVEAARLRFRPILMTSLAFALGVVPLVVANGASAV

SEQ ID NO: 14210 - protein, 188 aa, Myxococcus xanthus
MSVNIQLEWTPNPSTLKYVVDRRLLAGGAVNFTNPEDAQAKSPLARKLMDVRGVTAVMIGTNFVTVTKGEEGEWDELNDEVMSALDTHLTANEPVVDEAALAAAREAAGPSGGGTVEGRIQDILDNEIRPAVAMDGGDITLDRFEDGIVYLHMKGACAGCPSSTATLKMGIEGRLREMIPEVLEVVSV

SEQ ID NO: 14211 - protein, 238 aa, Myxococcus xanthus
MVDAGSGNAYLGFVLYELFLKGSASGTLLSIEGRPDLTERAQGRAQRLGFTRMQFQTAHIDTAQYPERIHLLMALHACDTATDDALVAAIRHGADHVAVVPCCQAEVAAQLKEKRPVVASSGSMSLLYAHAWHRREFGSHLTNVIRALTLEAFGYQVTVTELTGWEHSLKNELILGRRVHRENRRARMQLERLLAETGVNPKLTRELGVKPAVSAAVETVSAPEPDVSEEASEHVVAR

SEQ ID NO: 14212 - protein, 169 aa, Myxococcus xanthus
SPPPPRVPASVFEGFFVRGLQAEGRLAQELEALGYDSRKPELDYPIALWQRAVALARRERYAELGDEDAYRQLGRQGVFGFAQTLVGRVAAVALPMIGPAQALERVPRYLAMMGRSDVDVSMSSEGERGRRLSLSDRYNRPELMAGGLEGMLEMANARPRISVEERSSG

SEQ ID NO: 14213 - protein, 156 aa, Myxococcus xanthus
MKLEEALDGLAFEPGRGDVCVDLGAAPGGWTQRLVSRGAKVVAVDPARLMPELTGNPRVKHVQESAFAYAPDEPADWLFCDMAWRPLEVAQLLAKWGRRGWAQHLVANIKLPMKDKNPILLRVRHTLGQEGGWEGLTVRQLYHDRDEVTVTAHKMK

SEQ ID NO: 14214 - protein, 234 aa, Myxococcus xanthus
MPYPLDDATATALIALHPWVLTRSPQAPVQAAVEVLVQAEQARRGQPDAKTGALQVPALTQGNLLKEEYDLSTHGHHDGWRVGAVIADVQGMINVNARFGFPTGDAVLRATVESLSAQYPGAKVVRIHADAFAALLVPTSQLTVEEHLAAPTRERLAQGVRPVLPPGTPDADVPSWTVSLLELTVDAPSHWQVLGPLLWAELERTHVMERTGRAQGLQRRRIRLDGSIPGPATL

SEQ ID NO: 14215 - protein, 496 aa, Myxococcus xanthus
MIEWTLKKLIGTKNERELKKAHAKVARVNELETRMRALKDEDFVSETNRMRQEIQNGRSLDDLLFEAFAITREAARRVIGQRHYDVQLIGGMFLHEGCIAEMRTGEGKTLTATLPTYLNALSGRGVHVVTVNDYLARRDAEWMGRVYRFLGMTTGCVLHELNDKQRQEAYRSDITYGQNNEFGFDYLRDNMKFRLQDYVQRELNFAIVDEVDSILIDEARTPLIISGPTEDSTDKYYRVDQVIPGLVPDQDYTLDEKHRSVSLTDDGIEKLQKRLGVGNLYDPGEIEMLHHVDQALRAHTLYKRDKDYVVKDGEVVIVDEFPVRQIPGRRWSDGLHQAIEAKEGVKIENENQTLATVSFQNYFRMYSKLTGMTGTADTEAEEFAKIYNLDVRVIPTNRPPIRKDLQDVVYKTEREKFEAVAAEIEELHKNGQPVLVGTVSIAKSEVVASFLKKRGIPHNVLNAKQHQREADIVAQAGRKGAVTISTNMAGRGTDIL

SEQ ID NO: 14216 - protein, 43 aa, Myxococcus xanthus
MDLEFPRMKGDFSAMKKYRFSRDEARFAAPKDGRRLTHAMDAP

SEQ ID NO: 14217 - protein, 102 aa, Myxococcus xanthus
MHGGMDIAAPHGKEVFAPSDGTVVFAGLEGGYGNVLVIDHGYGIKTRYGHLSKMLVKAGDKVKRGMHIAAVGNTGRSTGPHLHYEVRVNGIGQNPRKFILEE

SEQ ID NO: 14218 - protein, 1036 aa, Myxococcus xanthus
TSSNFNNAYVVPDYASTPQQMVMPSHLTLELFHLFNLGEVDVGDVACHEAVHYVQLQQTDGVWGFLNLVTGGLFQPNSYTESWFLEGLATYYEGQFEKDAGRPHSPIWRGWYDSVVQATGGRLNPGYLSPEQRALDPFGGNYITGMHFVEYLANRYGESKLWKLVDEQGGSLVPPLAVTLRFKRVYGRDIGSLFAEYTQSLRENLQVRERPSAQRTWVPDAGYFSRLASHAASRVTATVGVGRERYTRLTVLEPDGRVRFERPLVELLPGRRWVLGSPTLVSGMSFSRDGAWLYLVMADLNTEGGYTAKLWKVDARTGDVVRLWDDVMGMGGSITPDGTAYVYVRVDGDSANVVRLDLETDTRKALTDFGASTSVGPPAVAPDGERVVFPLSGDAGWDLVLREADGRLRWLTRDGRFNYSPRWMDDERLVFLREHEGRLQAHVLTVATREVVRITDAPHLVMDVHPVGTEEVVFLNRDGLNFTIDRAPLVPIAPTEADAGTARVEVAGHAVLAQAPHPSAPSPETEPGAPRLPEVRTETPASESEQTPTAAPSESEFAAFPMPGAPVQPDAAQPPSPSETAPGHGAPLSGQPSTSDEASPPPGAAPDHGAPPSEESPANTAEGAVPPPLAPQSEQPATEDTAPPSPSPAAEDAPTALTALDGPVEAPPDPGMELQILSDEPYSPLERLFIPELRVPYLLAGADPDNTDDTYTMGGLALAGQDRLGFHAYSLLLSFDTREDAPSLSLAYGNAQLAPWYIQVSGAYIRQNQRTDLQATAFASRSFWTTPVTFGVLALRREYDATDRFPRMLTRIVGPEVSVSYFAGDATSYGSTQRGLGMTAVAGVYPGAFLRDSTMGDVRLGLDAFTGGLPFTGRDNLRLTAVGRFLPGAPSGLLQVGGLRAGQIWYTNRESQQTAPLPLQLQPGIAFSEYLRGYEDLEIRARDALIGSATYQYRVPIDYGWASTLWLFPSLFVRDVGVEAFGSLARTDNRANHAAVGASASLHLTFGQAIPVSLYYQYAYRFERGLDHLHLVGFGL

SEQ ID NO: 14219 - protein, 25 aa, Myxococcus xanthus
MWDAPVDAQGQHRYAHRRSEVREGL

SEQ ID NO: 14220 - protein, 859 aa, Myxococcus xanthus
MHSTLFGEPRLGAAKAVAGRRALRAGLPLSIMLCVLSLAVPSSAAAQEAAEAEAPAKVKRRKRVVKPAAPARPAAKTAKKPKKPVKPPIEDADEPEIPVLGGGPATDDPSPASAPAPVPTPPSAAPLTPATPLTAEPASPQALPPVGADFNPPDAPTHLSPATATLPAHQPAPSSNIPISAPFAEPTLDRPLPPQSGLAGLGTDPLDGADALEESVNRVLSEAVVTTAGKRNQRISDVPLTVSWIPADELEGTGQFTLCEAIQYFPGMECRRGSMRKAAVSARGLGSNYLSNRLLLLQDGRPLTDPWTGQFYGDETTPLTNLKQVEVIRGPGSSLYGSNAFSGVINVIQRQPSDLIEKGKNVGAEARVLAGQDQTWRLHGTVAGRGGPVEALLGYYGFGSDGPQLFNDPRVGRVDTNQDSLVHQVNGKVRIGPLALDADFTDAEIGRPGGTHISTVGNCGRCHYTPNDSESVQNFNASAQVDQQVTDNLRLFGQAYGLFKRRDVLMENAFGGDPTRALGKRRRLGGEARALWTMGDLNVTFGGDLKADAVNVPNVLPELSMDDTRQTILGGFVDAEYRLFNRLVFGAGARYDRYQIPERVWQNRTDQVSPRASVVFHAVPELLTLRTNYGRAFRAPTLAELAINQQMYAATLVGNSNLRAETLDTIEASVDFWPFDRRVRLTGTGFYNLAKNFINQQLVFGSVSQFQNLGDARVAGFELEAAAQIPSINSSFDIAYQFLDAKALPYDDGPQSPLDYAPAHRIYARGRTNIGKVAFVELYALLVGSRYDPGFEVDETTGLPTTRVQLPSYVTASARVGFNVYDGISVSFLGSNLFNAKYEESHGFPAPPQSFFSEVKVRY

SEQ ID NO: 14221 - protein, 248 aa, Myxococcus xanthus
VLYRPPVAAKSFGRYEDFSRAVAGGMVDFAVVDAWAAVQLGAKAKPVAWASRAGDTQQRWAIVALQRGVVKDLAGKRLAHVKGAGPADPKFVTHVVLGGDLDAQKHFKLAPVPNVESALKMLEAKGAEAALVPLAHVPKGKDVRVLFRSGRVPGAVLVDLRNHEAALTGALGKVGAVAPFDAFARLQDKDFDEFSKLVTRGPPRRQPVLAEGAELHVEAEVLVRSEELGPALPSFVGDLAVSAEQPDD

SEQ ID NO: 14222 - protein, 278 aa, Myxococcus xanthus
VPFTPATGRRVLVAPGEDRAAPEAELYAAAQEFARAERLSGIHVLFPTEEELPALVAQGFAVRLGVQYHWRNQGYRTLEDFLARFHAKRRNQLRRELRAPTEHGIEVRTLRGDALADADADTVYGLYATTVDKYPWGQRFLTPEFFARMLARFRHRCEWVEARREGRLVAGAFNFTGANVLYGRYWGCFEEHPFLHFNVCLYHPISEGITSGLERFEPGAGGEHKLTRGFEPRLTYSAHLLLHPGMDRAVRGFLAHERAAVEGSLPQWRAETGFKEGD

SEQ ID NO: 14223 - protein, 79 aa, Myxococcus xanthus
MSISHLRFFSLEHPLLMLLALTAAHATSAMTRREAPAQSKHRTWAVGLLLAMLFVALAIPWPGLPHGRPCSGTSSQTNR

SEQ ID NO: 14224 - protein, 107 aa, Myxococcus xanthus
MAQKHEHDTSVITESAPKQKLKKPPLYKVLLHNDNYTTREFVVAVLKEVFHKSETDAVQIMLHVHYNGVGVAGVYTYDVAETKIQTVEAAAQENDMPLRLSMEPEEG

SEQ ID NO: 14225 - protein, 700 aa, Myxococcus xanthus
MQETFERLTQGVDPEPQQTIGVERVLHRAAMHALSAEQKLIDGGDVLVALFREDESHALYLLQQEGVTRLDLLNYISHGVTKDGEGEGEGEESAGHATPAGDDDEGESPKKSPLEAYTVQLNIEAKEGRIDPLIGREKELERTIQVLCRRRKNNPLYVGEAGVGKTAIAEGLALHIHEGRVPEVLKDAIVYSLDMGALLAGTKFRGQFEERLKGVLKALKEQQNAILFIDEIHTIVGAGATSGGSMDASNLLKPALASGRLRCIGSTTYQEYKSAFERDRALSRRFQKIEVGEPSVEDTILILEGLKSRYEEHHGVKYQPEAIRAAAELSAKHINDRFLPDKAIDVIDETGSAERLKPEGQRSNTVSGADVEAVVAKMARIPAKSVSASEGVQLQNLEKELQGVIYGQDSAIKDLVSAIMLARSGLRAPEKPIGSFLFSGPTGVGKTELAKQLAQSLGVEFLRYDMSEYSEKHTVSRLIGAPPGYVGFDQGGLLTDAVRKHPYSVVVLDEIEKAHPDLFNILLQVMDHATLTDNNGRKADFRNIVLILTTNAGAQEMSTKAIGFGDLAKPVDATRAKKAIERTFTPEFRNRLDGWILFSGLPPEVILKVVDKEVRLLQKMLDEKKVKLALTPAARAWLAEHGYDPAFGARPMARLVDNSLKKPLAQALLFGDLKNGGTAHYDVADDSLKLRTEPATAEVA

SEQ ID NO: 14226 - protein, 520 aa, Myxococcus xanthus
LSQQFRQSLGLAPKFVLVTALISATAATLLTGVATRRLESDLADSYLGAGRHVARGLAVAAEQGVAAGASALQPMLDASVGHSDLAYAFIQDSAGNVVAHTFPDGFPDALKEAVATAGAGSVLEADAGGVRLRAMDVVAPVAGGRLGSVHVGVSRDHIDELVSALRVRMVGFAALLVALGVAVSALFGRSIVGPLKSLTEVAGHIVESGDLTRPIQVKSGDEVGRLASSFSQMVDRLREVTLNLQQAAVALTQSTEHLNSSSTEQAQTISRQAAALQETQVTAQEIKQTSMLAAQKAESVLSVAERADTLAKSGEASIELTMAGLNDIRVQVGEIAQKIVELGERTQQIGGITQTVKDLADQSNMLALNAAIESVRSGEHGKGFGVVAREIRALADQSIEATTRVRELLDDIANQVTLAVRITERGAERMESGLAQVRTSGQNLRELSSIVQDNAAAVRQIAAAVSQQNVGINQITLAVNDLSKMMDETVARIGSTGEAATTLQIISEQLSSAVKSYRVE

SEQ ID NO: 14227 - protein, 388 aa, Myxococcus xanthus
NAFNPQAARLIIDSLRYWVTEMHVDGFRFDLATVLGRTGEGAFDRDAALFQILHQDPVLGRVKLIAEPWDVGLGGYQVGGFPPPWREWNGKYRDALRRYWKGDENLASEMGYRITGNADLYAEARRRPQASINFVTAHDGFTLHDLVTYSHKHNEANGEHNRDGADDNQSWNCGVEGETDKADVIALRERQKRNLLASLFLSTGIPMIVAGDEMGRTQGGNNNAYCQDNELSWVDWNLDERRRKLLAFTRKLIHFRHRQPVLQRRRFFKGQHLWDSEHKDLTWFRPDGPEMKAEDWEKPFVRSLAFLLGGDAIPTPDERGQRIIGDALLILLNSHHEPVTYKLPPAAQSQRWELELCTTDDNRGPEPVKGETFELIGRSLAVFRQVAD

SEQ ID NO: 14228 - protein, 250 aa, Myxococcus xanthus
MLGFPAEAFPGGCGMPVPKRSRSAARALARAGGTVSRDAQEEGVKQVYGEIASAYEVLFPALHRYEERVERFLAAVVAPGARVLDVGCGPGLHTRGLDASIAVVGTDLSEDMLALARTARPGGAWHVHSYHQPIPPDWGRFTVALAIGCLDFCDDLPRVLKHLAEALEPGGKLLFTVLERRPGLDGHEAPVQPIQTAGPAVTLHLYSFEETARAVAEAGLLPRTYAHAPGWVQLTEQRTMWFGWWEVERR

SEQ ID NO: 14229 - protein, 337 aa, Myxococcus xanthus
MTRPCPRDRDWSIGVRGMPPGATGSTARAGSPPPISPRRTDSVQPGHTAPGPRPASVCRANPSTPTRHRRCRGLLTMTLFPLRWFCAGALLITLSTACTRSTPAATVERNIPVKAQSQGPDEYVLADDVSVRKLAPGVWLHITVVTLEPFGRVSTNGLIIEDGETSLLVDTGWDARQGALLLDWARDTLRRPVRAAVVTHFHEDRLGGVPALAPHGIPVHGLEETARIATSLGLPGPTETFAKTSTVDSLELFFPGAGHAKDNIVVWHRDSGVLFGGCFVKDGASTNLGNVADADVAAWPASLSRTRQRFPEARVVVPGHGQPGGPELLGHTEALLR

SEQ ID NO: 14230 - protein, 84 aa, Myxococcus xanthus
EQRDGCWVKQTRAFPSTLKEEVGPCARPVPIWSEDRLTRLVQECVMHTDYRWQSRALVAWNRNEPLPDRESEEKVLADCMSRAE

SEQ ID NO: 14231 - protein, 55 aa, Myxococcus xanthus
  unsure (1)..(55): unsure at all Xaa locations
LFFAVNALWALAQTXVASTLGARPVSVVLGYGPTLLXRRLGSXLWAFRPLALRSV

SEQ ID NO: 14232 - protein, 211 aa, Myxococcus xanthus
MAVSRPQPFTTSPIRYEAAFGGYDTTDSDPSKHRIDERNPVGRGFATRQAQLTGKPAHTIEYPSGEPATRGPAGFGPIDAAWMPRRKLAGTYDARWERTKKPLLPDDYDPTFALSAPGDQRLDGPLTGGERVELMNMTPEGVLRFELPRISLGFTTHVGRRSEEHGARLTTVLVEPEARRLSLVWQGTLCVPAPDADYLDETEIAELKEAE

SEQ ID NO: 14233 - protein, 36 aa, Myxococcus xanthus
MAAALGTSFGDQPQSDIVVADVFQFGPALTLINISG

SEQ ID NO: 14234 - protein, 348 aa, Myxococcus xanthus
MSPPRASALLLTIVVSAGGCTKTPTEEVRKEANGSIQCQTLQHLACTGLYGEGGTGWATRAIPPEVRPYEPGLQLWSDGLDKTRFIYLPPGTKVDTSKSDEWRFPVGTKLWKEFSWKGRPIETRFLWKRPDGSWLRTTYRWSDDGKTALELTSGEKDVPGTEGYEIPSQQDCQSCHRGRGDEVLGFEAVALAHDGARGLTLAKLVEEGHLSHPPAQVPRIPGTPVEQAALGYLHMNCGVSCHSANRMALGNSSGLHLRLEAGELGSVQETDTWRTSVNVKALIQTSGMFGKSSQRVAPGDVQHSSLLYRMGQRGDFMQMPPLGTLVVDEQGRALIQRWIEAMPVKKGG

SEQ ID NO: 14235 - protein, 506 aa, Myxococcus xanthus
MHKEPIIGIDLGTTNSCAAIVEDSGNVKLIPYKGGEYTIPSIFAIDDKGNELIGYEAKRQWQLNPRNTVYGSKRLVGRGFGSEVVDTMKQVVAYNMRPGKQSDVILDVGKKEFALQEISAKILGKIREVASNYLKMPIKRAVVTVPAYFNDRQRQSVKDAGKLIDLEVVRIINEPTAAALAYGVGKGLKEKVVIYDLGGGTFDVSIIEIRDRVFEVKATGGDVFLGGIDFDNAIIHHVLKDFAAKTGLDLATDPVAMQRIKDLAERTKIDLSAREEVPFNIPFITMTSQGQPLNIEMKFSRKMLEQLTNQLVDRTLQMVARVLVDSGLSTKDVDEVMLVGGQTRMPIVQDRLTKFFGKPPSKGVHPDEAVAIGAALYAHSLQDDTNLRIQLLDVIPMAIGLEKAGGAFHTVFPRNASIPNAKQLLATTSMDNQTELAVRIFQGDNELVARNDMLGEFTFSGIQPGRAGPALVEITFDANVEGILTMRARDPVSGREMKTTVRVSNA

SEQ ID NO: 14236 - protein, 324 aa, Myxococcus xanthus
DATLPYVAPSNHGLRDVRYVHFLAELGDADCRTKLEAFQQDVLLRRGELLPFVDALGTKWNTGFTVVGGPDRALEFSAVEASFYFWQYGTASACASIPAAGAPAAETFAFLDDVVGVAFTYSDRFIAPFEYAYYQAATQLGWSRYPANHLRGLLRYPGENTPDVYVSFPVTEPFDMRAMLRVEHWVRNHGKRMLFIYGENDPYSATAFSVREDNDAFRYFAPEGNHGASIGGLAEPERALVMERLFTWMGMSVPSAAVRAQALEHATEAATSKPAASWVPRGHLQQRVHASEWDARSSGFIRLDSDAPNRKTMAESLQAPRARR

SEQ ID NO: 14237 - protein, 107 aa, Myxococcus xanthus
DAGTILNPERVRSQMEGSIIFGMSIALHGAVTMKRGVTEQSNFRDLKLVRIGEAPRKIHVDIVPSELPSGGIGEPGVPPVAPAIINAIFALTGTRIRELPVSRTLAV

SEQ ID NO: 14238 - protein, 154 aa, Myxococcus xanthus
MNVHNVLKLLHLIAVVVFLGDIVVTAVWRLLADRTREPRVIVYALRLVQFTDKYLLVPSVFALAATGMLRAHLQDIPLWTNPALAAGQVCFMLCGIVWQLTLRPIQARQLAMAEAFGDTGASFDDYLLLTQKWFRWGILAMALAFGSMALMVLH

SEQ ID NO: 14239 - protein, 1089 aa, Myxococcus xanthus
EQGVRAYMALLAAFGAYLGRVSGQDDVVIGSPFAGRRIAETEPLIGFFVNSLPLRIDLGGEPTFLELLQRVRRQVLDAHEHQDVPFEKLVEVLKPERVLGTSPLFQVMLAYQQTHTAKMALPGLEVTPVAIPSGAAKFDLTLTLSETAQGFEGVLEYDRDLFDAWRIQAMVRQLTGFITRLAAEPRSKVVDVDLLGAEERARLTPRAPEAAPSLPAVHEVIAAQAAKTPTAIAVEAEDGTLTYAALEARAKAVAQALVQRGVTPGTLVALAVERSVGMMAGLLGILKAGAAYVPLDPAYPRERLTFMLEDSGARVVITQAHLTSRFPGTDVVVLGDDTLESFEPRSGALAYCLFTSGSTGQPKGVLIEHSALANHMAWMDDAMPLAHEDRVLQRTSLSFDASVWELFAPLMVGARLVLAPHGLGADTEHLARVLRERDVSVLQLVPSLLTALVEEPGFANLPALRRVCVGGEPLPSATVATLFSRSKAEVWNLYGPTEATIDSLAHRCLPGQVGAHGPTEPIGLPIHRMEALILDGRLRPVPEGVPGELYLAGPGLARGYLNRPELTQSRFIEHAFPGGPTLRMYKTGDVVRRLADGTFLFVGRADRQVKLRGHRIELGEVEAAIARHPAVREAVALVRGTGGDSRLVAFVVPHASAQRPEPTELRSFVEQQLTANMVPGQFVLLDALPLAPNGKVDTRALSAMELADARVTALEGLPRDALELEMVRLFEEVLGVRAVGIHDSFFDLGGHSLLALKMKLAVEKRLGRPLPLVSLFRNPTPAQLTAVLRTENAAVSPLVPLTPEAHALMAAGAANPNRTPVLYLVPGGGSTPFYLLSLARHMEGVPVFGLQPHVLHGDVPPPDTVEAIATWYADAILPMQPEGPYSVGGHSMGGHIAYELAQELKARGREVGVVAMLDTLAPFPDVTRPQGEGWDTAQWMLHLAGIMEAFFNVKIDLALPEVRAMGEAERLQFFVARLQAAAVLPEGAQPVHVQGILNVARAHDALNYRPRRGQPVPLAVFRAEDRSGPSTAALDALVQDGTLGWSQLTQQACSAYPVPGTHLSLLRDPHAAVLAQHLLALIPRPTPTP

SEQ ID NO: 14240 - protein, 409 aa, Myxococcus xanthus
ALEFDMEALRAGQVQLTHFTGILPDGLPVSFESGDAEAPPARPADGYFPPAQRTLDVYLGVPRERSGVESFGSGERLGSSPRYTPASRPVSDLTASTSISQVAFGQRNVRLLFGTEPRDDFESIKLCELSRDRSGNLMLVESFIPPCLRIDASPFVMNELRTMLRLMVSKQRQLSSRRRHRDASALEFTAGDVTLFLELNALNGTIPFIQHALDAGNLRPRDLYLALAQCAGQLCTFSVSADPSTLPTFQFTNLRATFEELFRRLSELMRAVALEQCLSVDLTAGADGMFRGRLEDDRLERCGHFILAVRSELPERVVAEQLPKLSKVAAWEDIRALVQAAAPGVPLAVTYRPPPEVPVQPGTVYFSLSMNDGYWRNVMRDRNLAIYLPQPFDANRTTVELLAVPTANR

SEQ ID NO: 14241 - protein, 183 aa, Myxococcus xanthus
MPPGEAPATVLVTDDDERFRERLVRAFVRHGFQAHGAASAHAALEAARALRPGYAVVDLRLPDGSGLELVRELKALDANTTVVVLTGYGSIATAVEAVRRGATHYLAKPADVDDILLAFAGATLPSGQEAALTHEVPSLARAEWEHIQRVLADCGGNISQAARLLRIQRRSLQRKLSKYPVPK

SEQ ID NO: 14242 - protein, 238 aa, Myxococcus xanthus
MDRVTEATKDCFDAAIQLRGSEASAVPPPETLHHRLRGVVDETLRRAAVLGFSHQDAQDMAYALVALIDEVVLGRPEEYRQLWMPLQLHYFNENVAGDGFFARLNTVRKDPHRHEVLQVYYLCMLFGFQGRYRIRGGELELMTLIDTVQKDLERARPFDFDVLSPHGDRPTESLLSKRKKASMVSISAGALAVAVLFYGVLQFFLNDKVGELRSRIEVHAARNTATSASQTQATGGAQ

SEQ ID NO: 14243 - protein, 735 aa, Myxococcus xanthus
MAYLLPLLGIGAPMFALMTYLGLTMQQAAIVAALAGLLAAGVVWLVKRIRARAAAKKLEGALAAQADEQATTVRPDLQPEIKAMQSEFTKAVEALKASKLARGGKDALAVLPWYLIVGPPGAGKSTALRNSGLKFPYLSARGGVRGVGGTRNCDWWLTNEAVLLDTAGRYTSAEEDRPEWLAFLDTVAKHRPSRPINGLIVAISVSELLNADPQAVGEMGQTIRERLDEITTRLKMLVPVYVMITKCDLLPGFVEMFSDLSRVERGQIWGFTVPLEQQREASTDLFRERFDQMLSVLEQRSLRRLGQERRLETREKIYGFPQKFDALRKNLAEFLQPLFLENVFQDTPVFRGLYFNSGTQELRPVDKVSPSAAEIFGSTNGRAQTDGATDGRSYFLWDVFTKVMFQDQQVAVRSSLEEARVRRQRMMLASAASAATVLLLSLPTVSFFKNRNMAEAVTEAITSVNLDPRDDIRRVEDLIPLRNRAPELTEYEEGSAPGVHALRPLPGPQAAAAGAAVLQRGAAQGAARQAVRAHPAAPGHVREEPGPADGAQRRGLQQALRRVPPVLRRLEDVPAGDHAPRPARAGAGRTAAQVAPGRNRQALEARAGRRGGRAGRGEPRGDVPADARQRADAPRGAEAGARAAHRLRPRHRRGAVGAPLAQQRAPGAVGAGAVGGQHERRVPGRDAGAARGLGAAYERHLARAGRLHAQGLRRRHPRAAGPGLPGPAVVGAGPR

SEQ ID NO: 14244 - protein, 668 aa, Myxococcus xanthus
MRFGLYQGHKLLPQARQFYNAALRRVLLGKQFELIQQRLDTFGKNPDLLTVRSDEDYSKHFDAYRQYFDDLKMYLLVTTPRDPREPELDELQRKWLQDEIVKHWKRVRGDAVDERAVANHAETFLLMLANEQMLPEERKPAREQRIAFGRVTGVVQSARRSLNNVPLVRLELAQLVANMSGAYPDVTLEQLVGSVPHMSATSRVRGAFTRKAYDDVIRERLDLAFQDQQSWVLDRDEKVDTVSSRRELRTRYFEAYTQEWKDFLGAIRVQAPENLTQMESLLTNLTRGKPKPYGRLFRALTYNVVLDKRDAKAAEADTGFLAKAGKLFGSEPGKDVPQKRELLNANSPSGAQEVTARDLEREFASLIRFATETSKTEDGEESLTALDSYEDQLATVQTTLLAVKDKPAESGLLLDKIESTRNNVEMMVRKQTDNVAIFERLLLPPFQEMRSVVFVGVACNKSKLWQDQVVMAWSSAFKGKYPFDRASQADAPLPEVAEFLRPEGGLVRKFVKEQLLEDVVATGRRWEFTSSGGVMYRPDLLGFLEKTGALSTTLFPGGDTVDPLVRFQVRLRPGVSADGMASQISSITLTLDGTDETYRNGPDTVWKPMIWPGQAGKLGARITVQSADGSTETTLEAEGDWGLFRLLERVKRIEPSADGRYFTATWEI

SEQ ID NO: 14245 - protein, 38 aa, Myxococcus xanthus
NGALVSIDFRPERTANPLFGMSGNTSKLLAIFRDPRLQ

SEQ ID NO: 14246 - protein, 107 aa, Myxococcus xanthus
MGLNVEDVKVGTGTEATAGKSVTVHYVGTLTSGSKFDSSRDRGQGFTFRLGAGQVIEGWDKGVAGMKVGGVRKLTIPPEMGYGARGFPPVIPPNSTLLFEVELLDVR

SEQ ID NO: 14247 - protein, 125 aa, Myxococcus xanthus
MAAVEITKDNFKETVSKEGIVILDWWASWCGPCRAFAPIFEQTSNNHPDIVFGKIDTDAQQELSGAFEIRSIPTLMVFRDGILLFEQPGALPAAALEDLLKQVKALDMEQVRKEVAAKRGEPPQA

SEQ ID NO: 14248 - protein, 240 aa, Myxococcus xanthus
MGIVGHDIRTPLSVVLTTAKSQLASGALEPAQQKAFERVARSGERIQHIVDLLTDFTRSRLGGGIPVIPRAGDLNELCREVVDELQVARPGRTIRCDFSRDSLHGVWDLERMGQVVANLLDNALKYSPEPSAVCLATWEKPDAVFLEVHNEGAPIPPSLLPHLFEPFQRGEDSRERARTSLGLGLYIARAVVEAHRGRLTVRSSEADGTTFRLCLPRRADARLPAGGASDAGTSPAPMTA

SEQ ID NO: 14249 - protein, 33 aa, Myxococcus xanthus
SAALRWRFQPARRGEEAIDVRVDVPVTFVPEST

SEQ ID NO: 14250 - protein, 303 aa, Myxococcus xanthus
MLQLTIYCMNTERRKSRKWWCATLVVWGLAGTACDNVATGDVQVSMSGGDGTQRGLPDTLFQDGWSIQFTRYLVSLGDVTLTSASGETHRSSRHVLVDVQKGDIPLVELTGVPAGRWDVGFRVSPPEARTELADGQVSAEDLAMMRERGFSYFVEGHATKQGEPVLRFRMGFPVNALMNNCINGADGTQGIIVPEGSVARPEVTIHAEHMFYDRLGTHRGVQLRFEAIAATAGEDHVITPGGLATQELTDLRGRDGNELRDAQGQPVIYQPGAFDVRTLQEFITQSVVDQAHLNGGGVCTVVK

SEQ ID NO: 14251 - protein, 431 aa, Myxococcus xanthus
MADGDGSANGVSEDMLRRVFISRPRVDYCKLGPDNNLGPVNVFYRPGDITRVKVAGQVYAAGVTQGGGAGSGLVAQLGYGPADSDPRSDSGWTWVNATYKTDHGNNDEWEADLPNPGTVGTWRVAYRFSISENVWRFCDADGVNDSDEGNLTFSLSKLGTLTVGDEAPKPAVTWCKIGLDRTAPEAINYTTTQTSGLKTVYAQVNLPGVTDREGAGPGLAGQLGWGPVGEDPRTSSRWNWSTQLTFDQDNFEVNDQWKGTLPNPAINGEYRYAVRFNHDGGPIRVCDGNGVDDGGQNFEMDQLGTLNVTGQPVIPRVIGYCKLGPNENNTPQSLAYTTGDAASHVIIASVNVAGLTNTTTGEVAAIVGQLGWGPAGEAPATSDEWDWTTTAQFKGDFWDNDEYEATLPNPGVVGSYRFAYRFQVNGGEFLY

SEQ ID NO: 14252 - protein, 427 aa, Myxococcus xanthus
MAARLSSSDIALGWLVRLRWHAVAGQALTVGVAVRVLELELPVMPLLALVATTAVSNLLLALWLRREPEVRPGLLGAVLAFDTALLTGLLALSGGPANPFAMLYLVHVTLAAIVLGPRWTALIAMLSVLGSTSLFACHVPLPDTVNPPGSHGLDSLHVVGMWVAFTLTALIIGFVVARVAAALRDRHAALARTQRLAARAEKLASLSTLAAGAAHELGTPLGTIAIAANELDALILEAPQEALEDARLIRDEVERCRDILERMSARAGQTMGEVPERTTPSDVLARLREQLGTADQARLQLEPGPDVPFWCPVRGLVQVLTNLVRNGLHASEATGANVVVSAHREEDRLRFIVEDRGTGIPRALLPRLGEPFFTTKPAGQGMGLGLFLTQTYAELCGGRLELSSEEGQGTRVTLELPLRKESSDATR

SEQ ID NO: 14253 - protein, 274 aa, Myxococcus xanthus
MAAIHAGLTLLCMATLYPVLWVVKMALSPTDGLALTANPFPETVTLEHFRQVLSGTDAAGRWVFGRQLLASIVVAGATTLVGLTLAVSAAYALSRFRFPGKEGGMQALLVTQMFPATLMMVPIYSILQKLHLLDSLTGLVLVYATTALPFCIWNLKGYFDTLPRELEEAAVMDGASTFQVFVRVVLPLARPALAVTALFSFMTAWNEFILAATLLNDPSRFTLPVALQRFVGEHKVEWGKFAAGALIVSAPVMALFFALQKHLVGGLTAGGVKG

SEQ ID NO: 14254 - protein, 689 aa, Myxococcus xanthus
MALVQATELFTSKTGVQVELLALPYDAYAAKLTNAIPHGVGPDVFIFNHERLLNFHAMHLVAPASGLAREDYFPNAVEALEVDGQVYGYPMSLKSLALYVNTKLVPQPPETTDALLAMLPALSDADAGRFGLAYESGDFYFHAGFLFGFGGELFDANGRASFDTQGMARSLAFVKDLQDQRFIPQEASGALVKSLFNDGRAAMIISGPWFAGEIAPQVDYRVVGLPAVSTTNIPIRPFLGVETAYVSARSERAEQAQALARFISLGEASRVRAMVGRQIPADVAAYTLKEVREDTLISSFREAARHATPMPNTLEMARVWEPMKLALRAVLQGGTAPQDAGALADRRYRALHRERPPDASPLPWLGLVGAMALGGSVWVLRRPAATLPFKQRYPDVAQAVAYITPAATGVALLVFVPFAVGLSLSLFHHEAGGYAFVGLANFVDILASRGYSITEPLSFYFTLAVTLLWAVVNVVLHVSIGLFLALLLKDPLLKLRGVYRVLLIIPWAVPNYITALMWKGMFHRQFGAINGLLVALDLEPVSWFTRFSTAFAANVVTNTWLGFPFMMVVALGALQSIPQELYEAAEVDGASKWTQFRRITLPLLRPAMLPAVILGSVWTFNMFNIIYLVSGGEPGGGTDILVSEAYRWAFQRNEQYGFAAAYSVLIFVVLLVWSAFTRRLMRSSSEVMG

SEQ ID NO: 14255 - protein, 95 aa, Myxococcus xanthus
EATVLLGLRPQDLRVESQGPLTGTVDAVERLGFDGYAFVKTEAGLVAARFDKGVNVSVGDKVHLAPVADALHVFSKDGAKALRHPEQRAALEIAS

SEQ ID NO: 14256 - protein, 32 aa, Myxococcus xanthus
LQKLATVWPRIAELVKRMANVREYTGQPAEAL

SEQ ID NO: 14257 - protein, 614 aa, Myxococcus xanthus
MSGDDLTLRRTEERANTGRELLQAYAVYGREGIRAYEAEPVSGGSAAAFVLDAAAVRVYPDGSIVNRIHTVQKALEQSGVQEIAEVNVPRGAQVLALRTLKADGRVLEPENIEGKDTVSLPGVAVGDYVEVEYLLAEPPRGPAQPGFTGSAFYFQIANQPNAWVTYTVVAPKGVGMKVDAHGMKVPEPKVDGDLEVFHFETRRVPPFIPEPDAPPSANEYLPFVIVGAGDTGNESLVKLYGDAFQERWLRTAEVDAFARKAAEGKSGLDAVKALHAAVMQRFSGRDASLSQTAASTVAQDRGSRLTVMKAGLDALGIPSRVVAVRTFNTDPSAYTFPQDALLPYAALRVEVPGSEPVWVDTSVRYGPFGELPELAMGGREAWLLPEPGRPLQKVQTPPLKETPGKEVKLALKLAEDGTLSGQGEETYSGFEAAQIAEAFNQLSAESRNQALQGAVARYFGGASLSSVKLENQEQVGAPFVLRYEFTVPRFGRMEGGQRMALGPLTFPAQLGRRFVQLSTRRTPLYIDTTEASRTQVTLSMPKGWKLADPQASLEANNAFGRFTRSEKQDGSTLSVTESLRVPRNRVMPGQYELFSGFTGDVDLIQTRELVLVKP

SEQ ID NO: 14258 - protein, 214 aa, Myxococcus xanthus
MDGYRFINGYWEPDGRMWRWVSGGWARHDSPVVEIPIAVASEELSTQQAPPPLRVEHAPPPPAPSYVWTPGYWYWAGANYVWVDGMWAAPPRPGLVYVSSRWMRRGPSWYFSAGGWATRGSVRVTVPVYRHAHVTVARRHPHYFTHSWRRYPAVRHHVYHPGNHYRRGPGPVRQHYRGNNGNHWGNGNYHRASPGGNGGGGHHRRDGGHRGGRD

SEQ ID NO: 14259 - protein, 336 aa, Myxococcus xanthus
RPPSRDAPAPKPKWGLVIHGGAGVISRENLSPEREEEVRAALTQSLQAGHAVLASGGSALDAVSAAVRILEDSPYFNAGKGAVFTHDGVNELDAAIMDGTTRKAGAVAGLRHVKNPISLARLVMEQSPHVMMVGEGAEAFAKSQGVELVDPKYFYTEDRWQGLQRALEKERSQPQPSSALPAGYDPVSGDHKFGTVGAVALDQTGALAAATSTGGMTNKRYGRVGDSPIIGAGTYADARCAVSATGHGEFFIRYTVARDICARVEYQNVPLPEAADVVINDVLVKVGGEGGVIAMDREGNVAMPFNSAGMYRGYVGEDGKPVVAIFRDAAEAAGAK

SEQ ID NO: 14260 - protein, 368 aa, Myxococcus xanthus
MTNPEAAMNAPEHPPTLTAPASRPVPRFGSQSFLGETWRPWARSHAGSSSRTCWGVHLPSPARAGAATSDRRRSVFFMVSPPYSVRRPQANPFAVTLRGQEAGLFRGRRTRIKCWGVPGGERPMRTASGAQLDFGRLALLALMLGVGWYFWDSPALWPMKVLVVMMHESGHALATLLVGGSVDRIHLAANESGSCLSRLPPGLFAKVAVYSGGYLGSAVAGAGLMLATFRFRLRRWVLGTASVWLTVMGLVYAGDGFTLLFCLGTAVVLALGAKFLPDGVVDALNLFIAAFTALYALFDLRSDLWNSAVRSQSDAALLADLTYVPAVVWAALWSLIAIGLLAVAAYTSLHARPKGLQMPSITARARRV

SEQ ID NO: 14261 - protein, 347 aa, Myxococcus xanthus
VLGYPGMTYRALLAEEMAERQSRLYPRMRDVFGEAIRILEAEGEKDPAGKIAVASQLKGLHNVYKNSGGQLAGLKRGHIVEKQREAEAAVAVWAKKAGAKWQPALDARAALLVEQSAIAKSFDREFLLAASSRLARGPALAVVVSRLAAERAKPDLERRPEYMEREHVRIKDRLERDQKNLFLPAERQLLLAFVRRAQALGAEERIAAVDKHFGKTFSEKDVLAKIDAMYAGSKVLTLDERMKMATESVGQLEARKDPLLAFGLDLAKEQAALDEVKDKRQGAALRLRPEWRKAVLAHAGKPVAPDANSTLRVSFAKVQGYAPRDGAIYTPQTTLSGMLAKHTGEEP

SEQ ID NO: 14262 - protein, 253 aa, Myxococcus xanthus
RCWTVRGLPGPPATTGAPALRGVDLEVRAGEIVGIAGVDGNGQRELAEVLTGLRPLTSGSGALLGGPLSDLTPAQARTRGVGHIPEDRLHRAVVKALSVEENVALGRHTRPPFAKGPWIDFKGRRERTRELTVAYDVRPPDPEVALRALSGGNQQKVVVARELDARPRLLVVVQPTRGLDVGAVAQVHAKLREARDQGTGVLLVSLDLEEVLALSDRVYVFFEGRVTGHFLRHEFDERELGRRMLGTTEPGHA

SEQ ID NO: 14263 - protein, 88 aa, Myxococcus xanthus
MRERLTVRRARTPARGDSGGDEVHRNETNGAGRELEAETPVGATVVLDYNRAYNPTCAFSAYSLCPLSPRQNRLPLRVPASEKRPQSQ

SEQ ID NO: 14264 - protein, 1232 aa, Myxococcus xanthus
MDFPSDERRIQAFWKDRRIFERSLETREDAPSFVFYEGPPTANGLPHNGHVLTRVIKDLFPRYKTMTGHYVPRKAGWDTHGLPVEVEVEKELRIHGKAEIERYGVEPFTERCIESVFRYTSEWERLTERIGFWVDLNQAYVTYHRPFVESVWWALAELHRKGLLYQGHKVVWWWPQGGTALSAAEVGLGYKTVDDPSVYVAFPLRDTPDTALVVWTTTPWTLPSNMYAAVNPGVDYVTVDAGERKLIVAAALREALAKKLKQDLPVLATQKGSDLVGQRYQPPFDLYHQRAGDTRLPLKDGGEDAQAWRVLGADFVTLDSGTGIVHIAPAFGEDDYEAFRKDKARFAQPEALELFCAVKPDGTFSDDVPLVAGRFVKEADKDIQRHLKERGLVLFTEQYKHEYPFCWRADDDPLIQFARPAWYIRTTSVKDEAIANNRAVNWVPEHIKEGRFGDFLANNVDWALSRERYWGTPLPLWVHSETGEVEAIPSLQALREKPGNNVAAVEAELNAFLAGKPHEANARHLIVHKPWIDKVTFEKPGMPGRFQRVPEVVDVWFDSGCMPFAQWGFPHAPGSREIFNRAFPADFISEAIDQTRGWFYSLLMVSTLLFDEETQARMGLSPQRGWPQPYKSCIVLGHVSDKEGRKESKSKGNYTPPEIILDEVRMDFAVLTATEAGVPGEPGVALIAREDLEGLDIQEGAKVQLFRPDRPDVVITATVKAHKKLKRRVLLLAPADLQTLDVAPSERGASVMPVEAPRMAPSERVVLKDPPAKAPGADAFRWFFYAASPTWSNTRHSLSNVRLLQKDFQVKLRNVYSFFTIYANIDGFNPAAGNTDATDSPWEAIRRSQGWREVKARPVLDRWILSEVHLTLRDVTSALDTYQVYDAAQRMVALVDALSNWYLRRSRSRFWAPGFEQDKQDAYFTLYEALTTIASLSAPFIPFFADEMWGNLVRKPWPTTQPESVHLARFPTVDASLIDEGLAAEMGAVRDLVSLGLKVRTDNRLKVRQPLSRADVILARKELTDRVAVYRDLIADELNVHEVRFVEPGSPEADVVRFRVRPNLRAVGGRLGPKLAPVRKAFDTGDGAALHRELLQTGRVAMTVAGEDLVFTAEELETLVEANPGYAAAGMGVGVVVLHTELTESLVDEGLVRELLARVQGARKDMELGYTDRIQLWVDGDARVKRVTDEARELIARETLASSILVGPEGLTGKEEEASINGLPARIRVERA

SEQ ID NO: 14265 - protein, 364 aa, Myxococcus xanthus
MLPSVLSVLLALGVCWALIALTMEPGTATDAYLQMLWGGIGNWPACLDGAAATVITRPLGESAMKAAILTLTGLSVAVAFKVGLFNIGAQGQMLLGAVAAAVVGAQVSLPGVLHVPAALLGAALAGAAWAGIAGLLRIYRGVHEVISTIMLNWVALSLVDNWLVVGPLRGAAEGGQSITGTAEIQATAVLPRLLGEGSRLNLGFPLALAAALAVWVWLTRTRSGFETRAVGLGAEAARAAGIPVARRMGLAMALAGAMAGLAGAVLVLGTEGRYPGTLGAPYGFDGIAIALIGNNHPLGATVSALFFGVLRAGGTRMQLLGVHKSFPELIQGLALLFVAGRMVWLALLRRRNVAPAASAEVPRA

SEQ ID NO: 14266 - protein, 271 aa, Myxococcus xanthus
MEGMMRVGAFCAAVAALTMPTPLAVVMGMLAGAALAGVHGFLSIRWRSDQVVSGIALNLVALAGGTFLLESLYGPNGTPPIQQLTRWNIPGLGAVPVLGALSGHSAPTYLALLLPFAFQGLLTRTPLGLRLRAVGDKPQAVATLGLSVPGLRWGAVLGSGLLAGLGGAVLSTAVLDRFEQHTPAGLGFMALAAMVFGRWTPVGAFLAATFFAFGNALRIGLVSSAPGLVELIPQGVLLALPYLLTLVVLTLQGQRSSAPAALGTPYEQESR

SEQ ID NO: 14267 - protein, 364 aa, Myxococcus xanthus
MERLCSILAPAGYDVLTASGLGAAAAAHQSADLVLLDVERPGTDGLATYRRLQDALGSPALPVLMLTPSADRETRREVLEAGVDDLLITEPLDPLELKVRIHTLLELKAHRERGGQRAEALQDPRVRWVEMERLARVGTLAADVAQNLGRVGEGLQRALEHVRTRALQGLPPDADELKKLGVAGEQMRLHGQHLLSLGTTNPKDIQRFDLRDLVPAVVERMRDAGRLGTAEVKVQLPDEAIAVVFNRRQLEQVLVELLANAVDAVEDVTDRPRRIHVGVELPDIFGDFGPRLYVKDTGIGIFEDELQAVFEPYYTTKAPEKGAGLGLTVARTLVEAMGGAVTVHSRVNLGSTFTVELPEQTSSW

SEQ ID NO: 14268 - protein, 175 aa, Myxococcus xanthus
GHHRLHGQIGWPGISLGLLHGGSERFDIGGKFSFNWGREGWVRYTDPGIKLQAWMRLQLVKERNFSLALTFQPGPFFYFNRHDTDVGLALPVGVVVGIPAGSAVMVNLGLDIPFHVYFGEGIGPVFPVLVGGGLEYFVNRQLGVTFNVRLGPAVIPDIDDTEFTLEALFGVAYRF

SEQ ID NO: 14269 - protein, 605 aa, Myxococcus xanthus
MNLTADPALTSAATGGTVSPRNDATQLVAHGQAYLCGRPLGEILRAIVPSLTEEKLQEALAIQDEKGQRIGEALVGMKAVSEEDVAKALGHQLDLPYLARIFAEEVDAELVKRIPINFAKQSRILPLSLEGDTVAVAVADPLDTAALDHVRVLLGQSVSQRIALGSTITDAINSVYDRSVNETEQLVDEMETQDLDAIAHELDEPKDLLDEDDEAPVIRLVNSVLFRAAKERASDIHIEPMERELLVRFRVDGVLQEVIKPPKRYQNAIVSRVKVMGQLNIAEKRLPQDGRIRIKLAGRDIDIRLSTIPTSFGERIVMRLLDKTATLLDLAEIGMSQKTLESMEAVIKRSHGIILVTGPTGSGKTTTLYGALSKINTPDLNILTVEDPVEYQLKGIGHMAISPNIGLTFAQGLRSFLRQDPDVIMVGEIRDKETVEIAIRASLRVHLELCTVQTNDVAGDVTRLVDMGVEPLLEVCSLTGILAQRLVRRVCPDCRVPFEPTDAELKELGHSVASFKQRYGVDRIYKASGCPSCNRNGYRGRTGIYEFLPVDDDVRQLVLKNVDASTIKRSATSKGMTTLLDDGARKIALGETTIAEVLSITQEDM

SEQ ID NO: 14270 - protein, 418 aa, Myxococcus xanthus
MPVFEYRGLNSAGKQIKGLLEADSPKTLRSKLRADGIFLTDVLAQAEGSRAAVAKGTNAALVARDIDLRKLGRGRVNTDDVAIFTRQLSTLLGAGVTLVESLSALVDQVEKERFKRALSDIKQRVNEGSSLAEAMGQHPKIFPSIYVNMVRAGEASGALDAVLTRLADFTENQARLQQKILSTMLYPAIMMVVGGGILVALMVFVVPKVTKIFETMKATLPLSTRFLIASSNFFQSWWFILLPAMALGVVLFMRWTKSPSGKPKWDRITLKAPVVGNLVRLLSISRFARTLSTLLKSGVPLLAAMDIVKAIMTNTVLAEVVEKARDSIREGESIANPLKRSGEFPPLVYHMVAIGERSGQLEEMLTSVADNYETQVNVRISALTSLLEPLLIVVMGAVIAFVALSILMPILQVNSAIR

SEQ ID NO: 14271 - protein, 142 aa, Myxococcus xanthus
TKRSHRAQRGLTLIEISIAIIIVAMLFSAAVMGIGSITGAKAKGSAGELAGLIRSLYDSAALRGQTCRLVFEIPDPKSEQATRYHAECAEGAVTTARDRDETLRAENSERERAARNRSSGSGRDERRNYLSGGSGTNAPSAL

SEQ ID NO: 14272 - protein, 172 aa, Myxococcus xanthus
ANETQTQKSTGVANDASLSLLDEILSEAKLKPKDEGYDVAKRGVQAFITEMLAPNRSEERVDKALVDAMIAEIDKRLSSQVNEILHAKEFQKLESSWRSLKFMVDRTDFRENTRVEMLNASKEDLQKDFEDAPEVTKSGLYKLVYSNEYGVFGGKPYGIISANYDFNVGPQG

SEQ ID NO: 14273 - protein, 29 aa, Myxococcus xanthus
MYAYYSPDWGYYINRDVCGRNGPLICPLY

SEQ ID NO: 14274 - protein, 164 aa, Myxococcus xanthus
MSKESSVAPTERVNIVYKPATGNAQEQVELPLKVLMLGDFTGQEDARPLEQRAPINVDKANFNEVMAQQNLKVTLTAADKLSADPNATMNVSLQFKNLNDFSPESVVNQVPELKKLLELRSALNALKGPLGNLPAFRKKLQALLADEDGRKALIKELGLTEETK

SEQ ID NO: 14275 - protein, 506 aa, Myxococcus xanthus
MAPAFGPLQDAIARLRAGLPEPEPESVPDGRTASSEDADASQPPVDGTASSQDEDTPSGEDGETVVRAADSANGTRPGAPSDSAETPTNGNGNRSAREAGNASANGKPAQANGAGNSAAPGKGNTAPGNPTAKNAPAPAKISTAQGTAKASAASQGGASANGTPAPPRAAIEVPPLPELPAAPDLSSVEAITDFLRTVGGALLGAAGALRRASPEDPLSYRLNRMGLWLHLTQPPATDGNGRTQIHPLPDLLGTKLETLEQNQRWGELLDESESALARHRFTLTLHRYSATALEGLGAAYAGARTALVQELAIQLRRMTGVETLISTLGSPLTDDATQDWLRDHVLRASAPPPAPSAAVASVSTTLALGPLSLGPSVHADSAALEAEARTLLEEGRVHEAVTRLQAAVAAASTGRARFISRLELARLCANAGQLPLARAVYDALDEEVSAHALDTWEPALAAACLEGWLQTRTEAEKESGPVAVKFRNRYRRLALLDSSATLRVGA

SEQ ID NO: 14276 - protein, 274 aa, Myxococcus xanthus
MEAGVERSRRARVDLPAEPVCFVFTAPGQKQALVGLMAPSQDSVGRAFPLAVFTEVSSAETASRLALTPEAYQPFLRAAGALAQSAAELEVPQLLERVAALPLPGPGDYSLAKRLLNAVLADHHTVDLLGPVVEGTPEGGRYYALHTFLTACAGERGKEQSPAGVTLDCPLTTRVGPVAWLELSSRLLKWTHQPPAFFWSEGEKPRLLISLGAASPALFLALAQPSRPGAQVWPLRTERPAAIDNARKGLTASARQVIDAPSTTLEQLLQTLSR

SEQ ID NO: 14277 - protein, 150 aa, Myxococcus xanthus
PAAASASFLKDLSSQNGTFLNRHRITSEVELMPGDEVSLGNALLRLRGPGGTPALGVPAVSHDEKPPSRGALSTVGVALGAAALGSGVAALIALLSTAPAGGAEHTSPVPPPAAPQHAAAASPTVVASGAPTRLDMEVPAAGSAEKTEDG

SEQ ID NO: 14278 - protein, 151 aa, Myxococcus xanthus
FLGLRLKLPAGAFLGPVLLGIPLTALGLPVGAWPPGLLPLALWVLGVRVGSQFDASAVQELKRVAHVALAASVAMVVGCLLLAWGWSAATGVDLLTTYFATSPGGVDSVLAIALGTRATLSVVLAVQVGRLLLIFLVAPPFLRRLSPARGA

SEQ ID NO: 14279 - protein, 271 aa, Myxococcus xanthus
MEALVSLLTRRSTVVLTGAGCSTESGIPDYRGPGTRARARNPIQHREFLTRPEVRARYWARSLMGWPRFSSARPNAAHAALAELEQAGHVRGLITQNVDGLHHAAGSSRVIELHGALAQVRCLACGAQEAREALQARLLSLNPGFSLEVLELRPDGDADLTSEQLSSFQVPACLVCGGTLKPDVVFFGDNVPVPTVASAFALLEEGDALLVVGSSLAIFSGYRFLVRASERRMPIAILNLGECRGVELADVHLEARAGDALPRLAAALARS

SEQ ID NO: 14280 - protein, 320 aa, Myxococcus xanthus
MSSPTESAVHPRRFHAESLVHIHRHLLASLRAGPVTIEVPDPDLGRGCYPGERVGPSGALLHRPLRSWCDLAEGLACRLLTPRAVDATHIALTFERLGPEATWHAGGQADEAVSLQERYGAASAFARLRKLEDAGFLLPWLEALGRIRLPESGRVLDLGVNRGDELAAFSWLEEAPDVRFVGVDHSASAIEEARARFPDARHRFVVADLNALPEDLGRFHLVVSVGTLQSPGVDDHALLRRLVQEHLEPRSALLLGFPNSRFRDGEVVYGARVRNLREPDLSLLVKDLSFYRRYLHQHGFRTFLGGKYDLLLTAVRGASD

SEQ ID NO: 14281 - protein, 200 aa, Myxococcus xanthus
MNTSLRLKLLGTLVAHDSQWSLASVEDLDAKRIRSVMTGDDLQGARVVSIERERITFLMDGQEEFIRADRHGGVSHAPFLANAAPAHTGVRAVGAHTYEVSRRAVEDALANMDGLLTQARVVPAFRDGKPQGFKVFSIKKGSLYEQLGIQSGDVLRRINGVSLDAPDRALEAFMLLRGASHLELDIERGGSPVRKVYDVR

SEQ ID NO: 14282 - protein, 125 aa, Myxococcus xanthus
MAEAERYLPTFVGRLEDRLRAHGLQDANLLLRITGCPNGCARPYLAEVGLVGKAPGRYNLHLGGDARGQRLSHLYRENIDEDAILAALEPLFEGYARERQPGEGFGDFVVRAGHVPSPAVQPRPS

SEQ ID NO: 14283 - protein, 672 aa, Myxococcus xanthus
SGTSPAIKQAEAALRAEEEKFRSLYRYTPAMMHSIDAEGRLVSVSEFWLRTLGYSREEVLGRRSVDFFTPESRRYATEHVLPVFFKTGVCKDVPYQIVKKNGEVLDVLLSAISERDASGRMVRSLAVLTDVTERKRAEDALAESEKRLRAILDNANAVFFILDRQERYIFVNREWERLFHRTLQEVAGKSTADIFPGPQAARFHETSQAVFTTGELVQREECIPLEDGVHTHLTQKFPLIDSSGTLYALCGISTDVTELKQMELGQRFLSEASQALVTSLDSETTLQRVAELSVPTLRELCVVSLLGKDAALRPVAVAASSPEGGRTVREFLQTHPPVSGPRDGPYGVLETGHSESSPDAMGLLDPDGLRDERWSAVRALSARASLNVPLRARGPILGVLSVVAAHPGRPYGPRERSLAEELGQRAAFAIENAELYRKAQESIRARDEFLSIASHELKTPVTSMKLRVQQLTRTLSRQESGQLPVEKVAALLDVFGDQLRRLSHLVEHLLDVSRVNERQVDLRLEDMDLVAVARDVTGHLRGQMGRAGCVFELVAPTPVLGRWDRLRMEQVMINLLTNAMKYGAGEPIRMEVSRVGEGARIRIQDHGVGIPLEAQPRIFDRFERAASRNYGGLGLGLFITRRLVEAHGGTIRVESQPGKGATFVVDLPLEAR

SEQ ID NO: 14284 - protein, 148 aa, Myxococcus xanthus
ALKSLLVAAFALYEEARMAPTPAARDALIAMGNNYIAWREQHDMAQPVFSPAVQRPDEVSRVELLRAITPLLSTDFGTMTWTYADFAYSRPDRDGNPLTSPPTEYNWALFWDRWTGILFAFDAAYLQPTALWVMPEPLVDPTAAANGG

SEQ ID NO: 14285 - protein, 189 aa, Myxococcus xanthus
MDGTQEFVNRNGEFAIHIGLAIAGKATLGVVYRPVGDTLYWGVVGQGGFVEHAKGRRALRVSDTAEPSALRLVVSRSHRSRLTDAVVRRLGITHEQACGSVGLKCGLLAEAACDLYLHVSDKSYRWDNCAPEAVLRAAGGILTDLGGTPYAYDGSELQNRRGLLACNAAAFEHVAPVVAGFAREAGILR

SEQ ID NO: 14286 - protein, 315 aa, Myxococcus xanthus
MPHIVTLTLNPTIDVATSVPEVTPEHKLRCGPVRRDPGGGGINVARVVRELGGEAIAVYTRGGATGSQLEELLEEKGLLRRSVPLQDATRESFTVAEGTGAREYRFILPGPTLSEREWQRCLDALEDVAVGATYIVASGSLAPGVPEDFYARVARLGKRLAVRVVVDTNGPPLRAALEEGVFMAKPNRRELRDLSGASVEDFATQAAAARELVAQGRAEVLAVSMGADGALVTTRTAQFRATPPPVRTYSSVGAGDSFVAGMTLALARGQSTEDALRWGIASGTAALLTQGTDLCYRADVERLFTQVKAEPVSRP

SEQ ID NO: 14287 - protein, 79 aa, Myxococcus xanthus
TRGTDSGGQNYQRDNIARQLTQWESYGVTTVTSLGLNTPLIYELQKEVEQGTLPGASILSGDPGIGVPEGAPPMKVVEH

SEQ ID NO: 14288 - protein, 186 aa, Myxococcus xanthus
MNVSQLLLERGFETATVSEALGQVGVALDVDRVYIFENATSPTGELLCNQRYEWTAAAASAQLDNPELQNVPYSEVMPSWVAPLSSGKAVQGPPRAFPSPARELLEAQDIRSLLVCPITVGGEWWGFVGFDDCRTERKWPPTEVSVLQALSNALAGSLRHARLRSMLSGVQSQLRTIIQRCETTAS

SEQ ID NO: 14289 - protein, 166 aa, Myxococcus xanthus
MPDVIAPRLRVLFCGINPSLYSAVVGYHFARPGNRFWPTLHAAGITPHTFQPTEQEALLALGYGITNVVDRATATADLLNPAELARGAKALEAKVARYQPRFLAVLGVSAYRIAFGRPKAALGTQPERLGDTRLWVLPNPSGLNAHYQLDALGRLFAELRRAVEQG

SEQ ID NO: 14290 - protein, 300 aa, Myxococcus xanthus
MTLEQLEHFRRLSHVTRDTLIGDAQVSCVDYSIPGYQGAEIVVSVIARQGHSVPGPAVYHIHGGGMVMGTRFAGAKPLVEWALRHDAVCVTVEYRLAPEHPAPTLVEDCYAGLAWMAAHADMLRFDPNQLVIFAGTAAEGLPAATTLLARDRQGPRLLGQLLQCPMLDDRNETESAHRYDGVRVWDRTSNLTAWRAVLGDLCGGPEVSPYSAPARASDLSGLPPTFIDVGGAETFRDEAVAYARGILAAGGECELHVWGGAFHGFYDIAPQSDLARACIAARDAWIARMFARGAMSPCPP

SEQ ID NO: 14291 - protein, 115 aa, Myxococcus xanthus
MPGSLSYSGKVFELFASDGTPIDGVPFVRASGEMPSNIVAAVQRLQADRVWDPTPCVHDLQTGFARDRYCRNIAVDWSNMNADANVMRIAGDSPLTTPGTRTQWSSPLPSRWGTY

SEQ ID NO: 14292 - protein, 129 aa, Myxococcus xanthus
NSARAFVDLLGSVIPAQRAAPVAAARHYNIESLGPSNAMQQAAHAREVLPSLLGLLTDERMARCVDEAFREIFQGDRWPRGPERSKWLGFARELRANDPKITAEQVRSAIANELRLERDGLDVATVENI

SEQ ID NO: 14293 - protein, 161 aa, Myxococcus xanthus
PNGEHIDQMKALVEGLKKNPDSRRHIISAWNVADLPSMKLPPCHVLFQFYVANGRLSCQLYQRSADLFLGLPFNIASYSLLTMMVAQVTGLQAHEFIHTVGDAHLYLNHVEQAKTQLSREPRPLPRIHINPEVTDLFAFKYEDFTLEGYDPHPAIKAPVAV

SEQ ID NO: 14294 - protein, 159 aa, Myxococcus xanthus
MKLSAIVAMAANRVIGAGNQLPWRLPADLARFKRITMGHTLVMGRKTYESIGRPLPGRTFIVVTRQRDFAPPGVQVAHSVDEALSLAKASGDSEVFIAGGADLYAQTMDRVQRIYLTHIARNFPGDTWFPDVDLSGWTCVEEQAHPDAEPPHTFLTYER

SEQ ID NO: 14295 - protein, 417 aa, Myxococcus xanthus
MTALTTREGGRFLAELPSRTWLEVTVRVVGDETWVLATDITQRQHAENEVARTEERFRQLGERFQVALDSAQMAVWETNLVTGQVFRSEAHDRLYGYAQPQAEWTHEKFLASIHPEDRAEVEAQVAALFTRHVDAYTSTFRTRWPDGSWHWLTSRATVIRDATGNVVVVRGAILDITALKETEAALQQAVRTRDDFLSMASHELRTPLTSLRLQLQLLRRLGASTPGATLGSDKVAGKLDNTERQLRRLGALVDNLLDVSRIQTGKLDFQFADGDLASVVSDVVSRFAEEARLAGVRLDSHVDAPAPCRFDRLRMEQVVSNLLTNAFRYGTGKPVKVSLTYAPDRTRLVVQDSGPGIPASDRDRVFERFTQGDNAQRRGGLGLGLHIVRQIIDAHGGRVHVEETPGGGAAFVVDLPR

SEQ ID NO: 14296 - protein, 62 aa, Myxococcus xanthus
MMACGGPVEEAPVDETGSAAQELRRCDLQGRCAANEVCVGGPDGICYPCNRYPQYCEIIIEN

SEQ ID NO: 14297 - protein, 617 aa, Myxococcus xanthus
MTRAASLLLFLLLALPIASRADDGASEERTWHRLIGILQYLEADYPLAIESQSAFELAEQKSFAAEAVDAARGLGPAAAAFLPRVQDIQARVDKGEDPDGVSRECGELVENLVTAGGLARSPRRPPDLALGQSLFATNCAACHGADGSANVAIAANMEPAPANFQDAELMEGLTPYKAFNTTSFGVPGTAMPAYPTLSEEERWSLAFYVFTMRLPECEGTPPRVSLERLANATDADLVKEFGQENLACLRRKMLDADEERSLLAARENVQQAMRLGAAGDIAGAKAALLDGYLNGVEPVEPKLSARDSALTLKIEQGFLKARMAAERGSPHLQDEGRELLALLDQARRDSGTTASLLSTMWLTLLILLREGFEATIIVAALLAALRKMKATEHARVVHFGWISALIVGALSYVLGRHLLAGAQREWMEGIAALAAVGMLVYAALWLNARSNISQFMGELREKMQGALGRGSMLGLFLIAFTAVLRESFETAIFLQGLALDSPQGVAWGALAGAVAMVVMVLFINRLGYRLPMKTLFNASTVILVLTAVMLLGKGLHSLQEVGALPLAPVPFITVDMLGIYPDALSLAPQLLLGGIPLAIVLLRRKGRPQPVSEASAG

SEQ ID NO: 14298 - protein, 153 aa, Myxococcus xanthus
LVLSGQNAAWAQELPASEPARAPASELTPPPLVPAPGGWDAPTRHDEDAGDDSRTSQETEGTTSVNEQALPGKARARATDPVPRVAVEFLGGAGGGIIAGSLGLITGFFVGASTVGCDECGIVASVGGLTGVVVGIPAGTWLGGKLMGGRGTF

SEQ ID NO: 14299 - protein, 1270 aa, Myxococcus xanthus
RLLHVEDALESSGALAERPAPAPEALAWLLPVGANQSPWALVHQGLTELFDALDMRLRPSEGATWVAAAESSAERPELEALWALSRGLTVTFPSEQVTAQWEVLQGGGPRQGAMDLSLIYFANDEDSLVGPKYELLIEGAKYADANGFSAVWTPERHFHSFGGLYPQPAVVAGALATITRNLSLRSGSVVLPLHDPLQVAEQWSVVDNLSGGRAGLSIATGWHVADFTFAPQNFEDRRNVLLRNLETVRALWRGEKLRRPGGGGVTVEVGLRPKPVQKELPVWLTAAGSPETFRLAGEVGAGVLTGLLTQSLEELKQKVALYREAWRRNGHPGRGHVALMLHAFIGDDEQEVLRTVRKPLLSYFRSSAEITATLLAAQGYQGEIDKVSEEDVNALLEHTFEHHAKGTGLIGTVESGVQRLLHVREADVDEVACLIDFGLDTPVVLEGLRRLTVIRERLVQDASQRKVQRQAEGTLAVDELLALARQSGAVLLHASARLARTLVELPQAREALEPVGALVLDGASAELALSLHRNLGTEVLLAGAAGEGGLLPRPPSERVPEGLQSWVLDAAGLPVPPGVVGELALEGAGLPWDLWRANEQERRRFVQHPSSSSARLFRTGRHARLRVDGRVEHVTLPAAPKVQAPVAAQKPKPKAPSVPALQPEHSAIPRVPRTRPLPLSFAQQRLWYLQQLDPSSTAYNNGSSFRLTGPLNVEALQAALNEVVQRHEVLRTTYQLTEEGAVQLIHAEGSLPMPVEDVPGETPEAREAEMLRRCAALGALPFDLDKGPVARAVLLRMGLEEHVLSLMQHHVISDAWCTLVLGRELSVLYACFSAGIPSPLPPLEVQYADYAVWQRQWLEGAVMEEQVRWWKERLTSVPALELPTDRPRPAVQSYAGGSFRFELPSDVSEPLLAFGRREGATSFMVLMALFQALLGRTAGQEDFAVGIPTAGRSRPEVEGLLGCFVNTLALRSRLEGAPSFRELLGRVKSQSLDAFAHQDAPFERIIEALQLPRDQSRTPVFQAVLNVVNTPTVDVAHQSLKLSQLGIEADTSKFDLSLEIVERKNTLFCRFEYASSLFDGGTVQRLAGHLIELARAVIVTPDLPLQRVAILSEDERRQVLKGFQGREMAPASEASIHALMEAQVARTPDAVAVAFESERLTYRELDAKANQVAHHLRGLGVAPESLVGVCLERSVDMVVALLGVLKAGAAYVPVDPAYPKERLGWMLEDTGASVLLTHEKWKTVLPPSAARVVCLDSAAGEVAKQPVAKL

SEQ ID NO: 14300 - protein, 191 aa, Myxococcus xanthus
MAATLGLMACARQVPASATPTSTSTEPRAVRLLLDTPARETHTLTRLREDIEVDATEGERTPRVVATGQTPTLSLDGHRARLYGDAKGTLGIAVDNFLLLEVLDASGQVTRRATVGFTEAVHMGREQVDSVGRRAFNFEAGEVDITHLLPDSAPFQVRATALDTWGVGRVSDVYLLLAPGSRADNDDLRDQ

SEQ ID NO: 14301 - protein, 180 aa, Myxococcus xanthus
MHRALPTLALHLSVLSLTACSAKAPPRTEPVPPPPPAVKIPASCEQNQGGEYHHAGNPAFRYYGDDDGSTLSLAVVRAHDSAAVDAPDAGSPSIVLRRTPAGFVGETRATGFSGAGTPCPVTFPTEVVRCTDAGLTLRSAASTSIDEDCRTAPSGAPSVRLEQVLLRGPPDAGTSPDAGT

SEQ ID NO: 14302 - protein, 271 aa, Myxococcus xanthus
GEVPERDGRVRYAFAAAAVRDFPLFVSRGYASSTATVNGVTVESHYAAADQAAGERVLKYATSMLAEFERRLGPLPYTHFRVVQAPLSGGAGGMEFPGLVTIATQLYRGAAGASEMLGGSMQGMEDLEAMLGMLGQSGGGGGVLGQLNGAMERTLEFTVAHEVAHQYFAGLVGSDPILEPVVDESLAQYAALLYLEWKHGKKVAESVRQETLVGQYHLYRMTGGKDGRADRPTGHFADEMEYGALVYGKAPLLHHASRKLVGDAAFLKALR

SEQ ID NO: 14303 - protein, 176 aa, Myxococcus xanthus
MVDGQQVGAVPQANVLLRPGSREIEFRAPGFKPDVHNITVFAGRTYEVTGNLRPLLDTSVATADVPKNPVLEPSSKLDPDDETAPGLSFAGDPETPEVEGSKPWYGRWYVWAGIGAVVAAGTVGAVMATQGGGASPLSPDDVCRPANCDAVLGGIRSVRGGGVRLQAPPPAGAIRF

SEQ ID NO: 14304 - protein, 353 aa, Myxococcus xanthus
AAPDLTVFEVLPILTSVNADAPIPGLFDFIRRRPFVYESAVLKHGERRVDLRGAQLSRLTLDVTGVHELYLNDGLEDLSLVGQPDPALKIHGEADGRWLTLSLGAPDMPWSGLDTLDSLHLRAARDVDASRIVRRFPNLTELRIWGAPGYLRNTEELAKLPALAMLTLSDLFGMSPDEFPGPEQLPHLGMLWLTSIPADVAAQVKKAYKAAAREGLDLSVRQPRKADWLAENLDNPFRVWDGADNISPAQAKKASALYRQARSAALKSVSEGDRSPAALVSALTPIVTAYTDGFNKLDARHTFIFTEEREQIYLALMGIFDAVDEKLRSTEGTPAEPLNRDALVSVMDSIRDF

SEQ ID NO: 14305 - protein, 253 aa, Myxococcus xanthus
MRTSLSFASLLVASSLTVGCLGPETDTDTDAVQSIEQQATDPLFRVHNIVEAVLPAANYDGVAGNECIALVNPEHRLRKIIIVETAGANGACALNAYSAGGALSFTWGDTAVYQGPAGIASIRAALSDTDGAVHRLTGTLTSEATTLAHLQSFLTQTNTQQASQLATFTAERVHSRYDFEGQEQVYAEAAYQAVRVTQPCENPGYPTLEARVHNGFVYGYKASNTGSCRSGWFPLRYVYNRNWQLVDSYEYSE

SEQ ID NO: 14306 - protein, 153 aa, Myxococcus xanthus
ALMGPLAALGDGFFWLSLKPATGRVSAALVPLLGVWAVPLFLVLYNLVHLLLRVRLYWLGLTLGDRLVEAVARANLPARGAWLRAVAAASADGVAAWLAVSFGANAGGLYAPLLAAGCLALGVASYVLVSRRVPNYVVLYVAAGLACVAGAFL

SEQ ID NO: 14307 - protein, 92 aa, Myxococcus xanthus
MASVVEGTYEIINALGLHARAAAQMVKVANRFKSEVTIEAQGQRANAKSIMGVLMLAAAQGTQVKLTCKGDDADACLQELAKLIGDRFGEAQ

SEQ ID NO: 14308 - protein, 271 aa, Myxococcus xanthus
MSLKGIGQETVDIIERGQYLAPSGQCVQLGEAVERAVSGTELYRPGDFSRLSFPTAANPSAPRIEVTAEKTGAAARRLVEAGASHVAALNFASAKNPGGGFLGGAKAQEEDLARCSALYTCLLTQREYYDVNRAEPSPLYTDHLIYSPDVPFFRDEGLTLLEQPFHVSILTAPAPNAGVAQSRDRGMGGRIRKVLDERALKVLRVAAHHGHRTLVLGAWGCGVFRNNPVEVAEAFALGLGSLPGAFDRVVFAVYERGGDGPNLRAFQARFG

SEQ ID NO: 14309 - protein, 568 aa, Myxococcus xanthus
MRMKTAIDLSDRQLAELKEQITRTEGSDHALILEAHRLMLHDPMLVDEVNRLIIEDRINAEWAVRRVARKIKHLFDNIPDEYFRERRSDVDYVADRIIRNLMGQVVDEEVEVPAEAIVVAHDLSPADAALMARSGRVGGFVTDLGGQTSHTAIVARARETPAVVGAGRASEQISPGDLVAMDGIRGVVLVNPSDEQLAVFREEQRRYQESERLALATKDLPAVSTDGFQIRLNGNIEFLEEIPSLLAHGAEGIGLYRTEFMFLDRKTAPTEEEHYRAYRQVLEAMGGRPVTIRTLDLGGDKVPGKTKHEKEPNPAMGLRAIRYCLSNRELFRTQLRALLRASVHGNLRLMFPLICGVSELREARSELEACRTELGRAGVPVGKRFPVGIMVETPSAATIADRLAQEADFFSVGTNDLIQYSLAIDRQNREVAYLYRPLHLSVLRQLRGIIDAGRAANIPVSMCGEMAGDPLYTLVLLALGFDELSMTSGQIPVVKRFLRRVSRVDAMELLQNAMELTTAEEIERYVRTEMDRRFSETMEPGAPGVGNAEPADHEPSEHGASPSGRNTA

SEQ ID NO: 14310 - protein, 138 aa, Myxococcus xanthus
MTARDRDGEKVGTIIAADAAGFFIGRGRLFMRDCRLSFSDVADIDGEDVYLREELSHLPDLKPEALAPARRTSTTAGLPLQHDLTGGLGWADDDTDEEAQVSSPARESSGMQQWASGEGEAAPRREAPSADARRYTRH

SEQ ID NO: 14311 - protein, 101 aa, Myxococcus xanthus
MAKKSKVARNAQRKALVAKYAKRRAALKARIRDRTLSYEERRAAQDALASLPRDSNPNRVTNRCALTGRPRGNLRRFGLSRIAFREKALRGEIPGVIKSSW

SEQ ID NO: 14312 - protein, 36 aa, Myxococcus xanthus
MNRFVKLRVSTHGIRIINQRGIDRVVRELLAEGVKL

SEQ ID NO: 14313 - protein, 288 aa, Myxococcus xanthus
ARRHRARVRGPTRRPAAGNRLHHPGRGPRGDGPAAGGLSAHARGAGARTPTLGAAGRPIPRMAGAADGRTRRGRGARLMQPALRALAPPAHAFVWTPEALAGIYREDLNLCVWRRGLDTPLAHWLSDVAATRELDVIARVRGDAPDLRRRLDGLPQGPPFEAWLTDVHFLLHLYADLFGAAELGVRLHILASDMCPRFHVDRVGVRLLCTYAGPATEWLENAHVARGALGASGDVTRPGAPVHALERFDVALLKGESWPGNQGNGAVHRSPAIASSGRRRLFLSIEAL

SEQ ID NO: 14314 - protein, 49 aa, Myxococcus xanthus
ARPTAEPGDTRTAAARLYAAARELGVGSLILTPLVARQRTLGVLTLRAR

SEQ ID NO: 14315 - protein, 157 aa, Myxococcus xanthus
MSRALERLSAAPPVVAVLEELLCQASATLGASGAFLCWWGGTGDVSTLAKHGVDAQLAAIWAQQLLAQAPAPGEPRLPRVVEHVSRDALLASEPDALRRLGATALLSQPLFFASGMGAAGVLGVLFREAWQPREEDLRRFGLSVKLQTLSLKRERMA

SEQ ID NO: 14316 - protein, 373 aa, Myxococcus xanthus
MDAAEPLLFDKAYVLCYRTFDIAEELDLERARRVLTEDSRRLKLSRENSQYIQLPNPPLAYELGRRPLALRDGPVMVDVTARLFDHGAVSIILQVPVVPGTSLKALTRMADELYDSQALEDLALELVEGVRRTIAPAAQAPHLWEQNESYTVIFAEHIRGNPTADELVTRADLARLLLGESGTVPLSPRESESVLQSRFSYTIQDLVVIDWNSAFVYEPSGSRDIPDLLEIANAQLLEFRYYDERLDAHITRIHEKVQAARHGWATLFRSPYRSLARQTLSTLVDLNEFIERVENSLKIIGDFYLAKVYESAVRRMRIPPWQAAVTRKQQLLAQTYGLLKGDVDIDRSHTLEAVIVLLIVLEIFFAFFRVFEH

SEQ ID NO: 14317 - protein, 195 aa, Myxococcus xanthus
MLFKQWSELETLTPNEYLEFRDTLGSFSGFQSFQYRAVEFLLGNKDAQALMPFRHVPAIHGELERLFESPSLYDEFLRHLSRMGHPVPQSHVQRDWRKPYEKSPEVVEVFRRIYQDAEAHWDAYEMCEKLVDTEERFQLWRYRHMMTVMRIIGFKQGTGGSSGVGFLRKALDLRFFPELWDVRTELTPPPPRHRP

SEQ ID NO: 14318 - protein, 130 aa, Myxococcus xanthus
MGTFFVLSNFGADFGGFELQVMQDSGFALDDWSFREGQGWNRQPEPVRLGMEAGRWVCLEWEVRRDSPSSTHGNTRVYVDGTLAHDFTNIGMRAFNNFSVGYGFVHPLGASGSETWIDNVVVSTQRVGCD

SEQ ID NO: 14319 - protein, 169 aa, Myxococcus xanthus
MIRNEIEVQLKPLRDVVARLEEGTADLDALRNVAERLAPLAEVVGPLFGAQIPAAAKAGRRGPGRPPAARSAVTAAPAAVGGKRRGRKPAAAGADGSRACAIIGCGKPSRTKGYCAAHYQKLRMLEKTNRRPSDWKDYADPDSVDDIKLPRGRAASKALAAAAQAGHAG

SEQ ID NO: 14320 - protein, 361 aa, Myxococcus xanthus
MAEAGLKRTTPLATATLVIGANLPDVDGLVTLAGSDASLYWRRGWTHGVLALALWPFVLTGLMLLWDRYVRRRRHPDLPPARFGPLLMLSTLSVLSHPALDWLNTYGVRLLMPFDGTWFYGDALFIIDPWVWLLAGAAVIMADARTRRSAAGWVVLGVASTALIMVPAFVPWPAKVMWAVGVAAIVWLRLRGTHVLSAQRVARVCGVGLLLYLSAIFVGSQVAAPGALEWLRSQNLPVERAIAGPLPANPFVRDIIALGPDRYHFVRADFLAGDAGRFRISDASVPREAQPGPVIQAALSAPQIRGLANWLRLPTYQVDERADGWRVTIRDVRYSRMQSGGLGTAVVVLDGALRPVRVERP

SEQ ID NO: 14321 - protein, 303 aa, Myxococcus xanthus
MKRLGAAVLVMAVGCAPLDVERRTERGPLLRTYAQEKALNERIPFATTQVQWPQLTLAFSSSDICRTEQHGEYAEDIISTHSNTGAAAAVSTGGILTVLGGTLLVGRTLFSDTPNRSAIDEKGRYGASSRDVATGWGLGLLIAGVPAVVAGIVQLSRSGETRETRKTDELLSLREVPCQPKPVDGVVELAGGPGPQPPPRLTLNGALVLTADEIRQLSFVGLALDGTPVTLEEEDLDRLETFRTCATLLATPVDPQALAGEARSQPDRLRMKRELARGCTTLPGAPAQPLLEAIEGALGSTAL

SEQ ID NO: 14322 - protein, 46 aa, Myxococcus xanthus
LAYLRATGRDPSPLVERIGLPANKSRLAEVTLPVAPLAAFLGGGGA

SEQ ID NO: 14323 - protein, 288 aa, Myxococcus xanthus
MSQTYLSLTVELPEEASEAVQDLLHESGALGLEVRDREAPLMPGVRGPNPGEAIIIGYFDERDTAESARDEVASSFPEAKLTLDEQPQQDWSNEWKSLIKSVHVGRLWVGPPWDKANAPAGTVQLVIEPKMAFGTGDHPTTSLCLAAVDAYMAEHPGAAVLDVGTGTGVLAIAAKKLGAGRTVATDNDPISVELAQENQAENGTPDIEVSGKELTQVEGTFDLVLANILANTLIELAPLIVAKTKDRLVLAGVLSHQRADVEAAYRNLGLTVLTGATQGEWVRIDLQR

SEQ ID NO: 14324 - protein, 126 aa, Myxococcus xanthus
MAYSVSSFAIEGVDPGYFATYMGTSPEKVDAALAGIRAELERVRDEPIPAEELARAKQHLIGTHEIGLQRNGSRAALLALDTCYGLGLENFLHYADHVAKVSADDVREVARKIINFDRSALAVVGP

SEQ ID NO: 14325 - protein, 61 aa, Myxococcus xanthus
AIAWIYGGDLSDAVRARTADVSAFMTVPSLERPAVVLAVPPVPALAFVVALLKRKKKASKG

SEQ ID NO: 14326 - protein, 427 aa, Myxococcus xanthus
MRLDALSRLVRLSLARERKGAFFSAFGVAMGVGALVFFVGLGLGVGRVIREKVFPTDARLVDVVPPAVSLGSLLGGGKLDAPTVERLRELPGVEAAYRKMNVRVPAVTRYDGVFFGTRLRMGMEVLALGVEPALVQGDVQMGEFKDAGEGQPIPALVSTRLLELYNKTFAPARKLPQLSANMLVGFGFPVEFNRSYVAAASASGPTQSGQAQVVGASDRALLAGITIPLDAAIRLNRAFGVDSENYSGVTLVATDPSQVPVIVDAVKGMGLEIDDQERRMAENSGAAVALTTSALALLSLLICILAAVNIAHALSASVRARAKEIGVMQAVGASRADIRAIVLAEAAVVGLAGGAAGTIAALLLALGVNRLAAGYLPNFPFKPDSFFSFPWPVVAGGVVLGLVAALVGAYFPSRRAAATDPARTLAG

SEQ ID NO: 14327 - protein, 31 aa, Myxococcus xanthus
MSAAAGRVLRLKDGQLVEERAGLQVATGGAP

SEQ ID NO: 14328 - protein, 336 aa, Myxococcus xanthus
MAASLQRLPAQRDFHVWLPGGAGLVPPGTVQGVTLTGRIEDRAVTLNADAPWPDTQASLAALDAVAPAASTLLTALPADSFLVAQFRGDASHLDGVWPYLAGGYLTRAVQNSGLNVKTELLDNLKPGTVLGLSLSPTVNLGAGMPVLDLRRTNPFRFVHLVALADAEDAAKMQSTLEQLPRIAENFGAKVEASELSGQRVYLTSYRAGEGAHFALAPNGRLVVASPKARLESTLTSLAKPSGDGPVAADLKDAGKDAAFSAVLDLRRLSDAVKNLPSEAWGIGGFAIKATTVRWLEAVDDLRAVTLAVSRKDKALQAELSLRLAPSAATSSPSAAP

SEQ ID NO: 14329 - protein, 121 aa, Myxococcus xanthus
AVRLDVGFGFYHQPRGTAGPLGLDVMELFRVPLADMPLVASVNRRAWDADADFEVTSEHVWLSKAGRAKAIELYERRKRETWKNNVLGYSLSYARLVELEVRLLEKEWTGKPGLFATFRLR

SEQ ID NO: 14330 - protein, 91 aa, Myxococcus xanthus
AWTSSASGWRASNLSGESREVVSHQLAGIEDLMRLTHEQSVAIRDPEVVNRQLTMLSAEAEATEESVRQMEQFLEFSEETRGPLPHGSRVR

SEQ ID NO: 14331 - protein, 181 aa, Myxococcus xanthus
WAMEARQVCWAHLLRKVFSFSERDGPAGAIGRELLDYIGILFDYWGRLRSGELQRDTLRERMASVRTQVEALLERAVAARLPHVSGSCEDILQHRAALWTFVDREGVEPTNNHAERELRAFVLWRKRSFGTQSPRGNLFAERVMTVAHTARKQEKNVLEFLTACCTAARTGMPAPSLFAAP

SEQ ID NO: 14332 - protein, 1484 aa, Myxococcus xanthus
RAALVSGKLPIVWHSGTGVISGPASLPAPAPAIQPALSQEELETALREELVAVLGAEAVGQDASTPLTLLGLDSLGAADLQGRVEKRLGVRVSIAALLQDLSLRSLAESVSAEGTGRRLPPLQRRPAGDAPTPASFTQERLWYLLQLDPSWTSNQIPVALTLRGTLDVAALERALSEVLRRHEVLRTRFASRDGALLQRVQAAGPVSLPCLDFMGVRGDARQATLEAQAVLDAQHPMDLEAGPLVRCSLLRFGPEDHVLLTVLHHLVVDGTSVALFMRELAALYGAFVEGRPSPLAEPEFQYGDFAAWQRAYFTPDALTTELMWWKETLAGAPQLLALPTDRSRPQRLSVHGARRLRLLPASLMARLHALGRRQGATPFMSVMSALATVLHRWSGQSDFVVGTVISGRDAAGTRELMGDCTNFIPLRVRLSEAATSADMLSEVKSRMLGALAHGYVPFEQILAAVQLPGAERRELYNVGFILDDYELPRALSVRGGLTLDVSLVDNHTAELDMTFEATHRPEGLLIGCKYSADLFDAETADRLLSHLEHVIRGMVDAPEAPLTTLPLMSEADRQHALHGWNPRVEAPPFGTLTDLIEAQVERTPDAVAVAFESERLTYRELDAKANKLAHHLRGLGVAPESLVGVCLERSVDMVVALLGVLKAGAAYVPVDPAYPKERLGWMLEDTGASVLLTHEKWKTVLPPSAARVVCLDSAAGEVAKQPVTKPAVQVGPQALAYVIFTSGSTGRPKGAMNAHEGVVNRLKWMQEEYGLSGTDVVLQKTPFSFDVSVWEFFWPLLAGAKLVVARPGGHQEPAYLVKLMKAEGVTTVHFVPSMLRAFVEEPGLEGLGSLRRVVCSGEALSAELVKKAYARLPAPVRVHNLYGPTEAAVDVTYWPCPRGEDFHRVPIGRPVANTVLYVLDVHGQPAPVGIPGELHIGGVQVGRGYWQRPQLTAERFIPDAFSGIPGARLYRTGDVARWLPDGTLEYLGRADFQVKLRGFRIELGEIEAALAADPAVHDSVVLAREDSTGDQRLVAYVVLDDAAAAQEVDASSQWQAIYDEAYARETTESEDPTFNIVGWEDSYTGESLPPAQMREWVDTTVAQILSFQPKRVLELGCGTGLLLYRLAPRCEAYWGVDFARPALDRIERQRERMGGALDSVHLLHQSVDDFSALEPGSFDTVVINSVVQYFSSPEFLLDVLRGAVRVLKPGGRVFLGDVRSLELLEAFRASVRLHRTAGPGATSQFAYRVQRDILAEKELVLSPAFFTALPERIPGIQRVEVLPKHGRYDNELSRFRYEVILHVGDAARTPARRTKPDWVDGAGLTLDGLREQLSARPGLLAVRGLPNARVLEPTRLVELLSATPPPTVARLREALHDWSGPRGVEPEDLYVLGSELGYEVRVSWASAHRDGALDVVFAHPDEVGTLDLSPEPKQVTSWDGLASDPLRGARSAQAVSRLRDALADKLPPHMVPSAFVVLPARRCL

SEQ ID NO: 14333 - protein, 210 aa, Myxococcus xanthus
NTKVRMSVFTSTGYSASKIPTYDRDVLASRGYMQAANDWRNIEMTGFVKVNSVSDVSDNFAWYARGGKHNDNHSGCEGSSYKGSLHYDGRVRWQKETWHVSYNQASYKSGTSALRGRWVGFKSVMRNTKVNGKEAVRLEMYLNENADKKTWKKVYDMVDSGSWGGDASHCGGAVNAMPITWGGPIAVFRWDSANDVDFKWLSVREISPEQ

SEQ ID NO: 14334 - protein, 139 aa, Myxococcus xanthus
MSRSSTGCKGATKAGDQALFFATRQSTNGCGACANGTSTGPECDSESCTPGCLQTARTSNDFFGCGNFGTEATCGPLNRFSENLCSGLEGSPWSCNAATTADDNGLCEAYTAIKTGSRFGGCALLPRHLHRFRQGRRLR

SEQ ID NO: 14335 - protein, 70 aa, Myxococcus xanthus
MNRFADTDGDGTFNTLSSNDGEPERRFTLVDTAGCNCAQIVDALGMSQEHAQSGCSLSTLENWVSRVKEN

SEQ ID NO: 14336 - protein, 94 aa, Myxococcus xanthus; identical to SEQ ID NO: 12442

SEQ ID NO: 14337 - protein, 177 aa, Myxococcus xanthus
VESIYAVGDITDRINLTPVAISEGRALAETLFNDNPTQMDHTNVPSAVFSQPPVASVGLTEQEARERHGKLDIYVTSFRPMKHTLSGRNERTMMKVVVERESNRVLGCHMVGTDAPEIIQGLAVAVKCGVTKKQLDATVGIHPTAAEEFVTLRDKRPDPDERLAAELGRDAAASTRR

SEQ ID NO: 14338 - protein, 274 aa, Myxococcus xanthus
MYWEVHKAVEQALRADPNTLETLFVPGAKALDPVGEWLLAERDAFVSKALFGSFGRYAMSQLDKLTRSQRLAEHRDLLLEWLCEEPAPDLDEVARRLSAVSPREAPSAQDALLAAKTYVKQLYRSLWDQGLLAANDFKALTAYARSGGQRPPSARELRPKNAYNLLRLVATATGWLREGAPVFEASGALKARLLDIKAGRVPLEDVLRDAEALAPDLEAAHRESRLPEHPDYERADRLLRRVGEELARRWVLKEPGPLGRDAPEAPAMGWRDSE

SEQ ID NO: 14339 - protein, 251 aa, Myxococcus xanthus
MADRVLDEESRHRAHLVVSLSGAHAYGFPSPDSDLDLKSIHVAHTAALLTLQPVHVPTERLEVLEGVEVDYSSNELLPVLQGILQGNGNYLERVLGAIPLRVSPELESLRPLVRAVLSRKMYRHYNGFAQGQLREWEKSGFRSAKRLLYVLRTTLTGTHALRTGVVETDVTELLSQYGFVEAHALVEQKLRGEKSELPEALSARWRGEVSRAFEVLEAARADSVLPESPPDEAVAALEAWMLDLRRRRFDG

SEQ ID NO: 14340 - protein, 246 aa, Myxococcus xanthus
MMKPLHLAVLRMLPALCLACAHPPQAPREAPVAAPALTYETYTVGAGEPEAMLVALHYSGSTPGFWRPLLEDWRTPTRVVLPRGPHPRREGFTWFAAGHEQKVTAEKTADVAQMAARLAELIRELRAAHPRIRRVAVTGFSYGGDLAWALALRHPEQVDVAVPMGSRLLGDPTPGAPATRRVWVLQGEVDPIITAPQTAARVDALKAAGVPIDVKVYPGLGHDFSPQLIEDWRTFLQQQLRTEAQR

SEQ ID NO: 14341 - protein, 97 aa, Myxococcus xanthus
MAEPRRWYLITYDIRDPKRWRKVHALLKGYGEWLQLSVFRCSLTDRDREKLRWELSRRMDAVDTLLVIGLCGGCVERVRAINAKEDWPEEPAPFKVL

SEQ ID NO: 14342 - protein, 181 aa, Myxococcus xanthus
MAEVSTGKTWNALFTETLAQPLGLPSGVTYFTAPNHPLGTTNPLVAGGLRASMNEYAPLLALVFHRGTHPGGVIGTPELFDAQAVEPFPGVVVGNSPAADMGLDLRYGLTAWLECPTPAQGCAVISSPGAFGWTPWVDREAGYYAVLGMHLQRDDPGAGVVSFAMHLSTEVKPLIRAALAP

SEQ ID NO: 14343 - protein, 85 aa, Myxococcus xanthus
MSDERFTTSREVYHRIQWDPRFDPREFTIGYDAHGETREEMPFAAFVPDGEIPWHRVWYFKRGHQVVWDREQRLDLLNSPQPPPG

SEQ ID NO: 14344 - protein, 407 aa, Myxococcus xanthus
  unsure (1)..(407): unsure at all Xaa locations
AYARVGEGDPLTLEDLAKVERRLVATGLFQEVKVSYEPSGPGRVRLILXVEDKASWVVAPTFVLQSDNVGGGVLYAENNLWGRSKKFATAAQVSTAESGIFAGFLDPNLFGLPQLRFSLEGQLRSDRVDEYQAGSGQRRPEVVRRTRMNSASIAGELGFLLFERVRAAAKYRLMSIDAKSPDTAEEVTTPAFSLGPSQQDASLRLMVGIDTRQNLHAVMEGLNLEASYELSNPGVGSDFRYERFGLLYRHGLRLVGEHNLVLRGEAVAGVDLPFHQEFVMGGNSLRGFVYRQFRGDTRLSFTAEYHFPLFTVNPLSFRGVAFSDTGMMMWRKLPGDRELRDVNGRVVRSYLPDTEDGLGNATVAQGVGAGLRLYLRNIVLPLVGVDAAYSVNSGEFRFYLVAGVNPS

SEQ ID NO: 14345 - protein, 127 aa, Myxococcus xanthus
SQESTLEARDLRLIQAIVEEGSVTRAARRLYLSQSAISHQLSGLETRLGVTLFERVRKRMVITPAGQRLAALAAEVLPRLAREQALLRAALTPTPPRPLRLAAQCYTCYQWLPRLLTGLSTAHPEVV

SEQ ID NO: 14346 - protein, 56 aa, Myxococcus xanthus
VRILREAETPGASVVEVARKHGVVEQTLYRWRQKFGGMEAGDATRLRELEKENARL

SEQ ID NO: 14347 - protein, 389 aa, Myxococcus xanthus
MREKFVPVTYAEVDGLAIQEGDMVLGTVQQMEARVREVKALGLDASGPRAQGLAKTDLNSRWPNAVVPYTIDSGVANQNRIQDAINHWHDRTHISFVLRTANNAAQYPDYVRIQSGTGCSAHYGRLGGQQGVWLDGSCSTGTIIHELGHSLGLNHEHNRQDRDTYVIIRWENMVAGAASQFQQNNNEDDDFFGYDFGSIMHYGPMQGSKNGRPTIEGRGGQTIGQRNALSTLDVVTVTRLYSRTITLRASNGDYLVAEGGGGAMVDANRVAVGPWERFQLVDLDGNDLVTGDLVQLQTINGNFVQATNGGGSTLNAWEMAPGNWETFRIWKMAGTGLSTIATGDGVVLGTLTPGYPKYWQAVNGGGAGVTVNTDTINLGPANIFTVAFP

SEQ ID NO: 14348 - protein, 57 aa, Myxococcus xanthus
MVGERTLYCDGSNDDWGVTTRYYKHIMMSCDNGVYQQFKCYDCTKFPCKVVPCPYQN

SEQ ID NO: 14349 - protein, 66 aa, Myxococcus xanthus
MPHDDAAALRRQKTLERVTLGPAAEAHEPKSHRRRATPLKGRKKAPSEMNVKHLGGPKKRLPLHGG

SEQ ID NO: 14350 - protein, 126 aa, Myxococcus xanthus
MLLPVGLFFLRPLLLQSAIFIGMGLLFRRTSWPVSLRREQQRQLKAWVWGLPAAAELTRVERQVAPTLHAGRVVQLDYVFTVHGQRVEGSVPSPHASDLLRRPGERVWAVYVAEDPGASALWPPGP

SEQ ID NO: 14351 - protein, 183 aa, Myxococcus xanthus
MRIRYRLILTGAGVLAVALGAVEFWPQPEPEPLPAALLAMAVPPPAPPAPPPRVVPVTAPEVAPPAPVPRQEAPQVTVARMAPEPVVPSPEESFPPPEDNDDIEPELPQTAQWELEKTARLAALVERDVVRLAREREDAVAQGDVQRGEQIDALLQRNLGQLRELHDEVRRLAEEVNGVVPEE

SEQ ID NO: 14352 - protein, 58 aa, Myxococcus xanthus
MGPKHPGIKLSALIGNERSMLSVSSSLKEAIQKHCANEIESLPFTLYDHCNRPHREGK

SEQ ID NO: 14353 - protein, 297 aa, Myxococcus xanthus
RTKLWWSVVLPACACGGAAKTGDELRSRQAGLSLSATPGDARGTFVHEDETVTFSSREVEPGVYRLEVRLRGLTLTGLMEPARGVSTLDGFAEANARDAQMGVADRALLTALYRELNEALPSGDAAAPAAMYLRRAVSVWSQYPDTVGLRRAVMGEKGRGYTMLCSYAQCNGRNSGSCEGRYNWYAHATHDCDRGGFDWPGNQQLAQLGDHYSCNGDEFFLAGDTWHCGSPNHWHRPKVVGNCFGRCGSTCGGDTQYTVDATNHDSCVRNGHILVSGWCNDQFTAAVDDELFAPNCY

SEQ ID NO: 14354 - protein, 129 aa, Myxococcus xanthus
ARPGRAEEVVEEGPRLEFREALQLRIDQGLSAAGAAAVSLRRGRVGLHLTGSPWVRGGLEVSFDRLVLLPGPLQGPPLALHEASVTFTVMPQRAWLSVGLFRPQVGRESLTSGFEVDSLDKAITQGPFR

SEQ ID NO: 14355 - protein, 153 aa, Myxococcus xanthus
MNRFLPLLVIALVTAPLASLAAPPSQPAKKEVPARQGKLVFVATTGLEDLGTLSSSLRHVKNAKESGYLSDVVWLTYGRAVVALDPTVKAVPAEVREAAQAAKAAGVRLVACGTALQKFGIDPKKLQPQADVVDDGVAELSRLVAEGYQVIRY

SEQ ID NO: 14356 - protein, 135 aa, Myxococcus xanthus
MAAAFTWGTSAGDLGTLVKLTRVVLLAPALVVLGLVSGAGGQVRYSLKEPPIPWFVIGFLAVGVLGTVGVLPAAAKAWLSTASVFLMVMAMAAMGLGTHLSMVRRAGMRVVYAGLVGFAALALAAWGLIHVLSIQ

SEQ ID NO: 14357 - protein, 532 aa, Myxococcus xanthus
MSRLLSALGALLVLASGCASSRPPVTASAPTSQRQQLTVIYVADLHAQLRAHPELFWNDGKERIEMAGGFARVAAAIQQIRAERGGDVLVLDAGDTIQGSGAAALTEGGVLIEPLNALGLDGAVPGNWEVVYGPAVLRQRARELKHPLFAANLRDAASGERLFPPYLVKEVGGVKVAVVGFTDPDVPRRQPPGYSKGLRYDGPEALPELVREVREREGAQVVLLMSHVGLAKAVGIAARVPGVDAHLSSDTHERTYVPIEQGGSWVVEPGAFGSFLGRMDLWLEDGKVVDRRWELIELTASRFPEDPEMARLVDAALAPYDEQLSSPVGHTDVTLARYAVVENPLDNVLADAIRAAGGTEIGLSNGFRFGTPLLPGPVREADLWNFFPITNKLKTGKVSGRQLRAFWEQELENVFAKDPEKRFGGWLPRPSGMTVRFRSEAPKGQRLLALEVAGEPVVDERLYTVTACEREGDSPDMLCRIPGVQDPQVLDMDAHEAVRRFLAGKPRLRESLEGRAVGLDLPAVLRTQQVQP

SEQ ID NO: 14358 - protein, 83 aa, Myxococcus xanthus
CSQAAGATLVDVRTPEEFASGHLPGAVNIPVDELARRFGELGSLQTPLVVYCRSGARSGRAERLLKEQGFQDVFNLGPMSTWP

SEQ ID NO: 14359 - protein, 270 aa, Myxococcus xanthus
VLNAYFLQEEATRDARRGAAESPVLEEVLAKASALGVRALRTNGHNDALSKVGDTAIQVAPLEYDEVALVGLDWVLTRARFHGVRLVLTLGNYWDAYGGAHQYVEWRGLPRPVEGDARFFTDPVVVAHFKAHVARLLNRVNTVDGIRYGDHPPVLAWELLNEPRERGLDKEGARLRAWIDHVAREVKTHAPGHLVGTGEEGFEPSPDGYDPGFWSRSGSPVLRTPGASFTRNTASPYIDFASVHFYPESWGLGGIDTAEAGARWIPLEHS

SEQ ID NO: 14360 - protein, 461 aa, Myxococcus xanthus
PHPRIAAAKVTFHIHPEELRLEALGSYRIRNKTDAPISKVMLNLPDDARVRGLSLAGVTKPAMHDAELGIFIYELPTPLAPGADSAIVFDLEFGTKGFKHGGARTDIVGNGTFFDNMKLPVLGYQTGAELEDDRDRKDYGLPPRERLPDRDDPKAKQDNYIRQDSDFIAFEATVSTAKDQIAIAPGYLEKEWTEGNRRFFHYRMDKPILNFFSVLSARYEVMRDTWRDVKLEIYHHPTHTFALDRMMRGMKDTLEYCSENFGPYQHRQARILEFPRYASFAQSFPNTIPYSEALGFIARVEDGRADDVDYPYYVTAHEIAHQWWAHQVVGARAQGATMTSETMSQYAALMVMKHRFGPMKMKRFLKFELDRYLAARAFESKKEVPLARVEQQLYIHYQKGSLVMYALQDFIGEERVNRALRRYVEKVRFQGPPYTGSSELLGFLREETPPEYQYLIEDLFE

SEQ ID NO: 14361 - protein, 378 aa, Myxococcus xanthus
MFTALLTFELRRRVKMISTWVYALMLAAAAALMTLAIGAVFKGFSVASGPELVRVNSPHTVFSFTISLAYFGLFMVAAVFGQAAYQDFGHNTWMLIFTKNVKKGPYLLGRFLGAYLFSAVLMLAIIPGLMVGAACVWLVDADRLGRFQLTSYLWPYVMGVWPTLFFAGAVFFSLTALTRRMAPVNVGVVVLVMGYLTLSAAMSDVQHQDLASLLDPFGFLTFENATRYWTGGRAQPGPRPLRRAAARQPVAVECGGRRAPGTGRPALPHHRGGAAGTRHAQGEGGPRPGRHPHHPGVAHDGQLAAHGLRHLLAGIPRHPPLPGVLVLRRGRAGHGHHGHLHFEADIRHRHLAGDVAGAGDGHANVPALPAHHHHLLCG

SEQ ID NO: 14362 - protein, 293 aa, Myxococcus xanthus
MELRLEGVSKTYPNGTRALQGVNLTIPRGMFGLLGPNGAGKSTLMRSIATLQDVDAGTMTFDGIDLRRDKDRLREVLGYLPQDFGVYPKVTAWDMLDHLAQLKGLAQRGPRHDTVKALLQKTNLWEHRDRRLGGFSGGMKQRFGIAQALLGNPKLLIVDEPTAGLDPAERFRFHNLLAEISTDVVVLLSTHIVSDVADLCQNMAILAQGNVVASGHPLKLVESLHQRVWKRFVTHQEELDALMKQLEVIAVRRVAGQRLVHVYAESPPEGFEPASPDLEDVYFHALARASKQP

SEQ ID NO: 14363 - protein, 72 aa, Myxococcus xanthus
MTRNLRTGTNYLETHIEQLGPTRYELTCRPVVVAGFYVGLFLAGLEASGAKHPSVQIVRREGEEAVYDIAWS

SEQ ID NO: 14364 - protein, 344 aa, Myxococcus xanthus
HLREPARVLALTALALATPALAAEGFTSVTASGDDGNVPSNAIDGDPTTRWSSDGVGEWLTGDLGAVKSLSAVDISWHRGNERVNRFVISISTDGTNFTQVHSGSSSGNTAAPERYSFSPVNARYVRITVNGSTMNTWASIAELAAVTDGSNPPGAPPERFTSVAASGDDGNVPANAIDGDPATRWSSDGVGQWITGDLGTVAQLGAMDIGWHRGNERVNNFVISTSTDGTTFTQVHSGRSSGNTAALERYSFSPVSARYVRITVNGSTMNTWASIAEMQPGTGSTPPTNPPTDPPGEQGQDKFGVTMIYPTRSGGEQWFLADNATSDKRFGPQVCAQLLQALR

SEQ ID NO: 14365 - protein, 718 aa, Myxococcus xanthus
MLAGCKEDKAPEAPDAGPVETGPAALTEKEPNDRPDQALDITRNSTVSAELTAQPNKADEDWYRLAPGAPRIADVTVSGLPGGDITLEVYDRDRNRLVGINSEGEGKPERFPNLYVENERFIRVVPTRKGVGGAYTLEVRMRAPEDGEEREPNDRAVDAVSLPLGQTVTAFLGHAGDEDWYRIELPDPTQPSAPEGAGPGGSAEDPATAPSGDSPSQGTPSPGDGTAPQGMGGTLPGTGGTGAPLGQDDAMGGGRAGQQGTTGAGAQHGQGNPGARQDLTGNGFETEEGAAPRGAEADGTPGLTAQEGMRGASLGQGGVDDFARDEAPPSPAVEGTFAGSEPPPVGSQAVGEAIARALDAGTAVPPEPPSVALKIELTGVDGVRPELSVLSAAEAPLFTLRGKEGETLSLRNIGVRAMDRVVYVVVKTSWVGTGKEARRPFNATMPYTLTVSQEEAGASAELEPNDELHKATPVTAGGYRQGFLAPKGDVDHFVLKTSEPVLAKVELTGVERLDLVLSMVEPPEGESGKETVLLRANDGAIKEPERLNNVACNGACYFRVEGASRKVDGKWVKDFENAEQPYRITVTTVPDNGGEEREPNNTADRAQDLMLGQPVRGTVYPVKDTDFFRLDLSDRPVRTPIRATLLGILKVDVGLYLHRVQPDGKLSLVQTADRAKGDQPESIRYSAEPGVYLFEVRDARNRESNFQDSYQLTVEETE

SEQ ID NO: 14366 - protein, 306 aa, Myxococcus xanthus
VLVDRASRGDSAWTSHLLTSSAWLGARVDAATGALELSFDHLVMDGTAMAELSLAASEGLPRREGRAAPGEWLTGPEEPSPLLRVELPEGLDFRNLACAMLQAVQRAGEGVFPVDNPTLLVPVLPASPHTVARKWRRIGIAVVPSRTRTGPMTPAHVAHLLEQTRRGGGVLKDIFSTLYSPALPWWMPSLTTHGFAFTPLLRQVPAALGGNALLSKITLEVDDDEALARHSSLFFNTMRPLSAVGGGVALCVTEVLHATPSGVRKRFFAALAGSGALGSREKLLAFRDVLVAEAVSRARPRRPALP

SEQ ID NO: 14367 - protein, 241 aa, Myxococcus xanthus
MLFPQGERFFVRSVNHYMPQLADTPALHAQVKAFFAQEGKHAREHQDYIELLESQGYDIRRFMRRYESFLWGVIDAKFPPSLRLSITAALEHYTALMGENTLTLGVFADGHPAMRNLIEWHAAEEIEHKAVAFDVLRKVAPGYGLRVLGMVLGVLSLFALWFAATVTLLRQERGLGWTGLLRELWRAHRKDPVLFQVLGRGLRQYLRPSFHPLDNDNLELARAHLATLEAPPPEVPEREAA

SEQ ID NO: 14368 - protein, 660 aa, Myxococcus xanthus
  unsure (1)..(660): unsure at all Xaa locations
ERGTAFFIAGPDGQALQDAELERLKPVLHDRMTQAVVGRLEDAAILFAGHTPRPFTTVDVLGGGRAALVTANRELGLALADDEMDYLVARFTELKRNPTDVELMMFAQANSEHCRHKIFNASWTIDGKPQERSLFQAIKNTYVQHKEGVLGAYKDNAAVIEGFEVDRFFPSPESGEWGSVREPAHIMIKVETHNHPTAISPYPGAATGAGGEIRDEGATGRGARPKAGLTGFSVSHLRIPGFEQPWEQPYGKPDRIVSALDIMVDGPLGGAAFNNEFGRPNLTGYFRSYEVQVPTPGGVEVRGYHKPIMIAGGLGNIRASHVQKGRLQPGDKLIVLGGPAMLIGLGGGAASSMAQGASAADLDFASVQRDNAEMERRCQEVIDSCWALGDKNPIRSIHDVGAGGLSNAVPELAHDNDLGGRLELRAVPNAEPGMSPVEIWCNEAQERYVLGVAPEDLARFAALCERERAPFSVLGDATAEQTLKLGDTQFGNAPIDLPMDVLFGKPPRMHRDVTSRPVSFAPLTLDGSLALLAERVLSHPTVADKSFLITIGDRTVSGLSSRDQMVGPWQVPVADCAVTLSTVTSTTGEAMAMGERTPLALIDAAASARMAVGEALTNIAAARIGKLSDVKLSANWMAAAGSPGEDASLYAXXHAGGHGA

SEQ ID NO: 14369 - protein, 96 aa, Myxococcus xanthus
VDTSPSRSAPTLVLIDASGFIFRAYHAIPPLTTSKGVQTNAVLGFTRMVLKALRELKPTHVALAFDKESRTERQKIDPTYKANREGPPEDLVPQYA

SEQ ID NO: 14370 - protein, 445 aa, Myxococcus xanthus
MVPAGLVGVLLMVGMVSSILNPKPVDVQGPGGAAQMDPTQKIQDLLSECRSYASSELGAPNWEKAHEVCTQALDLDPIHPEANTLIRRIKLEKESFEYYSQGERLLQRLKPEEALESFRKIQKESEYFRRARAKAREAAEAVTKRAQEDCKLYLRDSQWSAAVSRCEVYMAVWCQSKPREDLQPPLGFTLKLEGRLRRDEWRPKDPMFVKFLIARQKMDANAAPWVCPVAEVLAGDERVADPRTFVMEAAKKRFPNKLMQAALLDYWGGRGSEALATMQKLRANYEAAQYHAEADELMKIMSTVDQLFKVGQSYLAAEDPEKAAEPFREALATDKAVMLELAESKPSFYRRNILQDIAEKSYQRGKHWADREDRRRACRVWKLGFSFYAGNPNLNKAAAFCSSRALEAFRAASGCGDMAVALDYAVKGDGVEEMVVAKQAELGCK

SEQ ID NO: 14371 - protein, 207 aa, Myxococcus xanthus
MATLVVRHPDGTENEFAITGELKIGRQQGSDILITEGGVSRTHARVFDEGGTVFIEDVGSANGTFVDGQRIMEPTALTPQSEVLLGDYVLRLKPAAVRGSGARRSAARPAAGGDEPMPVGDEGGGVRATRAMPSIKKGSGAAKSEPGAALAKRPARPARPAPGGGARPAPAGGPVLRGMVGPWARQTYPLKGQGAGGAAAARRHHAG

SEQ ID NO: 14372 - protein, 614 aa, Myxococcus xanthus
MQPGSHALRTKGGLLASVPMFLITLAEKGGGTEQREYHKNEVTIGRLPGNDIILAKGNVSKYHSRIVAKDGKFIIVDMKSTNGTFVNGKKIAAPQVLKPTDQVYIGDYILNVEALEDEGPVMTRAGQPEEEYYDEQGEEPYEDEEGAYEEDEPYEEEEEEAPPPAPAPKGMPASLASALAKNKRKVDPRQERYTRLQKEIHDRLIEYLDLRRMDMDRLGDDELWRRTEKAIRDIIDQMEADGELPEDVDREELLTDVINEALGLGPLEAFLASDDISEIMVNHANQIYIERKGKLTLSEKTFSSNQAVLGVIERIVAPIGRRIDESSPLVDARLKDGSRVNAIIPPLALKGPCITIRKFKKDSLKIADLIKYKTVTAQMAEFLEMCVKARRNIVISGGTGSGKTTTLNIISSFIPEGERIITVEDAAELQLPQDHWVQLESRPPNLEGKGAITIRELVKNCLRMRPDRIVVGECRSGETLDMLQAMNTGHDGSLTTLHANTPRDAIARLETMVLMSGMDLPVKAIREQIASAVHMIVQQTRFSDGTRKICYITEVSGMEVDIVTLQDIFYFKQDGFTEDHKVRGRYVASGFVPKFYDELQRKGIPVNMSIFRED

SEQ ID NO: 14373 - protein, 181 aa, Myxococcus xanthus
MQACGEQGLLLFCCILTFPFLLPVSIPGVSTVFGLLIVLIGVGVTFNRTPWLPRKLLDKPLLRTNLAPALDKGADVFTKYVDKMSKPRLLALTHGSSTNRFNGFMLFFAGVLLMMPFGLIPFSNTLPALAALFFAIGILQRDGYFILMGHGMTVGSLTYFTVIIYGAVQGGRSLASVFGGG

SEQ ID NO: 14374 - protein, 230 aa, Myxococcus xanthus
KTTGRVRVFDFGLVRGATTESASQPSDASTPSDASGFAGTAEYMAPEQCAGNADISTRTDVYALGVLLYEMLTGRPPFFGPTPDVLQAHLSLRPPPPSDFAPVPPAVEEVVLRCLAKEPARRPENAAALGSALREAFEHAHRATEPATPRPAAPGEPRPAQVRRSVAILFLTSRANPVSLQKALASYGGHLAFSDAQRIAAVFDPDAGENPVRRAMRAAEGLAERGLSRT

SEQ ID NO: 14375 - protein, 180 aa, Myxococcus xanthus
LELLENIENQGGGAGSEKALVFVLSRAMQDLLAQLIAERFRLGRVDIVNGEPDSRKAALQNIDAFSRAKGFQVLILSPLAAGAGLNIVAANHVIHYGRWWNPAKEDQATDRAHRIGQVRPVHVYYPLLHRQGRPDMGFDLRLHDLVERKRAIARDFLSPTNDDTQQYSGVFQRAHEEGEG

SEQ ID NO: 14376 - protein, 244 aa, Myxococcus xanthus
MSASGDGSEKSLADLMAGVAVVFLLLAVIFILEAHEQREAAIRDKEAAIEKVDSQKEGVQESLIALREDLISLDAMLDGGFIALSGLDGGVNALEIEFKNMQFGLGQCRTPLAYVEQFERGAVPLIHRVCQAVEAMRDAGAEPSIILEGHTDDRPFLGTSWECGVREGVARYSFENNVRASAARAQEVFFTVRNQLRDAGYERDCFDSNFVVSGRGQTAPRPGTDGSEPENRRLVIRVRGDLRL

SEQ ID NO: 14377 - protein, 288 aa, Myxococcus xanthus
MVGYGAWALSQVERFPGLRTLELEHLYYQTRGQRLAASVVATVPAEHVEREWQTKVEPQVEAMKEHAQAARASDVPANYGPPCGKYGGCPFMAKCLTGENKTMSLRDKLLNKASESTPLTVAAVERDAPEPPAVLPPDAPTPTPVQTAPEVAQATEQPAPKRRGRPRKAAESEQPTDAAPSPPSALRVLFVDCIPTTIDGPTPESLTSYVDTMHRKVAEAGGVDDVRFAGSDSALGFGKWRGALAMAARAELPAPGSYVALGVSQSELMQVIVEALEPAFDVVVRGLR

SEQ ID NO: 14378 - protein, 226 aa, Myxococcus xanthus
MAVLDVTDEDSVQRAVASVLAAEGRLDVVVNCAGFVMAGAVEDVSVEEAQRQMDTNFFGALRVCRAVLPTMRAQRSGLIVNISSMGGAAGLPFQGLYSASKFALEGMTESLRQEVAAFGIEATLLQPGDVLTRVREYRQRARQSGPGSAYQEAFERVMNLVESGEGAGVPPEHVARKLLALVERQRVDVRYSVGRLSQRIGLVSKRLLPGRTFEHLVMALHGMSRR

SEQ ID NO: 14379 - protein, 422 aa, Myxococcus xanthus
MIPFLMMLPMLVPAGVKRGRSSKARREGGLSPVPSPTEESGSAPPVRASSRRRLPAQVLGQRALNRALLQRQWLLQRSRAGVMEALEHLVGLQAQATHPPYGALWTRLNGFQQEALTRLMTERQVVRAGMMRGTLHLVTARDCLALRPVLQPALDRGLKHSSHGKQLAGVEVQALVAEGRALLEARPSPRGELGQRLQERWPGHDASALSLGFSSLEPLVTVPPCGTWGHGERMVYATAESWLGQRFEPAAPPDALVMRYLAAFGPASAKDLQAWSGLPRMGAVLERLRPELRAFRDEHGVELFDIPNARRPDPDTPAPVRFLSEFDSVLLAHADRTRIISDAARKRVFTINGIVRATILVDGFVRGTWRIERARGTATLCITPFARLSREDRAALSDEGGRLLAFAASDGQHADIRFERVG

SEQ ID NO: 14380 - protein, 574 aa, Myxococcus xanthus
MGFPSPRVKSLLALMLLCLAPVTWGCGGSEPSPSPRPDAGPQRPDAGASTNDAGTDAGTEDPDAGEPPPGFTLQTASEVTLRFIPEASAGLNVTITREPTFTDAVHLSIEGLPEHVHVTTDVIAATESEATLSLAAQEFARYGSVPVTLVASGGGARVEHPLNLVIRPGPAALDTSFGGNGVAMPAFGHPEVRIHALAAQPDGKWILAGATGSTGLRDVLVARLLPNGTLDPAFGTQGTVTLDVCGGDDYVDAVTVLSDGRILVAGGAIAGPGSCSGRQYQSLLFARYTSAGDLDTTFGDTGVRTFQISAGNATLHAVTVDSRGRIVGAGTVQHDDLDFVIMRLTPTGAADTTFSSDGLAWDDLGADEDGLAVVTLADDRIVVAGTTNAIRNRMALRRYNVNGTPDSSFTYRSASDWPRLTPRTLHLLDGGKLLVGGSGRWNAGTDSPNSGAVTRVHASGSPDTSFGWDGDSVTHWSAPGVQQERLVGTGILHGGELVLAVASTINGATDGIGLIHLSADGKTALRTHRTNLPGAEVALAAALDTDGSMCVAGLRADEGSSTTAPFAARFWPHR

SEQ ID NO: 14381 - protein, 57 aa, Myxococcus xanthus
EQRVMGDAEMTLSELGEHFGFSRERARQLEIRAKDKLKLALVTLMAEAGVDESTLNA

SEQ ID NO: 14382 - protein, 66 aa, Myxococcus xanthus
ALAYLHRRGIIHRDLKPANVLVAHGQVKVLDFGLAVGREHVHHAQPGGTPGYLAPELFEDQPPSEV

SEQ ID NO: 14383 - protein, 58 aa, Myxococcus xanthus
MAIQTAALRTLKRPPEQLKREDLPQLLEGLKPMLNTFIGALHAKVILAEISASLEKLR

SEQ ID NO: 14384 - protein, 179 aa, Myxococcus xanthus
MLVVVLANVSTTYALILLAMTYRQSGLQPPSSVRSNALWVGTAVAALAVGVPVLATEVRHLGTDAISTMSAVISLASTLADMTTILLVAPILGVAYMLRGGRLAWVWWAMGVSGAMWLFYDARVWLGPLLPGDAAQNAELLRTLRTSGLVLLGLAGWLQRTALAPQQSPVAAQTHAGVS

SEQ ID NO: 14385 - protein, 325 aa, Myxococcus xanthus
EFIRLIQKNGGVLNGSTRFDFTNYFEVIPSNALEPILWAEADRMRGLDVTEENLKNQQGVVTNEVKVNVLNQPYGGFPWLDMPQVANTNWYNAHNFYGDLKDLEAASLEDVRAFFKTYYAPSNAALVIVGDFEPEQVKGWIQKYFGPLPTVAQPSKPDISEPRQTKEKRHDKQDKLAQRPALAVGYHMPDVGTPEYFAMALVDEVLLQGNDSALYQQLVQKKGLTGEVSGGVNQLGNHWNYNGPMQWTAYLFHDADTTTETLLAEIDGVVAQLQNQPIDAATLERARVKARSGLYGQLEGFLGFGRADLLASFALFFDDPARIFR

SEQ ID NO: 14386 - protein, 171 aa, Myxococcus xanthus
MGLGALLALWGANLVFVGALGVMVGAVQSVSPDEGKTTSDGVGILLVAAVFVAVGRFAWKKGLSPFRTARRHEQLLGFIRAQTRIRVSDVASQFRLPEEEVAAMLTTLIARHEVDLVYLADSRVYLHREALERGKNVALRCPSCDAPVSAEAVQPGDKVDCSYCAAPFLVT

SEQ ID NO: 14387 - protein, 549 aa, Myxococcus xanthus
RGAALGRPVPGGPPHAMRRARYTVPGREFIDTLDAVLRHDFSTRDLPGHGLKAVAKHLGLAGPEREHIPGARVYDVFRTDPARVRRYARDDVTEAGGLARLLGGAAFALARMAPRRYERLADAGPATGVLDPLLVRAYLREGAALPAHQEGDGTPHSGAALHLFATGVARRIVKADVASLYPSLMRQYRIGPKRDRLGVLLALVDRLVDQRLAAKGRARAAAPGSQERFTNEALSAAMKIVVNSAYGYLGAVGLTRFSDVHAANEVTRQGREVLGLLCRELARRGVTLLEADTDGVYFAVPEDWREADERRVVSEVAALLPPRVQLEFDGRYAAMLSHEPKNYALQPYDGPLVLRGVAFRSSRAEPFGEAFLRRALRCLLAEDIPGVREVYVATVMALRRRELPTPEVCAHVRLTKTGAQYLALRPRRRELPYEAMLASGRKEWPLGEQVRVYRAVGGRAGLLPIPEADDPGTARPLSREEDPRDYDVEYYVRLLRETFAARLVRALTPEDFRTVFDDPGQPSLFAPSLEDAKPILTVLTEPAAALEGA

SEQ ID NO: 14388 - protein, 617 aa, Myxococcus xanthus
RKDRHRRRLGGGDGALPGRRRRAVDVKLRPRPVQAELPVWLTAAGNPETFITAGRLGCNILTHLLGQTWEDLEKKLSLYRQAWRDAGHAGEGHVTLMLHTFIGEDMAKVREVVEQPFRNYLKSSADLMRGLGSTLGIDMDSATEADLDRLAGHAFDRYFETSGLFGTPRSVRERVGQLYSLGVDEVGCLIDFGIPADTVLASLPLLDEVRQRCVRDSRRAGTAKTIPEQLREHGVTHLQCTPSLARALLSEPESVEALGGLQRLMVGGEALPGALAASLRKALPESAELLNMYGPTETTIWSSTARVTPEETAAVVSIGTPLLRTCLYVLDARMRPAPVGVAGELYIGGAGVVRGYLGRPELTAERFIPDAWAREPGARLYRTGDRARWRPDGTMEFLGRVDHQLKVRGFRIEAGEIEAALTAQPSVREAVVVAREDVPGDVRLVAYVVPAQGATVEASALRDALAQRLPEHMVPSLVMELPALPLTPNGKVDRRALPTPNVVRSAKAAFVAPQGQLEEQIAQVWRSVLRVEQVGVHDNFFDLGGHSLLMVQVHTQLKSVLGQDLPLLKLLEHPTISTLARFARQGPAAAQSQVEAAQDRAKRQLESLKRQRQRARK

SEQ ID NO: 14389 - protein, 110 aa, Myxococcus xanthus
  unsure (1)..(110): unsure at all Xaa locations
DPQQRLMLELSWEALEDAGIAADRLQGSPTAVCFGAAWMDYEMTLQRFGMKRISSYTSTGYHHSVLANRVSYVLXLRGPSFSIDSACSSSLTAAHLACESLRXGESXLAL

SEQ ID NO: 14390 - protein, 122 aa, Myxococcus xanthus
MLFLCSDVGEDDAPTRIRVGSHRDVARVLAPAGDAGLTFMELAGKLDVSAHRPLALATGEAGTVYLCHPFLVHAAQPHQGTQPRFMAQPPLLSRAPFSVQGPEDDASPVARAIRQALNETRA

SEQ ID NO: 14391 - protein, 312 aa, Myxococcus xanthus
MEELGAALHFAHGRGILHRDLKAQNVMVIPLAEGFTVKLVDFGIARVEPPEGLAGLTSGGAVLGTPVSMAPEQIRGQALDARTDLYAMGVLLYQLLTGSLPFEGTSVVEVEEQHLHAPPPHLDERVHAPPALDAVVQRCLAKAPGDRWPDVPAFLDALRAALAPTPDATWAVAVYVDLRFPVALDEPTDADLDARDATLDATLTELETRGWMLALESGNAVLAWKSLPPASEARVPALVEARQVADSLLRQACEAAGDSVEVRVYAHAALCELNTDAQGLPRLAGGELLRLESWASGGTAGEVLLSDALASR

SEQ ID NO: 14392 - protein, 296 aa, Myxococcus xanthus
MERAAASDATVLLEGETGTGKSRAAFAIHQASARASGPFLTVDCGAIPGNLLESELFGHEKGSFTGAIQRRVGAFEEADGGTIFLDEIGELPAELQPKLLRVLENKEIRRLGANGYQPVNVRVIAATHRDLRAEVNAARFRSDLFFRLAVVRIIIPALRERPEDIPLIAERILMAFGAGSEQLAALSTPEFIAQLQHAAWPGNVRELRNHLERCLVFQDAMPPDAEEVSAQAVLRSLVDPKQPYAEARRRALEVFEREYLDALLKLHGGKVSQAATAADMDRVYLYRLLRRHRLRT

SEQ ID NO: 14393 - protein, 138 aa, Myxococcus xanthus
MRKRFGSGDTYETSDIGTTRQLVEAARRAGVDHLVLLSSVGAGRPVGAYLKAKAEAERLVRESGIPWTVVRPPAFEGEYHHINPVLRALTRLPPLRNMRPIHLDQLAAVLLRVSEQRAPLNQVLEGDTLWAEVAAAGA

SEQ ID NO: 14394 - protein, 375 aa, Myxococcus xanthus
VSKELAAWRQEVADRVGRKPVLRKAAIEFFLWCAPDAASSEAELTVLALVRTATDRRQVKRLKEHPSSRVRLRVRTLQSWFQGPSAKGKPGAPVEPSQASGPATLTEALRHLHVTRAVPLGGRTWLRDRDLEELLLGAFGRVEAEFSSRYPERFREDTETLAADLLEALRAELARVKADVAALMAQGQPSPWELSMTVRRREPEPVPEPVPVDGEVAPEAVPPPLAAARLGVEVAFVLDVAVGDFLRTRRVVSVQVVKLEQRGEGQWLPAFRLGREHLDAQLLRTDAAFCLFLAPPFPRAECWVVPSRTVRAMMESQRSLSGVPRDGVQRVARSLSHWLLGDVVGLWTGDERPESFARLSRVEDGPDFVVEWGLR

SEQ ID NO: 14395 - protein, 174 aa, Myxococcus xanthus
LAEWKKDRVVITNAAGKPVPKEEADEVAKHLPELGKPHRMEAAFPKNPLAVGATLEGFSDTLAKQIVDEQGDNTRVTQARARLVEVRQDPRGAVGIFDVAMTVLRQETKAPFLLTIPLQGQMSVLAEGIQLLELTLSGPVKVELTDDAVEQGFEARGEGAMRLRLMGRKADAAR

SEQ ID NO: 14396 - protein, 201 aa, Myxococcus xanthus
MQLHFLAGMRPERLPDYVLVVNMDNSTRVVDYTDRSSAVLWGDGASAAILSPRVPGRWQLTETLLAGDPSGADKVRVPRMGHFTQNGGEVQKFAIRRAGETFQALRTRFMERHPDKGAGAVSFIGHQANLRMLEAVQRRCEVPDARHFFNVHTRGNTGAAGAPGVLSEHWDDPAVGDAVVLSVVGSGLTWAGALLERTPAQ

SEQ ID NO: 14397 - protein, 168 aa, Myxococcus xanthus
MLLVAGAAQAGQKQVGGVHMPVSLNLKGRTVELAHMELHKQLFFKVYVWSLYMEDRPRSTHEAINSNSVKRLHFHFLRNISRDQLVGSFRDGLEHSPALRRGPLANHLRIMLASLKDVQKGEDLVITYTPGVGLEVGGDASGGVFIPGKNFADALFSVWLDSHPIFPR

SEQ ID NO: 14398 - protein, 50 aa, Myxococcus xanthus
MAVVRSLQNAGVDPTFLSAAGYGQYQPIAANDSAENRSLNRRIEIVLAPK

SEQ ID NO: 14399 - protein, 688 aa, Myxococcus xanthus
SATAQLLETVRKEAKPGIWSNGVNLARSGAVVLQSQKGGELELRVRAKGRPVALTVVLYPNDDAWECDCPSQVDPCEHVVAAAISIQQAEKQDTPMETAATRWARVVYHFTRVDGGLELRRSIVQVDGAETPLEGSLTSLMARPAEAAKLQVENADLLADRILEQRRTRGTLAPETLEAVLKVLESARNVLLDGRPVAVSDEQVLPRAVVEDRSGQIVVTVSKDPRVQEVVSPGVALASDTLVRLGETTMSGPWLQNLPIVRTYSADHLGDLTSKIMPELGRRLPVEVRSKRLPRLDRELKPRILLELNQLDAGLSVLPTLVYGAPPVVRIDNGRMVYLRGAVPLRDEAAEQRLIHQLRDELNLVPGRRLTVQGSEMVRWADKLRRWRGDLAGDAAGLVSPDVKLRPSLHLESSVTGQGVPDVRFQLSFQVEGAKGEVKAVDAAAVIRAWTEGLGLVPLDGGGWAPLPRAWLDKHGQRVADLLNARQEDGKVSNHALPELTALCETLEQPPPPGLDRLAPLVSGFEKLPPPELPAELNATLRQYQLQGVSWLGFLRGAGLGGILADDMGLGKTLQTICALGPGSLVVCPTSVLPNWAAELKRFRPSLKVCVYHGPGRALEPSADVTLTTYAIMRLDAAVLGAKTWDSLVLDEAQAIKNPDSQVARAAFGLKANFRVAVSGTPIKRFRV

SEQ ID NO: 14400 - protein, 674 aa, Myxococcus xanthus
VVELHAAQLEGLLAGDTPEARFQDFTRRLRQPQVALDILERYPVLARCVVLRIGEWESNCLGLMKRLTRDAPLLWQRFNAGQSPGALVEARGGFSDPHRGGQGVFILRFESGLRIVYKPRSLGAEAGLQQLLTWLNARGATPMMKGAEALDRGEYGWMEYVDPAPCASAEEVRRFYERQGAYVALMHALDGTDLHFENLIAAGEHPVLVDVETLFHPLSGTRTLRDSEHAVEAPPVSVLRSGLLPQQFWGTRKKAGVDLSGLGARAGQLTPQAYLMTTERGTDRMRFERRPVEMPGSNNLPRLEGETAPVLDYRDALADGFTRMYGLLLEHREALLAEDGPLAAFAHVPMRVLFRNTAVYGALLFESYHPHALTDGLERQRFFDHLWRAVVPAPDFAALVPLETEQLERGDLPYFTARADSKDLEAGSGQRLPDFFQETGMARVRRRLVGLSPEDQTRQRWVLERSLDVLLLSSQTVARPTYPFREHTQPGLRDALLVEARRAGERLLPLAFERRDEAHWLGLDAGDGGWRLGSPGPDVFQGRAGIALALGYLADVTQDARFTRLARATLRTQARLLAEEPASVVGLGILNGWGGILYALTHLGVLWKDDALLDEAAGYVRRLRPLVEKDTVLDVGAGAAGCLLALLVLGEHRPSDTLWATVDACGQRLVNIRT

SEQ ID NO: 14401 - protein, 86 aa, Myxococcus xanthus
MNRDDLLDVLTRYVANELLDGDAEDLDSSTPLLELGVLNSLETARMMGFVQKKYGITIPSESLKVENLQTISAIADLVYDARPRQP

SEQ ID NO: 14402 - protein, 495 aa, Myxococcus xanthus
LAQQLVMTPQLQQAIKLLQLSRMELLEQVREEMEQNPLLEQPDEQAPGDVGDKEPGEASLEADNMEVPRDVDLPAATSDTATEFKADGEGPPEIDWEQYLNSYQFNEPTTASNKGNVATDDMPSFEANLVKKADLVDHIQEQLGTLRLNDAERRIAMLILGNLDDDGYLKLPEVDGDPLIRLANEADVPMHVAERTLRRIQMLDPRGCGARDLQECLLIQLQGIREPHAPLLGLIIKRHMKYLESKNLPAIAKDLKVTLEEVVGAVRLLPKLDPKPGRNFSGDDAQYISPDVFVYKMGDDYTVVLNDDGLSKLRISGTYRNALKTGAVGPGQTKDFIQDKLRSAMWLIRSIHQRQRTIYKVTESIVKFQRDFLDKGIAYLKPLILRDVAEDIGMHESTVSRVTTSKYVHTPQGIFELKYFFNSSIARVSGEDTASEAVKHHIKQLVAQEDARNPYSDQKIVELLRSQGTEIARRTVAKYREVLGILPSSKRKRYY

SEQ ID NO: 14403 - protein, 74 aa, Myxococcus xanthus
PPMRKLDDGSYVRVASDGEESAVEVADMKKLMEDVRETDARRVAEAHAAEMAAWEEDYRRRKQGGRLFTRAAAD

SEQ ID NO: 14404 - protein, 233 aa, Myxococcus xanthus
MGASAGLGYAIAEALVKEGATVAICSRGGEKLERAAKALGAALAVPCDLTQPQAAKALVETVTAKLGGVDVLVVNTGGPPSGGFESLTAEQWQLGFQSLWMASVDGIHPVLPGIKERQWGRIVLVTSLAAREAMNNLTISNGLRAGLLGLVKTVSNEVAQHGVTLNAVLPGYHATERMQQLGLTDEKVAPQIPARRLGRPEELAALTAFLASEQASYITGQSIAVDGGAQRGF

SEQ ID NO: 14405 - protein, 424 aa, Myxococcus xanthus
MRRETVDGGRSINLAISTRGLHALRQVGLENEALKHAIPMRGRMIHPPQGELVYQPYGKDDSQHINAMSRGWLNAFLMTAAEATGKVRIRFKQRVTDVDFGSGALTVHDDATGEARQEPGRVVFGTDGSASAIRQALEKRPDFKGTQEQLGHGYKELTIPAGPGGAFQMEKHALHIWPRGTFMLIALPDEEGSFTCTLFLPWQGPVSFASLDTPAKLEAFFGAQFPDAKALIPDLVEAFFSRPTGSMVTVKGAPWHAGGQTLLLGDAAHAIVPFFGQGMNCGFEDCVVLDQLLGQGAGWEQVFTDFERLRKTNADAIADMAVENFVEMRDSTGDPRFLFRKAVEKVLLNAFPGEFVSRYSLVSFSHVPYRLAYQMGALTDGIVSELSEGLPRAEDVDLKRAAELIRSRLTPFMKEHADGFRTEG

SEQ ID NO: 14406 - protein, 426 aa, Myxococcus xanthus
MTTPYLFEDSESFARKLDAEDALRGYRDAFHFPPGPDGKPVVYLAGNSLGLQPRNAARYIQEELEDWARLGVEGHHHGRHPWLHYHELVTEHAARLVGAKPLEVVVMNTLSVNLHLMMVSFYRPTKQRFKILVEAGAFPSDQYAVASQVRFHGYDAREAVLELKPREGEETLRTEDILETIERHGHEVALVMLGSVNYLTGQAFDLAAITKAAHAKGCFVGFDLAHGAGNLRLSLHDDGPDFAVWCSYKYLNAGPGALGGVFVHERHAHTKDLPRFEGWWGHDKQTRFQMGPTFSALPGAEGWQLSNPPIFQLAALRASLELFDQAGMPALRAKSERLTGYLEFLLDRLPEGFVRITTPRYVKQRGAQLSLRFRGEPQGLLKRLGDAGIICDFRKPDIIRAAPAPLYNSFTDVYRFVKTLEGHARE

SEQ ID NO: 14407 - protein, 259 aa, Myxococcus xanthus
MFGYWTKPEHGADLARFLNDHLVSVVHAHPKRFVGLGTVPLQSPELAVRELERCVKELGLAGVQIGSHVNDWNLSDPALFPFFEAASELGASVFVHPWDMMGEAKMQKYWLPWLVGMPAEVSLAICSVIFGGVLERLPKLRFAFAHGGGAFPHTLGRIQHGFEARPDLVAVDNKVPPRDYLGRFWVDSLVHDPEALRYIVRLFGQDKVALGSDYPFPLGEDRPGTLIESLTELEPAARERLLWRNAFDWLGRAPEDFAP

SEQ ID NO: 14408 - protein, 132 aa, Myxococcus xanthus
MGRLTPINFKKWIDEHRHLLKPPVGNQQVWEDREFMVTVVGGPNARTDFHINEGEEFFYQLEGTMNLRVIDEGQVQDIPIHEGEIFLLPPNVPHSPQRPAGTVGLVLERRRQPKELDGFMGQRVQNGDKLCT

SEQ ID NO: 14409 - protein, 48 aa, Myxococcus xanthus
MKKDFPTFNRLWAEYFKDNPPCRTTLEINRLPTPIAIELKCIATIGGE

SEQ ID NO: 14410 - protein, 256 aa, Myxococcus xanthus
TGSTRTGAEIARVAAPAFKKLSLEMGGKNPNVIFADCDFDEALATTLRSSFANQGQICLCGPRIFVQRPLYERFKEALVTRTRALKVGDPLEAGTDQGALVSQQHFDKVLGYVSLAKQEGGRILTGGQRANVPGRCRNGWFVEPTLIEGLDAGCRTNQEEIFGPVASIMPFDSEDEVLAWANSTRYGLAASVWTQDVKRAHRFASRLHSGIVWVNTWMLRDLRTPFGGVKDSGVGREGGWDALRFFTEPKNVCIKL

SEQ ID NO: 14411 - protein, 208 aa, Myxococcus xanthus
VAVSLSQVRETGLARSLGAAPPGYRVLEPSQALASVALAVEHMPAHLLSGVVGAAWPWRQAGLGEGQGLDAAHVFLVQRPGDVPPEGLSDAVLHSLPEWPCRADGAVDREALAADLSGAGDGAAAGPFETVVMDAFHEVLGAQGVGVGSDFFTLGGSSLQATRVVARINERTGLQLREVALFEHPTATALAEHVRRVVDLTQLDNLIA

SEQ ID NO: 14412 - protein, 290 aa, Myxococcus xanthus
MGDRLTTFYEDQLYADDVVHASSSPYQRIILTRGKRGFSLFLNGNLQFASLDEYRYHESLVHPAMVRAGKVENVLILGGGDGLAAREVLRYPEVRSVTLVDLDPVITGLATNYGELAKLNRHAMTDPRMRVVNGDAMQFLTEGGAQYDVVVVDFPDPNNFALGKLYTTGFYKLLKKRIAPDGVAVVQSTSPLFARRSFWCVETTLKAAGFWTEPYHALVPSFGEWGYVLIAHEPPARHRPLPEGLLFLDDATMASLTQFPPDMGPLPVEVNRLNNQVLVHYYEAEWQRWN

SEQ ID NO: 14413 - protein, 216 aa, Myxococcus xanthus
MSATLPPDSAVHRRDCVPLVVPPVTLEGHDVRLEPLRPEHAPALAALCEDDIFTWFSSVLRTEADVAAFIDNACQAAERGSERPFVIIERRTGAPVGTTRFLEIQRDHRTLEIGYTWLGRRVWRTRINTECKYLLLRHAFESLGVMRVQFKTDKHNARSRAAIERLGARFEGVLRHHKLVRGGVVRDSAYYSVVDTEWPEVKVRLEGLLADGGARV

SEQ ID NO: 14414 - protein, 412 aa, Myxococcus xanthus
MGAVTDVDDAGRPRFEESLLIHEPEERFFYRGHWYEGLYLHAGASVEDLEELRRFEARMNGFASARDAKGRRAFAVPSGLSSDDAEWTALDALSMAAWMEREGFRSARLKWVVDYACRDDFGTTAEHVSAWAGIWYFTARQDGNGERSEGYLSWPEGNGRLVRQLVSALPNGAVERSVLVHTVEPVEGGCRVDALEAGSGKPRAFLARQVVLACPRFIAAHVVAPWRRERPAWLNGFTYGPWVVANLTLSSPPRSRGFPLAWDNVFYESRSLGYVVATHQTLRQDEQGPTVLTWYLPMDGADVKAEREKALSASYADWEALVMADMRPAHPGISGQAQRLEVQRWGHAMVRPTPGFMWGQAKQSAGESLGSSLHFAHSDLGGMGLFEEANWFGVRAAERVLAELGRREVSWL

SEQ ID NO: 14415 - protein, 440 aa, Myxococcus xanthus
AAITEISVGYPGRNGTIPFENGFLSEMLAGHGYNTYCVGKWHLTPAEQTSAAGPYSRWPLGRGFERYYGFLGGDTHQYYPDLVHDNHQVRPPKTPEEGYHLTEDLVDRAIGFIADAKQVAPDKPFFLYFCTGAMHAPHHVPREWADRYKGQFDDGWDAYREKVFRRQLETGVLPPGTRLSRHDPDVQDWDSLSPEERRLYARMMEVFAGFLEHTDHHIGRLIQSLEASGELENTLIMVISDNGASPEGGLHGSVNELKFFNNAPESLEQNLAALDELGGPRHFNHYPWGWAWAGNTPFKRWKRETYRGGTTDPFIVHWPRGIQARGEIRSQYCHAIDMVPTVLDCLGIDPPTELRGVTQSPIEGVSFKYSFQDADAESRHHTQYFEMFSHRALYHDGWRAVCPFPGPSFTESHEPFGMLKLTEARLREFDTEGWELYHVG

SEQ ID NO: 14416 - protein, 74 aa, Myxococcus xanthus
PWRQTSRGGGYTLDGALREALLALPTEIMAASGRFIYDNCAALRGANRPFVPLFRNFPESVPHDTRQLYVQRML

SEQ ID NO: 14417 - protein, 141 aa, Myxococcus xanthus
MGRALASVGARRKRPRPVVRCPWPERQRQQRLWQLKCRAVYARPEEPVCYEDEMDVHLNPKVGPDWMLPGERREVVTPGNNQKRYVAGALNSRTGELTWVKGERKTSALFIELVRAVSEANPMARRLHFILDNAATHSSET

SEQ ID NO: 14418 - protein, 350 aa, Myxococcus xanthus
MITVFSIAFAVGTPLVITLTSSVDRKKLLIFFMLVFAAANLVTLALSDYGWLNASRAASGLSAGVVEVIALTLAATLAAPGKKAGAIAMVVIGFSAALVVGVPLGRVISGIMDWRYIFAGLGVLTLASLVLVVRAIPSTRGEAAVPLKHQLKLLKNGQISIVYVMTFFWISAFSIIYSYISPYLANVARMADGTISIMLLICGIASIIGSRLGGWFTDKSGYAPTLLAGFAVHCATLGLFFLFGQSAWIMYALLITWSLSAWSSGPALQFRLISLAPESTSIIFSCYTSMIQFGMAAGAIAGGVVIQIGSLDQLPSVGAASVLVSLVLLATVASEKARSGHKLGLPGRKA

SEQ ID NO: 14419 - protein, 249 aa, Myxococcus xanthus
RRAVSSDPAWRMESGEGFLRALGPSPSPFDNSLCWAHTDEENVEAVIAAQMAYFRSLGRAFMWKVYTQDSPSDLETRLLRAGFEVQAHVTLVVLDTARSQPATALPPGVEIRRVDDATGLAAAMKVQEVVWSQDCQWLHDALKEELRTQPDTLSIFVGWSEGRPVCSSWIRIEEGAPFASLWGGSVLPDFRGRGFYRAMVAARAEVARQRDIAHLYVEAGDMSRPILERLGFQALSQVAKCIYRPPGVA

SEQ ID NO: 14420 - protein, 211 aa, Myxococcus xanthus
MKQIIDDFHALYFGALVTREYHGGGERWMGVPIRKVPHDLWIYQEILHETRPDLIIETGTMFGGSALYFAHLCDLLGHGQVISIDLDQRESVPRHHRIEYMQGSSVAPEILERVRGRIAPGTRTMVVLDSDHSAEHVLQELRLYSPLVSPGHYLIVEDTNIGHPLHTFQVERGPMEAIEAFLPTAPDFERDSSREKLLFTSNPGGFLKRIR

SEQ ID NO: 14421 - protein, 1311 aa, Myxococcus xanthus
GPCWKLWSPTGSSGWLAFPCWICPRIVLVPAVPNFRAGTHAVALPRPVSEAVESMARRHGATPYMVLLTAFSAVLGCFSGQREFAIGTPIAGRTHAKLEGLVGLLVNTVVIRTDLTGTPTGQELLARVREAALGAYAHADLPFEKLVEAINPERDASRTPLFQVMFSLQEETGGAHTVDNLGLEPIERGTRTTQFDLTLWLRPTHEGYSGALEYNAELFEPTTVARLAHALEQALERLTATPEREFTALTRPQGRQWQALLAASTTSPAPAAPFPGVHQFIARQSRIHPERLALMAPGEVLGYGELDRRATHVARVLRTAGVGPETRVALCAERSVDAIVAMLGVLKAGAAYVPLDSTAPRERLLSLIEGVEAPVVLVQTGLAAGVSGTPARVIHLDVLRAQAALEPAVPLDVDVCPENAAYVLHTSGSTGRPKGVVVPHGALMNHLLAVQQRYGLGPEDRVLHFATLSVDVAAEELFPTLAAGATVVLSPPGAAPPVAEFLALLEQATVTVVNIPAPYWHEWVEELPRLPVAIPPSVRLLVTGSQAPSPERLARWRERVPSHIRWLNAYGPTEATITATVCEPTARVEASRVPIGRPLAGGCLYILDASGHPVPAGAPGELFIGGAGLARGYLAQPALTAAAFVPDPFSGREGARMYRTGDLARLLPDGDVEFLGRRDHQVKVRGFRIELGEVECALEQLAEVREAVVLHRQAPAGDGHLEAHVVPAVQGLAEATLRLRLGATLPSSQIPARIVMRESLPRLPSGKVDRRAVSGWQASEALHAPRPPPRNATEETLVRVWTEVLKRREVGIHDNFFELGGDSLLAIRVVARANDAGLRLTARQLLLHQTIAQLSEVIGDQPEPPAPTAVGGPIPLTPSQRRFLESDVPAPHHWNRSLLLDVHEPLQTEAFQEALRLLLARHDALRLRFVRHESGWKQFDAGSAATPPFSRVDLSSVPDTALPPAIESAAQALQRSLTLTDGPLFRVAAFDLGAHRPGRLLFIFHFLIADGVTWALLTDELQEAYRQILEGQSIQRPPAPVSFRAWAEHLHALAHTPRLEQEATAWLSQLEGACGRLPHDHPGTNSEGSMRSVRMSLREDETQRLLQHASATRSGLEAVLLTPLAHTLSQWMGGAALRVDLGRHGRAELEGLEPTRTAGCMAADVPVRLDVVGASGLSQALEWVASSLRQLPGQGLGHGLLRYMNGTEGLARRLGALPGAEVSFDYMSQRMLTENPAFRLARESTGTDRDPSARRSHVFQLIAAVVDGLLQFEWRYSNELHEPSTVERLAATYLAGVRHLAESRSERNTTP

SEQ ID NO: 14422 - protein, 242 aa, Myxococcus xanthus
MKTNASVLAVMTCSLLTAPLAIADNTAPVKSASVDLNGDGTPEAVSIQFDEPKNEFILKAGSATIRGPGDDNEPAGVFIVDLDSRDKRKELVVRTGQTDYDQRSYIYGFDGKALKLLGTVPALTEAKGNGIILSDSWQGFWNRRDKYVVDAKTGKVSEVPQDLYAVGVEATVKQSFPLARSRTDKSAVATLAQGSKIQVLAAAPPGRKGEGYLYLVKSSTGLLGWATAKDLTWKTDGLPIAG

SEQ ID NO: 14423 - protein, 163 aa, Myxococcus xanthus
LGYRMGTELTAVASFGNLQAPCRLVQLSLEHLTLNLGTQAAPKPGDTASVVLGHGERWATALDVEVMDVRGAPEVSMRFLAPPLDAGRRIVSVLEALRDNGLLLPPETRPVWKERIEHPDRVRRICDALVGRQARGMARTADGRKVPVTAAYFDPHEGRMGWR

SEQ ID NO: 14424 - protein, 167 aa, Myxococcus xanthus
MALERGGVDGTAGRDVCVPTRAYYDFDPNVWVRQPMEDARIVLQDGTHTITLVMKNGKAKRLFSFQGPGAEDRLTRGQEYSFRWLPEGEVPSRAAATLLREGGSATATIPTEQEEAVLRFTLLPTTPVAAHLLTLSATAPGEVLECTGVATCEATVFHSEERVVNVQ

SEQ ID NO: 14425 - protein, 26 aa, Myxococcus xanthus
MGRAWELIGIIKPEHKPFGIVTDVGD

SEQ ID NO: 14426 - protein, 376 aa, Myxococcus xanthus
RHWLSLMPGEERLCLTVELRIDPQGRVTAADVYESVIRSWARLNYDEVAAFLDRGEVSAPMEPVREVMPWFRLAAARLAVARAARGGMEFARDEARFTFDQATGELSGLVSEKPTSAHAMIERFMVAANEAIAGWLLARGLPGVYRVHEQPDPLRVADLNAFAETSGFAAGFGRELTPLALAAFDRQIAGAVAEPALRSVLRRSLGPSRYTVKPGPHFGLAAPLYLHFTSPIRRYADLAVHRTLKGYLRGRRDFVDEDPGMEALAVHINAKARASTRAENDRHRELEARWMAGHVGKQFQARVTRVRPFGLVVQLDGMLVEGVVPADALSGGPFRPDARELSLVGKERTFTVGMPVTVKVTSTDEQLGRIELSLVE

SEQ ID NO: 14427 - protein, 888 aa, Myxococcus xanthus
MGYHDTHTPNVILRNVFQNPGWYTQYTPYQAEIAQGRLEALLNFQTLVMDLTGLEVANASLLDEGTAAAEAMALALAVHQKGEESGAAFFVSDGCHPQTVEVVRTRAQPLGVEVVVGDHRTVDLSSKKFVGALVQYPTTDGAVHDYRAFGEQVHAAGGLFVVAADLLSLTLLTPPGEFGADVAVGSAQRFGVPMGYGGPHAGYFATKNAYTRVMPGRIIGVSEDAQGRRALRMALQTREQHIRREKATSNICTAQVLLAVIASMYAVYHGPSGLKAIAERVHGLTVLLARGLAKLGLKLKNDQYFDTLRVELSAAHVRAVLGAAEAARMNFRRIDEKTLGVSLDETTRPADVEDILAAFATGTGKSSAPVLADLVGDGVESAVSQALRRSSAYLTHPVFNSYHSETEMLRYIRRLEAKDLSLTHSMIPLGSCTMKLNATAEMIPVTWPQFGRLHPFAPTSQAAGYKVIFEQLEQMLTQVTGFAGCSLQPNAGSQGEYAGLLVIRAYHQSRGQGHRDVCLIPSSAHGTNPASAVMAGYKVVVTKCDENGNIDLDDLRAKAEAHKDALAALMVTYPSTHGVFEEEIREICAIVHERGGQVYMDGANLNAQVGLTSPGLVGADVCHINLHKTFCIPHGGGGPGMGPICVASHLVKFLPGHPVIQTGGSEAIGAISAAPWGSASILLISWMYIAMMGGEGLTQATKLAILNANYVAERLNAHYPVLYRGKRGKVAHECIVDLRPLKKTAGVEVEDVAKRLMDYGFHAPTVSFPVAGTLMIEPTESESKAELDRFCDAMIAIRQEIRDIEEGRMPKDNNVLKHAPHTARVVAAPEWNRPYSREQAVFPTPWVRDNKFWPSVGRLNSVLGDRKLVCSCPPIEDYMTPEPKAATA

SEQ ID NO: 14428 - protein, 129 aa, Myxococcus xanthus
MADNIPGDLKYTREHEWARVQGTSVVVGVTQHAQESLGDVVYVELPKVGSTVTEGKQFGVIESTKAVSELYSPLTGKVVKVNDGLSDNPSTVNTDPYGAGWIVEIEPSDPKQVDGLMDAAAYTALLQNS

SEQ ID NO: 14429 - protein, 278 aa, Myxococcus xanthus
MQVVQFVDREGARRTLLFNPSDYERGVSAPFYRALRERYGGFVSDKVMSTRHGSVQSHLAALGLIPSDVDYLAFDHLHIQDLRGWLGGDGMPAYFPRARLLVQRAEWEVALEPHPMQAVWLVPGGADIPRERVVLLDGDVWLGQGAALLSTPGHTRGNMSLAVATSREVFVTSENGVATESYTRSQSAIPGVRRFAEHMGWEVVLNGNTREDSLDQYSSMVVEKLFAGTSSVEGAFINFYPSSQLTAHVMAPGLSPTIVLPAPNFGDVRPTPASRRAA

SEQ ID NO: 14430 - protein, 204 aa, Myxococcus xanthus
AALAGMGIDNLRVELDGPEVPIMDGSAAPFAALIQSAGVREQEAPKELLVIRKAVSVVDGDKQASLTPARHFRISCTIDFEHPVIQGQSFDLDFGDRDFAREISRARTFGFLRDVEKLKQMGLARGGSLENAIVVDEVSILNPDGLRFPDEFVRHKILDAIGDVSLFGRPVIGHMTAYKTGHALNHKLVRKVMSDPSCYEIDTA

SEQ ID NO: 14431 - protein, 471 aa, Myxococcus xanthus
MRASQTSRAGFLAERERWLRGVPVEGREELLFEFEMLLRAVERYLNLNTVVDARDRPLVTRDFREELADVRDAMDRAIRVARHLQDPDSDQKMVFRKYVETQLADDRVRRALIEEQLDQETPPESLFVLREAFDALKNLLDHLLKLPAANLGLFQDVGKLSLREIVLNRYFRPFRPLEFRVEYDRLRSVRLLDTLVTLQEEQRTAFTTAFLGLFRLLHYLAYVDAEEQPPFSRRVRVLLALVRSEATALASWMHSELSPNAGSKSLQAATLRAARDIARETERVAREVLVNLDRDAEAPLRAASAFTAVLRTQVVALVEALAPNGGLADGVFDELMSPQEAALRLRKDLWVYAQLCRAAESHLRAEDVPAAERVLDALKGFLGYFHDGSYQLLRYGDYDAFDRFTSLLVELPWPPEGPGIRARLGEDLRRFIQTLESTFHSVSRRTHLQGRGFDRQDAEALRDRFLTTPAR

SEQ ID NO: 14432 - protein, 78 aa, Myxococcus xanthus
MDRKILLTILDKFGGGPVGVETIAASVGEQRDTIEDVYEPFLMQEGFLQRTPRGRMATHRTYQYFKKQPPPTPQGSLF

SEQ ID NO: 14433 - protein, 168 aa, Myxococcus xanthus
LSTVLGIALTSLSIVLSLSMLVVQNAAGQFSPRLLRHFVHGAGIRVVIPVFVATSVFCLVATHEFGLVAGAERAPRPALSLAMLLLVVCEGALVFHVLHTLQSMRVENIVQRVRVDTLRVARRLERLRSGDLEAPAEVPAPTGGRWPLRAEQNGFVVSVDARRLLEVA

SEQ ID NO: 14434 - protein, 349 aa, Myxococcus xanthus
MPVGLSFFVFQAISYTVDVYRQKASAEHSFIEHLLYLLFFPRVVSGPIVRASELMVHFRQTPSLTPEAGGHALFRIAVGLVKKLVIADVLGAGLVDPVFAAPEKYASAECIVAAVAYTFELYYDFSGYSDIAIGVAALFGFKFPENFNRPYLAKNIGEFWNRWHLSLSTWLRDYLYRPLGGNRVSKPRVLFNLMTVMVLGGLWHGADWRFAVWGAVHGVALCVSRCWEWSVGKPESPGIPRVALGMLTTFTIVVLTRVVFRAADMAHAGEFYERMMAGVPGIANVSPLVWGMLAAAVFFHAVPMKLYTVSSDLFVRMPVPVRAAVLVVLGLGIRHLSAVEARPYVYLQF

SEQ ID NO: 14435 - protein, 39 aa, Myxococcus xanthus
MGRPAQPAELAPSYVFLASDESRYVNAEVLGVTGGRLLA

SEQ ID NO: 14436 - protein, 675 aa, Myxococcus xanthus
SKWPRDRVGWTGVAFSSEKGSQSTRYDVEGSRVAELFFLAQPASGSVQFSVDGKPLQRIHTRGFSKNKSEAAFARVTLPQGAKSLTLTTSGKVELHGMTLESGAPGVVYDTVGLLGGMAEVYLRAQPAAFRAQLRQRKPSLVVMMVGGNEAFFYSRDRTTLDEVRAQIKELMSRVRTNVPNAACLLMAPIDAGVRTMSGEVVSRRGTQEIGAIYREEARAAGCAFWDAYAAMGGEGSALRWLEEGLMLDDLVHPRARGSDLLGHLFDLSLQRAFAKSRAPLVAVVDPAGLQNADTALARTFDKLKRREAGEALRVGVAQLGGSHTASHYFTDAVREVLTKRFGAAGRGFIAAGKASPRLEPAGVTRALEGDWTIEDAAKDAPPGGLWGLTGIRAVGGPGAKLRIQFCKDCPEAKESSGRLDLYALDAPDVRAPDIAIDGELLPPDAPPPEPLTEPTVRIRSFPVTGSSHTVEVTAPKDGNVTVLGASLEYDTPGVVYDALGLPGATASTLGAMDAASVDAQLASRRPDLLVFWYGTNEAGRTDLDASALRRDYTEMLTRLRKATNAECLVMGPTDRLTQDANGRWSEAPSLASVLNTLPQVAKDAGCAYWSTRAAMGGERSMLRWQRTQPALGHADGVHLTPEGYARLAGAFSRELLTAYEAHKKAGPTSRVEDN

SEQ ID NO: 14437 - protein, 109 aa, Myxococcus xanthus
YRAALPAYEVPTEAEAYEMEYYFEVADAAQRRLAGRGDSFQPLIFQVAPRAVRAGAAADPSSRPWYKSPWLWVGVGAVAIGATAGIVALTSGEERGRVPITIRVEPPAP

SEQ ID NO: 14438 - protein, 135 aa, Myxococcus xanthus
MERAVANDVQALQVAVVSRGSSRSCTEIQRTCLGTQVRRDDLVVLKDAQGREGRALRFPVDLATLQSGGSLELAVDVPVGRDYALVIEAITTGTPPGFLGSSCNYLREVNAGDNAPVIAAPLTLTGGDCNPSIAP

SEQ ID NO: 14439 - protein, 226 aa, Myxococcus xanthus
MSRILIIEDEQDLAGLVDYNLRAAGFETETASTGASGLAKARAHPPDLVLLDLMLPDVAGSEVLRMLKADTELRKASVIIVSAKGQESDRVQGLELGADDYVVKPFSVRELLLRVKAVLRRADAEDGPSAVLASGDISLDTTRHQVRVKGEEVLLTALEFRLLRTLLERSDRVQTREVLLSDVWGIQAEIHTRTVDTHIKRLREKLGPAGDIIETVRGVGYKLSPP

SEQ ID NO: 14440 - protein, 403 aa, Myxococcus xanthus
MQRQLDLLARHTRERAEGGASTAAPGVPERLDEVAGLEGAIDSLHAQLSARNAALTQEARTLTAVLDGMTEGVWVTDAEGTVVRHNDALRPLLASTNSPLTGQRPLALIRNEALHDAVMRACRESASSHLELTLDGHFPRTLSIRVTPLAKDLPGSAAVFHDVTELRRLEKVRKDFVANVSHELRTPITAIRGYAETLQGGALNDPVMAPKMVEIIHRQSERLSELVEDLLELSRLESREVSLKLARVTLADAAARAADTVRPKAGGKGQVVSLHVPQDLLAVGDPRAVEQVLLNLLDNAVKYTPAGGRVDVYGEYEQGRCVVRVKDTGVGIEAKHQSRIFERFYRVDKGRSRDMGGTGLGLAIVKHLLQAMDGEVKVESEPNGGSTFTIFLPLAASSSAATG

SEQ ID NO: 14441 - protein, 314 aa, Myxococcus xanthus
MRVAILADIHGNLPACEAVLEDIARSVSPDYIVAAGDLALRGAHPRETVDLLFDRCDSVLMGNTDCYLAGNYLGGAYREKDHWKTELLRWTRDQLGGALLEKLGALPFSVRYTPRKGQDLFVCHANPRNLEESLDPTLDDVAVRRFFSHLDAAACAFGHLHFPYRRRVGRMLIADVASAGIPRDGDLRPAYGVFTFTPKGWRVQIRRVRYPVRKATQALTARRVPGGPLLVHKLVEARYRHHNALMEAARRHSGLPPPGPVLRPPPGAASRAAATPMDSRPSPEVDPASLPTDLDGTVTGAAPLPLDALNDFEG

SEQ ID NO: 14442 - protein, 164 aa, Myxococcus xanthus
MSARELPLLFIRHAVAEDSHVLGDEARALTPEGRAAFRHHARKLARLTPLRGIITSPLVRAVQTAELLAEAFGVSGVEVHPALLPQRGAHKRIVDLGRERGAGWALVGHNPSLERAAIRALEHELPDKLRKGAALALHPLKNGGFTLAWWATPGKPVKRPGDLR

SEQ ID NO: 14443 - protein, 276 aa, Myxococcus xanthus
MTLRTLGLTLLGTAGLLTLSACKKEEPAAAPPAAAPAAKKEPHAASPIQAPEGAAAAPVAPAGKGVVKGTVKFTGTPPEAADIPASNDPACEGMATKDASVLVKDGNLQNVVVRVKGKVPGAPPAPATPVVVDQSKCTYVPRVQGAMAGQQVAFKNSDGTLHNVRGIAGTKPVFNVAQPPSGAPVERPLPADADVLKLKCDVHPWMSAFVVSNENPYFATTGADGAFALEGLPAGTYTVEAWHETLGSKTAEVTVTDDAPAEAAFSFSAEDASAQK

SEQ ID NO: 14444 - protein, 66 aa, Myxococcus xanthus
MAIGTVKWFNDAKGFGFIAQDNGEDVFCHHTAINMDGFRTLQEGQQVEFEVTRGPKGLQAQNVRAV

SEQ ID NO: 14445 - protein, 124 aa, Myxococcus xanthus
MGDTSVKKVESRHSPKGEMGQKYLASGVRLSMRLWEDEPPGEPAPATARDYETVGFVLKGRAELHLEGQVILLNPGDSWLVPRGSSHTYKVLETFSAVEATSPPAAVHGRDESKDAGTKPPAKA

SEQ ID NO: 14446 - protein, 199 aa, Myxococcus xanthus
MLLTPEGPLIDSFHIARYADAHGSAPTLFPAEHAEEIAAWNARSEAALGAARVRYLDRLANDRAAKLEQQPPAFPGFVRQLSVPAVDLAMTFLRRKYGMPDSTAAEATLVFELEALQRALAGGKRHLVANRLTYADLAMAVTLQFVSPVDGGHIAVGPATRAAGIHPQLCARYPDIVAWRDALYARHRRSEQPAEPVQE

SEQ ID NO: 14447 - protein, 221 aa, Myxococcus xanthus
MQFNITFRQFGASDSLKEYAREKVERVNRLLDRAGEAHVVLSLERHLHHADITIHSGAWVLRGRDKSDDMYASIDLAMDKIERQLRRYRDKLKSHHGRERVHHRHDLVEQLRVRHAVFELPDVDALTSLAEASASEDAPKPAVVPAQPAAPSQAAREVRATHLTVKPLTVDDAVMQMNLMNNDFYVFHNVESESLCIVYRRKDGQYGLIEPHAPAIAATGT

SEQ ID NO: 14448 - protein, 430 aa, Myxococcus xanthus
MGRLGGFVRARLHRRLFMWFGLSILATGAVVATVMSLVGGGTWKQEGDRVRAFVGHRFEEVWDEPARRDALVASIEKDLQVGVELRDASGAMLAQSQVPCRRPELNLPVVRDGITLGSVRACYASFRPKNPLRMVLPLALSCMVLWLASGKLARRLARPMDALVRATRELGSGRLDSRADVAPHVTGEFAVLADAFNDMAGRIEKQVADQRELLAAVSHELRTPLARLRVLTELLRDGGGNPKTLDQVDREVVELDALVGELLASSRLDFGQLTPRVLDGQTLATQALERAGLASSLLGMDVERAGLVGDATLLGRALANLLENARKHGTGAEALRIQERGEHLAFCVEDRGPGLQPGEDERIFRPFYRRDQGTEAREAGSLGLGLALVQRIAHVHGGDVFAENRPGGGARVGFTVRKNGPPASEGRPTA

SEQ ID NO: 14449 - protein, 226 aa, Myxococcus xanthus
MSTRVLLIDDDTRMYELLEQYLGQNGLSVTHAADGGRGLAALEASAFDAVLLDVMMPGMDGLEVCKRIRAKSRIPVIMLTAKGDETDRVVGLELGADDYLPKPFSPRELLARLRAVLRRSQPSAVADRLESGGVSIDVAGREVRVEERAVELTGLEFDLLVALVRRAGRVVPRDALLGEAGRSDTVVGERTVDVHISHLRQKLGDVGTRLIKTVRGVGYVFAKEGP

SEQ ID NO: 14450 - protein, 127 aa, Myxococcus xanthus
MEAFAKARDEVGPSRTALGAALRGEHFDGAALRELFARHDVAIDNVRRTVQGSLAQVHEALDPRQRRELADLLEHGFGSAYGWHGGHGGWHRRCGGPGGWRGGGFGHGGHRHGDGHGPWGRDDARGV

SEQ ID NO: 14451 - protein, 425 aa, Myxococcus xanthus
MKVQVEELSPIEKKLSIEVDNARVAEELSRAYSNLGRQVRLPGFRQGKVPRRILEQRFRDQVEDEVIQRVVQSAYVEAIREHNVEVVATPQVTNSGLKPNTPFTFEARVEVKPKVEAKDYVELPLTKSDTAVTDEQVNEQLERMRQSMARLEPVTDRDTAASGDYVTVDFDATVDGQPFAGSKAEGITVQVQPGELVESKIAALEGVKVGESKDIDYAFPQEYRVEEVPGKTARFHITLKGVQKEIVPELNDDFAKQSGVAQSIDELRTKLREDMEKARKSQVEGEEREALMKALLERNTFDVPRAMVERAMDSMLRGALQQLQRSGVDPRQLNLDFNRLREDMREKALQEVKGTLLFESIAQKEGIQASDADVDARIEQLANEAGQPVAVVQKYFKGADERLGLSLRLREEKTIEFLRSRAKYS

SEQ ID NO: 14452 - protein, 203 aa, Myxococcus xanthus
MPVPYVIEQTHRGERSYDIYSRLLKDRIVMLGTEIDDDVANVIVAQLLFLESEDPDKDINLYINSPGGSVTAGLAIYDTMQYVKCPVSTICVGQAASMGAVLLLAGAKGKRYALPSSRIMIHQPLGGVRGQATDIEIQAKEILRMKAKLNELIVKHTGQSIERVEKDTDRDYFMGASEAKAYGIIDEIQNPRKVVGLGKEEKK

SEQ ID NO: 14453 - protein, 197 aa, Myxococcus xanthus
AGKNVEKRDNQTLCCSFCGKSQKEVKKLIAGPTVYICDECIGLCNDIIAEEIDREETKDTKLRIPRPSEIKAVLDEYVIGQERAKKTLSVAVHNHYKRIESKVAMEDVELQKSNILLLGPTGSGKTLLAQTLARILNVPFTIADATCLTEAGYVGEDVENIIVNLLQAADHDIERAQRGIVYIDEIDKIARKSENPS

SEQ ID NO: 14454 - protein, 303 aa, Myxococcus xanthus
EANPQQKAEGTAAGQGGQHAGWTRERVELVKRTICPRGISEDEFALFIEQCKRSGLDPLLKEAFCVARRQNAGNRERPNWVTKYEFQPSEAGMLARAERFPDFKGIQASAVFTEDDIVVDQGRGEVVHRFNPAKRKGALVGAWSRVVREDKLPVVVWLDFSGYVQQTPLWSKIPTTMIEKCARVAALRKAYPEAFGGLYVREEMPAEDYESHSDEHGSGPYEVLGSKPGPLKASFPPLAPQEPRASQAAAAQLDIDVPLQPKQPRESTLEAVPAANPEPAAPRPKPSAVVVAFGPHKGKTAGE

SEQ ID NO: 14455 - protein, 168 aa, Myxococcus xanthus
KTFLVVNPRSANGQTGKRWAEISAQVGRALGDFGHGFTQGGMDAARITRQALLDGYECIVAVGGDGTLNEVTNGFFEDGKALNPNAALGLIPRGTGGDFRRTFGWDLELASSLERLRSGTTEPFDVGQLEFIDNAGQPATRYFANIASFGVSAVVAQEVNQSSKAFRA

SEQ ID NO: 14456 - protein, 247 aa, Myxococcus xanthus
RLPYGEKTVPVKAFNFTEDVVGHHERYLWGHASVALTSRVADSFAKFRWSPNIIGPQSGGAVENLPLHQYEAMGEIQTKIPTEVMLTERREFELSEEGFIGLVFRKDSDNAAFFSANSTQKPRFFGNTPEGKAAETNYRLGTQLPYMFIMTRLAHYIKVLQREQIGSWKEKSDLERELNHWLSQYISDMDDPAPAVRSRRPLRAARVVVEDVEGQPGWYRCSLQVRPHFKYMGASFTLSLVGKLDKE

SEQ ID NO: 14457 - protein, 163 aa, Myxococcus xanthus
MAESVHLYLKANGSDIKGDSTQTSLGRADSIECVAYSQKVFTAREAGSGLATGRRQYEGIEITKRIDKSSPLLMKALCENQVIDATFKFFRPNPTGDGTTEQFYTVSIKKARINAIQQTVPNSFVPASTNLPPMETLQLVFHTINWTITQGGVTHEDTWDTQR

SEQ ID NO: 14458 - protein, 138 aa, Myxococcus xanthus
MQSRTKPEVLRELSATLVRAHPLLTADRLVEVLREREKLGSTGIGEGVAIPHGKLPGMGQLQAAFGVSHAGVDFEAIDGKPTHLFFALVAPENSAGVHLKALARISRLFKNPRFRAAILEAPTAADIHALIVQEDARP

SEQ ID NO: 14459 - protein, 131 aa, Myxococcus xanthus
MGSRGLLSRIAEGNGTLAPPGDVVESIAEHLRNLLNTRKGESVASPGYGILDLNDIVHSYPSAIPRMTQSIRQAIQEFEPRLKSVVVHYNADPVDPTALRFDITAQLATRDRRGMVRFHTQVHPGGRVDLW

SEQ ID NO: 14460 - protein, 583 aa, Myxococcus xanthus
MFSKYYLSELSYLREMGRAFGLANPSVAGLLVERGADPDVERLLEGFAFLAARIRERVDDDVPELVHGLTELLLPHYLRPLPASTIVEFTPHLRALRGRSRLAAGAEVASQPIDGTSCVFRTTTDVDLLPVQLTDALLDRSSITAPVLRLYFQTTEQGRAEVLREQGLRLFIHADLSAASVVLLWLLRYCRQVRVRGASGQGDGIKLPVNAIQPVGFHRDFKLLPWPRASEGYRHLQEYLTLPEKFLFFEVRGLDAAAGLKEDRFEIAFHLERPPPLDARIHREMFRLHCAPVVNLFSVPADPILHRTLDREHLLRASDLPPNHAEIYSVDSVTGLKAGRNERRVYRPFYEFTHTAGGDAEQSFYRLRRAPSPLDEGIDTYITLETPRNIAPEVNAEEALSMDLTCTNRSLPSRLQVGDLTASTSASPTQAKFKNISPVSRPARAPLGTELHWRLLSHLAINQHSLADAAALRRLMDLYNFHSLTDNLAARASRLRINAIRAVETKPVTRFLEGAPLRGHRTRVDLDEENFMGVGDSFLFGSVLEELLASHVTINSFNELSIRLHPSQTEFAWLPRNGSQTLL

SEQ ID NO: 14461 - protein, 58 aa, Myxococcus xanthus
  unsure (1)..(58): unsure at all Xaa locations
IRFRHDPSLGFPSGDVSSVTLHQVPVRAEDPYSKRPLFEVVTRFLGLXGAVSPLPHYL

SEQ ID NO: 14462 - protein, 396 aa, Myxococcus xanthus
AQRATRLGRLNLLLPGSRVPAPPGMEHPASAVDRTTWHGAAHLFGLQDVCFLCLPDLPELVADAPEPLPIPRLPPAGATGFVECATHGAATGSEWKTPERAAPRCGLTAYLDWAAFLAVVAELLRDRRLRETHLVAALPLPSTSLVFDTSAGKRAATQDLGAFIHASGVLTPFQSAFIQLAYPWLRTASSEGLPERLAAPDGALTGVLARNALLRGTFRSALGLGLAEVREVFPIPTRLDQEPRDPGSPLRALGERVTLLGPTPRGMQVLSDVTSSQRVSHRQAPVSRLISSVLRAARQLGADLTFSPSNEDTWLALRYRMESVLGRFFAEGALRGATPREAFSVRCDRTTMTQDDLDNGRLIALVELAPAAAIERVQVLLSALEGDVSLQQEEAA

SEQ ID NO: 14463 - protein, 159 aa, Myxococcus xanthus
MSGDLWPLHTFRFELTFQPEPLSGSGPEEAPVDGAFSECTGLEATMEPKAIRVGGHNLGAVQRAGPVSFGTVVLKRGLSSGERLARWFMRVTDGDYGYRCTVRIRLKAPSENGGTQTVLTYKLERAMPVKFKAADFNARATDVGIEELHLVHEGLSLED

SEQ ID NO: 14464 - protein, 358 aa, Myxococcus xanthus
MTDATSQPEHHRPTVRIFGKADARVTGLVSSMRLEEAEGGLCSLELRFEAIARYADTVAEQVFEDEQLLRLGAPIGIYTGPESAPQEIFRGVITGIEAVFSHDSAPEFVVLAEDALQKARLARRTHVHSDLKLAELAEKLARDLGLTPIIPGLRESLGLQVQWNESDLAFVRRLLATRDADLQVTGDELHVSARSAVRRGILELTLYSELRRVRVTADLAHQATQVTCTGWNAIQGARVSGQSSGSRPGPGAGRTGAELLQQTLGPRTEHLGSLPVSTSDEATAIARAAFDARARRFVRIDATAEGTPALRVGTHVRLRGLSARFDNTYYVVRASHRYDTLHGYETDFEAECAFLGEP

SEQ ID NO: 14465 - protein, 76 aa, Myxococcus xanthus
TDTAHAQERRLLGAMLGTYLAKVVSVEDPEHLARVKVRLLTAPEGLADADVALWARVAVPFSGSGWGALFLPDKDD

SEQ ID NO: 14466 - protein, 638 aa, Myxococcus xanthus
KDAEKGSWVSRIAALQDVKTYAELNWEGSFEEYLEIVRQNPKVTRTAFQRIYDMILSHGKTEYIDNKKKLIRYHFFSDEKFGGRDAIFGLDVPLMKLVNVFKSAAQGYGTEKRVILLHGPVGSSKSTIARLLKKGTEDYSKTPEGAAYTFSWLTDKKGSDGAPVKEKMKCPMNEEPLNLIPREWRSKIYAELSAPESGYTIPDGSELCPACRFVFKDLMTQYQGDFAKVMSHIRVNRLVFSEKDRVGIGTFQPKDEKNQDSTELTGDINYRKIAEYGSDSDPRAFNFDGEFNIANRGIIEFVEVLKLDVAFLYDLLGASQEHKIKPKKFPQTDIDEVILGHTNEPEYKKLENNEFMEALRDRTVKIDVPYITKLSEEVKIYEKDFNSRAIKGKHIAPHTLEMAAMWAVLTRLEEPKKHNLSLLQKLKLYNGKTLPNFTEDNIKELRKESNREGLEGISPRYIQDKISNALVSDKGEGCINPFMVLNELEAGLKTHSLINNEDTRKGMKELLTSVKQEYEDIVKNEVQRAISADEDAIAKLCGNYIDNIKAYTQKEKVKNKYTGLYEEPDERLMRSIEEKIDIPDTRKDDFRREIMNYIGALAVEGKTFNYRTNERLHKSLELKLFEDQKDSIKLKNLV

SEQ ID NO: 14467 - protein, 197 aa, Myxococcus xanthus
LDFLKGAANLLAGPMSTAVDFAGNALGLPPLITNSIKAAAGAATGNVMLAASGAMGVAQELSKNPPAKTEYHASSSGSSKADSGYAPSASSSPILNPGSSPLDPKMLDYSDALKVLEANFQQLDLLDGKKNGSLSKKDLQRISTDASLSPQLRDAARFMVENTALFERLDRQGPLAKKSIISPLYNLDTFTVQGPQP

SEQ ID NO: 14468 - protein, 528 aa, Myxococcus xanthus
MATAPAPFSVSPPHAPGLSAVPAPQHEPGTRLLVGLLLVAALVPRLGVFFVNENLFGDAVVRTELAERWLRAPHIITAYGDGAYQFGPLHMYLVGAALSVFDREVAGRVVSLLFGVLSVVPLFALTRRLFGWRAGVVAGLSFAAWGMHMQFSTTASSEAVSLFFMLATFALYAEGVDDNRFLPLFQAALMLNLACALRYDAWMYIPLLTVALCFSSQDKVVSLTRAVGFGLVCLPFPLLWMQGNELMHGNPFFPVVAVEDFHRNWVKSSLGSGSNVLWRLQQLGFWPGIALLTLSPLVALLGMAGMVRAWRSRPDTRWLVAAAVLPAAYFTFRAAVLLTFVPLGRFTVTQVALLPVFVAFGFAGLVATRGGPMLRKALAGVTVLVAVAVPVAMGVYTFRADGPLQSTMRPISPTSTNPVALMQVAKFLKAEVAAKGGAAALDVDPNYMDLQLAFFSGLPEERLARVRWDTFRQRMQEARPEVLVRFDGGALAKAEGVKLEERSLVLDGVAYQKLDGFTAPLHVYRRQP

SEQ ID NO: 14469 - protein, 281 aa, Myxococcus xanthus
MDVVLRPISDRFFHEHLLPFFQRAMGDAPGALESLQEQLGDGQARMLCERMLATALPGGVGSVDADPWADLVDRLVFLHWTEGPAGWEVGEAEAGYADGWDEALHLALMVEEADYPYWDARGSRDVRDRFRFRPREDVGLASLLAGLWEPFPEFPPDQVFTTQGRGEYSPVTRYAFADWAWRPAKKVAHWQVNLPRKLERLLTREQARMKLPSLPEKEEVLAYWLGKQPQPPPLTVAFSGLGPRAANWIRELGALTAHLRGAALAKQGLAALVTKGSGVRI

SEQ ID NO: 14470 - protein, 253 aa, Myxococcus xanthus
MVVSVSPEVETVLGVGAGRELRTEYGPEVAVPLYVEWQAGAGRGQARYRVRVGRPEVRAVDDEGMEPAWRLAEELGAVSGRDGAVVLSDRGVPVQAWVQLGPGASAALSSLVRAALSSDWLVTPRLPEEPVGAGARWVVARAQEEGLAVVTYELVELEGARGRVRFLLQSQGAEGPLAPRAEGELRFDLRRPFPERLEVLYTSRAELGTQGARRLEVVRRTRVTLESGSPLAPAHPEMIAAPWISEGEQVRAP

SEQ ID NO: 14471 - protein, 134 aa, Myxococcus xanthus
ADKKGLRYLYLDGRTKDRMGKVDEYNNPDGPPLFFISLKAGGTGLNLTAADYVIHFDPWWNPAVEDQATDRTHRIGQTRAVISYKLITRGTVEEKILALQRRKRELAAGVLGGDGDEMGRTLTEQDIQELFTEI

SEQ ID NO: 14472 - protein, 407 aa, Myxococcus xanthus
MEALGGDEAKVRERAEFLRFQLDEITRLDPEADEDARLDAERKRLGGAEKLKRHASEAELLVSGEEQSAVETVGRALGLVHESVKCDATLAPVAQALSTALSELEEAQRRLNRYVEGLESDPSRLADVEERLDALKRLCRKHGTHLEGLLKKRGEIEVELGTLENRKEILEELAADRRKVEERARKAAAALTRARAASAVTFAAQVREGLGQLAMGKAAFEVRVTPSDSLRPDGMDDVEFFFSANPGEPPRALAKVASGGEASRLLLALKKALADSDGGGCYILDEADAGVSGAIADVVGRMIKDVSSHRQVLCITHLPQVAAYADAHLLIRKGLKGERTVSEVVVLDAGAERTRELARMMSGVEVTREALGAAEALVRSANRALGTRARRESGPEGAPRGRLRRTA

SEQ ID NO: 14473 - protein, 217 aa, Myxococcus xanthus
MGGHAGGGTASRIAVETIDKEMRRAREGKDNPFLSVPNLQDSPIPEALRTAVERACLAIFTAAQEDARLSGMGTTVISLVVRDEHAFFAHVGDSRAYLIRGDLIQQISEDHSLVNEQIKAGMITPEEAKHSRYKNIITRSVGFEEEVQVDVMGLVSEPGDVFLLCSDGLANMMEDREIHETVVKARTFEEVPKRLIDFANERGGDDNITVIVVRVEA

SEQ ID NO: 14474 - protein, 97 aa, Myxococcus xanthus
VIPDHDAPVKRYTIQRSFLTQVGMGLMLVVGLGVGASVHYFQVAADASENRILREENLTLRSQLKSVRERIEHIGSTLDRVERFDQKLRAVTLLSDP

SEQ ID NO: 14475 - protein, 262 aa, Myxococcus xanthus
MKKQGSRRSDEGSEKAVRGLVTQPQGTGGWTPPAADGEVRIPVEEGVELRGLLQVPPGATGVVVMVRGHGSSRRGATDQEVARLLQHEGLATLAVDLLTAAEEEACRERDLRFNLGLFGGRLAGVARWLRRAPRTSALRIGYFGAYTGAAAALAAAAMRPEAVDAVVCRGGRLAQPGAALARVRAPTLLIVGAEDTSAQEPHRRTYAALTTEKRLEVIPGATHRFEEPGTLTQMVDLACIWFLQHLGAPRWDSLPAPRAAGS

SEQ ID NO: 14476 - protein, 135 aa, Myxococcus xanthus
MPETKIRVLIVDDDQDQLSLVERTLSAFGFDVRTHRSSLGVSNLVRTTQPDLVLLDVNIPALSGDKVLTLARGQAPKGTKFILYSASDESQLRALARASGADGYICKSVQGEELAQRLEALHLKPAASEAVQAAR

SEQ ID NO: 14477 - protein, 691 aa, Myxococcus xanthus
MGVLMQSLDDGAVVFSHNADELLNPASNVKLVTSAAALASLGPEFRYDTEFLVEPELGADGKVKTLYVRGKGDPSMTTERLWGIVAELKHAGVRDVGEIVVDDSWFDAERTPPGYDQEDTDRAYMAPTGAVSLNWNAVAIYLRPGNAPGAKGVVEMDPPSDYFVVENQLTTGPRRARRVSVTSDPSGLQQKIVVRGQLPGERGGAVSVWKKIDNPPMYFGQSLKQMLVTRGVKMKGKVKLGKTSTKARMLHVSQSDTFDVLLKRLNKLSSNFVAEQLLKTMGAELRGSPGSFTKGVDVVEQFLERDVGIPRGTYVMKNGSGLNDANRFSATQLNQLLRHMVQRFPFSPEYLSSVPIAGKDGTLKYRFEGSDAVGRLRAKTGTLESVSALSGYVTSAGGERFTFSIMANDFAGRAGPIVAGLDALGAAVAATGSSLGPSTAVAALADSGRPSGAVDDVAARIKTYLELGAQRDQRNIGFLRTAWRSERDPAVRAVLAESLYQSNPHDYLGARTLLDSYSATAEVYGRLKDVARVLSVEVPGVSSMVELAAGGNAEALARVLELAGAAGTDAQAQSEMAEALSEVARTAPEELVVALRAASAGDRDACTTLLARGLVQAGQADHPFWKSLRRTLGASDPRLASFAKGLDSTLSQKVAEAKAPAKTPEGFTPVQMVAPAGNAPESSSADNRPGG

SEQ ID NO: 14478 - protein, 220 aa, Myxococcus xanthus
MESERIRVAILEDQQVFREALVAVLEGAGMDVVADFGEPAPFFARVRETLPHVALVDLRLELPGWEASTSGMSALQCLHDFFPAVKPLVLSGHREAEVVEQCLQAGAAGYLWKQNVGCAEVVEAVERVVRGKRLLPAGLAWPRPEASPRGELGRLTPREREVLGYIAAGADNLRIAACLGITERTVKAHITAIYKKVGSENRTQLAVLGCQLGVQRPASL

SEQ ID NO: 14479 - protein, 153 aa, Myxococcus xanthus
DPHLDNFMAMPDGRLGLMDFGSIKRFSPRFVDVNQRMLRQTMRMEPLDILSLSREVGFTVELPDDEAEDLITEVLRIAGRPMRLPDYDYAVCEINRDMRHHFSRNAPRFLKIRPPPEAMMFFRSTGGLAQNLRLIGARGDFRAVFLEVTDLPA

SEQ ID NO: 14480 - protein, 344 aa, Myxococcus xanthus
LARAARNIALAHAPQKPQWVEVETEPGVLVGRRPDPLGRVGVYAPGGRAVYPSSVLMGVVPAKVAGVGEVIVCSPPGPDGLPHPSVLAAASLAGADRVFSLGGAGAVAAMAHGTESVPRVDRIVGPGNAYVAEAKLQVVGAVAIEAPAGPSEILVVADDTANPAAVAREMLAQAEHDPEAACVTLALGDALADAIAAEVERQAERAKRWEIVTSALGSRGAVLTVASLEEAWPFVADFAPEHLLIATASPREDLGQVRNAGTVFLGERSSVAYGDYMTGSNHVLPTAGLARAYSGLNLLDFYRWTTYQRVAPTAAASLAEDVGRLADSEGLFAHADAARAWGRP

SEQ ID NO: 14481 - protein, 56 aa, Myxococcus xanthus
MVPLPGALAVAERMRERDVNVRAFQALTGVGDALRIGVGPWPLMEAALAALREALR

SEQ ID NO: 14482 - protein, 197 aa, Myxococcus xanthus
  unsure (1)..(197): unsure at all Xaa locations
MRVTLFDYGAGNLHSLAKALATVPGAEVRVQEDPLRALDTDVLVLPGVGAFGAAVARLEPGREAMRAALEQGLPCLGICLGMQLLFEGSDEGEGAGLGYFAGRVKRLAAKRVPEIGWNQVEDERTLAGARLDTVYYAHSFVCRAADASVVTGWTTHEADRFPSXVRRGRVVGVQFHPEKSSTAGVRFVQAFLREVAP

SEQ ID NO: 14483 - protein, 37 aa, Myxococcus xanthus
MEDLRALAAAGAYGAVIGMALYTGRLDASAVAREFAG

SEQ ID NO: 14484 - protein, 178 aa, Myxococcus xanthus
MTTVIRETKETQVRVELAPGKGVTNVDTGLKFFDHMLATFARYAGLDLSLHARGDLTHHVMEDVAITLGTAVQQVIPATAARFAERTIPMDDALVQACLDAGGRFYYQGPLKNRLYEHWMRSFSEHARVTLHLRVLRGKDSHHATEASFKALGLALRDAMVDSGSVFSMKGSVSLEVK

SEQ ID NO: 14485 - protein, 128 aa, Myxococcus xanthus
LTRRLVVCLDVKGGRVVKGVQFEGLRDVGDPVELARRYEAEGADELTFLDISASAEERDTLWELVRRTAEQLFIPLAVGGGVRTVDDVGRALRAGADKVSINSAAVANPALLTACAERFGAQCVVASL

SEQ ID NO: 14486 - protein, 279 aa, Myxococcus xanthus
LKSGADCRGGPFGRERTGRRVQELLTNLIGNSQGVFAYATVFGILVACGLGVPLPEDISLIVGGFLAHKGAANLSVMMVVGFAGIIVGDSLIYLAGRRLGGRLGREGGGGFFARIVTPEKRAKVEGLFVKHGQKIVCIARFMPGVRAVTYFTAGSVGMSYWRFIFWDGLAALLSAPVFIWLGFHFGGELDTMISKFKEGQFAVMGVLAVAAIGYFVWRRRQAAQRAQAAAIVEPVAVPALVHESVAAPLRPQVSSTGDALFVAAPEQAAADSSHELQKS

SEQ ID NO: 14487 - protein, 222 aa, Myxococcus xanthus
MPKILLRACAVVLLAATSTAQAQAVPPAPSEAEDSSTPANPVPVDAPPDAQAAPPEAEPGEVPASAVTEDVPAVSPEVPPVPPNGGAFAKDNALVPEGTPFLPLHIEDPARARALAEETERSAPALVVSGGISLGAYQAGFLSTLVRFWSVAQREGAQADLGNPAPRVWTGASAGAVNALLGGLASCDTAFAQPTWSSEQSLFWTVWIDQLDLGRLLPLRAE

SEQ ID NO: 14488 - protein, 165 aa, Myxococcus xanthus
MAGGVNKVILIGNLGADPEVRFTPGGQAVANFRIATSESWVDKNGQKQERTEWHRIVVWGKLAELCGEYLKKGRQCYVEGRLQTREWTDKENRKNYTTEVVANAVTFLGGGGRDAGDGMGGGGGGGGRRQFSQQRGGDNNDYGQPPPDDMGGGHGGGNGDDDIPF

SEQ ID NO: 14489 - protein, 618 aa, Myxococcus xanthus
MQDTLQLILKKAHTTHFKEDWTFAYGITVTNLRGREVPFGEGGPDAQFKLKRVTEKLVVQVMTQGEGKLTARLPFMEGAASASFPHIGVKPKELAYYPALGAQPTGDGGHEVSLSNLLLTPQASGAFPLAFPPVPVEVSFFNQTQWGPLESLKLIDGGVLNNNPVDLAVRLGSRWVERSTSRETTLNRERFPVVYLDQDAVAWDWASPPERPDRSRSPLDEAYFQHLGNVLNAARDSAVLNTLEHDINLSGRIQIPRRTSVLPSEFQFAMMGFFDRRFREHDFYRGMQDAIRFLSTQLTSTRAVDLLVPRAGKERLRDRELRVLNVLGIDSAGFRCVVGNDCTTTPQLGRLRQATNALTQKAEAGQLRKGQVDDLLTVLGDVGYQYSEGVMEGIEATGTREDLIPVRQRVGTAFHSLVTQQRGNLKIPLRPAGAALLDEWLTYSKPHHVWTLSAMRQRGVGVGVELPFLASEQGREDYAYSRNEWRFGAVLSGLGVRDMDQLVPNDTRIRWASLGLYIDCVSDMDGFSGAIPFLDLGPYVRWRAGLGVSAGYLSKPNEWALTVPEARLGVDLAEMVGVRLTMPVYLLKKTEGERRLIRGTPKYFKELGLGVEFLLTRW

SEQ ID NO: 14490 - protein, 128 aa, Myxococcus xanthus
APPNPKRPPRPPRPPGTQAPQDSDVELPFDDDEVDPLQADDPRPQRVPQFPAGSRRSRRQGPGGRANSDRELASRFDTANEYSDPGYAPAFLYVERGPGAGQLVPVKQGALVIGRSSSSDLHLQHASI

SEQ ID NO: 14491 - protein, 337 aa, Myxococcus xanthus
MAHNKTLAAQLYGEFKALFPHNAVEYFVSYYDYYQPEAYVPSTDTFIEKDSSINDNIERMRHSATHSLRTRDDVIIVASVSCIYGLGAARSYVELAVRAAVGEEMGRDTFMRKLVEAQYKRNDLDFHRGTFRARGDTVEVFPAYEEERAVRVSFFGDEVERVTEFDPLRGVTLGALEKIVIFPASHYVAEEDVRRRAIQTIRDELSEQLQTFKREGKLLEAQRLEQRAMFDLEMIEQVGYCSGIENYSRHFSGRAAGEPPPCLIDYFPRNLLVMLDESHQTVPQIGAMYRGDRARKETLVGFGFRLPSALDNRPLKLGEFEELVPQAIFVSATPSEC

SEQ ID NO: 14492 - protein, 559 aa, Myxococcus xanthus
MMRSLPLLLALCSAPALAQRVQLTTPAEKSASGVIAPEVLRAHVRFLANDLLEGRGPGTRGDALAQAYIASQFEALGLQPLGTDGSYLQPFDLVGVTSSPKELSFQAPQGAVHLDFHTDFIAVSGVQSPESKLAASELVFVGYGIQAPEYKWDDFKGMDLRGKTLLILNSDPEDDPQLFAGKTRLWYGRWDYKYEQAAKMGAAGAIIIHTTPSAGYPWQVVQTSWTGEQFELPAAEGPRLQVKAWTTEQATRRVLQLAGKDLGALWAAAQKRDFQPVPLGVTVSSRLTNTVRRSPTANVLALLPGSDPKLSQEVVLYTAHHDHLGRKEGGKPGEDTIYNGALDNASGVSAMLNIAKAFKALPKAPRRSILFAAVAAEEQGLLGSQYLAEHPPVPHGRVAANINIDGANIHGRTRDLTVIGLGKSNLDATLVALAKTQGRVVKADQLSDRGFFYRSDQFNFAKRGIPAAYFGSGMDFIGKPEGWGKQQREVWESKHYHQPSDELRPDWDFSGAVEDIRLFFLLGAHVARQPELPRWNKGDEFEAARLQSLEALKRQDTSK

SEQ ID NO: 14493 - protein, 275 aa, Myxococcus xanthus
MSAKYLGETFDIHGGALDLIFPHHENEIAQSESANGVTFARYWMHCGFLDLEGAKMSKSLGNVVRLRDALTKVDPEALRFFFLATHYRHPLSFSDKALADAETRMEYFYETLRKVDERISGKDFGKGPLHGDPQRFFTEFESAMDDDFNTAGGLGSLSGLFGMMNELTDKPPVKDKALVGRTLHALREDVRRVSSVLGLFEDAPDAWLLRRRERAVRERGIDVAEVERLLGERTAARAAKDFAAADRVRSELKEKGVEIMDTPAGTTWKVAPLQG

SEQ ID NO: 14494 - protein, 299 aa, Myxococcus xanthus
MTEGVPEAGELAERLHRLALEATDIRDYELVPRDFLDAESPASTVKQMLTSHSSHVGHLGLRQRPVYEERPLHVSNEEQLRRAQPRVLALRDETAWVEHQLTHLARGTDVVTVLVEGLGDATPSAVWTVAHSLPSALGESAMYLEAVHADGRTEWLRSGDERSEDLVLRRVAVRMSAIGLREVLAPLRGYALVDLVYGDGPRQVLVRLEHLSEDVGSLEDVPRVMAAWDEAVVRERDARRSGAASVGAASHVILRGREGVTTGRPHDSTELTHVASGRRPREALAWAARVLREPSQGHD

SEQ ID NO: 14495 - protein, 764 aa, Myxococcus xanthus
MEKNVHLFVRTYPGLGVAAHVLTHPHLAAFAPTLHAARLDIAAVVGRLLKRGELWDEETHWSDLRQRKTTLTVRALEHGKMLSVPLRLTVLTHGVKARTARKGAPARQSLRVWVPRVDVKGTLHDAADLEPFVEEMVRHELYLASLDRLHSLAYVGEEQVETLSVPVRFRDTPRARALDAAKPQRRQAPPPGLAEASRCLNEEARAGLLERAWERDLEVSRLAEAVTSRTRASVLLVGPSSVGKTALVHELVQRAEAATTGSPLHGLEVFSSSGGRIMAGMRYLGQWQERVKHMVEALRVRQAVLHLDSLSELLSLGSGDTGLDVARQLLPALESGEVSLVLEATPEDVARAERTHAAFLQSLRHIAVAPLSAQAARNALQQASHRVGRARKVRFTPDALDRAGELTERFGSGPSPGGAVSLLRAASTEPGAAGEVNAASVTRAFCTRTGYPLELVDSAIRLDPDALLRRFRERVVGQDEATLLLRNLVVTLKTGLADPSRPLGAFLLLGPTGVGKTESALALAEYLFGDVARLARFDMAEYAAPGSATRLVGEAGGQQGSLARRVREQPFGVVLLDEIEKADAGVHDLLLQVLGEGRLTDATGRTVSFRNTVVLLTSNLGADSAGRSLGFGERGPLERAAHYLGAAAAFFRPELLNRLDRVVPYRALTEDVIQSLARRTLEAALSREGLSRRGVKVTFDEDVVKHLARTGFDARYGARPLKRAVEQQVVAPLARWLAAQATSAPPQVVLRVEAEGRIALSGLE

SEQ ID NO: 14496 - protein, 193 aa, Myxococcus xanthus
MSFTLPDLPYKKDALAPHMSAETLEFHHDKHHAAYVNNLNKLLDGKPEANKSLEEVILSSDGGVFNNAAQVWNHTFFWQCMKPAGGGKPTGELAAAIDRDFGSFEKFKEEFSTAAATQFGSGWAWLVLEGGKLKVTKTGNADLPMKHGQKALLTIDVWEHAYYIDFRNARPKFIETFLTHLVNWDFVAQNFKG

SEQ ID NO: 14497 - protein, 319 aa, Myxococcus xanthus
MGEYIYYFGWADAAARLEVEYYPKLVVSGPLSPATVPRFLIAPGEDVPALRRALLAAAAGSAQEAGCSSVHVLYPTGDEADFLEAEGLARRITLQFHWKNPGYGSYDDYLARFDSKRRNQLKRERGAAATQGISLRTVRGEGLSQAHARRAYGFYTSTCERHAWGQIQLTPDFFARVFRTMPGSVELVEAVRGQQVIAGAFNLATPERLYGRYWGAFEEHPFLHFHVCLYHSVEDCIRTGRKVFEPGAGGEHKVSRGFEPTAVHSAHLIFDKTLDGAVRGFLRREHARLAPAVEEAERICGLKPWPLAASPGTQGATGT

SEQ ID NO: 14498 - protein, 286 aa, Myxococcus xanthus
MLKNTDLRVVLATTTELSRQARGTHGTAPAAAVLLSQALTAAALMGALQKGDARINIQVECDGPLRGLFVDGDTSGLVRGYVKNTYVEYSGSDGQYHWRPVLGNKGFLSVLRDLGGGEYYRSAVELEAFDLAADLERYFRQSDQLPSHVLLAQLPEGGAAEPLGRVAGLLVQPLPSADMEAFAALGERLRRDFVPSLQAHGEAGAAAVLRALLPESDFEVMSRYPLRFGCSCSKDRVLRALLAMGREELTDLLEKEGQAEATCQFCTTRYVIPGDEIRGMLERGAI

SEQ ID NO: 14499 - protein, 228 aa, Myxococcus xanthus
MKAPETDEDFIQWYEDCWADRDEVEYPKMFGAIDEGVFTLDQTDAIQAWMESELAQVQEADPNWGPMGVRVSPPSESYPYWTYVTSGLSNPFTVAPGEDIPDGAPSGLGYEMVIHSPEEAKWPVFRLLDMMAYNLVSLRAFAMGHRYPVEGSLDGGESKLSGFVFVRDPSRPDHFVLPSGKVQLLTLVGATRNEMAFARSNGMDKLMAKLVAAGSGYITQPDREEVKL

SEQ ID NO: 14500 - protein, 295 aa, Myxococcus xanthus
TPTLITAVHFEPLHLPLTEPFAIATGAQYAAENVLVRLTLADGSEGLGEAAPFPAVSGETQASTLAALEQVRAGLVGRDARAWRPASEALGDSLALAPSARCAVETALLDALARHYGVPLYVMLGGAQSALDIDMTVTAGDVAHARKSAQAILARGITTLKVKVGALPPVEDAARLVAIHEVAPQARLFADANGGYDVAEALAFLKELARADVPLALFEQPVPAHDVAGMAELTRRSRVPVCADESARSAKDVLRLIREGAAHAINIKTMKCGVVEALTMWSLARAAGLELMVGG

SEQ ID NO: 14501 - protein, 654 aa, Myxococcus xanthus
MDVLLVALEEAERHQPEGCMVLHAVRDAAGALVDFQWAWANPAGARALGHAAPELLRGRRLRELMPGSGLASRVDLLRNVVEAGRPAADSFQEGDVWLQGTAVPLRDGVLLRLRDITSALRLEESVRETLDWVRSMLEATPDAFFTLDADWRITFVNHEAAALSGRSQEQLFRQILWQACPELLGTRMERELRRVASGAGHTIFEWRATPGRWHEVHAWGANGNVSIFGRDVTARKQAEAERDVLLSREHSGRLEAEALVHERTRELMAARERLVQSEKLAMAGQLAAGVGHEINNPLSYVVGNLQFALEQLEPLATQGAVRESLARALGEAMEALREAKEGAERIRTTVRDLQIFARAEEPQLSPVDVHAALEFGLSMAMPHLRHRARVEKRLGPVPTVMAHETRLGQVFLQLLVNAAQAIPEGDVARYQVTLSTWRDGATVVVEVADNGHGMAPEVLERAFEPFFTTRPLGEGAGLGLSTSLGLVRGMGGELSASSAPGLGSVFQVRLPTTDADAPAVRVAEDTDLPGRKRVLVVDDEPLLASVLGRILGVRHEVVVVHSGREALDTLARDADFDRIFCDLMMGDLTGMDVYDALSSRQPELLARFVFMTGGGFSERARTFLQSVPVPRIEKPFELGVLHALVEDAPPRAGP

SEQ ID NO: 14502 - protein, 150 aa, Myxococcus xanthus
MEPRVSYPPRLAHLATRAVVVAKLVPTYAQAHHIDEEEAAQRLSSALSGRMLPTLLDVTWTAMRGKAKRLTDDGLVEKVAATLSERPLRPGRIAPVGPALSAFFILVDLEVGTAGDAARRVMESDEGRRRGEEGLAEAGRFLAAELTRGK

SEQ ID NO: 14503 - protein, 76 aa, Myxococcus xanthus
STPLPTTLRILRSLTDIPRATWDALVDAQATPFLEWTFLTAMEESGCAVPARGWHPRHLTLWRGSRLVAAAPAYRK

SEQ ID NO: 14504 - protein, 181 aa, Myxococcus xanthus
TGQDVFLEAAATLTRLYPALPVRFYLVGAPLYQTPGSQFSEDELRRLIASRGLAERVGLVPFQPHPACVYRALDVFVHASTRREPLGLTIAEALACGRPAIVSNASGAAEALTNGTDALLIPPGNVHALVQALRTLLEDAALRARLGTAARLTAEASFSRERYASEVLTLYRTLVRSSPPI

SEQ ID NO: 14505 - protein, 357 aa, Myxococcus xanthus
MRVGAGAWDVTTVAPRFFHGDLSPLALQLEADEPARTEGVRAFFSRSLHTFLYGPEVHAHLARGADLVHVWEEPYVLAGLELALLTPRHVPLVFSTAQNLSKRYPPPFAQAERFVVQRASGWVAWGETVRDNLLTRPGYAERPARAIPMGVDADLFQPDRAAGESLRRELGWETSGPPVVGFLGRFVPEKGVPLLMDALDALDTPWRALFVGGGPMEGALRDWAARHTHSVRVLTGVPHAGVPRALNAMDMLCAPSQTTRQWREQFGRMLAEGFACGVPVLGSDSGEVPRTMGDAGIVLPEASVSAWTQAIANLLESPQRREELATRGRERAVTRFSWPVVAKAHLDFFTEVLEQRG

SEQ ID NO: 14506 - protein, 260 aa, Myxococcus xanthus
MRRPYTLIAGDFVDTGGMDRANLALALWLAKQGYPVRLVAHRVAEVLLRHPKVRFVRVPKPANAYLLGEPLLSAVGRAWALRTRAEGGRVVANGGNCPVASANWVHYVHGAYTSEPSGGVLRQLKGRVSHRYYVRSERQALRRARVIIANSERTRDDVVAATGVPASRVRVIYLGGDAERFRPVTAEARREVRASLGWPESRPVALFVGALGDRRKGFDTLFQAWLRLCARADWGVDLKVVGSGASSVCVGARSRGQRRG

SEQ ID NO: 14507 - protein, 443 aa, Myxococcus xanthus
MGGGLLASSRLVPLFVCLLICCQLALLVEAIAPLRVAVRVLAFGVSLLLLALVRGRSLKHPALPFILAALGITALQLFNPGTGAPLAALAQLGIQLAIAAPLLWVTRLAIDPKTFRRTLALLFFFNTASAGVGVLQVYFPGRFQPALSAAVQGQGEGYVSSLKFETSDGVRVFRPMGLTDIPGGASTGGFYAVLLGGGFLLSSRRGLTRVLSVGGILVGLFGIYLSQVRATAVMLVVCLVALAAVLLVSGRVGRFLALLAVMGTAGVATFGWAVAVGGDAVMSRWSTLFAASPDEVYHRNRGYFLTGTFADVLPEYPLGAGLGRYGMTNAYFGDNSDRERPPLWAEIQWTAWVYDGGILGVLFYPLGVLMSLLWAFQVARSRDGPQDEFWLWGSVLFAYNLGAFALTFSYPFFMSQTGMEFWLLNAALFGALAHAKTVHPHRR

SEQ ID NO: 14508 - protein, 15 aa, Myxococcus xanthus
MEEALRALSEQEVPV

SEQ ID NO: 14509 - protein, 234 aa, Myxococcus xanthus
SYFTQLLEGGYEAVHLLSDSKSGLRAIVGMHNTRLGPGLGGTRALATYASEEEAVADALRLARGMTYKAALAGVPHGGGKAVIMLPRGSFDREKIFESFGRAVESLGGRYITTEDSGTSPDDMEHVRRHTKYVVGLKERSGDPSPVTAYGVARAMEATAKHVFGSPDLKGLRVTVLGVGHVGMYLVKELHQRGAKVWVSDINPASVQHAVTQYGVTAVDADALHRMEADIYAPF

SEQ ID NO: 14510 - protein, 119 aa, Myxococcus xanthus
MSHPLRVLHISSGNLYGGIETLLHTMARERNLRPSLSHAFALCFEGRLARELRDAGVEVHVLGPAKTGRFLVRVARAERPARAAARRALRRRHLPRHLASGAVRARGAHGWRSPGLLPA

SEQ ID NO: 14511 - protein, 33 aa, Myxococcus xanthus
MAWRSLSLYSEALGRPAPVMAPDVALLRLTGSV

SEQ ID NO: 14512 - protein, 36 aa, Myxococcus xanthus
PPAKLGIVYSPEGLARAARLVGVARAKQLFLAARKL

SEQ ID NO: 14513 - protein, 70 aa, Myxococcus xanthus
MADVAAHITGTVWKIEVQVGQQVNAGDTLVILESMKMEMPVEAEDGGTVKEIRVKEAQSVNEGDVLVVLG

SEQ ID NO: 14514 - protein, 450 aa, Myxococcus xanthus
MFQKLLIANRGEIARRIGVVARGMGLKTVAVYSDADAELPFVKEADEAVRIGPAPAKDSYLNTAAILEAAKQTGAQAIHPGYGFLSENGEFAQACADAGLIFVGPPPEAMARMKDKSQARKLVSAAGVPVVPGSEGVVPDVASALAEAERIGYPVLVKAASGGGGIGMAVARNAAEMEKVYRQCTDRAKAAFGKEGVYVERYFPAPRHIEVQILGDQHGHLIHCLERECSIQRRHQKVVEEAPSVLFADGRNPELAQKLFTAAVAAAKAFGYANAGTVEFLYSDGEVYFIEMNARLQVEHPVTELTTGLDLIGWQLRIAAGERLTVKQEDVKRRGAALEFRIYAEDPVKFFPSPGPLKVFQPPTGEGVRLDAGYGEGNTVTPNYDPMIAKLIVTGETRAQAIERSVTALQSFRIEGIKTNIPLHLRIVQDAAFQAGELDTNFLEHHAKPA

SEQ ID NO: 14515 - protein, 405 aa, Myxococcus xanthus
MDQFDQNKQAAKIRVVGAGGAGCNAVNTMILSKLDRVDFIAANTDVQALAASKAPTRLQLGQTLTKGLGAGANPEMGREAALESRDQIAAVLEGADMVFVTAGMGGGTGTGAAPIIADIAKSLGCLTVGVVTKPFLFEGNKRRKQAEQGIVELKAAVDTLITIPNQRLLSLSNEPMPLLETFKRADEVLLNAVQGISDLIQYHGYINVDFADVKTIMSDKGIALMGTGNSTGDKRALIAMQQAIASPLLEDVTIDGATGLLINITGGRDMTLQEVNEALTLVHDAADSEAEIIFGSLIDENISDEVKITIIATGFVHRDAPKVRTVAPVVQVPLSRPAPSVLANAREEVASLVPTKGSGSRPLTVESAKSVSARTAVVKDAPLPLDEDQFDIPTFLRRQGQTELP

SEQ ID NO: 14516 - protein, 193 aa, Myxococcus xanthus
MDPDDRCPNDPEDKDGFQDEDGCPDPDNDRDGIPDAEDKCPNEPETINGFQDEDGCPDKGKVKVLVDGERIVILEKVYFATGKDVILARSHPLLKQVAAVLRANPQVELVRIEGHTDDQGNDAKNLDLSQRRANNVRAFLVKEGIAEGRMEAVGYGETKPVDTNKTAKGRENNRRVGFTILRVGKVEVEREAR

SEQ ID NO: 14517 - protein, 351 aa, Myxococcus xanthus
IRRPVEEASLMAGAEISHVYTGIAGGHIKGFNSQGIVAVKDKEVREADIARVIDAAKAVAIPLDREVIHVLPQEFIIDDQGGIKEPLGMAGVRLEAKVHIVTGAVSSAQNIVKCANRTGLNVSDIVLQPLASAEAVLGEDEKELGVCLVDIGGGTTDIAIFSGGSIVHTAVIALGGNNLTSDIAIGLRTPAHEAERIKQKYGCALSSLINKDDTIEVPSVGGRHPRVLGRQILCEILEPRVEEIFQLVHREIQKCGYEDLLASGVVITGGSTLLAGMPELAEEVLGLPVRRGMPRGIGGLVDVVKSPMYATGVGLVVYGARHLDRRMFRIREENVYKKVKGRMREWLEEIF

SEQ ID NO: 14518 - protein, 855 aa, Myxococcus xanthus
GGIGGRTWVGEAPPYSREVGGLGGAPLIFDAVSYAVFGGGGGAGHGNNDAAGGGSAGGGLVFIRGASLSGAGRVSADGFAGGNAIGLANDAAGGAGAGGTVYVRVTGALSCSANAVSARGGDGGSTTHDQHGTGGGGGRALIQGVTVGCIPVVTGGFAGTQPTANAPGGLTYGAAPGNPGIVTILPGAFPASVAAPVVVTPANGSTTGFRPVISGTAPASSTVIIFVDGVEVARVTADPSGNFSFTPTADLSVGAHTVNAYALFQGVSSVLSNTNSFTVVSDTTPPDTTIVSGPPAVSNSTSATFDFASNEGPVTYECSLNGAPFAACTAPQTFTGFSEGEHTLAVRAVDAAGNMDPTPATYAWTVDTTAPDTTIVSGPSGTTTSPNATFDFSSNESPVTYQCSLDGAPFVACTDPQTFTGLADGAHTLAVRAVDAAGNEDPTPATRTWTVDATAPDTTIVSGPAAVTNATSATFDFASNESPVTYQCSLDGAPFAACTDPQSYTALTEGEHTLAVRAVDAAGNMDPTPAQYAWTVDLTSPALPTIDSPADQEEVATTTPTLTGTGEPGSDIYLEVGGATYGPVLVDEDGNWTFTVPDPLVEGPHTVSITSVDPAGNSAGPVTSTFIVDLSAPDTFIDSGPTLLTRDSSATFDLRSEGGGVAYECSLDGGVYVACADPATFTGLADGDHLLLVRAVDAAGNVDPTPAQYAWTVDTTAPDTLVVSGPATPTSSNSASFEFAASEPGSSYECSLDGAAYVSCEETVTFDGFAEGEHTLLVRAVDAAGNVDPTPAEHTWTVDLTPPVAPLITTPANGAVLDDGVVTITGTADGAESVTLVLDGVPYGPIPVDAGGNWT

SEQ ID NO: 14519 - protein, 34 aa, Myxococcus xanthus
MSFTLYVMGRGRLGFASKLAVVRSAYFPAGTGDR

SEQ ID NO: 14520 - protein, 153 aa, Myxococcus xanthus
MRAVVQRVLEASVTVEGQRVSDIGPGLLVLLGVGKGDTEADVAWMVEKLATLRIFEDAAGKMNLSLEETSRQLIVVSQFTLYGDARKGRRPSFIDAMEPVSAKALYERTCELLRQRGLSVGTGIFAADMKVALVNDGPVTLLLESPGPAAPKG

SEQ ID NO: 14521 - protein, 282 aa, Myxococcus xanthus
MAGWLKRAAQSLPPEDLTPRFHALLARVRQGLPVLPQEAQRHQYVLVRGMLGDELPGYLLDNVQRLERRGLSVREAAVDTEGLLANNVAVLREVLRDAEYFGRSVVMVGHSKGGVECTATLALYPELRHVVRAVVTLQAPYGGSSIAHDLATTPQLRRLIDFAFPLLFHGVSRSVEELSYPQRQAFIQQHPYPADIPTVSLATSRLSRTSTLYPLQRYLHERYGYQSDGMVTAVDAEVPGARVVRLHDMDHAEAALRGLPGLVRYHPGDLTEVMVALALEAR

SEQ ID NO: 14522 - protein, 52 aa, Myxococcus xanthus
MLLLGVVVSVQGVLASIIYSLIGLAVFVSGFYVIRLIMPFDVHKELEAEQHT

SEQ ID NO: 14523 - protein, 620 aa, Myxococcus xanthus
MVEFTAGSAQVVVCGYCQTVVARKGLDFESHGKIGSIVPTDSPLQLRAEGRYRKAAYTIVGHLQKDHGAGPWDEWYVEFADGRTGWLSESEGTFHLMFDMGPEEGVVLEDLHPGERLHLRDRAWVIEERGHGRVVAAAGQLPSDVDPTQDAWYVDATGPKGAFLTLDFGTRGHSPEVFVGEALKLEQLGIPAGQLRPRVRKVELQQARCTQCNGNLSLRAPDKTLRVACPYCGALLDARQGKLSFLRMLEKPSRPLIIPLGTKGKLDGAEWICIGYLERSCTVEGVRYPWEEFLLYNARRGFVWLMNSNGHWVFLKPLPAGDVSLSPDVAAFYEHRRYKCFQHVTAVTDKVLGEFYWTVRVGERAQASEYVSVPYSVNVDATDDEVSYTHGEYLEPEVVKEAFGLKEPMPQREGIAPSQPNPHQSGLRSVFVWTGLWILALFVLSAVLSLTAAKTVVLEKAVVVPPDATPGTPAAMHFSEPFELPKRGNMRVEISGTPFNEWLGIQGDLVNQDTNDVVLFYEELSYYRGNDGDGEWTESNMSTSTYLSPVPAGKYALRTTASFEANPRRPRPMTYRVKLIHDTPNSSWFCFALGLMVVGPVVALYRSHSFETRRWAESNV

SEQ ID NO: 14524 - protein, 340 aa, Myxococcus xanthus
MKKMPAALQLDSTEPVELPTVEAPSLEGVSVAQVAPAPLTEQELVDRFDALRRQHADVRERQPGEDVALEDDALVDVLGFANNRLMPFSVRENWWVRVAADPGLPGFFESLAGAKVGQSVGIELTLPDTYPVEALRGQPARFLVSVKAARELKLLEDDSPELLSRLGMGSITDVMRKLGDELAQARLADVDRLTQERVMDVLVDRTPVELSAALVDEEIRQRWAEAERPILQRKDFQPDELQEALEGWLQDPLTRMDAAYRITLALVLRAIAERDGIQPDRAATEAMLEDLANLTGVNRQELGVAVKEDEALARRLYEMALRFSTIDHVMKKVTLTPAAA

SEQ ID NO: 14525 - protein, 286 aa, Myxococcus xanthus
ARPGQSDRFEDAHNRVTQAATGLRSVSDAAVATQVRDAFGPRRFGPVNLPGGNGPVVEGANTRLARGAGAVSLAANVAQLPTGAVETFRDVRDALRNPTEANVREAVGTASGTLSTGLMAARDGLSLAGNVSNYRAATDAARTAFTAAAPDASRAAANRVATTAANTALEGASRQVVRRAAAEVAERGLEGAARTAGTAARAAVQGGGTAVARAAGRFTPGLNVAIAAADTVAVVNTITDPNASAGKKITAGVTALGSIAAATNIPVVSQVGAAVSTVSGFIGSFF

SEQ ID NO: 14526 - protein, 1192 aa, Myxococcus xanthus
MRRSLLVCLVLLATASAAQEKKAPRDADLGRKSATAVDKSLAGDITREKKKEEVAPALQYDQFRLGVELQVASKRREQIQSLKKIISLSPDPKEAPSLLFRLGEFYWEESKFFFFEANRKDDDLIQAMNRNDAAGQQRAKAEKAEFSAKQKEYGKLAVEQYTKIVQEYPNFERTDEVLFFLGQYLMEDGQDRKALVAFKRLVEKHPQSKFIPDAYFAFGEYYFNNSKGKRPELEKALVAYKKAAEFPESQVYAFALYKQGWCHYNMGDFESAKDKFKTVVLYGELAGANALEKDGGKGGGRSSLLREARTDYVRAFAHHGDVAQARAEFGKVATNPEDRFTMLKQLANLYYGDGKDREAAITYNGLIKEKPLSPEAPGFQGRIVDCILRMGNKERTVVQVRRLVKIMKEVEGSGVIKEDKDKKLLAEAKELSERTLSNLAVTWHNEGKKTRNEETFRYADAVYSDYLTLFPENPKAYDLRFFWAELLNDSLQNFDKAAANYTLVVLQDAKVLEAKDDKGKPKPGKPGKWLQNAAYNAVLAYDEVVKAGEARGEGKSEAVGSDITKKATIPTLKKALLDACERYLKYVPKGEKRVEIAFKAANIYYRHNHFDEAVLRFSEIALGYPEYKFENGERAAEISANLILDSYHLLQDYAKVNEWARRFYANDKLAVGKFRDDLAKLIEQSSFKLVSQLEEKKEFEKAAEAYLAFVKDFPQTEIADLALYNASVDYYKAKRLDKAIEVRKRLFAEYPRSKHVPDSIYANAEALEAIGDFEDAAATYEAYVRGYERSLGDKGNAKARGGGKKKRGAVDDNKPAVVQKWDESKAQVALFNAATYREGLGQVKAALRNREHYLTLWPRAKDADEIRLSIIDLTAKSGAAFKAIKMLEEYERDNMRSPSRFLAAEGRIVDLYKKMGKTRDVARMQKRIFEHFDQLPRRVQGSLEKPALATAAQAQFLSVDLDWNEYRRLKLYWGAPPSPDRFKASIQDKSRALQVVEKKYVQTVTLGAPEPAICALHRIGLAYDHFADRLINAPMPRGLDEESEQALRDEFANQAQPLKDKATEAFSATVAKSRELDVYNDCAAESLKLLRTTYQPDRYPDMPDEKVALKGRVQLIGGDLLANIQDVPPPAPKAADAQQARAETLQEDLTDLTAQLRSQTETQVDARPAATTNGATPAKHGGNDEEPEDFPL

SEQ ID NO: 14527 - protein, 315 aa, Myxococcus xanthus
MAPKANGEACGVCGGRTYVIERRGDQAQARICACSEHCSVCGGRGHVLVEREGEFSQKMGPRRYEVMETCTCTKLRTRIARFDALGLPASAAHANFENYRSYEEAQDRGRSVAMQFAYQYVQGGSSKGYIISGPVGTGKTHLLAATLAHLALELGVRGRYVEISLLYATIRRGFQEGKSGGEIIGPLSEVEVLAIDELGKGRGSPFEMETLDELIARRYNAGRTTLFATNYSLEPERRAMRSAAPSGYRTTDDSRSAAREAELLRERVGERIYSRLCELCTFVEFPKETPDRRRPRQEMNAPMHHAAGNGRPQGR

SEQ ID NO: 14528 - protein, 218 aa, Myxococcus xanthus
MSLLPESASFEELVQDYFLAVRGAGLMLSALDTELLTTWAREGVPFEVVARGISRSAEKALWDARPGEPVLRSLRACRRQVESEIKKYRELAAGAGEEPSSSPKRKRARSWEETRHARLCAALEDLAGRNEALSHRVRNLRITVLAHVPEEPAAMDAQEALAFLLVLRALPFLDRCAVWREALAASAEQQVMSPRARKVSRRFRVLATVRRRLGVKEM

SEQ ID NO: 14529 - protein, 266 aa, Myxococcus xanthus
MSKHPRSKGGRLSAGLKLIGPLCISVGLLVGLRLLGPQYLDQQTLSGWLRPLGALAPLAFILLLAVRPVTLLPGQLFTAVGGILFGMAAGTVYALVGTLLASGLIHLLARRLGRKPMRRLAGDKHPVFERAAREHGFQLGFLACINSVIPADVMLATASASGARYVPLALGAVVGTLPGTLLTALFGSSLGQGKTWMTAVSATGMVVSLLLGLVLGRKLMRELLAKEAAVASGGPGRVHPGPGDVRPTGSRRPGAAPCLPAAPARR

SEQ ID NO: 14530 - protein, 156 aa, Myxococcus xanthus
PAEVGSRALQATARELERVAERLRNMLRAEGSSATVDTHIARGKPVEAILRRARAFGAELIVLGRHGDKPLRNMFLGSTAENVIRGGDLPVLIANRRAPGPYLRPVVAVDADETSKRAASFVPTLMTPGSELTLVHAYDVPLEYAVFPGLTAKEYL

SEQ ID NO: 14531 - protein, 82 aa, Myxococcus xanthus
MHHHAPTLVVYLLGTLGTSYHLANGLQGFAMGWGLLSSERSMRKFEPVVIILFLVLTAMSWAVIYALYTAGAAFSPVGATPP

SEQ ID NO: 14532 - protein, 536 aa, Myxococcus xanthus
MHFELAFVLIFAIATAVAIAARYFKIPYTVALVVAGLLLGTFKAFEPPHLTKELLFAIILPGLLFEAAFHVEFRKFWKNKMAIHALAIPGLLASAGLTAFILTRVVDGLDFVHGFGMLSALVFASVIVSTDPIAVVALFKSLGAPKRLLILVEGESLLNDGSAVVLFTLIVAVATGGQFTVGGALFDFIKVFGMGVLMGSAVGFAVAQVIKRVDDAMVEITLTVIAAYGSFVLAEHFHYSGVIASVVAGMLCGNWATHEGMSPATRIAVESFWEYLAFALNSVVFLLIGLEVQLSSLLASWKPILAAYVAVMVARAVVVYGVSALLRFTKEKMPWTWSAVLTWSGLRGAISMVLVLGLPTDFPHRELLVNMTFGVVVLSIIFQGLTMAPLLRKLRITGLKDAFQEQYELARGRLGAIHAAQAALESMRRAREIPGDVVTQLEKDYQEKEVVAEKELTALKQQSMRFHEEEHQEAVRRVLIVEKAALLKAYQSATIGKEAFARLTADLDERIAAADAAENHVPPEGETPAVAGAASA

SEQ ID NO: 14533 - protein, 314 aa, Myxococcus xanthus
EPIHKVHPHLRGLVEGRFEGEPDWKWLADCEQPVVFSALGHGDLAKQFAGLEKQWAEVGIAERLLLVDLSSDFRLDHPGRYAGAYGRPHPSPELLGTFTYGLTEWKRDAVKTAKRIANPGCFATAVQLALLPIASTPGLGLLAVSGVTGSSGSGSLPGEGTHHPTRAQDFRAYKPLEHQHEAEVEVMLVAHGAQRHRLAFVPHSAPMVRGIFATVQFEWPEHGGAVVTASLMEKYRRYYEGSKFVRIVEGTPRIAAVAGSNFCDIAVATKGRSVAVMAALDNLVKGMAGQAVQNFNVALGLPEDTALRQAACYP

SEQ ID NO: 14534 - protein, 352 aa, Myxococcus xanthus
MGWKTFFLALKDEWTRDEVGDVAGALTFRMILALFPFLLFLVSLAGLLIEPAQAQVLIQELARVAPREVTSILSERIEALANSRPVGLLTVGGVGAVWAASAGVVALMTALNKVYGVTESRPIWKLRGIALLVTLGGAAVAILAAFAVIVTPVIAGKLPGGLGTVLMWLRLPVAGLLMMFLWAVLYYVLPDVNQKFRFITPGSVVGVLIWVFASWGFSQYVANFGKYDVNYGAIGGVIVMLLWMWISAQVILLGAEINAILEHRSPDGKAPGQKVPEQGKALTATKTELEAGGASLPGAPGFQPVVDPVTGRPLDDPPSAPPRLRDTPLAAAFKWTVGMGLGLFLLRKSDSR

SEQ ID NO: 14535 - protein, 167 aa, Myxococcus xanthus
SQTPSWPLRCGAVLLTAQLVLACGGGEPKPPPPTDLTPPTTRATPAGGDFTTAVVVTLACDDGGGSGCAATYYTLDGSTPGTGSTQYREPFTLGSTTTVRFYSVDAAGNAEAPGTATLTLVGAADTEPPSTVANPASGAFSSPRSVALTCDDGAGSGCAATLYTLEH

SEQ ID NO: 14536 - protein, 138 aa, Myxococcus xanthus
RSDLRRLTWACVLLTCGLSLAEPLVGPSVGRGDALLAEGTRLYNKRKHKDAAEVLLQATRANPSLLPAYLGLARARMGAKDVPGACAAYRAYVRSAPDIQDRTKAQRELALCERKLKAARRKKRNKVPPDMTARHVEL

SEQ ID NO: 14537 - protein, 516 aa, Myxococcus xanthus
MFVSCLLSVSLALSAGAAPGMPPDTQAPTPSHTLWLVQALYPGQDALLQRTEEGIAALIPQDVQAEQLIGRGALAMHLKGQGGDLRCVSGEARCREPLEAYLESLGLERVVLVQVGQDDAGYRFRAVSVRPGTGARGQAETANPAFEKALAGVLVKFLSLNATVVAETTPAGATVFIDGVKVGSTPFTTEVLPGEHTFRFELASHLPKEETRVMSSRQQVKLDATLEKVPARLVVKAQPEGAEIRVDGQPVGTTAVDQGIQPGTRRVSLTLDGYEPHEVTAEIAPGGTYTLEHALTPTSMQSFKLAMRRRKEATMARQSYLEASFEMQRLTGTSLASQPLSTSEELESLRTRDVRAPGSRNLRGVGVEYGRYGQFFGVMLVGATYASTGDTWTLGIDVPPGVGGVGPDGVSSLDTRVQAVSLRALQPQLRYVLGPVSFAIQVGLEGRGLLVKERAGDAAIFKDGLYALDLHASGQATARIFVYEGLYASVAYQHSFTLLKKIAGTSNIRGGLGYAF

SEQ ID NO: 14538 - protein, 297 aa, Myxococcus xanthus
MRAVRGGDFTATVTPGSDDEVGEVVHAFNGMVKELGEARQRLSAEAESRLALEAGLRRVDKLAAVGQLSAGLAHEIGSPLLILNGRAQALAARADLPDDVRRNARILVEQSERIERIVRQLLDLARRKPSKLESLDALASVRAVVELLEFDARKRDVRLTFHSEEPLPRVLANGDGLQQVALNLLTNALRATPRGGEVRVTLAPSTFQPAPGLRERHGVRLSVEDTGVGMDDAALERFFEPFFTTWSAHGGTGLGLPVVKAIVAEHGGAVTVTSRPGQGTHFIVHIPSEKEEGTGAV

SEQ ID NO: 14539 - protein, 376 aa, Myxococcus xanthus
PGLAPEEIERQVTVPLERVLNGTPGMVQMRSESLFGLSLIFLTFDDGVDPFKARTIVGERMSNADMPDGADVRLAPEATPLGKIYQFRVLSDRHTLTETRSEMEWNIARHLRQVPGVADVLSLGGFLKEFHVQVDPSRLLAHELTLADVTEALERSNRNVGGGFLRQGDQELLIRGVGYLRGAQDVQSIVLKSEDGTPVTVGDVARVVASHTPRRGSVSHNLDMDVTEGVVLLRRGENPSTVLEGVHAKVEELNSRVLPRGMRIEAFYDRNDLVGHTLSTVHHNLLHGALLVVAVAWLFLRSLRCSLIVASVIPLALLTAFIGLKMVGLPANLISMGAIDFGILVDGAVVLVENVLHEAGVQRPRRRKEMWGSSCA

SEQ ID NO: 14540 - protein, 367 aa, Myxococcus xanthus
MNRTLLLGLWAFSAACSGAGTPSASAERAAPAPLKEGVVQLAEASRAFITVTPVKADASSAALQAPARVAFRDGALSRLVAPLAGRVVSVHVRTGDTVKPGDALVTLDCPEAAASRTAVATATAALREAQSAFEREARMFEQGVTTERERLSAETRLAEARAELARAQASVGFVGTGSGTTVVLRAPMAGTVLGRSAAEGIAVQPGGDVLVEVGDPSALWVMADVFERDLPLVREGARVRVTMPSVHAPLEGKVDSVGAVVASGSRTAPVRITLDTQEQSLRPGMFGRVRIDSPDASLTLPVEAVLLRNGKDSVVYVQQDAGTFERRPVVVAQPVEGRVQVIAGLSPGDPVVTRGALLLDGAADQLL

SEQ ID NO: 14541 - protein, 274 aa, Myxococcus xanthus
MSNPIIEALDAAMIPFRRTHAGEALARVEETLLINTGRQPLPPLPALQRPSLFYFPGLGTRGWYSASEYPSLDSLARLLKEATPMLREEFLTRAHQGELLAYEEQMPGRFPTLDRQDWGSLYLLKEGMRNETNCEACPRSAALMETLYPQFSPSGAFFFSVIGPGTKIPPHHDTMNLKLTCHLPLIVPPDCRIRVDGETREWVEGESLFFDDTFLHEVWNNSDRPRVCLLLDIWHPGLTAIEREAITALGRVMGQFINQGYTPPWSTNGRIFEH

SEQ ID NO: 14542 - protein, 31 aa, Myxococcus xanthus
VFQKSNPFPKSIFENVAYGPARGRDEGQRRS

SEQ ID NO: 14543 - protein, 139 aa, Myxococcus xanthus
AWAGQVADRYDRRRTVLLMGPGLAVTAPRWAGMRLVCAPLVVGLAQVGLSYSTSPLGAAVMLAISSFGIATLAGLTLMFIQLTCPQDLQGRLLGLHNILFAVVPPAGIVMGMLTHYVELRVSMRFFGLLFAGVSTAWLL

SEQ ID NO: 14544 - protein, 103 aa, Myxococcus xanthus
MAGTEGDAMPEPVHFRLNAGVSLMLIPTGGFGWVAGGNRVAEPGVSECILGLSLETEAQVDALIARAREAGAEVPAPPGKQPWGYSGTFKDPDGHVWMLDVAG

SEQ ID NO: 14545 - protein, 164 aa, Myxococcus xanthus
MSALMGVGCNGAQPQDPAAEAEVIAETAEVKQGAVGDVVLRCDEFQGGTHLEVVQTATGFEAAYVSEEYDPWDCRCTYTKREILGQYNQCRRSTVDPRIMNCYRIEPSGTIGKVVLSTTRVQKTQMVIGSSTTVNYSELSVAAINQDPGQTPRRDYVFPLSDCQ

SEQ ID NO: 14546 - protein, 185 aa, Myxococcus xanthus
MGSFVLVAASEMGDKTQLLAFSLATRFRKPWHVLAGIFVATVANHALASSVGSWVSAHVPAKWMALLLAVLFIGFGLWTLKPDTLDEDGGKPPRFGAFLTTVVLFFLAEMGDKTQLATMAVAARYQAPITVTLGTTAGMMLSDGLAVFLGDRLAGRVQMSWVRWAAASLFFIFGALSLWTALRMS

SEQ ID NO: 14547 - protein, 1735 aa, Myxococcus xanthus
SPSPEEDLSALSLEAQGDEVRRRIIAEANFEFDLSAGPLLRVGILRLDAQHALVLLTLHHSVTDQWSLGVFLQELMALYKAFEEGQPSPLPELELQYPDYARWQREQFETRELAGQLDYWRRQLTPQPSALVVPSDHPRPALKTYRGGWHHFRLEPELARKLKQLAQKEGATLFMVLMAAYQTLLHRYSGQQDFAVGSPVANRRAPELEPLIGFFVNMLVMRADASGDPTFRSFLHRVRQVCLDAYSHQDVPFDKLVEELQPPRDPSRNPFFEAVFVLQNVPQPALRIPGLLARYVELDLGVSQFDLLMELREDRPDRFIGRIEYCADLFDAKTVERMDRHYVRLLESVVENADQRLSELPLLRTEERQQLLVDWNAKSTAFPRETPIHSLFSEQAARAPDAVALVSGETLVTYAELERRANQLAHHLRTYGVSRGTRVGLCLERSPDMVVGLLAILKAGGAYVPIDHHYPAERISLLLQEAGIGVLVTTKPLAEGLPASNSKHVCVDTDADVITALPHDAPLPATVGGDDLAYVMFTSGSTGRPKGVCIPHRAVSRLVLANPFIHFGPDEVFLQLAPVAFDASTLELWGALLHGARLVLAPPHTPSLDELAALLTHHRVSTLWLTAALFEQMVLHQGNALAGVRQVLAGGDVLPPLRVRQHLERIPLGAVLVNGYGPTENTTFSATHSLRAGEAFGTSVPIGRPLGHSTAYVLDSRMEPVPVGVPGELFVGGDGLAWGYLSRPELTAEKFLPHPFSSAPGARLYRTGDRVRWRADGSLEFLGRSDFQVKVRGFRIELGEIESVLQQAPGVQEAVVLAREDAPGDKRLVAYFVPTAAARSEEQAANAVGGIRTFLKARLPEYMLPAVFMPLEVLPLSPNGKVDRKALPAPYADLNRTGTPFEAPRNASEQTLADIWAEVLGLRQVGIDDSFFELGGDSIRSIQVIAKLREQGLELPTLELLQHPTIRELTGVIKATSVAPAGQIAPFSLVSEADRQRLPEDVEDAYPLAALQSGMLFESALDASAGIYHDMFSFHVEMALNEPLLQQAFRELFARHAILRTSFHLDGHEEPLQLVHREVEPPLKFEDLQHLEAPQQTAYLQVSAEKERVQPFTWNQAPLMRLCVHRRSETTVQLTIVFHHAILDGWSAATLLSELFGRYLELLEGTETPAAPSPAATYRQFVALERETQNSHESERFWLRRMDGVDAASPRPLRSRDDERVLHTHDVRIPGPLQQALLRVAHEAGVSLKTVLLAVHLRVRGFVEGSTSVVTGIVTNGRPEVVDGERMIGLFLNSVPFPVTLPGGTWLELIQQVAKHEQELMPHRRYPMARLQQKRGGQPLFDTLFNFIHFHVAGGLSQQKGLRFVDEMLGAAWMELPLGVTFTQDPDTSSLSVSIATTGTRHEAERTRELGQYYLRALEAVAAGPSGRYEQAALLPPVDRDTLLEAWNATRREAAWEGCLHERFEDRAALSPDALAVLDDEHSLTYAELNRRANQLAWALRTRGVGPEVRVGLCMERAVDMVVGVLAILKAGGAYVPMDPAYPAQRLAYMVSDSNVSCMLTQQRVADKIAGHKVEVLCVDDAGLVNGSRDASNPPRLSRPQHLAYVIYTSGSTGMPKGVMVQHASVMNLRAALAATAYAGVGKPLRVSLNASLSFDASVQQLVQLADGHALCVVSQATREDTRLMLAWLERNSVERPGLRSLTTAAASGRGSGRTQPFARTGRRRGTRRGALGPA

SEQ ID NO: 14548 - protein, 161 aa, Myxococcus xanthus
IANAALKANQAEFEFQAGPFTAGELAVLGFEAEETLSQPYAVEVALAARPDVDVDEKALLGQDARLTVMLGDGTARFFHGIVSRMSRWDEGNGPERRRYRATVVPRLWTLRHRRKSRIYQEMTVPDIVHKVLDEAKVEHRLALTGEYPKRDYCVQYRESDL

SEQ ID NO: 14549 - protein, 334 aa, Myxococcus xanthus
RATPCAPLLARYAALWARRNGQRELWVGAPAVGREGAELAETIGYFVNPSVLRLELDGGLSFRALMAQASRTVHEALEHAAMPFSLLVERLAPLRQASRSPLFQTIFSFQQSPPRSEKGLAALAQGTGGARLSLAGVAMESLELELGTAQLDLALSIAELDGRFHVALEYNVDLFEPGTAERLLRRYESLLRSAVDQPDAPLAVLQLDPAEDRARLLAWGRALETPPPACMHTWFEASARHSPETGTILSGEGSLTYGQLDARANALAWRLRQLVLRPDTRVVLYLERSIDQLITVLAILTPGGAYVPLDPEFSNARCADVLVESEARIAVTRA

SEQ ID NO: 14550 - protein, 186 aa, Myxococcus xanthus
VLSEGRLELTPLVSLSVNDPLYSKGGLYVRGAYYLGDTLAVCDRVSLMQVVPSDYGRHRKRTFNRKIYYSVPQWDGMGDAEWRPIYRKVAFLNSILHFDGYLLAGAGVVNTETSALPGRGLNPAADLGLGMRFVAQDYIAVNVALINTSYVDQPLGSSKGAIQNVMTLNAGISLFLPFKSTGRDSE

SEQ ID NO: 14551 - protein, 256 aa, Myxococcus xanthus
MKRFFRVLLALCLTAPVLGFAQTTEEAEAGDVSEVDKDRLGPLRERVRPVSGHVFLKKGRFEFSPSATLSLRDAFYSKYIFGGTLTYHPMETLGVSLRVGYAINTVAGAAQKCTFGDGGEGSTRGCVPPTLDELDGNAPGQIKLLGGADVQWAPIYGKVSLLAETFVHFDLYGIAGASVVQYRGPGDSLGAEAQNYLTPGANLGVGARFFLNRWITLRTELRDLIYVEKGTEVSGNYLRNQLLFELGVSFFFGSES

SEQ ID NO: 14552 - protein, 563 aa, Myxococcus xanthus
MGMGLDLTQEAPKPAAPTMSFDAVDVSGKTADRQRLDVAVSLFKNDEYEKASMAAHELLEDPKLAGLHTEARYVLAKSLYRMGMYHSSLGEFSKILSLGPSTKFFKTSLEWLFFISRKTKNETVILDEIARHANQEFPEKYRNEFRYLLARYHFVRGRALDQVGQPEEADKSFSEVKRLALTIPRTDPFFPRAKYLEGLSFFRNGSRQKDAAAKRANGEMLAAIEAMKEVVRLTRPAPGKTADQAKLDKSLRELAFMQLARTHYGMQQNRFALFYLGKVERGNTQWLEALFESSWANYRVGQYEQALGSLITLSSPFFREEYFPEALILKAVIYYENCRYRESNIILQDFERTYLPVHDQLEALVKKNMEASEYYSVLSDVQKKNKDGLEKNETDIILERILRLALTDQDLRKTNDSILELEAEMDAFANRADTFKYSELSKSLLEGLKVQRTALISKAGIMAKGKLETELVALKQLLANGLRIKFETTTKEKEFLEEQLKAGGRTAIVKKYKYSVAVQDDQLYWPYEGEYWRDELGTYQYTMTKGCIERDTANRKVQSAEAM

SEQ ID NO: 14553 - protein, 145 aa, Myxococcus xanthus
MTLTTALLLLTLGAAPAQPAAKKFEFDRHYLVLLERVPGAKKLPEAELAQLQKEHLAHLTRMGESGKMVLAGPFDEQDDVGMRGACIYRTATKAEAKQLAEQDPMVKAGRLKVQVMAWYTEKGYLAFPKAPPVEDAKDVAKDAGK

SEQ ID NO: 14554 - protein, 319 aa, Myxococcus xanthus
QLVSAPILGRLSDRYGRRPVLLVSQVGSLLAYLLFAFAQSLPLLFLARVIDGISGGNISTAQAVVADITTPKDRARGMGVIGAAFGLGFVLGPALGGFLGAWGGNLAIGLFAAGLVAINLTGTYFYLPETRVEGRPGEGHARTLKGATLAMSLPVVGRCLVLMLVFTTAFAQMEGTFSVYLLTRFLSSGPVPLQEGGLFLRAAVTDLDVLREASLRSGWLFAAIGVISAGVQGGLVRRLTGGPGSAPGREALLATVGFGLTAAGLALLPVAPDYAWLFPVMGLLAVGSALVTPCLSALVSLHAPPERLGAVLGAYQAFG

SEQ ID NO: 14555 - protein, 886 aa, Myxococcus xanthus
GTDVVIRGHGFAMGATVSIGGTAATHVNRVSDTELRARTAAHGAGLVDVVVTNPNTPAMTLANGFTYATVTSILPAEGPVAGNTVVVIRGDAFADTTTVAFGGTPAAAVAFQSAQELHATTAAGIAGPVDVVVTRAVGGAEQVTHGFAFRAAPTIASVAPPAGPAAGGTSITLTGTGFVDGATVTLNGVNATHVRVLSPTTLTATTAAQLHGTVNVMVTVHGVPSGTLVNGFTYRQLPTLAAITPAQGALEGGRAVDITGARFLDGIQVRIGGVDCTDVAVVNAGLLRARVPAHVAGACDVQVQNPGEPLSLPLANAFTYVDVPTETGDNDVVFLMDGEEYFEEFRLNLEAVRQAPRHALTYVRLAFWMIEASVTMGDRAHFRVPNHTLLSYIDRVIRAGHDFDIIVWRPAKVERVSEGKGVAEVNEAFAQAVAEIDRAAAAAGPGVGRVRVFLETYEGEIGASNHQKIAIFSVAGQRTVLLGGINLSPSYFAPNDHSNNQTWHDAAIRLRGPATDDVEAEWMRRWRRTSQIEERWIWNSFGGGGDILARGFAFNASQTVRREAIQIQENRTLQAPQAANINVSIALTRSEGKTRYRKLRDLLLARIAAADQYIYLENYHFADPEIVRAIYTRHEVRRQAGQELRVIVMMPTGGGAPGYMTRRSWLQIVLRLRRPNGTHYCSRVYYMVNGVEQHIDRVDCVTWTVVDTYQANNPTASSWLEADTLTFRRNGGGGIDTVVKLEDISRVDCALHIYTCMNVTARARIYTHSKVAIIDNRWLIVGSANWSYRSMQYDGEISAFIDNPALAQNTLQRLLGHYDTATPLTVNNIEAEACTNLAGVLGTNLVRQAAIINHYVVLPLGHTTQPNFGLPRVRPGLMEVPNYTWY

SEQ ID NO: 14556 - protein, 297 aa, Myxococcus xanthus
MLVDQLQQPFPRIMKDAVFAPLGLKDSTFEQPLPKALEARAAVGTRSGGTSVEGRWHTYPEMAPAGLWTTPSDLARIALEVSKARNGKSRRIVSPAMARQMLTAQSSNFGIGFAREEGKAWFGHGGANAGYRAFLMALADSGSGIAVMTNSDDGSRLFDRLLASAVAEYGWKGMEEARPDSPSTTVDLLVRLQGVDSALAWFKDRKQGQATDAQLSPGILNEIGYGFLRQKKLADAVKVFEANAAFYPEDANAHDSLGEAYAEAGRKDDAVMRYKKSLELDPKNANAVKMLEKLGGR

SEQ ID NO: 14557 - protein, 389 aa, Myxococcus xanthus
AVESPNQLEEVLVDFWFNHFNVSSDKGAVRWMVTAYERDAIRPHVFGNFRELLGATARHPAMLFYLDNWRSVRDGMPERVSREPEAPKPGLNENYARELLELHTLGVEGGYTQQDVREVARCFTGWSIRKPRQEPAFYFRRRAHDPDDKWVLGQRIPGQRSVADGEQVLDLLARHPSTARHVASKLARRFVSDTPPPALVERVAKVFLDSGGDLPTVYRALFLSPEFWAPEARAAKVKTPFEFVVSSLRATEAEVTVRPRLVKSLAKMGEPLFRAPAPTGFPEGAAPWVNSGSLVARLNFSLELVSGRMPGTKVALKALATPTEPTERAWVDSLGQALLGAPPSEETRATILDALSKRAEAASAVGETRPVDVSLIAGLLLGSPEFQKQ

SEQ ID NO: 14558 - protein, 258 aa, Myxococcus xanthus
AQAQEKLGMVNVRVKEAEAGAIEKQGHAEANIVREKLLAEAAGAQEKGLAQARVLEAEASAIQKRGEAEAIATREKQLAEAAAIQEKLLAEARGLAEKAASMKLMDGVGREHEEFRLKLNKERDVELEAIRAKKDIAHAQAEVLAKAFANAKFNIVGGDGQFFERFVKAVSFGTAVDGALDHGEALKTALGGYLNGEKDLPADLKEILSKPGLSNDAQNLAVAALLHKMAASPVAATSAGLKALVEDVARPGTVDKQG

SEQ ID NO: 14559 - protein, 52 aa, Myxococcus xanthus
MRRDRRRAANNNLRSAVQVTKCPNCKEPVMPHRACTSCGQYKGREVVAQAEA

SEQ ID NO: 14560 - protein, 80 aa, Myxococcus xanthus
MSTSTIEAKVKSIIADQLGVGEDEIKPESSFIEDLGADSLDIVELVMAMEEEFEVEIPDEEAENIKTVNDAVSYINTHKK

SEQ ID NO: 14561 - protein, 249 aa, Myxococcus xanthus
MSGFKDKVVLVTGGSRGIGRACAVAFAKAGASTVVISYAGNEAAAQETVALLQAEGAKAEAIRFDVSDSAACASAVDGIVKGHGRLDVLVNNAGVAVDGLVMRVKDEDWDKQLDTNLKGAFSLIRAVSRPMMKQKGGAIINITSVVGEMGNGGQAAYSASKAGLIGLTKSVARELSSRNIRVNAVSPGFIGTDMTHQINDEMRQKMLEGIPLGRLGNPEEVAGAVLFLAGDAASYITGEVLKVNGGMYM

SEQ ID NO: 14562 - protein, 313 aa, Myxococcus xanthus
MSKVAFVFPGQGSQAVGMGKDLYEKFPEARAVFDAVDAALGEKLSTLCFEGPDEALKLTANTQPAILTVSLAAHAVFAKRGPAPSFVAGHSLGEYSALVAAGAMDLGDAVRVVRARGTFMQEAVPAGVGAMAAVLGLVPEKVKAPCDAAAEGQVVSPANYNSPEQTVIAGDAAAVERAGVKCKEAGAKRVMPLPVSAPFHCALMAPVQPRLAEVLGGIQVSAPSVPVVTNVEARPNADASRVVPLLLEQVSSPVRWIECVEALKAEGVTRIIELGPGKVLVGLVKRITKDIELFNVEDSASLDKALAALGVAA

SEQ ID NO: 14563 - protein, 288 aa, Myxococcus xanthus
MDEHASTAFRRKRDSSLRVGFELVRDGRAEALVSAGNSGAVMAGGLLTLGRLPGVERPAIAALFPALKGGGRCLLLDAGANVDCKPTHLAQFAVMGEAYVRARMGVARPRVAVLSNGEESSKGTPLTREASGLLRRSDLDFVGYVEGKDLFSGEVQVVVTDGFTGNVVLKTSEGVGMGVIGMLRQAIERRGGLAEKVGAMLLQPALAGLRRVVDYAEYGGAPLLGIQGVGIVAHGRSTPRALFNALGAALAMAEGGVQAELTRCIGRAAAWLPTHPKGKRATDAGVSD

SEQ ID NO: 14564 - protein, 120 aa, Myxococcus xanthus
MKVPVEFTLNLVPESLARGDDFKDDDEKAMEKKERSQGESGGSFELDDVDQELFDGKTINLDPIVREQLLLALPMNAVCRDDCKGLCSQCGANRNEVACTCETRPVDPRLAPLKNIKLNN

SEQ ID NO: 14565 - protein, 125 aa, Myxococcus xanthus
GLVPFALMMATSFVKISVVLSIVRSALGTQQIPPTQVITGLAIILTVYIMAPVGQQMYRAAGLDIWAKGPGVFSSETVGSMLGAANKSKEPLREWLIKKVTTKDRALFFNLAKKMRKALEHTGSR

SEQ ID NO: 14566 - protein, 228 aa, Myxococcus xanthus
MRLLLGAALVFAPPAAMAQAPSTSAPTVKPVVPPAESAPPPAPAVASPATPAPAAEKADPKADVELLEADRALDAELSARESAKSARSGAGGDTLSESEETDSLGWTLVRTLLVLGVVVASIYLTLNVGLRKLMGLQGTAAGRQPLVSVVERLPLDQRRSLFVVKAADEYLLLGGGEGGLQLLSKLDVEAVERIRAQRPQTNAVPLSPFLQKLLSRRSGGPPSQPPGS

SEQ ID NO: 14567 - protein, 467 aa, Myxococcus xanthus
MSLESEDEGSGVHERTMLVDLSQLRPSRQAPPQESPASQEPPASQEQRWRPFAFRNLEKVSRAQGLLAERLRWLTPADGTAVAVAARLTELFDAEVRLTVESVQVRPMAELRRFLGDPTFLAVLAPGALQGRAVLEVELALAHVAVDLLLGGAGETVGLRPLTDIEEGVMAYVVLEGLKLLVPGLQAAVPRPRLDGVARGVDEVSARLGDDGPMLAVHLQATLGPHSGMVRLVVPAAVLDAAEPAVESTQRRARGKADLEAFASRLSAVRSWLRAEIGSAEISGQDLASLRVKDVLLVDALSARTDKGEAGTARLRVGKGTAGWAEAEVFVGEDGRYQARITDFVQGEPGHPGSADEASAEPGDEEEDFTNPELDVPPELEGAALDDVSKPDGSDLLGDVPLQIAVELARVPVTAQQVVGLRTGQVLELNRGPGEPVELSVNGKVVARGELVELEGQLGVRIITLAS

SEQ ID NO: 14568 - protein, 110 aa, Myxococcus xanthus
MAPVPVAKPKGTAGSERLRALATEIAQKIVDRVRVGTNAAGNAEFQIDLRGDVLSGLSIKVSARNGKISATFSGSNREVLKQLEGASEGLRSALSGRGLRLEDVRFEAKA

SEQ ID NO: 14569 - protein, 162 aa, Myxococcus xanthus
MPPYRLQALQDMRARAKEEAEQAFSSAIKALEKEKAELQRLIDDLEQRKRERKAKVAAYLKEVMFKGAGINGMNMMNRFEERLKDEEAQVALEVERQREAVKVAERLVEQRRREMAEAAKELKAIEKHRENWQKQVKYERQQREELNQEEIGNALFLARQRK

SEQ ID NO: 14570 - protein, 273 aa, Myxococcus xanthus
MKSLLKPLLAVFLLALPAVAQAGTVTIKGSDTMVILGQRWAEAFMKKNPNIKVQVTGGGSGVGLAALQNGTTDIAMSSREMKKAEADKLRARYKAPPAQRSVAKDGVTFYVHQGNPVSALTTEQLMKIYVGDITSWKQVGGADAPIVAYSRENSSGTYVFVKDMVLDGEDFAPAIQTLPGTAAVVNAVSKEKNSLGYGGAAYAEGIKELKVKKGNEEIAPSADNIKSGKYPLARDLFFYLRAEPTGDIKAFIDFALSPEGQAIVTQVGYFPVK

SEQ ID NO: 14571 - protein, 279 aa, Myxococcus xanthus
ALQRGLFAGSGVGKSTLMGQIARNTKADLCVVALIGERGREVREFIEDAMGEEGMKRSVLVCATSDQPSLVRLRAAYVATAIAEYFRERGGNVLFMLDTVTRLARAQREIGLAVGEPPARQGYPPSVFSMLPRILERTGNSEKGKCTAIYTCLVAGGDMEEPIADEVRGILDGHFILNRALGERNQWPAMDVLASLSRVMSGIVSKDHKKAAGRLRELLSTYEKQRDLILLGAYQYGTDPRTDQAIDKYDAIIDFLKQDTHSNSGFEETVEQLIALFDE

SEQ ID NO: 14572 - protein, 462 aa, Myxococcus xanthus
RNQFWCTVKVSECGRFAVLAKWDYVHANVITLLRLADDARIPVATAMTSLNQVQVIGESLLIHTDLDAPRGRLCTAPLTAPTQWRTLIPESEHTLQTVAGVGGRLYAVYSRAASHHVRIHAEDGTWLRDLKLPALGAVNRNEGEGIVSGVSGPWRGDEVWVNFMSYVQAPSVYRYDYDADLLTPYHVPDVGLDASEYVTEQVWYPSLDGTRVSMFLVHRKDLPRDGQWPVRLSGYGGFNISVEPRFTSLQAAWLKWGGVLAFANVRGGGEYGRAWHEAALKTRRQNAFDDFIAAARWLVSEGYTVPARLASRGNSNGGLLVAVTAMQAPASFGAVFCRAPTLDMLRFPSFGYLSSATVEYGSPEDPVEGAYLAGYSPYHNVRAGLRYPRMAFVAALNDRTAPPHDPLKMVARLQAEGTQGGPFLLLPLRDSGHGGGTTLTALIEQDVDELCFYCGALGVSPG

SEQ ID NO: 14573 - protein, 233 aa, Myxococcus xanthus
MTAQEYLALKPSQRLRYRLYRHPAVLLGVGPIFQFLLRFRMPGIVAKERRPERRSILVTNLALVAVHLAFLALGDWPRWLVVHLIITQVAAGLGIWLFFVQHQVERPYWVPRAQWSLKGSALQGSSHLVLPRAFEWLFGAINLHHVHHLKPQIPNYLLRGYMEQHGLAEEGVKLGLRDSVRAFRLKVYDEATGRMTGFPPVHAGQARTPLASPPSIEPTGQLGRVLTFSGEER

SEQ ID NO: 14574 - protein, 240 aa, Myxococcus xanthus
MPDYVHVLLGLVLGYVISSYVESFMHEYVSDGRPKTVRFRRRAPRVFRPIINKHFSHHTIHHVRTFRSNHVTQFRSEEEKQKLTEELLQRGKHGRTIINGAFATRLHGEGAFVFVAPLVIFFPVFYFTLKPIAFLAGCVTLLLPPFMSHFVHPYLHMPFEEGQRTAPRWLAWLLRTRYMRAVYRNHFLHHRYGGVSNFNLVLGADIVRRRTRVLTEKDLSVMAEVGMPLPEEAPTRTVHG

SEQ ID NO: 14575 - protein, 291 aa, Myxococcus xanthus
MQGTQDSTYVRSLLSELSPRGLRAAVLCHRGGAVPNRRAPFYHAGFTDHLAWLVRFVREQEPHTPLYGVGFSLGGSMLIRYLAETGHASHLSAAAAVSLTFSLGSTARRACEGINQLYQLRVLNSYKRVARLKAHLPEFASRVGTLNGMRSIQAFDEVFTAPLHGFKDAEDYYERCSSQQFLPGIEVPFLVLNAEDDPLVARDTLPDARALREHVRLELTPHGGHLGFMYQRSSGLGYYPPARLISFFLQEPSEAHESLSQDVVGHALLALEAGDARGRADEHAGAARPAQ

SEQ ID NO: 14576 - protein, 143 aa, Myxococcus xanthus
MRVDALTSTLEQRVLPNDLDLNLHMNNGRFLTVCDLSRVDLFIRTGLLALMLKQKWAPIIVRHTMDYKKPLRPFQKYTVSMSITRWDEKYFYATHQFLSRGKVVAEGESTAVLLGREGVVPPEKVIEGGHPPGKTGRRWRTTD

SEQ ID NO: 14577 - protein, 1362 aa, Myxococcus xanthus
VPVQGEQGALGAAPRRVTRSRQKPLGFSLFYFAADEGAPGAERYRLLLEGARFADRHGFQAVWTPERHLHAFGGLYPNPSVTSAAIAAITERVAIRAGSVVLPLHHPVRVAEEWSLVDNLSKGRVGISVAPGWHADDFVLAPERYAERRELARRDLDTLRRLWRGESLSFPNGAGTPIDVRIRPSPVQRELPVWLTAAGNPDTFREAGRLGAGVLTHLLGQRWEELESRIALYREAWREAGHEGEGHVTLMLHTFVGHDVERVRETVEAPLRRYLSNSADLMRGLGRTLGVDLDPASVRPEDLDALVGRAFGRFFDGAGLFGTPRTCREQVARIEALGVDEVACLIDFGVDTDAVLASLPALDAVRQRCERDFRLQSQEEITVPAQLRRHGVTHLQCTPSLAQALLLEPGAAGALVGLERLLVGGEALSAELAERLRGTMGGALLNMYGPTETTIWSSSHAVDGSPGPVPIGTPIANTSLYVLDAELRPLPVGVPGELYIGGMGVARGYHARPELTAERFLPDPASSNAGARMYRTGDRARWRADGTVEFLGRVDHQLKVRGFRVEPGEIESVLARHSDVAQAVVVAREASAGGARLVAYVVARPGTALSVEALLAFSRRSLPEHMVPSAFVPLDALPLTPNGKVDRKALPAPEGVRDVAREYVAPRTDTERRLAELWASLLGVERVGAEDDFFALGGHSLLATRAASRIREAFGVDLPLRELFESSSPAALGARIDARLLGASGVPPLVARSHEGALPLSFAQQRLWFLEQLEPGGAAYNDAVAVRVEGALDVALLERSLREVVRRHEVLRATFHDDGGTPSWRIHPEARLALDRVDLTALSGADQAEALSLRLAEESLRAFDLGAGPPLRATLLQVSAREHVLLLVLHHLVTDGASMGVLVLEVAALYRAFSQGQVSPLSPLPLQYVDYAAWQRDWLRGEALEAQLAYWRTRLGGAPRALDLPTDRPRPAVRSSRGVSRSMLLGPELSHALKTLAQREGATPFMVLLAGFSALLSRHGGQDDLCVGTPVEGRDRTELEGLIGCFVNTLVLRVSLAGTPSFRELIGRARETVLGAFAHQDAPFEELVKALQPERDLGRSPLFQAMLVMQEDPLPELVIPGLRLNVQPQPSLTAKFDLRLIITDTADGFSANLELSTDLFEPDTATRLLEHLRVLLEAGVREPEQQVHALPLMTSAERHRVLVAWNDTDRPRPGVSVLHRLIEARVDRTPDVVALSFESDTLTYRELDRRANQLARYLRARGVGPDTRVALCVERSLEMVVGLLGVLKAGGAYVPLDPEYPRERLEYMLADAAAPVLLTQARLSERLPRDSATVVCLDSEWDAVAREREERLDVTVDGSDRA

SEQ ID NO: 14578 - protein, 229 aa, Myxococcus xanthus
MPHVLIIDDERDLAELIDFNLRGSGLTTHVSHTGEEALVAAREQNPDLVLLDLMLPDMSGIDVCRQLRASPQSRGVLIVMLTAKGEESDRIRGFEVGADDYVVKPFSVRELVLRLKAILRRGAPTAGGTAPLALGPLRLDVASHRFFVEDREVALTALEFRLLEHLLARLGRVQTREQLLEEVWGLSSSLETRTIDTHVMRLRDKLGPARALLETVRGVGYRMLDPAAG

SEQ ID NO: 14579 - protein, 140 aa, Myxococcus xanthus
MPEYRNPKPTVDCIIELPGERIVLIRRANPPVGWALPGGFVDEGEPLDVAAVREVQEETGLHVKLSEQFFTYSDPRRDPRQHNISTVYIGSAEGEPQGADDAAEARAFRVDDLPKDLCFDHDTILSDYVTYKRTGQRRKL

SEQ ID NO: 14580 - protein, 269 aa, Myxococcus xanthus
  unsure (1)..(269): unsure at all Xaa locations
HYALVLLALGGLLTLHELGHLVAARLLGVRVPRFVFGFGPPLVSFRLWGTQYVLAAVPLGATAHMQGMNPHRADVDEAAGFAARGPLLRILIILAGPLANYALALGVLFALYTSGTHVVVPLTVGTVQPGSEAARAQLLPGDRIVNVAGQPLRSWSEFVEKVGAAPGVPLELGVERGGDARSVVVRXXXDERGTGRIGVSQQYVYKAHGAGEALSHSFTHTVKVAEEGVALLKRMMQHGLESADAASPGALVRQESPDAMLSGKDALLL

SEQ ID NO: 14581 - protein, 332 aa, Myxococcus xanthus
MLEKALAEHLQTPHVALFSTGWGAGFGVIAGLVRPDDHVVLDALSHACLQQGAAAATTNVSRVPHLNNRAMRRKLQEIRARDTQNAVLVVTEGLFSMDSDVPRIEELQSICREYGATLLVDVAHDLGAMGPRGTGSLGVQGLLGKVDLVVGAFSKTFASNGGFVATRSPAVRQFIRIMGGPHIFSNALLPMQAAVVLESLRIVRSEEGDALRAKARENILALRGAFEARGVTCLGEPSNVVPVQVGDAKVARLASKKVFDRDIFANLVEYPAVRLRETRFRMQVMASHTLEQVQRAADGVCDAIEEARAELEVRPAATRASRRDEQRPQVEL

SEQ ID NO: 14582 - protein, 619 aa, Myxococcus xanthus
MEQYQQLWDEAAKDPDKYWGDRAREELYWKAPFQTVLDWKPPHARWFVEGKTNLAYNCLDRHLATRKDKPAILFEGEPGDRRSLTYGELSTEVNKLANALKSLGVRKGDRVGIYLPMVPEAAVAMLACARIGAVHSVVFGGFSAEALHERMNDAGAKVLLTADGGWRKGAVVPLLKNVEAALPHMPTMEKVVVLRRTGSTLALSGPKLVAWDTLVSGQSAECEPEWVESEHPLFILYTSGSTGKPKGVLHTTGGYAVNTSLTTRWVFDLREDDVYWCTADVGWVTGHSYVVYGPLMNGVTTILYEGAPTQPGPDRFWDIIERYKATILYTAPTAIRAFMRLGEEPVRKHDLSSLRLLGSVGEPINPEAWMWYRDVIGGGRCPVVDTWWQTETGCIMVSPLPGATPTKPGSATLPLPGIHAEILDREGNTVPRGQGGLLFVTRPWPSMLRTVYGDPDRYVRTYFNELPGMYFTGDGARTDAEGYIWLMGRVDDVVNVAGHRLGTAEVESALVAHETVAEAAVVGRPDDLKGTALVAFVTLKQGHTPSDALKKTLAAHVGREIGAIARPDEIRFAEALPKTRSGKIMRRLLRDVAAGNQASGDTTTLEDLNVLAALRQNDD

SEQ ID NO: 14583 - protein, 198 aa, Myxococcus xanthus
MQSTVGLGLRYSGMTPSLPAAVTLALPRCVPWSIVRAVSTPRRHRLVLSGLLLACLVGCLPHVQEPGDYVFEPVEVLRDDCGLLETNRSQLYGTLQISGRVVRLDFGFLDSHLVGYFLEDGDHFSIDGSVVKAAAEVNGQECLLDQINIHIDGTTQCETQFNGVLRVRYDTRRPDECVCEMWLRYEAVKESKRCDTEG

SEQ ID NO: 14584 - protein, 498 aa, Myxococcus xanthus
MPASVLIVDDEKNILLTLSQSLQLAGYQTHLANSGQVALDVVSARPVDAVLMDVKMPDMDGLTALAKLTELKPELPVIMMSGHGTIDTAVKATQLGARDFLEKPIARERLLVALRNVLKHQAAMAELQELRAQLGRYDMVGSGPAMQRIFSLIQRTAPSEGRVLITGENGTGKELIARALHQHSKRKGQPFVKLNCAAVPHELIESELFGHEKGAFTGAVSVRRGKFELAHEGTLFLDEIGDMPQAMQAKLLRVLQEGELERVGGAETHKVDVRVVAATNKNLEAEIAAGRFREDLYYRINVVQIHSPPLRERREDLPDLIKTFLDEACAKNGRRPLTLSPDALAVMSAYDYPGNVRELRNLVERLAILCEGPIVTRTDALELLPRGRNVPPPAPVETPASPLPPPSPEAAVVLASSTPAPAIAAPVATEPPAPVGFRPRADRTFREQVEDAEREIIQHVLSHTHDNVTEAARLLDLERGHFYKKMKALGLRRGSSES

SEQ ID NO: 14585 - protein, 28 aa, Myxococcus xanthus
MLRRVAQVIMVRGYAVGTYNLTLTYRFP

SEQ ID NO: 14586 - protein, 83 aa, Myxococcus xanthus
GTVLVLLHCQLTGTVPEGTWGPFLLLVGVALSLALWFTGVHGRRALRVLYALGEGRLPSTHEALLKALLEARSFPERSFAFCR

SEQ ID NO: 14587 - protein, 123 aa, Myxococcus xanthus
MEPPGHVRGMLLCHAGPHRLAFHAHEVASIASPSGHAAASARRAFHETEGSARVLVSASGGAVGVDALEIDAEPHRVLPAPPVTVRASGGSLQGFVMARGALWPLVGLADFERFLRGHPGEGA

SEQ ID NO: 14588 - protein, 144 aa, Myxococcus xanthus
MAVQEPEARQSYLVFACGSSWYAVPAESAAEVVTFPELTRVPGAPAHLLGVFAHRGEVIPVVDMGLLVGGVSQGSRRAVLVRLPRGTLALTASTVAGVSPVTGTLEPLGPTGVHVHLRGPAKSGPRDVAVIDPEGLFDHLSQGT

SEQ ID NO: 14589 - protein, 390 aa, Myxococcus xanthus
MVEGRQPEIDLLEGEGGPIVVAVPMFQEGRFKGVLLGELRASALPTRPTAQTSLVLMDDQGQILMPVGFNLGAGDITGGLRALANMPGPLTLDDKHMMGAGAWVGKSDLLLVVLEEETATAGLRARFLRQLAFHIALLSSTLIIFILLLRHSYRSLLAAEERLRRQETMAALGTAASLIAHEVKNALNGIQAALSVLRHTPAGSELPVGALRSQVERLSHLARSLLSFGAPRAALRRRCEVHLLVKDALQGVKLLPESEAVALTTSLEESLWVQGDAALLVSAIDNVLRNAVEAGAVAKDTGMQLAPWVSVSLTRDEHDAVLVVEDNAGGVDPRLEPRLWEPFATGRAKGVGLGLPMARASVEAHGGSLNYVRSPLGSRFTLRLPLEVAR

SEQ ID NO: 14590 - protein, 233 aa, Myxococcus xanthus
MGGCTPSYPKCNEDEHCAEKGEVCVQGQCQECATDANCQEGFTCQANKCAPKPPECTTDSACGSGRICEAGKCAEAQCQQDTQCPGGGKCESGRCQVPENTCASSSDCGEGQECQAGQCVTASAERCDWSPVPLGFNESGLSADAQQRLSDLAQCMKTAPGRVTLAGHADERGTEEYNLQLSNRRAASVKRYLTDLGVPASQLGTVGYGETRPVNSASSEDAWSENRRVEFQR

SEQ ID NO: 14591 - protein, 138 aa, Myxococcus xanthus
DEAWSPYLGKQGQDAADFLAENPLNLTAEEVKELDRAVKGEALDNVVKEYNTEVERLNAADGGSRPKFAELPREMQTVIASVGFQYGSLKTATPNFFAQVTEQRWDDAKANLEDFGDRYPSRRGREADLLGEGIATLS

SEQ ID NO: 14592 - protein, 398 aa, Myxococcus xanthus
MLLKEVSGETETRRRTGIAEFDRVLGGGVVSGSIVLLGGDPGIGKSTLLLAALDRLARHGPVLYVSGEESLRQTKMRAERLRVEGEAIHLFAETDAERVLTATEALKPQALVVDSIQTMYLPELGNAPGSITQVREVAGRLMAYAKRTGVPTFLVGHVTKEGSIAGPRVLEHMVDTVLYFEGERGHPFRILRAHKNRFGSTNEIGVFEMKGAGLVEVSDPSALFLSERPVGKSGSVVTSTLNGTRPLLVEVQALVAPTGYGTARRTAIGVDGNRVALLAAVLEKKEEIPLVGCDLFVNVAGGMQLTEPACDLAVCAALVSSLQNRPLDPKTLVLGEVGLAGEVRAVGQVEPRLAEAAKMGFQRVVMPAGSARRLEDAGPKMKIVGVETLGDALVAMFD

SEQ ID NO: 14593 - protein, 153 aa, Myxococcus xanthus
MGTLSKALGVMGAYVATSREVADLLVSRARPFVFSTALPAHLCAAAEAAVDAVEGDPDLRERLWRNIRRFADGLRGLGVRAEPRSAVFPLILGEPERALDAARRLREAGVLVKAIRPPTVYEGTNRLGFCLSASHSVGHVDLALEALRSVEVP

SEQ ID NO: 14594 - protein, 223 aa, Myxococcus xanthus
MGAAWREVKDGPQFDSVLEMVRGVRALGMEACATLGMLSESQAKRLREAGLSAYNHNLDTSPEHYGDIISTRTYEDRLRTLNRVRDAGISVCCGGIIGMGESVDDRCNLLRTLANQEHHPESVPINALVAVEGTPLQEQQRVETVDMVRTIATARILMPQSMVRLSAGRQQMNEEAQLLCMMAGANSLFFGEKLLTTGNPEYTQDMALLEKAGIRPLEPRQEG

SEQ ID NO: 14595 - protein, 69 aa, Myxococcus xanthus
MPGNQSMGLLATTLLGIAGSFVGGFVASLFRSDGRVFDLHPTGLLFSVLGALLVLFLVGLAGRGRRVHV

SEQ ID NO: 14596 - protein, 366 aa, Myxococcus xanthus
HLNSFSAEVTRVAREVGTEGKLGGQAEVRGVSGVWKDLTDNVNFMARNLTTQVRGIVKVVTAVANGDLKQKLAVEAKGEVAALAETINNMTDTLGTFAEQVSTVAREVGVEGKLGGQARVPGVAGTWKDLTDNVNFMASNLTTQVRGIVKVVTAVANGDLTQKLAVEAKGEVAALAETINNMTDTLGTFADQVTTVAREVGIEGKLGGQARVPGARGTWRQLTDNVNQLAGTLTSQLRAISDVATAVTKGDLTRSITVVAEGEVAALKDNINQMIVNLRETTQKNQEQDWLKTNLAKFSGMMQGQKSLDAVSRLIMSELTPLVSAHHGAFFLVDGAEAGTPLLKLTSTYAYRERKHIANRFRFGEG

SEQ ID NO: 14597 - protein, 586 aa, Myxococcus xanthus
EHVSLRPIQKVLCANRGEIAIRVFRACNELGIRTVAIYSDEDRTHEHRHKADEAYLVGRGKRPVEAYLGIDEILDVAVKAGVDAIHPGYGFLSENAAFAEACERRGIRFIGPRSDVVRTMGDKVAAKHLADACGVPVVPGITLEGDDAHVLEQARAFFAKQGGPILVKAAHGGGGRGMRVVREAKALEDALASARSEAKSAFGSSSVFLERFLEHVRHIEVQLLGDLHGNIVHLHERDCSVQRRHQKVIEIAPAPNLAPAVKEAICDAAVRLARKAGYTSAGTAEFLVAGDAFYFIECNARLQVEHTVTEQVTGVDLVQSQLRIAEGFRLDAPEVGISRQEDVVPRGYAVQLRVTTEDPANQFMPDAGVITAWRAATGFGIRLDGSNGYTNAVISPYYDSMLVKVIAYAPTFQGAVMKGQRALREFRIRGVKTNLPFLENVLAHPAFQQGETYTRFIDETPVLFQLEPRRDRATKLLQYLGDVIVNGHPTIKKDQRLKPTQFLEPRLPKTPSGPVPRGTAHILAEKGPRGLADCVLAQKRVLLTDTTMRDAHQSLLATRMRTRDIPRVAPATAHLALELFSLKSWG

SEQ ID NO: 14598 - protein, 447 aa, Myxococcus xanthus
MSTYLLLVDDDRTFASLAASVLRHEGFRVTLAHSLHDARGAMSREAPDLVVLDRRLPDGDGIDFLPELRAQLPNTPVLMVTAHGDIASAVEAIQAGARDYLSKPVELDDLVLRARRAVADLQLQERLRLAESELGGRRRLSRPHSPKMLAALQMLERIAKAPRSPVLLLGETGVGKEVIARHLHALQGGQGSFVHVNCAALPATMVESELFGHERGAFTDARTARRGLVEVAAGGVLFLDEVGELPLQLQAKLLTFLDKGAFRRLGGTAELSSSARVVTATNRDLTKEVAEGRFREDLYFRLSVFRVDIPPLRERREDLLPLAQSLVAELGAELGRRPVSFSSAARARLERYPFPGNVRELRNVLERALVLEAGPELELAALEPQGTSGPPDVDPDAFVVSGAPRPLQDVERLYVRHVLARLDGRRMEAARVLGLSYPTFLRRLEEE

SEQ ID NO: 14599 - protein, 421 aa, Myxococcus xanthus
MKFLRELRSVLNLTVLVAGLGYFVDLFDITLFGVVRVASLKDIGVTDPADILQSGLLIYNAQMVGMMVGGLLWGVLADKRGRLSVMFGSILLYSFANLANAFAWDVTSYAVLRFLGGVGLAGELGAAITLVAESLPKEKRGLGTTIVATLGMLGIVAAAFLGQHMHWKTAYLTGGFMGLALLFARFKVSESELFSKKMDPARANPLLLLTGGRFIKYICCILIGVPIYFTTGILFTFAPELTAGLNVQGTVTAGNAILYGSIGLTLGDLLAGVFSQWLKSRKRAVAMNLTAGFVLMLVYGLTPGLTSTMVYGLSFLIGITVGYWAVLVTMAAEQFGTNIRGTVATTVPNFVRGSAALAASGFAYLKGEMSVSTAALIVGSICFGLALLALTRLEETFHRDLDYEETANGPQPAAQPSQSGT

SEQ ID NO: 14600 - protein, 673 aa, Myxococcus xanthus
QAPGFMCFFRGQGHVFELANTAYMQLVGHRDILGKHIRDALPELDGQGYFELLDRVFTTGQTFVGRGMKVSLQQTPDDTLAESYVDLVYQPIIEPDGSISGIFVQGHDITEQKRAQDELRQYKDHLEELVRERTRALEESEAERRQAEAALRQAQKMEAVGKLTGGVAHDFNNLLQVISGNLQLLFLDVGDNAQAQRRLTTAVGAVERGARLASQLLAFARRQPLNPTVINLGRMVRDMDDLLRRALGEDVALETIIGGGLWSTFADPNQLENVILNLAINARDAMASEGKLTVEAGNAMLDDHYAQFHPDVVPGQHVLLAISDTGCGMPPEVLERAFEPFFTTKPEGHGTGLGLSMVYGFVKQTGGHVKIYSEVGHGTTIKIYLPRSLQAEMPRAEVIPEQVEGGTETLLVVEDDAEVRATAVEMLTELGYRVLKASDGQSALAVIQSGIPIDLLFTDVVMPGPVRSPELARQAKALSPDLEVLFTSGYTENAIVHGGRLDPGVQLLSKPYRREDLARKIRQLLAARQQRIAQREAPQPTRGATTPAPARVKQTGLRILLVEDDENILLPVCELLETMGHTVTAVACAEEATPLLRTQEFDLLFTDVSLPGKSGIELAHQAVQDVPGLRVIIASGHGANVDIGAKGPLDSAVILPKPYGLSQIEQALAQAMA

SEQ ID NO: 14601 - protein, 267 aa, Myxococcus xanthus
MHLIAAAQMVSTADKAHNLEAATRLVRRAVALGARLVGLPENFSWMGPEPERQDAAEGLDGPTLSQMASLARELKVTLLAGSVLETGAPGGRLYNTSVLFGPGGERLAVYRKIHLFDVEVGDGATYQESAAVAPGTEVVSAETEVGRLGLSVCYDLRFPELYRRLSREGATLLAVPAAFTLMTGKDHWEVLLRARAIENQAYVLAPAQGGRHSANRVTYGHALVVDPWGLVTARASEGEGLALAPVDPELQARIRRNLPCLEHRRLN

SEQ ID NO: 14602 - protein, 110 aa, Myxococcus xanthus
MKGGVQIKRATADEWSPAREGQPLYENDKVRTEAGAGTDIVFAANGSTVHLTGDSLISIAETRTRPGQQRTDLTVLRGRIDAELEKPATQSLSVTTPSATIQAGREIVFQ

SEQ ID NO: 14603 - protein, 115 aa, Myxococcus xanthus
MKAALLLLTWLGTTPPGTVVVGPNESLRQVAQRTLGDARAAEELRALNGLSSDDVAAGTRLKVPGHERVLAHKALETARTLVARSKHASVPPPASCRLKVTKSHVHEAQYMQCSS

SEQ ID NO: 14604 - protein, 566 aa, Myxococcus xanthus
MPTQQANPSVNLNLVLDQVAKDKGIDRAVLIATLEDAMKTAAKKHFGQDRELEAKYDPDKGVVELFQAITVVEEIVDPVQAVNQISLVEAHKKGMEVEPGDELVFQIFYRDEDAAEAKAQDDQYGDILRLKTFRRGFGRIAAQTAKQVILQRTRDAERENVFNEYRDRKNEIVTGIARRFERGNIIVDLGRAEAVLPVREQVPRETYRPGDRVQAYVLDVLRESKGPQIVLSRASVNLLTKLFEMEVPEIAEGIVVIEAAAREPGGRAKIAVSSRDSDVDPVGACVGMKGSRVQAVVQELRGEKIDIVPFDEDPARFVCSALAPAEVSRVIIDEANHAMELIVPDDQLSLAIGRRGQNVRLAAQLTGWKLDINSESRVRELREFANRSLGSLPGVNEMLVETLYAHGFRQARDIAEANAELLAQLPGIDPARIPSMQEAARTRMVEDQAELSRMDYEREQARIAEARRHPDELSQPERMARVRGVGEKTIEQLILAGYRSVEDIANEKDLAKLGDVPGVGIKKARQLKSAAENYLVEEAKLRAELNAERGAMTVALEGGAEATKAP

SEQ ID NO: 14605 - protein, 161 aa, Myxococcus xanthus
MSEKNLKQTVEERALALLEPIVAGEGLELVDLEFLREREGWVLRLFIDKPGGRVGLDECTQVSRAVDPSLDVEDFIPHEYNLEVSSPGVDRPLRKPTHFERVKGQQVKVKTFGPVGEPPRKNFTGTLTEVAGDGISVEVEGAGTFHILFKDIAKANLEFQF

SEQ ID NO: 14606 - protein, 419 aa, Myxococcus xanthus
TSGVPQSGGPQDELAHAVTTSGDAVYTAGYTSGQLGAEPSAGGQDAYVSKYDASGALLWTRQLGTSANDRALAVSADESGNVYVAGYTWGSFSFYENAGGTDLFVAKYDAKGAFQWVRQFGTATDDYATGIAATRLASHDVVFVSGYSLGRFDGSAPQGNYDVVVAKFDTGGNPYWLRQFGSARSDVALGVAVSPNEDVYVTGYTYGSFDGVTNPGNTVDLFLAKYSVLGEPQWIRQLGSSHDEFGTGVAVADDGGVYVSGYTSGALEGSTRLGSYDAVLVKYDTQGNWHWTRQIGTATTDYAQSVAVGKEGRVYLAGFTSGAMGGEPLLGSTDMFLATYDSRGTWLDFRQVGSTSADRGQGVATAEDGSVYLVGYTLGQTSSFPSAGGYDAVLYRFLDGAALPDEPGPWGPRGDSKGL

SEQ ID NO: 14607 - protein, 236 aa, Myxococcus xanthus
MSQQGDGAATARYKQAAAEWAVDGFLQPGMVVGLGTGSTAAFAVQRLTALRAQGRLLDIVGVPTSRATEALARSLGVPVSTLDAHPVLDVTLDGADEVAPDLSLIKGGGGALLREKIVAQASRRVVIVVDAGKLSPVLGTHWPVPVEVMSFGWRSQARFLESLGARVTVRQGAGGEPFLTDQGNLVLDCAFGPIDAPAALAASLGARAGIMGHGLFLNLATDLVVAGPEGVEHRAR

SEQ ID NO: 14608 - protein, 210 aa, Myxococcus xanthus
VLQGIFSSASFLYRTELGAEGAGANQVVRMTPNEVATALAFAITAGPADAELMAAAEAGQLDSPDEREKHARRLLATPAAQRHLYRFVEEWLGITGQANLTKNNQVFPVFSAAFKVSSQAETKAFINHILKERNGSVRELLNADYTYADARMAYFYGTQPSMPDGTLGRLPLPAERAGILTHASVLATYALFDSSSPIRRGKFIMHRLLC

SEQ ID NO: 14609 - protein, 235 aa, Myxococcus xanthus
SARDPSPVQEPTRPSTPALSAVSVERGARVPELTGTESTARAATGGGRPSPEERVFERPTGSLSSRDVAVAFVIGKHSVAPAPEPEPAKRPATTVAEAATAGSSEDDLGPDADFDRVLSGPGPNATKHHKPTVYVPPDPTAPRESLDLATVFAVVHARRSELAACAREQSAPPQEGDRAVLRLSVLPSGKVESITTETPWLRGTSLVRCMQQKIGAWTFPRHRTQGAPVVFRYEF

SEQ ID NO: 14610 - protein, 109 aa, Myxococcus xanthus
MPAYVLVEVSVHDAQTYERYKQLAPPSLKAYGGRYLVKGGPTQALEGTWQPPRFVLLEFPSVELARAWWASPEYAAAKALRHESAHSIMLLVEGVPATTPVTEVGESPA

SEQ ID NO: 14611 - protein, 725 aa, Myxococcus xanthus
MTIRRTEGPKPTIRSTAASEAQSKTAAKPATIAPNVIKDGFGPAAKTSDLARAEKTLKPLPPPVGRLSLESREAQTAIQTSLAHLAPSTQTSIRNPGIIGGVQFPAYTPKSVERDSLGMTHVRLDRQHEGVKVFGEQVVTHLDAEGKVKSTTGDQSEIPAGLGKEKPKVSHSQALDIAMKAFDGKPDRQPNSERVIYKDISGEYHSAYRVEVTNVDGTDNPRKMNYLVDANTGKLFEQFNTIDGFARQHGAAHGHTHAEGADHADHAHGAAATASEIKASATPKAEIADLATVTSKINVTQDGTVDQLKLDLDIDHTFKGDLSVTLTSPSGKSETVHNRKGGSADHIKGSFDLSGFAGESAKGEWTLSVKDNARRDTGTLNSWGLTITPKAVEPNEPGPGEKIADDTSMYSGKVALETKKQADGTYTLEDGTRGKGVATYDAMNRERASGQTQIKDNNDVWGEATDPERNKAAVDAHYGGQMMYDYMKDILGRDSIDGAGEKLVSYVHVSNNYVNAYWDGEKMSYGDGDGRNSGPLTALDIAGHEIAHGLTERTAGLIYRGESGGLNEAMSDIMGAGLEWYASQKNPDVKFNWTVGETAWTPKNGDPTDGLRYMDDPTKDNYSVDNYKNYPKQTEVHGSSGIANNAFYLLTNGGTNRTSGIEVKDAIGMEKGLKIYYRALAHYMTPSTTFAQARTATINAATDLYGADSAEVAKVKESWTAVGVN

SEQ ID NO: 14612 - protein, 122 aa, Myxococcus xanthus
MGEARFQPRLPPRFGEWFIDQLFVVALPEEFFYRGYLQTRLRDAWPQGRKFLGGRLGPAFWLTALLFALGHLAIFQAWRLSVFFPALIFGWMRERTGTVIGAALFHAACNLYVRFLEVSFFG

SEQ ID NO: 14613 - protein, 127 aa, Myxococcus xanthus
MVEHDGKTLPARVVMASQDLQVAVLAAPDGAYPAAPVKVLRDGDSLDGRWLVGVLPAKKGQPARPVPARARAAQPPFYDVPLALPAGSPVFDAEGRLVAVVVKKHRRGCRVLPLSAVKVELASVDMP

SEQ ID NO: 14614 - protein, 402 aa, Myxococcus xanthus
ARARAWCAPSLGGSVRRQAETVADVDIIASAPEAGPVLDALANAPGVAAVLGKGESKCSVRLEAGDLQVDLRVLPDEDFATALHHFTGSKAHHIRLRNLGQERGLKISEWGVHRDDGTKVPVTDESGLYALLDMQYVPPELREDNGEVEAAREGQLPQDLLTLEDVQGAVHAHSTWSDGRNSLEEMALAARALGLKYLTVTEHSEAAIYAGGLKVDDLKRQWEEIDRINAAVSGVRLLKGIEVDILESGALDYADSVLEQLEVVIGSIHVRHGMDEDQMTRRLLAAMDNPCLQILGHPTGRLINSREPYPVRMDEVLERAAERGVAVEVNGKPARLDIKAEYVRQAVKRGVRLVVSCDAHQKEDLRNLAFAVATARRGWARKGDVLNTLPTDRFVTALRERR

SEQ ID NO: 14615 - protein, 60 aa, Myxococcus xanthus
CSKVAQLQQTLQQLTQRNVLLETRVDPSLLGGVSAQVGSILYDGSIRTQLEEMRRELKQR

SEQ ID NO: 14616 - protein, 492 aa, Myxococcus xanthus
MSQSLLHRYSEGPSTLAAPEEARPFLGALLSAAGCGVALLDRELRPVWVNATLAALSGLEPRAHVGRPLAELWPQVAQALSPLLARALSGEDVTDTPVRGVLAPAAGERHLRVGLSPALQGGALAGVALWVRDETERFLEEQRLRARESHMRSLADVACDGHFLHDNGIVMDANRAMSQLLGYASPSEMIGRHLADYVAPEFRSQVGLVLSRGLEAPYEVVVLRRDGQRLPLEVLGRYVTWEGRQVRLVAVWDISSRKAAEELSANTEQFRHQMLGAVDAELRAPLQSLREGTRSLQRLDGLEEPQRTLVSQVARSARRMERMLQELMDFTRTRLAGGLALRPEPAVLDAVVTRVVEERRREHPGRTLHLETEGDLRGHWDTHRLAQLADNLLGSVLHQGAEDSPVTLRAVGAVGGVTLCVQSPRLTVAAEERSSLFEPFRRERSATPEGLGLGLYIARQIAVAHGGKLAVESCSGGGMSFTAWLPREGPGH

SEQ ID NO: 14617 - protein, 515 aa, Myxococcus xanthus
MEIRADEISRIIREQIKDYGKKVTVAETGTVLSVGDGIARIYGLEGALAGELVEFANGVQGLVLNLEEDNVGVAIMGDFQAIREGDTVKRTQQIASVPVGKELLGRVVDPLGKPLDGKGPIAATETRRLEVKAPGIVSRKSVHEPLQTGIKALDALVPVGRGQRELIIGDRQTGKTAVAIDTIINQKGLNVYCIYVAIGQKQSTVAQVVEKLNRYGAMEYTTVVASNASDPAPMQFFAPYAGVAMGEYFRDNKMHALIVYDDLSKQAVAYRQLSLLLRRPPGREAYPGDVFYVHSRLLERAAKLSDEEGAGSLTALPIIETQAGDVSAYIPTNVISITDGQIFLETDLFFAGVRPAINVGLSVSRVGSAAQIKAMKQVAGTMKLELAQYRELAAFAQFGSDLDKATQETLARGARMVELLKQGQYEPMPVEKQVMQIYAATNRDDPKKRGWIRDIPTADVVRWMREFLEFADGKHPNVAKDLASKRELTADIKTALSKAITEFNEVFQPTPGAKV

SEQ ID NO: 14618 - protein, 111 aa, Myxococcus xanthus
EAMQRNESAPPRRAWLPWGLLVSAVLLATTGAWAGSRSISALVERNDALTREAAESEARVAELQALREAMSRRLRTLEQQHHAAYAAAVTATAACTTALQPPPAPGKPLEH

SEQ ID NO: 14619 - protein, 282 aa, Myxococcus xanthus
MAIACVVLDFDGTFTDVAAESAPFLRHFRQGLAAALGEDLEAAWEEEVATLRAGADALGWDLGGRVVAPATADPYLTATCAAHRLMQRFGQGQDEARRSDVVQKLYREAYAHSATAFKPEAKEVLEALVATGLPVTVVTNAHTDLVEKKLDQLAPKGREKLTVSGDARKFLLDPPDAPDARFTAVPETQTLDGVLRRPVYLRRGRYFEALKRVWASTGTTPEQTLVAGDIYELDLALPAALGAHVQLVARDNVLPYELKAMELLGARGGVDRSLHGVLPRLR

SEQ ID NO: 14620 - protein, 186 aa, Myxococcus xanthus
LKGAIFNLPIGDNASGDDPLSGLAGLFGGGAGGKDGASSGGPQPAGLGGMGGAAMGMAQPMFTQMVEQITQTVREVHLTVYWQEGTQVESIDLVTHVVSLGPGSDRNGGAAAAQGGGSDNQWVTQDGRPVANPIPGPNGVMLDPTTRQPLRRLSDAQQDLGGRRGNMGGGSPLGNPMMPGGFRGTR

SEQ ID NO: 14621 - protein, 213 aa, Myxococcus xanthus
MEVMVAVAITALMGTVVAMAFQTGLTAKETVEVDADRYRQVRVAMNRMAREIGSAYVSDRYDSTRFRDQNDRPSNFVGERGKLLFTTFSHQRLYTDVKESDQAIVGYFVEASEDREARGRQDLKRRVNANIDERMEQGGHVDVLFEGVKELEFAYWDSEKKEWDDEWDTRRTERKSILPTRVRVTLTAVDETGKEARYVTQARIMLNTELPRY

SEQ ID NO: 14622 - protein, 455 aa, Myxococcus xanthus
MPLPFFQQTPRRRRKPPPRPARRERRSRGVALIIAIVSIALLTVIATDFAYNSRVDLQLAANQRDEVRAYYMARSGIALSRLLLRFQKQVDQTPIPNPAAILGQLGIGGTPQAGQVQPSSLNIQLFKMARVDCHMLRGLVKSDGAGGEVSALEPKQDDNFKLDEEDADPAAREVASQMTMRSFGGFEGCFLATISDEEEKLNVHRLIAGAGDARPTALRLMDMMADPRFEFLWERDDANKVRSTPQDVLLALKDWADDDRTGSAFNPVDPVNPLPGGFSDEGAAYSRYEPGYQPKNARFDSVDELYRVHGVNDQFMAAFRDRLTVYPDINRRPNINTDDPVMMGLAIMSVADQTRPDPRLRDPVFLNELIERVRAARMFSFFGMSVQDFVAVVEAAGILVDPAVKSNVAGNRLVGDKSQTFTIKSVGEAGSVQKTLTAVIRLDDTLGRLLYWREE

SEQ ID NO: 14623 - protein, 533 aa, Myxococcus xanthus
MARILGLDLGSHAVKGVVLEAKTKTHTTHGFAEVRRAQEGERADTLRAAVQELLGQLPPGNVDQIVIALPGPALTTHSLSLPFSDARRIEATLPFEVGSQLPFDISDVVYDYQVVGLKDGEGKEKASDLLVGVVRKEELAELLALLSELKVDPRIVTHPGLTYQNLFQQHPGLFQGTGEGGAVAVVDIGHERTSVSVGKPGEGVQFARTFSGGGKDLSKALATEFQTSLAEAHHWKEQHGAVASAAQGPDAERAAAAFVRGLQPMLRELRPTLKAFTARTRQQVGAVVLCGGTAKLPGIAEQLSRDLNLPVRVLALPADAKAIPAAEQPVAAQAYSLSLRGNAAGVRAPRFNLRRGEFAFKGDFDYMKDKLGLLASFAATLILLLIAFGVVRNSVLARREAQVDAVLCDTTQRILGRCEKDYNRALNMLAGVESPAAALPRLTAVNLLAEVTGRVPDDMPVKFTRIQIDLSRVILEGETDSSKQIDTLSNAIKNHVCFKDVRQGKVEKTRDGSKMSFRLDVQVQCPGEQGGES

SEQ ID NO: 14624 - protein, 185 aa, Myxococcus xanthus
MAKLQEVFAPVQTWFERLSDRERRMVSIAGAAVLVFVLFAVVMTFTNSASGYRKRTEDNLTKLQEVNTLAASFREAQANRQSVEQQLRSSNVQLISYIEDKATLAGLQVPNMTPKGEVGIGDGKIVESAVELTFTDVDLRKLTDFLQTVESGPGVVKVKLLRIEPRPASDTLTAWTTVATYRMKP

SEQ ID NO: 14625 - protein, 322 aa, Myxococcus xanthus
MSTDSKAARWKILLGYAAFAVVAFVVGLLVTFPYDAIRKRLVSEAAQAGLAVRIGSLRPGLAGITATNVRVSKPPQPLSADTVAALARGEGMLGAAELGEPLVLDSVALRPALFPPGIALRASVMGGTLSASVGLLGDTRVKVTADGLQASGGNLPAFTGMDLDGELNAALSLTMPKSGAQPDLSQANGELTLDTRNMVIKSGKVAIPMGGGTAVPMDLPQIDLGALTGRIQFVKGLGTVESLRLKSNELEAVATGTLKLGKRLEYSEPGMDVNIKLDPEFQKRLGLVGAGVTILPPDKTDPSFRAARLAGFLNRPTFLPRR

SEQ ID NO: 14626 - protein, 341 aa, Myxococcus xanthus
MPELVFFRRGEEVLRVGVDRARLVLGRGEQSDVAIPDPEVSRLQVALLWDGERCRVEDLSGKGTTVAGQSITHGELPDGADLALGQWRAVFRISGGSEGADVTTEVGHTTSVQSRDTQAPRWQPAQVRVKQGLNESVHRFTGEGFTAGKDAGCDLVLQDRFASSRHLKVTRRDNTFHVVDLRSTNGTWMGPVRVFEAEVPLPTVLRVGETELVLEPAAPTTRKEPTSFHGIIGGDPSVRQLSELIERVAPSSAAVTILGESGTGKELVARAIHACSQRANRPLVPVNCAAISKELIESELFGHEKGSFTGAMGARKGAFEEADGGTLFLDEIGELPLYLQT

SEQ ID NO: 14627 - protein, 171 aa, Myxococcus xanthus
VSRISAGRLSLELEELELGSLVRDVVTRYEPQAARTGSPLQLEAGDFDIVGRWDRLRLEQVITNLVDNAVKYGNGRPIHVRLEPHDGGARLTVRDEGIGIEPQHLPRLFGRFERAVSERNYGGLGLGLYITRTLVEAMGGRVHVESRLGRGSTFTVELPSHLGAEQARQAP

SEQ ID NO: 14628 - protein, 314 aa, Myxococcus xanthus
MSDFYAGRDDAESEATLLHALERGITFFDTADMYGSGANETLVGRVLKPHRANIVLPTKFGIVRDPQDPQKRGINGRPEYVRQACEASLRRLGVDVIDLYYLHRLDVQTPIEDTVGAMAELVREGKVRFLGLSEVDADTLRRASKVHPITALQSEYSLWSREPEDGVLQACRELGVGFVPYSPLGRGFLTGQIKRFEDLAQDDYRRFSPRFQGENFTRNLELVGHIERLAKEKGCTPAQLALAWVLAQGKDLVPIPGTKRRKYLDENLGALEVTLTDQDVAAINAVAPPGVAAGGRYPPSMQSSLPKASQPRGQ

SEQ ID NO: 14629 - protein, 274 aa, Myxococcus xanthus
MLVVLGFSVGAGLLGSLLGIGGGLILIPVLTLLLKVDIQYAVGASIVSVIATSSGAAAAYVRDRMANTRVAMFLELATTAGALSGAFMSGLVGGRGVYLVFGGVMAWSALVMLRRMRASAETPVPADALADRLALHGSYWDESQGREVSYRVTRPLTGLGLMYVAGTVSGMLGIGSGALKVPAMDLAMRLPLKVSTATSNFMIGVTAAASAGVYFARGNIDPFIAGPVCVGVTLGAWLGSRHLMARVNSTWLRALFVGVLLWVAFEMLRKGWAS

SEQ ID NO: 14630 - protein, 428 aa, Myxococcus xanthus
MLATLPHYQSLARLAPSVWRLNPPGLAPEAVAAFLRHALPPDESVFQGVRRVPGALPRVRRSEGTPETREDEDRLAERLVAALADSVGKHLAAGAVDVSLSGGVDSAALCALAARQAPGRVRAWTMDVHFADATERRNARTVANTAGVELVDVSVSDAVLPELFEPAVLSQETAILNARAVASHAFYAEARRQGASTLLSGAGADEVLMGNPAAFAGAAARVTEDRRLVHKVLHPGPVDNLGVDLRVLRLPWDAELASGDEDHPEEVRYAAWVLWELVLPPELRGASAHGVNVCTPYLDADFADVALGLPLGVLARHGAGKWLFRHAVRTLVPDEVRLARKTPRYAHTALSSPVRARWLELYREWLTPARLAPLECIDAGATRALLERYARLAADAPEASAMDRLLMRLCSLAMLHAHASARPPCPES

SEQ ID NO: 14631 - protein, 397 aa, Myxococcus xanthus
MSRILIATSPEKGHLNPMAGVAQWMRRMGHHVGWLCIPEPAPQLERLGVEVLTLPHAEAPVPAIETGGEALARLVLDEAALGQWIRGLLIDAVPSLLAPVREAVERFRPDVMALDGMQYAAVLAAHALRIPWAGVSSALSLLEPPIDYGLRRNVRALADERQALFSRHGFDARFRNCECLSPDLNVIFATEAFLGSDAGLPPATHLVGPSQPPEARGDEVDFPWERLGSKPVVYVSFGSQISWQPDLFQTMTEAAAPLGVTVVLSAGELADTDFVHSLPGDVVAVPYTPQRQLLSRVSVLVSHGGANSVMEALTEGVPMLLLPVCNDQPIQAHFLAKSGAGLVRAPRSLSVEDCREALRQLLEPGTVLRQRVAGIAASYQARDGAKDAAERILRLVA

SEQ ID NO: 14632 - protein, 176 aa, Myxococcus xanthus
RDWDVWRLVLPGVSPLEVWNLPVMGRELWELLGAPRVDADRRAGVPEPALAGRLGPALAVALSTLVKRHAVDAVWLSGGLVCLEGFGAMLSSVSTALPCPVYVAEHPLFAPALAGLRLLAPLAPAHPVALDVGQTGIKCVSPTAAPRIFERDAALLPRYFIGMARPPDRRHVKAAG

SEQ ID NO: 14633 - protein, 55 aa, Myxococcus xanthus
MPALGEVDGVPLDTPDLLGQMLGYLERETPLATCRYCLGGDGAWQPHAQLPRIRS

SEQ ID NO: 14634 - protein, 267 aa, Myxococcus xanthus
CSTAIPVSTRPDNATAPGGVSGGGTQARLGGLAEMPCRLALNRPVRGPSFLAEQPRLLEALEMKRIQALAIAGALCGGTALAKDKPDMRGLTVTVGGGVEGYSGGLAPRIDPGAAYGATATLKPSTVLGIELGYTGAINKLDRRGLEDLARNPDIVRNGGQAVATIGLTATPVQPYLLGGLGMNWYNVRRGAEALGYRDDTAGAVPLGAGLRFYTGSFTADVRANYNLLFNQELVPTLPPAENQPVKDVTFAGGSSYNATLNVGATF

SEQ ID NO: 14635 - protein, 334 aa, Myxococcus xanthus
MSIDVIDEVPAQGGRPLEDGAGQEARSLPGMVYIPGGTFWMGSDHHYPEERPTHQVTVTDFWMDSQLVTNADFARFVEATGYVTVAERPLNPDDFPGANPALLVPGSLVFKKTLARVDLRDLTQWWFYTAGACWKYPEGAGSTWQGREQYPVVHVCFEDALAYALWAGKTLPTEAEWEYAARGGLDRKVYVWGDEFAPGGKLMANTWQGEFPWQNLNTDGFEGTSPVGNFPPNAYGLFDMAGNVWEWTSDWYQERHEGNGGKPCCIPVNPRGPATSDRSLDPCLPKVKIPRRVLKGGSHLCAPNYCLRYRPAARSPQAVDSGTSHIGFRCVVRP

SEQ ID NO: 14636 - protein, 296 aa, Myxococcus xanthus
MKQKITGFHLDREDHWVADLKCGHRQHMRHDPPWMVRPWVLSEDGRRSRLGVELDCKRCDEAGHAVAEAVREALRTVALRAYDDGGLSGLCAEGRWELALDALGAADLRPVIRRALAPERGEGALVSARMILRPLLPDDARAIQRLAGDREVAANAAGIPHPFEDGMAEAWIASLDARSHVFALGHSESGEFMGLAGLVEADEERPRTAELSYWLGRAYWGQGFGTEAAQTLVRYGFETLGLESLHASCFSRNPGSRRVLEKAGFRHAGHQARALRHLGQDEDLERFIQERSRSRP

SEQ ID NO: 14637 - protein, 380 aa, Myxococcus xanthus
MDPHSTIAEFSLVKGGLLFETERRLRRGPRKRYDPVLRALAFSAIGWLPLLIFTLPSGGPTVGSLFMELQVHAQLLVALPVLLAAEPYIDGRLAFAVRQFLNSNLGATDGLRTFEADARRAMHWRDSYIVEALLLILAYALTFITPADATRSWTLSGDGFSMAGWWNLAVSQPLFRFLALRWLWRGVVWSAFLLRVSRLPLTLVPTHPDMMGGLGFLPVCQACFSPVVFSLAVVVAAYTSRVEPKDLSANPAAYVIPLVVIAAGAVVLVFAPMSFFVPQLVRAKRIGDEDFSKVAAKHSRQFEHKWFRGGPEPELLGAPEMSSLADIGTAFTLERRMRLLPWDKMALLAVVGAALAPLVMLLVMDRQFISVLKFIHEGLR

SEQ ID NO: 14638 - protein, 88 aa, Myxococcus xanthus
MRPSGLAEVEAAKADGRWAAAYASHKNATVPEDLTVALSASPRAARAFEALGKTRRYGLILKVMTARTEKGRASQVRRVVAELDAAAD

SEQ ID NO: 14639 - protein, 142 aa, Myxococcus xanthus
MNTLRGLCTFNLWADDLRAATRWYAEQLGVEPYFSSEAAGRGLGYVEFRIGDYQHELGIIDRRFAPPGLATARGGTVAYWHVDDIAATLDQLLSLGAQLLEGVTERGPGFVTASVIDPFGNVLGVMFNRHYLDVLGGARGQR

SEQ ID NO: 14640 - protein, 105 aa, Myxococcus xanthus
SEAPKLEPRSLEAVTAAVQDGEDASLLHPELLISDLLRYGVAASLALVTLGTVVTFFRHPDYLVSSEALLRLTSPHPVPHTLGDVVAGALAARGQAFVMAGLLVM

SEQ ID NO: 14641 - protein, 120 aa, Myxococcus xanthus
MKNGEIVLGFLPVAGFHRMAVNSTAGKAAVDKALAEHFGRPVKLTIQDASPDDPRLGPSLADQDAQTRAAHEKNTDSKVRSHPAVRAVLKFLGGEIEHIQVYEPERPGAVPADDTSDDSA

SEQ ID NO: 14642 - protein, 105 aa, Myxococcus xanthus
MPGVDLNYFIRQANKLTEKIEERKQQLAEESVEAKAGDGRVTVVANGIQEIRSIKIDKEAIDPNDTSMLEDLITAAVNAALASSRQHMQRELAKISGGVKIPGIT

SEQ ID NO: 14643 - protein, 197 aa, Myxococcus xanthus
MTPDPLNRLVAQLAKLPGIGEKTAQRLAFHILRAPGEYAAELSQAIREVKEKVHLCVRCFSLTDAETCNFCRDARRDERVLCVVETFADLMALERTREFKGRYHVLHGVLSPLEGVGPDQLRIRELLERLNDSRVEELILATNPDVEGEATALYLTRLLKPMGLRVTRIAQGLPMGGDLEFADQATLAKALSARRDL

SEQ ID NO: 14644 - protein, 611 aa, Myxococcus xanthus
MAEIFLAKLLGADGFERNVVIKRMLPHLTNNPDFVEMFRDEARLAAKLAHPNIVQIQELGFAEGCYYICMEYLAGEDFSTTLRLAGRKRHYVPLPVVLRVLIDAARGLHFAHEFTNEAGQPLNVVHRDISPSNLYLTYQGQVKVLDFGIAKAESRLVNTRTGVVKGKYMYMAPEQARGKEVDRRADIFALGVSLYEALTHVRPFSRENDLAVLNALLQGELKPPRELRPDLPEELEAILLKAMAFKPEDRYPTAEAFADALETFLSEHLSGSGAMPLGAFLKGHFGEERFTERSRIPTLATLTATYGGAAAGAQGQAPGAEPHGTNLYGVLAREGDATSAQRPGMSMRPSSPGVPAHGAASRGSTSPESAPTAGGRRWRTLAVGLAGGLMLAAAGIVGYRQWMTTPASVSLVPATVPVVEAVAPEAAAAQVGAPMEAVAPVGAAAQAGSLTDAVANGAGGDVGETDSAQLSVDAAGVTETDEAGLAGAASDVEAEADEEGADAAPVRSKKASSQKRVTLGIDDVQRVVSRGRARITTCFERYKADLPSSPGEVQVQLTIVSSGKGRAGTRGPLASSGVGRCLEAQAERLRFPPHRDQEVTVVMPFSWRVTQ

SEQ ID NO: 14645 - protein, 93 aa, Myxococcus xanthus
MNKLELVYDNSVPVLMVSTPRNGQAAGAKVRAAGVAPVDARLSINGRPVALDGKHRFNTWVEPVGSPPVLVFKMTRPGAPAVHTVRTLKQRGP

SEQ ID NO: 14646 - protein, 208 aa, Myxococcus xanthus
PPGPVSAQVTAEGYASAEATATVEEGMRAELEVRAAPLPPPTGALRVTVVDARTGAPLPDIRVSVGTAQVRTDLAGQVVVKDLAPGPVAVAVASSGFQSADEAAVVIAGQESTLSVPLAPEKKGTRATLVGQVRSVRGGKPLAATLLVTKARVRARTDAKGAFNVQVRGGTYRITISARGHLSQTKVITLREGERTILNVDLFPRGKR

SEQ ID NO: 14647 - protein, 479 aa, Myxococcus xanthus
AHMNVLFISSEVAPFSKTGGLGDVAGALPAALASLGHDVKVITPRYRDLRGAERLEPTGQSLLLRFPFGELSGPILSARVSERLEVLFLENAFLFGNRHGLYGDAGGAFADNHRRFAYLSVGALQAAQRLRFIPDIIHANDWQTGLVPVALRRGFQTGPLAHAKSVFTIHNLAYQGQFPKDVMGDLALPWDLFTAHDGLEFHDTVNFLKAGLVFSDALTTVSPTYAREIQTPEQGYGLDGLLRHRAHRLHGILNGVDTHEWNPEDDAFLPARYGLKDLSGKAVCKRELLARFGLEDGPAPVFGFVSRLAWQKGMDLLLEALPAALHADIRVVGVGSGEGPLEEGLLALQSRYPKQVGVHIGFDPGLSHLVEAGADFFLMPSRYEPCGLNQMYSLRYGTVPIVRATGGLVDTVEGGLDGNGILFEAFHKSALLAAIRRALALYADPSRLDEFRRRGMEKDFSWGASGRRYEALFHDLVAE

SEQ ID NO: 14648 - protein, 284 aa, Myxococcus xanthus
MAEVYQARARVTTQRSPGEPDEIVIKRLHPSFRSDTAYVKAFVDEAKLTVRLRHPNIVRTYRLFKAGPDYLMVQELVSGRTLGYMQELLVKAGAAMPPESACYIAWCLLKALDYIHRAKVGENGATIVHRDVNPANLLLGINGDVKLTDFGVAEVEGLMRGDSGALRGTLPYMSPEQVLGLPVDARTDLYAVGIILWELWSGRRLFVGEHEAELMHKVRDARVPLLTSSPELPDYAVQVARKALFADRARRFQTAAEFIKALESLSRRAGWPLTVEALQPLLGG

SEQ ID NO: 14649 - protein, 160 aa, Myxococcus xanthus
MRSRRAVILGLLGGGLAVSGCLGSVPFRPRAYEDAVRVVGFQVDFRQDGTGVLDLDLAVTNPASDAATLAAVDFTLRVDGRRVAVGTQQVAAPLAADGSAPLRVLFPLASARATGGPEPVPRRVQVEGGVVLRFGGTERRAPFRSERVLPLAWVPPLDGD

SEQ ID NO: 14650 - protein, 190 aa, Myxococcus xanthus
MSLFRQCVFPISLAVLGSTSVLAAEKSPPPEPPAPSRKVDPTKAQTEAWLREHIEAWNDSEVHVTVKDCRIMVLDKPRERTEIVDLRGLLLPIEVIRLNGGNDATLRLRVKEKHTGTYSMFRKCSAENRYCAEPTGKFQSLPYVDLSVTSVRDFVPGRQTDVDKSLRLERALEHYSRLCGAMEDARNRLF

SEQ ID NO: 14651 - protein, 267 aa, Myxococcus xanthus
MARMHMSALLMVALLAAPAQPLTWKVTGADVTFEMSAKDLRALRDGKEVFGLQSRQADFLSNFKAEEGTNTFGWEGSQSLKVLSVVGPWVSYENSDSGFTGGAHPYASTSYVTEDVTKPKGAFSLLSVFPEKDVVAALKADRFIRKHIHDEAAFKDARTVDALMQSLEPGEDCVGFDSGGLESVKRSVAFHHIEGNKVAVRISFGYAAEACRGRSFVVGVLLTISAELRPALKRAARREEGFLMKDAKAVKAPSVHFTWESPEPKQE

SEQ ID NO: 14652 - protein, 182 aa, Myxococcus xanthus
MVIKGYVDMMLKGTAGGLTAPIQRYLERLRRSADDQSAIIERRLAKVQDEGVEDLRPLLRTAFIPAARGQRIMDTTMTLPDRPVAIPGPRDDVELLVRVLARTVAASGAPTAVRVEAAGDASVWQLRINIRGGKPLPEKTVTLLRHLTQRLRGGLSLPEETGNGWVVHLPVDDTVPVAPRDA

SEQ ID NO: 14653 - protein, 181 aa, Myxococcus xanthus
MSDGSSDDDVDITMTLGVVLALASIYPLVTALTDEDVSQEEVVTGEVEEERSQRCDERTFSLKGPLHWSVSLGAARRTGRTGEDGAVSLGQPLNELVEQAITDEASVRRLVAGRGIAFRLELERAPPADFRLDSKALPDAYFRRFADRYGQQLGGSERARFENCELIGKSARETLECYWSQ

SEQ ID NO: 14654 - protein, 185 aa, Myxococcus xanthus
  unsure (1)..(185): unsure at all Xaa locations
QHPELIVXQDIIRPAHFVPWMKPIGDXLRDMQKQKIHMAIVVDEYGGFMGVVTLEDILREIVGDIGDEFEVEEKQVEKLADGSFLVDAALEVDAFTQTFGFPLPEGDFDTLGGFLSSMAGHLPDVGERFAYSGWQFVVASKEGPRIDRVRMSRVKSGLTKDGKAAESRDGLGREHGREEQASAKS

SEQ ID NO: 14655 - protein, 251 aa, Myxococcus xanthus
RGKNQSNPLSGGQSMGAESVAAALRKATEDSRVKAIVFRVDSPGGSYVASDTVRREVQRAKEAGKPVIVTMGSYAASGGYFVAMEADRIVAHPGTLTGSIGVYAGKFVTAGFWEKLGVNFDSVAAGKNAEMFGSDADYTPEQQARMDASLDRIYADFTTRAAASRKLPLEKLQSLAKGRVWTGEDALAHGLVDALGGYPKALELAKEAAKLPADARVNVEVYPRKKPASALLSELLGQTGDNSEDDATSIS

SEQ ID NO: 14656 - protein, 213 aa, Myxococcus xanthus
GTTSAGVVVLGIVGIQVARNAAVHGWFGGGEVQTDDFEMGEITIRVAQARVDDEELFEYPGHGARRPGSGEPGVKPATGSSGPGKVAMASTTRAPADRKPRPGGSVTTDPDGMETTQQFDQSAINQVVASNKSTLFRCFKEEAERTPGIYAKVPMEFVIGNNGRVSKLWVDNHQFKKGPLYECLLSEMQKWPFRAYEGEQATVGLSFTIGKRG

SEQ ID NO: 14657 - protein, 212 aa, Myxococcus xanthus
MSAASVAETEIAKKALSVPPGTFRHTVLTAAKRFKSTWAELGKLLVQVRDEAKFEEWGYPSFETYCLKELHIKKQTALKLTRSFSFLTKHEPEEELTAQEFPQRAPAFEVIEVLADAEERGQLSPTEYKSLRDSIWSPEKNPAELKKEFAERFPRPPPEPPPESAQVRKLAQMARKLASELSGSRRIPNAVAERAAALAEDLEDIASGVTDA

SEQ ID NO: 14658 - protein, 121 aa, Myxococcus xanthus
MIPEFIGRLPMIATLNDLKEEDLVIILSQPKNALVKQYQKLFEFEKVKLTFTKEALRAIAREAMRRHSGARGLRAILEDAMLEIMYDVPFREGVKECKITEQVITRHEAPQLVMEKEKKTA

SEQ ID NO: 14659 - protein, 577 aa, Myxococcus xanthus
RPELLDAERALLDGQGDSAADAYDRAIRLARQYGLSLDEGVACEAAARFHLTQARERVARTYLEEARAAYLRWGARAVVARLEREHPRLLPSAPTPTRTDAPTEASLAALDLASVIKTARALSGEIVLGKLLRKLMTLVIENAGARRGLLLLKRTEGLVIAAEGSVDGDGVVLEAPIPMESSASLPTSIIHYVVRTGETVLLHDASAEEPFSEDPYVRSAQPKSLLCSPLLKQGSLTGVLYLENDATRGAFTPERLEVLRLLSFQAAISLENADLYASLEEYSRTLERRVEERTAEIQHKNAELAETLTRLQEMQRQLVAQEKLASLGALTAGIAHELQNPLNFVNNFSNLSSRLAGELEETLKGLADRLDSEAREDVLETLQDLKQNAQRIHSHGTRASDIIKTMLRHSRKSEGTRSKSDLNLLVRDSMNLAVQGLRSRPGGASVKVETTLDPTVGVVELVASDISRMLTNILDNAFYAAAQHQQQAGAGFMPQVHLSTRRVGSKVELRIRDNGPGIPEDLREKLFHPFFTTKPAGVGTGLGLSLCHDIVQEHQGDLRVESAPGAGAEFIVTLPAP

SEQ ID NO: 14660 - protein, 557 aa, Myxococcus xanthus
VVGGVANATQNVVEGAKDKAGDVVGGVANVTQNVVEGTKDRVQDAAGNVRNAAGDVFEAGRTATQRTLSATGTAAAVTANGLGNVLKDAAERAGPVLDKATDIAADGLDVAGRAIQDAPTLNPLQGITNDIIGGALQGTADVVRDPVDTARAIGDAVNLNRQVDQLKPGESTSISLYAEANGATLAGKVKGTLGVSRSEEEGGGYTVSVTGEVGAGVAAKLGAKGAADAGAEAFGTAGATVEFKFDTAEEAKNATRIIAASTATAGAAASNPVLGAGVNHVLGDPLSDLAGLTKNMSAVEFKLGAEASVNAELGMKGLPEAISAGAGASAGINQSTTARIEMEGGKPQKLTLKQSLEINGNASASAGVGIPTGGGDSVSLPTNASAGVSGSLGVELEQSVELPEGFNPTDFIKDPKGTAREIGASVRDTHEAKLTLTDSRQANASALGLGGATGREVKAEISGNINDIATSGAFGSIARGDVGQALDQLKDKVEIKATVQDKHKVTGDFGVGVHAGVGGGEVGLSTERTYVGEEQDLNAAQLAELYLTQRWSAGIPG

SEQ ID NO: 14661 - protein, 166 aa, Myxococcus xanthus
MFTGTGAALKKDRNATARTYLWMHPIYGGTALALEEVSARLKPLPRPLRALVYTGLIFGAEYGTGWLLKRLLGRCPWDYAPHRWSVHGLIRLDYAPAWYLTALLFEPVRDTLLHVTSEALRQTPEYRDAEARGTLPPTALPEEKPLEAGLAAARFESAQAEPAPIP

SEQ ID NO: 14662 - protein, 344 aa, Myxococcus xanthus
MFDWLHTLFSRDLAIDLGTANTLIYIRGQGIVSNEPSVVAVQQDARGGKKVLAVGKEAKEMLGRTPGNIVAIRPMKDGVIADFEITAAMLRYFIQSAHNRKTLVNPRIIIGIPSGITEVERRAVREAAANAGAREVYLIEQPMAAAIGAGLPVTEPSGNMIVDIGGGTSDVAVISLAGIVFAKSVRIGGDKLDEAIIQYVKRKYNLLIGERTAELIKMGIGTAYPTDEVMTMEIKGRDLVAGVPRTLTVSSDEVRDALAEPVNGIVEAVKLTLERTPPELAGDIADRGIVLAGGGALLKNLDTLLREETGLPVFLAEDPLSAVVIGAGKALESLDILRQVCQPG

SEQ ID NO: 14663 - protein, 168 aa, Myxococcus xanthus
IKGDSPNPEAPTGTGADPLIGRNLNGRFSILEPLGIGGMGKVYRALQAPLERVVALKVLNPSFPSSRDPGFQKRFLREASLTSKLRHPNTVTVIDYGQTDDGIFYIAMEYLDGRTLAQVLGQVGPLAWSRAIAITQQICRSLREAHSQGIVHRDLKPANIMLLNEQDH

SEQ ID NO: 14664 - protein, 225 aa, Myxococcus xanthus
  unsure (1)..(225): unsure at all Xaa locations
LGTSMHAMSFXEHLPFIGKPLLRWRTPRGVRPAVPLLIDEGEAFPGSFVIARRAEELGQGEPLFPATDLPVIQRWDDDSEQVHSAARAKVVAALLENRQAQAESLPAFLPMGLRSLLAPSARLGARFVARKHQAPTDIGAAVQEKVIPTLERLRESLGGRPYLLARFSFADIAAALMLQFVRPVDDSYLPLGPGTRAVWSDAELASRFPDLLEWRDGLYAKHRRP

SEQ ID NO: 14665 - protein, 107 aa, Myxococcus xanthus
MIQMTSVLDVADNSGAKKVFCIKVLGGSKRKYASIGDVIVVSVREALPNSKVKKGDVAKAVIVRTKREVGRPDGSYIKFDGNSAVLINKDMEPIGTRIFGPVARELL

SEQ ID NO: 14666 - protein, 54 aa, Myxococcus xanthus
MSLREKYKAHVEDHDYPKKITINEGDRVRIAETKPASKDKRWRVVEVLEKSKNV

SEQ ID NO: 14667 - protein, 64 aa, Myxococcus xanthus
MATPKQLKELSADDLKQRAADLRERLFQDQLKRRTGLLDNPAERTQHLRDLARVLTVLTQKTKA

SEQ ID NO: 14668 - protein, 113 aa, Myxococcus xanthus
MTYGEYGLMSLQPGWITSRQIEAARIAMTRHVKRGGKIWIRIFPDKPITKKPVETRMGTGKGGVEYYVAVVKPARILYEMEGMTPEVATGALKLAQAKLPVLTKIVKRADLSL

SEQ ID NO: 14669 - protein, 60 aa, Myxococcus xanthus
MARYEWYREGRVPLHTLRADIDYGFAEAKTTYGKIGCKVWVCKGEVLPGKGGQAPMPSNR

SEQ ID NO: 14670 - protein, 114 aa, Myxococcus xanthus
MESTAHLRFLRMSPRKISTVAELIRGKPVEAALNILKFTKRAAAKPVEKLIKSAVANATDKSKGQVDVDTLYVKTISVDQGPTQRRFMPRAMGRATPIKKKTAHVHVVLAEAKK

SEQ ID NO: 14671 - protein, 95 aa, Myxococcus xanthus
MARSIKKGPFVDDFLVKKIEDMIKTNKKAVVKTWSRRSTILPEFVGHTFAVHNGKKFIPVFVTENMVGHKLGEFAPTRTFGGHSAEKKVAKAPGK

SEQ ID NO: 14672 - protein, 116 aa, Myxococcus xanthus
MAKEDRYAQVRMPSGTVRKVLIECRATVGQVGNIEHEIIRIGKAGKSRWLGIRPTVRGLAMNPVDHPHGGGEGKSGQGNPHPVSPWGKKTKGLTTRTNKRTDKFIVSGRRQGARSQ

SEQ ID NO: 14673 - protein, 97 aa, Myxococcus xanthus
MNLNDVIKGPLITEKLDKAREKFRQYSFIVDRKATKHDVARAVETLFKVTVEGVNTNIVRGKIKRVGRSIGKRPNFKKAVVTLKQGDSIELFEGGAA

SEQ ID NO: 14674 - protein, 506 aa, Myxococcus xanthus
SYQLKDYEQHAISARYGALFMDDGYRERKLYVDVRVGDYDFDSSVAEGLEFSFSTKGTSYVSRKEGPLDDSPLALRTSLWLITDEKYKSALFQYLKKKGEDVYAVEDPKRPPSFTREKPVKHVEPPVEAPFDRERWVKVARDVSARFNAHPELFDSEVRVTKDKVTRLFVSSEGSRIITEETLYGLHVSAVTRAPDGQLLDNSRNFYVPAEAELPDVARLNKAADDVIQELLALRAAPAIDPYTGPAILAPEAAGVLFHEAVGHRLEGDRQEGDNEGKTFKGQVGKQVLPSFISIHDDPTRRVLQNEPLNGYYLFDEEGVRGQRVTLVEKGVLRNYLQGRRPVEGFLQSNGHGRSQGNLKPVARMANLMVESTNGVSDAELKKRLIAEAKRQGKPFGLIIRDITGGNTNTSGYGYQAFKGVPRMVYRVDVKTGKETLVRGVEIVGTPLSAVNRILASGQKPGVFNGFFGAESGNVPVSTVAPAMLLQEKRAHSAPMEGKDRPPILT

SEQ ID NO: 14675 - protein, 118 aa, Myxococcus xanthus
MAPKARDYFYRPPRKVRRGALKSALSLRAQEKTLIILDGFSLDAPKSKQAFEVLTKRLKLQNALVIDDKGNTNLHRSVRNLAKFDVLPPEGLNLEAVLRHSHLVLTSAAAKTLEGALS

SEQ ID NO: 14676 - protein, 102 aa, Myxococcus xanthus
MATQKIRIRLKAYDSKLLDQSAGEIVETAKRTGAKVAGPIPLPTRINKFTVLRSPHVDKKSREQFEIRTHKRLLDILEPTQQTLDALMKLDLSAGVDVEIKS

SEQ ID NO: 14677 - protein, 165 aa, Myxococcus xanthus
ARVEPGIIKVGEKVEVVGLRPTQKTVVTGVEMFRKLLDQGMAGDNIGALVRGLKREDMERGQVLAKPGSITPHTKFKAQIYVLSKEEGGRHTPFFKGYRPQFYFRTTDVTGSVKLPENVEMVMPGDNIAIEVELITPVAMEKELRFAVREGGRTVGAGVVAEIVE

SEQ ID NO: 14678 - protein, 186 aa, Myxococcus xanthus
CSKWLRKKVKRRWRAFLLLMVGVPALVLITLPFMCASRFVFTALFTAWGAWWWVVFTAAKSARAWEPSAGATRPPWFLRVWTVLTTRVPGFRWGSLQRYGASWGRRTEEVFAPISSTERHPWVFAGLAVVRFLGSFPPMKFFVRPLIPVASAHLLEEDVPAARKALAAGANASPPEAEVPRPADVW

SEQ ID NO: 14679 - protein, 116 aa, Myxococcus xanthus
MLAGTLVVRERRLKVPSALGMPGDEGLLADPLFVSRVKRLSSEEREVVLTAALRREELRMEARLRLFAALGARLQDALAMEKPPHLSDEKWALLVAAALLPPKGQPRSTPQRRQTA

SEQ ID NO: 14680 - protein, 65 aa, Myxococcus xanthus
RVRRLVAALSLVSALPFVACVRTPPPHERALINNELCTQEMAKGDLTRAETFCDLGLEFSPQCAV

SEQ ID NO: 14681 - protein, 953 aa, Myxococcus xanthus
MGGVVALVLAVALSAGQRMPALALYLFADTFSTFVSFRFWGRMAAAFDAREARRAFTALNGFAMGGGIAGGLLVQGLAVKLGTPAIVVSGAVGLLAAGAIFHHLYKGLPPTPPRGRPASFLGLRYLAESPYAQVLAALGIAFAVLSSFVDYLFRLRLEGTLSEDALTALFGSLQLWIGLFCVAFQLLVAQRLLKRLGLLRYVAMVPLVLAPLAGAALVTPSLWPVHLLRLVETAVSYSILPVGIQLLYTAVPDDQREGLRATVDGLLRKGGVVLAGLLLIGAGRAANGVTMAVAVVGMCAALGLLLVRLKSAYVAALGEQVGAPEEEDVALEGEEEQRLLAEALAAPSPERVLRAVAMMEQAEVPLRPHLPALLRHPHERVLERGVSLALELEAHELAPVLERLVEEGPRRPRDQAVWALARLSPERAERLLPALLNHPDVGLRCAAIGALVKSTGSAVALDALRAMLSRGEGAPVPERREVARLLGRIQNSRFAEPLARYLEDADGSVRHVALVAVGRGGYAELAPRLLPFLTWREERKAAREALVALGDEVTPLVEEQLNKHMAPLAMRLQLPRVLRGIGTPAALDALLFSNVRDDASLHFRIGAQMSRLRDEHPEHPVDVERVREALGRRREVYRNLVGAFRDLRAALGDGSLLTRAVGDRMDQALELSFFLLGLLHPSHVMRGIHYNLVGPDLRRRALALELLENLVDEEDRELVMEQVEAHHRELPPGAPGRLWRRLAALVQSEDGVLRACARHVAWVNGLHVLPQEGDMSDRTVQRMFALEGVSVFSQCDVDDIAAIAAVAREASFRTGERIYAQGDPGDALYVIVDGAVDAFHDGEHVLRFQGKQAFGEVSLLDGAPRPTDMVAAVDTRVLIIDRRDFLDLLADRPELLTGFFRAVSLQLQALIDLPDSRETGERLEMTAPLGPLAPPLPDGPAPDGNDDRSRDDS

SEQ ID NO: 14682 - protein, 172 aa, Myxococcus xanthus
MRTLLCTLGFTLALLSASPAHAQFANRSLGLSLGYMDFNRTNGLDDAFFVGVDASLYIENGFEVVSLSKIAFPRDTTDRNEKRVVGLAPSIGIRYLLMEESIRPYVGSDLSYLVVFKNSVSNFVGIGPNVGIDFFMSDSVSVGARAQYNFYIALNEKTQRTLTLSAGAAAYF

SEQ ID NO: 14683 - protein, 94 aa, Myxococcus xanthus
CSKVDYAVRSPKQQFIVVTEAGIIHQMKRAAPNKTFIPAPPDNGCACNECPYMRLNTLEKLWRCMKERTPELTMPEDLRERARAPLQRMLDWSQ

SEQ ID NO: 14684 - protein, 151 aa, Myxococcus xanthus
MRAKDRLRILLQGDRPPSLGAPETGFGPSAIFAHPPQDLPALLRLADELENLARREAGERALVWKCGDCGARYAVPVALVRQVSIRCERCGTPVELAATRSLGEESLIDPFLGAVNHSRRELAAFFREAMARGWPVLVAEDKRVPRTQPSA

SEQ ID NO: 14685 - protein, 439 aa, Myxococcus xanthus
MVSSPLLDRIKKRDARVGVVGLGYVGLPLGMAFAEAGFPVMGLDVDKRKIDKIEKGESYIKHIPGAPLAELSKSGKLKATTDFAKAKDMDCVIICVPTPLTASREPDMSYIIQTGEALAPHVRPGQLFILESTTYPGTTEEVLKPLLEKNGLKAGKDFYLAFSPEREDPGNKSFNTKTIPKIVGGYSPECSEMAAALYGSALKEVVPVSSTRVAELTKLLENIFRCVNIAMVNEMKMLCDRMGVDVWEAIQAASTKPFGYMPFYPGPGLGGHCIPIDPFYLTWKAREYEFHTKFIELAGEVNWQMPYYVVQRTMEALNKNKQTLNGAKVLCLGAAYKKDIDDMRESPSLRVMTLLAEKGAELSYHDPYVPELHKGHGFNLEMKSVPLKPETLGQYDAVLILTDHSDIDYAMLVDRAKVVVDTRNATKGVSKGREKVTKA

SEQ ID NO: 14686 - protein, 128 aa, Myxococcus xanthus
MLEEGLAQVREAGVAVDFLRAEAPYLPFHDGVLGAVLMSDALPYVADLSRMMMEVHRVLRPGGRWVASTYASVGAPRALLHRGVGLHPRGEAELRREAAAAGFVRFERVSLPSLLVVKAEKGSAQTPR

SEQ ID NO: 14687 - protein, 204 aa, Myxococcus xanthus
MGLGLLALALYFLLPFDIRGYVYYLNTRYAHLAAALLVATVPAAIPAWRRPLRVAALACAVVLAFVMARGYRAFSREAQAEWGPLVAATAPRPRVMGLMFDPGSRVVRQPVFIHSAAVLARARGGVPNFTFASTPHSPLRYTGEEPPTFPSEWRPQQMDYERQGVWYDHFLVRGASPSRVFGPQLQSELAVVAEPGKSALVRRR

SEQ ID NO: 14688 - protein, 401 aa, Myxococcus xanthus
MSSSSSDPRSLLDALRSGAPLPAFPAEAVESARAMARDVSQAALARVEALPEPLALAVLEAAVSDGNAVLPEALASSSVKPLAKAAKKALYQLRSRGVAVAGPARAAPAEPPAAAPEALNALASAVTGGGERALVLARVLRGAGVEVVQMQLSHERGVVALQLGDRNRATWRKLVKDGLAHGGIVELPPEEAAALLAEAAGTNLRTRTPFPKGLDVVLRHFGVQPQQSPTELPPPEPEDIRRAQEADVLHDTVELASWLPPELDMQALVQKMDEVMHSPLSLSDVQRQEQLQAAVLGVARDFFTPEVRQRYALRLWRMADYFERSSRPREADIARAEARRLFHGAQEPFSRFAERLFEKVLALVAAAGARAGARPGADTGPAEAAPAPTLERRSPGGLIIP

SEQ ID NO: 14689 - protein, 122 aa, Myxococcus xanthus
MTRIGMWVAGGLMASGLLLAPGAAEACEAHRRPAPETKAAEATPKAVEPSASGVERPLDVLDSLMAAKCQCGSKADCTCKKGSCDCSKCKKPKRQVMDALRGQPANLQFDEARYDASAGIFI

SEQ ID NO: 14690 - protein, 187 aa, Myxococcus xanthus
MFLVAPDDVVQALASFVRKGDPDASVLLDKFIERNRVYIRRLSPAQMRKRIRLEPVGQHHDLERIYARLNERYFEGRIDAAITYGPAPRVKGPRKSIKMGSYSADSKVIRIHPALDQPVVPRYFVEWIVFHEMLHHVYRTRKGEDGRRCIHPPELMEHEKQFHDYARALAWERENLDLLLRARVTPA

SEQ ID NO: 14691 - protein, 604 aa, Myxococcus xanthus
MRIPHALSLGAAALLALSAQAAAPGRPSPTLPSGYWPEEKVAEVLAKTQEVRLSPDLSRLTLDEQAAVKDLLEVGAIFQGLYESSRHHQALPAHAKLEALDKKLGSPKRTQDLLTLYRLYQGPIASTLSNAREAFLPVDAQVSARNVYPVDVTMDHVDPSLVPNPGERQSLLSEKTVVRRATAANLRQDVKVLQTHPVLDTLHPGLRQALQAKAKRPDAKALYAVPYAVAYGPELVKAYGLVMRAAQRLEASDVELARYLRYRARDLLTNDYESGDAAWVTGRFQKLNVQLGAYETYDDALFGVKAFHSLSVLLSNEAATQELRKRLGGLQAVEDALPYAAKKRVREDIPVGVYDVIADFGQSRGTNTASILPNDALAARRYGRTILLRENIMRNPDLFASDERIWRAAVVDAHARELVSEGNFQRTLWHEVGHYLGPDRDQKGRTLDDALEDYAGAVEEMKADLVSLFSLHDFHKKGALDAAGLRAVQASGIRRTLQNVRPREDQPYQRMQLVQFNWFLEHGLLQADPQTARLSIQYDKYPAVVTSLLEKVLALQHGGDKAATAAFFQRWSAWTPELHEKLAARIRDAQGARFRLVRYDALGD

SEQ ID NO: 14692 - protein, 223 aa, Myxococcus xanthus
MLTEEEYTGLDEAVSALGHRLTTTPEQYAAALYLPNWYPRLSRYTARSVWTEGMDAAEAWHAAQALGPQPWLVKDHVKSAKERWDEACFIPEGTTQARFEQICANLVDERGDRFERGLVVRKFLPFKTYGRTPAGPAHLEFRLFFGGGRLLAAEPYHEFDVDVPDFTGFEPLARRIDSPFITLDVAMLQDGGWAVVEVNDGGVSGLPPGLDPRTLFEALFAPR

SEQ ID NO: 14693 - protein, 223 aa, Myxococcus xanthus
MYLGMAGTAVMLLGGCASHRSSAKVDKQWVARVPPGELGNVREAQLTEDHAREQIPRTQVARQDAEAEREVAQRNEDATKSRHEAAEAALEAAQATGDVAAIERAQNAACTTQHALTLAEAETAWRDDAVTTLKSLEVMRQRELDVADAQLEQAKYEAVNANADVRAKELSPGDFSSAVADARRKAADQQRQVDANLQREHQAKARWQQLQDQGYGGSGSQQP

SEQ ID NO: 14694 - protein, 213 aa, Myxococcus xanthus
GDVLCAGQVLRYMVRMKLKLPLFLSLSTVLPALISCGAPTSTDTAHEAVVLGTQAQALATGTPAAEGVLSFLNDYSISYTVLDLEVPLDSQAAQALIDFREGPDGVLHTGDDRRFVSIEQVDAAPYVGPAALAALQAYAKGTGRVELPVDGHVGTLHGVAFNVAEARRAILAVNTESASNLETVFGIPAAAVQSLVAARPILHMVQLSRLANV

SEQ ID NO: 14695 - protein, 1126 aa, Myxococcus xanthus
MPSAPEASPYAMPPPAAGAPSFDFAELPVPANADPFALPPPGADFSDLPAPAAPQALEFADLPAPAAPDLSFDFNEPPAPGADPFAVDFSAPPAPALAAAPFAADFGSAPAPGADPFAIDFSEPPAPAPAVAVNPAVDFGDVDFGAPSSPGIPDSLEFDPTARPDDDLEADLSDPLPPPPNAGPADGLEMLSFIDDAAGKDGGAQAGAKVRRFHVRRRSGKVFGPFDEGVIVKMLEDGQLLGNEDVSLDSETWSAIGTVPTFAAAIQRLMEGPAKLVTPTAAPAAAVVDAPRVDGASPQANMKRLEQLYEGRMAAVSVVDRSGNTEKWKKRVPLMIAAGVAVVVAGIGAGTEFGTRYGAFGRRALFPARLSDGSAEAKQVADAKQALLTDTFASYKQARELSAKVLAQKEYPEVRSLWCQSVYYLQRRYAAGNPNEMSRCRQDMADIEFLGEKDVDVIKASAAIALTSRQADSVIPTLSGAYGREDTQGDVELAFLLAEAYSQKRDEKRALDTLNKVLAKNPKSAKAHHAVGNLHQAADRADEAAAAYAAALEADPKHVASAVELAAVELLVRKDVAKGTEAVERALAEDVQSALGPAELARARGLKGVAMFQKHQPKEAEAELKAALEMDAKSTFLRGQLARVLRAQRNFEGALPIYKALATEEPNNLEFADGHITALVMTGKMQDALEAVKKANGVFPNEARIAYLYGRIEDALDNLSDTEGHYKRAIAADDTLVEARLYLGRFYLAQRRNAEARPQLEEAAKKAPENAGVRAGLGELALAENNTLLAQQEFERSVKLDPILADAHLGLSRVALLTDDLETAKAEANRALELDPHLLKDGRLQRGLVLWRLGQLEEAVAELEKAKAEDPRSTTIPITLGAVLLERGDLPGAESNLGLALSNEPSNHEALYYLALVKARRLEFTQALDNMRKAVERAPNRPDYHYAYGVILRDAKNLPDAMSAWRKTVELDGSHADAHEALGHALLEGGQFDEAIASFEASLKADPRRTRVLGSIGDAYFAAARWNDAIKRYQSALKADPKLTYVYYKVARAFTEQAQHAKAIDWYRKATSLDSENPMAYYYLGFAYKERNKRREAVQAFKDYLSRKPDATDRKDIEDEIYDLQN

SEQ ID NO: 14696 - protein, 484 aa, Myxococcus xanthus
MEVALRAANLAQALAMFSAAPAVARPDFLVPVLSALAEHTAWVEAHLEDRGAVPNNHLVSNYVGLLVVGLLFPELPGAPQQVSLAVGGLPEQMEKQVHLEGTSFEGSIPYHRLSVELFTLGYLAARGAGVPLGPRYESRLRRMFHAVRAWCSEQGLAPQIGDNDSGRVFPLRDREDNAHGYLVGLGAALFGDAGLGGGEFVDEAAWLLGRAGQARFAALAPAPEPVSVSFPEGGFHILRGAGVVITVSAGKQGQGGVGGHSHNDKLSFELHVDGRPVIVDPGTGTYTREPALRNWFRGTAAHNTVQVDGAEQAPLDEARLFALPEEARARVVAFLPGKSVDRLLVRHDGYRRLPAPVGIERTFRLDRGERALAGRDRFVGTGRHDVVGRFHLPDEQARVVSPQVQVLSRAGRVMEEPVSFEPLVVELGPEGAPLAWVVLEKGLTARLVPSKYSPGYGRVVPSLAVEIRGQVTPPAWLRWGVVFR

SEQ ID NO: 14697 - protein, 426 aa, Myxococcus xanthus
MLDLRNVAQNFDAVVARLKTRGGNLDLGPFQRLFAERRELYVSVESLAARRNAANEEMKRKAKEDPKALDALRGDLRAVSQEIKEKEARLKDVEEELNRILLLIPNVPHESVPEGGGAEDNVQVSIWGQKPDLLFAPKQHFELGEKLGMLDFERAAKVSGSRFTFYKGALARLERALVTFMIDVHTSKGYTELLPPYLVLRETMMGTGQLPKFEDDAFKTLGEPERFLIPTAEVPVTNYHADEILEGESLPIRYCAFSPSFRAEAGAAGKDTRGLIRQHQFHKVELVKFAHQEKSLDELEAMTDDACDILRRLGIHHRVMLLCTGDMGFAARKTYDIEVWLPGQNSYREISSCSDCGDFQARRAKIRYRAQRGDKPQLAHTLNGSGLAVGRTTIAILENYQREDGSVAIPEALVPYMGGLKELKPI

SEQ ID NO: 14698 - protein, 263 aa, Myxococcus xanthus
YASSLLLGCAALYLRERRPWRVEIDGPLTSAGYLELTLTWLSRFGFDILRSPSSYTVAGYAAPPAVPTLPGDWSSLGYLLLVAWKTGGTVVRADTGSAHPDDAIVRLIEQVGLRAVPAGPPFTLKVEGQLSGGLRASGEECPDLLPTLAALACVLPAPSTLTEVGILRVKESDRLEGIRTLVKAFGGTTELQGEQLLIQPPRTPPAGFEMSSEGDHRLAMTAATLCVLSGTPLTLTGPECVEKSFPGFWRQLSRVGVRITDAG

SEQ ID NO: 14699 - protein, 390 aa, Myxococcus xanthus
MGYDPAFLNTANCKSAITFIDGDKGILEYRGYPIEQLAEKSSFLEVAYLLLNGELPSEKELQQFNHLVTHHTYVHENVKSFMDGFRYDAHPMSMVSSTVAALSSFYPDAKNIKDPLSRRIQITRLIAKMPTIAAFSYRHTMGLPYIYPDNDLSYVANFLAMIKRIGTSTYKVHPVLERALDILFILHADHEQNCSTTSVRTVGSSEVDPYSAVSAGIGALYGPLHGGANEAVLRMLRDIGHVSKIPEFIKSVKSGEGEKKLMGFGHRVYKSYDPRAKVIKRVADEVFEVTGKNPLLEIAVELERIALEDEYFVKRKLYPNVDFYSGLIYEAMGFQVEMFPVLFAIPRTVGWCAQWEEMVTDNEQKIARPRQVFTGAPRRDYVPMDKRAVK

SEQ ID NO: 14700 - protein, 119 aa, Myxococcus xanthus
MSIDFTCQKCEASFELDAQDLIEGTEKIVCPHCDAKAPANLTEDFVAALTEMRAQIAALDKRFAVSMTLESEDLEDMLDDDDEEDDEDESEDDDLDEDEDEDVDDEEDYDEDEDDDDRR

SEQ ID NO: 14701 - protein, 102 aa, Myxococcus xanthus
FPAFTPPVALAALGKAQGQPCITEGEDDPKACSELVELEVQDVVPLEEAQDHAVVLATKDKGIALPHYGDDALPICIAFLLVERHPPQPVAQDLLYDLVTRP

SEQ ID NO: 14702 - protein, 606 aa, Myxococcus xanthus
MDLPKSVVHALHDRAAQQEQRPALWTRRGGAYAPTSWFEYAQRVRRFALGLHALGVGAGQPVGILSFNREEWHVADLAAIAMGGVPVGLYTTSAPEQLEYILGHCEATLLVVENERHLRTALALRERLPKLRHVVVIDAPTVLPEGVLRYADVMALGTGADEKPYWDSVHALKPEAMGTLIYTSGTTGHPKGVMLSHHNLVWTAKQLTDSVTFGQPAASSLVSYLPLSHIAEQIISLYSPLLNGVQVYFAASVDTMPQSLREVRPSFFFGVPRVWEKFKAKAEEGLASQPPSKRRVVAWARRVASERHERVMRHQSVPMTLEAQYLLARRLVFAPLKERIGMERVSFFATAAAPVGREVLDFFASIDMVIHEVWGMTEVTGPGTVSTESHTRLGSVGRAMMGVELRIADDGELLVRGGNVCMGYYKNPEATAELLADGWLHSGDVGQLDADGYVQITGRKKDIIVTSGGKKTSPSNIEELLTALPGVGHAVVLGERRNFLVALLTLDVEKARALAKAQGWPEDAARLAEDARLRQFLQERVERDVNPKLSRFETIKRFAVLPKDFSVEGGELTPKLSVRRNVVAEKYAGLVESLYDESPQGGSQTG

SEQ ID NO: 14703 - protein, 239 aa, Myxococcus xanthus
KSMRVEGVDVAICDACVPQGTQGVLGAPFSERVDVAFDEVTQEAVLSLKGGPPEGAVTVDALVLARRSEFPFPAYVSDVTVDARGQRLGVGLSEQKPERDRGVYERERKGVEEPQGPFNAGALVDAQSGQVLAKWPVHRGVVATAAISPDGRSLASGGWDKRVYLFTEGDVDARGEHRFDWSVRRVRFSPDGRWLGVAAWTPQVASRDGDSDPAAVLLDVGYESPTVQGPGTAGASVAP

SEQ ID NO: 14704 - protein, 127 aa, Myxococcus xanthus
MRIAAALGIEGTRERSVAAHRIHTFMQKDQLIAYDLSIIYFERGIVGVEDAALALFGRELSELKLEELAELQLALPPYSDYYGIKICKNPTVLRQDRNRLLEDLAAWRLVSEDRARNAMAQPLACAR

SEQ ID NO: 14705 - protein, 23 aa, Myxococcus xanthus
MVRGVMTTLQARGMPAGDIHLNF

SEQ ID NO: 14706 - protein, 355 aa, Myxococcus xanthus
MVVGTPEYMAPEQARGQEVGPMTDLYALGVVTFEIVTGRLPFVGSSPVDLLMKHVEARPPRPSEFVSDLPPALDAFILQMLTKDPETRPNSADALRQQLHKLRRTLRASTRSNPSALAPGFEKAAAVAEADSRRPTTPVPVPPELNTPLTSQELRAAGVRSPLRKHLPLLGAVSFALLLLAGAAAVVIRGAKAPALVPPSIMPQQAAAPEQTAAVTPQQAAAPEQAAAVPSPPPESEQAPVEEVPLQPLVVAAVAPAPPDSVERPPPAPRAEDTRVAPPRPLKASAPTLEDILQSINRLERRVDRLETSGKIDAPKANAARNLLAKYRDDARADTSAHARIDLLKKVTGVAGMIR

SEQ ID NO: 14707 - protein, 848 aa, Myxococcus xanthus
MDPQLLRSIWPVFSAETREQIQAIGSKVLGLEGPAQGREPDLLPSLKRLVHSLKGSAASLGLDDIEQVVHAIEDGLATFNQEERLPRDTVEAMLRGLSAIEGAMARGDAGQSPVVEGLSSLLAALGHESAEAVPQTAASGAAAQALEVLDLLEAGLSALCSPDVPDRAAVVRTAVERARTLKASAESAGAQKVATLAEAAALGFTRMEPGGDSAGLAASDVAGTLVDLRTALEAEGGAGAVARAVHSLRASPSPAPVEGAAAQGPAGAAATTESRGPADQTVRVSVKTLESIALQVELLLAGRAQQTRRGAAHRVLMDGMREVLMHLERASSQLAMAGGGPALEPLRAGVTQMRGLQKQLLELTKESHRDGEQLTLVAQVARDDLRDLRMVPASQVLEPLRRTVRETSARLNKQVTLELSGGEVRLDRRILDALKDPLLHLVRNAIDHGLESTEERRVAGKSEAGRLTVRVEPRGSRIAVVVEDDGSGLSPSRVRATAVRRGLLPADEAEKLSDAQAARLIFQPGFSTREQVSATSGRGVGLDVVQATAQRLQGSVDVAFTAGRGTRFTVDLPLTLAAALGLLVRTGTTVSAIPSDSVNRILRLNPDDVGTVAGRVVARLDGEQLTFLPLAEAIGLPRLPLALDSGNVQAAALLTVGEDKVLFAIDEVVGQQEIVVRSLGRHLKGVRHLAGAAVLDDGRVVPVLNAAELVRAARPETRSVARETARPRILVCDDALTTRFAMKSLLEIAGYPVVTAADGEEAWGILERTPCQLVVSDWQMPRLDGVGLARRIKSHPQLHRTPIILVTSLDSPEDRAAGLEAGADGYLVKREVERGRLLELVRQLLPVS

SEQ ID NO: 14708 - protein, 482 aa, Myxococcus xanthus
GAGLFIDPMDGDDDAGVGTRQAPLRTVGRALAMLRELDGGPRHLFLAGGAYDEADLVLDVPVSLHGGYAGRSGGWRRAANRVAMFDAGTLGLTVQGLQDAGVLMEYVQISAATAAGPGEPSIAVRMVDSSGVRLRHVTLAAGAGGQGAPGEAGDAGLGGPDGGEGGDGLSGYSDPGQGGTAPPITCPDGIQPTGGAGVIGSSGGNPGRDGGTGGPGEMGGAGGAGGEAPDAACSRFECVCNPYPGERGQGGAEGGLGTPGGGGAGTGVLRDGTWVAGQQGEPGGGGTAGSGGGGGGSGGICKLENTIVAGGGGSGAGGAGGCGGEVAPGGGGGGASISLLLIGSQAAMEEGSVLRTLGGGPGGEGGEGGTGGPGGEGGHGGNGGQVVRDGGVVDGGIIIHRTTGGPGGEGGPGGAGGAGGGGGGGGGGPSVGVWCGPGATVRYTDGGVTFQVGPGGPGGAGPGLDGSTGEQLPDFNCVSANP

SEQ ID NO: 14709 - protein, 160 aa, Myxococcus xanthus
AQIYLARPQGAEPDKRVVVKRILPHLAENDDFVKMFLDEARIAARLNHPNVVQIFDLGAQDDSFFIAMEYIHGDDLRRLWRQSELMGQPLPVPLVCRILIEACAGLDYAHKRTDPTTGRPLGIVHRDVSPQNILVTFESGVKVVDFGIAKAADQATVTNS

SEQ ID NO: 14710 - protein, 66 aa, Myxococcus xanthus
MEAGADLLLRRISPARAGEIERKVDRVLDLFDRVDVAPVLMPVLKRHLDELEALMRETREVRAARR

SEQ ID NO: 14711 - protein, 545 aa, Myxococcus xanthus
MVQMDFRGTPEAHAPCELTLTPQALDFGTIPPGQGAVLGLKLENRGTDLCPVKNLRLRDDGGGVFTLPGGGLHGVIMYPGDWFSFQVAFRAPVAGGHFTGTVQIEQMQPANPVLLVPLVANTQAVCLVASRRYMDWGVARPDCPAEPMEVNFLNACAAPVTVNDVWIGPGTTDSEFGFSAVPASIPFVLPPNEAFTVGVEYFGLVSGMNLSPLYVGSSDLPAPLMVPLVGESSMRVEKTDNFIQQDVSKVDVLLVVDNTASMAVEHPRLVEAIPTFVQTALDRGVSVNVAVTTTGIHPVTPTDPANACPGGAEGGEAGRFFPVDNSLPRILTSATPNLAQQLQQNVQVGRCAEVEQGFEAMRRALSRPLVNSADDPRTPLPNDGNVGFLREEAALVVLFVSDEDDHSPDAVDTYVDWAQLLKGQNQPQRATFYAIAPPAEGCATAGGAGTRYAQATSRTGGEVVRVSAEDYRPLLQAVGDKAFSAQERFPLSDLPEPGTVTVTVNGTPSTSGWTYDAATNSVVFDVVPPAGTRISINYRRSCDAM

SEQ ID NO: 14712 - protein, 198 aa, Myxococcus xanthus
MIRTFVLADFVTLGNGFAGAGAILSAMQYLASGDVGWLWVAFGLMPVALVMDVMDGRIARWRFKKSPLGADLDSLADVISFGMAPAALAFAVGMRGSLDVAALLYFVACGISRLARFNVTSADLSDETGKVKYFEGTPIPTSLALVMVMAAATWAGRIGPDLWGGEWRLGPLVLHPLALMYVASGSAMISKTLRIPKI

SEQ ID NO: 14713 - protein, 190 aa, Myxococcus xanthus
PPPPFDLRCSIAELPRSDADTLHTLVSEGYLGTDLGDMAARLSAASQATTNELHQRALAGEALPTARLRESGALFDLARDTGEPSAKAAAQAPFLEGLAALQSGDSTGAQRLFAKAASAAPERTEYRVWRAAALQRAGDLDGALTVLETDLPQDARTDVLRAASAQRKSPEAGARELERILFQRYAPATR

SEQ ID NO: 14714 - protein, 140 aa, Myxococcus xanthus
SLFICQRCEAQHEKWDGACPACGGTELLTVAPAVDRMLGRVVASRFRILRRLGQGGMGSVYLAEQVGIGQQVAMKFLNSGLSMDPDVARRFLNEAKSYARVAHPNAVTLHDFGQDEEGSLYISMEYVEGDDLKSLLAACV

SEQ ID NO: 14715 - protein, 297 aa, Myxococcus xanthus
MVSDIFNPARWKAVEGFKFKDITFHRAVDQGTVRIAFNRPEVRNAFRPRTVDELSRALEATRFMTDVGCVLITGNGPSPKDGGWAFCSGGDQRIRGKDGYKYKGEEGESDPARLGRLHILEVQRQIRFLPKAVIAVVPGWAVGGGHSLHVVCDMTIASKEHAVFKQTDADVASFDAGYGSALLARQIGQKRAREIFFVGANYSAEEAFQMGMVNAVVPHAQLEEFALEWAAEINTKSPTAIKMLKYAFNLPDDGLVGQQLFAGEATRLAYGTDEAQEGRDAFVQKRKRDFKRFPWSY

SEQ ID NO: 14716 - protein, 165 aa, Myxococcus xanthus
MERIRADGYRVDAYQFPIIVDERESRSTLVQRLAGVLDLPADREVLMLYTSFLRPHGPSVLWSYGPGSQSLAVGITGGGVELPGAFAAKPLDWTEFSRDLRLAVRWTHDLHVFSLEGCVQQGFLNRLRTFDWDAPVTPPATAARRVDTVRRAARLLLRTSAWVLR

SEQ ID NO: 14717 - protein, 41 aa, Myxococcus xanthus
LGYADGRTGPYGLYFETGQGADFTNGHGHGYDMVLHESRKY

SEQ ID NO: 14718 - protein, 194 aa, Myxococcus xanthus
MSKDDAKIDYTGLRRQLTEAHSLLDGKQGVSPEKRREVLSARARALAESRHEERQEVLSVLAFQVGGERYAVRIEHVDHVIEARGIASLPGAPRHVLGALVSRSRVVPVLDLRQLLGLEGGGMSDLSKVVVVEADDSEEGFGLAAESVEGRKELPKAELSQPPPGPFLFLTPDRLTVLDLEQLGGPSATRPEGE

SEQ ID NO: 14719 - protein, 224 aa, Myxococcus xanthus
MASPDGTDTLLLIESVKPRLRGVSHAVAFVAALLGCIQLALMPVRGPQYLADLVFGGSMVLMFGVSATYHRFTWGMDAYRRIQRFDHAAIYILIAGSFTPMATLDTTGDTSLYLLWLMWIAALTGAGLTLLGVHTSRGLRSALYVALGAVATPVMLRLPEVIGSGRVAWLVLGGVLYAVGAVIYARRWPDPIPTVFGYHEIFHLLVVAAAGVHYAVILDIVGGA

SEQ ID NO: 14720 - protein, 81 aa, Myxococcus xanthus
MEFHKGRLFDHVHLRVQDLDASKRFYRAVLDVLGVPFFSESPHHPGYYGAFVLDPDGNNIEAVFHGPVTRSAESVVMKPTF

SEQ ID NO: 14721 - protein, 233 aa, Myxococcus xanthus
MFGDDVVEYLRRQKKVTAKLVLYSDISEAELDGKTKASGADGYILKSGGLEAVLGGVMGLIGPPALSIPTAVPAPAAAPAAAPTPPPAPAAPAPAATGGLKPAPTTGGRKPRILIVDDSEMTARIIEADLVTKGFEVHVADTADKATKIILKKQTRPDLVLLDVRMPNVNGEQFCRFIKSNSLFKGIKVLLCSGENVEELQRICREAGADGYIPKDAVMGNLVAKELMPTGNE

SEQ ID NO: 14722 - protein, 305 aa, Myxococcus xanthus
MIIKVKEPIAPEYARIQPGQIIYTYFHLAGVDPELTKTLLQKKAAAVAYETLQPDDGSLPLLKPMSEVAGKMAIQVGAKCLERAHGGKGILLGGVPGVRRGRVTVIGGGVVGLCAAKVAVGMGAEVTIIDVNMERLTYLDDVFLGRVGVLASDSESISRSVREADLVVGAVLIPGRKAPKLVSEALISEMSPGSVVVDVAVDQGGCIETCKPTTHDNPTFEVHGVVHYCVANMPGAVPQTSTYALTNVTRPYSLRIANVGLAAAVKEDRALARAMNTYNGHVTYEAVAKDMGYAYMPIADALAGK

SEQ ID NO: 14723 - protein, 213 aa, Myxococcus xanthus
MLDFRQPNRTKQEFEELALAHLDPLYSAALRLTKNERDAEDLVQDTCMRAYRFFDKFERGTNIKAWLFKILTNTFINRYRRKVKERTVVEGVEREAVHERFVSRDATDFAANPEQYFFDRLLSDDVLRAIDALPIDFRLVVILADLQEFSYKEIAEILECPVGTVMSRLFRGRKLLQKNLREYAEGQGVFRHDGEPVNAPADLEEYRHRKKTG

SEQ ID NO: 14724 - protein, 187 aa, Myxococcus xanthus
NCQDLERLLYPYLDGEFQPEERVDLETHLSGCADCRRRAEEEKQMQQALRRAARHSVSGMRAPASLRAGIQVGLKQEQRRVQFGVWLRAGAMALVVVTVGGGWAAFHAEQRLSAARTEAVQRHSKSKALPFEIASNTPEQVEEWFKDKGDPRITVPQIPNAKPLGGRISILNGREVAYISYETLPDN

SEQ ID NO: 14725 - protein, 289 aa, Myxococcus xanthus
MKDLVAKHMARFPDNRVLKQLKTCAMLYRCFTSQNTFYVRDEGAIPASVMCNARCVGCISDQPADGPPASHERMDDGPTGEEMGQIGLFHLEHAPGRTMVSFGQGCEGEPLTRWKQIAEAIRYMRARTQAGSININTNASLTRGLEALFDAGLDAIRVSLNSAVKDLYEAYYKPVKYGWEDVEASIALARERGAYLALNLLLFPGVTDREGEVRALERLVKKYRVDQVQTRSLCIDPLQYLEVARERGAGGEPVGIRTLLQRLKAARPGLIVGNFARGLDERENAAGHR

SEQ ID NO: 14726 - protein, 272 aa, Myxococcus xanthus
RRQDIVLDGTAFLFLLAITSVSGLAFGLLPALQVSRLDVRGGLAAAGDGSTVPGFGRRLGASLVVVEIALSLVLLVGAGLLGRGFLHLLGTSTGLAPGQVLTLHLSIPDDRFFKDGALDAELPGRLLEPVLEAVRALPGVTAAGMTSVLPIQRAWNNARYQLEGAPLPEPGDEPRAERRASSPGYFAAMGIPLRQGRDFTSLDAAPDQPGVVIVNETLARRHFPAGGALGHQLRIGGDAVHHRRRRGRCPPGGTGARTARRVPRPPWQALGR

SEQ ID NO: 14727 - protein, 237 aa, Myxococcus xanthus
MKPWPAGTFRQEVPWATSCASGATPYTIVGVVGDVRQAGLEREPLAEFHVPHGRPWGDDGLVLVTRTSVQPETLLPAIQEAIRRVDGTVPVYRALTLEQVISQSLAMRRLVLGLLGGFAVLAVLLAAYGLYGVISLRVVQRTRELGVRMALGARPADVLRLVLGQGAGMTAVGLGVGLGAAWALSQVLASQLHGVSARDPWTFGAVAALLAAVALLACWIPARRAIRMDPLQALRKE

SEQ ID NO: 14728 - protein, 697 aa, Myxococcus xanthus
MKRLFVIATLLGAAPAMADEGMWTYNNFPSAKVKEKYGFEPSQQWLDNVRLSSARLAGGCSASFVSANGLVMTNHHCARGCIDQLSTAKKDYIANGFYAKAQGEETQCPAMEINQLVKITDVTETLNKATQGLTGKKYADTLKAKMSELEQACSAGNAKARCDVVTLYQGGQYNLYEYKRFQDVRLVMAPEHAIAFFGGDPDNFEFPRYDLDVTFLRVYEDGKPATTNNFFKWSDKGAQEGELTFISGHPGRTSRGLTIAELEFQRDVVLPKTLMTLSEMRGMLTEFGRRGAEQRRISTNLLFGVENSVKALKGRHEALLDKTFFAQKVAAEQDLRKKVEANPEMKKKYAAAWDEIAKAQAQLRNIRQDLTFMENGGGLSSTLFQVARTLVRGAEEFPKANGERLREFNQANVPALEAQLFSPAPVYPELEIARLTFSLTKMREELGSDHPFVKKVLGKESPEKLAARLVKGTKLRDVKARQALYKGGKAAIAASKDPMIQLAVALDPDMRAVRKSYEENVESVIRKNSELVAKSKFEIYGTNQYPDATFSLRLSYGAVKGYSENGKQVSPITQMAGTFEHATGEEPFALPKSWLKNEKALDGTTPMNFVSTNDIIGGNSGSPVINKDAEIVGIVFDGNIQSLGGEYGFDESVNRSVSVHSQAIIESLTKIYGATRLLEELRPGSTKVPPVKASPAK

SEQ ID NO: 14729 - protein, 127 aa, Myxococcus xanthus
MNAKVLIVEDTKTITNLLQVYLMGWGLEFFDAPNGAIGLTKARELKPDLIISDVQMPEMDGFALCAAIRADRQLHDTPFMMLTSLKDDASRQKGKLVGASAFLNKPVSVDDLRSKVRDILKLPATRY

SEQ ID NO: 14730 - protein, 167 aa, Myxococcus xanthus
MPGAAELEKLTCEDSTEALIKARNVNRPETDRLVDYIELYSSLRKRTATFEDAMNRNPDLSYREGTQHLVNAKDNCIQQTADVRVEFETYMRELVGVPTVQEIKGGNTVTIARLDFNTLRQAIETLEPDDKDTLLNQVNAAEKRVAPSTPAGDESAPASGGGRKRGR

SEQ ID NO: 14731 - protein, 385 aa, Myxococcus xanthus
MSHGDRVEALPPGFEAIGRSGNSPFAATAHATKPWFGVQFHPEVVHTPQGKAMLRAFVFNECKVSGSWTMKGFIDEAVGTIRRQVGEHGRVICALSGGVDSSVAALLLHRAIGPRLQCIFVDNGVLRQNERAQVEALFVDRFHVPLKTVDARQRFLDKLAGVTDPEKKRKIIGREFIAVFEEAARDVQDAEFLAQGTLYPDVIESVSYKGPSVTIKSHHNVGGLPETMKLKLVEPLRELFKDEVRALGRELGLPDEMVSRQPFPGPGLAIRVLGEVTEQRLELVRRADAIVQEEIRSAGLYKEVWQAFPALLPVQSVGVMGDERTYESTCVLRAVTSVDGMTADWARLPFPVLERISTRITNEVRGINRVAYDISSKPPATIEWE

SEQ ID NO: 14732 - protein, 92 aa, Myxococcus xanthus
QGAKDRYFKADVESVKLVPEGIEVRVPYKGTLAMNVHQMMGGIRSGMGYVGSCTIDELRTQSTFVRITSAGLKESHVHDVIITEEAPNYRVG

SEQ ID NO: 14733 - protein, 165 aa, Myxococcus xanthus
MTHFASRRGSALAITLIALTVLLLLVVGAITFTGRNQSAAVAKTRSDRVEACAETARRYLLSRLKVFGTGAVPVTSISLEQVLQDDQVVADSSVMRTAHLGDTASAPTAAELASSSFSSGKDQVSDAGHTLREGTAGGSYYRVVVMCDEPGGRQAETEFVFRFGI

SEQ ID NO: 14734 - protein, 1497 aa, Myxococcus xanthus
MKALFSTLTALSVLLAAPGALAQDPASCSLQSTSRLDALLNPARGSDERFFTSPSGPPNILLILDTSGSMAYWPIAWSNNDSHSYSKNSSGTFPGCRQANIDELNYDANVAYPRMWLSLTNQDSPWFVPTSYYRFDGSGSTSQSSFGMTRNPVKFNEPPPNTVISGTAAEACAQVVDSGNNNTQAAARAACAQCLATKGYFQYTQEKRVASGNFLNFYSPRGHSAVNVISQVLKDSERTRFGVVTFSASSEATDTAKWSGQDVVRFERFGPSCGDSLSGAKREDHRNNLLSKMRNGLRFNTGTPLTQAMWGASTYFRSAGSDPFPDWFGSDYLRDSGFNDEAAPGRAATCFTCGFNAMILLTDGEPNEPGGDSAQVPAQVRNLDVPCSNCAAASQGSNSGGSSSHIHRIAKWMWTNDLRPELSGSQAVATYTVGFALTNTQAINLLRVTADAGGGRFYAATNSSQLKTALQAIVDDVQNRNIAFAAAAISSFQTGSSTLSALMPRMSPASGDSAWRGDLWRFNQFNEFVEGVDKNGDGDMDDIFVVDRDGDIVVEDTSGNFVKDGGSTPAAQFWEARRALMARALTSRKIYTVTDSNQDGRLTAADNAATPIEFTVENREVLKSYFGILGTPVCPTVQSLSPLDIDPGTLMTGLRLTPQQAAAAMSVAVPGFGNLAQAQTWVNDICVRTLIQYVRGQDLADEDGNGNRTEVRRSVLGDIFHSAPVLVDPPMDKFLCNLGMSNQCTRTLYSQQLGVSPTPLATESISRCGNTVEVDAYDAYLHRYLRRDKLVLVGANDGMLHAFRDSTASTDNCEGGLPMIEYSPSNGEEEWAFIPPDLLSRLHEMAGGHQYYVDGDIMVRDVWADGSDGSQPDGIKQSTEYHTMAVISEGRGGVHYVALELRADSGTGRFGAPRMQWMYPQPDSPEAALFGKTLFSLSPKPPPIGPVLVEAGTAAGPVSRYNVETQERWMVALSGGWSPGQEKGRGIYMVDAWSPEVNGRTDNLWWKFEYDPNASGEQHGPAQHLTHSVAAPVALVDYGVGGNVQQDGFFDTAVFGDMRGQLWVARMSVPGALDPSTGLIRNWSAARAFQMDRDAVGPSGGQGDSLTRTWPFYYVPSIGIQPGTGAMRALVGTGDRYALLDDQAGICRFDNPQACARYGCGNVEVDYRVDRIGENITQSRHQWTQRGLAQSTLTRGTASQPACGDPGQTVVSARFTRHEARSCPGAPQDYTSMSPARVECGKDAEGNFRCLDVSNVAPNFADLELTRTVNAIGKNRFYGVRVYGVAGQTFAEDATAVSAEGPMTASQFDAERLSDRTNDNDTSGDLVDVTNITCDASGACSATGALPDGKGWMLEYTDNHTHKTAGGAATVASCTLWNVIYPSQDGEVCSSTAARARFYQADFLSGLPNCAASFENARYQERAVLSPPPEPRHRGDDFAHGQREIQRRHAGARTAPGHLGGRVGEQRGAPERVRATPHPGAARLPPRERGQLPAVMT

SEQ ID NO: 14735 - protein, 140 aa, Myxococcus xanthus
MPALEDAIALAVAAHQGQRDKAGQTYILHPLRVMMRLDTDEERTVAILHDVVEDTPYTLERLRELGYAENVLGALDALTRRQDETYEAFIERLRPLALARRVKLADLEDNMDVRRLAAVTPKDAERLARYRAAWARLREP

SEQ ID NO: 14736 - protein, 430 aa, Myxococcus xanthus
WVKTSLAPGSRVVSEYLRDAGLLPYLEAVGFHIVGYGCTTCIGNSGPLTEPVANAVTEGDLVVAAVLSGNRNFEGRINPHVRMNYLASPPLVVAYALAGEVGMDLDNEPLGTDPNGRPVFLKDIWPTNEEIQEVIRTSVKPEQFRSQYANAMEGDALWQQLPVGKGSTFQWDDTSTYVRKPPFFDNLPKEPKATQDIHGAHVMALLGDSVTTDHISPAGNIAKTSPAAKYLMANGVEPKDFNSYGARRGNHEVMVRGTFANIRLKNLLVPGVEGGVTVHIPTRERMSIYDASMKYQAEGTPLVVLAGAEYGTGSSRDWAAKGTMLLGVKAVIAKSFERIHRSNLVGMGVLPLQFEAGQDAQSLGLTGHEKFDITGVAQDLAPQKKLTVKATGESGTKEFTVVCRIDTPNELDYYRHGGILQYVLRQLAKG

SEQ ID NO: 14737 - protein, 277 aa, Myxococcus xanthus
GVAAAGLLGLGGWKARHANDAEATTPPDATTPGQVAATLPPTPPSEPLATVAPPDTTPAPKESAGRPGPGTSQPPRPASRGVKGATAPGGLSPRTDGTPAVGGTVRGMGTRPAGEDEEAPRKPLVRKLPVSILVRPYGSIRVDDGVPSAQPLQKHDVEVTPGRHTVTISCDYCEDVVDTIDVQPDGDNVFHLRAQPKASRLSVDFEPAGALVRVGDEFRSAEDSLKTPFEVRSPRGPAGFQHTVVVEVSHPGYVPERRVVHLRPGEPTTLRGSLRPE

SEQ ID NO: 14738 - protein, 323 aa, Myxococcus xanthus
MLLAPGATLAQDAGDPEVAALRASFEYGKYAEVMDRAASRIDRGGLDEDDLAELHKLAGLAAFNLGRTDDARRHLRALLRLDPDFSLDPFVVPPPAVAFFDTLKEDMDTELDFLRQERRLRQEREKAEAERRERERLEAEVQRRRAEELASQVTVRTVEKRNFLVNFVPFGAGQFQQGRTSLGIVFAATEGVLAVTSIISFFAYEGLFEERTIDLDNVLDPDGRASVTVRYIPTSRARQRDAWQLLKLSSAAGFYAIYAVGVVDALFHHEDQVVRSTVEPRAEQPAEPSPRSTSARATAPKTYTRVGLYPTRGGLGAGLTLSF

SEQ ID NO: 14739 - protein, 487 aa, Myxococcus xanthus
MGDALRNDLSRRANSVSVELAKTLAPMLSVKRDPERLQELVQGALSLGPEVAYVRVHDADGVLLGEAAAERYVGEAQAPASVEGDASVLRRRSVKGTGLVETTTPVLAAGSTAQLGTLQLALHEEGLSQTLREATRFTAIISLLVLVACMVAAWLVSGMLVVPLERLARAEAGIAAGDLRQQVDLQGSDEIGDVARSFAVMTDALSHLLQDLRSAAAEMEREAAGVLATSTQQSAMAHQQASAINETSTTVAEIAQTSKQATAYADSVISQTQKSEALSAEGQQVVSESVSGMEKLGEQVKAIALSITDLSERTMQIGDIIGTVKDVAEQSNLLALNASIEAAKAGEHGRGFAVVATEMRTLAEQSRIAAEQVRGLLNEVQKGTRQAVSATEEGSRRAQAAMELAREAGTTILGLSEVIRESSGAARQIAGNTRQQTIGVEQISTAMSELTSAMGDSVESTRRIEQVSGNLTNLSKRFSDLVGRYQL

SEQ ID NO: 14740 - protein, 651 aa, Myxococcus xanthus
MASLTVRTPDGKIRAVSLHKRLTSIGRGPDNDIPLEDTSVPASALHVTFDGTRYEVGSLGATFHVNGKKRDAHALSTGDVVRVGHTELIFARDDAPRAPPLPASPPRELIHTSNPDSHTSELPGVPGRELLLLRRLTAFSERLLGLYDLERLLEGLMDEAIEVTRADKGFLILMENGDPRVKVARNVSRENIEDAVEKDKISDSIIAKVVKEQKALIVADALDSPEFNKSESVVNLRVHSVMCVPLMQKGDLFGVLYVGNDRLVNRFEPKSADMLTIFAAQASLILQNAMLVSDLKLDNTELRRKLEDQRYGDIVGACQGMRDVYKRIDKIAPTDISVLITGETGTGKELIAREIHRRSTRAKGPFITINCGAIPENLLESELFGHVKGAFTGAVATKAGKFQAAIGGTLFLDEIGEMPLQLQVKLLRALQEKVVYKVGDNRGEPVDIRVVAATNKVLEDEVKKNTFREDLYYRLNVVTLKLPPLRERGEDVVVLGRFFLQKYAREFSSKARGFTPSATVSMRKYGWPGNIRELENLIERVLLFADGPLITARDLPEPVRQGTGVQAGANLASAVASIDVPTGEVGLKDIVRMKAAELERDLIVKKLEETGGNVTRAARLLQISRKSLQTKMKEFGLRDTTPDGQEDGPDE

SEQ ID NO: 14741 - protein, 305 aa, Myxococcus xanthus
MVQATEEAAAQMPNAVPDAGAVAAAPTPAPVATDPVKAAGLERISVSINGPLETALVNAAGSDVGPALAQVVTRTLVWWVSVPGEILRGDTLEVLYQRRTNEEPLVQAVRFTSAKLGKTMSAYRYHANGEPNARYYLSGGDELELRLERSPIDDYEQVTSLLRDGRKHKGVDFRTPVGTPIKAPFNGVVKRKNWNFSSNGNCIELVESGGKGRRALFLHLDEVDKSVKPGTRFSVGQVIAKSGNTGRSFAPHLHYQLMTQDDRVLDPYDQHKTYRRSLAAQHRSGFEAEVRRMDGLLSASVVAGK

SEQ ID NO: 14742 - protein, 142 aa, Myxococcus xanthus
MLFGVELVPFNRPAKSQRFALDVRGIGNYVGSGRYYNELSAALRKLLTSEDYFQVGGMLGVTANASQAFQIRASGMFLYNTNHALTAEDPGRDVNNDGGVDTQPGSPDLNPNFDWRYDLVSRRFLAVESTTFRFDLSATFSF

SEQ ID NO: 14743 - protein, 63 aa, Myxococcus xanthus
RGEVVVLVEGRTGETRWSEEELRRALEEGLSRGEKLKALSTELARRAGWAGQDVYRLGLSLKR

SEQ ID NO: 14744 - protein, 204 aa, Myxococcus xanthus
MALTHLLQPTPAPQRPPGVTCEAYVRGEGKHCLHYRPGGGCTLPGVGGTCTEWLKVNRQARPHRDVTAQPVPAPPVKAAPAAVDLFGHPLTEAGSKKLAPAPASRPAPPAPSPDVKGLDAETPLSGLRGLTDEDIASFRALNAEVCFASETYGEVWLVPAYTGQARKELTPEHAATLVRVLSAFPGSRVMSFEKRQASADEVSP

SEQ ID NO: 14745 - protein, 205 aa, Myxococcus xanthus
MWMLRHGVLQETTRTEEQLEAALAYVETLGQQMETAESFPARLNPNCVYCDHRRDCPAYAQALEGRRGVVCEDTSDLESVARERQEVAHLAKILGARKAELEGVLRAHLAEQDELVLAGTRYRMFNTTSLDYPLEPTVAVLAPATGLPREDLVQRLASVEKKALDALLKDAGKRLGTARVALLKAELDSLAAKHHSPRFWAKEVA

SEQ ID NO: 14746 - protein, 88 aa, Myxococcus xanthus
MPEALIRRGLQYRTGQEMSDVEVPCFWVEAKAHQRTNVREAMRQAVETCPPGRWPLAVCKDDGQPPLVAMQLDDFLELVREWWEARPR

SEQ ID NO: 14747 - protein, 62 aa, Myxococcus xanthus
LTRLRRRIIGNAVPKEDLDQLVLATFLSVARAFPLSRWGDWTAARLRQQTAREVFRYLRKER

SEQ ID NO: 14748 - protein, 47 aa, Myxococcus xanthus
AELRAWLRPLVGDDTELLVSVLLYEEGYVEVGASWGCAAAVRSAPRA

SEQ ID NO: 14749 - protein, 619 aa, Myxococcus xanthus
LNRTGAKLDPEWLAAAAPHLLKRSYSEPHWSEKSARAMVKENATLFGLQVFKERPVALASMDPARARLMFLEHALVRGEYRTRGAFQEKNRQVLERVARLRDKARRSELLDSEALLTFFDQRAPADVTDGAGFEVWRRKAEAADPGVLVLSMEDALSHDPDLSPAHYPDAITLHGASVPVTYTFDPSAEDDGITLSVPLLLLAQLVPGELDWTIPGWQREKLTALLEQLPRAQRKQLGPLPEMVDRLEKELVPFRGPMIPALARAVSRLCGMDVTEESLRADAVVPYLRLTLRVLDERGKELARSRDADALLKQHGGHARAALRSAAPPSDWERKGLTAWTFGELPPVVPRRVGGLEVRSYPALVDRGAAVDLVLLETSSAAEAATRTGVRRLLMLAARGHVAVSAARMPLPFPSLDGAPPARGQADAFRALVLARSVDDAFKLAPGAPLPRTKAAFEALVREGSPRIESAARDWANAIVVTSAELAATLAALKAASKGPSGAAAVRDIRSQLGHLFPANLIEWIPFVRLLHYPRYLRAAQARLSRAVANPSKDAGKAAPFTPLWETFLARRATVRDQEAAQELRWAFEELRVAIFAPEVTTPVSVTVAKVGAALTALR

SEQ ID NO: 14750 - protein, 365 aa, Myxococcus xanthus
MAEGLPEGRFRILATDVSGRALQRAREGVYGPWSLRRIEPEQEKRFLVANGDDYSVIPQVRHAVEFRRHNLAVDPPPFMGLGAIFCRNVLIYFPTELAQEVLKRFISALAPGGLLFVSPAEVPLTNGLGLETVDAEGSVVLRVPVPGAPRAVTPESRLPRLGMGRNQVASPVPPTGWPQALDDSRARRARVPEGRLSLNEPGTSRPAWAASTPDAATPAVPRSVAVDALAAEEVPPLERAIIAARAGHFEEAEALAREAAKALVPEAYLLLSMVAEVRGDLNGAVEAVRKALYLEPRLALGHATLVALYGRMDRPEDAERARQNALRALDGLDDEHPLRGVETMTAGGLRQALAPVEQAGWLGVR

SEQ ID NO: 14751 - protein, 186 aa, Myxococcus xanthus
MTRNVKRFLAGSLLSLTPSIAFAGQIELDFPDFLTQRSEYVSLREGAVQVPVRKGPSVEAIGPAVEDFFVSNQAGVDLHLGIQILTGSFNGTWNTHPVPPSTYGGFQVGAPAPAPTVIQQYYYTVDPANPAGSKTCVWRVEVTDNAGACNAQVFFGTYGGAICTVDAAQSSIDPVTCQTQVVTNMQ

SEQ ID NO: 14752 - protein, 190 aa, Myxococcus xanthus
MDAASVDRIASELGLAYVYYPASVQVDDDDFGNALLSRWPIVADRKVHLPHDDPYHQRRRIAVLATLDIGGTLVQTASVHNATPIVGLGGRLDQAETIIDAMEGTGPVQVIAGDFNTSDPGSLRQMVKLFSERDFQWASEGVGDTVDSVIGGLPLDFVFAQGLAPLERGVDRRPAGSDHHPVWVRFAWPR

SEQ ID NO: 14753 - protein, 260 aa, Myxococcus xanthus
MPFVDTVNRFDKRWLDWRGDPNQIPTKDKKYIWVDTFGRWRIVDPLRFFQRLRDERNAQSRLDDIIDGETRNTIASFALIEAVRSTNRPFEDDEYTAETERAESLEQVAQGRDKLTRQIRLRAAEIVKEFGVELVDVQIRRINYVDEVQVKVFERMISERKRIAERSRSEGMGRAAEVRGQRERDLKEIRSAAYRKAQDVTGAADAEATKIYAEAFGRDPEFYQFMRTLEAYPDVVDSSTSLFLGGESEFYRYLRSSSKK

SEQ ID NO: 14754 - protein, 112 aa, Myxococcus xanthus
  unsure (1)..(112): unsure at all Xaa locations
VIXEAYAELNRFIPRAKGEAEKALRSAEGYAIERVNRAKGEADRFARVYEEYRKAPDVTRRRMYLETVSQVLRSAGQKVVLDESVKGLTPLLNMQATDPAVSGSASQTEGRR

SEQ ID NO: 14755 - protein, 221 aa, Myxococcus xanthus
ELSGGSELATTWRSSDPALGIHSSAALSMLPYNLEQEGDERALFPQGRLDADLQQVDLRDMNSWRLRLADVQTAEMLEVHLINAVAPFILVGKLKPLMLRDRSSPGHVVNVSAMEGSFSRGTKTDKHPHTNMAKAALNMMTLTSAPDYARDNIYMNAVDTGWVTDEDPAQHAERKVQELDFQPPLDIVDGAARVVDPIIASENSGEYVWGNFFKDYRHTAW

SEQ ID NO: 14756 - protein, 138 aa, Myxococcus xanthus
MKGISTEMHPYLRMTAPPGVARLEDVPFEPGQPLFRSKLLLGGVLPVGWSDVTLRELEPGRRFVEESPMSTMRQWRHERRIIEAHAGVDIIDQLDFEPRFGGRLAEAFIRRLFEHRHSVLRRALTPSIGGRASQEKPA

SEQ ID NO: 14757 - protein, 107 aa, Myxococcus xanthus
MSPEQFHVEVLKLLLQVATVDGRVAHSEIRHILDTARGMSVPLQELAALTRCLQNNEPLPPPNMGILRANPAAVIQEAKALIASDGSVHAAEIEMLRQIRELLGVSN

SEQ ID NO: 14758 - protein, 80 aa, Myxococcus xanthus
MKTVFAAALLAAATAFANTPAPAEPAAEAKPAAVEAKLEAAEAPQAEEAKAEAAPEAKPAKKATKPAKKATKATSASEAK

SEQ ID NO: 14759 - protein, 173 aa, Myxococcus xanthus
IEAFSKVSEASKLLLEKGLGPSTGMEALRMVGHALGVDRAYILENRVQGTYGRFITDMRHAWAEPPTPSPLANPVMRAFSFREFAPGWVDMLEAGMVVACPTRDAPPTIKDLLERQGTQSILLCPINPSRQQWWGMVAFEDCRRPRAWKPEEVTLLKSLARAVAASVRHGQML

SEQ ID NO: 14760 - protein, 447 aa, Myxococcus xanthus
MSSARILVVDDDPQARDLLQRLLGPLGAVTQAPDPRRATERIAEGAFDLVLTDMAMPEPGDGLKVLHEVKAQLPDTPVVVVTAFGNIEGALDSIQQGAFDYLAKPFDVDAILRVARRALEQKRLVEENRSLRQQVERGSLMLVGRSPALLEVYKHVARAAASNVPVLITGETGTGKEMVARALHKRSPRMNGPFIPVDCGAITESLMESELFGHAKGSFTGASGARRGVFEEASGGTLFLDEIGDVGMKVQSQLLRVLQEGEIRRVGESVPVKVDVRVVAATNKDLKTRVAEGLFREDLLYRLDVVHLHLPPLRERSEDIPALVEHFAGRHARGGVRPVVTSEANARLAAYDWPGNVRQLENVVARALALNVTGVLGPQDFPEPIGDASTPKMAGLAGDMPSLAELSRRYAAQVLQHVGGNKSEAARLLDVDRKTLYKLLEAPEAES

SEQ ID NO: 14761 - protein, 117 aa, Myxococcus xanthus
MHLATASTAFAAPSVANKSPAKVDIQTVEVKMKSITKKFERSDWKDPNTLDEIAKLLDDVETRIARIKEKDKDWATSSVETFFWESPPKWKKASEEVDRPRGDASPHGAPRAVPDHR

SEQ ID NO: 14762 - protein, 128 aa, Myxococcus xanthus
  unsure (1)..(128): unsure at all Xaa locations
MDAETVXEVVRLVELEPLPGAPAHVAGTFVYRGSPAIVVDLAALLGVKREASLDAHLVVCGGGARTVAVLVDRVRDLVESPVLVDGTPDGTSPLPWDASGLMAGLCRTPEGVRPLLRTAAVLVGPEAP

SEQ ID NO: 14763 - protein, 295 aa, Myxococcus xanthus
MRVRNTALGAGATLLAILLSSLVGWRVTSLLKRQEAIIQGQLEELGRHNQELDAFTRRVAHDLISPLAPLKGYLTLIRRTGAVNDAGALEMLAQCESSAVRMGELIEALLRFCRAGTRGESTVGELDTAVTTVLLEVAQTAAAQGVALERELEPGVAVDCPGQLLQVSARNLLTNAVKYSAGRPDPRVKVRVATEDGMAVLEVVDNGIGMAPGTQASLFQPFFRAPEVRGLPGHGLGLVTTKRVVEAHGGTLVVRSEEGKGTHVVVRFPRVVRPAAGTSGSQTTTASAGMRKVGT

SEQ ID NO: 14764 - protein, 155 aa, Myxococcus xanthus
MRFLCFATALAVLGTGCATGIPLERLEAQVLEADRWRREYEAERERTEAFALRMAQLESALERVLLERAEAEQARAALLEELVRTEADRHALEEHNTQLLALEREVNELKELKEMHEELSDVWYESALERARRRLNNPPQPAAPPAAGNVAPTAP

SEQ ID NO: 14765 - protein, 1747 aa, Myxococcus xanthus
MSAVSNIEHDPIAIIGIGCRFPGGAKSPRHLWELLTQGRCAIVEVPKERWDHRRYYDPDPDKPGKTYVRAGGFLQEAIDTFDAAFFSISPREAATLDPQQRLLAEVAWESLEDAGLPADKLAGSPTGVYVGGFMLDSMLTHMGPMNRELIGPHTAVGSTMTVLSGRLSYLFNFQGPSLVVDTACSSSLVSLHLACQSLRARECNMALAGGVNLILSPQSVQLVAKLQALAPDGRSKAFDASANGFTRGEGCGIVVLKRLSDALADGDHILATIRGSAINQDGKSTGLTTPNVLSQQALIRQALDSAGLKPEQVSYVEAHGTGTPIGDPIEVEALRETYGAPRADGGVCGIGSVKTNLGHLESAAGVAGIMKVVLAMRHQRIPAHLHLKQVNPRIQMEGSALTIPTRLTLWETAAGQPRRAGVSSFGISGTNAHVILEEAPAPAAKEALPQRPELLPLSARSREALQSLAERHAERLGRGGAASLSDVCYTASSHRTHHTHRLTVLADAPERTVERLRAFARGELPEGTWTGRKAFGARRKVVFVYPGQGAQRAGMGRALMEQEPVFRDALVQVDLALRPHLGWSVLDEIAADEQRSRLAEIDINQPVLFAVEVALTALWRSWGIEPDAVMGHSMGEVVAAHVAGALSLEDACLIICHRSKLMRSLGGRGATMALVELSVEEAEEAIRPWSGKLWLGGLNAPRSQVLSGAPEALQEAVAALGQRGVFTRWVKMDVPSHTPLVEVISRELEGRVARISPRAAQVPVCSTVTGEFLDGTKLDAAHWGNNLRLPVRFEAATRRLLASEHSVFIEVSPHPVLLPAVEQTLGAADAEGVVLASLRRGEDERHTMLSSLGALYATGHRVAWNRLYPSKGQLVPLPTYPWQRERFWMESVSRAARTSRSTSGHPLIGERIDLSAQGDVSRLWQVQLGPKHFPLLSEHRVQGVPALPAAAMADMALSAARQTLGAPVSLEEVSFSALMAFPEDEERVLQLWLSTERSGPHAFRLFSAPVLRETPSDELNWTLHAEGTLRQGDSAIAEPAGLEALRARLSTPVSVDAHYQGLRDIGLDYGPSYRVITELYRAEGEALGRVQLAGERTAEDARYSLHPALLDGCFQVLAAALGGVDGEGGVYVPSSFSRLRALAPAEAALWSHVRIVNGAASGASAIECDVTLLDDQGRVVAEVQRLVCKKVSAGSQPVDDVDRWTYSVQWQPQPRVAREDAVAGRGAGRWLVFADARGVGQSLARQLAEHAEVSVVVEAGAAYARLSEDHYRVNPSRLEDFQALLRDAFSEQSPCKGMVHLYGLDVASSVAEPETFEQAVTLSGTSVVSLLQAWAQRGWRDAPRLWLVTSGLHVLARDSAPGAPAAAPLAGLASVITHEHPELRCAHVDLSAQPSPEEVTSLAAELLADSAEDRIALRGGQRHVARLGRGVAGGKAAEPRELSAEGTYLITGGLGGLGLEVAKWLIQRGARHLALTGRSAPTDEANRTLGELRTSGADVRVYAADVTRADDVTRLLASMDAELPPLRGIVHAAGVIADGVLAQLDAERFRTVLAPKVQGAWNLHAQTLGRPLDFFVMFSSAASMLGSPGQGNYAAANAFMDVLAHHRRAAGLPALSVNWGPWADVGLAAVATNRGDRLALRGVGNMPPAQALDALGRLLAKEAAQVAVVPLDLRQWREFYLSAAQSPFLSALMQERVSTPASRKGTAREMLAAAEPSQRRGLLEGYLREQLGRILRMEPARIDPEQL

SEQ ID NO: 14766 - protein, 99 aa, Myxococcus xanthus
DKPRATYPAAVFVGCQDATVRYRYKGMDRKSAYRTLGRELVRSYFDTLVGKVVGIALKVAGPERAMKRVSLSFSSVFSPVDIQVESLGPADWRVLRAHE

SEQ ID NO: 14767 - protein, 119 aa, Myxococcus xanthus
MGDEVRSVASLSGGESFLVSLALALGLASLSSETTQVETLFIDEGFGTLDPETLEVALATLDALQATGRQVGIISHVSGMAERIGVQVRVVKQGGGRSRLVVEGDPGMVPPSMGQQEVA

SEQ ID NO: 14768 - protein, 214 aa, Myxococcus xanthus
RNSLMRYFTCALLAASLLTGCGGGKDPDPNPQPDTDAGPGGNGDGGTDAGPIEEDAGVIPDPDPDPGLVPTDIDDPDNSTKDSDCDGLTDAEEFATIYPGGAKTNPGLRDTDGDGIRDGVEVGRTSSPDPRCNFPGDQDTTTRTSPVLADTDGDGIPDGLEDLNRNGRRDPGETDPNAIDSDGDRLSDGADDANRNGVVSPGETDPRKRDTDGD

SEQ ID NO: 14769 - protein, 307 aa, Myxococcus xanthus
MENVREIWPRDHGRFQLLSRLGRGGMAEVFLARMQQGPHAGAQVALKRVRPERLRDAEAHEQLLHEAELARCLRHPYIVGFVEYGELPDGGYLALELVEGPDLGRVLARCRRRRIELPIDISVLIVRQVLEALSHAHHAVSTTGRPLGVVHCDVSPHNVLLSRTGEVKLADFGVARSRAGAVQDIRRLGKQHYRSPELLAGDVSVAVDLWATAVLLYELLALESPFPSGPEEQVESSIRGGRVTPVRMRVPGVPDALALVLDRALAPVPSQRFGSAEQFARALAPLSDDRVATPLAVAAVVRGLMET

SEQ ID NO: 14770 - protein, 93 aa, Myxococcus xanthus
MEFRTELDFVREHALNISNGGLFVRTAHRPLPDSVVTVDVKLPNGERLQGDAVVVHVVDDPYTGGVGLAFLNDDATFSQTLDDYLASLAGGVG

SEQ ID NO: 14771 - protein, 238 aa, Myxococcus xanthus
MLESAAPDDALRRAQTAHRPGDITMMTVSAFKWVPPFAQGLVRDLRVRWALEEAGLPYQVKLIDNTVQASPDYRKLQPFGQVPVLEEDGLVLFESGAIVLHIANKCEALLPADSAGRARAVTWLFAALNSIEIVIQPLAEVDLFFAQEEWAKLRRPGVVESLKERLGELAAHLGEREYLEDCFTAGDLMMATVLRILRHTDVLDGFPTLKAYKERCEARPAFQRALAAQMAPFQQPRA

SEQ ID NO: 14772 - protein, 277 aa, Myxococcus xanthus
RGFCSGGWPLALPRGPHRGLVGEVRATSAGSALELHDFRAYQPGDDLRQVDWNAVARTGELVLRIRQDEVSPRVEVVLDGSRSMALSSRKAACAREVALLTAEVAARQGLTPTLLVAGARPERAQGQACRAALEAADFDARDGLPESLGRLPPLRPCGLRVVVSDFLFEADLPAMCARLARGASGLFLAQVLDAEDLDPAGGDGARLVDSESGAALEELLTDEVLAVYTRRFAEHQRGLRGAALRARGALLTARAQDGLGALVAGPLRPLFLAAGAS

SEQ ID NO: 14773 - protein, 243 aa, Myxococcus xanthus
MTWEEFRASVYEDPEGKLIFDGDMALDSEEELRAFFDNHVAAETGTSRGGLAVYNTSPTKALSGDVKWSATQARNLTYCVSSTFSGNKARVVTAMNSATAAWEATANVNFTHVTAQDGACTASNNNVLFDVRPVNSGGQYLARAFFPNSGRSGRNVLVDNTAFGPISPWTLEGIMRHELGHVLGFRHEHTRSTGSCFEDNAWRALTSTYDRASVMHYPQCAGTQTGDLVLTTLDKQGARALYP

SEQ ID NO: 14774 - protein, 496 aa, Myxococcus xanthus
MSARGPDGVTVLEQVRREAAARVESEEATQVTLLASGGTPRMLAGPEAEPSRALAALESFQAQGADHDPMPTLIWAQELAGAGRRVAFFTDVPPVNAALVPASVRWTALGAARGNVALVSAQRRDEGPTATVTLRVARFGEAPEEVDVRVRALPGAGAKAGTERVERVQLPEEGTATVRLTFQEAGDVEVSLPDDALPEDGQVRLPPAPMRPIAVALAQGLGAPEQTALERFLAVSPEVARGVEGSAMDVVLVLGPPGTDARVTVGAGGSPRTFVGPFFSEKGHPLLDDVQLAGVRWTAGDNPPGKPLVSAGDAVLVSEEADGRVHVNVDLSRSNVQRVSAWPVLLSNLVREARRTREGFPRRQLMLGEPLPVVTLAGARYALVGPGGSRPVFGAGEVTLSPPTGPGAYSLERDGDVVDTAQVLALDARESDLRERGRAEVPAREAGDDDAGGNAPGRARWPLVLLLAALVADFYLTRREPPGASGASAPSTGGAS

SEQ ID NO: 14775 - protein, 784 aa, Myxococcus xanthus
TFSLPQAWVLLLPLGLFLWKYGRRPGPPMWLRAALLVLVVGALSGPELRWADAGSDVVVVVDRSASMPRDVDRTAQELITLLESQRRPGDRVGVITFGREARVEQPLATLGGFGGFTRPVDAEASDLSAALDVASALIPDERTGRVLVLSDGRATGVDARGAARRLAARGLSVDWRHIARPEPPLDVAVVSVDVPAAVSEREPFQFSAVVHASAAVTGTVRLERNGRVLLQGPFDFQPGPNVLPLRDLVEEPGLVRYRLSVAAPGDGVVENDQGVAVLRVEGPPRVLLLTNQSRGTLAQSLAASGLQLDVRTPFRLTLDDLDGVGTVVLENVDANALGEPGLNALAAYVEQAGGGLVMTGGRNSFGEGGFRRSPVEPLLPVSLEMREEQRRASLALSVLMDASCSMGMTVPDGRTKMELAAEGVVAALTLLNPKDEVSVHMVDTAAHEIFPLSPVEAGLPLDAVARGFSGGGGIYVGEALRAGRTEILRSEKPTRHVLLFSDAADSEEPDDYQRTLAHLREQEVTVSVIGLGVPSDPDADLLREVAHRGGGRVYFAEDAMSLPRIFSQETLTVARATFVDEPASLEGAPDLPLLGRLSADGLPQVGGYNLTYLKPRANVALRTLDTNGAPILAMWPRGAGRTVAFTAEVDGPYTGELRTWSSLRAALEGMVRWTLAGAAPVGDAVVRTERRGHLLRVTLDLPPGEALPGVVPTMVLLPGDGRAAPVERPMRWEDEDRLVAEYPLEGSGTWHPVVRLGAKVLRAPPVTLPYAPEFEPGSAKAGLE

SEQ ID NO: 14776 - protein, 242 aa, Myxococcus xanthus
MDDSEDSPFDGTFGLEAFAEEAPSEDLESFASSASPHVGIGSDDSLEGFDLPPPMPRPAEPEEEPGRVVREEDLNRPERMGRLKDAMLQICEALAYIHGHGLVHRDLKPSNIMVDDDRQVRLMDFGLAKFLADDAAITEAGKLVGTYRYMAPEQILGEPLDGRADLYSLGVILYELLSGRPPFDAKTPHELWRQVLETEPPPVLALNLHGDPQLARVAHRLIRKEPDDRFQTAEEVYEALSE

SEQ ID NO: 14777 - protein, 394 aa, Myxococcus xanthus
MDAFYASVEQRDNPALRGKPLIVGGHAQRGVVVAASYEVRPFGVRSAMPMARATKAAPHALVVKPRFAAYAEASEQVFAIFERYTPLIEPLSLDEAFLDVTASVGLFGTPADIARRIRKEIADELNLPASAGVATAKFVAKIASDLAKPNGQREVRAEETVAFLAGLPVSRLWGVGPKTEEALRLAGLKTIGDVASRDLEWLEDRLGSSGRHLWELSQGIDTREVVPDRAAKSVGAEDTFDEDLVGVDALKPHVHAQALRVARRLRRAALKGRVVQLKLKFADFTLITRRTTLREATDDGQTLYRAALELLDKSHQGKPLRLTGVSVQLDEEPPQLGLFPAAAPRTAKLNAALDKIAERFGSKAITTADIAGSEATDSAEHRSERPVDKGGPKD

SEQ ID NO: 14778 - protein, 263 aa, Myxococcus xanthus
AEVFLAKAAGPRGFEKTLVLKRILPHLAEDAAFVEMFLGEARLAAQLEHPNIVQIFDFGEAEGSFFLAMEFIDGPNLRKLVKRAAEEALPPAFCAKVVAAAAEGLAYAHEFRDVETGEPLGLIHRDVSPDNILVSRQGAVKVVDFGIAKVAGQGHRTLTGVVKGKVAYMPPEQLQAKAMDRRVDVYALGVVLYELLTGKRPFDATTDVSVMQAILFESFIPVSARRPDVPVALQQVLDKALAKDRERRYADCRALQDDLERFV

SEQ ID NO: 14779 - protein, 137 aa, Myxococcus xanthus
MKSLTEYLWFETPRRRELVRLTDTVTALVRKSGIQEGMVLVSAMHITAGVFVNDDEPGLHEDIWEWLQHLAPAGPDYRHHRTGEDNGDAHLKSLLVHHQVIIPVTGGKLDLGPWQQVFYAEFDGQRRKRVIVKVMGE

SEQ ID NO: 14780 - protein, 499 aa, Myxococcus xanthus
GLDDAVLGAAEAALAAAEAEDAAEARGEDAEEVPIVLEPEPEPTPDERALHAPHVRPSGEPAEIDPDELDPDALKVVLRLHQHGHQAYMVGGCVRDLLLGRKPKDFDIATSATPNEVRGIFRNCRLIGRRFRLAHVYFKGGKIIEVSTFRANPTELEHAANGGEDEGDGEDLLITHDNVFGTAQQDARRRDFTINGLFYDVAEGRVIDYVRGRRDLDERFIRTIGDPEVRMREDPVRILRAVRFAAKLGLDIESRTYAAMEGAVEDLPRCAPARLLEETFRLIRGGVSAPALKLLDALDALKILLPPVNAYLKQHGKEGEKTFYAFAESLDRRVSAGEALDDAILLAMLLIPISRSTGPEESQEGRPSVSQVVEDLLAGFVQSARLPRRIAERCRMLLLAQRTLSGERRRRSAAFKRHPLFSEALTVFEMTVEATGENREQLEAWKAGEVPQPRAAAADGEESDAGGQRKRRRRRRRRRPSANGSSGESADSSSESGDA

SEQ ID NO: 14781 - protein, 337 aa, Myxococcus xanthus
MRALVLTAYDGRPESLRVESRPVPRPTTGQVLVRVAAAPINPADLMFVRGQYGIRKPLPVVPGLEASGTVVASGGVAGRLLVGRRVACVAPGEGDGLWAEYAAVPLGQCLPLRGQVSDEQGASLFINPFTAWVLMERAKEGGHTALAQTAAAGTMGRMLLALAKRRGVAMVNVVRRPEQVSLLQDLGAEYVLSTHEPEFEERLLRVCHELKVSLAFDPVGGRLTGQLLHALPEGGTVIVYGSLSEQECRIAPSDLIFGRKRVEGFWLSEWHRQGFGAAQIKALMGVPSLVGQTLETPVRARLPLESAGEALRIASADMTSGKVLFVPAQGQAPGESL

SEQ ID NO: 14782 - protein, 107 aa, Myxococcus xanthus
TRVGVPLPLAWLVPAAVVLGCARGDKWDRVLLGGLGVLLTALPYALGMAPGWTVAFSAAAAGALLVRSRLSERGENGQVAEARPTLFHFGLGAALCAGLTLGGMEVS

SEQ ID NO: 14783 - protein, 100 aa, Myxococcus xanthus
MAVVPGNAELDLKALARLSGDRKVDTVPLKELQPLTGFIRGGCTAIGGKKDYPVYVDETMELFDAIAVSAGVRGTQLVLAPADYLRVTKAKTGPISRDKA

SEQ ID NO: 14784 - protein, 564 aa, Myxococcus xanthus
MTPEPGDCFGAVLEGQGAGLRYKLRVDGEGPFPDPWSRSQPQGVHGPSEVVVPDFAWTDAGWKGVAPQALVIYEVHVGTATPEGTFESLIPRLAGLKELGITALELMPVASFPGRRNWGYDGVSLFAPQQAYGGPEGLRRLVDAAHAHGLAVLMDAVYNHFGPDGNYLRVYSPHYFTGRHHTPWGDAVNYDGEGSAHARTQVLANVEMWIADYHLDGLRLDAAHAIIDDGTPHLLTEVAERARACAPGRKVHVIAEDERNERRLMRPASEGGLGLDGVWADDFHHQLRRAFAGDSDGYYQDYTGNTEDLARTLNQGWFYEGQVSKNLGHARGTKADGLEPWRFVHCIQNHDQVGNRAFGERLGHDVSPAAFRAMSGLLLLSPYTPMLFMGQEWNASTPFLYFTEHHAELGKLVTEGRRKEFAGFARFAGAEVPDPQADDTFTRSQLDWAEAEQPGHAGVRALYRELLRLRASEPALRETGRGSYAARALGPDALVLERRGGGQRLQVLLSLRGALDYPVPAGSALVLWTEDACFGGSEKLQPLKQDTVRLKGSALAVIRLPAKD

SEQ ID NO: 14785 - protein, 380 aa, Myxococcus xanthus
MSPRVVLPGGTIGMLGGGQLGRMMALAARTLGFQVQALDPDADCPAHSVVDLCVTASFGDTAAAETLARACDTVTLEIEKIPLPTLEAVARHTPMRPGADVLRVIQHRGRQKGWLAKGGFPLGPWREAHSAAELAEAIQALGGRCFVKSSEGGYDGRGQVEVTSADEAAQAWRELGERSVVVEAALALQSELSVLVARSPNGEVAVYPPAFNHHEERILAWSLLPGPLPPAVLDTATELARGITESLQVEGLLVIELFLLKDGSVLVNELAPRPHNSFHSTEVACLTSQFEQAVRAVCNLPLGSVEVVRPAAIVNLLGDLWLKDGGPRFQEVLAMPGVRLHLYGKREARKGRKMGHLSAVGSSPEDALARVQAAATALGM

SEQ ID NO: 14786 - protein, 153 aa, Myxococcus xanthus
MGGRSDLEHLQPAVDILKELGIPHEVRVVSAHRTPDWMMEYASTAESRGLSVIIAAAGGAAHLPGMVSSKTLLPVIGVPMPTTLLSGLDALLSIVQMPKGVPVGTQAIGKPGAANAALHAAAILCLKYPELRERLAAWRKARTDEVLAHRELS

SEQ ID NO: 14787 - protein, 181 aa, Myxococcus xanthus
KPDENEKVFTGNGGFRTGDMGYLDPDGYLYITGRIKEQYKLENGKYVVPSPIEQSLALSTYIANALVHGMNKPYNVAIIVVDVDTLKKWATEKGLDTTSMPELLKRPEVLQLYREQLNEFTRDVKGYERPQRFLLISEDFTVANDMLTPKMSVKRRNVVARYNDAIEALYREGSDRNVSAA

SEQ ID NO: 14788 - protein, 707 aa, Myxococcus xanthus
MFFTLEDDPSPALRRAVQELLELRESERREPHGVLEACFTADGTTFRARLLDVATGGLGLRLESSVRIERLTPGTELGGLQVLRGDTLVLRAGHATVRMVRPLRAHEGQGFHLGVSLERPVEHARSSAAPLLNDSVRIRGLLRRAVRAGVGFGLRTHEGNRLVDFSRAEVLPEESRLVLREQSQPGTLFHPGDVVRLCLDFGGVCHVGTTAVLASEPNQVEVALPRTLSLHHRRNSLRFRSSAERPFAVSFNSPLTGEAIVRPLLDLHTGGFAFPFDAGREAFPPGLVLDDVMLQLPDGTRSRCRAQVQDTGQLTVTEEGASMSRPRRCGLRILELAPEARAAILDAFIKARCPDARDASELPFSDVWDLFRSADVRFPDYPFHETATPEPLVVAHQRLGNGIHGLSKAIVYQREGRLYGHISGLRIYSRTWLSQHLVVRPGYHRHESISQELVALAADYAESLDDVEYLRALWRCRNRWTSRIYGAIASRLERPGLSCLHAFTPCRLPVDAALPPPRSDLRVRPAETSDLRWLEQHLRETQDVVRLRSSDLVEGEMTMGTLGGRYSDARLRRSRSISVVEGKDGPQGFVLMEDSSPGLFWAEWYNAFSLVMVEPDAREADAVRQALVTHAVANSARRGRSTAECLASDADLPALEALGFHNLVKVMEFTAHPRLVRDWNAYLLAVFERLAAHGRGGSRMDDKDIAA

SEQ ID NO: 14789 - protein, 262 aa, Myxococcus xanthus
MTYLMESAQEVHRLQAQASATSYAERLRLTGLRPGDAALDVGCGPGVITSEMLDVVGPHGRVVGIEPQAEHLAAARGLLAGRPNVELRQGALPDTQLPADHFDYVWCQYVFEYLGEPGPALAELVRVVRPGGRVVVADIDGVGLWNWPFPEDLQEASQKLLAALRAARFDLHAGRKLFHLFRKAGLVDVRVHISPFYVAAGAVDARLREDWVIRFRTLRPLAEPFFGGAGPYDAFCERFLALLDDADTLKYAMVLTTEGVKR

SEQ ID NO: 14790 - protein, 948 aa, Myxococcus xanthus
MLRSVMLYYERTYGRDRLVRVWQREELPLTLAYVETLTNFVSVGFTERLFDVLDKDSGDPDFMTKAGRSIASPEAVGFLYYMMKALATPRSVYERALELDHTYNRVGGFHIDTLTDSRVQVRYVSRIRERDRNFCRARQGNLSAFPAIWNLPLAEVKELRCQVDGADCCEYDIRWQSLPPLAWRYIVGGMAGMVAGLVSGTLNLAPPVFAVSSLGMVGVAAGAWLHTRAALLRKDEKLSEQHQGLQTSLEDLQRRNDEIFAANKALEDRVAERTQELSEANTKLEASLARQQELDRLKSEFFDNVSHELRTPLTLILLTLEALAKEAESLPPELPPLVTNMERSAQRLLRLINNLLDLAQLESGKARLRYQPLELFGFLSTVVPPFHTMAERQGVTLRLEGATVTPVHVDHERIEIVFQNLLGNALKFTQKGGVTVRVREDDSEVHVEVEDSGQGIAPQDIPVIFDRFSQADNSGTRRFGGSGIGLALVKETLELHAGGISVTSELGQGSVFHVRLPKGTAHIREDLRERRQAVMPVRRERRISGAFPSLEPTGTDVLGASPPPARDHAGPGPESPRIMVVEDDPEIRSFLARLLAQHYRVMEAINGDDGRQRALRERPDLILSDVMMPVMSGLQMLTALRNDPQTVDIPVILLTARQEVTAKVEGLGTGANDYLGKPFSPNELLARIETQLRLREAAVRAAENERLAAIGLLTSGFAHEVRNPLNGLMNALLPLKDMLTGGSADVELSKAMLEVVEECGQRIRHLAESLLSFTRTSESPVVLSLDSSLDSTLSVLAWKVPPGVKVERAYHCSEPIRGNPGALNQVWLNLLDNALRAVGDKGRVRISTANTAEEAIVTIGDDGVGIRPEDMERLFQPFFSTRAAGEGTGLGLALSRRIIIQHGGSIALSSVPGEGTQVEVRLPLRPVAPRVTGGLPDLASEPRVGRLG

SEQ ID NO: 14791 - protein, 243 aa, Myxococcus xanthus
SYYGMRGLLVLFLTSKVNGGFGWSTADALSLYGTYTGLVYLTPIAGGFIADRYMGQRRAVVLGGVLMMIGHLILALPSVTMFYAGLGFLIIGNGFFKPNISTMVGGLYAPGDGRRDSAFTIFYMGINLGAVLGNFICGTLGERVGWHWGFGAAGVGMLLGLIAFVSMQNKLLGQVGLVPERMVAAAEAKPGTPEKSGFGRDEIDRILVIFIMALFVVAFWTGFEQAGGLMNLYTNAKVDRGIL

SEQ ID NO: 14792 - protein, 87 aa, Myxococcus xanthus
MRAEVDYAKEIQEFKRSMNAVILAHYYQESEVQDLADFVGDSLALAQAAASTKADVIVFCGVHFMAETAKILNPSRQVLLPDLKAGC

SEQ ID NO: 14793 - protein, 135 aa, Myxococcus xanthus
DAQGTAAMAVGARDLGFGVGFLKKQTRQAKLKLLSANLADAQGKLLFPASLVTTVGGVKVGVVGVSPAMAKPTPVGLAVPGQAHEQVQGLPVQPAVAAEAKRLREKSKVDPVVVLAAVPHAEALQLADQVEGVDF

SEQ ID NO: 14794 - protein, 44 aa, Myxococcus xanthus
MKEESRLALEELIKSYPKSVEAKTAKERIAELDKKAAPAKKGKK

SEQ ID NO: 14795 - protein, 395 aa, Myxococcus xanthus
MAVDGNKATRWSASGAGQWIRGDMGSVKPLNGLDIAWFRGNERINLFDIATSTDGTTFTRVFVGISSGKSADFERVTFPTVNARYVRVTFYGSTQTTWGSITDMAALSGATIPDPEPENPDPENPDPENPDPGPGSTQDKFGVTMLYPTKSGGEQWFLADNATSDKRFDPQNTITRNSDGSWKMKNSKVRMSVFTSTGYSASKIPTYDRDVLASRGYMQAANDWRNVEMTGFIKVNSTSDVSDNFAWYARGGKHNDNNSGCEGSSYKGSLHYDGRVRWQKETWHVSYEQAAYKSGTSALRGRWVGFKSVMRNTKVNGKDAVRLEMYLNENADKKTWKKVYDMVDSGSWGGDASHCGGAVNAMPITWGGPIAVFRWDSATDVDFKWMSVREIPAEQ

SEQ ID NO: 14796 - protein, 421 aa, Myxococcus xanthus
MALSGPQVRRLDERLAARSQGLTPHQYLMFLQSPSGVTDLEDLIAAVVVNKTDLFRDEVQLAAFRAQVLSPLVARNRRPLRVWSAGCATGEEVATLLVLLAEAGANSDSTVLGTDIAGDTLRRARWLAYGREQLRRVPPELRSRYFVRSGAKEALTPALRERASFQCHNLMESPYPVAPGGGGFDVIFCRNVLIYFTAEAFQRTVEALAGSLAPGGALVLSASEPLLRVPPTLRVRRGEQAFFYVRPEEGESEAPPAPLSWNGAAPPSRKRGTALPPGRAPARARTEAHHGFSVPAPTEVEGVRGPVATAPEPSPEACAEADLLFACVLDGAASGVSDAVAERDLRRCLTLDPDHAAARYLLGLLLEQCRRTAEATAEYRRALQALESGRSRPVAFFLNPDRLRVACAHAAERLEFSIQKR

SEQ ID NO: 14797 - protein, 352 aa, Myxococcus xanthus
MGKKVSVLVVDDSLICRQLICEALSKDPDIEVVGTCADGKQAVEMTKELRPHVITMDVDMPVMDGLTATEHIMAECPTPILVLTADPRSQAPELTYRALELGALALQIKPAIDAGPDAWNLVREIRLLSSVRVIRHLRRPQRGPLLPPRVATSVLPAVSMGVVVVAASTGGPQVLFKMLSELPADFPAPIVIVQHINAAFAESLAGWLAGASKLKVRLAQDGEPLMPGHVLIAPPGQHTVIPFRGRVGIKLGVERDGHMPSGTVLLESAARTYGRRAVGLVLTGMGADGADGLLAIKQAGGLAVAQNEESCVVFGMPGAAVERKAVDHLIHGDEVAATLVRLARGESLSVGR

SEQ ID NO: 14798 - protein, 211 aa, Myxococcus xanthus
HDLRSPLWALTLSLSWMEQEVPQQGILGESVRTGLAVTARLDRMISDLMDVPRLEEGRLEPQRATFPATRIVEDVRRSLESVARARKLTLDAEVPVQLELEGDADLLVRVLENLTTNALRYAPSGGRVRLEAGADVNGRWLAVRNDGPPISEEARGRIFDKYEQADAERDSRRGYGLGLYFCRLAAEAHGGRLAVEDAPGWSTSFVLRLPA

SEQ ID NO: 14799 - protein, 81 aa, Myxococcus xanthus
MLTAWWATWILSNIISNVGNAFARADTANPTSLSVSLLAGILSEGLSIAAAVLCIRVIGDIESLLVARRAEAEATMTGATL

SEQ ID NO: 14800 - protein, 436 aa, Myxococcus xanthus
MNREREVLVDADVLVQDGRIAKVGRGLKPRGTRRVVDVTGKVVLPGLIHGHLHACQTLFRGRADGLELLDWLRERIWPFEASHDAASMRASADLTFAELIRSGATAALDMGSVYHYDAVFESARDSGFRLVGGKAMMDAGAGVPAGLRESTEDSLKESLALKERWHGTHGGRLRYAFAPRFVLSCTPELLREVARLAKEHGLRIHTHASENAKETDAVRQYTGGEDNVAFFHTVGMSGPHVTMAHCVWLSQEEQDILRDTRTVVCHCPGSNLKLASGIAKVPELLEAGVAVALGADGAPCNNTLDIFYEMKLAAVMHNPRVGPCAMTPMRVLEMATLHGARALGLEDEVGSLEPGKRADITVVDVSGLHAGPTPEDVLVPLVHSARGSDVAHVFIDGQPVLRDGVLTTLDAPSVLANANAQVARILKRRQKKARSG

SEQ ID NO: 14801 - protein, 134 aa, Myxococcus xanthus
MADEIPWERLFEEAARVRARAHVPYSRFPVGAAVLFADGAVVAGCNVENATYGLTVCAERNAFAAAVAQGHTQPVAVAIVVDTPEPCPPCGMCRQVMAEFGGQELPVRSRTPQGGEARYTLGGLLPHAFTKDFF

SEQ ID NO: 14802 - protein, 99 aa, Myxococcus xanthus
MRLKVRREGSSEDFEQHEGDLSLGGCAWQGSGWAQGTRVEVRFRLPILPDEVEAKGEVLQAAPGANGPAARVRFVDLPVESELAIARHLDDVQSGTARS

SEQ ID NO: 14803 - protein, 136 aa, Myxococcus xanthus
MNQGAALYIHPGVKVRPCEWGYGVFTDAFIKAGDLIEECHYLKLPRALSQNPQLQDYVFLLQWARHEVPREGEWVALVLGYGMIYNHAREPNTSYHREATRDVFCYHALRDIHPGEQLCISYGEDWWASRDQGVPA

SEQ ID NO: 14804 - protein, 156 aa, Myxococcus xanthus
MLGLRKKAAAADEAREKLRKVVEDGSTVRKLKEIVQVQGGDPRSIDDYSLLPQAKATVDVVAPRDGFVTGIDTEGVGMAAVALGAGRQRTDSKIDPAVGFTLLKKSGESVKQGEPVVRVHYNDAAQLENVKARLLAAYRFGDVAPVARPLIRERVE

SEQ ID NO: 14805 - protein, 424 aa, Myxococcus xanthus
MTNQHCVGTASEAQNTQYEFMAEGASCSTSCASWFGCPGNVIPGGTLVKVDAPRDYALIQLSQNPVNTYGYLQLRSSGAVVNERIYLPQHPAGHGKKIAVRSTDARDESGFAEIYSRNEASCQSGGPNDIGYYADTQGGSSGSPVIGHSDNLVVALHHCANCPNRGVPIEAVISHLGTSLPQCALPAADCPNPGGNGEPPPPPPPPPPPPENSFDYTASNTNSAQQNTTNHTIALTAGQTLTVATCGLTGTQFTGDTWLRLRNPAGTEVATNDDSCGGRGSSITFTATTAGNHEVRAGCYSTGSCTGRVVWEISGGSGGPTSGSFNFSGSNTNSAQQNTTNHDVAIAAGKSITVATCGVTGATFTGDTYLRLFNGATQAAVNDDACGGRGSSLTYTSSTATTLQIRAGCYSSGSCTGTVVWNIQ

SEQ ID NO: 14806 - protein, 476 aa, Myxococcus xanthus
MNVQTATDSSDRIWEQEILPALERYIRIPNKSPAFDPDWVRSGHMEAAVQLVADWCLAQAQHLPGLVLEVVRLKDEKGRERTPVIYMEVPGTKGDDTILLYGHLDKQPEMTGWREGLTPWTPVREGDKLYGRGGADDGYSAFASLTAIRLLREQGLPHARCVVLIEACEESGSYDLPAYIEALAPRIGQPSLVVCLDSGCANYEQLWMTTSLRGMVAGNLRVDVLTEGVHSGDASGIVPSSFRVLRQVLSRVEEEGTGKVLVEALHTQIPEARRDQARAAAKVLGEEVFTKFPWVPGIRPMSDDGAELVLNRTWRPALSVTGVDGMPALNSAGNVLRPFTTVKLSMRIPPRVDPKAAMDALTQTLVKDPPYGATVTFEGEKSSTGWDAPPLASWLSNAVESASATYFGRPAMAMGEGGTIPFMGMLGERFPEAQFLITGLLGPGSNAHGPNEFLHIPTGKKLTCCVASVIADHFKR

SEQ ID NO: 14807 - protein, 421 aa, Myxococcus xanthus
AEKLGAILVRKGLITQAQLDEALRAQLIYGGRLGSNLVELDILDIDTLAMVLGEMCRYPVAQEADFVAAPDAVLQLLPAAMAEKHQAFPLEQEGRRLKVAMASPLEIEHADALGFITGLRIVPYVTPELRLFQFQELRYGIKRETRFIQMTSTKRPNRTAAVAPPVALPSMPSALSMTPPPPAPVRAEPEAEGMFGGLAPGQYLSGDDPDTEPEDSGSVRWESAMSGSSHPLDPLASSAPPVARIDFGEDGGRRGGTPEVPVPPTLTPAGGGARPASPPRLTPTETPRAVAPPPFALEPAPAEEIDLLEEGEVLEEGEVVEDVAAVPEDFDGGVPAPGVAVASGMPVALQGAGGGTPPPGLASRQGVPTRPPFSPMGAASSEPGASDRGASGAGEGMGVPPGMLSRPSAHPRAPGRTPPLG

SEQ ID NO: 14808 - protein, 447 aa, Myxococcus xanthus
MVMLALAFVLAYATRFSGIVPVTEGIPPWTDSFFSLLMVLVIFPVTFHQSRLYGTNRSRTNTGEVFEVFKSTITAALILVAVTYFVRERYSRLTLVIFIVYAFALVTCSRLVTRYLVSEIRRRGHNLKSILVIGAGDLGQRVIETVEHHRELGFRVMGVLTLHPEKVGQYVNDVRVIGVVDQVNEVLDSHPVDQVILALPLAGHAHVKALMDKLALRTVDVRVVPDLYQYITLYGGLEEFGGLPIIRLQGDPMEGWSRVAKRAFDILFSLLAILITAPLMAATALAVRLTSRGPMLYRQERMGMDGRTFPILKFRTMCIDAEHGGAMMTCPDDPRRTVIGTFLRKYSLDELPQFFNVLRGDMSLVGPRPERPVFIEEFKRQIPRYHLRHKVKAGITGWAQINGLRGQTCIEKRIEYDLYYIENWSLLMDLKILVRTALGGFLSKNAY

SEQ ID NO: 14809 - protein, 530 aa, Myxococcus xanthus
MTLTLRVHGGTGGNNAVVLTRAVVNGAFTPGTELGPYCTGGRIRANTWVTCTVPISLLAPQGARLTGLVLQEGLGLSLPTLYFDELGVRGMATPPPPVEVAITPTSATVPAGGTQAFTATVTGSTNTAVTWSVQEGAAGGTVTPAGLYTAPAIAGTYHVVATSQADPTKSAVATVTVPNTPPPPSGTWVSGYYTGWNADMYPPEKVDFSALTHILVGRVTPNPDGTVNTQFDNSNGPAIARTLSTRAHAAGRKAIIMVGGAGEHDGWVGAASNANRAQFVQNLLNAMDTFGYDGLDIDWEPVEQVDKPALLALIQALRAARPQMLLTMPIGWVNSNFPEDADPWFTNLVPYLDQMNVMTYEMTGPWGGWLSWYTSALTGEAGNHPTSVSSSLSAWANAGIPKNKLGMGIPFYGMAWRNITGPYQPYTDWSDYVGSDNSFTYSKILQLSATGVYHWDEAAKASYVTFDVPVEDGTVRWISYDSPQTIAAKGAFAHDNGYGGTIIWTINQGCTDPQTGANPLLDAVKNAFLP

SEQ ID NO: 14810 - protein, 34 aa, Myxococcus xanthus
MNDGVRTLVSGKKALDVGTANPMNLHPDGGWELL

SEQ ID NO: 14811 - protein, 145 aa, Myxococcus xanthus
MSALASGDTIANSYVDVSAYLTSKADIEAWYQLRASLKQNFDDICGDTFCEGEYSNIESLRFRCSVNALTGRMGQCVWVFAASNEEVDPATGSVTVDARTWACQVPVAPRTTIQEFLTALAGTSPLYATLPRTQTPLYEGLGNCL

SEQ ID NO: 14812 - protein, 217 aa, Myxococcus xanthus
MHEQALQSRYRELLESVEAWAKGFGGRLVLGPPVPDEDIDLVPELLGIPSSNGRPVLPAGLREFWRRCAFARVEFRDWDDGGAWTPLPANFRVYSPDEVLEETRWVRIPTDVTLGNRPLSTTHLYALATCDVLPRDAQWCVAASGGALTAPVIVLNHMGDLTWAQLQDSGQFVWAEQQTAHGATFTTFLDWLEHYVRHTCQLAPESLYPDGVTARPE

SEQ ID NO: 14813 - protein, 182 aa, Myxococcus xanthus
MANTSNENAVAEAVKRLKSLAEEIEDMSIEFSTPVTADEVAQLEKKFKLKLPPSYVHFISTYGTFKVLHGGRELIGMEEPGFLRAAAPDPSDAVNGDDPEVEEAINQALFFQRADDDAVDNFWCFNPRDVTPEGELGVVGYYHDEAFDLSPRLGTEDAEHFRDFSAHIVRVIDALIENFAEA

SEQ ID NO: 14814 - protein, 203 aa, Myxococcus xanthus
MSLLDDLLKKGSLHTPCGTAARRAALKAKLTNSGATEVVSGDLKLSEGDDRVLEASRVVVKGNLVLEDQSRLLVAGDLEVEGSIIHEGFDYALLFTGGALSAKNLLFHGELVSLGPITVQQVAWTYYNDYSTYSDSLKARIVVAADRFDAVDDVQADHHFNGHPSDIREALAKQLSADVVDADGDWSYEEIAKHLLRGRALLR

SEQ ID NO: 14815 - protein, 86 aa, Myxococcus xanthus
MTGGVFQTLALASDVHDECAEEASDECEDCSPNCVLCVCCPLRAAPAPALPNARLIPPPRPLPIPSRVEEPTLSGVGTDIFQPPRA

SEQ ID NO: 14816 - protein, 89 aa, Myxococcus xanthus
MHSLRTLSVVLSLFAAPVLADESKPAQQPQTAGSEKPRCEHGVQKSLCARCNPKLAPVFKAKGDWCPEHARPESQCVLCNPELSKKGVK

SEQ ID NO: 14817 - protein, 155 aa, Myxococcus xanthus
KAETVSGPHPEAAPLAPLVRLGDAVVGRPLLPGNRFTVLESRRDAYPAMLEAIDAARTTLSLCSYIFDNDMAGRRFVEALSAAVKRGVEVRVLVDAVGSRYTWPPILGRLRRAGVRAARFLPSLMPYRLPFANLRNHRKLMVVDGRVGFTGGMNI

SEQ ID NO: 14818 - protein, 520 aa, Myxococcus xanthus
MRASRVGPSVLAVLLALSAASCSQQASPPTAKAPSPPPVASGGTSTPSEVALCEHRVPAELCTRCNPDLIDVFKDQDDWCGEHGVPESQCFQCNPGLTFTARDTTPKDWCKEHAVPESRCTKCNPSLVAKFIEAGDYCREHGFPESVCPYCHPELVKAAGAQPPTFPEPGTRVRLASAETAREAGIQTRRAVKRPFARTLDVVGQLDFNQNRLAQLSARSEALITDVRVDVGDEVKAGQPLVLVTSGAVGADQGRLSAAQTRLTVARSALEREQQLATSGIRARKHVETAQAEVAAAEAERNAARAALSAAGANGQGPQGTYALSAPFAGTVVARDAVAGRHASAGQPLIQVADLSTMWALLEIPEADAFQVRAGQRVTLTFESMPGQTRDATLTRVSASVDRASRTVRARVELPNPDGALKAGLFLRARVQVAPEHEAVLVPHAAIQRAEGQTLVFVRKQPGLYEPVAVELGASTREEVEIVKGLSAGVEVVTTGAFLLKTEILKDSIGAGCCETAGGE

SEQ ID NO: 14819 - protein, 853 aa, Myxococcus xanthus
LTRLIEWSLSHRWAVLLGTGALVISGLLAFRALPIDAIPDTTPTQVQVNTVAPALTPNEVERQLTVPVEQALAGLPRVSELRSISKFGLSQVTLQFEDGTDLWFARQQVSERLSRVQLPAGIAPPTLGPVATGLGEVFHYLVKSRTKSLEELRTLHDWVIAPQLRSVPGVAEVNAWGGEEKQWHVIVDPLRMQQFNLSLGDIYRALEENNANVGGGVLERGGAATLVLGVGVLTDGNAIEDVVIAAHHGVPVRIRDVARVEVGHEIRRGATTADGEGEAVLGLGFMLVGENSHTVTKALAQRLEDIQRTLPEDVRVEPVYERTELVDHVLRTVRTNLLEGALLVIAVLFIFLGNWRAGLIVAAAIPLSLLFAFNAMLRFGIAGTLMSLGAIDFGLVVDSSVIMVENAERRLSEARDGRSLLEVVRDAAVEVRKPTLFGELIIMVVYLPILALEGVEGKLFRPMALTVIFALLGSALLSMTLMPVLASFALKRGGGSPHHEPRLMRWLQRIYRPVLEWALAHARVTLTAAALLIVGATLAATRLGSEFVPRLSEGTLVINTVRLAEVSLSESIRYGSQIERLLLSRFPDEVRRVWTRTGTAEVATDPMGVELSDVFITLKPREQWKRATTQEELVNEMKAELADLPGMRMAFLQPIEMRVNEMIAGVRSDVGIKLFGDDLDVLKAKARELETLVRAIPGAADVTVEQVTGQPVLEITVDRAAVARYGIPARSVLDVVEAVGTRIVGEVREGERRFDLAVRLSEEYREEPTKLVTIPVASPGGERVPLGRLTTMNETSGPTTIQREWGKRRLVVQANVRERDLGGFVAEVRRTLDEKLELPAGYYVRYGGSVSNI

SEQ ID NO: 14820 - protein, 150 aa, Myxococcus xanthus
MLLAIALGTALASVPGINALERMVAAEVHAVYGPSDERNGARVDRGGVAFVGKRTRQLRCGRLAGVGSDTWAAVMSATAGVKTKPTLGRELESFQPGFHEAHRQARERRRAVATDTVRLLRSAARMVRGGNAGDRPTLVTQSLRGPPGRG

SEQ ID NO: 14821 - protein, 600 aa, Myxococcus xanthus
MIWLGFVVGRAFGWTTLESLFTGALISVSSTTIIAKAFDEQNIRGRLRELVVGVLIVEDLIAVLLMATLTAISSGTGLSVGELSLTTGRLVAFLVGLVVVGLFIIPRAVRYVVKLNKPETTLVASVGICFAVALLAQAFGYSVALGAFLAGSLVAESGEEKVVEHLVQPVKDIFAAIFFVSVGMLINPALIAEHWAAILVLTVVVIVGKLFSVTLGAFLTGHSTRTSVQAGMSLAQIGEFSFIIAGLGLSLKATGNFIYPVAVAVSAITTLTTPLLIRVSGPVASYVDRKLPKPLQTFVTLYGTWVERLRDAPRRQTFGASVRRLARLMVLDAVLLIVLVIGTSLTAGKLGSLIEQRLGIDENLSRYIILGGAVLLSIPFLVGVVQVARRLGEELAEAALPGRKDGRVDLAAAPRRVLLVTLQLGIILLVSVPVVAITQPFVRGAMGPLILLALIGALGVTFWRGATNLHGHVRAGAQVIVEALAAQSHSREPGADEHALDHVSKVLPGLGEPVPVRLETSSPAAGKTLAEVNLRGLTGATVLAIRRGDSSVSVPSAQEVLQPGDVLALTGTQDAVEAAKSLLTGAPAPTSEPEPTGAQV

SEQ ID NO: 14822 - protein, 33 aa, Myxococcus xanthus
MPGRVVAADKGAHAEIPTQTLPLAELDEASTPA

SEQ ID NO: 14823 - protein, 201 aa, Myxococcus xanthus
  unsure (1)..(201): unsure at all Xaa locations
APIDELSQRVSAAFADRTLLKDAAHVAAVRETLARLDSGELRVAEKGVDGWKVNAWVKEAILLFFAVSEMKVMEVGPFEFYDKVPLKKGLEAAGVRVVPPGTVRYGAFVEKGAVVMPGYVNIGARVGAGTMVDTWATVGSCAQVGKHVHLSGGVGLGGVLEPPSASPVIIEDGAFLGSRSIVVEGVXVEEEAVLGANVVLT

SEQ ID NO: 14824 - protein, 69 aa, Myxococcus xanthus
GIGKLIGGAADAAKRAAEAAAKRAAEAARRAAEAAARKAAEAAEQAAAKAQEGQGEDLQRGPGADPGRL

SEQ ID NO: 14825 - protein, 239 aa, Myxococcus xanthus
MLVSLVIPVYNEIPTLAELLRRCVAVDFPKELVLIDDCSKDGSREFLRQLQEQGVGLLGGTPRNRNEVRVLFQEKNQGKGAALRRGFTESTGDIIIVQDADLEYDPRDIPNVIQPIIDGVADVVFGSRFTGTPRRVLYYWHTVLNNVLTTLSNMTSGLNLTDMETCYKAFRAEVLRSVQVEEDRFGFEPEITAKVARGRWRVFEVPISYHGRTYEEGKKIGWKDGVRALYAIAKYSVKR

SEQ ID NO: 14826 - protein, 126 aa, Myxococcus xanthus
MHHTREIPREGWGDYLALLSNLERDHWVRIETESVDFGDQPLAGRLPLVEIALESKGSDQGSVEIIVGRPGGEVTHRILKPDHIYADESESGELECLDIEDADQVKTLIFFEPQRAGDELGIGAPS

SEQ ID NO: 14827 - protein, 156 aa, Myxococcus xanthus
VVTTTGYVDRPKPLLAGMQMVQDQSTSNASSIGQKAALAALQGPPDTIAAMVKEYRERRDFFIAGLNALDGVRCRMPEGAFYAFADVRGLLGRSYKGKPVTSAMQLSEILLDDFRVAAVPGEPFGAEGYVRMSFVTSREVLQKGLARLGELVKALS

SEQ ID NO: 14828 - protein, 52 aa, Myxococcus xanthus
MEKKYGKAPARLGLDLRNPKDVWTAVGNISGRPAVLVYRKYRDEFRAFAYTD

SEQ ID NO: 14829 - protein, 102 aa, Myxococcus xanthus
ALKPGQAIGAAVTLRGDRMYEFMDRLITVALPRVRDFKGVSPKAFDGKGNYTLGVREQIIFPEINYDQIEKVKGLNISFVTTAANDEQGLALMRHFGMPFRQ

SEQ ID NO: 14830 - protein, 61 aa, Myxococcus xanthus
MAKLSKIAQAKRKPKFSVRQYNRCPLCGRPRAFLRKFKMCRICLRNRALRGEVTGVTKSSW

SEQ ID NO: 14831 - protein, 138 aa, Myxococcus xanthus
MPVNDPVGDMLTRLRNASRARHDKVVIPHSKLKLEIIKVLKDEGYIGEFVVHEQTVQNKRTVFPEISVQLKYGPDRAPAITGIRRVSKPGLRRYAAAREIPQVLGGLGISILSTSRGIMVDSEARKQKVGGELLCTVY

SEQ ID NO: 14832 - protein, 188 aa, Myxococcus xanthus
MSRIGKLAIKLGDKTKAVIAGEQVNFEGPKGKLSVKLPGKVKVEIKDGQMTVQREDDSREARSLHGLTRTILANAAKGVSTGFEKKLDIRGVGFRAEVKGKAIHFSLGFSHPVVFNLPEGVTAEVDKAPRNEDSLPTVGLTLRSSDNEALGATAVNIRSLRPPEPYKGKGIKYAEERIRRKEGKTGTT

SEQ ID NO: 14833 - protein, 118 aa, Myxococcus xanthus
MPTKIEARLKRKNRIRKKLSGTTERPRLTVYKSLKHIYAQVVDDTTGKTLAFASSLSKDLKGQDEGDKKADAKRVGALIAQKCKAANVEAVVFDRNGFPYHGRIAAVADAAREAGLKF

SEQ ID NO: 14834 - protein, 89 aa, Myxococcus xanthus
MALKVKLVKSFAGASSDMLDTIRGLGLKKFGDERLLKDTPAVRGMAFKVKHLVTLETVSGDAPAPKRRKPAKIALRERAIAYQAKQNKA

SEQ ID NO: 14835 - protein, 175 aa, Myxococcus xanthus
MSTLNKLQRPARSWHRKKRVGRGQGSGLGKTAGRGGKGQKARTGNMRFEGFEGGQSPLQRRLPKFGFTPPNRTVYAVVNLSDLEQHFDAGATADVETLRKVGLVKGRYHGVKLLARGELTKKVTVVVHKASEAAKAAIQKAGGAVEEIPLVAHKPESAAKAHAGKGVKAPRQPKA

SEQ ID NO: 14836 - protein, 404 aa, Myxococcus xanthus
MNAFMDAQKQSGGLVSLFNLFSGGALEQMSIFGLGIMPYVSASIIMQLLAVVVPSLERLQKEGAGGRQKINQYTRYGTIALSVVQGIGISRWLASLGRSDGGQSGFNQVVVPDDSVWFTFMTVVSLTAGTAFIMWLGERITERGIGNGISLIIFAGIVAGLLPGAKQLLDLTRQDVISMAEVLALVVFMLIIIAAVVYVERGMRRIPIQYAKRMAGRRMFAGQATYFPMKVNTSGVIPPIFAGAVLSFPATLGTWFPFLQGFQRAIEGNLWIYNGLFVVMVIFFAYFYTALTFRPDDVADNIKKQGGYIPGIRPGRQTAEFIERVLNRLTFGGAIYLSIVCVIPSVISGLLGVRFTFGGTALLIVVGVALDTVQQIEGHLISRNYEGFAGPRGPRIRGRVRVAA

SEQ ID NO: 14837 - protein, 231 aa, Myxococcus xanthus
MDEFDKLATSRSDSRFAGQQTTKDVSGFGVQRSLLHMLSAPSADFPPDFGFTSRQRPDTMELACVTFIACGAFSGLSATAEGLARSEHLGFGREPLPARVESIATRVTEEQLEQTTAFARYGFIPELIGRFNRLVSFSPLDAGTLDDILQHNVLRAYEREFEQEGLRLQVDTEVREFVVARALKRETGARGLRTTLAPLLERAAYEHFGHRDNDGTLRLTLEAGEVQARRV

SEQ ID NO: 14838 - protein, 33 aa, Myxococcus xanthus
NLILLGPPNAGKGTQAKRLFADFQIPQISTGDI

SEQ ID NO: 14839 - protein, 194 aa, Myxococcus xanthus
LKSMVMADILDMVTHEAPLILGGTTLAVLLAMWLTLGGLRIALLCMAPTVVSLVALLGLMPLLGLEFNYLNILVIPILIGTTVDAGVHLLTRLSSPGHDFVSVYSETGKAICGGLLTSAMGFGALFLADHPGLNSIGALANLGFATNLLVMLVAFPALLLVLSERRLKRHSARKESQKPEPPRQSGRGEPTHAS

SEQ ID NO: 14840 - protein, 173 aa, Myxococcus xanthus
MAKQMKRGWMWAGALAGTLALGTAYSATEAPVQVAQVDPSTGQTVTPGTAPSNTTSGTGPGTTPQTGSTNTNPNTLPPATNPNTLPPGTSTTTPGTGGSGATGTTPYNTGAEGATSTVPGTTPYNTDAGTGGSGVLPTPGIGTTPGLDAPTGTGTSNTVPAPSGVVNDGGTGF

SEQ ID NO: 14841 - protein, 237 aa, Myxococcus xanthus
METLVTRLLSLRVGMPRELGVTGAASPLERPWTSAIFKEPVTGPVWLSRTGLAGDGQADRKVHGGPEKAVLAYPITHYDFWRERMARDDVGAGAFGENWVLSQGTEADVCIGDVLRVGGARVQVSQPRQPCWKPARRWGQRDLSLLLQQTGRTGWYYRVLEEGPVQEGDVVALLERPFPTFTIAFANHAMHGHAPEDAALLAECPLLTPNWRDSLRRRAQGSRGDDRPRLVGPNSAD

SEQ ID NO: 14842 - protein, 96 aa, Myxococcus xanthus
MDDPALSPESETVDPTLNPGTGGAGTEVDPNLDPDMSSEPGTGGAGDVEPLDNTDTDEMDANDDSTLEPGTGGSGMTDPDTRVTPPTPLPETGSTR

SEQ ID NO: 14843 - protein, 393 aa, Myxococcus xanthus
MSSWFHERHGELLESAVLGTGPLGAPTLRLRLHPAAGEVALVATSGAHVSVSAETSTVGPGYHRFLCDTLRAMGDALGIVWAEGRASSKGGDPTGYFHTGDAGPVDVHMLASLQEAVGWVLRMLPQGESGFALSMRFGHTFEYPGALLTPLGPRDTRWLVDVYEDPRRGIDVFPWWTPGIDARMRLNRARCRLWTDVVWRPPLLDDERHLMRDVARLLEQAWRENPSLPYPWREWQEVLGFLGVGGTLAEEVHQRASQAPGGPPMGYRRGEVQVALPAGWEIRIPGSLAEAHLQDGTWVARDHRRSVRFVPLEDGGADSLMPSLMERRAMDLEHHGKRVSGRASLHMEPGECRLTALCTSGKRRALCVVSFDDPDEQDWALGTWRSLDHAVAA

SEQ ID NO: 14844 - protein, 56 aa, Myxococcus xanthus
VRDLHAAGIEVILDVVYNHTCEGNHLGPTLSLKGIDHASYYWLKRRGGLTSVSRGL

SEQ ID NO: 14845 - protein, 210 aa, Myxococcus xanthus
MDLLMVDGQRAPFAGLGVDGKVLNDYIWVKENLGKGFFKSVLSGSGGYFSAVACKTVPHYLTHSHWVECEVVNGASEAYRLGPDGGAMGEPLAPGATLFRGRLMMAAAGTMPFYGYGFRMFPFAGQRPGFMQLRLGQVTPTQVLTHLPKLWNGRWFPESLMDFHAREVTIRFANPMPFQVGGDAAGYREQVTLSVAPESVELVDFTGALN

SEQ ID NO: 14846 - protein, 110 aa, Myxococcus xanthus
GRRHDEVSEEATLVPYKVARGPNGDARVDIDGKQYSAPEISAQVLLKLKRAAENYLGEKVTEAVITVPAYFNDAQRQATKDAGEIAGLTVRRIVNEPTAAALALELTRSS

SEQ ID NO: 14847 - protein, 253 aa, Myxococcus xanthus
MSPHEPFPLYHPADVRRAFSSDDATRRFAKVAQLEPGSRVLVLGCGPDGSAALLLAREMGCTVVAADTDDALLNPVRERVRAQGLAEQIEVRRVSLDALGLSDGEFNGILIQGRVLYALKATLANMRSLLSKRGRLGFTFPARVGRFAPKASLDFWERRIAGPLLLPRELLQVVEGAGYEPESAESLHDAELDAHYRDIETFLSSVPGSQPAALREELALHRESNGKASVSYAFVVGRRKEQGEKPPASRDRG

SEQ ID NO: 14848 - protein, 217 aa, Myxococcus xanthus
MFDVWTKLLMEHERVTAFLARAARRHHVRVLVKPSDAYDAPLEHMMLASSGQVPGASDRGRVRFSPEEREQLGRYDVPYFFRKADGGPLLMMDAPPTSAAFRPVGEQQFLGSTPPPAPHILNGEQLGLMNLGVALRDAVDAVAQDLRHRVQEAPQWGVRLSLAKDRRTGAVSFDWPETGKRLTFSWNRRTVRLTDEALDEAPAPQPGRRARRKPPTA

SEQ ID NO: 14849 - protein, 101 aa, Myxococcus xanthus
MTKEDAGSPPAGEGEKTPLIEYPSVYTFKVMGAQGAGFVEHVRELFKRFLGTELSPDSIREQPSSKGKYVSLSVSVYLLSEEQRRAIYDGLHKDERVIYYL

SEQ ID NO: 14850 - protein, 348 aa, Myxococcus xanthus
MADSNLMDNRILGVALDLMEAEPGTQAVFITKDTNLRIRADALGLIAQDYDTERVEITELYTGFAERLVPKDLVDQMYRQGAEVEPPDAESLFANQVVLLKDETNPSHTAMGRFNGSKGRLVPLVRQIKDGTWGVRPRNMEQAFCLDLLLNDDVKLVTIVGKAGTGKTLLAIAAGLQKVTEEGLYQKLLVSRPIFPLGRDIGYLPGSVEEKLNPWMQPIFDNVEFLMNLSRADKKAGRGYHELLDLGLMEIEPLTYIRGRSLPNQFIIVDEAQNLTPHEVKTIITRVGDNTKIILTGDPFQIDNPYVDATNNGLVHVVNRFKSEKIAAHITMSKGERSALAELAANLL

SEQ ID NO: 14851 - protein, 315 aa, Myxococcus xanthus
MPRIQPINPRYRRIYQALSGPDLAVSESAGMTLEDLGLGSAEASRGDLVFGTYSPQGLERALRAYGLFQRVEERVGPLELRVVCTDPYRPRIILWSRRFYVPVADLDLRRTTGAEVGLGDALAATPLLYLDSLLLQNPGRAFDWNRPPLPGQNHPGLKLAGHILDVLLLMARRIGTEALALTPSTFAAACVYDRRFLFVDGAAQGRFLALRQAGRHLPRWLHAWAVELHCMRDEHGEAVAFKPSPMVSPLSSRLGLHFDANTWDDALQLDARRQLTLDEETLQRRFPWERMPPGPPPERVAELLGYDPLAPVVAH

SEQ ID NO: 14852 - protein, 176 aa, Myxococcus xanthus
MSQDVHPDEQETEDDAERAPFRRYLTRAGAERLHRELVHLLNEERPKVTAEVSAAAAQGDRSENAEYIYGKKRLREIDRRLRFLQKRLDTATIVTPAEQTDRSRVFFGATVSLEDEDGGRSTYQIVGSDEIDASGGRISVESPMGRALLRKAVGDSVEVRRPRGDIELTVVDIRYE

SEQ ID NO: 14853 - protein, 1302 aa, Myxococcus xanthus
RDGYLWLGTWEGLARFDGARFTVFDKRNAPELRNHTIKALAEDASGTLWVGTGQGLVAYRKGHFERAPGAAASLDSARVETLVAADGVLWVGTTTGLWQVPLGEGVARQYTEADGLPASHITALTPGEGTSLWVGTPEGLARWVDGRVEPAPFPFPGPESRPYVMALRRDATGVLWLGTKAGLYSWNGLVASRFTTDEGLPSLSVNALYADGDGNLWVGTHRGGLTRHNSKGFSEPVPGMEWMAESAVLSLLEDRDGHLWVGTYSGLMRLRDGPFATYGIPEGLADETVSAVLEDRRGTLWVGTTSGLFRYENRTFHHVGTEQGLPESVIPAMHEAHDGTLWVGTLTGAYRYDGQRFTRVSRAQGLPHDVVTAILVDSRGDTWLGTQAGLARMHGGGVTVYGPKHGFTNPIIVMVEDSRGRVWFGSDTGLVRWDGEQKGFQRFTQQDGLPGDLVLALHADPDGTVWVGTETGLGRWREDTWARFTVAQGLYDDAVFSLVPDGDGSLWMSSNKGVSRVSRRDLEDVAAGVRPRLTTMDFDTRDGMRSAECNGNTQPSAWRGEDGRLWFTNLRGAIVVDPVRVRESRQPPEVRIEEVRVQGTPVPMEGPVELEPGASRLEIRFTAFTPVDAARLPFRYRLAGHDDTWVHAESRRALYNGLRPGSYRFEVQAKGRDGGWTEPVSLDVVLEPKLWQRTGFWLLCVLGVGILGVSVYLLRVGQLKDRERWLAERVKDRTQALARANAELEANMHTLRQAQAQLVQTGRLAAVGQLAAGVGHEINNPLAYIVSNLEHASEEADALARELDGTRDVGARLKDVNQALRDALLGADRVRRIVQDLKMFSRPDDEKQGPVELHAVLDSAVKIAMGELRPRAKLVRDYGDVPRVEGNEARLAQVFLNLLINAAQALPEGQAGTNEVRLVTRRGPDGRVVTEVRDTGSGISLELLGRIFDPFYTTKPVGVGTGLGLSLCHAYLTAMGGTIAVDSEAGRGSVFRVTLRAAAEAQRVGGDGASVEPPATSDRGVPGAAVPVTPASSGDIATVPDVSVEHGVAASDATTMRLRGEAAPRAELDSTPQASAPERTQGAGWGITPPQAKSTDGRAADSAALAASQENGGRMAAQNASVTSGMSRSSEAGTVGSHQGEPSSTHASAEGSPPDRMGEDGRFSATEAATRGRVLVVDDDALVSGAIRRTLARENDVDVLVSARRALEKLTGTEARYDVVLCDLMMPEMTGMDLYDALAQVDSRAAERIVFITGGAFTATARTFLERVANPRVEKPFDPEALRQLVRSEVARARREASGRAA

SEQ ID NO: 14854 - protein, 211 aa, Myxococcus xanthus
MDAIALLKADHKTAEQLFRKFEKAGPNAHKLKRRLVDQMVTELAVHAVIEEQVFYPAVRSRSEELGPDVLRSLEEHHVVKWLLAELDGMSPEAERFDAKVQVLMENVRAHVLQEESDLFPALKKVFRPQELRTMGDVLEMSRKAAPTRPHPMAPDTPPGNLVVGAVSAVMDMGRDALRAARRKATTKVRSVASRGPGQVVREMAGAEASGP

SEQ ID NO: 14855 - protein, 45 aa, Myxococcus xanthus
LLTGLTAFAQPQPVSAPRAQAPAGMRTIRVEGTGEVKAQPDEACS

SEQ ID NO: 14856 - protein, 323 aa, Myxococcus xanthus
MNDILRVRVARVTREAEDILSYELVATEGGPLPPFEAGAHLEVRVPGPGDFLRAYSLCNDPEETHHYVIAVARDAKGRGGSNAMHERVHEGDVLEVKPPRNNFPLLFARSYVLVAGGIGITPILSMARVLQRTGADYTLHYCARAPGRTAFHELLSQAPFAEHVRFSFDGGDPARGLDVKGLLATRQPGARLYCCGPTGLMKAVRDAATLHRWPWEKVHFESFTAEGTSAATGREEQGFEVTIRSTGQVLQVPVGQSVLNVLRRNGVRIPSDCEAGTCGTCVTRVCDGQPDHRDTFFQAEPAGDQRMLVCVSRARSKRLVLDL

SEQ ID NO: 14857 - protein, 655 aa, Myxococcus xanthus
TKLLTLISRRSFLEGLNLSVGGLALGVFSGGLAAAASDASTAKGAPGLNPNVFVHVAPDGAVTIVCARSEMGQGVRSSLPVLVADELGADMARVTVAQPDGDKVYGDQNTDGSSSVRGVYDDIRRMGATARVMLVAAAARRWKVKPEACEARDHAVFLRDGKRSLGFGELVADASRLPIPKAKDVKLRPKSELRMAGRPMPLLDGPAYVTGTAVFGADIRLPGMLIAVVARPPVVGGKVVRFDATRALAVPGVKKVLELPAPKPPYTFQFWGGVAVLAENTWAAMRGRDALDITWEDGPNASYDSTTYREQLTASIREPGTVARNVGDIDAALASAARIIQAEYHIPHQSHVPMEPPVALARVENGTCEVWAPTQHPQAARGVAAATAELPEEKVQVHVTFLGGGFGRKSKADFIAEVVWLAKEAGVPVRVQWTREDDVRHDYYHPVSAQQLTAGLDASGKVIAWRHRTAFPPIASTFGQATRPSPSDLQQGVLDLALSVPNVRAETCEAPPHVRIGWLRSVYNIFHAFSVNAFVDELAHLRGTDSRDMLLEVLGPPRKASLQELGITALRNYGASVEDHPVDAGRLRGVIERVTAMSGWDARKANGRALGLAAHRSFLSYVAVVASVVKDDQGRIRVDKAWVSVDARTISNPER

SEQ ID NO: 14858 - protein, 48 aa, Myxococcus xanthus
MCAAALLAKKPQPSDKEIDQSLAGNLCRCGTYTRIRSAVKKAAGMSEE

SEQ ID NO: 14859 - protein, 47 aa, Myxococcus xanthus
MVKAKTKTKASKQTKKLTQALRELNKTTKPAGSANVFNTCSRFMYCV

SEQ ID NO: 14860 - protein, 210 aa, Myxococcus xanthus
MASLSALLLAGGCKREPDAAAAQIPALPEVAPNALRPVEAFAAILDRKERSRALFLEASRVFFHPRCANCHPAGDSPLQGDDGQLHDPPVVRGPEDQGVVGMECISCHQDKNQDLARVPGAPKWHVAPIEMAWVGKSPREVCEQLKDTKRNGGKTPEQMIEHNAHDALVAWGWNPGSGRKPAPGTQAQFGAIVAAWVETGSECPSEEARP

SEQ ID NO: 14861 - protein, 172 aa, Myxococcus xanthus
MLAAAYEGWAQKASMEKRRGLLAVPERKSGEKAHRTPPPPQWRWADDETFDKLVVQPVAYAIQVKGGPHALLLAGEHGLHRFIEGSQISMVHAYFEPRPLSLFDLSSREALQKQLPKNEVRQVRLSGSGSGQGTLTDLRTGVQQRFGLEGPDLEPLLEPWMQWRVFNSRDED

SEQ ID NO: 14862 - protein, 251 aa, Myxococcus xanthus
QATAVTSPTVEEKRGLLELMQHIGVSAVSLGMPAAGPWALEEVVTLARHIREEALRLEPNCAARTLHSDIVPIVEAVQRAGQPIVVHTFIGSSPLRQCAEAWDLDFILRSSTAAIDFAVRQGLEVAFITEDTTRSTPETLELLFRAAVEHGASRLVLCDTVGHATPAGTRALVRWTRDLVERLGSPVKVEWHGHNDRGLALINALVALEAGATRVHGCGLGIGERTGNAPVELLLLNLKLLGWIDQDLTRL

SEQ ID NO: 14863 - protein, 212 aa, Myxococcus xanthus
LETTEGSIVRATLRALVEPRRLLPILVISVALITAQVRFSHAPLWAAFGLGLLMCLLFIAVAPVSYRVLFPEGLDLSHGGIRLLLYATVGSGVVLTSGFVLPKLLGMGPTFLTQPTNLAVCGALFLVGGWGLGRDIGFEESLTRERARAARFALEAEQAQLLALRSHLDPHFLFNTLNAIAEWCREDGAVAETAVLRLSTMLRSVLAGVFRA

SEQ ID NO: 14864 - protein, 40 aa, Myxococcus xanthus
MFALPSPVLVVAAIVLFPVVLAGSMLLDAFETELEERPAQ

SEQ ID NO: 14865 - protein, 517 aa, Myxococcus xanthus
MGAFAIGLGGADIVAAMVLGETWLEVPEAITVEYQGTPAFGIGGKDIILKTLGLLGRNTAALERTVEYRGEAARGFTTDMRFTIANMTAELGGLNGIFEPDARVTEWLAMRPSNKDEALYFRADEDAPYVQRFSIALEKLGPQLARPYAPDNVLEVQDAVGMAVDGCFIGACTTTEEELVLAALLLEQALRGKAARPASPKRLVVPGDLAIHERMRQAGLWRHYEQAGFRIGPPGCSMCLGVASEKALPGEVWLTSQNRNYENRMGPGSHAWLASAATVAASSLEMRVEDPRAALKRIDPSVLERILARKPAGRPIEFRSSEPRLPMTPQPHDGGTRAGTASGGRIAGRIQRFGNHVDTDAIIPGEFCHLDEPSELARHAFRYVRPEFLERVQQGRTLIVAGEGWGTGSSREQAVWALAGAGIKAVIASSYAFIHRRNLVNEALPHLVVTSPAFHALVQEDEELVVDLETGLVEHVASGQRFQAERPSPIARALMQEGGLVPAIRRLGARALHLGAP

SEQ ID NO: 14866 - protein, 336 aa, Myxococcus xanthus
MRILQVLDAEMRLGLSLEAFDFGAERFLRTGVGLPPGQMDVFRTEFDAILLGAMGDPRVPDNAHAREILLGLRFGLDLYVNFRPCSPLAERLSPLKGKGPQEIDMTIFRENTEGIYGAIGGSFKRGTLDEVAIAEEIHTRKGVERIIRAAFKWASAHGKRHVALGDKSNAIAAHGLWLRTFREVAAEYPQIEARHYYVDALALQMVTRPESLQVIVTTNLFGDILTDLGAALSGGLGVAPSANLNPDSTPLFEPVHGSAPELTGKGLANPAAMVLSAALMLEHLGQAGAARRLSTAVQQTVAEGQCTRDVGGTLSTTEAADAILDRMLQGLRRTRT

SEQ ID NO: 14867 - protein, 184 aa, Myxococcus xanthus
MHPPVPSLTDTTLVADLNARLRDVPDFPKPGIVFKDITPVLADPRLFGRVIDAMSAPFRGQHVTKVVGVEARGFLLGAPIALALNAGFVPARKPGKLPHRSVVERYSLEYGSDGVEMHEDAILQGERVLVVDDVLATGGTAEATVRLVSRLGGELVGFCFLLSLDFLEGPNRLGRERVTTLLTF

SEQ ID NO: 14868 - protein, 42 aa, Myxococcus xanthus
MSFRYTGCGGLYRNPVVPVDCADPGVIYYRKRVVAECTSAGS

SEQ ID NO: 14869 - protein, 161 aa, Myxococcus xanthus
MVLLDWIATEPTPAFLRAVRGLQTERWSKVRDSLLQGWLEGLDDDAIHRFVRDDMGAFDEAMWARAGREIEAAYAREGSPLRALAALEPMPLTMHLYARPESHDYLAAQVDFGAEHPGFHVLKLPATSHFPALEVPAMVAAGIEALVSAREVPVHADAVPA

SEQ ID NO: 14870 - protein, 202 aa, Myxococcus xanthus
MPRPSNTEERRQQIVAGLLKVMSERGYERASVSEIAKAAGLSAGLVHYHFSGKQEILLTLVEQLAAQARQRVATRLERVKSPDARARVDAFVEAFLATGDDAAPAAVASWVTISAEAIRQPEVRAIYEQVVRADLEHLTSLVAAVVGRRKAPALAAGLFAAVQGYFVLAASVPGLVPAGSAASTVKRMAAGLLDPAGAKEDA

SEQ ID NO: 14871 - protein, 43 aa, Myxococcus xanthus
  unsure (1)..(43): unsure at all Xaa locations
RTATKLGLLSSLYLSQGLPFGFFTQALPVLLRHQGLXVAFHSD

SEQ ID NO: 14872 - protein, 31 aa, Myxococcus xanthus
MPLPVDPELNRIAMRRARERTDGMKEALGLR

SEQ ID NO: 14873 - protein, 44 aa, Myxococcus xanthus
MLTGVMVGLCLGVQGAALTLVPGKGVPEDCCGAAGRPVKFILDE

SEQ ID NO: 14874 - protein, 186 aa, Myxococcus xanthus
ARAHALLHVDREADAAQAADKALAMVETTQRLSRFLPLALDRAALYNLAAGRFERALTLYDRELPLVEASPQDEEGLRNRMVVRLARGAAALGAGQPQRTLEDLEQVERDLATPGVRSALKWAHSTPEHVLRSYRLIASGLRANAETRLGRLDAAARALETRRKLYLTQLDQLVRDEHIRAVALGE

SEQ ID NO: 14875 - protein, 601 aa, Myxococcus xanthus
MDASHIALVSRTTIQGDLHLSRVELGGEWRVTPLLERNLTSPTLSPDGRWLVYVPIERSVRQVGPGFAARAAPHLEALRLDAPGAKPVPLSLDIPGQTGQPTFSRDGRYLYVVQFFTDSNADGVIDASDSGVLFRVPFATERDDAAEQAAAANPDQLTSASWNCQYPAPAATALAATCSRAQSLDVYQMPLDGQVPSAWDARRLSEELRMVGRRADELLLYRHRLLLETRPRLRRLLMMRMSMLHLAYEDFSAAEFYARHLGSVSDPATAGLEEPLRVLIEHRRAMKERERGRMVEELSVAEQKRMAALDPANAPSPAAAVFQRVVRSELADDAGDFTRARKELEAAEIADTTPRAVLEAYHARADALYRKLHEREPLIEAGRRLSEHRIFPADDQLDFARAAVRALYRGRPYDEADAAMAQALTTAPVGSAYAYALELGRHINALRSERPPRAVREALLGFYRQQKDPLRRRVLVQDAVERAAGLGADGIMESLAMVYVDDTPPGSEERRRAERLFRRAIMGRAYRRLARQRQDMARADFDLVTQRTGSLESAVEAMNLRLRAGVSPDVVEKEVTTTAPNMPKPLAHFVKAYVAVRQLSK

SEQ ID NO: 14876 - protein, 155 aa, Myxococcus xanthus
MVDRATALEEQASGSFKDVEQRLARAGMNPTPVPFTPNQLEELGIQPTPLVENIGRTPADRVDDLLRRHCVGEGRDGLLVNTRRRCQAGRMTADDVALVERVNRSRQLLWKWMRSARPDVPEETLRRNWHKVHAEGVVCGGWVEAEDGTWGEKQC

SEQ ID NO: 14877 - protein, 234 aa, Myxococcus xanthus
VIDEAHRQGLRVAAHIHDLEDAKRLVAAGVDVLAHGVRDMEVDAELVDAMKARGTWYIPTLGLNESFYIYAEGPAWMADPFFRRALSPDLARQLDDPAWRASVLEDGKTAPVNKKALTINLKNVKTLHDAGVRIGFGTDSGATPVRIPGFAEHRELKLLTEAGLTPLQAIRLATANAAELLGLKDRGVIEAGRRADLVVVQGDPSTSIDDLSRIESVWHRGKQVPGPTSAPAQE

SEQ ID NO: 14878 - protein, 899 aa, Myxococcus xanthus
CCQAADIELGRLLAVIPAEWRPFTLERGKVKLDTQDVTLSAMPQLGPRGRLGLDVDVASLRVTGEPVRLALGGGRVTLVATPDPRQGLSAQLTFGIDGLDVGGPTALRIPKAHGEVKGHQLRPEPSSPLQVAGNASLSGMVESLDLRTPDLRAQAERMGFQLSAPLAAAPPLALSANVPVGALHVSSPDGRTLLKGPVRVKLDASNAFPQLDEPQLSRGRAQLVLDIGDIQASLDATKDTDAVSYTLAARTPDLAAARPFIPDSVAARIPWRHLGVSLDSKGSVKALFSSAPRLEHRTELKLQRPAWDNVTASDVAVVMRSRGDAWRHQGDVDLRIEGLRTGEKDMGLQHQTLTLDLNRRKPAFRLGLTSHEGPKVMLDAAAAFDRKARALRIDVKGDIPPLGPLAPLLAMAQVPPELDAGRLAVGIELHGTLRGVLTGVTADGTPRLAPDPARTASFDGTAVVSARGLRWRQDALSLNVPALHWQLASRVEGPKRTVHSDLRVEKLTVGLSDRRLSFSELTSDTTASFAEALEADDIELKQHLKLRALEQNPALPYPVQDVEATFSARRKPTGVIHVPQLQLTNAGTSTHLKVRGRLDLSEDRRRLGLRGELSQDMARLARPGMLEGSGKVTVDFRVGSPDLVVFRTVSNLLLQDLNLRLPEQGFEIEGMDGNVPLTENLEFSEGQLRLLSDIDVNPYPMLRFADQHPLLSRSGYVSAKRISTPLVAVAPLAGNLSIDQHVVSMTQLEMGVRGGRITGQWLLDWQGKHSTLEARVRATGVQSSRGEPFDGNAAVVISAKDRSINGRAEILRIGNRHLLDLLDIEDPRHVNPATNRVRYALRLGYPEHVRVSFNHGFGSLRITMGGLAKLLSIDEIRGIPMGPIVDQLIKSMTPPETTP

SEQ ID NO: 14879 - protein, 236 aa, Myxococcus xanthus
MRLLDFLRGRDGTTVAEISEALEVSARTVHRDLATLREQGIPLSSDTGPGGGVRLERDRGVAAVHLSQEEVVALWLAANLSATGSTLPWGGAARSGLQKLFASVPKERARGMRELCRRVVVGRPASARVLKDVGTPPEELLAVFERAFREQVCLSFEYRDRHGKATRRIVEPHGLLVESPVWYVLARDVEKAAARMFRMDRIRRARLVPDRPFTPDMEGLRAQADAQRANGTRAPG

SEQ ID NO: 14880 - protein, 250 aa, Myxococcus xanthus
MSLPAPFLFRRDALRDRRATLAMLVVALADAANTALFFAAMERGPVSIAVLTHYLAPLLLALLAPWVLGEERSTRALIGGPVTLVGLALLIGRPDGDFSGLTALLGAGSACFYAIIVLAAKQAARAYSPMAVTSLHAPISAGVLLLCFGDRVLPPTVDGGTLLVLVGGIVCGLIGNILFHTGLRHVPTAATAALTYLEPLTASLVGWAFFSETLTPVALGGGLLVLVAGAWVAAERRATLQAVPLRAAAR

SEQ ID NO: 14881 - protein, 157 aa, Myxococcus xanthus
MEVPVRRLLTRIHAPPAELAPLQEAGAITEAGWQVFLVRSLTERSAAQAMAAYVSEATCALAAELDAEVLGLYVDVSGDTARICRCGPEDGPETFAGRRQAALNRTAEWLEVTPVSLSALFHLDLPDAEYEPDADDRFVEEKLREARTLMERYRQGK

SEQ ID NO: 14882 - protein, 394 aa, Myxococcus xanthus
GPLFAYSLVPVLSVSLLLFFTAVLRGHNARGLTLYCLATAGWTGALLLLCIPSMAWVGERFVAGGAFVAAAYLHSAYDVTRQRSYRLVVLAYCVAVVVTGIGAFLPNVLHGPLAMGRGPLFWPTMMLAVAAAGVPLVHLSRAYRGEAPERRPILLSLGIAGLLAYLGSIGNALLLSGGYALPFGMYLVLAALLVLVHVINAHQPAADRRLLERSLVYSAVAAVLSAGFLFGVLTLLSGSGQPFLTEYRVGAFFLLALAALAFEPVRQALQAWLGRRLLKGRATSDELAVALAREEARADQSARLAELGQFTSAVAHEVRNPLGVLAAHLKLLERRGGDPDTVAAMREQIDRASHFVDELLRYGRPRPLDLRRVDVSATVALAYSTARQGLGSLA

SEQ ID NO: 14883 - protein, 247 aa, Myxococcus xanthus
MEQLARAGRFVIRYDHRDTGRSSHGVPGATPYTLDDLAADVISVLDGYGIERAHLVGMSLGGLLCQLVALKYPERVLSLTLISAQIFSEPDFEDPGMDPAVLAHFQRAATLNWSDEAEAIGFQVELSRLCVGRARRSFDEARVRARAVQDYRRALAPQCALNHAGLSGGLEWYGRTREIEAPLLVIHGSVDPVIDHAHGVALSRAVKGACLVTLHDAGHDLHPDDWETMTRAITAHTSAASPPHGAR

SEQ ID NO: 14884 - protein, 150 aa, Myxococcus xanthus
MSRAALIQRFKNKEHLYFRLMERTAEQKREYFAGLPVEVGAQGLWRFLKTLVSVMGEGEALDAHLLLAWEDVRDPTLRRMAHERNLLVRDAIAVRLPPSVDRGAVSALLQDVIAGATMQWLVERTPPLTEYVLARLRTLLGCVFPRESFD

SEQ ID NO: 14885 - protein, 120 aa, Myxococcus xanthus
MAVLATEAWSAVVEEAWSPMLAPSRPEVRERILSEMRATSQEGVRGGLGALLDFDPVTPLRRYSGPRLSVVTAFNEEPGSYHHLVPELPHAKVEGTGHWVQLDAPDEVNRLLDGFLATVR

SEQ ID NO: 14886 - protein, 204 aa, Myxococcus xanthus
MSAYAAVARAPRTLTEKEVALLLRATGLHKDGFRDHCLYSLALASGLREHELVALNIGDVFDERGRARRHVTLTVFKGSRRHPGPQEVVLSDTVRAKLEKLLRLKRAQGHDVSPQAPLFLSRKGLRLSTRQVRHGFAVWQVRAGLERHLNFHAVRHTACTGVYRRTKDIRLTQKFARQRSVDSTAIYTHSSEDELVRVTNDLPC

SEQ ID NO: 14887 - protein, 107 aa, Myxococcus xanthus
MNLAENLARDFPQVVEENFTNEAKERWATDFKILLQRRDVTLPRQRELVGQIHSIKRRVLPSGKVSFDAERTNRGHADKFWAVALACQRERGPERRGGTEIGVRVIG

SEQ ID NO: 14888 - protein, 32 aa, Myxococcus xanthus
TPNSRLPTLVYRGVTLEGGQASALETLFSANV

SEQ ID NO: 14889 - protein, 205 aa, Myxococcus xanthus
MSIISEPGLYRAIFAAKPHSHEKAEKVERFRRWVTHTVLPSIRKTGSYTAPGAPSPQPRPSPLQVQVLAHLEVARTLASFVPGLKPELAAACALDAIHRDTGLTMEPHRKGLPAAAEPPARLNATQLGQKLGLSARKMNLRLAACGLQGRNEREEWELTDAGREYAEAVPFSRNGHAAYQLLWRPEVLGVLEDAARSSAISVGLG

SEQ ID NO: 14890 - protein, 329 aa, Myxococcus xanthus
MAQKKPLKKLGRPTKAEGPRLPHDEVDRLLVEGEEVPTTRGRVKRRFPSLRELAERFGVAHSAVARYAQQHDCLGRRKRLLAGQQPDETPALDEAPAPAEAPPPPKRKTGRPRKSEEPALPRQELDRALVFGDVKTLPDGSTMTSYASYRELAERFGVATSLVANYAKEHNCLRRREEAKTRIATKADQKLIELRANAIAVSKDDALKMIDGYLLGFEEALSEGRVRVDNPTDFNTMVRLKEFVMGGADSRQELHATFSLEGLQARHAQALRAARETTPAERGEVDAEVTASDAEDLDTAAPESPKDDALVAPPKDVAPPPTPIESAHR

SEQ ID NO: 14891 - protein, 114 aa, Myxococcus xanthus
DTYTQSQLAEWLPDARPATPVESPRRPSVRRSFVRRDAVLVHLARATLPRSDVEVLMATVVRREKLRAYVSRLVEGDTTEVERVYQRLKRQRTRLMQRLRTQDVDAAVQPPGGC

SEQ ID NO: 14892 - protein, 98 aa, Myxococcus xanthus
GLSMTSNLSLVDAAFHTGIFVAPQSGWVGSTLAHWLSNGVEFDSDESGGPLVDLDTLMPGECAVDRGTDLRLPYCGTAPDIGAVASDCPEATTAALME

SEQ ID NO: 14893 - protein, 163 aa, Myxococcus xanthus
VIRRIDLVRKAHPVTTLQGDWLYRPSGVTVSAHGNTLFVVESGMSRVVRIRDGLTSVVAGTTPGFRDGAPESSQFLPYLGIAVLKDGSLAVSDPGNYRVRRVVLNADGNARKVTTLAGSGRYGHSDGPGDAADLVLPAGLTVGPDGRLYVADAGNSLVRAITP

SEQ ID NO: 14894 - protein, 45 aa, Myxococcus xanthus
SDPGPPTPDPPQIALTVPASIISDDKFQVIVTVSGLRGRLDAQRQ

SEQ ID NO: 14895 - protein, 446 aa, Myxococcus xanthus
MTLTLERNDIPYATAGLAANLSLNAVATCSDGRTNRSQPAPVSYFPVQRRIVEPQNAGQVVTDHFVIDGTSANPTFLGCGVPPTEISTLYRVNLSGKVTGTVGMPIACTPETVITERNPISGKRWVWTPNVGAFAVDADLRITARTTTDIGPTQLTVLPGGDAIIVNRIDEVRRLSHNPDGTSESVAEVKWLYAPTTLESVIAPPLVRADGLILIASLGTGPDASRTDVTVTELYAGETGEQGAGGTARAAYKLRTFARNERLPLGAFNDTGNTLFLGLQLGSEQSQVIACAANQDECKGARIQWTSPALPVPVAHILYHPGASRLVAVGQQRVWFLDASGQIRNRDNRSIDANGALNVLQVLRRPNSPELFLLNAPARGLDGAPTLPNEIVAVDQTSGGEARELFRHQVVGSLGGAIDPEGRLWVRTGFDVVQTLPLSDYRRYRP

SEQ ID NO: 14896 - protein, 841 aa, Myxococcus xanthus
MRYSLLAGGKRLRPVLCLAFADLVARGSAVSAVAGDAACALEYVHTYSLVHDDLPAMDNDDYRRGRLTNHKVYGEAMAILAGDALLTEAFTLVASGPESMRAALCRELAVASGAAGMVGGQVLDTAEDRPSALDYLIRMHRMKTGALIRAACRMGVLASGGDADALARADTYGDAVGLAFQIADDVLDVTATAAELGKPAGADAAAGRFTFPAVVGLEASRTLADQKVAEAIAAVRPLEGEDGPLAALARLHGGAEVLMSELLSRIGSPSDVRALPEEALPLLCQELREDIISICGRVGGHLGASLGAVELIVALHRVFHSPQDALLFDVGHQTYAHKLLTGRRDRMHTLRHAGGIAPFLDPRESPHDALLAGHSCTAVSAALGVLEGRRQQGHRGHVVAVLGDGGLTGGLTFEGLNNAGGSSLPLVVVLNDNQMSISANVGAIPALLRTREARDFFEGLGFTYLGPVDGHDLPALIRALREARASSRPVVVHALTLKGKGFPPAEADTQTRGHAMGPYEWRDGKLVRSRGGQRTFSEAFAAVLEDAMARDPRVVAVTPAMLEGSALNALKARFPDRVHDVGIAEQHAVTFSAGLASAGARPVCCIYSTFLQRAYDQIIHDVCLPGLPVVFAVDRAGLVGADGATHQGTYDVASLRPLPDLHLWSPMVGEDLAPMLDTALAAPHASVIRFPRGTLPPLPEGLGAGEAPLRGARWLLRAEQPRLTLVTLGPLGIAALEAARGEPGWSVLDARCASPLDEAALLEAGRSGHVVVAEEGTTRGGLGSAVLELFAAHGLMARVRLMGMPDAFVPHGDARVQRAEQGLDAEGLRRAGLALLAGGGR

SEQ ID NO: 14897 - protein, 126 aa, Myxococcus xanthus
MSKLKITIVDDDRDTRELLAAALEYEGFAVTMAANGLRLIASLQLHRPHAILLDVNMSWIDGFELCRAVKKNEQFRDIPVIFISGRGEPEDKRHGMAVGAADYFVKPLDMDKLVSRIRELVPAQIP

SEQ ID NO: 14898 - protein, 118 aa, Myxococcus xanthus
MEVAKSDKAPKADKVAEAEVPEQYGDVVSRLEETVGRLESGNLSLEDSLKAFEEGIRLVRRGEKLLTEAEQRIEQLLLDEDGNDVVAPLSVAARPAAPAPAAPRAPTPRPPPEDDVPF

SEQ ID NO: 14899 - protein, 206 aa, Myxococcus xanthus
MSRPRLLPEPVGLKFVTQETPPDWDAEFGFSGPLELEIGSGAGGHALEYCRRHPEVRFVAFEWRKKYARDTQDRADKAGLRNLRVIESDARFIVPRIFAPDSLAAIHLQFPDPWWKRSHAKRAVIQPAFAELLYGKLAPGGLFDMRTDVQDRGVTMLAILESVGFKNPLGSGVFHPYDPEEVPSTRERRYLASGEPVYRARLLKPA

SEQ ID NO: 14900 - protein, 221 aa, Myxococcus xanthus
GLERRVLELREEQGQLASRLEDPRRAINHQRLHLSEQVESMMRVLRPAVRGHREELRSLTERLQRARPQARLGEQRAHLLKLAMRLSEAVRAGVATRHGALATARLGLERASPAAQVSRERARLAAHRARLLALQQGALADAQKRFQRLEGRLDAMSPLKVMSRGYSVVFRQRDGAVVRTGADVQVGERLGLKLASNGAKSLGGCEEIEATVTAVKGPVDC

SEQ ID NO: 14901 - protein, 911 aa, Myxococcus xanthus
GGDAITITASGQFAFATPVAFGASYDVTVEAVYPVACTVSRGTGTMGNQPVTNVSVSCKTTRFSLGGTVTGILPASSVELTTGTESIRVNADGAFAFVGPVDDLSGYSVTVSSPPMGQACDVRNGTGTVSGANVTSVVVTCWALEYSLGGSVAGLSGGQSVVLKNNGGDALTVASNGSFTFPTPVSYWSTYAVTAEARYPLICSVPNGTGRIGVGGIADVVVSCTTRSFTVGGEVAGLVEGTALELWNNEQERLTVSANGPFAFLQPVADLSAYSVSVMTQPEGQSCEVRQGTGTLGGAAVTSVSVVCSPRSYLVRGTVAGLGDGQSAVLRNNGGDDLTVSADGAFAFPTPVAFGATYSVTAQATAPLVCTVSNGTGTMGEGDVTHIEVLCGTASYPVGGSVSGLAEGAMLELQNNGDEVLLVSANGAFTFAQQVAEQGSYSVTVKTQPENQRCAVSSGGGTVSGAPVTNIVVTCENVYRLRVSVSGLTGTLGLKSGADTLTVATDGESSFPLPLRPGEAYAVEVSRHPTGQTCEVVSGGTGTMGEAHVTVMVACEANAMVVRVGAGAAALNTNATEIFIDEYRPMGGAPVRTFAIPASSAAGAARLTVAGSDVHQGYLSRSGNGRLLTFTGFDADVGLANVSGTAASETPRVIGQLDLAGTFTLPVRLSDAYDRDQVRAASTVDGTGYWLSGRGGGIRHALPAENTTVSTAISTGVTDTRFVSLFDGRVYFSLGIPPSPNPQGYNQGVLTFPTEQPTAAVAPNQLPSFSTTFNSSGFALLDERPEVAGVDTAYVSINLNQNASQGGTPDTLRLEKWTFDGVSWSKVSSFVPTFAVAGTTTVRIATHGVSAVRTPRGVRVYVTTYQSSGGGAGNLLVSFLDDGSSSTPSVRVVATALANTSFRGVSASPLP

SEQ ID NO: 14902 - protein, 639 aa, Myxococcus xanthus
MMLTAMATRSDGTTVDVSNEATWSSSDASIVSLNKRVASGAALGGGRVTATFASVSGGTEVTVSEAAALAVTPAASMLIEGHPSQLHAEATLSNGRTQDVTASAAWTSDMTDVAVVSMTASTRGQVTPVGQGSATITATFNGLRGTGQVSVSKLSITSVVPTFQTMEDGVVSFTARITKALPPSTRLRWRVSVIRHNPPADLHLPPTDSPVVGQPVRYFSGAAGEVADRPETWTGGSETDASGAAYVGQDAGFEVVSTGLQGAEGHTYSFRTRFAIKGDYSFHLELFEVGAGGELVRIGDATELSATVGTMRATDDSELLLFTASPSAEAQTEEESFPQAFAVRPDGSQFRQITQAPTPFFSPRDVHSEVIRSPDRKSVVWVDGRDKFGGIYFQGLLYIADADGSRVRRLTQASSSLCGERMPEYSPDGQWISFMRSCSRDPYPGRDGLEFTFIIRADGTDERRVLISGINDMPPPVPISPLVFSSFSRDSKTLYTVQYATKGAQLWAFSLEDGSARSIINFSVQGQEMASIVRFPMELPNGDLLYHYWNEDVWTDTWLERIRPDGTGREIVRPVMRGSRGELLQSLFTLSPDGTKVAYTERDPVTGVNTIMVSNIDGSEAVSMKNPPAYFVRRIFWAR

SEQ ID NO: 14903 - protein, 52 aa, Myxococcus xanthus
  unsure (1)..(52): unsure at all Xaa locations
SPATAARLQLDALAPFHGGRSLSQVGTSVASVRRSPLGSSVVTLXQEVGGVQ

SEQ ID NO: 14904 - protein, 521 aa, Myxococcus xanthus
AIRYALPNGLTVVFEEQHAAKVAAFQVWVKAGSADERPDQAGLAHLHEHMLFKGTERRGPGEVARDVESHGGEINAWTSYDQTVYHIVIASQFARMGLDILGDAVRRSAFHAGELSREIEVVCEEIKRSQDTPSRRASRDLFSTAYQVHPYRLPVIGTDESVRSFTREKVLEFYHRHYTPKNLVLSVAGDLREAELREWVDDIFGGDWGRPYEGRVARAPEPVAAGRRILLRPDEVKEAYLHLAFGIPQADHEDVPALDVLAMIAGQGDASRLVREVKRRHNLVNDIHTFAYTPTDPGLFSASMTLQPANAVRALEEAARGLATLRATPVTAEELATAKALVEAEAVYQRETVQGVARKMGFYQSGMGSLEAEARYYEAVRNLTPEHLRAAAERYLRFDRAVVTGLLPEGTPLTEAQVHEVLDAVDRAPAAAPPERKPRKVAVSDSPVRILKGTSAGPSDIITEKLPSGATIVVRVEPAVPLFAIRAAFAGGLRYETPEDNGITTLCSPAAITAGGNAGRH

SEQ ID NO: 14905 - protein, 134 aa, Myxococcus xanthus
AEERTCTLELKVRQREKRIVFEDGAPVACQSNLLHETLGKYLVEKGKLSETDYQKALAESISAEVPLSGLLVQKGLISPFDLYKQLQANLAHKLLDCFRWVDAKYRLIADVEPPDASVRTNTGQLILTGVAHGK

SEQ ID NO: 14906 - protein, 276 aa, Myxococcus xanthus
MSKWILWLFLTLLTGSPLLSLGLIIVIIFVADRFTWQVLPSPVRLLKRFQRAGQLAGTILTNPHERRARHELADIRVEQRRYAEAVDILKPNLEAGDEDVDTLYLLGVAYLGAGDAQRGELLLDEAAKLDPDHKLGAIDLERGRFRLKRGDVPGAVEALERYCKVRHGTVEGRYLLAKALSRAGRGDDAKRMRDLAWSEYVVAPRFQRRRERKWAWRARPSRPLMYAAAVALVLSLLASMLPRFVITPEGDYGGRYDHGAYGEPPSAVGMEEYQGE

SEQ ID NO: 14907 - protein, 401 aa, Myxococcus xanthus
MPFDAPVDALTGMPAARFGLYLHFPYCLAKCPYCDFAVAVARQVPEERYARAVLAELDTRLAAEPSLAGKVLDSIFLGGGTPSLWHPRYVAQVLDGIAARLRVAPGVEVSLEGNPERADAERFAGYRAAGVNRLSLGVQSFQPETLKALGRAHDAAMVEGAVDAARSAAFPVVAMDFIYGVHGQTVAQVEADARRAVALAPEHLSTYALTVERDVLAEDTPLSKRLKRGELELPPDDTVVDMARVVREVYGAAGLHRYEVSNHARPGFSSRHNALYWTGGEYLALGVGATGMLLSPQPHRYVNLRSAERYLVEAEAGRLPEEGREPLGPEELFAERLAMGLRLVSGVDWEAVCERYGQPVEPRRAEVARLVAHGFATLRDGRLALTEKGADVHSAVCARLL

SEQ ID NO: 14908 - protein, 639 aa, Myxococcus xanthus
MGGSPEDKLEYFRAVVRQKTETLARARTLYAERDGELNGVKQSLTLARKELAESKASVSAFQEELARAEAESQSRLASLQDELSAVEADRKDLSRALAEVESDVPRLTAELQEEREARGAVAEELIGAKEALSLAQDRVAELAAEKSEAQGALEAVQEQYQQAIADVERLTSELEAASAEKDSLGLRTAQLEAALEEAQSGLSALESESDWSKSSLEEAQGRAGTLEAERDEARKQLAVVEDGLRTLQEQVAELERSLALKDAEIVGLRAALTARTTEAAELPALRQALEARTAELAQLKAKLEAEAAKAEERSQALEEGLAQASERAHLAEGEAAALKEALEAAEVEQVSLRDRMEADAAALGEAVQQAETKVSELTAAVEAAHADHASWKEQLAAVELKAATKDAERVGLAARVSMLEAASGQREAELVRLQAEVAKAHEALALERARREAAEVERTDAEVKAAQAEAQVESLTVGQGGAEAQVASLTEELEAARAEADKVERLQGRLKMMEGALEGAKAQAAAAGKSDAARAATEAKLARAEASLKAEEQKRADVESSLRAEQEARRALEAKLAEQPGTPSQSAGAPADWEAEREQLKADAANLKRKLVAAETALENAAGYKAKIARLEAQLKGKR

SEQ ID NO: 14909 - protein, 161 aa, Myxococcus xanthus
MRELERALHLMSYLEADMICAFRFDRTSEGAKRIIYSFVYNMLIRSLFDIQIKDVNFSFKVMHRRVLEAMELHSQGSFIDAELVVKAIRQGFRVFQMGVDYFPRTRGVSTLASPSVITKMVRELVKLYPKMRAPQPPVHPVRLPPSVQQLHAVPPGRTARG

SEQ ID NO: 14910 - protein, 347 aa, Myxococcus xanthus
MADGERKRTLEVARRAPLAGELSGRTVLLVDDDPVHLRHVRDGLAPHGYVFTEAHDGAQALSAIRESRPDLILMDVEMPGLGGVEVCRIIKANAGEDGFGFIPVILMTARQAAGKVEGLELGADDYLVKPFDMLELSARVKSMLRLKALQDALVEKNRELDRANKELAARREELLALTRTDALTGLSNRRAFEERLNDEFARSRRYGAPLSLVMLDIDHFKRINDSFGHPFGDHVLKAVAQTARARLREVDLLARYGGEEFIALLPETGPADALRVCERVRDAIAALELEHVGGSGKPQCVRLTASLGVATVPSGDLPSAEALLRAADASLYAAKGAGRNRVHQHAA

SEQ ID NO: 14911 - protein, 234 aa, Myxococcus xanthus
LTGQADQQAIEEAINRSEIFRFISKPWNDSHLVLTVKSAFEQYALQAENERLYTVTQAQNAELKLLNADLEERVAQRTRMLSQAKREWELSFDCMETPLCVVRARDFAVRRANLAYADVAGRSIEEIPSDTTCYRYLFGRNEPCTGCPLPAAVESGKGARGEVRQGGRTFVVAAYPIAGDERVVCTYRDVTEEQSMTRRLIETEKMAAVGQLAGGVAHEINNPLGGILAFAGEH

SEQ ID NO: 14912 - protein, 186 aa, Myxococcus xanthus
MASLAAQVSELQRLSSTDGLTGLHNHRHFQERLREEFRRAQRYDDSLSLILLDLDYFKEINDKYGHSAGDGVLREVAAALTRGVRETDLVARYGGEEFAVLLPRTHLTGALTVAERVRRELRALRLEVSDSLQVTASLGVSSFPHRTVLTPEQLLLTADEALYQAKRDGRDRICLHPQLPVGPLGT

SEQ ID NO: 14913 - protein, 222 aa, Myxococcus xanthus
MSDLIEQALLRYDGLPVAERFHVHARAFSAPLLAMAARTPVGAVADIGCGHGLLSALLALEDPRRTVHGVDPDSRKVAWARRALAGQPNVRIEEGTVEETLAGGASGRFDAAVVCDVLYLLPEPKWPGFLSTVRDLLKPSGRLLLKEVEGDGSWKHRKALAQEWVMVSLLGRTKASGGMALKPRAEMTRYLKDAGFAVREVVDLGQGYTTPHVLYVAENSVP

SEQ ID NO: 14914 - protein, 377 aa, Myxococcus xanthus
MARSASRTIVLVVLSAVVACGAAATAGAWRFFHKDPNNPVVRLDEYFTMGWVAWDSSWYMRIAQEGYQFAPGQQSSVAFFPLYPLLIRAVESLGPNVYQSGVLITLLCGPLALMLFTVWARKLTDEDTALKAGLLMACYPFTLYFYGAMYSDALFVLLVVAAFLLLERGHLGPAVLVAAVATAARPVAPAVVLGLLVRRLEWKHARGEKWSAVDFLPVLSGLGFGAYMLFLWHQFGDPVAFVKVQGSPGWEQIPGWHTWLKVSWFERVVLAPQDKREAFRLAAHAFFTLLALALVWPTRKLLGWGYAVYVLAIVGLPAWSTKDFMGMGRYLLSAFPVFLTAAMLLRERPLLLRGALAVGAASLLVLSWAFGADYYVS

SEQ ID NO: 14915 - protein, 84 aa, Myxococcus xanthus
PMVNEAIRCLGEGILRSARDGDVGAIFGLGFPPFLGGPFHYVDSRGPAEVLRKLEHYHDKLGERFAPAPHLVEMVKAGKTFYPR

SEQ ID NO: 14916 - protein, 299 aa, Myxococcus xanthus
MCRTCGEGGSQAWCPACRQREGVGQAFPLTRENWSVSGLMDLSWDAFKREWVMLCVGVLIFLAGSFAGQVVSQVSSMVGGATGSTVITVLGFFIGIIGSYAIQGGITLGFLRMSMDVLSGRRADLGRMFSQFGKIPTYLGTLFLSFLLMLPLLLLIVVGAVGAGLATGTVSWSELVALKDLPPSELDSAVTPMLPGFAVMGAVAFALYVFPGGWLLTPLILMQPELARTESPGAVETLRRCFDYSRGQRLPMIGTVLLGGLLAMVSVFLCCVPVIPALGFLQLLMAGLVMALSSGAEEA

SEQ ID NO: 14917 - protein, 476 aa, Myxococcus xanthus
MSAPPLHPDDIHTSPGDVGQDLNHSPLLGETLVVDPRTTVKLHKCRLAVTSGPDTGRSVVSDKERLRCGAHPGNDLVLVEDRTASRHHFEIQFTERGYLLVDLGSTNGTFLDGRRIERAYLSPGSQIRAGSSVLTFAPLDEEVTIEPDREGELCGMVGQSMKMRQIFGLIKKIAPMGVSVIIQGETGTGKELVARAIHELSGRTKGPMEVLDCGAIPPNLIESELFGHEKGAFTGAVSSRPGAFERAHGGTIFLDELGELRLDLQPKLLRVLENHEVRRVGGNDVIEVDCRVIAATNRDLMKEIQVGGFREDLYFRLSVITIQLPPLRQRRDDIPLILKRALADPEVVGKHGKKRFSAESLGLLMSYSWPGNVRELMNVLSHVLTFSEGEEIQPAHLPPRVRGQVREGPLPFNEHLSFKNAKEQLLENFEREYITSVLTRCEGNLSRAARESGLHRKSIERLVKKYQLDTKGMKSR

SEQ ID NO: 14918 - protein, 239 aa, Myxococcus xanthus
MVFLILGTLQLFLMLQGRLLAEYAAFRATRVGSVNHGDCQAMTHAAILALMPSYYSFLGGAGGSPGQKLANAFAARRDNQYNGATGRANRVSMPDGNHTGAIVWIIRDSPLATAVPNEDALFDQFDNPAGIVRLETRLVYWFPLKIPFANWVIARLTMARWGWRDYTNQNPLMQTQRARWTQGPPSMGLEGLIREEALRRMNSEQYVIPIHASASLRMLTPVQRRFFQTQNCAPAPEAL

SEQ ID NO: 14919 - protein, 100 aa, Myxococcus xanthus
THKLLSRGQTLVLFALTLLLLTLLVTLTLSFGSKVKEKMEVQAAADAAAYSQAATTARVFNEMALMSRAQIGHLVSKAAVNSLIDWSSYYRAQIGATRKC

SEQ ID NO: 14920 - protein, 223 aa, Myxococcus xanthus
MKTLHKPLQITLYQDVLCSWCYLADLRLDVLRQELGEAVRWSVRPYPLRVHDVLPTTREQRALVEEVERAQREPDAAARMLSTDLWLGGDPPRTSVPALAALEAARLQGPQARAFLARAMQRAALEQGVNVSRPDVVFELASRVGLAMNEFSAAFRSEETRRLILDEHRDATHRGVRGVPTLVIGGRWMLCGLRELAEYREHILACLGKVSVPRSGSPERVVH

SEQ ID NO: 14921 - protein, 133 aa, Myxococcus xanthus
MPWLVALVLLLSLGGCNRPRFGTPQDAYTSFHRLVKRGELQQAWGALSKPTQDALAQRAQVVGEASGGEEKPEPMALFFANVPPPPDVTEVSLVREEGDVATVLVRAGESSHEVRMVREPSGWKVDLSASLQP

SEQ ID NO: 14922 - protein, 329 aa, Myxococcus xanthus
MSPRKVKPKKVPVLPGSQAPDRPERAPRRGHAKKTVVILSRKRALYSTRRLVAAIRARGHRPLVLDTLRCCLLLAQDAPRMTYRGVEVRGVDVVVPRIGASITAYGLAVVNHFEMMGVPVLNPPTSIARSRDKLRALQYLSRSGLNIPRTVMAHDRSNVRRLVEEVNGLPVIIKLIKGTQGVGVMIAHTLPEVQTILDTFWDLGQEIVLQEFVAESEGRDVRALVVGDRVVGAMRRKAKSGEFRSNIHRGGEGQAIELTAPYTEAAVRAARVVGLEVAGVDMLEGHAGPRLMEINSSPGFEGLERATGMDIAGAIIDHALKYAEAKRAG

SEQ ID NO: 14923 - protein, 113 aa, Myxococcus xanthus
MNGHLDGGFIPVATLDVLDARGRAVVQVDGVAVALFRVNGELHAVADACPHRAGPLSEGDLVGYVVHCPLHTWPFDIRTGQCPRHPGVQVRTYVVRVQGQHILVSASGRVHAP

SEQ ID NO: 14924 - protein, 175 aa, Myxococcus xanthus
MARAVADFLRAAGLNLQDVHLADTPTRVAEAWAAEFLDGYSRTPEQALGETFPAPPGSSGELVVVTDLRFHSMCPHHLLPLTGRAHVAYVPGKRVVGFGRLSSLVDCFAHRLILQEDMAREVARSLAQVLGSPATACIIEAEQACLRLRGDKQRDAVTHAEAYEGTLRRDGPLRP

SEQ ID NO: 14925 - protein, 472 aa, Myxococcus xanthus
MIAPLPRVEPERVARVREALAAVLAPEQLRVDDAALAAYARDESDSGVHAPDLVVFPADTRQVSEVFKACAVHGVPFTPCGARSGKSGGSLPLHGGVAVSLERMNRILSISPEDLTAVVQPGVITGDLMKAVEAVGLFYPPDPNSWEVCTLGGNVAENAGGPRALKYGVTRDYVIGLEWVLPDGEVVRVGRRTIKGVAGYDLVGLFVGSEGTLGVATEITVQLIPLPREVLTALVVFPSVLHAARAVSAVLAAGILPRCLELIDDVALRAVDGRGFQFPPGAGSAVIVEVDGNGREGLLAELSQLGDICASQGATETLVAQDASQREKLWAARRVISPALRALKPHKISEDIVVPRSKIPEVIERLKAMGAELGLTVATYGHAGDGNLHANILYEGAHQRPLVEEALRRMLVMTVELGGTITGEHGVGHAKREYLSLEQSPALIDLQRRLKAFFDPSGLLNPSKIFPALMRS

SEQ ID NO: 14926 - protein, 234 aa, Myxococcus xanthus
MANSTKYAAEGLSHYLRNLGGHQQLTREQEYELARRARKGDESARQTLASSNLAFVVAVAKKFANRGARLDDLIQEGNVGLMKAIEHFDPKKNVRFATYAVWWIRAYITRYLKDNRSQVRGGEAERGSMVDFSLDATIDEDGETTFLDRLEDNSPSPQQVFLAHEQDTEIQEALAKVRKRIGDLGWDILTERLTQDKPLTLEELGQRWGVSRERVRQVELKTKNFLERYLHGFN

SEQ ID NO: 14927 - protein, 35 aa, Myxococcus xanthus
VLMESYYPDTTARLVASKIPAPLVTLHGGTDFKAK

SEQ ID NO: 14928 - protein, 368 aa, Myxococcus xanthus
MPGGGSALSIPGVNNPNTGANFLDLSFILDVAAAAFTDKEPLQSGAHDPTRNGFNLQQLELSIGSVVDPYFRFDANIVFSQFGVEIEEAYGTTLALPYNLQVRAGQFLTRFGRINPTHPHSWDFVDQPFAVGRIFGGESNRGLGAEVSWLAPLPWYVEVIGSTTDATGGATARSFLGATSERVQSPFDLQLTGAVKQFFPLSDDLSLMWGLSTATGPNPTGYRNRTDAFGTDLYLRYRPITQAHNTTLITLQAEAFYRRRQVPGDVLTDFITYAQAAWRFSPRWATALRYELGTAARGEDGARVIDPLDPDWTESRNRVSANVTFWPTEFSRLRLQGARDHAGWRDEPGYSLMLALELVTGAHGAHAF

SEQ ID NO: 14929 - protein, 141 aa, Myxococcus xanthus
MNQRAHTFARCTATLLVALWLCQPLGALMHARDEHAHRFCPQHQTFEETALGTGARLSRLAIDQSPQLSALPEAVTDSAALPHEECPLVTSGSRPELLTPYRTTLVLTLLAVSRPATAPPRVQAPLSILDTAPKASPPAHA

SEQ ID NO: 14930 - protein, 251 aa, Myxococcus xanthus
MDKVIVITGASSGIGAELARQAAAKGARLVLAARRKAELKVVAGQCGHEALAVVTDATRRADMERLRDAALARFGRIDVWVNNAGRGITRSVAELTDEDLETMWRDNVNSALYGMQAVLPHFQSRDAGQLVNVSSTLGRLPIVPHRSAYSAAKHALNALSACLRQELRETYPGITVTVVMPGVVATAFGDNALGGGPDSRGLPGAQRVEDAATVILDSIERPRAEVYTQAATQAQVERYYQDVEAFERGGT

SEQ ID NO: 14931 - protein, 435 aa, Myxococcus xanthus
MARHAVLILVVALFRAAAFAAPPPEGFGGHPESLRIRLVTIGPGADMHQRFGHSALWVEDTRLKKGLLYSYGTTSIANGGPVRFLLGRPTFWAARLSVERTFLLYRALARSIDVQDLMLTVEQRQRLLARLERDVQPASREYAYHPLKDNCATRVRDVLDEALGGALREALTEPARATQRELLRRYIQTHPVSELLLMLWLNDAVDAPATQWEEAFLPRELARLLMGVSYVDGSGRRIPLVNREGASSPSMDASAPVDAGWEGTSAWGLGAGGAALAIILAFLRGRGTHRMFQILFGLYHAVFGLTLGAAGVALGGLMLFSRLDVMQGNENLLLANPLAFGLLPLGILMMSGSERAERWARRCVWLLAAGSLLAVVLKLLPSFDQDNRRPMALWLVANLGLGLAHAWRLRRPSTAPAPAAGAREGARGSTRWWAV

SEQ ID NO: 14932 - protein, 188 aa, Myxococcus xanthus
MTVAEFMARKERTQRKAAIKQARGEVENAVVADFLAQLISDKAEVSVVLAERSLLDTLQAEEPIAFTLERTGRLEKLQVVLLARRTDWERLLPGLERDAKLTQKPSAVARQPDKRPHSDPRAFLDHIGQTVRMVLRNGITLQLPLMRVGRFDLLLGEEGHEVFVPLHALLRFEPVTSTSDESAPADEA

SEQ ID NO: 14933 - protein, 71 aa, Myxococcus xanthus
KRLGKVGLLVGALTLGGAVVGCKAEDDTAKKQRIVGSDHLSKKEFKEAAAAYALSLQADPKQEKVWEKKAF

SEQ ID NO: 14934 - protein, 390 aa, Myxococcus xanthus
MLIGLGAVLGHLYVYRRLVRPLVQGRMPRLLAIGVLVLMTGVLGNRRTVLDLLPESAEGLLTMAVYTWMGVALCLVIALLLTDAGRGLTALARRLRPHAPPAPPAPASSPTVDEDRRRFLGQAVAGTAFVAGGGLAAYGSWRAFSPPLITEVAVRIPKLPKALDGLSIVQLTDIHVGHFIQRRYMDALVQQANSLRPDLFAITGDLVDGDVASLGGHVSALAALKSRYGSYFVTGNHDYYSGDEEWSAFLESLGISVLRNRHVPIGDKGASFDLVGVDDWSGGRRRNKKGYDLELALAGRDSDRAAVLLAHQPANFKVAAECGVDLQISGHTHGGQLMPMTMLIGLAWEHSAGLYAHGDSNIFVSRGCGFWGPPMRVGSPPELVKLVLTA

SEQ ID NO: 14935 - protein, 148 aa, Myxococcus xanthus
MLLMTPGKAHAVDGDRQVTHLRVRIVTGSDDLRKASNAFAEFSYTAINGSHISISQNLNNGANWPNGSTRTVDVELPDGVLYSNMREFAIRFQSGQSNPFETGDNWNLNDIRVTAILDDGSETIIVQDSGNPYHRFKSDVNTRRAWVL

SEQ ID NO: 14936 - protein, 261 aa, Myxococcus xanthus
IGSAGVFASVICGIARRLVLEAGTASVHMERARTNLRALLREHHDVRTLLSAARLRADLLLREPLSASAPGHASALVEDLGELSSFIESVKARTLSELTVIEDATAVNVGATLRRAMEVVQARFARVRFELEGTAGLARAAANDVSVRIVGGERGLTHVVTNLFVNACEGDGRQGARTVRISVEPNPALHRVLLSVSDDGPGFRPGLLEGERPRAGTTKPEGAGLGMLLVSGLVEASGGTLRACNPPEGGARVEVTLPTSG

SEQ ID NO: 14937 - protein, 68 aa, Myxococcus xanthus
MSEKASSDWYHAILYVGADIVMQTFVKAIALALLFTGKSTFETVFVKTQDEARAWVAQHRLRLKSKAG

SEQ ID NO: 14938 - protein, 137 aa, Myxococcus xanthus
MQQLEWTFGSHSVRYEAPDVVQATFVGPIDLDEIKRAVDVYGEIAQQYGPYYLIADIGRSQLGAEPRRYLSENGKADWFKGTVYVGADVVQQTFGKVIALGMLFTGKARFETTFVKDHDEARAWVAQHRQKNKKKLG

SEQ ID NO: 14939 - protein, 116 aa, Myxococcus xanthus
LASGTHLTDEAKAILDQGFPTAHVLLGMDPPEHTRLRRLMNRGFTAQRIAGMGPFIREMATTLVDRFAQDGEADLVKQLAWPLPVHVILGVMGVPQEDVWKIKRWSSDWQQPLEHI

SEQ ID NO: 14940 - protein, 269 aa, Myxococcus xanthus
MKRPGLGTALAVVAFLTFFLGPFCWQVLTSLWPDGELTRPWPSHLTLENYASVLWGRPFLRVVLNSLVVAALTTGFCLTVGAAAAFALAKLEFRGKGVLLSAALAVSMFPPIATVSPLYLILRTVGLRDSLVGLALPYATFALPLTLWVLTSFFRALPDELYRAARVDGCTPFQAFRQVLLPLAAPGLATTAILVFIFAWNEFLYALTFLSTPEKRTVPVAISLFASEYREPWGEIAAASVVATLPLVALTVLFQRRIVSGLTAGAVKE

SEQ ID NO: 14941 - protein, 164 aa, Myxococcus xanthus
MFNPEYGVINRLLPGQDINWLGAPGYALHAAILVDVWKTTPFVALLVLAGLQGISEDLYKAARVDGASPWRTFVSITLPLLKPALLLALLFRSLDAFRVFDAIYVLTEGGPANTTDTLSIYAYKTLMRSGDFGYGSTLSVATFLCVVLLAAVWLRLLGREEAAR

SEQ ID NO: 14942 - protein, 426 aa, Myxococcus xanthus
MRRVSSIVLALSLVVGLGVWGCRRQDAAGEAGGRTRLVFKYQPLWGPPEPFRELLARFERENPGVELVTEALPNASDLAHQFFLTSLEGGARDFDVLVVDVVWVPEFARAGWIADLSAEFPPERLREDFFPGPVEAVVVEGRTYAVPWYLDVGLLYYRTDLVPRAPRTYAELERFAREAMAKTPGLQGYVWQGRQYEGLSCNVYEALWGHGGRALSEDGRVLLDDAPAREALAYLRGLVERGVSPATVTGFSEEESRRVFQEGRAVFMRNWPYAWNEAQKPDSPIRGKVGIAPLPTVSGEPGSGALGGWQLAVNAHVSPERRKLAARLIAHLTSPEANRVLALNYARNPPRPAVYQDARLREEAPFIAGLLPMVERAKPRPVTPYYNLISDVLQSEFSAAVAGLRTPEPALKRAQRQVDHLTGEGP

SEQ ID NO: 14943 - protein, 136 aa, Myxococcus xanthus
MRQFISRIIKPWLALAATAAMVGITQQGCTKDADAAKAPAVPEKRENGVRIVELSVTEKGYEPSPVSLKKGEPVKLVVTRKTDHTCATEVVMDGYDINTPLPLDQPVEIAFTPKESGKLVYGCAMNKMISGVFMVD

SEQ ID NO: 14944 - protein, 590 aa, Myxococcus xanthus
SARGWAVSDLVARTWWAARRGLPGLRQARGYQRRWFRADLLSALTIGAMLIPQGLAYAQLVGVRPAAGLYAGVVGMLAYALFGPSRHLIIGPEAGAAILTAAALAPVAAGAAPARYASLAALLALLVGVLSLLGGLLKVGALADFLSKPILIGYINGAALIIIGSQLARLFGQERQSDTFSGQVFEVATHLERTHVPTLLLGLGVITALVLLRQLLPKVPGPLILVVLTTVAGGLFQLEHGGIKVVGPLAAEPPAPGLPSLRFEDVRSLLPAAFSLALVNYASSVLTGRFYADRFRYRLDSNQEFLGQAAANLATAFSQGFPVTGSDSRTAVNVSMGGRTQLVGVLAAGVVLVFALFLTPLLHDLPMVTLGAIVFVAAVYLLEFRAIIDLWRVRRVEAVLACVTMAGVLVLGILQGILVAVALALADLIRRAARPHDAVLGEREGVPGYHDIERFENAETVPGLVIYRFDAPLFFANARHLREQARALVSSADAPVRWFVLDASAVFDMDVTAADGLEKLRREFEEEGVVLGVAEARAPLRALLRRTGLLERLGPENVHATVEAAVHHFLKDADARHARDGEPPALPPVH

SEQ ID NO: 14945 - protein, 553 aa, Myxococcus xanthus
MASKAKPTGNGNGNGKQSRKPNILVIWGDDIGIWNISAYNQGMMGYFTPNIDRIAKEGAMMTDCYGQQSCTAGRAAFITGMNPLRTGLTTIGMPGAKYGLQDSDPTIAEMLKPLGYTCGHFGKNHVGDSNPYLPTVHGFDEFFGNLYHLNAEGEPECPDYPKDPTFKERFGPRGVLRSWATDRDDPTEDKRWGVVGKQRIEDTGALTRKRMETVDGEFLQGTLDFMERAVKDGKPFFLWHNTTRTHVWTYLQEKYRNATGYGLYADAMRELDDIVGVLLAKLDELGIADNTLVVFSTDNGVEKMGWPDGGNSPFRGEKGSTWEGGVRVPCMVRWPGVVEPGRVINDIFAHEDWMPTLVSAAGGPKDLVAQCQRGYKAGDKTFRVYLDGYDQTGLLAGKEKGPRHEFIYVLDSGNLAAVRYDDWKLIFSYQEGEGPDMWFSGKRFDPAWPYLINLRSDPFEYGPKAGLYLKWYGERMFTFVPAQALVQKFAQSLLDYPPSQAPGSLSIGPIKERVKRKLLEARERKEETAIGDQVMALAEQVERFVRRAQQSHA

SEQ ID NO: 14946 - protein, 365 aa, Myxococcus xanthus
MTQVVAPRRSPADFARLPFNPHWNLGRAARLLQLTDDIAAGGVGLPEARARLDRIVAERSPYPKWLVLLAYGVYGAAAAARVGGAWWEMFAALLVGAIAGVIHFGTLVSQRVDLQKSFLAAFLGTLVAFGLRFVLPPFDVVQALFGGAVLLVPAMVVTLGSLELASESVEAGMTRLVYGLLRFLMIGVGIVAATTLWGFLLPVPEYSDVHVLSPWVTFLLLAVGGVALAVCMAGRRRDLVGIVGGVLIAYGTQAGMKAVLGEQGSPMVAAFVLGVAGLLYGRGGLRMPMTVIMPGLLQLAPGFMGTQAIIALLGMGRPGAEDARPFDVLMVALQLVLGLVFATLVVPPRIPVDGDDTAPSGSGSA

SEQ ID NO: 14947 - protein, 871 aa, Myxococcus xanthus
MVVVGRASEVARKNLANSVASVNSEEINRAPAQTVDQALQGKVAGANIQSNGGAPGGGLQLRLRGVSTINGSSAPLYVIDGVLVSDVAIASGVFAITESVAGANANPTQDNQVNRIADINPNDIESIEVLKGASAAAIYGSKAANGVVIINTKRGRSSEPQFEVTQRLGMYTLANKLGTRRFNSVEEVRDTFGEAAVQYYEQGRRFDHEATLAGRRDLSSETLASVSGVTGNTKYFASAMIKNDEGIIANTGYEKQSFRLNLGQKLGDAVEVNVATNLVHSLGQRGLTNNDNASISNYMVLPRAPEFLPLEANSDGVYPQNPFLSNRANPLQTAALVKNDENVWRFIGSGDLTWHLWKTEAHHLRVLANAGVDRFQQENSLFFPPELNFEPIDDGLPGSSLFGTSQVRNLNSGLNLVHTYKPTSGGIVATTSGGLQFEERNIDSIYIVSKNLNAGQQNVDSGTVVNLRQNRSLVRDRGYYVQEEVLLLDERLTLVGALRGEQSSANGNPNALFLYPKLASAYRIPSFHPKVNEFKVRAAYGETGNLPLYGMKFNGLRATGNIAGSPGLVGTGIAGDRNIKPERQREVEAGVDALLFGGDVVAEVSIYQRNISDLLLQRALAPSGGFATQIFNGGSLRNRGVEAMVQVTPVRGGFEWTSGATFALNRSRVTDLPVPAFLAGGFGTALGAFRIQEGATATQIVGNDGVDENGRPIVRKLGDTEPTFRMSFTNSLKYRDFSLSFLFDWQQGSDIINLTRYIYDDAGTSPDFTTGGRERLVRQRTHASTYIEDASFLKLREVTFMYQLPKDWVSMVPAVKSARLSLSGRNLITLTGYSGLDPEVSNFGNQAISRNVDVAPFPPSRSFWTSLDVGF

SEQ ID NO: 14948 - protein, 447 aa, Myxococcus xanthus
MTIQLTKKAFVGLFTVLGLSGCGSLDVPDLNNPSLDDFRERPTRPAVLTAATGLLLGHRAGVAAPNGYVAQLGIIGREAYVFDPADPRAVGELLGPTLDPGGPAFGGNHWTNPYLNIRNANALLDSLDQVPNTPDAEKEGLRGFAKTMQALDFLVVINTRDIEGAPIDVNLPIGQLAPIVGKEAVFERIAALLDEGHAHLGSAGESFPFQLSPGFAGFNTPTTFRQFNRALAARVAVYRGRYPEALTALSQSFLNQSASLDLGVYHSFGTNSGDTDNGLISVNVYAHPSIVTDAEFQENDTVDDRVVRKLTRLPEPRTAADGKLSTEWRFRIYPTNNSPVPIIRNEELILLRAEANIGDRNLGPAVDDLNFIRTTSGRLPPRLDIDENNALDELLKQKRYSLLFEGGHRWIDLRRYGRLDTLPRELDPDIEPHERFPIPAAEMNARQ

SEQ ID NO: 14949 - protein, 518 aa, Myxococcus xanthus
NERYEPQAIEGKWQTRWDDAGIFRAGSRPGAPKKYVLEMLPYPSGKMHMGHVRNYLLGDVYARYFRMKGFDVLHPMGWDALGLPAENAAIKDGVHPAVRTAENIASFKKEIKSLGYCYDWDREVNTSDPEYYRWNQWFFIQMLERGLVYRRFSKVNWCTGCHTVIANEQVKDGVCERCDSPVVDKEMPEWAFRITRFSQELLDALDTLKEWPHRITAAQRNWIGRSDGAEADFRVQGHDTALRVFTTRIDTIFGCTYVVLAPDHELVAQVTTPERRAEVEAFAKRMAAQSKTERLGEGTEKEGVFTGAYAENPFTGQAVPIWIANFVLSDYGTGAVMSVPAHDERDFAFARKYSLPVKVVIQPASGDKLPPGDKLEAAYTEYGVLEDSGAYTGQTSEQARQAMAALLEKDGKGKATVTYRQKDWGFSRQRYWGTPIPIVYCEKCDPDRNGIPVPVAQLPVRLPEIDTQAVLTGKGEPPLAKVASWVNTSCPKCGGPARREAETMDTFVDSCWYFARYL

SEQ ID NO: 14950 - protein, 66 aa, Myxococcus xanthus
KYSPAGFKMRLGLKDVELVLGAARTAEVPMPLASLVKDQFLGGVAQGHGDLDWSALGALVARTGRG

SEQ ID NO: 14951 - protein, 283 aa, Myxococcus xanthus
LRRGLAVNLAASVALLVAALRARDALKVTSFPTLLLFTTLFRLALNVSSTRLALAEGHAGDVIQAFGEFVVRGDYVVGAVVFAILTLVQLLVVTKGAERVAEVSARFTLDAMPGKQMSIDADLRAGAIDQAQARRRRRDLERESQMFGAMDGAMKFVKGDVIAGLVIVAVNLLGGTVIGVLQGGMPLAEAASTFALIAIGDGLVSQVPSLCIAVAAGLVVTRVASEKEEDTLGAEIGAQFFGEARTLWVVAGLCVALALMPGMPHVTFLLLAGGLGGLGHVLS

SEQ ID NO: 14952 - protein, 624 aa, Myxococcus xanthus
MGAVYLGEHVSIGSRVAVKVLHAHLTMYPELVQRFHAEARAVNLIGHENIVSIFDMDATPPRPYLIMEFLDGAPLSAWVGTPLAAGAVVSVLSQVCDALQAAHARGIVHRDLKPDNIFLVRRKRNAPFVKVLDFGIAKLADAHMPQTHAGIIVGTPEYMAPEQSLGRGVDGRADLYALGVIAYQLLTGRLPFNDEGLAAQLVAHQLRPPPPPSSVYPAVSAALEHVILRALAKKPEDRYASIAAFRNALQVALAEHVRVSARKTRPGGLAVLERAPVAPDMPTEGQSRGRLGVDARAGHVPSSLASTSQRRLAPAAPAVPRASLVEVPVQVVLRPGESPVRLRGSGLSRGGLFLHGGRVLPPLCSRLPVVLELASGPLSVMCEVVRVVPPAQARVWGMPTGFGVQFVEATAVLKAAVDALLQGEPVRAVPQVPLTEDPAVARLLEAWRQRSAGDAYAVLALEPDSDMGTVRLRTREAWRSLESLEQHSLTPPQRAQVDALRVRVREAAEALGATVQRALYDAWRGNHRGVAKCLEAGLTAEQLESLRREFLARRPQAMGTARSHFQSGGALERDGQLSQALDQYERGLKLAPLEVDMLQRYRRLRRVLGGRATAPTGHDRARSP

SEQ ID NO: 14953 - protein, 102 aa, Myxococcus xanthus
MYAVIRTGGKQYRVAEGDVVRIEKIAGDVGAEVTFTEILLVGGSESPKVGQPTVAGAKVVGKVLAQDKHRRVLHFRKEKEGWTRRRGHRQPYTEVKVTSIAG

SEQ ID NO: 14954 - protein, 988 aa, Myxococcus xanthus
MGGAAELFTRHVFLDLETTGLDPRVDEVIELGCIFFENGREVERFARLYSASRPLPLTIRRLTGLTDADLEGHPRFGTDIAELREKLSGWTVVAHNAPFEKGFLPDLLGPIHAPVLDSCELMHYLHPELPSHSLESLLRWGGLALRQPHRAVSDCEAVYSVLVHAMERCVREGRGDDVVDLLAALDPRKGAELRLAMEGVGLKDGASGAFDYEEWPLVDLLSRLAAACREEAAPLSLEAQGFLRGKPERRRAGGATALPEPEADAPVLPVRPDEVSALLGVGGALEQAGEGFMSRAAQLDVAQAVARALSDGGQLAMEAGTGTGKSLAYLAPAALFAARNGRKVGVAPHTKTLQDQLLEKDLPRLHRATKGAFGYALLKGQTNYLCRRRALEATRVEPGMGHSARAPRAYLRAYLRRSGEGDLDRLSHWFRERFPVLMALVPAVRSEASTTLGEKCPHFHRCFYHSAVAQAREADVLIINQSLAFAWPARYPKLDHLVLDEAHEVEDVATTALTLELSDLAFLRLIERLHGRDGRRGLFAELRKALSASRRTETRSLMGEVEDGLRRLLDDARDLGARVTELCEPTATAVGEDPDEGAYSPELRITATVRTLPAWEPVREGLEGVRGALQALHVLLSVRVLAALPELAARQPALERELSGATTELGELAVLAGELSGEAAPGRCYAATAEPKRQRWSLSAQPVDVSAYVSKDFAESKRTLVLASATLGTGDGFPFVLRRLGLDGRGGRPAPRLVRAATPFKLHEQALVVLVTDAPRAHEEAFVEWASLRISGLAQTMGGRVLGLFASTRRMERVGTSVRGRLDPLGIEVLRQSRGHSRSLAARQEKDTGTVLLGTKSFWQGVDIPGRGVGCVFIDKLPLEPAMRPLVAAREEPLSRSGGEYMGFLHYRLPRALLQLRQGVGRLIRATTDRGVVIISDPGHPSYRGHLMNALEGYRVEALPWAQARLRIHAMLKETGLTVESGPARSWG

SEQ ID NO: 14955 - protein, 91 aa, Myxococcus xanthus
MAHKKGQGSSRNGRDSNPQYRGVKVYGGETVSAGSILVRQVGTVIHAGANVKLGRDFTLYSVVDGVVKYERLGRDRKKVSVYPAAAEQASA

SEQ ID NO: 14956 - protein, 221 aa, Myxococcus xanthus
KFVDEVRIFVKAGDGGNGAVSFRREKYIERGGPNGGDGGNGGSVVFVADPQLTTLLDYRYQQHHRARNGEHGMGSDCNGRAAEDMVLKVPVGTLVKDANTGELLVDLSEAGQRWVAAKGGRGGLGNMNFATSTRQTPRFAQDGTKGEELTLRLELKLLADVGLLGFPNAGKSTFISRVSRARPKVADYPFTTLVPNLGMVQYKDGLSFVMADIPGIFRAHI

SEQ ID NO: 14957 - protein, 304 aa, Myxococcus xanthus
SPTQRRIPVVNLSHYRTGTPQERARFVQVFGDGIKEFGFVTVEGHGIDDGLIRRTYTDVERFFALPEATKAQYAQAGHGGQRGYIGYGQEHAKNRQVGDLKEFWHVGRELPPDHKYHALYGPNVWPTEVSTFREHTLSLFNALDGAAGVMLQALAEYFGVARDTFSGMATDGNSVLRLIHYPPLKERFIPGGVRAAEHEDINLITLLCEGTASGLELLTRDGEWLPVDTLRGQIVVDSGDMLSRVTNEIIPATTHRVVNPRSKEEDTVRYSMPFFVHPYADCVLQALPCTQTADTPARHAPSTV

SEQ ID NO: 14958 - protein, 67 aa, Myxococcus xanthus
ALSFFCRESSAWFREAPPEHRRRQVARMLARLRPEHLRWLGHMRLAPAVRGQLEVLVAAHFPVDGTA

SEQ ID NO: 14959 - protein, 58 aa, Myxococcus xanthus
MESMETALTMALLGVSVLPLVGDDNPPEEWTARPDAVRDIRDDAPDDDLDFESAFASY

SEQ ID NO: 14960 - protein, 602 aa, Myxococcus xanthus
MTTAPRPNPLLSDRDVDFQLYEVLDATSLCALPAFAEHSRDTFTLLLDSTRRFAREVLYPTYRDMDAQPPSFRDGRVHVHPLMRELYPRLVELGLLTATRPPDVGGQQLPLTVHAVSTAYLMAANLSVYAWLGLTLGAAHLLEVFGTPEVKATFMEPMYRGEWTGTMALTEPQAGSSLADVRTRATPAPDGTWRIQGSKIFISGADQDFNENVVHLTLARIEGAEGGTRGISLFAVPSRRPEGGTLVDNDVRVAGVIHKIGWKGIPSLALNYGESGDCHGWLVGPPGRGLACMFQMMNEARIMVGMNGVATATVAYHEAVAYARERPQGRPTGVRDATRPQTPIIEHADVRRMLLRQKAIVEGGLSLLLAASYQADLAGHGQDEATRQRAGLLVDLLTPVAKSFPAERGFEANALAVQVHGGYGYSSEYLPEAWLRDQKLNSIHEGTTGIQGLDLLGRKVVAGGGAALQSFAEEVGTTVARARAAGVTPEWGEALEQALAETTTVVTELGARGMSGEVELMLRHSADFLELFSVLAVAWRWLAQAAAAKEALERGDPDADFYEGKLAAAQYWFAVELPRVPLLARLCRTGEDSYARMRPEWF

SEQ ID NO: 14961 - protein, 200 aa, Myxococcus xanthus
MFSAVRVCPLLGFVDNERKQVGCLAHPLVTGGTDLRDCGVYRSSVCETFTCPSFGWLTDAQAKLVQVACADWYLYGLVITDVEFVRGCLRLLEWELAGPARPEVLMEQPEALAAIRRMFALKETAPRRGTNATVFGRFNRDADGEPVPRTVDYVKLGVRASPEDDVVLCLGYAPKDATELMGARELVRSHVKAVARALAA

SEQ ID NO: 14962 - protein, 116 aa, Myxococcus xanthus
IGSEAVQAREDEDWYLGAARAAQDATVETGQGGSGNTPLEDVIIASSSVNGRVTKVKQNTLIVKDREGSVYELELDPRSRGLRQGRKVPLRQLKEGTPVRAQFVLMGGRTVARDVQ

SEQ ID NO: 14963 - protein, 68 aa, Myxococcus xanthus
MEILGATILGVVIFSVLIMGVILGGAMGHKQERNLREITERQQAAGITGDVTMNDNAFACPPDQTAHA

SEQ ID NO: 14964 - protein, 39 aa, Myxococcus xanthus
MSNDLLDFTCTRLGGGYPEEGTRFRLCLPRFEKPDMLSR

SEQ ID NO: 14965 - protein, 308 aa, Myxococcus xanthus
MKVYPAVADAGRALAGQALALGNFDGVHVGHQALFAEARRHGRAAAFTFNPHPGKVLQPELAPKLITLLPRKLELFEELGLDAAVVQPFSREYARTPPADFEAALFDALGVAHVVVGSDFTYGSARRGTAETLREAAARRGATVHVVPPVTVDGVVASSSRVREYILEGRVSAARRLLGRPFDLDGTVVTGAGRGRGIGFPTANVDTQNELRPAPGVYAIRVQLPGESKGTWHGGAANIGVKPTFGGTEVTIEAHLLDFTGDLYGKELRVQFLDRLRPEQRFGSVVELTGQIKRDVEAARAVIAREES

SEQ ID NO: 14966 - protein, 431 aa, Myxococcus xanthus
MGHATYEQHFKHPIAVRMDTLRRERERGLTLAEDEQLRTLVERNVAEVPDLVARLDIERATALQAGLARVLGEPGELEALLARFLSVDDANFDTRFGQFYGELAPSLPLYRLKPGDVLSLKTPLESGTAVPVRVFGIFRFRGLGGDDGRVNTMSVVDLVTARHLSGRFTQAQQDEARALFETFGMEGEAMAPPESLDAFHPPDIVDAEAQTAHTEQAPVFERARALPETFSEDELSRGTVLQAAVVLAPGASAEDVAARMRALPGGEALATVGWQEAGGLLGGLVVMLQAVLLLFALLMSSFVALVAAGTLLLLARERVAEVGTLRAVGMQRREVFTSLLLEGSLLGGIGSVLGAVLGAALLWLATGDGVAVEDGSLQFFLGGPVLRPALALGGTVAVVVAVTAVVLLATLVPAWRGSAVEPIEAMRKGEG

SEQ ID NO: 14967 - protein, 313 aa, Myxococcus xanthus
MSLDVAAEGNAGFRVRTGSLEALAKPRTVALSTSLAERLQVEVGELATLFVQMPGGKRNAVDVEVVALLERAGVLGESAGLLVSNAMLRELYGFRPDSASVIQLLCGDGTELEPLAGTLRGALQKAGYEVLPPAHEAYGDKLGPLLREGWAGQKLDVSTWEDEAAFLDFVGQGLGLLLVLVGAVVFGVVVVGLFVSLNVSVRERTREIGTLRAMGMQRRSLVAAFMLEGLLVGWAASLVGAGMAAGLGVLLRDVLPVPDALSTLFFSGTLPLAPTLGHVVAAVLLVTLGAGLASIVPAFRAASLPPRSAMESL

SEQ ID NO: 14968 - protein, 259 aa, Myxococcus xanthus
MNARRPLSVLLLGWTLLLPAVALAEAEPKLAPDALLRHIDEKMSFTSDYKGVIRLYETRKDGAKRAMEVHVYRREADNDLLFLSTKPRHLAGMGTLRIGRNLWDYEATTGSWRRNTQRTNLLNTFTCEADFDRSRLAEDYAGKDEGDDTVNGVAYRKLLLTAKNDQVTFPLMRIWVDPQNNIVKKVGYTASGRTLRTDIVRSYQRIKDPLSGKHVLHYKEVLETEEQEGTQMVVRYDEVVLAPLDANIFTKAWLESRLR

SEQ ID NO: 14969 - protein, 153 aa, Myxococcus xanthus
ALPSVQGLQGSAENPVRSMPEEFGVLHTALEAELAPLHYAALWERVTALALELGMLAPHSSAANVLGIWHVLGEVLVPQVVGWKVPSVRARVQLFTSAPSRALHGDTLGWERHLTREQLDVVPLPSSHFGTLQQPCVQELANHLLEVLKRQGG

SEQ ID NO: 14970 - protein, 155 aa, Myxococcus xanthus
STTVTVKHGPPVRVEAEGVAQPVAKGESIRVEKGHPPPAPLRPLVAPSPGQPEDSARLKRRPDRDGHLGPVKLTWEAVRGAERYEVEVSRAQEQRAVFTQTVTSLEAKLPVLPAGSYRWTVRAVGPAGPSEPSAPRHFELVSERLKLEVKKGQWQ

SEQ ID NO: 14971 - protein, 558 aa, Myxococcus xanthus
MLVVGVVPTLMVGWLSVSHTRELLVRDAQELAQERVKQLRLKAEIFLGEPTDAVLGLARVPGFFGLPLEAQQTHLASVLNQRRDVLALTVFDANRQRLPGLQAFSKHDVPPTALAGHEERARALLENIEGVRYADVVKDPQGSEPVLTLAFPLGEPVRGYIAADLSLADLRKMLEQERVGSTGFAYLADRHGHLVAGGGGVAGLGEDVAQRGPVAHLLKQLVGKSDMELFHVGNFGEGRDAVVAAYTVLPETGWAIVSEQPVEHAYRQVDTMEQRILLGLGAAILVAVVLAALFSRNLTRPLKGFISGALELAHGKFGVEVDIKQKNELGELAQTFNYMSKQLLAYDMENRGLYESLEKGYLETIVALANSIDSKDAYTRGHSQRVGDVSVQIGREMKLTERELRQLQYGGILHDIGKIGIVESILCKQTRLTDQEMDIMREHPAIGDAIIGPVSFLGAVRACVRHHHERWDGTGYPDKLKGEDIPLLARIVACADTFDACTSTRPYQKAMPLEKAMEILDNLSGAQLDPKVVQALKQVLAKQGVRLEGHRLPVKLAS

SEQ ID NO: 14972 - protein, 554 aa, Myxococcus xanthus
MAELFLGVARGAEGFERPVAIKRVLPHLAREPDIARMFLAEARLATLLQHQNIATVHDVGQGPEGLFLVMELVDGWDLGVLLRSAARLGVRFPPHLAAFIVHQALAGLGHAYRKVHDGRPVMVAHRDVSPSNVLVSREGEVKLTDFGIARMAGPAHTAPGVFRGKEAYTAPEVLQGAPATAASDQFSLGIVFYELLTGQHPFHTEKDASAVTYAILTRPVEPPQGVPTPLAGAVMRMLARAPQERFHSPESLAEGFARWLAQVGEPATSQTLAAFLRGLGLPPPLSEQAAASRRPVTQAQADAGSLAMAVHAPSPAEAAASEEEPLSMPGGAALSVSGRMVHHCPRCNHVLSSPQARCSHCAMWPDASTGAAATPRTPTAPGAFAPSEGVELTAHQTLAESVPQTHVTPGAKSVLQTDADALELAERPPSPASDWPDEAALLRRSRLKRALGLLLVALLVGTGIWLWPQRSTLLIRVMSATGLRLSAPMLRIDSDPPGATVWVRDAELGTTPLLLENRYPAGRVPIQVRLKGHRTWKGTFSGGEAAHIEAKLKR

SEQ ID NO: 14973 - protein, 172 aa, Myxococcus xanthus
MDDKKVLDKKERLLAALDQGMVMIHLDARRPGVLVPASVKTEAHLRLNLSYRFDPPDLTVGEWGVRSTLSFSGSRFTIAVPWSALFAIASHVTKEFWMYPEDMPPELLQQTAASRPAQPLPVAPVPVAAERPRTFLREVQGERRDEPPADVPPADGPPDEPPPRRGHLRLVK

SEQ ID NO: 14974 - protein, 67 aa, Myxococcus xanthus
MHRGEIDRWTAKVRERGYSIIPLVLYFRNGRAKVELGLCRGKTHEDRRHDIKERETKREMDRAMRRR

SEQ ID NO: 14975 - protein, 298 aa, Myxococcus xanthus
RNTRLVMAPAVLKTVADVKDWTAGLLREGHRLALVPTMGFLHEGHLSLIREGRRRADVVAVSIFVNPTQFGPKEDLSRYPRDFEGDVAKCISAGAQAIFAPAGPEVMYPQGYQTYVEVTDVSQGLCGARRPGHFRGVATVVTKLLTLFRPEVALFGEKDYQQLQVIRALNQDLHLGADIVGMPTVREPDGLAMSSRNAYLSPEERQRALALSRGLKAAQALLREGTRESEPLVAAVRRELEAAGLREDYVELVDAERLTPLASVAPGQPARLLVAAFSGTTRLIDNMQLGGEENAGRV

SEQ ID NO: 14976 - protein, 416 aa, Myxococcus xanthus
MRNPTPLALAALLLGTPVSAQVSVSPTAQSEPAPSITGGVLQDVALWVSPGAPSSSLFLTAYNSPNAGLVTFGLGGEQLDAELTDGPMSAVAVRDGFPLSGVQQTLVVAASINFNGLAAYTADPDRAERVERIGAAGFLTGTQFSAVALYQNEDSGRFYVFAGTSTGVLRQYELAGDTGSVTATLVRTLATTGPIAGLAVDEASDSLFVTQQGQGLWRYPAAADAGATGQQLSIQGSGGLSANVGRVALYRARNGEGYILVADTGADAFAVYERRARTLVGSFRLADEDGGVIRANDPVALAVTASSLGTTYPDGLFVGSDAFSNPQRFLYARWPAVAEAFDPALRIDTRFDSDGGTDGGTDGGPGDGGGSGGPGPAPGPGNRPDESGCSCASASVPATAAFALLALVRVGRRRRD

SEQ ID NO: 14977 - protein, 328 aa, Myxococcus xanthus
MELHRGELVPCFEMPARADFILQAVRQAGLEVSEPQAFGLESLWGVHDAGFVEFLRTAHAQWRAIGKQGFMLPSGFPARGMRRDHLPSGINGQMGYYAFDAGTPIVQGTWDAAFAAAQCALTAAAWVAEGERSAYALCRPPGHHAGHSTYGGYCFLNNAALAAQHLRERGCARVAVLDVDYHHGNGTQDIFWERADVLVVSLHGTPETEYPYFLGYADERGAGAGEGFTHNFPLPRGTTWAQYSAALDSALDAVARFGPDALVVSLGVDTYVGDPISAFALEREHFPLMGRRLAQLRLPTVFVQEGGYAVEDLGLNVAGVLEGFDAGR

SEQ ID NO: 14978 - protein, 245 aa, Myxococcus xanthus
MTTTTAPLTPAKRRWRNFLLETGFQLKLTAYIVSVTLVLSALLGVFLVRGAQALMRETATAVEARSRAAEVSRELSGATLSNELLTRMDDPTFEASFREKAGAIDAAYEAERAAIVAQRAELERQQKLTWWALGGFLVAFIAVVGLGTIVVTHKVAGPLFRIRRMVQEVHDGRLRPPQHGLRDGDDLQDLFDATRKMVQRLREQNEEDARTLANVLLAAERSGASPELIHELRALDARYRTRLED

SEQ ID NO: 14979 - protein, 241 aa, Myxococcus xanthus
SWDTPLRIVSLAPRRSGGFIAGTERGLAFYEPRSARLERLLDPEPEHPHNRCNDGKVDPQGRFWVGTMDDHEEAPTGGLYRFDAQGHLARIDEGYTVTNGPAFSPDGRTLYVNDSPRRVTYAFDLSPDGAASRRREFLRFDEPHGFPDGMTADAEGGLWIAFYGGGCVRRFSPDGAWLAEYRLPVAKTTSVAFAGDALDRLFVTTGRDGLSAEELEAQPLAGGLFELTPGVRGVAPVPFAG

SEQ ID NO: 14980 - protein, 110 aa, Myxococcus xanthus
MLYSYGGGVTHLRGWDLPASVVVELALLAVLALLALRPEVERPSWTRYLPAGAVALSLAFAGLNMRLLPGPFVFVFGLGAVGFLAVQHLRAARAAELPPRQYEEAVEEEG

SEQ ID NO: 14981 - protein, 179 aa, Myxococcus xanthus
MPEPPKGTGARAALRPSRPQRDLAEPAYAADILEEADEHSRPYVVGNAPELPPEDKTDPGQSAPAYDGPKWLAHVPAHSPTVLGVIVVGCAVFLSGLLSSSGVGLLGTLLAVVSGTVLVARELRAAEQSPGFTERMPAVLMTPEAAAAATAVMVALALRSLSLGVLPLLMVAGVGAGGP

SEQ ID NO: 14982 - protein, 183 aa, Myxococcus xanthus
MKGWRYTLGFVVLCAGLLFVLFKGFGRNPHEVPFMMKGKPAPDFGLRALDSGEKVSLADLKGRPVVINFWASWCGPCRVEHPVLEWGARQYGSQAVFLGVVFQDTDDNARGFLQQYGASFPQLVDPRSRMALDYGVAGVPETYFIDPNGIIRGKHVGPIDPQTLALRIQELSTPSAPTEAARK

SEQ ID NO: 14983 - protein, 571 aa, Myxococcus xanthus
MGGYIAVFAYIHRREHARYMQLALGTMLAVGVFFAFLIAGPANPWGAVSPVPADGPGPNPLLQNHILMVIHPPMLYLGYVGMTVPFGVAVAGLLRGEIGEAWMAPLRRWTLVAWLFLSIGIILGAWWAYAVLGWGGYWAWDPVENASFLPWLTATAFMHSTMVQERKRMLKLWTLSLALASFVLTILGTFMTRSGIFNSVHSFTQSDIGPTFLVFLGFLLVLCVGLLAVRGPLLVPEGQLASPLSREASILVNNLVFVAITFTVLLGTLYPLISEAVHGVRVSVGEPYFNKMAVPGGIAVLFLMGVGPVLPWGKPDPATLRRQFIIPSVVGLVVTAACFAVGLRGVYPLMTFGLAGFVTVVTVRELVAPVRVRMSERKEGFVAALTTSALKAQRRFGGYVVHLGIVLIIVAVAASSAYVKHTSGTLKKGQVIELGGYQMKYLGLVSGEEPHRTYVAARIEVTSPGGKVSELKPRLNYYERSTDPIGTPGVRETPAEDLYVSLMAFSEQAGTASINIWVFPLVGWIWWSIPLLVLGTLIALWPRRKTAVAMAGAPAVGTSPLTGGDAERGAA

SEQ ID NO: 14984 - protein, 158 aa, Myxococcus xanthus
MSPVARNRLIALGALLVAGAGLGFVAFGNIGENLVYYWSPSEMLGQGDKAYSATIRLGGVVEAGSIQWNAEHTTLQFRVADDVKEGAPSVLVRATETPPQMFRDKIGVVVEGTYDKSGVFSSNRLMVNHSNEYRAPKEGEDPRQWQETLSDATAMGAK

SEQ ID NO: 14985 - protein, 136 aa, Myxococcus xanthus
MVLFTAMAGLNPSFFILYATVTRAMDAVDAMVGAPAHVQLDVAGRASETSGLAVAGLVAVLVMMTAYVGGAVIAEPLRSITEDATRIAQGDFRPPRHHRRGGRGVGHLRRLRADADAVGAGAGTTAARGPPDFHYH

SEQ ID NO: 14986 - protein, 201 aa, Myxococcus xanthus
MQRMKEDNQAIADAVVRLNKRVQQIGKVVEFINEIADKSDLLALNAELEGTKAGEVGRGFSLVAAEMRRLAENVIRSTKAIEQLIAEIRDATHAAVMATEAGLKTTDAGTVLAAQVDESLSLILELARQTSHAVRSISLATQQQQTGTDQLAAAMGDILRVTEQNFAATKQMAAANADLSTLARDLKDAVERFHVGPGGDA

SEQ ID NO: 14987 - protein, 589 aa, Myxococcus xanthus
MAPVPLANLVGAALSLRFASLTLAEPLAGRMGLMGILGGALCATALVSGAAVSLGRQRTLRGLERGDVPTTPQTLASAVAEVTRAPDEAFLGSLGLWLVTTLTLGACMWLGVGVELAVAARIAALGLLFGPLTALLVYCLVVLRSRKVVLWLAELGMTHAQLIEAMPRRAELRARLAAFAFVAVMTPAVLSAQLASALSNHIFTRLMAERDVSRQLMLAQELRVEALTQGGGLVLLVFALALTAAYLGGTMLGRPLRELSREAKRIAEGDLASPRVVPAEDEVWDVSAAFTTMRVHLADVMSQLQRAGAQISATTEEILTTSGRYEAGATEQASSLDETSATTEELARSARQIAENAGSVAEIAQRTLGAAQQGQGSAEAFLGSMARMRQDNGAISSAVVRLNKRVQQIGKIVEFINGVADKSELLALNAELEGTKASEVGRGFSLVAAEMRRLAENVLESTKEIEGLIEEVREASAAAVSATEGGVRAVETGTTLAQQVSESLRQIVDLAGQTSYAVRSISLATQQQQMGTDQLADTMADILRITQQSLNATKQVTTANTDLLVLARDLQGVVERFQIGQEPLGEEGG

SEQ ID NO: 14988 - protein, 249 aa, Myxococcus xanthus
MQLLSSALVLLLLAPCAALAQGDSRIAFLGKQLQKSKDPRSRSQAALVLGATEDPEAVPLLCNGLKDESELVRAAAAKGLAKLLEPGGLDCLQAHKADADASVQAAVSDAVGALKEYQSRPPRFYVHLEAVKDRTGKLPADLVKATEARLRSRLMRSGAQLAPAKETKAAAKGTLKKLRVRGYRITPELHATDGGGLRVALVCLTYPDLSLMGQVEVNAAGAQPGDLLKALVPRAVEEAAETFEWSSET

SEQ ID NO: 14989 - protein, 568 aa, Myxococcus xanthus
MGFDDVNVLVHEMEELVRCTEPLRYALSPASTDALLTTADAVLVFSGTQAADEPPPAVERLVAWLQECVRSESVRLPPGRLVPAEGAPATSEAAGRVGAQGGPHSAVQTNPGASPGRLLTIPVAEGSRPHVPSPGRSAMPSFVSPQASGAEASSGAGARAASSAPTVQGSNGLTAPRQPESRPDTAVRIGVESLDLLTSAVTNLTQVARRRELANARRLALARELSQLAREAEDLGPAGAALAARLGSAKEMAAVLHRESKLLSNAELRDLGMLVEEVQTLRMLPLSVLFEPYPRMVRDLSRALGKEVELVVDGEDTRADRAVVEALREPLMHLVRNALDHGLETRVDRVTADKKPRGCLTLRAAREGNRINLRVEDDGMGVDPVQLRKVAVRRGLFDESAANALSDAAARELIFLPGFTSRDVVTDLSGRGVGLDAVRTSIQALGGDVGVESAPGWGTIFELRVPVSLTVAPLLFIQVGTETLALSATHVSRALKVDSAEQCEVAGRPSLLVEGRVLPLAPLSSLLGLEPPRPAREGELALVVKSQNGAAALVVDRVLEERVQAILP

SEQ ID NO: 14990 - protein, 205 aa, Myxococcus xanthus
GAARTTQDGDIIEAVALTLIPYPDPVSGGTFETRRSRAAHEVFAGAGMRNLPVDALPLAMLALDRGTLRWLDTFLVRREVGAEQRSVVGFGVAPRELREAHALQYQQHLKEVLQARRAAGQSERFLASEHFFTLPAAGTLPAAAIEAGSLTEFYFPPEVDVELTVVAEDELGAILDESLQLPPIDLTQTGEALESVSVLVMVPRR

SEQ ID NO: 14991 - protein, 267 aa, Myxococcus xanthus
MSPPNDALLDAETRDRLHYDTGVLLDAGDFTAEQTYHRGRLTRALAYLHGVGTVAGLKVSHHEGAEPEHEELRVSAGLALDPFGRLVEVPTDACLKLDRWYWQEPLEMADFGVFTPAEYRLSPDAAGFPPTGVVADLFLRFLQCERGKTPAFAAGPFDAMDAVVASRIRDGYELRLVPRSTAYPPPEVPKSPFPDPVDEPDPVQRRIKLRQAVFNAWRGSREQELAKLWSDTFIPASLLTDPTQPDLKMRDPAWVFLARVVIGATGR

SEQ ID NO: 14992 - protein, 806 aa, Myxococcus xanthus
MDANRLRFYMLADAPDWVTESSVSAGEVCLYDAKRRTLRLGSLGESRTFDEALDLAVLEPRLARVPGAVDAFGTWAWWDDVAGQVRAAGGGAGTTLRFEPAQVGLSGAVTDLSPGAGGILYVAVAQRVVALHLRKVWSAVVFPAEGLAAHRIAADPRGGAYVLSGPPSFAPNAPPAVLGRMDGQPLLDVLSIPSGAGLFRPMEENPDPPRTRVLETLAWPGEVPVALACDTEGRLAVLSWVMDPALAGVPPNAGHARLRFYSGRFSTPVALPGVLGPFSLAILPDGRAAVLSLLDDGKVEAVAYALPAGASEAIPQGDYFPLPGHDGGPFLQGAKPPHHAVNPGLADMAPVPLQALSLPRCAERGSAANPPNRPFDSGDGRTVWHRLYVEALLPPRTGVRVWLAATDEPLAPPSDSPHWHEHRLGLIPEAPVHPDVPHGSWVPLPSEVPFQPGMLPAPPAPGESGLFTVLIQRAHAKVRALSGRYLWVRVELFGDGRRTPEVGALRAYASRFSYVDNYLPSLYREELFGEDADTTGRATPADFLERFLGIVEGVLTPIEDRIAHAHVLTDPGHVPGDSLEWLASWVGLSFDPVVGESQRRAMLRSAPALARRRGCVEGLRLALDLVTDGAVNRGAVVVVEDFRLRRTLATILGADLADTEDPLLPGLARSGNSYVGDTLFLGDEARKEFLAVFGDETLQSRAEAEAVEQLLERLAHRLTVLVHQGTDTRTLGLIRKVAEQEAPAHVQVSVITASRPLLVGVASLVGVDTYVGPAPAPTSVRVGHSVLGLADVIERPSSLDPRLEGG

SEQ ID NO: 14993 - protein, 411 aa, Myxococcus xanthus
FRLPSGSVERATFQLFIEEPGAGYREWRLIEDLALARRDEPVYALDSEAGAARCGDGVRGRVPPAGAQVLVARMRSGGGAAGNLPPGSLKDISAFRVDGSPAPGLRVQQPEPTLGGRDAETLAEAERRIPALLRHVDRAVTEEDYRRLAASTPGVQLGRVEVLPRFEPRRRRDGVPGVVSVMVLPTATRLEPPYPRADRPLLEAVHAYLDARRPLTTELYVIGCEYVPLGLGVGITVREGFGRETVVQAVRQAVRRFIFPLPAGGPTGEGWPLGRDVQDRELYVAVAQVPGVASIAGVNLFAWGTVTRVLRDPRRAGATADVARFTVEPPAPSVRQAEGPVNPSWLQLKGSTATTPVELSIADWQLPELLKVAVNADGEVPTMLHGIGDEGSGGMDSSQAGVAVPMVPEVC

SEQ ID NO: 14994 - protein, 261 aa, Myxococcus xanthus
CPKRENFEAAITPKTKMVWVESPTNPMLKLIDLARIAEVAKKRNILSVADNTFMTPYFQRPLDLGFDVVAHSTTKYINGHSDVVGGFVCTSREDVAEKMYFLQNAVGGVSGAFDSFMVLRGVKTLHVRMDRHASNAMKVAQFLASHPKVKKVTYPGLEAHPQHALAKQQMSGFGGMVTFDIQGGLEAARTFLKTVKVFACAESLGGVESLIEHPAIMTHASIPKETREQLGITDGFIRLSVGIEDARDLVDDLSQALDAAK

SEQ ID NO: 14995 - protein, 26 aa, Myxococcus xanthus
MKRLMKASLEWSSTVLNRVADRVFGR

SEQ ID NO: 14996 - protein, 332 aa, Myxococcus xanthus
MNPIERGRKLINTVRTGAEKAIDRTQDAVGNAVDNVKDAAAAGGRKVGQFVDGFENAVSGTARGVGNVVGGAARGVQEFFGGGNQPDRVHDGKLLGADGATFPPGTPLADIPGVTPANNPNPQSTILYVNGILTTKEAQSESLQAIANATGSRVVGIHNATEGMGADLAQSVKDKLDKGTNPAVDTLADALYTEIKAGRDVHLMAHSQGGLVSSRALNDVYNRLRIEDGMSKQDAKALMGKINVETFGGAAATYPDGPNYVHYVNRGDPVPSMFGLGPIPDKWNPIADGGKGSKVHQFNEFHLNPFDGHSFEDVYLKNRVPFDQAREGNFNK

SEQ ID NO: 14997 - protein, 32 aa, Myxococcus xanthus
MKVSIKWNSEVLDRVASRVFHPEELESKDTSR

SEQ ID NO: 14998 - protein, 146 aa, Myxococcus xanthus
MRYFEDFQPGDVSEHGPHVVSREEIIAFATQFDPQPFHLSDEAARDSIFGGLVASGWHTASLCHRLLVDSFLGQTSSMGSPGLDELRWLKPVRPGDTLHVRVEVVSATPSRSKPDRGAIKLRMEVRNQKDEVVMTELANVLFGRRP

SEQ ID NO: 14999 - protein, 156 aa, Myxococcus xanthus
MAELIHNHASGEMRSRRGATYGFSARPWLGRGGAAHLVLEGAVDAQRMGEGISTVTQLLASFGKEVPEHALERARRGMLASQAVSFISSEAWVNALLTARVRGFEPDTVTRRPALLQTVTAESLRKEFEGCFQRPVVSITADEGKARPVIQAMSQP

SEQ ID NO: 15000 - protein, 132 aa, Myxococcus xanthus
MMKEGELVVIDFQDALQGPRQYDLVALLRDSYVELDRDFVDAMLDRYIATFQEVSGERIDAASFKAFFDLLTIQRKLKDAGRFEFINRVKGNPGFLVSIPASLRYVRDGFARRPELRKLQDLVAKYVPELAA

SEQ ID NO: 15001 - protein, 138 aa, Myxococcus xanthus
KAMVLCAGLGTRLRPLTERWPKPAMPFLGQPLLRYHLAVLKAAGVTAVGINTHHLPDTMEAVARAECARAGLPLHVVNEPVIQGTGGGIRGLRDFLSDGDFIVFNGDILYPVDLRPVVALHQASGALATMVLQPMPAG

SEQ ID NO: 15002 - protein, 455 aa, Myxococcus xanthus
MDIHENILTAIGNTPLVKLNKLVGPNDATVLVKCEFMNPGASIKDRMALYILEKAEREGKLKPGGTIVENTSGNTGMGVALAAAVKGYKCIFTMPDKMSLEKINRLKALGAQVVVTPTNVPAEDPRSYYETAKRLHRETPGAFMLNQYHNPDNIEAHYNTTGPEIYKQTEGKFDYFVAGLGTGGTMSGAGKFLKEKIPGLKNVGVDPEGSVYEGYFKTGKLTEPHVYKVEGIGEDMLCGAMDFTHLDDVRQVDDRQCFIAARRLAREEGIFAGGSSGAAIHVAVQLAKEVGKGKTIVVVLPDSGSSYISKFHSDEWMRDNGFLEEKGAGTIRDILGDKRKDVKTARRGDKVDQVVETMRGHGISQMPVVGDDGRTVGMVHEYDLLNALVAGKAKFSDTIDSIIAPLQGALSLDTSIARLREVFAQDNVAVVKDGEKVVGIVTKIDLIDYLHRTAA

SEQ ID NO: 15003 - protein, 544 aa, Myxococcus xanthus
VWTPKQQGPPPTPRNRGPECPARYVLPPEPPSPFSLRGPRSMSPFALRPSSRSLRAALLFLTALLLPQAPARAEPGIRILNSLRAEELAFNALTSNRAALDALTEMPLHSKTFVLDGRLKHALEHPPARNVMAYLTECALPPGAAVEWTSRAGDTYTFQGEVGLCPGWEKDKPSQACLGYVTACLLARNNAFGRRVMVSMRGEDPSEPRRFNPSGAREEWSPMFLPCASGEAGLHAECGWLGENVGTCNPGDKVTVAAGAPHPATCTGQLGRIFGDRVLRVCEDPRGCSWEDRLADTLSNPCGGIEPSVEFKCPESGRYSVMSAPYSRAAIPGSWVAPVATSGTYPAGPFGAYTFREGAFYGNMFDSRGLTVEVLLNQDTFQPKLINLRFKGVVHDNVHACHGRDWVDGDSHLRSRICANADIGGEPIAGCVARAAGPCEPGSYNPRPARCKVNDGTAVWGDGDFEGCADARGILHPEPITVFLRSPCEVISPKEQTTCGVTCDYSEFPPKCSDTCKLKKSPGQCLQTDACLNDPAKCPAPPQQ

SEQ ID NO: 15004 - protein, 186 aa, Myxococcus xanthus
MGVSPELRGERHAAAVSFRVGIQGGPLNEGGGGADLFLGLEGRRFGVDLRLTGLGLPTDDGTSGSDSITLTQSHLTWALISHERARLRAEAGVSTAHAPDITFVGPSFGASLEACIIGPLDLEARLQVTPFPYRQVDANAALALKLGAVVLRGGYRGMVLDDAGYVDGVSNVDTFHGPFLGLGLTY

SEQ ID NO: 15005 - protein, 180 aa, Myxococcus xanthus
MREPEDTVPLLVRMGVQGDLLGDAGAMGLFMAMDGRRLGLDARITGMSLPATDGSDATDRITLLSAHASAALWAGERGRLRLEGGVASAHAPDILFVGPSFAASVEACIGPSPVDLEARIQAVPFPHRQVDAQAGLAVHVGSLHLRGGWRALYLNDAGHTTGEKQVERLTGPYLGLGLTF

SEQ ID NO: 15006 - protein, 109 aa, Myxococcus xanthus
MAEALHDEGFEVSMAINAVEALRVLAALESACLVLLDWEIPRVDGRGLLERLRSDERFAGTRVVVMTAEAGPLPPGAAGVLRKPVRLEMLLDATRRHCPVASGAVKTPA

SEQ ID NO: 15007 - protein, 136 aa, Myxococcus xanthus
VVLLHPVDMPALRASTLKSLLKMAGDVDELLRPEFEGAPGWPLVLSRSGAERLRAAEGQQLEPALATMKVRRVPVKDPGVVVNINTPETYERLFGTQPRLAPPPKRRGAKRGTAPATSNVAELGGGSAPMAAASEE

SEQ ID NO: 15008 - protein, 172 aa, Myxococcus xanthus
TLDTGQHLLGLVAPALCADAATLRRFCSELQRDLAGQAQEQDQDGEPASHLSFSEWQNELREELTERDHPAATFWEKHGTTAGAAVTLPFERPANAAQVFDPASLELTLRGERLSRLDAAARELGCSLDALLIATWSAELWKLTGQTDLVLGLQCDGREHEELSEVVGPLSR

SEQ ID NO: 15009 - protein, 275 aa, Myxococcus xanthus
MDAVARELDAMAELGTQNVVFIDDTFNVPLKRFKELCRLLIERRYGFNWFSYFRCSNSDDEAVDLAAQSGCRGVFLGIESGSPRILANMNKAATVEKYVSGMKRLHAHGILTFASFILGFPGETEETVEETLAFIQETRPDYYRTQLWYCEPGTAVDAKRQQYGITGQGFIWRHDTMESLEAMDHIDRMFLTVKDSVWLPQWSFDFWIIPYLLGRGLQTEQFKALMRLAHQLLALEIASVSSETKRAQQRNYVGQMEALVRQWNGASSQAVLAGR

SEQ ID NO: 15010 - protein, 62 aa, Myxococcus xanthus
MPDVEAPRPLSEPPDEAEERQSRYMEEEPGHTPGSAEGDDEDAPHRVRPYPDPDHTPGRAEG

SEQ ID NO: 15011 - protein, 1646 aa, Myxococcus xanthus
VKVLNPERSGGHASIFQVKLLLQDVALSELSLPGLTIQPVEVEQASAKLDLTVFVAETPRGLECKWEYSTELFDAGTIRRMVAHYQRLLAGAVASPGCRISALPLLSADEEQQLLAVWNDTRTEYPHAACVHTLFEEQVRRTPESLAVLHEGFTLRYRELNERANQLARRLQAMGVGPETVVGLCLERGPELVVGLFGILKAGGAYLPLDPTYPSERLGFMLRDARVPVLVTLERIADRLPSQGEQLLCLDADQEPLAREATSNLEVPVTAGNLAYVLYTSGSTGTPKGAMIEHRGVVNYLSWSTGAYRVAEGSGAPVHSSISFDLTVTSLLAPLVAGKTVTLVPEDDRLEGLAKALRSKPDFSLVKLTPTHLRLLARQLDAAALAGQARALVIGGETLSAEALEPWRSHAPGTRLINEYGPTETVVGCCVHEATPDDARTGSVAIGRPIANTRLYVLDEHLRLVPVGVHGELYIGGDGVARGYLDRPELTAERFVPDPFGDVPGARLYRTGDRVRRFPDGVLDFLGRRDEQVKVRGYRIELGEIEGVLGQAPGVREVVVVAREDIEGSKRLVAYVVPNEGADVEPEVLRQLARAKLPEHLVPSVVVPLDALPLSPNGKVDRRALPAPEAIARESHDGYVAPRTRAQALLCSLGAELLRLERVGIRDNFFDLGGDSILGVQLIGRANRAGLHLTPKQLFDHQTFDELAAASGTGGSIIAEQGLVNGDVPLTPIQCWFFRQPQPAPHHFNQAVLLETHASFRSDLLKPALLALLAHHDALRLRFEETGHGWLQRCAELERAPVVSTFNLSGLSPEHQRRELEATAASLQERLDLQQGPLLRAVWFDLGQGKPGRLLLLAHHLAVDGFSWRVLLEDLQAAHQSLLQGREIHLPAKTTSYQHWSKRLREYAASAAPAFDYWRRMDCSNVARLPEDLPGASAASDTAADARTYTVELGEEETSALLREVPEAFRCGMNDVLLTALTSVLANWTGGRRWLVDLEGHGREPLFDDVDLSRTVGWFTSIFPVLLEAPAGDGLLELLESVKAQLQRIPNQGIDFGVLRYLRQDDAGGPPADKAQVLFNYLGQFDQVFAGDGLFQPAEESPGPTVSPLAPRTHALEVNGLIHAGRLRIGWAYSEARHHASTIARLAERFLQVLRELVALARAGGHRERVARFPLARLAPVSLERLLAEAPGTEDVYPLVLGQREMFEHTRAHPGAWAYFTQLSCQVVGTFSPEAFVAACQRVMERHPALRGSVAMESMAEPHQLVHRAPSLPVERLDWTKRTDSEAHILLEQFLEADREAGFSTDRPPLLRFTFIQLAPQACHLVWSSHHGMLDGWSMSLLLEEVFTVYGSLSRGVPVELPPRPPFRELVAWLQRQQPWRAEEYWRRELAGLAGPPATSLAPAGGQRPLEHARYAERTLEMAPATTMALQELARTHRLTLNTLVQGAWALVLANGPRTEEVVFGVTAAVRPVDLPGVEDMVGHLINTLPTRVRLVPGTPVLEWLVQLQAQQAEQRQFGHVPLSTLRRWTGLPDDSPLFDSVLRFENYPIRFVLERTAPGFTVEAMRIIDRWPYPLSLVAVPGPPLRLELGWQRDRIDEDTATRALAQMQYVLERLLGDPGQRLCALMEGLQEWAPPARVESGSGV

SEQ ID NO: 15012 - protein, 184 aa, Myxococcus xanthus
MIKEGTEVRIVDNRTKEDLTSVTLAQIIFEEEKKKNQMPLSVLREIIRHPGESISGFIQKEVSPRVASIREEAESRLDKLLRRDENAPRAEGEPEAPVAAAEDTAAADTAAAAGLSPADLLKASQRAFEEWQRRIDERVKHVVENLTGNLPALGRDMASLTQRLDELEKKLEQAEQQKGPPTQE

SEQ ID NO: 15013 - protein, 304 aa, Myxococcus xanthus
MAGLLDKRLWIVSGKGGVGKSTVAAALALRSARAGKRTLVCEVNTQERVSRFLERPEAGPEVAQLEQNLWAVNVRPQEAMREYGLMVLRFETLYKTVFENRLVRQFLRFIPSLQELVLLGKIMFHLQEKLPDGRWRFDTVIMDAPATGHAISFLSVPQVLIQTVPPGPMAREAQKMRDLLVDPAVTAAVLVALPEEMPVNEALELHAALRDKVSLRTHAAVLNQSFPERFTEADLEALGGHPELLAVAQAHHDRAAQAVLAGTKLERNLHAPVYPVPRLFTPEFGRKAIEQVMEHLEPLVTGAA

SEQ ID NO: 15014 - protein, 278 aa, Myxococcus xanthus
MKQTWDELITRVAPPEQRERILSNRFYQSLSTALAGSQEYISMEKLWELRRSSNYELIVLDTPPTAHALDFLDAPNRVLDFLDNDAAKWLLTPALKAGKLGMSLFNRGGYVMRGLAKFTGTEMLQELSNFMLAISSLNEGFRERARGVRQLLEDPNTGFVLVTSPHPERMEEAIHFHKMLKQHRMEVVSLVVNRVHPMPTEALWADAATLTPSRRAKVEETLREQQILAEQDRTGIDQLQAACPGVPIVQVPRFAMDVHDISALWRTGRYLVGDETLG

SEQ ID NO: 15015 - protein, 173 aa, Myxococcus xanthus
AALGVVVSGCRTTGSAAREEPQAKSPKQEFHFDAVTVTADLELDKLNDEELFAGGTSAFAANDFQQAARYFGRLVDFFPDSRHRRAALYNAGLAHQRIKEWEEAGHRFSELSDPARGQGDALDAAFRVAEVDYHLERYEQASKLLGIIAAREDLPLNRRLEAQVQQGICQLES

SEQ ID NO: 15016 - protein, 266 aa, Myxococcus xanthus
MRRIAFINEKGGTCKTTLAVNTAAWLAKERGLRVLLVDLDTQGHAGKALGVDVRTLPRNVFHLLTDTSVRFEDVVQRSALEGLDVLPAYKEMADFPVVVAADERRAHRLADRLRAAEAAGYDAIVFDAPPSMGTTTRNILVAATEVVVPVALTYLALDGCAEVADTVRQVGEAEGRPDLRVTKVVPTLYRKTALATAILERLKAYFPDALAATPLGYDVKVDEAQSHGQTIWEYAPRSRGAQMLAAIAAELHGEPAPKRRRASQKA

SEQ ID NO: 15017 - protein, 94 aa, Myxococcus xanthus
MKKLVETGEERIGKLAQQLLSNEKFVAAVQTLVSRSLAAKGTLDSALRTALSAANLPSTADLEQLRSKVDDLERLLSSVEGKVDTLLAAKSPKK

SEQ ID NO: 15018 - protein, 301 aa, Myxococcus xanthus
ADVVDFTVPKGTSGRGLGTLLESHWLIRDARVWRWHLYRRGSFAPKAGRHDVSASMTLAELSTELEGNPIPEDVPFVVVEGWRLRDTDAALVAAGFIKPGAYIAAASKPKNFTAPFPLPSTGTLEGYLYPETYGVIPGKFDVEALIQRQLDAFAQRFFAPNRDTITKSGRTLHEVVVMASMLEREEPLPDQRPLVAGILWKRVDKGFPLGVDATSRYELAQWNDRVAFLKRLRDPQDPYNTRHKKGLPPGPIGAPTVSSLQAAMLPKPSEYWYYLHDAQRILRPSRNAEEHEALRRKYNVY

SEQ ID NO: 15019 - protein, 342 aa, Myxococcus xanthus
MESAAPDSLPVPDASGDDLRAVEELAQARNEIVAQIEKRVVGQREVVEHLLISLFSRGHCLFVGVPGLAKTLLISTLADVLNLSFNRIQFTPDLMPSDITGTDILEEDRTTGRRTFRFLQGPLFANIILADEVNRTPPKTQAALLQAMQEYRITAGGRTYPLELPFLVFATQNPIEQEGTYPLPEAQLDRFMFLVDVGYPTADEEVQIVKSTTGGPQPKLEKILSPERILALQELVRRVPVPDHVVRYAVELVRHTRPKEPGALDFIAKNTSWGAGPRASQYLVVAAKARAILHGRFVATVEDVRALARPVLRHRVLPNFTAESEGITSVKLIDQLLTVVKG

SEQ ID NO: 15020 - protein, 292 aa, Myxococcus xanthus
MLLDAQTLARLQGVKLRARAVMEGVLSGLHKSPHQGQSVEFAEHKEYAPGDELRHLDWKAYGKFDKYYVKRFEHETNLRAVMVVDASASMGYRSGALSKLDVATTLAGALCYLLVRQQDAAGLALMAGGKWKDVPPRASAGHLNVLLDTLEHTEPTGTTDLGSAADHLAEVLPRRSSVIVLSDLLDENQDALRRILALRQRKNDVSVFHLVDPAELTFPFDDPTLFIDMEGQGRIEVNPREIKESYLEEFNAFLANVKAACAEADVDYDLVRTDDKLDDVLLRYLSRRGRRR

SEQ ID NO: 15021 - protein, 298 aa, Myxococcus xanthus
MQLFLTGASGFIGGSLAHSLKARGHAIRGLVRDKVKAERLAALGIEPVLGDLEDRALLTAEARRADAVINAASSDHAEAVEALLAGLRGSGKPLLHTSGSSVIGDDVRGEVLSDKVFDEDTPFIVEPDKRARHAVDTSVLAAEGMRGIVLCNTMIYGTGTGLSPDSVQIPPLVKQARKSGVVRIVGKGVNRWSNVHIDDVVALYLLALERAPAGAFYFVENGEASYAEIGAAIAQRLGLGPVQSWSVEEASREWGEGHARYSFGSNSRVRGKRARRELDWKPRHDSVTAWIRDEMPLG

SEQ ID NO: 15022 - protein, 314 aa, Myxococcus xanthus
LLGALGALIPLLVHLFDRRRPRPHPFGPLAFVMRSQKRTASRLKLKRLLLYALRTLILLAIPIALARPELTRDAAAAQVVKGPAATAIILDASLSMRWSDGTPLFERARDEARDALKDLLPEEPATVLVCTQSPAAPPPPGFDRGRLRSLVDEAKATHGTADLSRCLDMAARALEENPMPAKRLVLVSDMTAAAFRLEAPPPTVKGPTGAPVKPEVVLRDAAEGHEVLNNRAIVDLKVEPALQAGPRTFQFTFTVRNFGTEAVKDLDAAVRVGEFTLAKGFVDIPPGGTTQKTLTVRFPLGGTVLGQVTLAPDV

SEQ ID NO: 15023 - protein, 193 aa, Myxococcus xanthus
MLERLRQVSFEDARAFMLGFYARYLSVLDLPVPVIAAVDGPAIGAGLCVALACDVCLVAEDSKLALNFVQLGLHPGMGATYLAPRRAGAQAAAELLLTGRRFDGKEAVKLGLALEAAPAGQVLTRARELAGRIAANAPLAMRALKQRLGLDRAELQRALEEEARFQAESYGSQDLGEGLAAAAARRAPVFQGR

SEQ ID NO: 15024 - protein, 208 aa, Myxococcus xanthus
MDTALHAAALAPSGQSILAGQLVDALEVDGQTFGAPGVRGFVVLTFDASGRLLWGKELPGVKGRITSVTVGADGTLVAAGDFIGLLVWGDASLGSSGAFVLTAGADGSVGWVRQPLCGPVTELGASVAVEDAGGVAVTCGSVLTRYAASGAWLGEQTLEAQPCASGVCSLTTAGVATVPGRGLAVTGWQRDGAGDTWNQDAFLRLVVP

SEQ ID NO: 15025 - protein, 239 aa, Myxococcus xanthus
MVAAYAAAGTPVRDVEELVLRQTRANFWDPDPIGAVLNADAAGHGLTGLLKGERFRKLLDATLPVRTFEELPHPLLLVGANLTLGSHDVFTSGELAPRVHATCAYPGLFRAVPLEGSLYWDGGLVDKAPALSLHESAVGAELDAILVHYLPSKTRKVVGGPMAYAQGLAAGSAALRQDHFRLQLTVLEQKQVPVYVVVSNLPPVSPTTMERGFDALDQAKLGAERALARPPVPFAQAEW

SEQ ID NO: 15026 - protein, 148 aa, Myxococcus xanthus
LSLSVLAFAPSAVAAPPAKSLKPRALAAKPTGRELAGDAYVERIVVKFHEGSRVRLRDQQLVALSSDRDAAERSLLAGRGLGDARLEADLGHVTSLLERAPRIGAMARLFDEAESTLEARKASGERKSGEQLADLNMDFQVPLMPGTT

SEQ ID NO: 15027 - protein, 767 aa, Myxococcus xanthus
RERVLVLDGAMGTLLQNEDLKAADFGGPEYEGCNEHLVLTRPELVESIHARYFAAGADVTETDSFGGTPLVLAEFGLGHKALEINEVSARLARNAAAAAEAKDGRMRWVAGSIGPTTKAISVTGGVTFEELVDNFAVQAEGLALGGSDYLLIETAQDTRNVKAALLGAERAFQKLGYALPVAVSGTIEPMGTMLAGQSVESLAASLEHTDLLYLGLNCATGPDFMTDHLRSLASMSAFPVACVPNAGLPDENGNYLETPEMLARSVRRFCEQGWLNVVGGCCGTHAGHIETMAKAVQGLKPRAGSPRPRASLSGVDYLEVTDEQRPLIVGERTNVIGSKKFKELIVAGQFDDASEIARAQVKRGAQVIDICLANPDRDELEDMRNFLEAVIKKVRVPLMIDSTDERVIEMALTYSQGKAIINSVNLEDGEERFEKVVPLARRFGAALVVGCIDEVGMAVTRQRKLEVAERSYELLTKKYGMKPEDLYFDPLVFPCATGDAQYIGSGVETIEGVRLIKQRFPRSKTVLGISNVSFGLPAAGREVLNSVFLYHNVQAGLDMALVNSEKLERYPSLPEEERKLSEDLLYNRGADPVTPFAAAFRERKAARVQVSTLPLEERLQRYIIEGTRDGLTADLEAAMQKYTPLEIINGPLMKGMDEVGRLFGANELIVAEVLQSAESMKAAVSFLEPHMSKAQAAMRGKVVLATVKGDVHDIGKNLVEIILANNGFHIVNLGIKVPPEQLVLAVREHQPDILGLSGLLVKSAIEH

SEQ ID NO: 15028 - protein, 215 aa, Myxococcus xanthus
MARQAEDAAGDSARLKDLLRAREDRQALNERLLEPGQSWFLWAGALASLLPPLEVADFGCGTGVLSVAIARWARRVWAIDQNADALEQARERAGREGLENIRFLREDLHRLSLASGSLDLVVISQSLHHVEEPQSVLSESARLLKPGGRLVLLELMPHEERWVLERLGHRHLGFAPESLEAALREAGFTSLTRETHARDGASPFRVFLLTGVKPS

SEQ ID NO: 15029 - protein, 236 aa, Myxococcus xanthus
MRVAGALGQGLLVAFRLMGVGLWGALKGGALFGLVGLAVGAATYALPRWLGVPPAPTWLVILGAVLPPLALSVAGGYAFMLQAVSGRLAEAAKSRGVVARVYSVLKPVTAQVARRLQGSGSLSREELSRVVNESMSEHLRQAEQARGEAPSSRMAEVERFLMEQSRRVLGVLALRAVVSAPDTATAVRNLETLGIERVEMMLVESLEDLFFLQVLLAFGAGVLVAATPALLMVWLR

SEQ ID NO: 15030 - protein, 103 aa, Myxococcus xanthus
MPVIHRVLFPATPQATLTPAKALLGCVVGPGDVPIPGALVELPTLKLTTRTDAKGCFRFPSVPPVPTLGRLEVRAKGALLEMGLEVLAAEPQPLLIRLPLKEE

SEQ ID NO: 15031 - protein, 235 aa, Myxococcus xanthus
MAVATFILLGTVASLLAAGRARQPSPGAPCPDGHCGKGLTCAKQLDGGVCLASQGQPCEAGSQCITGFCEPGVGCTVPLGKDCVSPEDCPGALTCADVLGSSVCLLEPGEDCEHDRDCASFFCNAERKCNRDDGRCDSNAECHSPTQCGATKLCQLPDGQPCMRHEACLSGYCSETCQISPESFQCESPCPAYTACVSGSCTPVDGKLLNQNMLLTAPRILKGIRELRIQQGTQP

SEQ ID NO: 15032 - protein, 165 aa, Myxococcus xanthus
MRTHTEAIPYEVHRDDGLVASDDPARIDLDVVHGYLSRSYWSAGIPRETVERAARNSLVFGLYSSGGQVGYARVVTDRASFAYLCDVFVLEPYQGRGLGQWMMEALLEHPDLQGLRRFLLATRDAHSLYARCGFQPLGAPASFMERHDPDVYVRNREEGAKGKAD

SEQ ID NO: 15033 - protein, 152 aa, Myxococcus xanthus
MTAPVQLDAPDIQDVVQSRTLGLAYVGTVLVVAHNAQPPAPDDWARYCELIARHQDTATGQLVLAEGPGPNATQRQQALNQVPKDYVIPPTAVFTESPLVRGVVTLFNWFSPRAMRAFIPGDIPGAARHLGLSEEQVRRLVDIGKTVRPALQ

SEQ ID NO: 15034 - protein, 152 aa, Myxococcus xanthus
MALKADGTVTVWGQDVFDLLVVPADLDDVVAISNTSSSALALRADGTAAVWGFGAAYYDLALTPDLSDVVDVAAGEHHYMALRSNGTVVAWGNSAFGQTTLPPGLTDVATVAGQAFNKSLALRHNGTIAAWGDTTSASSLPPPGLVLRVPAR

SEQ ID NO: 15035 - protein, 246 aa, Myxococcus xanthus
RGPLRGQARGRLSVRPGRFPVGYSVVNTDCDDTAPLLWRLLAYSHRDADGDSFTAPEVGTVCSGMALPPGHATTPRGNDCDDADPSIHTTVQAWTDADGDGVGAGDAVALCTDGTVPAPWSARGTDCAAEDAARWRQAAYAHVDRDADGHTHPEAGTVCTGASLPEPYFTQATGNDCDDSDAARYRWTVLYPDMDGDGVGTSPRTIPCIGAQTPLGFSLKGYDVDDSDASIQEDPEDDLMLELILD

SEQ ID NO: 15036 - protein, 243 aa, Myxococcus xanthus
MSGFVDLHCHLLPGVDDGARTLEDALEMARALVDLGFSTVAPSPHARPEYAPVEVVDVRRAELAEALERERIPLALGRNAENVLDDAFLRGLSTPQARKLGPGRYVLVELPYTAPVPALPDILFRIRTKGVVPLLAHPERCLEFERKGRAAEAVRAGALLQLDIGALIGRYGGTAKKLSRAFLDDGLYAVGATDLHGPVGARDWVGRSLAELRSRAGEASFARLMRDNPATLLAGESLESDPD

SEQ ID NO: 15037 - protein, 338 aa, Myxococcus xanthus
MWWAFRDTDWATQLASLKSANYAWLVPYFGCLLAIHVFRTLRWGCLLSGLEQVPFRKLNEASGIGFMMLLVLPFRLGEFARPFLIAQRSGIRRSAAMTSVVLERIVDGLFVAAMLRALLFFVPTETPEIRYVKLGSWLMFAVFGGGLAFLLFGLWQQQRTVNLVRATVGRLAPQVADKVADIVDTFVGAMRQLPKGRQVALFFLYTGLYWGVNGAGMSMLANAFDCSGAAPGTVCEPMDLTLFQAYVVLGVLVVGLMIPAAPGMMGTFQAATKVGLSLFLPAAAVNASGLAYANVMWLSQTVQQVGLGLILLSMGHLSFKDIAGKLDDKDGEAAAPSA

SEQ ID NO: 15038 - protein, 234 aa, Myxococcus xanthus
ATHFDPSAAAQPDSGVFGLPHSPEEAHVILIPVPFEATTSYGGGTSEGPTAVLEASRQVDLFDVETGRPYERGIAMLPEPQELRDWNTRAKERAQVVIEAGGIHSGEAALIQAAQDVNVLCDQMNEHVYRTTKHWLDQGKRVAAVGGDHSISYGIIRAHAEKYPGLGVLHLDAHADLRVAYEGFTWSHASIMYNVAERIPGVKTLVQVGLRDMSAEEYQYIADSQRPRARLSST

SEQ ID NO: 15039 - protein, 164 aa, Myxococcus xanthus
MESVLVEEYSVTIDQLDAGIAEHGNTNAPLVFATIDLIRQVATRAPASKTLKKVSKNPFVHHGDLVVEGPLKVLSLLVTGNLTVKGKASNFEGCQLFVGGDFECDTFQTEGPVIIGGNLKASTVDAFYNDYSLDVRGVLTADRLVIEKHQVLAGRFDVKERIEK

SEQ ID NO: 15040 - protein, 113 aa, Myxococcus xanthus
MTEQQQELEKLFRQINDLHYIQTYHRVEMPEAEYRQSLAKAERKNAEVVTQIRALLASGVSLDFKTINGHSPMMIAVPQNNVDVIQLLMEYGARHPGGFELRVPDSPGCGVRR

SEQ ID NO: 15041 - protein, 243 aa, Myxococcus xanthus
MGLVGGGAWSDLLVTHEREAMPIPDGMDFTDAAAIPEAYLTAFDALVLQGELKPGETVLVHAVASGVGSAAALICQAMGARVVGTGRNAAKLARAAAWGVARTVLCDTRPPRFADAVREETGGRGADLCLDLVGGGYVPETLNALAPRGRLMLVGLVAGAATEVNLGTVLTKRLRITGTVLRSRPLEEKIALAQSAERHLLPLFRTGALRPVIDAVVPRADIRQALERMAGNDSVGKLVVRWA

SEQ ID NO: 15042 - protein, 163 aa, Myxococcus xanthus
MRLPIVSAALALAAAGCATPGFDKLYPGMSSHQVVDAMGSGPTRAQEFPDSSTAWYYGEDRCVLMRDDKLVAKATSEDSTTINTPVVSVRDTSKALCAPEGYASSEKREQVIDTPFGTLKGNIDPKAAMEKVKGVVTGKSGDTAPAKTGAAPAETEQASTPTP

SEQ ID NO: 15043 - protein, 97 aa, Myxococcus xanthus
MKAAWLEDLLSLIPPISFLVGSRVAHRKPSAEYPYGYHRAVTVAYLVGSVALLFMGTWLFVKSVLKLVRAEYPSIGTTQLFGHTVWMGWLMLATLLW

SEQ ID NO: 15044 - protein, 231 aa, Myxococcus xanthus
MGLRFTAVMPEGVTGERILTIRAYGGDVVLVPREAGVHGAIVKAEELARERKAFAPRQFENLDNAEAHRVWTGQEILSQIPGGLVHGVVSGVGTGGTVVGLYQAFAEAGCPVTAFVARPIAGLGCDIECCSFSPRVPGVVDGMSRLYREADMPGRVEIDVSDDVAMSTARALIRRGFPVGPSSGLNYVAAVEAAKRLGPGAQVVTVFPDRMERYFSTELIQPKPVPARGAA

SEQ ID NO: 15045 - protein, 135 aa, Myxococcus xanthus
MLVRVLTVLVVLGLPPIAGAVEGLFHFCQGTVKLDLTCVCPQSKRTKAAPDTQEAGIRGNHHDCCGELAVQLPAPEPVTASSRHAWALTPLAVLPQAVPVVPPAPEALPTSWVRIRGVHHATAPPLYLQHCSYLI

SEQ ID NO: 15046 - protein, 355 aa, Myxococcus xanthus
MLTYEVAPLSITGSVPFGQVVGLSQQLPFPGKRGLRGEMALAEAQAMREDREALRLRLALMASTLFDDLFVVERSLDVTAEHLRLLGQLKKSAEAQYVTGRASQQDPLQAEVELSEVLREQVMFEAERERLRAQLNGLLHRAPQAPLPPLPEAMPAHTAESVPAERLQDEALRLRPELEGLRARLGGGEAAVRLAKRDYYPDVMVMGEYNSMWMDTPHQFMAGVTINIPLDFGKRKAAVREAESGLKRLRREEEQLISDIRVEVEQARSRAEEARRVVALFQERLIPAAKDQVSAARAGFESGKNSFQVLIEAERGLRRVELREQTALADVQRRRAELDKAMGHTPGLPRNGETR

SEQ ID NO: 15047 - protein, 412 aa, Myxococcus xanthus
MVEGVNQWLQREPKLENPYMGRRMLACGTTSEWRSAAPAGAHGEGDIAHYTCPMHPSVKQHGPGACPICGMDLTPVSRAELQSGIIRVDDLRRQRIGVKTAKVEQSSMDLSLRALGRVTFDEKSLVDVTLKLDGYIHELRVNATGEPVKKGDVLFTLYSPELYAAQQEYLLARQSQSAANASLVGAARKRLELWGLSAAQIERVAQRGQPVENMPFLAPASGYVLEKNVVEGAAVKAGERLFRIAPLAKVWVEADVYEQDLARVKPGHPVEVTLPYLPGKKYAGSVGYVYPSLQGATRTGRIRIELPNPELELKPDMYADVRFLLQGGAPRLQIPDSAVIYTGPRRLVFVDLGEGRLRPQEVKLGIKGNGTYEVLEGLSPGDVVVTSGNFLIAAESRIRSATDDFGGSHAAH

SEQ ID NO: 15048 - protein, 76 aa, Myxococcus xanthus
QPTENGEQGFIGRIIGACARNPFLTILLVGGLAAWAVHAVRNTKLDAIPDLSDTQVIVFTEWMGRGPDLVEDQITY

SEQ ID NO: 15049 - protein, 323 aa, Myxococcus xanthus
SAPLERELLVRIHDLMVKTRVLEERLIQMYKQGHGYFWIGGPGEEAFNVSLGLLMKKGQGPDFDYLHAHYRQSGTLLALGEEPIGSLRQMKNTATDPYSGGRNFAGHYSARKYNVAPVSSPIEVQYAIAPGTAMVQKRHGGDGITIVTGGDAGTAEGDFASCLVWSSRPANPLPILIIVTNNKWGISTAAEGQHGEQRISDRGKAFGIRSKTINGNDAVEAYTELREAMAYVRTERKPFLLEANVSRLYGHSSASGANYVSNEVDCLTDFEAKLEKDGVLTREQMDALRNSYTEEMAAAARQVRDEPQPDPESIWKHIYAEDK

SEQ ID NO: 15050 - protein, 343 aa, Myxococcus xanthus
MALHYAEEHLGVTDIFGEDVGAPLGGVFTCTQGLKTTWNSPLDERGIIGAAMGIAMAGGRPVAEIQFCDYVYNTIDLLKLAGNTSWSTFGDWNLPMVVRTPVGSGIRGSIYLWHSFDATMTHIAGWKVVMPSTPLDAYGLLITACQEKNPVMFLEPKALLRVKGEERIPGEPEDDRALSKLIDAPLGDRSQWKPQWPTGLEAYAVPFGKGKIVREGTQLTVVSYGRTLPLCTKAAETLAADGISAEVIDLRSLWPYDWELIKASVQKTGRVLFVNEDTEVTNFGEHLVRRTVEELFYSLLAPPRLLAGKFLPGIGLADALEMASVPQLGDITTAIRSLAGEQP

SEQ ID NO: 15051 - protein, 133 aa, Myxococcus xanthus
MASLLKELGYPQGTDQQTVHWVVSHPEIEIFVAGDPQDRPVGMVSFSHRPQLRLRGRVGTIDELVVTETWRRRGVGRALIRQILERCKVLSAKQLQLVSPMTTTPETRNFYTACGFTEIDSGVFRHVDTESQR

SEQ ID NO: 15052 - protein, 291 aa, Myxococcus xanthus
MRVDRRYVLTGTLALALWAVACNGGNGPGPGAPRDAGTDGGRTPTVDGGGTDADGGARDFACNVARQEGCADGQDCYFADLADGGTGSRCFEAECDVVAQDCAQGQRCTYAMENDVTQRRCVAPGTADEGAPCTLAPSDGRLAYDTCRQGLFCREAPDGAGSGFTCQRLCHATTQCGNTSECNTVLRLDGTKELPLVCGPPSTACTPFGDDCEAPLSCYPSTSGPLCAGSGNRTEGQSCDFSNQCAPGSACVNAGGGLTCRPLCQPGGTPACSTGGCRALDGNPGVGACVP

SEQ ID NO: 15053 - protein, 323 aa, Myxococcus xanthus
MRVPVARDGGRIRVTFRAGNGSMTLVRATVAQAGANGALASTPVKLSFDGAEGFTVDARSRKTSDPVDFPVAFRDELAITFEARGALAASTISAFPGSFARVGNHALVTGALGGTLFDRAVGVATVDVEGSTGRAFVAIGDSITEGYVDTKNDTRNAWPAKVEAALGVPVVNAGVSGQGFYDALAHLDGEVLALQGITDCIVLLGTNDLGDKDSLSLIQARMNTMLGRLAPFCRTWVSTLLPKEKSNYAPYEVVKSQRPELNTWLRSGAAGPDIIDLEAVTRQPANVHLFLDGLDVDGIHPSVEGHRVMADEVTRVLREEGGL

SEQ ID NO: 15054 - protein, 100 aa, Myxococcus xanthus
MALRPGKKEAERAQRNAETLIAACRAYQARHGQLPDTLEQLVPEFLPQLPPAKFSGPHFGFTYDVSGPADARRHVLGWTDRIPFGRPFFVFEEERWGYLD

SEQ ID NO: 15055 - protein, 113 aa, Myxococcus xanthus
MENGDPAAYANRRADERVAARFEVRFNQTQDAARALRAYSINISAGGLCLLTRKSYDVGSHVRLSMAIEGEEFHLTGVIAWVRDEAEAIGVRFTDMSDEDRARLQRVVDSFKR

SEQ ID NO: 15056 - protein, 102 aa, Myxococcus xanthus
CALKLERVQAAMQPYLPGFEVTPQPGRAAFRLEPGGHDVSAPEGSREAPVSTFEPLLLQVNRLLEGAGAPVRWVPTEDDWILAPPGLAELLVLHGVLGSRKG

SEQ ID NO: 15057 - protein, 83 aa, Myxococcus xanthus
QRALKRTRLFVGVTGSYVAGVVADTVLGLRRIPVADILPPPLGGDAAAEHLLGVVQASGNQEAINLLNFSKLLQTARQRAVAR

SEQ ID NO: 15058 - protein, 417 aa, Myxococcus xanthus
MSLDTPNEKPAGKARARKAPASKAGATNAASTSSSTKAITDTLLTVLSGNLQARVPKELVGESGVELAHLLNQVLDQFAASEHRKHVAAQEIDQALDALIGLVREGDLSRWNTTTEDPQLGPLLEGFGKVIETLRTFVREINEAALRLSSSANQVLAASTQHETSSTEQAAAIHETTATMEELKHASAQIAENAGSVARVAEETLGAARAGRGAIGEFIQAMQQIRSDGVAVADSIAKLSKRVERIGTVVEVIDEIADRSDLLALNAALEGSRAGEAGKGFSIVAAEMRRLAENVLDSTKEIKNLITEIREATAAAAGAAEASKSATESGEKLGAVAAQAVEGILAGVQETSDAARVINLATQQQRTATEQVVASMAEIEDVTRQTTQASKQATGAAAELTQLAGRLAELIKRFKAD

SEQ ID NO: 15059 - protein, 777 aa, Myxococcus xanthus
MDTEALKKSLLKKFQEVTADRLQKIQLGVLDLEKETADQAAEDVARELHTMKGEARMLGLAAIGQLAHAAEDVLRAEREGKTATEVATDVLLRACDVLSDLNEDLSGANTGNPASEEMVRMLAEVSGQTPPAIAGARPVAPPPAPPPAPVAAPVVTPAAVAAPPAPVQAPVAPPPTQAPVAEPGAHAAAAAPHPAAAHGRDEEAPSAAKSAVADRSIRVNVEVLDALGLLAGDLLVESARGRLRSSETEALFERFSRLGDRFLRLAEEIDISNEVREQLDRVESDLHMLRDDAFRFVRRNDDGINTLHGNLAKMADHVAEARLVPLSTVFDAFPRAVREMSRTQGKEVDLVIENADIGVDRSMLGDVRDALVHLLRNSVDHGVESPDTRQQLGKPLNGRIRIRVRVDGDMLHIEVEDDGRGIDPERLRQAAISKRLINAVQAAALSEREAIELIFRPGFSTRDQVSELSGRGVGMDVVKRKVETLGGSVGVSSRIGRGSTITLRLPQSLALMKVLLVRLGDDVYGMPAADVEAVMRVKPDDRLEIFGTLAVRHRGKPTALVALGPLLGLNGGNRFDKPPAVVVRHGEDHAALVVDGFVDEREVAVKPCGGEFLKAAPFIAGTAALEDGRIAVLLHVPDIMAEVRRMARPVTQAPAAKRLRVLLVDDSPIARATEGALVKALGHSVEEAQDGEEAYVKVQNNTYDLILTDVQMPKLDGFSLARRLKSTPAVARIPVIILSSLASPEDKRRGLDAGADAYLVKGELGVEVLAQAIDRLT

SEQ ID NO: 15060 - protein, 334 aa, Myxococcus xanthus
MAFRVLMVGKGLRALAARGLFDGESLVPVGPAEVDFAGALVAVQRHFPDVVLVDLSALDALPAIEHVMVERPVPVLALHPGVLSGQEAFQAMVAGALDVLERPANPGPEFWTHVSRKLVLLAQVKAVRQVQTRPPPQAAREAKPPPPYPLVAIAASLGGPKAVAQVLRMIPRAFPAPIAYCQHISDGFTEGLAHWLSNETALRVLEPEHDVLMAPGTVYIAPSGSHLLVRPEGRLELDAGPALRGFRPSCDMLLTSAGESFGPRCIGVILTGMGRDGARGLKEIRERGGRTIAQDEASSVVWGMPREAVLMGAAHEVLPLSRIGAALMQWVDVC

SEQ ID NO: 15061 - protein, 554 aa, Myxococcus xanthus
MPVLGLEEPEHYIQRLTGAGGEEELRSLLPLVTVGHTEFFRDAKQFRALEKSVLPDLVSRSRREMRKVSIWSAGCATGEEPYSLAMVLAELGALSLEVDLWATDLNLAAVEAAKQGRFTSRRAISINQARLTRFFKPVEEGYEALPALREYIRFDGQNLAVPVFDKVALSSLDLILCRNVIIYFDLPTIRGLMDRFLAALRPGGLLFLGYSESLFKVYDRFEMIEVDGAFVYRRPLNDKSMRAPPLRITPYPGEPDVAARRPVPADAFTADLRKRMLPEDVPLTTRLPAVSASSVAAPGSPSVTLPALGASSSPRSVVPGRLPAVSPHSPLPAIAARSRVTAELPTVGSVDSARPRITTELPAVATTPRAPTVEVPAWPTLLPPAERLAMAVRKMAQGDFSAAIAGVQRLLADEPSDLDGLLTLGNLFSLTGRIPEAREAFAQAIQREPLCVEARVFGGVAALQAGELSEARSELSKALFLEPTLAIGHYLLAQVHERTQDHEAARRSYRNAIAQLRFPQRPLAGHYPEMPDSADAISRAARYALAALEEQPLR

SEQ ID NO: 15062 - protein, 103 aa, Myxococcus xanthus
MKFDIPHSLPKEEVKQRVDQLLQYWGGKYGVKADWQGEGAKIVGKVMGIQMDASFVITDKAVEGEGTDPGMLLRGQAKSYLQKKFGSVLDPSKSLDQVKSSLD

SEQ ID NO: 15063 - protein, 364 aa, Myxococcus xanthus
AIVSNLFPTYIIPGPPARAPPRPLNVPLFAVDASCVVPMQRIATRQIGAYTLRPKLKKLWPEYLDRAVPNRSVKAAAAGRKLEPDFATSDARESRESLDAFDFDHSVAPIQERGGRKAGLDALQAFVHQRLEGYDEGRNDPGLARQSNLSPFFHWGNLFAGEAARAAIRARGAQDASVQGFLEELLVRRELGFNYCFHTPGPQQLSVASLPPWAKETLTRHQKDAREHRYSLKQLETARTADGLWNAAQRELVERGRIHNYLRMLWGKKILEWTPSPQEALQRIAFLNDKYAVDGRDPASVANFMWVLGLHDRPFQERQVLGKVRPMSSLRTAARYNLAPYLERWGRPEDPPVKLKRVRKTAGP

SEQ ID NO: 15064 - protein, 253 aa, Myxococcus xanthus
MPLQAFVHYGNTYDNAFWDGRRMVFGDGDGDLFNRFTICLDIIAHELAHGVTEDEGPLWYFRQAGALNESMSDVFGSLVRQMKLKQKADAADWLIGKELLTGNVEGVALRSMKNPGTAFDDDVLGKDPQPGHMKDYVHTWEDNGGGHINSGIPNRAFYLVASHLGGYAWERAGRIWYDAIRDSHIKPDMGFLDFARITVMSATRLFGAGEEEDAVREAWEQVGIRVARSGVRMPAFVGAVTQPSPQAGRAPRA

SEQ ID NO: 15065 - protein, 67 aa, Myxococcus xanthus
MGHCHFHPAEGRDEARLVFDNPYPCRFDMGLVKGMARRFAPEATLTHDTSAGCRQKGANSCTYLVLW

SEQ ID NO: 15066 - protein, 113 aa, Myxococcus xanthus
MRIELKREGGPAYFPGLARPRVVDLTSLPPEQAEALRHSVQAARFFELPPVVGTLPPGAADARRFTVTVEEEGRRHTVQFIEPVEEPRLHDLLEQVTKAERAQRRGARPGTPG

SEQ ID NO: 15067 - protein, 367 aa, Myxococcus xanthus
TTLVGRHIGRYRILEQLGSGGMSVVYKGLDTALDREVAVKVLHPHLAGKDESRRRLAREARAVAKLHHPNILEVFDFSAADAQDAFIVTEYIRGQTLKAFMDEGPMDPPELAAMVIHELAAALAHAHESGVIHRDLKPENVMVREDGVLKLMDFGIARLMDIEERMTVTGTLVGSPAHMAPEIIEGLEAGPTADVFSVGIMFYAAMTGRLPFSAPNTTATLKRILDGDYEDARRRVPALSDELADICAICLQRDPERRYPDAARLRDALADYLAGLGFARVGEELVSYFADPPSYRKLARQRIVATLLERSERQLAEKRTPRALASLNQVLALDTTNARALALLKGIQRAQRIKTWRRRGLRLGVGV

SEQ ID NO: 15068 - protein, 181 aa, Myxococcus xanthus
MGRHAGFLTLESGIAGGADVILIPEIPYSVESVVEKIRRRSTRRRSFSIIAISEGAFPQGGELAVLDTAEAIPGRGVVRLGGSGKALADLLARHIEAEIRVTVLGHLQRGGSPSAADRVLATRYGCKVLDLVSAGQWDHMVALRAGEIIAVPLSESRKERRVDPAGELVRFTKSMGISFGD

SEQ ID NO: 15069 - protein, 160 aa, Myxococcus xanthus
MNPAARADMESRADRALRRGELTEALRLYESLVRAFPADEGLALKLANARELLQPAELEVLEAARAEASIPLPVGPSSPVQEGERLFALGDYAGAAACYRRAVQERPDSELLKERLIELYGLAKAMPLQSPTDRALPDKPEPRLQALLDRVASRRRLKRD

SEQ ID NO: 15070 - protein, 147 aa, Myxococcus xanthus
MSGSQGFALAPDLEISGQHVFVAWQDDSPGNFDILLRASNDHGATFSAPRNLSLTPGYSGSVSLSAAQSHLRVAWENTTAGSVDIFYRASGDLGASFTPVTNLSNTPTRSSAPRVFASSGGSHGYVAWLEDLANENTDVFFRRTEAK

SEQ ID NO: 15071 - protein, 64 aa, Myxococcus xanthus
MVLLGIATKNLPIGTAYGVWVGIGAVGAAIMGIVLFNEPATPARVFFLVLLLTSIVGLKVTSGR

SEQ ID NO: 15072 - protein, 343 aa, Myxococcus xanthus
MKASSRYQAGIFINTAGARLPQNGPDWGTLKEMLFGTQQRTPPSALPMERDVAAALAKPPESGLRVTWLGHSSLLVEIDGFRILTDPIWGERASPSTIAGPKRFHPPPLPLEALPDVDAVLLSHDHYDHLDMPTIRALVPRQVTFYAPLGVGAHLEKWGVPAERVVELDWWQEVSLGEGEGRLRMVATPAQHFSGRGLTDRNSTSWTSWTLLGSQHRVFFSGDTGLTEEFAEVGRRFGPFDVTMFEVGAFHPSWGSIHLGPQQALKAHEMVRGRTLLPIHWGTFSLALHAWDAPANELAAGARERGVSLLTPVLGRPVEPTRERADTAWWSTVQAAAVVGDAP

SEQ ID NO: 15073 - protein, 225 aa, Myxococcus xanthus
MLLFAGTGKAHGVEAASVPQAPRAERAGLAIWTASVIDWSLLLVGPILGVGLNVALPVGMNVPLTDTTDGVFELRPMLARKRCTNIHGDAMPRCGTLQALRATVGLAWTPWPGERGDGFFIQPKLSGMVTHQTVRGTEIPVTAEGTRMETGGQVSLGFDVGYRKTSRRSRSFLAPVIGVGVGYSWNQQRGRVDPGWLFAREQARGWKDKFIVDLNLDLLRFGATF

SEQ ID NO: 15074 - protein, 510 aa, Myxococcus xanthus
MRLSLTHKITLAPIIVALLFVLLSQGYTVPRLQEAFEAQGRELSGALPAVLAAAVADGMKRSAHDEVQQTLEAVARHGGAAYVAAFDAGGTLVGVAGEKAQMLRDAREQLRSSEGGLVLRDGDTELQDLVAPVPGDAGWVHVGFDRTHARGLVEGALANVGITVLVALLVFTAAAFLVSRAIVSPLNQLSSAVRHIAERGDLRQTIRIDSDDEVGQLARAVGMLVGKLKELLHQLQSSTELLSDSVSGLTESADQQNEMVTRHAAALQETQVTAQEIRQTAMLASGSAESVIQVAERAEQLSRTGEEAVSASIDGMEEVRNQVAEIAARITSLGERTRQISGITETVKDLADQSHLLAVNAAIEAARSGEHGKGFVVVAKEIRALADQSIRATNQVRRILQDINQAIIGTVEITVEGTERMEAGLAQVRTSGETLKELTAIVEDSTAAARQIARTVSQQATGIEQIFTAVNELNTLMTDTVSRISTTSDSAMSLKMLSERVSQVVRAYNV

SEQ ID NO: 15075 - protein, 89 aa, Myxococcus xanthus
MCRNIKPLFNFAPPATDADIRAAALQFVRKIAGTRTPSKQNTDAFEVAVEEIFQSSKRMLDGLVATTPPKDRARFEAMKRLRYKKAESR

SEQ ID NO: 15076 - protein, 208 aa, Myxococcus xanthus
MNDYELIGSPGCGSAIVEMALSITGIPHRLTELPYLEPGPGRDRLLKLNPLGQVPTLILPDGAVMTESAAIILHLHDVSPQSGLVPEPTAPERVRFLNLLFRLVGAVYPTFTYADDPPKWTLPGPAADRLRDTVMERRANLWREIEAQVGKPHVLGKRFSALDLYVTVMTHWRPNKAWFIQNCPALAAAASQAEKNPHVAAVLERHFS

SEQ ID NO: 15077 - protein, 154 aa, Myxococcus xanthus
PLYLTYQRVLDAVRIFAGVPFALVGGVLALLLRGLPFSISAAVGFIALSGVSVLGDMVLVSRVRALLEQGQALGEAIRQAAVSRLRPVLMTAAVAAIGFVPMALNTGVGAEVQRPLATVVIGGVLSSTLLTLVVLPVLYSVFGAGKDTPMTRTP

SEQ ID NO: 15078 - protein, 384 aa, Myxococcus xanthus
LRFIWSMWGPEPRLAHALVNAVAVLIIACPCALGLATPISIVVGMGRGAQAGVLIRDAAALEELAKVDTLVVDKTGTLTEGRPSLTTVVAAPGFDEARLLHLAGSIERGSEHPLASAIVKGAEARGAVLTETHGFKSVTGQGVTGRVDGAQVALGNARLLEGLGIEAGAFLERAEALRREGQTVMFVAVDGKPAGLLGVADPVKASTPEAVQQLRADGLRLVMLTGDSRTTAEAVARRLGIDEVHAEVRPEEKNAMVKRLQAEGHVVAMAGDGVNDAPALAQANVGIAMGTGTDIAMESAAVTLVKGDLRGIVRARHLSRGTVHNIRQNLFFAFIYNVLGVPIAAGVLYPFFGLLLSPMIASAAMSISSVSVIANALRLKRLDL

SEQ ID NO: 15079 - protein, 34 aa, Myxococcus xanthus
  unsure (1)..(34): unsure at all Xaa locations
PAGARELKNPLAPLSPQALAEARAHWXLTTAPIC

SEQ ID NO: 15080 - protein, 317 aa, Myxococcus xanthus
NRAAGQAQGSAQGHSCRGPGSVRRRKLPVHLDLQPAPPAGAFRKLALGTWRSPGDPSAYAAVEVRMERAVAFLEAFRARTGQRLTVTHLVAKAAADALRRHPEVNVLMRWNRPWRRKEVGVCVLVVQPSETGRADLTTATVHRADSLSLGAFAETMASRIAAVRARRDAVIERGKRRSSLIPGFLMGLALRMLSFVWFTLNVDLRWVGMPWDPFGSVAVTSLGSLGLERGYVALVPYTRVPFLLAPGAVRTEPVVDAGALVPGQVMTLTCTWDARLIGVEDAARVLRDIGAALEDPEGTWGSASPEGGGAASGAEVG

SEQ ID NO: 15081 - protein, 75 aa, Myxococcus xanthus
MSVDTNRRVIASRPVGRALGGQDRFEKEGLEGPAEGGLAMARRQRMAGGTLRAGEESPFAAKLRKLAGGASDDER

SEQ ID NO: 15082 - protein, 115 aa, Myxococcus xanthus
MFEKHYTPEQLQQLKARREALGEEAIRQVEAEWPQLIARVRAEMDQGTDPTSEPVRSLAMRWRELLKAFTGGDPGIEGALNATHQQEPEVAVKHGLDPALFAYIGKAMASLEEQA

SEQ ID NO: 15083 - protein, 322 aa, Myxococcus xanthus
RLDRPMVEADDDATVFGGDLVTSAVSAHPGPAAGVLLASAAAWFVRAAGLLGSLEDPAWTYGLVCLGAVLALVLVLNRGPAKGMAQVGVVVQLLATGWLAREAPLAPVHVAYFILGVLALVMVVGEPGPMRRYLGLGLGLGAAVASAGLLALPIAGTSGAGVRQSLVGSELGYRLELPPGWGQLTREQLAPHLVLPASTLQGGGVGFGDAAQERYGLLWVERGTGKAAAAGCKGLFQALGGALGEALSLPAPPALGSAATVHPLRTPGGAEGTLACGVLADGRLVGLVVVAAQASGGADEAAFPPAQHGLHGVGHGFQLDRF

SEQ ID NO: 15084 - protein, 288 aa, Myxococcus xanthus
MNPQPLPAPAPETPPTAPDSLARPFKLSRRFDRTGRLLGDSAMERLANARVVVFGLGGVGSFAAEGLVRSGIGHLTLVDHDDVCVTNTNRQLHATVKAVGKPKAELMAQRCQEINPAAKVEAVREFYRADVAEQMLQPGQYDFVVDAIDNVKAKLHLLHRCVTLGVPVVSSMGAAGRLDPTAIRVEDLSETHMDPFAKDIRKLLKRKYAVETDKHTGITAVYSIEARRLPVTLQYDDATDGFLCVCPQDNEFHTCDHRTQIDGSVAFVTSCFGMNAAGVVVRRLASAR

SEQ ID NO: 15085 - protein, 153 aa, Myxococcus xanthus
MVLKRHLALARKHGLPVLMHCHRLHPALIELLKEEPLPEAGLLMHSYSGGVELARFYLQKGCHFSFAGPVTWAEARKPLDALRAIPLDRLMAETDAPDQAPMPHRGTRSEPGYLPRILEGMARVRGEPVEEVARQTTENARRFFREAFPAPSR

SEQ ID NO: 15086 - protein, 61 aa, Myxococcus xanthus
MPALRRTAQRARAAAGKVHLTVGEVIAAAFETSGGELVDVLAQLTSPQMTRALGRRIVVEG

SEQ ID NO: 15087 - protein, 382 aa, Myxococcus xanthus
VHTAGGLFIIGTERHESRRVDNQLRGRAGRQGDPGGSRFFLSLEDDLMRIFGSERIQGLMERLGMEEGEVIEHVWLSRAIEGAQKRVEGHNFDIRKNLLEYDDVMNQQRRTIYKLRRQVLAAGAGVPLVEYDEDPKTRIKTRSERTVSWADFRELILDSMEDVIVSLTDTYAPTRGVEGWDIAALQQGVKETFNLEMNFEGVGNREELQEHIYKAAEKVFQARDEEFGENFMRFLQYNYLATIDRLWKDHLLAMDHLRQGIGLRGYGQKDPKQEYKKEGYQGFIQMLSAIKAQFVTQLMHVQPRSASSAAEEAARIQRQLAQQQKKAVEGRATADGKLDEGSVAAAARPAAASRPAVGRNDPCPCGSGRKYKKCHGASEASV

SEQ ID NO: 15088 - protein, 324 aa, Myxococcus xanthus
METQDTQTQQQAMAAAGGITMRQLLEAGVHFGHQTKRWNPKMKPFIFGARNGIYIIDLQKTVVMARSAFRFVADITARGGSVLFVGTKKQAQDVVREEASRAGQFFVTSRWLGGTLTNFKTIKQGIDRLKTLEKMAEDGTFERLPKKEVAQLEREREKLEKNLGGVKEMSKLPRCVFVIDPKKEHIAIHEAGRLGIPVIGLVDTNCDPDGIDFVIPGNDDAIRSIKLFTSKIAEACLEGAARYRASGAAERDEQEEREGRDDRGDRRDDRRGPRRGDRRDDRRDRGGDRGGDRRGPLVEMKGAAPVASAEPAAEAAPEGEAAAE

SEQ ID NO: 15089 - protein, 210 aa, Myxococcus xanthus
MVKELRERTNAGMMDCKKALAESGGDFAKAEEWLRKKGIAKAAGKEGRVASEGIIGTYVHSGRIGVIVEVNCETDFVARNPDFQELVKDVAMQIAAAGPKFVRREEVPTDNLDKEKDIQREILKQQGKPEAMLEKILVGKMEKYYEGVCLVDQLWVKDDKKKVGEMISERAAKIGEKVSVRRFVRYELGEGIEKKKDDLAAEVAKTLGQA

SEQ ID NO: 15090 - protein, 252 aa, Myxococcus xanthus
  unsure (1)..(252): unsure at all Xaa locations
MSSDTKKPLPYQRILLKLSGEALMGEGKYGIHPPTLMGIAEEVIELAQAGVEVALVIGGGNIFRGVAGATEGMDRASADYMGMLATCINSMAMQDALEKKGLHTRVLSAIKMEQIAEPYIRRRAVRHLEKARVVIFAAGTGNPYFTTDTGASLRAMEINAQVILKATKVDGVYSADPKKDPTARRYRSLTYMDVLKQNLNVMDSTAISLCMDNKAAPSSVFEPGRQRGNIPRAVLGEGXIGTLVGGSETVWA

SEQ ID NO: 15091 - protein, 185 aa, Myxococcus xanthus
MSGDVVAELKGRIDKSLEGLRTDLTRVRTGRASIAILEGVRVDYYGTPTPLSGVASVNAPEPRLITIKPWEKSVLKDIEKALREANLGINPMNDGEMIRLPFPPLTEERRKDIAKQVKTKGEEFKVTIRNLRRDANEVLKTQLKDKKITEDDHKRITEVVQKQTDAGITQVDEIVKKKEKEVMEV

SEQ ID NO: 15092 - protein, 196 aa, Myxococcus xanthus
PTVLLASGTGALDGEALCRSMRAEGLAAPVLLLYSPDEEQADTRAAQAGADGCLVGPLKRPTVLTCVSLLVQREEALRRVGSVGVRPPPPPFDGASHAGGPPPLPGALGGRMVPPPPPPLDGVDAPVESVDARGMPPPPPLDEEAPEAESAQARVVPPPREAEAPLSEGHGAKSASLPPELDEEPITSPSSEADST

SEQ ID NO: 15093 - protein, 70 aa, Myxococcus xanthus
CSKGDFVLKSKGVYNGSHVNWKGTRRLRCRTLRAEPVDGGDVFLDVDGETPGRLPCTMTLLPGAIRLKVL

SEQ ID NO: 15094 - protein, 84 aa, Myxococcus xanthus
MLPPDLGYEEARARYAPFNKLVDEDVPTRDVLARVCLAALRRDKPTFITINNKAEGSAPLSAIKLAERVVLGRREEAERHAATR

SEQ ID NO: 15095 - protein, 73 aa, Myxococcus xanthus
MSAGGAGAQGEQAAGRQQGDPGSISTNLSALKGEVSSLSERFKAARERRRLQAEKEKQEWEREPKAPAGPRRE

SEQ ID NO: 15096 - protein, 839 aa, Myxococcus xanthus
MFALDSLSRGGCMLGDEVGLGKTIEAGLVIAQLMAEGKSRILILAPATLRAQWNSELREKFDLDSVLVDGRTVRATGNCFDQPFPVICSHPFAANKAHLTAEIPWDLVVIDEAHRLRNAHRPNNKMGQALKASLAGKPKLLLTATPLQNDLMELFGLMSLLDEQILGPEHAFRSRYRADEAGGMPEAAAIELKERLAPVVQRTLRRQVREYVRYTNRRSIVEDFTPSPEEHDLYEKVSEYLQRSEAAAIEPGKKTLLTLCYRKLLASSTYAIAPTLRRLSDNLEKRLQAAKLGQQALAMFEPEEAKQFVEEGEEWSDDPAKAPNVRALEQEVWELRQYADLADSIKVNAKGEALKRGLDRTFAVMKSHGWPEKALIFTESKRTQQYLSNLLSESGYQGKISLLSGDAGTPEDRRALVEEFRHRTQILICTEAGAEGLNLQFCNLVVNYDLPWNPQRVEQRIGRCHRYGQQRDVLVINFLNRMNAADARLFELLEKKLNLFDGVFGASDEILGALESGVDFERRILDIYQSCRKPEDINIAFDKLREELEGRISQRMTEMRSVVLERFDGDVRRRLRGQNEQTKEALAKRQQEARALTASVLGSRNSGRLEVAKAAYAVKERTQDAVSYLQLDAAGLPSRLARLAGSEGWWFAYKFETTGLKPEEKLAHLVLVRDRDGFRALPMADSAHFVKLAAKPERRRQPAPVSVQLMQEQALMAAKDEIVRAAERRNAQELDKAKERADRYVEDCLMESREAVEAARQTWIEARKQVGLAEDIADKAKARAHSDRMEREYRRKLSSLRNEEEKRYASKDRQLAELANKAKVMEKRALIASAYFWLS

SEQ ID NO: 15097 - protein, 194 aa, Myxococcus xanthus
MAGRIQERRKLDHAVDAALRLARVGLEAGDVVGVLAFASGVRAYLPPRKGREHLRLITESLYRTEAALEESDYGRAFDFAFARQTRRALVVLFTDLVDPDASASLLTRTLALRPRHLPVVASLLDEDVQAAAHGVPAQTQDAYARQAAARLETEYRRTATTLRDAGALVIRAPARGFGAATLNAYLDVKARGLL

SEQ ID NO: 15098 - protein, 158 aa, Myxococcus xanthus
MAGPPDSDLDDVARIRLVLARELETINEYEAYARASSNPEVRAFFQHLAAEEKEHVSEAVHMLRMLDSGQNDHFAKPFVPGHFQAAEAPAPATVHVPTPDGPAFSVNGRNGRLPSEPPTSLPPQRLLYGLPAPPPAVESHPLTVGSLRRGGGGSGSGR

SEQ ID NO: 15099 - protein, 287 aa, Myxococcus xanthus
MPDFLGHAENPLREEEWARLNETVIQVARRSLVGRRILDIYGPLGAGVQTVPYDEFQNVSPGAVDIVGEQETAMVFTDARKFKTIPIIYKDFLLHWRDIEAARTHNMPLDVSAAAGAAALCAQQEDELIFYGDARLGYEGLMTANGRLTVPLGDWTSPGGGFQAIVEATRKLNEQGHFGPYAVVLSPRLYSQLHRIYEKTGVLEIETIRQLASDGVYQSNRLRGESGVVVSTGRENMDLAVSMDMVAAYLCASRMNHPFRVLEALLLRIKHPDAICTLEGAGATERR

SEQ ID NO: 15100 - protein, 459 aa, Myxococcus xanthus
MAKVLVIDDEANLRKVLAAMLRRDGFDVTVAENGEQGLAEFHKNGADIVVTDLVMPKVGGMEVLGTIRAANPDVPVIIITAHGTVDSAVDAIKAGAFDYITKPFDQAELSSVVAKAAKTNESARRSVRPDVKARAAIIGDSSTIQEVYKIIDKVADTPSTVLITGESGTGKELIATALHGASSRRDKPFIKINCAAIPHTLLESELFGYERGAFTGAVTSKPGRFELADEGTLFLDEIGEIPVEMQVKLLRAIQEGEFERVGGIKTTRVDVRLVAATNRDLQAEIEAGRFREDLYYRLHIVPVVLPPLRERPEDISLLARHFVAKHAMRVNRRVMGLDDSALRALARHAWPGNVRELENVIEQALVFAEGEQLTDLDLPSHLTASGTPRVEAGLPVLQGDRPLPDILEDLERQLIARAYEKASGVKTETARLLGIKTSALYYKLEKYGFLPKGTPPEES

SEQ ID NO: 15101 - protein, 60 aa, Myxococcus xanthus
MLAAGRAPAAEWEGALRGTGRLLLDTNAPRDLSDQLTPSPERDFALSLLGSAEGRGSFEP

SEQ ID NO: 15102 - protein, 257 aa, Myxococcus xanthus
VVVKRASGAIETRGPVGDAPAEATATAEETTAAAESSAATPAPTPRPVIPTPAPTSALYEEVPEAQSFAEMFEAQAKEGGTPSRKGLRVGEKVRGTIFQLGADTAFVSVEGAAKSEAMIELRELKDDEGILRFGVGDTIDAHVVEVGAKGILLSRALAKGSANLALLAEARASGMPVEGLVLSVNKGGVEVAIGDIRAFCPISQLDLRYVEKPDQFIGEKLQFRVSEVRERNVVLSRRSLLEDEQRQLAAETSKNPE

SEQ ID NO: 15103 - protein, 525 aa, Myxococcus xanthus
MGLVRERVFAHYLGNTEVAAVFKAALRIPNFLQNLFGEGVLSGSFIPVYAQLLGRKDTETADRVAGAVFGILSLVTAVVVALGMVFTPLLVDAIAPGFQGQERELAVHLVRILFPGTGMLVLSAWCLGILNSHRRFLLSYLAPVVWNLVIIAALVAAGGRYEEEALVSVLAYAVVLGSFLQFAVQVPSVLKLMGRFRPTLSLAAEPVRQVLKNFGPVVLGRGVVQFSAWVDTAFASLISNRALSSLLYAQTIYLIPVSLFGMAVSAAELPEMSRATGEGADVAARLRQRIDGGARRICFWVVPSAAAFLFLGDMVAAALLQTGRFDAADSRYLWYLLMGAALGLVASTVGRLYASAFYALKDPKTPLRFAVVRVLVGTLGAWVLGLWLPGWLGVPQHLGALGLTLASGLVAWLEAGLLRRKLVKQLGPVGVPSGLLPRLWGAAVVAGLVAVGIKVGLTSLLGPMPGVSAEWGGGFLMPPRLHPVLGFAAVALPFGAVYFGMSAALGIPEAGTVLRKVGRKLRLVR

SEQ ID NO: 15104 - protein, 124 aa, Myxococcus xanthus
MDFDKNQDFKNQGIHKGEVTSVKVESLTLKVLSPNDQDLRFLDSVEFYARAGDREARIAARQDVSALDLRPPNPVLSLRVDNVELQPFVSAPSMSIIIRGRGIMPAREVRLQAVVKLQVETGLL

SEQ ID NO: 15105 - protein, 102 aa, Myxococcus xanthus
MAFQDRSNALQALEAEFQAEKASSLRKLEVKLEETLRELSEVERQLRSLRTADRRAQIARHQALRKEAEHQRWCFMVQREACGFVNHDDLDRYYPLPPSWRE

SEQ ID NO: 15106 - protein, 220 aa, Myxococcus xanthus
MTSPNFIPSTKPLPFELHPSSIQGQGAFAIRRIRKGTRIIEYLGERITQAEADVRYDDESMARHHTFLFNLDKRTVLDAGTIHNEARYINHSCAPNCEALIEKGHIYIYALTSIEPGEELVYDYGYERTEDMGPEAEALYVCRCGAPNCRGTILAPAKKAPARKTSAKKAKTSSTSRKKSASKSRGNKGAGGKKAAGKKSSAGTRKSTQRAKSPSRKRAS

SEQ ID NO: 15107 - protein, 109 aa, Myxococcus xanthus
MLGWLLQVGRRSGWPDDVREELSALAVMMRGLSQLDPTAASTHVALGGGLALTKRAVLERCEPLWAATDAITRERWARDRVLLGVAGKVRAKRLDAARQRIHEETRRSG

SEQ ID NO: 15108 - protein, 202 aa, Myxococcus xanthus
MVPMEDPIPADSISGQTMNYMELLPKTVRVSTALLEGRRSRSWRAAESVGLTDMLRSDTFAGFAAAVTGRALRRKWGIQALCYGPGDYSGPHNDHHPEEPEARDGYVDMHVSLTLPGVDHQYLIYAQDGHFTQMTPVSTVGGITVYRLPFWHYTTPLLARKGKEETSRRWVLLGTFLDAAPGARPATTILPAQPPAKRLPAR

SEQ ID NO: 15109 - protein, 353 aa, Myxococcus xanthus
QFAESALREQAWLAGAAGGRERAFWKEKLQGLPPLQLPVDRGVSSATSHRGATVPVAFSPGLSEALRELGQREGCSLFMVLYAAFAALLHRYSGQLDFGVGTVTANRGSVPPDLIGFIANTLVLRSDVSGDPTFSQWLARARKTVLDAQDHQALPFSEVVKAVGASREGGLNPLVRACFTLENIPAPTLDLPGTRWSFLGGAPDGSVEGVAKFELSLILASGEQGLAGMLEYSRELFDATTAERMVGHLQVLLEAVVAKPETPLSKLPVLSTEERTRLLTAWNGPVLGVPALCMHELIQAQVERTPNAVAVVSGTRTLTYAELNRRANQLAHHLRRLGVRPEARVGLCVERTD

SEQ ID NO: 15110 - protein, 424 aa, Myxococcus xanthus
MRAFLFVSLFATTVATAAEPTHTAPPASYLLRPDRVFEGVTSKPHTGWVVLVTGDRIAAAGPEAKVKVPQGTTSVDLSGTTLLPGLIEGHSHLLLHPYNEASWNDQVLKESLALRVARATNHARATLAAGFTTARDLGTEGAADADVGLKQAIHQGIIPGPRLLVATRAIVATGSYGPKGFASEWHVPQGAEEADGVETLTRVVRAQIGQGADWVKVYGDYRWGPNHEARPTFSLEELKRIVDTARSSGRPVSVHATTPEGIRRAVLAGAESIEHGDEGTAEVFRLMAQRGVYLCPTLAASEAMFEHRGYKRGVDPEPTHLQQKRATFRAALSAGVPMCAGGDSGVFPHGENARELELMVAYGMTPAQALQVGTSNNAAMLHREDQLGQVKAGLLADLVSVKGDPWKGITRVRVVVMKGGTVAV

SEQ ID NO: 15111 - protein, 78 aa, Myxococcus xanthus
MYHALGLLAVGLLGHFRPSSLLNGAGWAMMVGIVLFYASLYALALSGVRVLGAITTLEGLGFLEGWLLFTVEAWRTTK

SEQ ID NO: 15112 - protein, 338 aa, Myxococcus xanthus
MGTIVSRIAASNASRHAAARRGSMTPCSDTKGRAGSSSAPTTSRSLPSRMRRPRGVSQSANSLGKAFIAAEHIAPRNLYSCLAIITDKLIFPGAPQAMSRIDSRPRVISNPTTAPARAQPAAQQAANVARATAVGHTQVNSFEGAARARPAAAAQPIPGAWRGGPDTEVGKAVQSIVSRLQANPDANNITIKGDTAASLFSRAILDSKHVTNEQLIAMANVSLDQLASDEKTKAKVYKKVPNVRDLPVHKFTVAMMSAATGIDPQKLSEAVPDLGLTGAPNTPLLYAAKGEGMQRSTALHDFTDYLRGAGIKGLNKAVWGVENRVLSAIVSAVGGGRY

SEQ ID NO: 15113 - protein, 188 aa, Myxococcus xanthus
LLGYKVTWSSQQRDDADLPWAEATRRHAVHTTVGVVLAAVAFFLSPGLLLWLSPVVAGLLLSIPLSVFTSRASLGLWLERRGLLVIPEETEPPRVLERAQEVAEEHALEPVKDAVDHVISDAKAHALHLALLESQPSPAAVPMALASARRKLLGDNVEPLSPPEKTAVLMDAPTLTEARERRLTLAVS

SEQ ID NO: 15114 - protein, 506 aa, Myxococcus xanthus
MNATPAPEATAVEVKARALKGMFVLAARTVASQGLRVVSALFLSRLLFPSDYGLFGIVSYAASLGVFLGDLGLSAALVRQPHEPTRDETFTIFWCHQALTAVVVASVCLLAPQLTRGYALGDGAVPMVWALALGLFLSSLRVIPLMALERQLAFPVIARAELIENVVQVITTISLAALGFGAWALALGGLVRGGVGLVCIWWASPWRPQGRFRVDVLRRLLGFGLAFQLPPLVAAMVAGWVPLVVGHVLGKEAVGLVNWAWALASTPMMLSVVLNRVAFPAYCRLQDDPEGFAEYLRTSLRRLASVLLLAIPLAVLAVPVAVPLFFGTRWLPAVVLVQWFSMECILTTLVGLLATAQNAGGRPWERLAVVVCVGAAKWGLGTWAIQRFGLEGMGPAGVVVGLAEVWVTAWLVERLNPSMRGLTRQVVEPFVTLGLVLLGACLAALRLVEEGVVAQALVGAVLFAILVWARERLPGTLPLLGELRQILEFIRARRAARPTPASPAST

SEQ ID NO: 15115 - protein, 316 aa, Myxococcus xanthus
MKKPDLVISIVNHSNPELLHDCLRTLYATTRDSSFEVWIVDNATGGRGVDAMRRDFPQVRWLFNTERKGFSANHNQVLRQARGRHFCIFNDDTIVHEGAFDALVRFMDDNPRVGMAGARLLNADGTIQNCTFRPMSLAGQLFDIVFLPRPLHFLKAMAIDPAQYGHDEARVSWVLGACIVVREEALAEVGLLDEQMSPLGNTEDTDWCVRAWKAGWEVAFCPEAVITHLTSRSFRPSDTGADKVRIELWRTRLAYFRKHHGRLHETAMRAILVGTLPYNSAVLTQTLLRGRMSLPEYRKQLATFLGISQMGLRARV

SEQ ID NO: 15116 - protein, 188 aa, Myxococcus xanthus
ACLKQQDSALSLHLLAGTAGPLLDEARALGVDARLLPLPEHLSTLGDSALRGHGPLEALRFARRLAPTSGLLVDHGRALRRDVADISPDLVHSNGIKTHLLSAATAGLPLKRVWHIHDFLGERPLVRRALRLLSPLASAAIANSRAVGDDTRQVLFRVPVHVVYNGVDTTHFSPGPADGAQLDRLAGL

SEQ ID NO: 15117 - protein, 248 aa, Myxococcus xanthus
MARAQLAGLERAAIVFHSTQAVRMELLAHGLVPESRLVWAPYGVSPEYRPVPTPGAPDASEAVLAPLGGRPYLLHVGSAIPRKRLDVLFAVFAALRARYPELRLVQQGGALNGTQRAQVEALGIGDALLQPPRQERATLAGLYRRATAVLVTSEAEGFGLPVIEALACGAPVVASDLPVLREVGAEACTYCPVGDVPAWVESVTALLAGHDTQPSREARLTRASRFTWSAHARTVLDAYLRLLGASTP

SEQ ID NO: 15118 - protein, 294 aa, Myxococcus xanthus
MAIAMDSVWDETAEALRDMADPQAWMATVTASVSMYLLLWALPEPVSKGVAALVTATAIAYLGVDTVWLLLDGWIALVRQVDRATTFAQLSEAGEAYGEVLGENAARIFVMLATAAIGNTAGLAAKAPRLPGSSQAALNVEVQAGYRYAALGRVESVAMTADGFTVALAPHAVAMAAGGSSGAGRIQKHHIATNKNDVSAARGGPWTPEFRRIFKRAGMELKDPENIVQIQGHQGPHPQAYHELVFRRLNSATARCRSVEECRKVLTKALQQLAREAATQGTEINKLLTHGHPR

SEQ ID NO: 15119 - protein, 236 aa, Myxococcus xanthus
MVRLVASAANRVFVSIPQWAEHLPARVRPHAAWLPVPSNLPVDVSRAAVDALRAELGEGPWLGHFGTFGRLTAEPLEAALVPLLRGEGTRRALMLGRGSRAFVEGVETRHPELRGRLVARDSLALDDIAVHLTTCDVLLQPYPDGVSTRRTTVMAGLALGLPVVTNTGHLTEPVWREHGAAALAEGTAPAALVERAEALLSSADTRRELGQHAARIYREHFALERTVEALLRVGPT

SEQ ID NO: 15120 - protein, 222 aa, Myxococcus xanthus
MRPGGNIFQFLKREVLVGEHEVLHRTLKEALVGTCDSVLDIGCGSRSPLHSFSNLLPHTVGVDGHPTSIERSRAAGIHREYHCMDLMEAGQRFGPKSFDAVVALDVIEHFDKPGGFRLLEMMESLARKRVIIFTPNGFLPQDEWDNNVHQVHRSGWEVYDFELRGYHVTGMSGWKPLRGDYALPRIRPFRLGSRLSILTEPFATRWPRHAFQLLAIRDMEVS

SEQ ID NO: 15121 - protein, 144 aa, Myxococcus xanthus
MSEQKPRLKRPVENVRAELLADPDTQRIAKSLDMELEAYVELVLDYAQNPDKEPTLIVAPDEELRAAGYNPPTTQDVANFFIAAANGELGIGPPKSYYSGFEGKQDDANKPSLRGDEGQEPVKVDEETSQKLRQHVPKGGPDRV

SEQ ID NO: 15122 - protein, 92 aa, Myxococcus xanthus
MIGGLLDKMPFGIGQLAKPFVDKFIDNGLAMVAGGPLGGVASMFGKAGTVGKLADMVETVRTGAKTVGDIAEGRFNAQQMAAFAQAQLMRGL

SEQ ID NO: 15123 - protein, 457 aa, Myxococcus xanthus
MPTVVGELGGIQHYAWVFTAYMLSSTITVPIYGKLADLYGRKPVLVFGIVLFLVGSIASGLSTSMAMLIGFRTLQGLGAGAMQPVALTVIGDIYTLEERAKVQGAFSAVWGIAGLIGPITGGFLVKYLTWHWVFFINVPVGVGCLVLLLSYFHERVERKPQKLDYAGAALLTGWVVALLVGVQGVGVNLWGLPVAAVLLAAFVAVERKVAEPIIPMSIFKVPAIVISSIAGALFSAAMFGATTYVPLFVQGVLGGTPTEAGGMITPMIVGWPLAALVAGKLLLKTGFRPLIVGGLGLTVVGTSLMALLLGPQAPRLLPEVAMGLFGIGMGFASTALLIAVQTSVGWELRGVATASNMFFRTIGGAIGVGLMGGVMVSQLLKDPTVPISAANALMSPDHGQDLPADLLATLSGALGTGLSINFWLICAFTVAAFAAGLFFPKVSRTTTVSSTEVVAPH

SEQ ID NO: 15124 - protein, 396 aa, Myxococcus xanthus
GLGTSLFDQFFSDFGDEDFGGLSRSLQQPVERYDITEAFSDETRRVLEAAFQAARSAGAASIDTEHLLVALAKDPLGRTALSRMKLDPARVAERAESEMRRGKRPMERPELSPHAKRALELAYQEAYELGHSYVGPEHVLLGLLHEGEGLASEILREQGAQHGKARAAVAEALAPSSEARRSPTPTLDEYCRDLTSLASEGKLDPVVGRANEIETTLEILSRRTKNNPVLIGEPGVGKTAIVEGIAQRIISAAVPDTLRDKRVLQLDLSGLLAGSKYRGEFEERLKKVMDEVKSHSEDIVLFIDEIHTIVGAGAAEGAMDAGNMLKPSLARGELHVIGATTLDEYRKRIEKDAALERRFQPVVVPEPTAEQAIEILRGLKDRYESHHRVRIADEAL

SEQ ID NO: 15125 - protein, 320 aa, Myxococcus xanthus
MGGRATGFSAFIDDISLTTEDGGGGGGPLSMTNGFYIDPNSNPANWVRANSGDSRAARIQSSVANNLAARWFAAWSGDITTAVSSFVSAADAADKLPVLVAYNIPGRDCGSHSGGGAGSPEAYRTWISSFAAAIGNRPAVVIIEPDAVAQLDCLANDAERQTRISLIRYATEQFRDRAPNTWAYLDAGNALWINADTMAQRLENMGVRNVRGFALNVSNFYTTAQSASYAGSVNSSLSSRYGYTKPFVVDTSRNGNGSNGEWCNPAGRKIGTTNQVGVGGAEMTLWIKVPGDSDGQCGVAPNTPAGTFVPDVALRMIDGL

SEQ ID NO: 15126 - protein, 188 aa, Myxococcus xanthus
MAPRYFDLSEDIQSGNWDLGDPRDAQGNEVEDPWMFRAGQPVQVQGRLTIPVDATGRRLDFSTAGIGVTPVVHVSVASLFAQLAPDDVQLIPVDVPGQPDSYLILVATKLIRCIDDEASQVQFWKPEDDLPEKVGQYSAVDSMHIDPSKVGDAKVFRTWGWDIALIVSEDLKSALEQSGATGMKFTPV

SEQ ID NO: 15127 - protein, 218 aa, Myxococcus xanthus
MQYGPRADVSLSHALSPLSAITTSVAFNYARFSTGANNTIVTLREAWGHRVDRRTSLEAGAGVSVVHTIPVPPGEGEPEPGPLDAPRTELLPNLNVGVSHRIPSRTADFNGRADLRLVPFTDRLTARVYPRADLTLTGTWALGPRVRVSAIGGGAAAVGGSRGDSILSGGFTGSWILTRWVSVDTDLRGTWSRSPELPAARLTWAATLGLSVRQTGIL

SEQ ID NO: 15128 - protein, 52 aa, Myxococcus xanthus
MSVLILTIALPAKAARDPHPMRGLKKAILWFVLFNAAYTYGVLVWVPRLGFG

SEQ ID NO: 15129 - protein, 134 aa, Myxococcus xanthus
MESDLHTVLLVEDAPFFRKMLGDYLRDMGFKEVVELPSGRAALKHMETAARPDLVCLDLTLPDISGYDLCEHIRRSATMADVPVLVVSARDLPEDKAHAEEAGANGYLGKPFTQEEFTRRVQSLLKSTGARRAP

SEQ ID NO: 15130 - protein, 431 aa, Myxococcus xanthus
MPRKYRVETRMLTQRNFIISSLANPGRSIPVDADQPTRAAWEMVMKHDNLKSIVAQAKLVEYWELQRSPLNRLKEKVLRKPPVAMSDDDKRDALTAMLEQAMIVGVEGGTGTVSIGVEWTDPQLALNIVQAAQQNFLDMRQAAEMGAVQEAITILEKQVVEEAAGIQQAIGQLNAAVKRVEARQKKEEEKKGRRGGAAAAANAALGINTDHLLAQMRFMIQTKRRAIGDVEDFRSRRLTELRNQLSEQRVIYSPQHPIITDLEQRISSLQEDSPQLIALRSEMTELINEYVRNGGDPGELESGLATAAMGGATFGGPATSDDPEVSVAADRVRMLVMRHQEKMRRLDQARTELEISRASMKHRFSVLSPPTFPERPSKPKVKLIVAAGVVGGIGMGIFAALALDIIRRRILEKWQVERILKLPVLAELERR

SEQ ID NO: 15131 - protein, 243 aa, Myxococcus xanthus
MQAHYGVMNPTASWRTRLMTIALGMFHKVRSQGREALGVSCGLRGNGMCFTHHALAKVPHDAFSVVEDLEYGIRLARNGFRVHYVWEADVLGEMVSAEKQSRSQRQRWEGGRAQMRKLHGWPLLKDGLRKRDGTLLDIAMDVLVPPLSQLVLAAVGCAVMAGAFAWWSHNPMPWALGVAGFSVASLGAYVLRGWWVSGVGVRGLLDLAWAPVYVVWKVWLMLRGPGAEKRGEWVRTSREGENR

SEQ ID NO: 15132 - protein, 82 aa, Myxococcus xanthus
MYMAGVKTAMDEAAKEEEAPVIWDDAHNGDLPEWRRECIRFYGDCKTEPGWTGPCYECLRRCEAQEEWPVSMCKPGRKTRRK

SEQ ID NO: 15133 - protein, 140 aa, Myxococcus xanthus
MFSIEIRLRSDAAVAAALSRRYAREHGLTAQASAEVAVVVSELATNLARHAGGRGWVELWLEAEWLFIRSRDRGPGMEDPSRFFAGREGRPSPLPGDSLGEGGAAVRRLTDDVQVANREGGGFEVLARKRVVVQAKRRHG

SEQ ID NO: 15134 - protein, 205 aa, Myxococcus xanthus
MSETAAWLVLRGTVESLGLSLDTATAADLPRIIEALEPATRHFVDPSRRPQMMAQLRAQRAPSAGPEGTATSASAEVRATTYLVRTEADASHARLAARMLCESLGGRGYECQKVATAVSELARNQISYAGGGTIQLAPQLAPKRLLRVSAEDSGQGIPDLERVLSGTYKSKTGMGLGLLGVKRLADRFDVRTGPTGTQVDFEVWL

SEQ ID NO: 15135 - protein, 44 aa, Myxococcus xanthus
MVRQECARTLVAVVDALGHGPVAAQMLAEEMLGLVLPAPTKSSV

SEQ ID NO: 15136 - protein, 347 aa, Myxococcus xanthus
MAGNSGEDNANPGNAREVAPERPDEGDSPVLDGVSDAELDAIVGQLRTDKSLRTRPSAQPRYREATQSERLHRGAGRSRASTLGEEEAPPKEAAPVVKHAWYFVAGGAAYGPHDLADLKAHVERGFLGFDSLCWREGFSEWLPLGHIPELASALLPPAVPAGPPPIPPEASGAFMPPVARAVDVSEATTERVILNAPGTVVPPFAAIAPAAVVATPAVSAAAMPQTQAYGASLSVDAPRAPAEGAVVGPAPEADVAALAPEPVTVPAESDFAAHGAPAPDPMPVAEPVGTHAVLALPVPEERARRKRQLGFILPGGAIQGVLPANQLRSHARVRCRSEVRHRRWTRA

SEQ ID NO: 15137 - protein, 412 aa, Myxococcus xanthus
MPSSVQKIGYLIPEFPGQTHIFFWRELQALQGKGVTPELVSTRPPPARIISHSWAREAMSRTEYLTPPGPLGVAKAAAEVARAMPTGWARCLASIARAEGLDAKGRAQLLAFAVMGGRLASLARERGWTHVHVHSCANAAHVALFANLLSGLPYSLTLHGPLYDYGPNQREKWRHARFAFVITKKLLKEVNDELAGALPSRIELAPMGVELRKFNRSVPYSAWTGEGPLRIFSCGRLNPCKGHADLIDAVGMLRAKGLDARLSIAGEDEAGGTTYRKVLEAKIQETGLGDAVTLLGAVSEDTVRGEIERAHIFSLASLQEPLGVAIMEAMAMRVPVVVTGAGGVPELVDDGVDGILVPPQQPRTLADKLETVARDAQEAHRLGEAGRRKVETTFSSERSADMLAQMLQRAVV

SEQ ID NO: 15138 - protein, 535 aa, Myxococcus xanthus
MADDIAIGIDLGTSFSCVAVVQDGQPTVIPNEWGETTHASCVSFLEDGSVLVGNAAKKNIITNPEQTVYSAKRLIGRYYFSDEVKKAQAVMPYRIVEGDNNSVRIAMNEHSYSLPEISALVLKELKAVAETYLGQEVTKAVVTVPAYFNDNQRQATKDAGRIAGMEVLRILNEPTAAALAYGFGRDVNQRVVVYDLGGGTFDVSILEIGKDVFEVLATAGDTYLGGDDFDDRIMTWLADDFLARTRLDVRQNKFCLQMLKEAAEKAKIDVGQTGSAEILCQGICQDADGNVMDLRGQLNQDQFNRMVMDLVQRTFKVCDEALQSARLTAADIDAVILVGGPTRLPIIRNSVKHYFQKEPLEGINPDQVVAMGAALQSHALLDSKTQTFLVDVTPLSLRIGTVGGYTEKIIDKNTPVPIDRSKTFTTSRDGQEKVKIRVYQGESNRADECEMLGEFEFAGFRIGYRGEVKIEVTFEINTDGLVHVSACDTATGQKTSTSITLSSGMSEADIQQSIQANRNIRLAGHNSDDLPAAAQ

SEQ ID NO: 15139 - protein, 126 aa, Myxococcus xanthus
SFADDTLSIRADGDIARYEVLELADPPRLAVDLFGVGLATRAPRVKSGALRDVRVGAHADKVRLVLDVRGTMRAYRVDRANRGLQVVLGRAVARKATPSAQGTQQSAFRLGLSESGQRDSRPYRRF

SEQ ID NO: 15140 - protein, 74 aa, Myxococcus xanthus
MVEDPAGRGHIVRRNTRMGRQGGKVTQILRDSVTVTEVFSGNGEIIKNPVTLQLKPDAKQDPAYNMMTGRNYGE

SEQ ID NO: 15141 - protein, 205 aa, Myxococcus xanthus
MDKYLDQFVKAPPAIKFGGLAFVVGALTAANFFMVIQPTEEEIGWAVAERRKLDLELADKSEIAQNLNERRREMDVLEQKLSEALTELPEQRDIEELLAQINDIGKKSGLELSSVTPGKESVGGGEFFARIPIKMTVSGNYHEIALFLQEMANMRRIVNVNNIKFDSAKLKNEKVVLQSEFQATTFRFVEQKAAASTAGNSNSKK

SEQ ID NO: 15142 - protein, 225 aa, Myxococcus xanthus
MMIRINLLPVRAVKKREMGRQVLVLFAVVLIGAGVANYLWYDDRQSELEAHQAGVASTKARIAELEKIIGEVKNINTRKAEVEKKLAVLDALRKGRSGPVRMMDALASATPKKVWVKTFSENNNAVSIDGSAVSHDEVAEFMRGLNGVVWTPKGMGRLVDRRRDSKTARVEMLTSDATIEEFPEAQVSPFFKNIDLQTAKQVGGAQVGVPILVEFKITMTSNYAI

SEQ ID NO: 15143 - protein, 342 aa, Myxococcus xanthus
MILLKEQRKRGEVIYALQSFGMKPLPPEAIVDGALMNSTAIVQAVQDLMSELKVKGKDVAIGVSGHSVIIKKIQMPRMSQDELEESIQWEAEQYIPFDVKDVNIDTQILDGGGNDATGQMDVLLVAAKKDMINDYTTVVSEAGLAPVVVDVDAFAVQNMFSVNYDVPERETVVLINAGASVVNINIISNGATVFTRDVTIGGNQFTEEIQKQLNVSYEEAEALKIGGNGADADAVVPQDVERVLSSVAEQVAGEIQRSLDFYAGTAADSNFSKVYLSGGTAKIPALFKTIEARTGVPVEILNPFRKIEVDNRKFDPAFVMDVAPMAAVAVGLALRRPGDKLA

SEQ ID NO: 15144 - protein, 408 aa, Myxococcus xanthus
LREVLHAHPALTVLVMTACGSQDQGVQAVARAECDYVHRTCRPDEIVFVLRKAEERERLVRENRRLKQASLPSTPGGHILGESPALHALLRQVARLAPVDTTVLISGESGTGKELIARELHVRSPRAPMSFVAVNCGAIPSGLIESELFGHAKGAFTDARTAKRGLFAEADGGTLFLDEVGELPLAAQVKLLRVLQEGEIRPVGENRVEKVNVRVVAATLRDLSRLVAKGDFREDLYYRLNVVNLRVPPLRERREDVPLLARAFIARFNRELNREPPVAGLTAEAEALLKSYAWPGNVRELENAMERAVLLADEPHILPANLPERLWAASPPGPHGEKPHGDPVLQGGGDLSLKRAIRELEESYIRAALRKTKGNRTRAAELLDISHRALLYKIKEYGIDPDAEAERG

SEQ ID NO: 15145 - protein, 307 aa, Myxococcus xanthus
MKPAVVVTGISGNLGRTLAKLLHKHERIIGIDRRPFAGRPKDVEMYELDLRKKKAEDVFRKNEIRAVIHMGIMHDPRMSEEEHHSFNVVGTTRLLEYCAKYGVKKVVVLSSANVYGPSPDNSNFLTEDAPLMAASRFSGVRDLIEVDMLAHSFFWKHPHIETVILRPVHIVGPTIKNAPSNYLRMRRPWMMAGFDPMVQLIHVEDVARAMVEALRPEPKGVYNVVGPGEVPLSAVMRELGNTPIPVPHPVARPLLGMLFKYRLANFPPPELDHIQFLCAVDGSRWVKDVAWKPRHSMRDTIRSVQGD

SEQ ID NO: 15146 - protein, 74 aa, Myxococcus xanthus
PEQPTFHALTRLEPLATSVLLVDDNAANLLALEAVLEPLGQRLVRASSGPEALRWLLREDFAVILLDVQMPGVD

SEQ ID NO: 15147 - protein, 112 aa, Myxococcus xanthus
MWGNAFLLSLIYLLLGLGVEIALRYFPSRFLQRLSLSLDSLPARALELTGAMEPLRAAYFSGRISEMGVRVVFGVTTMVVIFLLAMVVGTLMGGVRTLLARRALREGGRRHP

SEQ ID NO: 15148 - protein, 51 aa, Myxococcus xanthus
MRLPSASERTAVVTSEFVFRDGTWLLESQDDGPFEGELPSPSTSPEQPPSP

SEQ ID NO: 15149 - protein, 99 aa, Myxococcus xanthus
NYSELASTELRRWRKELAKDLGVAPFIIFNDATLLGLSAALPVDREGFLAVKGTGESRWERFGPKVVEICLMARAAGHEPQAVPDAAVRARKPTIRRRS

SEQ ID NO: 15150 - protein, 174 aa, Myxococcus xanthus
MGSPQAMRDVYARCGGRCFAIALRLLPTHADAEEVLQETFLEVWRRAREFNPERGGLEAWVATIVRTRAIDRLRAQGTAARVVEGAVQQEPPVSAAPAAPDEAVSQEEARARVVAALAQLPPEQRAVVELAYFEGLSQREISERTGDPLGTVKTRARLALEKLGALLEMLRPHA

SEQ ID NO: 15151 - protein, 230 aa, Myxococcus xanthus
MKAILVSLFLLGSAPDSSAPAIPPEALAAPPVADESPTAWSCTVDTLRAGKECVFEADLSAGAPSDSQDASNKKLLQDVARALCTEAVGNIREGRPDATLTALCERRYITAVDQCGLEGTSFVVDAKGRFAPGARSCYRALANVLQEVQFMATVASPCCECAARANCPGTADRCYAEVAQQATAPQTQACLSDRCADACAVVLPLPRSGAHPAPTVQQRNRSASPGSASL

SEQ ID NO: 15152 - protein, 384 aa, Myxococcus xanthus
DLDPLWYKKALIYELHLRAFHDSNGDGHGDIPGLIEKLPYLQDLGINCLWLLPHYPSPLRDDGYDIADFYGVHPDYGTLADFQRLVDEAHKRDIRVITELVVNHTSDQHPWFQEARSDPNSPKRNWYVWSDTDEQYKGARIIFLDTERSNWTWDPVAKQYFWHRFFSHQPDLNYDNPEVQEAMLDVMRFWLNMGVDGFRCDAVPYLFEREGTNCENLPETHAFLKRLRKTIDSEYKGKMLLAEANQWPADVRVYFGDGDEFHMGFHFPVMPRLYMAVRREDRTPIVEIMQQTPDIPDNCQWAIFLRNHDELTLEMVTDEDRDYMYREYATDPRMRINLGIRRRLAPLMDNGRRRIELMHSLLFTLPGTPVLYYGDEIGMGDNIY

SEQ ID NO: 15153 - protein, 243 aa, Myxococcus xanthus
MKALGKVGFTQSYTYFTWRNFKGELQEYLEEITQPPVSDYFRGNLWPNTPDILPEFLQNAGPGAFRLRAALAGTLSSVWGMYCGYELCEGRPIPGKEEYTDSEKYQLVAWDLDRPGNIRDWIARLNAARRTHPALHQYGTLRFFSSNNDRVLFYGKRTPDGGSLVLMAVSLDPYAAQEALLHVPLEWLGARPDETYQVHELMSDQRSLWQGPDVQVRLTPEQPAALWAVHRFRRTENAFDYYE

SEQ ID NO: 15154 - protein, 58 aa, Myxococcus xanthus
MGPARESLWAELESVVLHWVKQGVNTFSVDNPHTKPTQFWAWLIRRVQEAHPQVFFLS

SEQ ID NO: 15155 - protein, 86 aa, Myxococcus xanthus
MRFLGNDRWEGEFPLTRNGRYEYTIEAWPDLFRTWTSELKRKVDAGRDVRSELLEGASLLEGAVSRTRTAKQPDHSRVLDESDVRM

SEQ ID NO: 15156 - protein, 212 aa, Myxococcus xanthus
MATQRIHEEDSFENETFADLNLQETDLGGKEFYRCTFLNCTLQESRWTRTRMESCVFTGCDLTRARFTETSLRDVRFESSKLMGIDWTDVGTFPEVTFDGSNLRYCTFAGLSLRKTAFLRCTALEMNFIDTDLSEADFSDSDITGSNFRGCTLTKADFGTAQGVFIDPARNRVKATRIPVEAAVNFVQTLGLVVSGYGEVPKAKTERKKGRS

SEQ ID NO: 15157 - protein, 316 aa, Myxococcus xanthus
KPRRAAQGFSPLHGLEDVPQTPRTRLNAVMLTEQGEGGASGADGLFTRTELQDAILSNRGMIAELLIDDVVARCTGHTTVPYGTDTVDISQACSLIAQWDRRYDVDSVGAIVWREFAGTFTMGELQASPALYATPFDAADPIATPHTLAPAPAQGTDPVLTKLAQAVTALTRAGLALDLPLGEAQFTPRVSGERIPIHGGGNYDGAANIVGFGTLKSTTPNAEVGSATRTVVNGRTALANGGYVINNGSSFIMAMEFTPTGVQASALLTYSESSNPASPYYADQTRLFSQKQWRPILFTSEEIAAAPAEQITLTGD

SEQ ID NO: 15158 - protein, 326 aa, Myxococcus xanthus
RFAALLLALLPVAAGAASPQAATPPPRTASFALIIGVNRSHEPDQPALRFADDDAARYLDLFRMLGARTYLLARMDDNTRRLHPQAAAEALDPKHPELASSVKKLGEDIALARSRGVETVAYVVYAGHGNVRNGEGYVSLEDGPLTGQTLSSDVVGKLGADRVHLIVDACYSYFLAYSRGPGGQRRPLPAGFTRAVGLALADNVGLLLSTSSARESHEWEAFEAGVFNHEVRSGLFGAADADGDGQVSYREIAAFVERANAAIPNERFRPQLHARPPKGSELLVDLRPGMERRLEVDGAQGAHYLLEDANGVRLAEFHNAQGQSLR

SEQ ID NO: 15159 - protein, 97 aa, Myxococcus xanthus
MGTQGGTIARDEDFGGLARLTYELDDTRSFHAIACSVTGWLLYHRFFDNAAAATAAFEEMKPALEALLTQLPEGGPTSPANTRLAGPLLAAFTVRHG

SEQ ID NO: 15160 - protein, 260 aa, Myxococcus xanthus
MSNCYEVSLNERSALYNKDHQAIARRMKLVQEDFALSSKAKKRIWKRFPVSDNSKRKLTLSDFFDKGRQSLYWLRRGPEGWHIGVKHLDPVPNQTLKKGNRPQFQPRQNQLQGGYGAFYPYEHNYHHLIPVGAVEEWVIGKGESGSPARSDQVVKLILISRWNIHNEKNMVLLPQQEFEALIVGLPAHCPWGVPAHAAYQSSLQGRLRKLRSKIDRAIRQKKHPKDLKADIIEELDSLSNALLSQVENMRAGVQLGPVNV

SEQ ID NO: 15161 - protein, 127 aa, Myxococcus xanthus
MESEEDFHYFGALIALVLAQSHLGAELAAFERTLQGGGSHRFDVVQALSKQEADAFDAGLHGMIEEQAAWVERQRRSGLFDPYRHKTEAFVFVEGAALVQLARRLGVPTQERYRLIPSAALELQART

SEQ ID NO: 15162 - protein, 327 aa, Myxococcus xanthus
MASLFDASRVTERARVAREIEQACRDSGFFYVTGHGVSGEVLARLERESHRFFALPRVAKEAIAMSMGGVAWRGWFPLGGELTSGRPDRKEGLYLGTELGSEHPRVKAGWPLHGANLWPAEVPELRAAVLDYVAACTRAAHALMEGMALSLGLDADYFRRHYTADPTVLFRIFHYPAEPQHEEVSWGVGEHTDYGLLTLLAQDDNGGLQVKTPRGWVEVPPLPGTLVCNIGDMLDRMTGGWYRSTPHRVKNVSGKDRLSFPLFFDPDFAAEVHPLPRGAGADVDDDRARRWDGASVHAFQGTYGDYLLGKVFKVSLRSRPRGVPTRA

SEQ ID NO: 15163 - protein, 379 aa, Myxococcus xanthus
MAAASGATVANLYYNQPLLGDIGEALGASGSALGLVPMLTQVGYAVGMLFIVPLGDSLERRRVIVTMNMLVALALVGVALAPTLHWMVAASFVVGVTTIIPQLLVPLAALLAPAAQRGRVVGTVMSGVLIGILLSRTAAAFIGTHLVWRTMFWIAAGLMLALAGVVRFTLPSQPPMASMPYPQLLRSLIHLARTEPVLRLHAVLGALSFGAFSVFWSTLALYLQSLPQKYDAQVAGLFGVVGVAGAAVAPLVGRYADKRGDRRINGAAIVVLLLSFVVMWPLGRWLWGMALGVVLLDLGVQANQISNQTRVYSLRPEARSRLNTLYMVTYFAGGAAGSWLGTFAWTHWGWSGVCASGAALCVVALLALKRGPKGGAAKA

SEQ ID NO: 15164 - protein, 145 aa, Myxococcus xanthus
MASTNKDVETLNSFLRGEISAVETYRKAIGHVSDGLARDALEYCQHDHEHRIEEIRERILKMGGEPVESSGMWGTFAKLVQGGADVLGEKAAIQALEEGEDHGLADYQRDADQVHGENRRFVRMELIPAQKRTHERLSRLKRTLH

SEQ ID NO: 15165 - protein, 224 aa, Myxococcus xanthus
MDASHAGTLSAGCEALFRSTETTLQWAWRVLKCAKAGPGAGPLATSARQCALEFLDRVPPHVRRGVAELLGYSSLWQAVCTRLGRPVARSTEELQHELGEDLQVLLHGAQARLGTAAALEQGLLVHLGRLRDSRRGEPGAPLELRAALDAFTHSLSELMTAASAYRRAWEAAETELSESAAWLGAGDPGFCSWMADHLSETVFAWRNAQASVRTLRELGELSQQ

SEQ ID NO: 15166 - protein, 117 aa, Myxococcus xanthus
ATGASTADAAVILVDARLGVLPQTRRHAYIASLLGIPYLAVAVNKMDLTGFDRGAFERIGAELVDFAHALGFEGVRLFPISASRGDNITRPSARTPWHEGGSLLAWLESLPHQRRQD

SEQ ID NO: 15167 - protein, 305 aa, Myxococcus xanthus
MSEHTFARASHLSELEAESIHILRETVAEFANPVMLYSIGKDSQVLLHLARKAFHPAPLPFPLLHVDTTWKFRDMYAFRDAFVARHGLRLIIHRNQRALAEGINPFDHGSQKYTHAMKTQALLEALAAHGFDAAFGGARRDEEKSRAKERVFSFRDRHGQWDPRRQRPELWNLFNGRVDAGESMRVFPLSNWTELDVWHYVLRERIPVVPLYFAAERPVIDRGGTLLMVDDERMRLRPGEKPEIRRVRFRTLGCYPLSGAIESSATTVETVIHEMVNARQSERQGRLIDHDEEGSMELKKREGYF

SEQ ID NO: 15168 - protein, 29 aa, Myxococcus xanthus
MEALVEQGDLDAVLPAGADATSLQLQVIP

SEQ ID NO: 15169 - protein, 240 aa, Myxococcus xanthus
MSPPQPQASALLAEAAEVKDAPAQDLLAWTERRFGARAAIASSFGVEDMVLIDLARQHAPSLRLFTLDTGRLPPETYELMEVVRKRYGVTVETYFPERARVEALESTNGYFSFRQSLEARKACCAIRKVEPLSRALAGQQAWVTGLRREQSVTRTDVATLEVDSAHGLLKLNPLATWSSRDIWAYVRAKSVPYNALHDRGYPSIGCAPCTRAVKPYEDERAGRWWWESAENRECGLHPVR

SEQ ID NO: 15170 - protein, 553 aa, Myxococcus xanthus
WWRASPRGEYHPVARIFHLKQGKVRAGRVAVVTAGTSDIPVAEEAATTAEAMGAEVRRVYDVGVAGIHRLLRRREEVQECHAAVVVAGMEGALASALGGLVGIPVVAVPTSVGYGANFKGVSALLAMVNSCASNVATVNIDNGFGRWLLRRPHLPHEGTQVSTMRRILYLEPVGGIAGDMFLAAGLDLGISPAELERALSGLRVPGWKLAVSRAVRHAISGTHLDVVLDAREAHPHRAYADIRRLIEEADTLPPRAKERALAVFRAIGEAEAKVHGVSIDDIHFHEVGAVDSIVDICGAAVVLELLGNPEVHAAPPPLGSGTIRVAHGAMPIPVPATLELLRDVPVRFEGVGELTTPTGAALLKVLAHIGHPPDFIVKKVVYGVGTKDFKDRPNVLRASLGRLEQASNEGLWVVEANLDDATPQLLGHLLERLLAVGALDAWVTPVVMKKSRPGHLLSALVEGGTREAIVDVVLRESTTLGVRYHRVERQALERDWVEVETPWGKVRVKRGLRQGAVLNAHPEFEDCRQVAEAAGVPVKQVMAAAVAALGPKD

SEQ ID NO: 15171 - protein, 407 aa, Myxococcus xanthus
MEGHTQWSRRTGTESVPTFTLEAGDLFGELILFLNAPYPHSGDAVTDVRLFRLEPATFWELLRLAPGLSRGLMELASQRSQQQAQDVRPQSEVLPVGRMAAELGAELGSPAAAARRSAARLGELMATVSARAMALGDHGLSLPQRSVLLALPREAAERGRTSPPLEPLARAEREEALGSWLEARGVADAWEAAPALVASGLDVAWLESVATRVGGALLGDVLAWLVVAVSCDVLMAEVARGTARVSALVEGVKAYAFMDPVPREDVDVHDGLEHALAALGHRLRGEHLTVEREYDPHLPRLKAEGVALDELWTQLVLNALEALGERGGRVRLRTWKDAAHVVVEVSDDGPGIPKDLLPRIFEPFFSTKPHAAGMGLDVCRRIVERHGGDLCVRAEQSGTRIQVRLPA

SEQ ID NO: 15172 - protein, 439 aa, Myxococcus xanthus
MGWFGAKLVSVVSSRPTHQLLGGLLLALAPPMAARLGHLTLCSHWLLVAMMWLQLRDTPDAHAAKRSLLWAAALNAVGAGTHPYLVAMLAPLAMALTVRLALGRVISWGRALLASVGIVILDVLIFALFGYFVGSNLGAEGFGQFSADLTTLFNPTDWSRLLPSLPVARRQGEGFGYVGAGALLLVVLSVVGAALRFRALRDLPWRRGLPFAVAVLLLAIYALSSRVTWTGRLVVDLGGLYEPFSRLTSAFRASGRFIWPLCYAVMGGALLLWLRQWRERAWVGTAVLALVVAVQAYDVRQDKSELRRRPEGFRRLQAPEWAELKGHYQHLAIFPPQVQWVCPYNEPLVNATGYMAYRLGLTFNSGYVTRTPPSIAEECNATMRPGGVDGDTVYVVVRQQVGAFLRAGARCGMLEGLPVCVSGQRNDAFAQALTRQPLR

SEQ ID NO: 15173 - protein, 337 aa, Myxococcus xanthus
KGLFYSGGALTIRGSNPLNEVRVGPQTPEALPAVRVESLTLNSLPALSSLSGVAAVAPHFDLTIWNTGVQWSPDAFPHVQVLAGTLTVHENAALEKLPVSHLTEVGGSVMISSNPVLQSLEGLGPLTRVGGVLDISSNKALTHLTGLEHLMVVKDRITVMNNAQLLDLRFDALSETGALAVAGNAALEQVGPMPSLLRVNKDIILAENPRLLRAADLPKLQSMGGALFVNLNPLLTDLSGFEQVTWMRGLYVKGNDALEHLSPLGSLHTLGTLEVRGNPAMTALSLDALARVRDAFVVTDNPQLPSCLATMLADDVYIGPPEERLIGNNDSITPCHP

SEQ ID NO: 15174 - protein, 408 aa, Myxococcus xanthus
SRPILWVGVSGPFSQQVVSDYARYRVKEKLQTIPGVGEVQLGGMLERNVRIWVDAQKLDALGLTVTDVSAALQREHVELPAGRIETQGREVNVRVMGEALDLETLRRIIVREQGGFPVYLKDVALVEDGFEDVRRMARINGEPAQGLGIKKQRGANAVAVAQGIRAELDKMQKDLPEGMQLGINFDSTQFIEESVHEIEFELMLACILTAFVCWVFLGSISSTMNVVLAIPMSLLGTVAVIYFLGFTLNTFTLLGLALAVGIVVDDAIMVLENIYRHSEEGKDRVRPAREGTAEITFAALAATAAVVAIFLPVVFMSGVIGKYFLQFGVTLCVAVLLSYVEAITLAPARCAQLLKTSREGRSRIGVWVDRGFEKLERVYARTLAWGLKRPWWVLGAAVVLTASSVFRE

SEQ ID NO: 15175 - protein, 234 aa, Myxococcus xanthus
MDCGAGNYCINNQCIRGCYDDSWCDAKDTCVSGLCRPRPVDPNTCSTAADCSGGKDCVDGQCRAACDSTTQCPDDYSCQIGYCMPIPDGGQCRANCECPAGQVCFNGKCKSPQPDPGQTCVANCDCPSGDVCTNGYCRPPAPPPDAGTGTACQANCDCPSGEVCSNGQCKVPPPPPVQDAGTSTPVCRANCECPSGQVCTDGVCKPVNTGSGNSCHATCECPAGERCIDNVCWL

SEQ ID NO: 15176 - protein, 212 aa, Myxococcus xanthus
MVSSIFPAPDVGHFVDPVGPSRRGPLSDDTSAETGPWLARFHAGDARVLNACYRDHFDTVYRAAVRVLPAVDAETVVHDVFLRLVSDEAARRSFQGGSLAGWLHTLSHNLAVDRVRRQRRESDALAQLAVESSASEEPTPPEPGLDASFLLERFRQESLPPKWAPVFEARFVLQLSQREAAAALRMRRTTLAYQELRVRQLLKKFLLTPEAR

SEQ ID NO: 15177 - protein, 170 aa, Myxococcus xanthus
MLVGEQPGDQEDRAGRPFVGPSGRLLDEALEAAGIDRAQVYVTNTVKHFKWTGQGPRRIHAKPTTTEIRACLPWLEAEIRVFRPDVLVCLGATAAQALLGKAFRVTQSRGQPMASEWARVVVATVHPSSILRAPDPRAKEAALEAFVDDLRQVARIIHGLSEGEGAHAPM

SEQ ID NO: 15178 - protein, 253 aa, Myxococcus xanthus
MSVRVEKNGLVTTVILDRPEVRNAVDGATAQALAEAFRAFDADPDARVGVLHGEGGTFCAGADLKAVSEGRMPRLELDGDGPMGPSRMVLSKPVIASIGGHAVAGGLELALWCDLRVAEEDAVLGVFCRRWGVPLIDGGTVRLPRLIGLSRALDLILTGRPVSAQEALAMGLVNRVVPRGQAREAAEALAREVAAFPQACMNADRRSAYTQAGLGTEEALRQEFARGVKVLESESIAGATRFAQGAGRHGKFE

SEQ ID NO: 15179 - protein, 278 aa, Myxococcus xanthus
MDSVAQTDDQKIYLIGFRLSGDPWPWRYVVAWTFQSVTGPGSYRAGPRPPIEGEPLVFLRGARSFAHVTHLPEERKGRDVSGVPAQDEVRLQALVRRIQEGDLTAFEQLYALTQADASRTLWHLVGNRVDVEDLLQEAYLRLLTAVKSYRGESRFRTFFYRVCSNVALSHLRWKRRRPEDSVWDLPEAVAEGDDPERVASRRQAARLVELALERLKPKKRIVFVYYELCGMSPDEIADAVGSSPNTVRSRLHHARLEFNEAMQRLLGANRSGGFHGAT

SEQ ID NO: 15180 - protein, 310 aa, Myxococcus xanthus
MFANRLRKGDKRFRKWARTQGLTAFRVYDRDIPEYPYAIDVYGDRVHVVEYPRRRAIASGAADTQREEVLAAVTQVLAVPSERVFVKTHTPQPWGRSQYGRVGQDSGRIVVEEQGLKFWVNLGDYLDTGLFMDHRNTRARVREEARGKRFLNLFAYTGAFTVYAAAGGAASTMTVDLSNTYLDWAEDNLDLNGLADARHTLVRADAKAWVEAQADAPERYDLVVCDPPSFSTSKKMSGSFNVQRDHPRLLAAIRALLAPGGVLYFSTNFLGFQLEPKATRGMEVEEITPRSIPEDFQRKEIHRCWRMVAP

SEQ ID NO: 15181 - protein, 553 aa, Myxococcus xanthus
DPPAITQSIKRDPGYLRALDTLHTEFDNLLAELKKSAPFFSMRYQVHMTWEQTLPGMTGYFAAMLYNQINVALKASPLSTVLEVRAGEDLCRMVGYTQQNGIRPWSHLTSGGTTANIEAMWAARNLKFYPLSLREALQRESTLSAAKALKVTLPSGTQARLVDLDAWQALNLDVDEVLGLPTRIHEEFKIPPETLTANVSNYMLQDLGLVEFTRRYLGDLPAPVFMVPGSKHYSLPKAAAILGIGADHMFSIPLDEEGRMDVSALEARLDQCMKDKQPVIAVTAVMGTTEEGLVDPLASVLALRRQKYHPQGMSFCVHADAAWGGYFASLLRAPPSSNKRLAGPPAPVLSLSRYVTEQFEALPEADTITVDPHKTGYLPYPAGALCYRNQSMRSLVAFEAPYINTAGSQEDLTVGKYGIEGSKPGAAAAGVYLSHAVVPPDQRGYGKILGRALYNCKLFHARLLTMNTVASDFVVVPGPRFKLSDSLKRKYGGEKQALEFLRQQIQGMRQEQLLSASSEEELELLRETGADLNILTYAFNFKTEQGLNTSLEE

SEQ ID NO: 15182 - protein, 45 aa, Myxococcus xanthus
MSPDFVYGVGDWRVNRHPRFAVDINNDDRADLIGFGDLGEYVKLR

SEQ ID NO: 15183 - protein, 245 aa, Myxococcus xanthus
MDSVALSTTTQLAVIGSGSGIPFKIDSGGKVLASRASTLDFFVGDTDTFGGNSGSGVYAKIDGSYLLAGILVRGNKDYVKRIGPAGECYVVNVITSIGSCTDAICSAEAINYVRPAIDAYCAVATNTRLCPGQGPATPVTFDFATSGTNNATRNTVAQNVTLSAGETLYVGTAMVMYATARGDTYLRLDRYETSTNTYTGVANNDDAYDSLSYIRYTAKVAGTYRIRVGCARDSACAGRVSYIIR

SEQ ID NO: 15184 - protein, 164 aa, Myxococcus xanthus
RDDDTFVLNVIQYVLTKGEGSRLIRSLVYEQKLAVSLMLDWSWRIDPGTILFYLALKPDSDPKKVEAALYAELEKIAREGITERELQKAQNNLRSDHLRELATNSGRAHALGHYEALLGDWRRLLTLPSTYTSITNDQVKAVAAKYFAPEHRSVVTLVPAPTEA

SEQ ID NO: 15185 - protein, 179 aa, Myxococcus xanthus
MDVPLPERIAGSDLILPLMKLGAGRKWRVFLLGAGPGVAEKVGRIVSEQYGVEVVGWDSPMVRLDGGDAQNDPIVAKIREKDPHLLLVALGSPKQEVWISQVASKLGPTVAIGIGAGLDFIAGTAKRAPVWISRAGFEWLYRLVNEPKRLWRRYILNDSRFATILLREFWQRTGAKKPE

SEQ ID NO: 15186 - protein, 411 aa, Myxococcus xanthus
MVSVRLVIRAGSATDPDGKHGLADFTARLLRRGTRLLNAQAIDEAVEFVGASLGVGVSEDTLSVALTTPSEHFVQMLDILGQLVREPTFPQSEVDDARERELAQFANDLDDPSIIADRAMVRALWGNHPYGHDVGGSSKSVKTFTRDDVVRFHQERMGPKVSMLIVVGAVDPQRVAAAAEDAFADWTGGPDAPVAIPAPERIALGGRVIIVDKPDQTQSQVRLGGPGMRMGHEDYFPATAMNIALGGGFTSRLMNEIRVNRGLTYGVSSWFDSMNAAGVFALSTFTKTESTREIIDVALAEIGGVREKGLKPRELADAQAYLAGLYPLRTETNESIAGSIAEARLHGLGDDWVERFRDRLRAVTPKQVVAAAKKYCFAQAPAVVVLGKADAVKKQLKGLGPITVVPASEYE

SEQ ID NO: 15187 - protein, 124 aa, Myxococcus xanthus
MRVARPGDTDAKASRTRVRPVETFERASLVEAEPLTGRTHQIRVHLLSLGHPLLVDHQYGREAPLTEKDLGGEGDSVVLSRTPLHAARVEWPALAGVEARAVEAPVPEDMARARELLRASVTSL

SEQ ID NO: 15188 - protein, 190 aa, Myxococcus xanthus
MVFALQTSTAFQLFDAESLVGPTVALTLTRELAAVFSALMVTMRAGSAMCTELGTMRVTEQVDALETMAVNPVQYLLVPRVLAGLFMVPALTMLFNTMGMGGAYVVAVGGLGISPGTFLSRTQQWLAPEDIFQGLLKGAVFGLSVSLICCFKGFNASGGAKGVGQATTEAMVASALSIFILDFILGILFF

SEQ ID NO: 15189 - protein, 245 aa, Myxococcus xanthus
MIQVVDLHKTFGDHKVLTGINLTVPAGSTCVILGGSGSGKTVLMKHMIGLLKPDRGQVIIDGEDIVPMGVESLQKVRNKFGMVFQAAALFDSMTVFENVAFPLREHTKDPEDVIRQKVRARLDLMGLKKDVEDRFPADLSGGMRKRVGLARAIVMDPKVVLYDEPTTGLDPITTDYVDEMILAAQKELGVTSVVISHDISSAFNVADQIAFLSKGVIVASGSPEQLREADHPAVKVFLETWFGKN

SEQ ID NO: 15190 - protein, 202 aa, Myxococcus xanthus
EAVFESLSQITADIQEVTGALREVLGGERGAGSLQRIVENLVRLSDSVDSTVRRNADRLDTIVGNVEAISADVRGITQGNQAEITRIIDNIEFITRDVRQVLGSVKNIVGTGEGDVKETVASLKETLKKLDGTLGNLEEITRKVRDGEGAAGVLLADEAVGRELRETVQDVSRFTSRLTDLQAEIGIQSTYLAAQGNSKNVF

SEQ ID NO: 15191 - protein, 165 aa, Myxococcus xanthus
MVGTKIARVRCNTCGGDHAYRAAPGATDRPASSTTRTARSSSSSSSSASKAEKVIISFEEQLAGKDVANAPRYSPKDTYKVDQVIQHPTFGTGYVSAVRGDKVDITFRTDTKTLVHGRGGGPVEKPVFNPPNRQVTGPADKPLPVGDSAEPAPADGAEPPPASED

SEQ ID NO: 15192 - protein, 508 aa, Myxococcus xanthus
MSRPRILIDGDTLKLEEILQVARNEATVELSPDAATRVRASRALVDRVAAGDTPAYGINTGFGTLAEVRIDKKDLRDLQRNLILSHACGVGTPLPLPEARALLLLRCNVLAKGYSGIRMETLALALDMLNRDVVPVVPERGSVGASGDLAPLAHLALVFIGEGEAFYQGQRMPAKQALERAGLQPVVLEAKEGLALVNGTQAMCAVGTLLQLRAESLADIADVAGAMTLEGLLGSHKPFIPEIHDVRAHPGQKDVAAHLRRILVDSELVESHVNCSKVQDPYSLRCMPQVHGAAREGIAFSRRILEVEVNSATDNPLVFADTERIVSGGNFHGQPISLAMDVVAMALTQLSSISERRVEQLVNPSLSNLPAFLAKNSGLNSGFMIAQVTSAALVAESRVLSHPASVDSIPSSAGREDHVSMGMTAALKGRQVSDFARSCLAIEILVAAQALDFRLPLKPGKGALAAYELVRSKVPHMDKDRELHRDIEAVSQLVDSGELLAAVRSATA

SEQ ID NO: 15193 - protein, 351 aa, Myxococcus xanthus
SGETNRLMKLVAQITDRPDEREQDVVVATGEQVSIGLLAMAIHAQQGKATSFLGQQVRIVTDSTFAKARIKSIDAQPIRAALARGHIVVVAGFQGVDESGSVTTLGRGGSDTTAVALAAALNADACEIYTDVDGVYTSDPNMVPSARKLDRITYEEMLELASVGAKVLQIRSVEFAMKYKVPLWVKSSFTDDPGTLVCEEDSSMEDVLVRGVAYDRNEAKITVCGVPDVAGAAAKIFGPLDEKHIVVDLIVQNPSKDGRTDVTFTVGKADFLTAQEVVRKVAEEIGASGIETDGDIAKVSIVGVGMRNHSGVAARMFRALSAEGINIQMISTSEIKVSCVVQAKYTELAVR

SEQ ID NO: 15194 - protein, 271 aa, Myxococcus xanthus
AVFRSRALESLLGWVGFSPFLVTPGNWRAWHVQAHHSAANVLVRDPDILPRQSEWRTQWFAKVFHAMSPGSGSLLSFVSFSFFFTAQGQAFLWHHSRLPQFKHVHMHRTRERVLTVLVMVGWGAVGWWMGPMGALYALILPLLIGNITLMIYIATNHWLLAAHEESDNPFVNTASVATHPVMDWLHYNFSHHQEHHIFPAMSPKFAPLLRKHLRDLNPEASQVYPHLHALRMLYRRPALYAEDGQTLMAPEGTPAIATEDLRRQLKEPIVL

SEQ ID NO: 15195 - protein, 347 aa, Myxococcus xanthus
MRLGLKADNLLERVADWFNLAPQPVAHAFFGMMASRTLMAGVRLGVYEALTDGPMSAETLAARLKLSEEGTRTLLEALIACEAVERQRGGRYRLAPRARRWLDPRSPRYVGAFLEFNYAQWDWWTGLEGVVRTGQAVDIHGFAPDDARWRDYIHAMHQMARLAAPEVVAAIPLPRGAKQVLDLGGAHGWFAAELCLRNRGLKATVLDLEGSARVGREIIASAGLSHLVTHREGDILTAELGGPYDGVMLFQVMHHLTPAQNVALLRRVRASLAPRGTLAVLEYLRENADTPTSAAPLIGLHYFLTSGAAAYTPAEVEGFLDDAGFRIENSRPIRHLPLQTLLVARLD

SEQ ID NO: 15196 - protein, 667 aa, Myxococcus xanthus
MLYDGGLSPDWKDLGWAQRELPKGAPARMRLFNYAGWILYRPKLEGTFGALSFRFSAPESFGEFLEVRLDAPGAASFPRVPIIPELQVRKDGEWSEIVIPMEQLNPRGQPFDRVVLRASKSVGREWVLFDKVSLVPLPPELAAALAAGGGRTGQGSGREAPMTIDCTAPSHRISPLIYGIAFDGLTEKRDKHQYEVGATTRRWGGNPTSRYNWKLGGAWNTANDWFYQNVDIGLSYDDFLESNRKHGMTSALTVPILGWVAKDAKSVGFPVSRFGSQQQEDNGSGNGLARDGTPLKPGAPTLTSTEAPPEFIAEWIRAIRKKDQERGQRSVQTYILDNEPMLWNSTHRDVHPEPLSYDGLLERTIAYGTVVRKEDPEGLIAGPAEWGWTNYLWSAADFAPGKMPHSDRRAHGNMPLLPWYLRQLREHEKKTGVRLLDIVDLHFYPQTNVGVGLEGNTDPATNARRIRSTRGLWDPTYKDESWIGEPIRLIPRMKEWVADNYPGLRISIGEYNFGAFRHMSGGLAQAEALGRFAQENIYSAYFWQYPTEGSPVFWAFRAFRNFDGKGSRFQDWWVPAKATEGTSVFASRDEAGGKMVAVVLNFDPDQAAQAQIQLKGCGTLDSVRVLGYSGAPGGFTEQTPGAKAAGSLTQRLPPYSMTVLDLTVKKP

SEQ ID NO: 15197 - protein, 203 aa, Myxococcus xanthus
MLAPVLLLAGAAVCLLLPPAFSALLGTYYVLTLAYSLRLKQVVMLDVLVLAGLYTVRIFGGALAVDVPTSSWLMMFSMFLFLSLALVKRLSEVRRLRQSNETSAHGRGYLAQDYEQLASLGAVSGQVSVLVLALYITSDEVTALYGHPERLWLICPVMLYWVGRVWLLAHRGLVNEDPLVFALRDRVSYAVGLVCALVLWAAT

SEQ ID NO: 15198 - protein, 464 aa, Myxococcus xanthus
MKPRESWGRYPQVEQQTHALVWRTDALPRKDGSLLPHGLGRSYGDSCLNAGGTLLLTSGLDRFIAFDPATGVVRCETGVSLDTILRLAAPRGWFLPVTPGTKFVTVGGAIANDVHGKNHHRGGTFGRYVRRFELLRSDGSRRVCAPDENPDWYGATIGGLGLTGLVTWAEVQLTPISNPYVLQETVPFGNLDGFLDVARASEKDYEFTMAWVDCLARGKKLGRGLLYRGNFAPPQFDGLPLARSHLSHGVGLAVPMDMPAFCLNRLSVSAFNWLYYHRQNGKPKQRLTHYDPFFYPLDAIYAWNRIYGRRGFLQFQCVVPYSTARDALKEILERSSRGGLPSFLSVLKTFGDIPSPGWLSFPREGVTLAMDFANRGEKTWKLVEDLDQLTRQAGGAVYPAKDARMSPENFAAYFPQRERFMQYVDPSFSSSFWRRVNPVSLPFSLAAERGETASPPPRSLLAIR

SEQ ID NO: 15199 - protein, 245 aa, Myxococcus xanthus
MKKVLVLGATSAIAQATVRLLAARGASLYLTGRNAANLDAVTKDAATRGAAKVASQVVDLNDFDTHEALVEAAYTALDGLDGVVLAHGVLGDQAEAQRSWAATEAVLRTNFLSAVSLLTVLANRFEAQKAGTLVVISSVAGDRGRQSNYVYGASKGALNVFLQGLRNRLAKSNVAVVTVKPGFVDTPMTAHLPKNKLFASPEKVARGLLSAADSRKNEVYVPGIWALIMLIIRTIPETVFKRMKL

SEQ ID NO: 15200 - protein, 451 aa, Myxococcus xanthus
MSATAPLSSVPEPQPAASEASVTPSAPEAWSLARRLAFRFAFAYLGLYFFPFPLDLIPVLGDFITSFQEGLWKAVVPWVGKHVLRLSTDITMMPNGSGDTTFDYVQVLMFFVVAVAVTGVWSVIDRRRTEYVKAHDVLHTNVRYVLAMSMLSYGLAKLFKSQFPFPSPERLVQPLGDFSPMGLLWNFMGYSKGYNVFTGGAEFLGGCLLLFRRTTTLGALVVAGVMVNVVALNFFYDVPVKLYSSHLLLMSLFLVLPDARRLLDVLVLNRATQPRPLQPPFPPSRWLSGAGLVMKVLVVGGIAYGFGSSRLEFIRKYGDSAPRPPFYGYYTVDSFTQDGQHLDATSGDARRWKAVAVSRFGRMNIKHLDDTVKSFGLEEDAPKKTLTLIDGQDDTAKKFVLAYTRSDANQLVLQGTLQEAAIEVRLTRVDESKFLLLNRGFNWIQEYPFNR

SEQ ID NO: 15201 - protein, 189 aa, Myxococcus xanthus
LRRLEEAHHPRFIVGLGNKALLDGEGFRHVVELDWWKSTEVAPGRTVTAVPAQHRSNRGLTDSAATLWAGYVLATSGGPVFFAGDTGFGPHFAMMAERFGPMRLSVLPIGAYRPTAFRPVHMGPVEALQAHKVLRSATSVAMHYGTFALALDGQDEAKYHLLWLLAREPVRPRFWALGFGEGRDVPALD

SEQ ID NO: 15202 - protein, 194 aa, Myxococcus xanthus
MGFPQNDLEQRLAVIRPDDTVRGLVFNSVFNLTEKKLGVEAATRLREPFFKRSPVDFFSYPAIDALRLLYATSEALTPVYGSMEDAVRACGAAAVTHFFQSTVGQTLNRLIGKGDPKRLLSHAPTAYSTLVSYGRREFAVLGDKQVRLAFHGDMQPVQYHEGVLKEALSVVGCKSRVVGTPRGVTGADYVITWE

SEQ ID NO: 15203 - protein, 157 aa, Myxococcus xanthus
LEQLMRYFQTRSPDRWREELQTFLRRAFPGQYEALATLLRDRLDYEKWVKDNDAYLRGLDSKQRRAAVWDARNRLFGKETAQRLWASELKHHALVDALQVIDARQDLPLSEKLSAYKARLGEVYGDGAPAQLSRHSQETMNRFLGLASVPRELTGIP

SEQ ID NO: 15204 - protein, 73 aa, Myxococcus xanthus
MVVDAPAGKVVLRWRCQHEVSARRGPRQLMYRLMYGQHFGWYGLDVLHWEAGRLREKRTYAQAGLPLVRRGRP

SEQ ID NO: 15205 - protein, 178 aa, Myxococcus xanthus
MIGSLVTDALELAKAANGNSDAKSIAKVVLTSDSYRITALNRAREAALAYRIPLVNHVLRVAQTAVMGIEIGKDVTLGKGVYFVHSLGVVIGGDARIGDRVRFYGNNTVGTAKDNGYPVIEDDVWIGAGARILGPVRIGARSRIGANAVVLQDVPPDSVAVGIPARIFPRKDTDEVAL

SEQ ID NO: 15206 - protein, 392 aa, Myxococcus xanthus
MRIAPLLCLAAALLASTSEAAVRHVIKNRRIEPRQTLAQALHDAQLPDAQVAAVISALEGVFDFRKSRVGDQLRLVIRDGELDFFDYRQSMVDEWQVRRDGEKYVGSKRAIEVEKQVAVVALEIQSSLYEAAVAAGEDPAIGMVLADVFAWDIDFYRDVRKGDTARALVEKFVSKGRLLRYGDVLAATYAGGLVGNKKVYRYVLPDGQPNYFNEEGASAKKTFLKTPLKYANVTSRFGSRFHPVLKYLKAHNGVDYGTPIGTPVWAVADGTVTQAGYAGAAGNMVVIRHANGFETQYMHLSRFGEGVRAGARVRQKQVIAYSGNTGRSTGPHLHFGLKRNGQYTNPLNQQFPRADPLPKELLPDFLAKAQELTGQMEAVSVAAVAGQAAAMP

SEQ ID NO: 15207 - protein, 497 aa, Myxococcus xanthus
MPKSLPPRLASLRDEIHGYAKEFGLDFFDTHFEMVSYDEMNMVAAYGGFPTRYPHWRWGMEYEQLAKGYEYGLSKIYELVINNDPCYAYLMESNPEVDQKLVMAHVYGHCDFFKNNFSFRHTNRRMIDEMANHATRVRRWVDKIGVEKVEDFIDRTLSLENLIDQHAPHIRRNPDPKKAEDELKANERVEGFKVDREYMRGYINPSEFLDSQRKKVEDEKQRAKKFPERPQRDVLLFLLEEAPLEPWEADILAILRDEAYYFAPQGQTKIMNEGWASYWHSTIMTRRALKDDEIIDYADHHSGTMGTRPGAINPYKLGIELWRDIEERWNKGRFGKEWDECDDLRARRAWDKKLGAGREKIFEVRKHYNDITFIDTFLTPEFAMEQKLFVYGFNDKRNSWEILDREFKKVKNKLLQGLTNFGQPIIEVVDGNFENRSELLLAHRHDGQDLKGDYARETLRNLQSLWRRPVNILTRYDNKGVILRFDGQSHSERKVEL

SEQ ID NO: 15208 - protein, 335 aa, Myxococcus xanthus
WEEGKDAISIPIPFIDIPRFKYGHKEQGGVGQGDGDVGQQLGPGAVEPGEGKQAGQGEGDHAMEVDVTLDELAQILGEELQLPNIERRQNERIITQKIRYTGVNTTGPESLRHFKRTFKQALRRQIAAGTYDPARPVIIPTREDRRYRSYKLQDLPETNAVIIYMMDVSGSMGDEQKEIVRIESFWLDTWLRHQYKGLEARYIIHDAVAREVDRDTFFHTRESGGTMISSAYKLSRDIILADYPKSAWNIYPFHFSDGDNWSADDTRQCIEMLRNDVLPNVNQFAYGQVESPYGSGQFIKDLREAVGDTPNVALSEIADKDAIYASIKDFLGKGR

SEQ ID NO: 15209 - protein, 40 aa, Myxococcus xanthus
MSKPVGKQEWFRGVEAFQASGLTQQEFSRQSGLRLSTLQS

SEQ ID NO: 15210 - protein, 35 aa, Myxococcus xanthus
MRKSIDCLMAMLLDGIDVAEVRSQPAWTPPGRTGT

SEQ ID NO: 15211 - protein, 280 aa, Myxococcus xanthus
VDVSIATNPSTGVKYDTPYRNFVSDSANYRFTTQALSEAGIGSTVSRSTFIDHQLVTNELWASYVPNSTQVIRPSITGYRDNTSDHYPIISRFNFGNAGGGGTGTGGTQYKVFINEYLPQSHNKPGTTMPDYDQQFVELVNTGTTAVDLGGWKIHDASSYAGEDDTRHVFPAGTMIQPGKSYVVYSGPTAVPTGATNATAASGGGLYFNRGVNTGSSGDTVLLVRPDNTVQDSAGYQDTEVGISYNRSPDGSSTGTWMPHTQLSAGVEASPGRRVNGTAF

SEQ ID NO: 15212 - protein, 344 aa, Myxococcus xanthus
MTASARDILQALLQKKARARDLQLHGADLTGAPLDGLRGDGLDLGTASLRGASLRGSRFSACSFERAVLEEAVLESATLRQCRLDGADLRRARLSEARIEDSSARGTDLSQADLRKTRLSETSFSRAILREAVLDGAEGVGVELRGADLTGASLVDVRLDEADFRGADLTGANVSGGSFRHADFRGAIVDGVQWTGCDRTGARFDAEDATLPRSQPSDTGIPPSAPENFDAPAMATWLGNLMEHALRSAPGSVHGAATRGPETPAELLQLLGSLQQDLGARGVELPDLTARVQPLLSALEQRGDEPPEEWKALLEALTPTGTEGRDASAEDIVRALLARLQPPR

SEQ ID NO: 15213 - protein, 92 aa, Myxococcus xanthus
MAWVMLQLHTHNALSASDLSPVGVWRPDELVQIVPAEIPQEDILRMWDALRRPYRPSVTYVARVVCIDVQGKPAGRPVVARRFDFTDEVPRR

SEQ ID NO: 15214 - protein, 243 aa, Myxococcus xanthus
MILERTESRALAAIRFLDAETQRPLTEPITVAGHGLRFTRNVRGLHVVTDAPGFSDYAASFDLPNPLPAAAAFTLVASDPTRHYLARSFTLELPRDATAPPTGQPLPPDSVFRPVDVTLYPSPLMRPSARSAVVRLRVVDAHDTPLPGALVSLALADPEITRWGQSNERGDALILVPGIPIADWGNPEAPVHFTFSLAAAWAALPQPPDPDALSQDFHPLSSTLDVAAGEEVTTTIKLDWVEL

SEQ ID NO: 15215 - protein, 324 aa, Myxococcus xanthus
MYAFEAGNGVSAFALRTALAAGPFTLTGGSDGSEPSAASYEDAFERLGGVEDISIIAAPGSSAYASAQAVRLGLISAAERRRAYRIAVLDTPRGYGPQDALALRAQVDSTKAALYYPWVVVANPLAGSEAADVPREIALPPSAFLCGIYARSDIERGVFKAPANEVVRGALRFEQDIHFAQQETLNPQGINCLRFFPGRGYRVWGARTVSSDPEWKYVNVRRYFNFLERSVDEGTQWAVFEPNGERLWANIRETIGSFLENQWRTGALLGADPKQAFFVRCDRTTMDQNDLDNGRLVCLIGVAVVKPAEFVIFRIGQKTADART

SEQ ID NO: 15216 - protein, 240 aa, Myxococcus xanthus
MQVAPDFLERHLAHHPEGSRTVVLGRIRPDPSIGDMPLFERWYAYLNNRMAEELSTPGARARGVHLFTGNVSFPRADYVGVGGFDKSLGQSEDVELGVRLEKAGCAFVFARDAYVLHGSDHVSFERWLKRAHRYGMFDTQVARKHPDVRDVNPWRLLFQTNPLTRPLLAATLVAPDASRVLTRAVMHAANAADKLGLEKAAFAGTSVVYGMEYLRGARGEAGGWTGIAREVARYLQGRGE

SEQ ID NO: 15217 - protein, 151 aa, Myxococcus xanthus
MPTRPTPYGAFNFEISFDGTSFGGFSDVSGLSTEVTLSEYREGSDPENHVRKVPGAFKTGDVTLKRGVVDSRAIWTWVEDVRRNGPLGRKAAVTIRLLDEARNPVQSWKLVNVTPMKFTGPTLAAKGGGDVAMEELVLAAETVRMGFPDVD

SEQ ID NO: 15218 - protein, 80 aa, Myxococcus xanthus
MRRLTFEVTERAAPTAPERMDVALFVGFVRRRPGTSVPAALSRYLFEQGWMTAPTLRVDPNDPQAPLTDVPLPSRASPLL

SEQ ID NO: 15219 - protein, 323 aa, Myxococcus xanthus
EDMDGFQDEDGCPDPDKDNDGVLDGNDKCPLTPGVPENQGCPAEAPKDRDGDGIIDSEDKCPDQAEDKDGFQDEDGCPDLDNDGDGIVDTADKCPNEAGPMQNLGCPIVDKDGDGILDVDDKCPDEPEDKDGFQDEDGCPDLDNDGDGTPDVQDKCPNEAGPTENGGCPDKDTDGDGIVDRLDACPEEPGVQEERGCAKQYKMVVIKRDRIEIKKQILFSSGSHKIYGKQSTAVLDDVAQALRDAPWIKRIRIEGHTDSMGNDASNLRLSQRRADAVMAQLLRRGIDPGRIQAVGFGETQPIAPNSTKTGRAMNRRTEFKVAE

SEQ ID NO: 15220 - protein, 339 aa, Myxococcus xanthus
MAGGRPSALKPAAFFKTLKARVPELFELADIELELFSNLDSSEMQPELWSRMAAHLHARLPHFDGAVVTHGTDTLAYTASALSFMLRNPPCPVVLTGSQRPLGKIRSDARLNLIDAVLSALHGPREVTICFDSRLYRGNRARKVKVSEYDAFDSPNFPVLGTLGVDTTFEPGLKSRGAFRLYERLDAKVFLLKVYPGLDPALPLQLLPHVRGLVLEAYGAGNFPIAPELGRSLTPLFLQARERGVPVVVVSQAHRNGVDLSLYESGAAALEAGAMGGADMTPSAALVKLMQGLAYHSGSSGALARYIQTPVAGELTVGRPTVAPEAPAGPPATRRPRGE

SEQ ID NO: 15221 - protein, 200 aa, Myxococcus xanthus
MSEEKTSVHSISDLLGSAQQQSAYLIVISAKSAAGIGRMFKLDRSEVVLGRSSEAQFQVEDDGISRKHAKVVALGDGRFQLVDLASTNGTYLNGLKVNAAPLYDGDKIQIGSNTVLKFSIQDALEEQYQRSIYESATRDGLTRVYNKKYFLETVRDVRVMSVIMNRHETRVDGEDLTTGERRHFRLDHITRAEVLRAAGP

SEQ ID NO: 15222 - protein, 83 aa, Myxococcus xanthus
MTASAGAVAELEARLLAEAGVTPEDFKRGGGETEGSRRPYRVRLGSPELTAEKTADGEDLWLTFELPRGAYATEVLHELLKDG

SEQ ID NO: 15223 - protein, 412 aa, Myxococcus xanthus
MATAPDLLVFSRTPAEGGSIPLPRVVLAGDAGGFPLSDLIAFLSQSRWSGVVRVHSPGGERSVTLREGEVRGASSDDPADRLGEVLVRMGYVERAQVEAALREQPPSKVGRSLVEKGLLKSHDLFKCVTHQVSEIFHAIVLCREGTFFLIDQPVEDKSGHIIQLSTQSLLMDSIRKIDEMAHFRKRISHGRLYVTRKRASDGKLEEDEDRVLGLLDGRRTILELGHAARLSEFDVTKVVFRLLEGGFASVTDKPLMVPGPGVPTPIPQPSERTAQAPARAPARPVVTVDPRPVARVFNFIFREIRDEVAKQGMDREFIAAANAALSGQGLSSSPVLEGLAFAPDGSLPENKLIESFERHRAQLGSEPLATFRQALSDMMFFLLFQAGELLESRADEDLARRVKELLSTLEVS

SEQ ID NO: 15224 - protein, 214 aa, Myxococcus xanthus
MAQLAARRVSEGSPATEVILSLSTYYSAFRDPRAQFKVDDRMCMGPAGAPVTVVEFSDFECPYCAKARPVLEAFAKKHAQQVRFCYLPFPLSMHANAKPAAQAALWARDQGKFWQMHDALFEHQSNLKPDAIAALATSLGLDGAKLAALLKTDAYKEELDGYRSQGRAAGISGTPSVYFNGRALDLSFVEAEMLSHSLEDELEWSANKNAWAAD

SEQ ID NO: 15225 - protein, 30 aa, Myxococcus xanthus
FRTLAEGQKVEFETRKGPKGLQAENVRVVG

SEQ ID NO: 15226 - protein, 363 aa, Myxococcus xanthus
MLEQQGELRFRRLVDTMPQFVWELLLDGTIGYANRGWLDYAGLSPEQGRKWKDTLYCLHPEDAPSLRSAWQEAQREGHPLEQECRLRRADGEYRWFLTRTIPERDEQGQLAGWVSTATDIDDARRAVETLRAASEAKDMFLTMAAHELRTPLQAARGYAHLASVKAGDTLAPGVDKALHGIHRSVNRMAKLVENLLDVGRIQRGELHLEPKSLDVGALLRDVAEHFEPLPEGQHIELDAPEGLVVPGDRERLDQVFTNLVSNALRYSPEGGRIRLAAREEAGRVHVEVVDHGLGIPGEKLENIFERFGRAHGISYGGLGLGLSIARGIVERHGGRIWAESPGSQGMGSTFHVVLPVEPGKPAP

SEQ ID NO: 15227 - protein, 65 aa, Myxococcus xanthus
MTHPASLPLALAADGCLLCVTLGETDFGAASKTLEFVGRERFLGSVTFPRLTKKQRRAASQKKKA

SEQ ID NO: 15228 - protein, 439 aa, Myxococcus xanthus
MEPEAESVHEDELRDAWPALSARERVEGFHLLPPERARDFFATLNAPAQLGLLEALSPGERGTWLRAMAPDDAADVVQRLSPEAREAWLALLDAPSLREVRALLAYGEDAAGGLMNPRFVRVRPEMRIDEALSYLRRQAREQVETVYYAYVLDEAQRLKGVVSLRQLFQATPDKAVREVMRTELIRVREDTDQEEVGRLFARYGLAAIPVVDDQGLMKGIVTVDDIVSVVQAEATEDIQKVGGTEALGAPYLEVGLPAMLKKRAGWLLVLFLSEMLTATAMTRYQDEIARAVVLSLFVPLIISAGGNAGSQASTLVIRALALAQVRLRDVVRVLRRELLSGLALGLVLGSVGVARILLWQVLFHLYGEHAFRVALTVGLAVLGVVTWGTLAGSMLPFLLRRLGFDPASASAPFVATLVDVSGLVIYFTTAELILRGTLL

SEQ ID NO: 15229 - protein, 286 aa, Myxococcus xanthus
MGPLNGGLPWPKGFGGARRLEKEWLSYIRDVYKLMPFYKSTRENASAIITGSRATRGQVSGQWQGKTVYVPENAIDTRRFGTEKSEGPVELPLRVAFVGRFVPYKGMAMLMEAAAPLIREGKVVLEYIGDGQEMANLRAQAAREGIESGVTFAGWVKHQELQGRLAKNHIFGFPSVREFGGAVVCEAMALGLVPIVMDYGGPGEIVSPATGFAIQMGTPEEIVLRVREVLTKLAADPSVIRPMGERARERIFKYFTWRAKAEQVLEVYRWVKGERGQPDWGMPLAD

SEQ ID NO: 15230 - protein, 527 aa, Myxococcus xanthus
MYAPDRPPYLRYGALLAFLVLATVGGAVIHPVVALAPVLCVGVVWVILKVPVKYPVLVVTWLVLAVDYVPERPQSGLWPSPLHPLGELMFAQLSYITKIGALRFPLVDVLILGLMGLAMYRRVTKSTIDPEPLPMPRPLIAVVALSLVAILWMEVRGIARGGDIKNSLWQWHQAAMMPFIVAMYHYAMRGPEDWPAFAKTIILAGLTKSAVSTYFAMVVVHELGVEVEYTTSHSDSMTFVFALLVATMRFIEKPKSAHMLRGLAIIAFIGIGMIFNDRRLAYVSFAGCLLAAFLINPWTPLKRFLVRTLPFFAPFIIVYIAAGWNSGSSVFAPVQTIRSLIDGQGGEGNLDYRDIENLDMIATWAQFPILGTGYGHEFLEPIPLPDIAFVFPQYRFHPHNSLLGLFAFGGLLGYTGVWMYLAVTIYLVVRSYHRTDVSEYRAAALIIVGLVATYINQVFGDMGIISYICTFQISLAVAMTGKLAVHTGAWPMPHSRLLGPAPAAPVPPPGAITYPNEDAPSSAANPR

SEQ ID NO: 15231 - protein, 433 aa, Myxococcus xanthus
SQALESLDARGYEAVGRTSPEEALALFERESFDLVITDVEMPRMRGTEVLEALLTRKPGQLVVLITAFGSVELAVAAVKAGACDFVTKPFNIDALVLTLERAFRERQLRREIVRLRAAVPGDTPGGLVARSSAMQKALEVSRRAARSDATVLLTGETGTGKSALARFIHESSGRRTQPFLQLNCAALPSGLAESELFGARRGAYTDAREDRAGVFVSVGGGTLFLDEVGELSLEVQAKLLQALETGRVRPLGSSTETPVRARVLAATNQPLEVLLREGRFRADLYYRLNVIRIEVPPLHERREDILPLVDFFLGRLDEQQQREVLGVSASALKRLLAHAWPGNVRELANLLERAVALADHDTLVPEDFDLPGGGESGLTSLLSHASGEDAPLEEVERAYVRRVVEAQGGNKAAAARILGINRRTLYRKLDLDE

SEQ ID NO: 15232 - protein, 294 aa, Myxococcus xanthus
YAGSRYQSERPMNVTAMKGMARQWPDLLSLTEQFRKAFLARMPPRTPGVLTAGELHMMVVCTLASVGYVLVRGTQPVPNGELDSGLAAMFRLIDGVRLVTNDLVRDAPEQPVTAQSIVDYAERHAVFHGPHGVCAGPPALINEYMQVLTGSAPAPIEAQPDIAARLGDLDAALDYGLLGQRVESVVRFLGATQGLLHERLRAAFAGHLPRTGLQECVEAPIDVAHYPLLRDDFPLAETYQREIKLSRWLFARIGEAFPGTPQGTSLDELAKLDPTEQATSQRGLAELFAHGLPG

SEQ ID NO: 15233 - protein, 57 aa, Myxococcus xanthus
LKELSVRAELLEQGGAPLWNAFMEELHHLHLGSPRPARSVFGELQAAYEKALVKRSR

SEQ ID NO: 15234 - protein, 228 aa, Myxococcus xanthus
MHPALPLLLLALTGAASTPNARGLNTQGFRLYQAGRYPEALERFQASARESPDYALAHYNLAATLGMLRKQGKVCEYSAHRDVIVEHLTQAVKLDARRLTRAKEDADFTPIRDTLGWQKLLGRSPAREADVPVLLREVSWFGPGVGVYGTTQGLRFGPSGRVTLWTKEVGDDGTPRQKETRGRYTVRGRQVALRLNGRAPLEGTLTESGALTFPGLETFTDSPSECEA

SEQ ID NO: 15235 - protein, 230 aa, Myxococcus xanthus
MSARPFIVAIDGPAGAGKSSVSKLLARRLGFSLVDTGAIYRCVALMAQREGIAFDDDAGLGELLGRVHIHFQVVGEENHVFLGGQDVSGEIRTPDISMAASQVSGRPVVRAGLLQLQRRLALESEKGAILEGRDIGTVVFPDADAKFFLAASPEVRARRRYEELFQKGVESSLDAVLADQTKRDRDDSARAVAPLKAAEDAVHVDSSTIPLSDVVHGMESEILRRMAQRA

SEQ ID NO: 15236 - protein, 311 aa, Myxococcus xanthus
MRNVSGATHLYPDATSFHLVRKLAAHVDVKPEQVVLGSGSNELIELLIRTFTTPEDEILLCQGSFSAYRISAQAHGRPFVEMPMREGFLYDLEAMAKAITPRTRMVFLANPDNPTGTAFSRDALTRFLAAVPPEVLVVHDEAYCEFVEWPEYTSAVPLVGQHPNLVALRTFSKIHGLAGVRLGYGIMNARLAAYLHRTRMPFNLTVLAQAAGLAALEDTEHVRRTREVNRAGLDYFAAELPMLGGTLTHSHANFVFVDFGRPAVALYEQLLRKGIIVRPFAGQGFPNHVRISVGTPAENARCVQVLKEILT

SEQ ID NO: 15237 - protein, 322 aa, Myxococcus xanthus
MATGTSYVLEFERPLIELEKKIDELKVLSTSGTVDFSSEISKLEKKAKKLQTEIFSDLTRWQVVQMSRHPNRPYFLDYVHYLFTDFVELCGDRAFGEDPSIVGGFARFDGKPVMVMGHQKGRNTKENMARNFGMPRPEGYRKARRLMELAERFEKPILTFVDTPGAYPGIGAEERGQAEAIAVNLEVMSRLRVPIISTVVGEGGSGGALAIGVGNRVLMLQNSVYSVISPEGCASILFRDAAKADKAADAMRLTAKDLLEMKIIDEAIAEPAGGAHRDPAKMAEALGKTLRKHLGQLAELSPDELVQDRYAKFRALGVFSGR

SEQ ID NO: 15238 - protein, 63 aa, Myxococcus xanthus
MLGHLPRSLRTLYLTRTKVTDAGLPALHKLPHLRELDLRGTAVSTEARSALARERGIHLVTGM

SEQ ID NO: 15239 - protein, 546 aa, Myxococcus xanthus
  unsure (1)..(546): unsure at all Xaa locations
MGKLYQQAVPGLEELVALFHVVDLLEGEEFDRIVVDAAPTSHTLRLFDLPTSLRKFLGLVKAGGDKTEAPPKKGKKAAAAAEAPGFLEQVGQKAEKLLALLKDPARTAFHLVALAEPVPEAQTRMLFTQLRERGLPVTEIVVNQIEDKDGCPACQGRRGLQAPHVRKFQALDKTVPVHLLGRREVAPRGLDGLALFAKAWAAGKETKALEFAAAEGPPALVRAPSMPPIAAPPLPPTRLIFFVGQGGVGKSSCAAAAAVTLTEKEGPVLLISTDPAHSLSDVLQSRLTDTETQVKGTKGLYARELDIAGWFNALRKRVKEKAEKAFEGAPRSGSEVPADLLYLRNLLECAPPGIDELAALSCLTDALVQERFKRIVVDSAPVVTSVRVVEMAETAKTWLGALHAVLTKHRAKGLAELADDIAGMIKHVKRFEDALASPSEARFVVVTRGEELAAARTERLVEYLKEKKLPVERVLVNRVGPKSTCDKCESRRKLEFNAAKAIEKKLGLPVTMAPALGRHPAGLRELKAFRTAWYALSPSAAKTKAX

SEQ ID NO: 15240 - protein, 463 aa, Myxococcus xanthus
  unsure (1)..(463): unsure at all Xaa locations
MLSAWGHKVEIAFDGHDALRKANEFRPDVVLSDLAMPETDGLWLLRNLKEELPDCPVVFLTGRGTIDAAVESIREGAYDFIVKPLDTARLKVCIDRALEKKETMREVQTLRRRLKQLGSSDLIAQSVGMRKVIELVEKVAPSKASVSISGESGTGKEVVSRAVHNLSLRRDKPFIAINCASIPATLIESELFGHERGAFTGADQRRPGVFEMAHGGTLFLDELGEIPIELQAKLLRVLEEGKLRRLGGKVEIEVDVRVLCATNRDLKQEIKNGRFREDLYFRLNVFQIHLPPLRERRDDVPILVQHFVDKFRGDSGKRVSGVHPEAMEVLKNYDWPGNIRELRNAVERAVILCDGELITREHLPPDMAGKSPERHTFRLPFGLSLDAVEREYILGSXQRNGNNKARTAEVLGVSEKTLYNKLNRYAAEARAQQAPGGGGGGPLGGQGSDGAMGAMGTNWFVIR

SEQ ID NO: 15241 - protein, 112 aa, Myxococcus xanthus
WAGWGTRAAKRRVQVQPSVETGVQIRLQYTSEVGFFLIQTMLRAFRRAENGGSIRVTVRGDETSAVLEVEDSAGACPEPLPETVAALQLRCSQLGVDLHVRAGLCRLSFSRA

SEQ ID NO: 15242 - protein, 294 aa, Myxococcus xanthus
MSSQRANQLIEAGLWLRLSGDAQGAQRLFERALELDPANTRAREYLAAAAGAPSRGTATPFERPPELEPSLGRLAPTDADLPVSPALEGDWGAWAEGQGGPSEAGGKSPPAPVVLPEALDGAPADVLELLARDVVIEFDEPVLQAKGDTDEYGIPAGHTQEFDLPVMESELDLLLRGAEDLLELDDHSGAVDLLFKAKELAPSDIRVESLRARSERMLMGRLESKLGDLGRVPAVRLQPDDIIWLNLDHRAGFVLAQIDGSVSYEDLFSLSGMTRLDTARILVQLIDEGVISAG

SEQ ID NO: 15243 - protein, 116 aa, Myxococcus xanthus
MQSKHARAESSLTDQQKKDGRCLSCHSPEQVTQATVNVTCETCHGGGQYYSPEYVMKDSELARLVGLVDPSEKQCRSCHDASSPSLRPFDFKESLKAIDHWSAERARRAADPSAKK

SEQ ID NO: 15244 - protein, 167 aa, Myxococcus xanthus
MINALTGRRKLVRVSNTPGRTRTLNFFDVDLERGGVRHQIRLADLPGYGFAKASKADKAQWEKMITTYLEKRHRLEAVVSIVDVEVGPTPDDLTTLDYLQAHNRRVLVVATKVDRLTKARLKPRLVELSKLMDLPLEVILPFSSTEKLGVDEVWGALLDTFGKSARV

SEQ ID NO: 15245 - protein, 567 aa, Myxococcus xanthus
  unsure (1)..(567): unsure at all Xaa locations
RLSPRQRVDALLDVAEARALVRSMPAEDLYVTIQELGLADSTELVQLASPGQFRAFVDLAGWRRDALDSHAVLTWLRAARGGVEDTGEFLRKLHTLDLEVLEIILREFIEVHDLEENPDVNPPGVTMETPEGRYLVEIKVEGVEMSAVRSLLNDLIAENPFEAVRLLEAVRWEIPSELEEAAYQFRRGRLQDMGFPSLEEAVSLFSRVDVAPAPVAATRPGLAPTTGHVDYLEAAFRGLTMVEAVNAEDELREVASAALVADLADPGDLDAIRRASETVRDYLSLALEHLTGADLERATDVLRDTPLRRIFQTGFSLTLQLKFRADRLAKAPGALVEGVLMVLPEEAAAISALRQKRPRRALRVEGAEPVAFRSRRELAATEALLARAEAQVQVFRGVLGGTDDSTREALARFGVPLETLGQERLLAAVVAMAVLEERADARPVPLGRVVELGQRLFEGAPEAPRLRASAAERAQKGLEPAVAPEAHAELRRLVMLTLSRLLEELGTPWLQDGRLEPVASAVLPMESSPSRRNFSPGRPARSARPPRSRRFRVXPAGPLACLWFAQV

SEQ ID NO: 15246 - protein, 159 aa, Myxococcus xanthus
MALDKQFIGREYGPYHYTLGEEKMREFTLAVGGAKPGAGTPGEPPAHVSPLLYDAQAAKAGPHGGLIAFPSFAVVFAIRPFSAAIADPALNINMQMLVHGEQDLEFLDVMRPGDVMTTTGRIADLYERARMGFVIVTSESRNQHGTLVVKGTWTAIIRG

SEQ ID NO: 15247 - protein, 380 aa, Myxococcus xanthus
MSETRKKATAGTYFITGYPGFIGKRLVEHIAREDPKGHIYALVQPKSFKEAQQHAARVKGAKVELLTGDVVDMHLGLSGEEYQRLCERVTDIFHLAAVAQLGVAKETAWRVNVDGTRNMLELARDCGKLTRFNYFSTCYVSGDRLGVIAEDELDRGQGFRNAYEETKFQAERLVQRAAATVPITVFRPCSVGGDSRTGEIDRFEGPYYLGILLVTSPLVVPLPLPGNGVAPLNVVPVDYVVEAVWRLSKDPRAQGNTFHLVDPNPMSARRVYELIAEKSNKKLPRFNLSARAADVMLRLPLLEKLARPQRAAISYVNHLAIYNCHNTLELLDGTGVRCPPLSSYLDQLVAYVRDQYRKRREGSDEYDPLDQGTAPDAERP

SEQ ID NO: 15248 - protein, 104 aa, Myxococcus xanthus
MDKLQALEERGVARVIYDVPLLIESGMHTWMEAVAVVWVPRAMQKARLMSRDGLDSDAADARLAAQLPLDDKRAHATWVIDNSGDLASTRAQVEAMWRAMLARG

SEQ ID NO: 15249 - protein, 128 aa, Myxococcus xanthus
MKNLTGVLVFSAVLFLAPGCTRKSGEAPGPTDASAATDEAARTGASKGALRAEDAGSGSTARAAQEACVDSWLQKQGLDAYGNPEGSMYAGGTPLFNERTGEQIDRLDFIFKNKPEVRQACSGDAAAE

SEQ ID NO: 15250 - protein, 155 aa, Myxococcus xanthus
MRILTVLAVLTFAVPAAAKPWQGIEPGVSKRDEIIKKFGEPSRTVKQDGKEIIAYLSKEAIKGTTQAQFKVDPDTQMVERIDVFPGPIIDKETVENSYGPSCPSGAAPATPCYLRKLTDDFRTYFLYPRLGLAIFFNEDGKTVQSLTFTTQKAAK

SEQ ID NO: 15251 - protein, 178 aa, Myxococcus xanthus
MLDGELYDPFDAELVAARNRARDLCQVLNATREGEQEERRRILQALVGVGGDTVWMQPPFFCDYGSNIELGQRVFFNFNCIVLDVCRVSIGDYTLFGPGVQIYTPMHPFNAELRRKEEFGKPVTIGSDVWVGGGAIILPGVRIGSRAVIGAGSIVTRDVPDGVFAAGNPCRVIREITE

SEQ ID NO: 15252 - protein, 50 aa, Myxococcus xanthus
MLTAALGKGVLAGIFVLSFESPVRGLVQRLIEATVFGWMVLVGVWLVVGA

SEQ ID NO: 15253 - protein, 139 aa, Myxococcus xanthus
MALLRELGPDENILAYAFNFRTATGELNRDLALANQLNKAIYDRLSIDPGSDIYGYDLIVSTTDLSGPGYGRGFIENYKARLGVGGSPGDNITVLRSVTMDPWVTETKEGSFIDVLEVEFRKVVCAALEELIPTRDRGY

SEQ ID NO: 15254 - protein, 57 aa, Myxococcus xanthus
APGGSSPILRLKLQHFKPEELYATLTAARLVPRERYGRFDGKPFDLEDSRHIGIAGT

SEQ ID NO: 15255 - protein, 158 aa, Myxococcus xanthus
MVLATVLASMLALPACEDRDAQATWTQASGSVALSRDDAFLYVVDSDNGVLAVVDTARREKVGEVKVGLLPERVAVGPDDTVYVSNRGSRSVSVIRRGDWNEAARIAVGGGARGPVGVARRGHAVRGEQHRAGDVEPRLVDGGGHTLAVGALGIAGGG

SEQ ID NO: 15256 - protein, 526 aa, Myxococcus xanthus
MAVDTRSLSVRWELPVGDEPRGIALAQGGKRALITRFRQGDLVSVDLTDADRPRVVREQTDLYARANVRDNVAASPNGLSPRLPPADIRFQPRSMSSVAVTPDGERALATVMWAREDPLSPDGTPTAPSGGSLYGGGGPCNTGGVVAPGLVTFDTDTGSPRVDDLDRCRPPPDLSPDFPPSTIISPESTHPIQGPVAAVVDPTGLWAFVVNRETDNVAIIPTGRRSGSDLRSGLGSTVRQLVRVGSGPTGIAMTRDGRKAYVYNAFDHTVTTLVSDGAGGTANIRTDGAPLPIAGDVLAPNEVAGRKLFFSALDSRMASTSVGASCASCHPDGREDGHVWGFPDGPRQTPSLAGRSMTKTGPFHWSGEFSTMRDFLDATVRHRMGGTVLDGVMVAQLSDFIDVLPAPDNPHRADVLTDAQTRGEAVFRKAACDTCHGGAHFTLNTQADVGTFVTSGLLQDDPVVRKQGLNTPSLLGLARTAPYLHDGSAVSLKDRLMQGRESNRHGMTAHLTDTEVDDLVEYLLTL

SEQ ID NO: 15257 - protein, 232 aa, Myxococcus xanthus
MSDKTRSILVVEDDLSILTGLSMNLRFEGYEVLQAQDGRTGLARALDESPDLVVLDVMLPELNGFEVLKELRQRGRDTPVVVLSAKGMETDKIVGLNLGADDYVVKPFGLQELLARIKAVLRRRYPSAGAGSPPPVTFGDVSVDMAARTVARARTPVELTAQEFKLLAHFLAHPGRTFTREELLSGAWGYHYEGSARTVDNFMRQLRLKFEPDPEAPRHFLTVRGLGYRFER

SEQ ID NO: 15258 - protein, 314 aa, Myxococcus xanthus
MGRLVSEVAQARASALGPTGLAERVLSSPLQDFRLVVLPTGEDPVARASTRNRVLYGVLLGVFYLTLTFGVVYTGRALYREAQLSRMKTDFVSLVSHELRTPLTSIRMFIETLALGRLKDPAQTQEVLTLLMRETERLSIFVERVLDWARIEGGRKVYQREIVPVSELVNAAVEAFRTQRMEDGVDLTVEVSDGLPALDVDRAAVAGALLNLLQNAYKYSGPDNRRITLQVRGSGKGVDLTVEDNGVGIAPQERTRIFERFYRVDNLLTRRTEGSGLGLAITRRIIETHGGRISVQSEPGKGSRFTIHLPAGKA

SEQ ID NO: 15259 - protein, 88 aa, Myxococcus xanthus
MAPTLQAGGVEVPALGRAAVRRAPAQGMSQVLAWDDDTDCAVVVTWLGGETERAVEVARSALIATKPAVLDAGTPGAPKEDAGDSGEP

SEQ ID NO: 15260 - protein, 148 aa, Myxococcus xanthus
MATSVYKTAIIGRVFFLRWEAPPSQEEIHTVFQQMKGAHEQLQHPLVLVASLSPKSSVPNSEQRRNLSTFHSDARPLFTEIHAIVEGNDLQYNLQRVIISGINLVTRTFDEAFHRVHKHADLVAPYLGKSLGVDGVKVIEEARARGVV

SEQ ID NO: 15261 - protein, 427 aa, Myxococcus xanthus
MDSQLALSEETPANDLRARVRKVLERRKLTDSVSAEQAAASWEQDRFVARARALFYARMMFLTLGLLILAVPAWSGYFGLTGPFSFVGYFAMLLYSVANLLVIDHPKAGRWVTYITLCLDVTISVVLIAKPHVGGGLQSPLLATQLLFTTLFAILFPKPLAILPPLLALPITTRLDLLLNRSVTAVELLTLLWYLALNFIIVYVLVYLNEREAAAHREVVSLQGDLKELAVVEERNRMAREIHDGLGASLSSMIIQSEYILNLAREEGLREEIRELKLTAEESIEELRRSLRMMREDFELAQGLEDYAKTFRERTGLDIRFERTGLQRKLDPDVQLALFRILQESLSNAVKHAEAKGVQVRLDFSEDRVNLVVRDDGKGFDPSRTPRGHYGLLNMRERAMKLGGQLIVDSSPGAGAQVAFSLPCRPS

SEQ ID NO: 15262 - protein, 127 aa, Myxococcus xanthus
MSHSYSKVFGALVLLGLAVSCRANHAPKVSTGPRPSPQVVGAGGVVSFVFEVEDPDGDAMTFQWQQLPAEPAGTFSDANARNPTWVAPEVSETTTFAIMVTVEDSEGDGILAQGPCAIFHSAGSQAY

SEQ ID NO: 15263 - protein, 59 aa, Myxococcus xanthus
MVLLIPCYMLFYAFSQFEHRRKGLIVAGFMASTVLAAVFLGLGLHSLSALASRSPPSGF

SEQ ID NO: 15264 - protein, 48 aa, Myxococcus xanthus
GHTEVLAEAFGVDVMMLMDGPRVRVALATNHVPLADLPRLLTVDGLTF

SEQ ID NO: 15265 - protein, 201 aa, Myxococcus xanthus
MLYAHLAKTPQAPVRAAVTLGSPFTFAVQPGLRTFIQKVEPVLKLRVIPTSRVTSIALFGAPPGPMSRYMMLAENMETEVVRRALANVPADIAGGVGRQFARWITTNRFTSYNGEFDYRESLSRVTIPFLLLAGSKDLLAPPMAVARAKEYLGGPVKVLVAGKAHGFGADYGHADLVLGRRAPDEIFPLVEAFLSAHATQP

SEQ ID NO: 15266 - protein, 104 aa, Myxococcus xanthus
MNAAKTLLNFILAGALLGFVVASWLGPNYLGWYNETPYATQTMCNLPEVVRKTSADLISYQVIGGGVGAGLFLILGVVVENRSHRKARVQTSQAPPPQEPRAPA

SEQ ID NO: 15267 - protein, 131 aa, Myxococcus xanthus
MEALLDAGFKVLLETSGAIDVRLVPPAVHKIVDMKTPSSGEHLRNDYRNFTSMNANDELKFVIGSREDYDWAKALIAEHQLLQKPYGSLFSTVFDKLHPRELAEWVIEDRLAVRFQLQMHKYMWDPNARGV

SEQ ID NO: 15268 - protein, 106 aa, Myxococcus xanthus
MFSTLAGFAEPGESLEECVAREVKEEVGIDVKNIRYFGSQPWPFGRSLMVGFTAEYAGGDITVDQKEISEAHWFSPDNLPRIPPKLSIARQLIDTFIERVKGPTAP

SEQ ID NO: 15269 - protein, 517 aa, Myxococcus xanthus
PLGGIAASYMNFSVGFFVGGQVLAGILGSAVTYGYGAEGKHGANYMQTMAASVASLCAMSVLIQSMVWLGMEMPAAWQLMLFVGCVGMFAVGVGMLYTPLLVDKLQLDYPSGLAVANILRALTDKRLLKASISKLGGGTLLGALAAWMTEKVAFVSSIGTSAATLGAGMIVGSRITVPAIVMAVIGAVLVPTLREIGWLGPQDPFRKIGFVIGLGMICGAAVVDLSLLAVQAAKRIRERASAKDEEEESWKKVNIPRLLAWVGVWGGATLVVGTQVLNQPVGWLLFGMLLALLFVLINGISFGITDQNPISSAFVISVLMMSMMGLRVPLVGMMAATILLISTSVGCDMQQDRSTGWRLGTNRVTQFRYQVLGVTMGALLCVGLARVFMTAYPALTINQLDNPNAELWPVGLRDDVQAGGRHPRPRLAVAGRRECPAPRIGHRLHLRTAAQGGARQRALPAVREGFPKGLRRRLDGGRHPASQSLRVVVRRLRGVPGVAVVRRGRHRDVRLEHVLQA

SEQ ID NO: 15270 - protein, 246 aa, Myxococcus xanthus
MTGAPVDAPQPPDSPPIRVFVVEDQTKILKNQLRLFENHPEMDIIGTALSGEAALEEVPKLMPDVLLLDLGLPRMTGIDVTREVKARFPKIEILIFTIFDEEDKVLEAVKAGASGYLLKGAPVDKIIEAIKEVRAGGTVIQPNLARRLLRHFRVEPDASPLISPPAAPEPSASDLPQEPLLKPLSDREREILQLIAKGVSNSEAARLLDLSKATIRTHLEHIYRKLEVTNRVEAVTEGIRKGLISV

SEQ ID NO: 15271 - protein, 154 aa, Myxococcus xanthus
MTYKLVGAIRDLGSLSQAVVNALLLGLAIGFIYELLRKVVRGNARYQQYVKGSRKGFAVGWTVDAILLPSPYASSFGGFVAFPVSLWFGAGGIVTSVWNTFSKREEPAVSGSPGEGEALPEDMSTMSLMGGGLIAGESLFFLIAGLIGLASLLA

SEQ ID NO: 15272 - protein, 321 aa, Myxococcus xanthus
MFLVEDGARHLGVKPVSCPGHIELVQRMAPSYRDLPLRLGEFGLVHRAEPGGALHGLFRLRQFTQDDGHIFCAEPQVVPEVVRFARSLKDFYAGFGFDDVQVAFSGRPASRAGRDELWDKAESWLLLAAKEAGLQCHMQPGEGAFYGPKLEFVLKDRLGRAWQCGTIQLDLVLPERFDLHYVDASGARVRPVMLHRALLGSLERFIGVMLEHHGGALPPWLAPQQVVVASVGEGAADYAERFAAKLQEAGCRASVDRRGESLSRKVLDAHAAGVPWLVVAGAREVAAGNVRLRQRDGAQRDVPWEDAAAELVASCRPAPNA

SEQ ID NO: 15273 - protein, 51 aa, Myxococcus xanthus
MIRTEVRCARCDGHLGHVFPDGPPPTGLRYCMNSVSMKHVPEGQPLELVKT

SEQ ID NO: 15274 - protein, 132 aa, Myxococcus xanthus
MTKNLETIEAGEPIRAAALRMRTCNIGSLPVLEGGQLVGMLTDRDIAVRSAALGQDPNTTPVREVMTATVITCDVDATLEVAEKVMEEKMVRRLVVVDGERRPVGLLSLDDLATVPEEVLHAGEVLERLQQV

SEQ ID NO: 15275 - protein, 537 aa, Myxococcus xanthus
GMELCPALGLTIPVGKDSMSMRTVWEEGGARKAVTSPVSLIISAFAPVLDVRKSLTPQLVDVADDTRLLFIDLARGKQRLGGSVVAHVHGQVGPESPDVEDPALLRGFFAAVQALSESGSLLAYHDRSDGGLWATLCEMAFAGRCGLDVDLAPLGGDVTAALFNEELGAVVQVRASDVARVREVLAQHGLSRDVHELGRPVTALQVRVRHGGDTLMAEDTLALRRTWSRVSYEMQKLRDNPICADQESAARSDASDPGLSPKLTFDPAQDVAAPFIAKGARPRVAVLREQGVNSQQEMAAAFTRAGFAAVDVHMSDILSGRVSLEGFKGVLACGGFSYGDVLGAGGGWAKSILFNPRARDAFAAFFARPDSFGLGVCNGCQMMSQLKDIIPGAEHFPRFVRNASEQYEARLSLVEVSKTPSLFYQGMEGSRMLIVTSHGEGRAEFPSVEDAARVNGLGLVTTRWVDNHGRVAESYPANPNGSPHGIAGLTTRDGRFTITMPHPERVHRSVQHSWRPREWGDDGPWMRMFRNARVWLG

SEQ ID NO: 15276 - protein, 300 aa, Myxococcus xanthus
MDSFRKALTTAIGNGDRYLAAYLQERLTELVGNDAARALQVLEWAKGASGPELGIYMDALKAAPAVHAPQVAQSLMKLGEDPGAPLQTRSAALDALETQRKLAPGDIQRLKKLALDETLDSTAWVATRTLGRVMKEDYERTGTFEPYWKELLDIGGTSDDMAVRLLALEMPSYSNPVIGAESFDSLKRILSSDRERDVREMAAFRLGVTSEPEKAMEILRAAFLAEHDLCVRWAIFRFAVRAGGDKALPMLEQFAAKDPRFTQDYLEFQALYASGTVDFARIWLGKREHHNCLVEEGAPH

SEQ ID NO: 15277 - protein, 320 aa, Myxococcus xanthus
MGRAALLVALSSLTPVTARAEATLRPAQCTVQGMLDDVRVAMKNGSPALKRYVKMRLKEAALAMPAESLLAALHGERDPEVLEALGAALATKASNAENPGLIQPLLARATGDADPALRAAAVRGLRGVPSVEFMEKNGGVVTYEQLVRDASPEVRAAVADNIVSESADVYSGHDRRVSEAAVSVATASEDPAVAAKLLREVSMEAVGHEAVEQVTRQLRAENPELRAAAATALGGVPGGASAGARGSLVDLFREDKDPAVRKAALQGIARLGQAHAVPVLESLRGVDRAMDAEIDAWVSVLKLNLQEWELVLREKQRRRR

SEQ ID NO: 15278 - protein, 179 aa, Myxococcus xanthus
MKLTMAGLVLAAAGWATSVTAATAVGPICDTAARVGSTTYYSCSGSSHNALDMSNGTCSVWNHRGMINVSRYYAYYGGCANNCSGGTSCNGGAGNYYVVTGGSGWDFRQLHLNSNVSSGSKTCDRCALGLVGSTGNSTGAHVHADNRQYGTRKTAWYTTVGTTCGSSAYCSNRVGTPTL

SEQ ID NO: 15279 - protein, 112 aa, Myxococcus xanthus
MRLLRLGNGPSLELFEYAAPEQRPPARPNDLGIQHLAVYVDDMDTALARFQAAGGEVFSSPHELPALEKGPGNAFCYARAPWGTIIEFITYPSPQPYEKQTALRRWKPPERD

SEQ ID NO: 15280 - protein, 261 aa, Myxococcus xanthus
GKVTDGLVVAAVVVLNTLIGFVQEYRAGKAIESLSRMVPENATVIRAGRKLRVPAAQGVPGDVMELAPGDKVPADMRLLSARNLTVEEAALTGESVPAQKAVAPVPEEAELGDRASLLFGGTLVTSGSATAVVVATGQATELGRISTLLREATDLQTPLTKALAVIGKYITLGILVISAALLGVGLVRGYAVSEAVVVAITLAVAAIPEGLPAIVTIALAIGVQRMAARRAVIRKLPAVETLGSTTVICTDKTGTLTRHEM

SEQ ID NO: 15281 - protein, 111 aa, Myxococcus xanthus
INLKHSVAATVLWLFVVVLGIAFGAGLYEHRVSLPRWLDTPGGHWSAQAARQDNVGLRFWAFVTTGPLTLLTLASLYFASQATGALRVWWLGAALAALADRLLTFSYHRAT

SEQ ID NO: 15282 - protein, 353 aa, Myxococcus xanthus
MGVIGAGFARTTQIPALRALPGVEVVSLASARREKVEEAGRQLGVSHVTTDWREVVSRPDVTCVCISTPPALHRDITLAALEAGKAVLCEKPTALDAREAEAMWHAARERRVLALLDHELRFLPARQRMRALLRSGELGAVRGARVFYRNDNRASPERPWDWWSDASQGGGLLGAIGSHAVDTLRFMLGAEPDEVLGELATHTPERPDALTGQSRPVTSDDEARLLLRFGATTAAIEMSMVSSGKPVHGVEVSCARGGLRVEGRELWRSTVGARAWERVALPEEPPLPPGLPDNEWARGFLLLAGALTQALREGRASVEDAATLEDGWRNQRVLDAARRSHAERQWIRLSSGP

SEQ ID NO: 15283 - protein, 171 aa, Myxococcus xanthus
MAEHKGIVTFKGQPVTLVGDEVKVGDAAPDFTVFKGLNDAVRLSDVKGSVVVVSVAPSVDTRVCAAQLRAFNKEATALGPDVKVWFVTLDLPFALGRFIGAEGIQNVTTLSDYKDREFGEKYGVYMKELGLLARSTFVVDREGKVVFREIVPEMTHEPDYDGAMKAVRAAL

SEQ ID NO: 15284 - protein, 117 aa, Myxococcus xanthus
MYQQKGTALGLRNAIRFFLGIEVRAVSPFASDTLVLGESELGVDWVLGPSERFARYAFNVEVERLLSTAERQRLRTLVEYLKPAHTHFIDLVEPLPPILPEHWELGLSELGETTTLH

SEQ ID NO: 15285 - protein, 257 aa, Myxococcus xanthus
MLGFINGHVTQGAGAHAASAVSVADAGNLLTAGTVEAALAEVLSAFSGGHFRGNETAVGQHKAILQPVLGTGRVLLLDAQGAGGAAARLRLYADSDSVWFTLNAAWNGSAWARDTTGAAAAGFRLSRNEAEFLHDASLTVTFTSWTRTLRLPLSSTASNTSFEVAGSVREVGRLGLQYSNSDTAAHDNLAGGGSVTFRSRFPGVPSSITLSPYAFAGSFVGNPTVMVPDRDGFAFYSHQTLPGLASTYWFGSYTAVA

SEQ ID NO: 15286 - protein, 94 aa, Myxococcus xanthus
MVIGTDTTYLGNEIPGLRGQKVRIFAVLRGGLRPDANPDADDYYVNDNETLAHLGGVTAEDCIDAALILPDGTTSFVHFDPRAIDLECFAHLRK

SEQ ID NO: 15287 - protein, 206 aa, Myxococcus xanthus
MPRTTAPKTKKLESMNLTELRARFREVVGEETRSPNKTYLIRRIEESLAAKKRRSPSRRATATAPSAPPPAPAAPATTSAEGTQPARQRGRFAGMSLQQLQEKYREVVGRPTGSSNVSYLQWKIREAEAGRINVGPRPEREVKVREDGKRVIPLSFDAEALDALDKAWRDAGLPSRTRFFMRAVHRELTAMGATQAAEHFAPKAEE

SEQ ID NO: 15288 - protein, 76 aa, Myxococcus xanthus
MSVDARAGYLTAVVRVDKRISRRLDSQPNETLVALFRERLAAEDSQRVTVHPLAAQSFEEAAKEMSGADLGASSDE

SEQ ID NO: 15289 - protein, 49 aa, Myxococcus xanthus
MLRRLAERIPIIHTCLPRLVDWGAEDAQAALNELRHTAIRERLHRPKQG

SEQ ID NO: 15290 - protein, 158 aa, Myxococcus xanthus
MARGSKAKYTAKQKRMAEHIEEGYQKRGVSDETAESRAWATVNKLTGGGMKKGGSGGKAKVARSRPLARKNARKAGRKGGKATAAKRAGTRRRAATGRTRKPAARAMRSGSKSTAARGTSARRATARRTSTAKRPASKSRSGTRRGTSSRGSRGRTRT

SEQ ID NO: 15291 - protein, 332 aa, Myxococcus xanthus
MDTVSAARPAPRYWVHLLLLVLTVGTTFTSYLLYFHFQRPYSLGEVSPEAAFRALAFSLSLLAILGTHEMGHYVLARWHRVETSLPYFIPLPVLGVGTLGAVIRIRDRIPNRNALVDIGAAGPLAGLVVALPILFWGLAHSTVVDAPDIPSTLFPGDGSLWVIGRDVFTWVMDRVTNAPPAPETPFNGVQTLFGDSLLMQGLTRLALGPLPEGKDILVHPVVIAGWFGLLVTLLNLMPVGQLDGGHLAYALWGRRAHWVGRAVALVLLVLTLFVTASWGLWLLVTSKLVGFGHPEVVEPQEPLSPLRKWICALCLLALIGCAMPIPLRQVMT

SEQ ID NO: 15292 - protein, 298 aa, Myxococcus xanthus
MLSPERIKSLCESSRPKLELMRAALRAHGSALVAFSGGVDSTFVLKVAVEELGDRALALTALSASVAPEEADEARELATRLGARHVVLGSNELANPQYAANPTNRCYFCKTELYDICEAQRKSLGLAVVLDGFNADDFKDHRPGHKAAQEHQVVSPLAQAGLTKEEIRAWSQSLGLPTWDKPQMACLASRIPYGTAVTRDRLLQVAAAESELRKLGFRQFRVRYHQDVARLEVAAEEYERFLAADVRQKINTAFLALGFKFVALDLEPFRSGRMNDAAGVARPGGTGKPEGFSLPVVS

SEQ ID NO: 15293 - protein, 251 aa, Myxococcus xanthus
MKFQCDACERLVPLETYRTEAGGLVVTCGRCGADSRVGPPATTAPRTEVPAVLAAGAAPAPLVPVAPPSDSWSASAPVTPALRVVRSESAPLTDDALFEPPPGVCPKCVAPRREEALSCPQCGLVYVNYQPEEHPLSDVLADAWRKLAARWEDWDAHDRLMTLAVGRGELAMVGRLYRIRLARAPDDAVARRGRDEVVRKATLVVPSSVEPAGTPNVFRRLKTVAVGVGFIVVLVLAVLVFQHLRTLSAGY

SEQ ID NO: 15294 - protein, 95 aa, Myxococcus xanthus
SLSVSTPPSVDSLLGPGGALEVALPAYEHRPEQLQMARAVERAFAEHSYLLAEAGTGTGKTLAYLVPALLSGRRVVVSTATKTLQDQIFFKDLPL

SEQ ID NO: 15295 - protein, 257 aa, Myxococcus xanthus
MVARGTRRLIVGGGDGTLSRAVVRLLGRDVTLGVLPLGTGNDFARSLGIPPDIEAACDVIAQGYTARVDVGLANGRPFLNAASLGLATGIAKRLTKRLKQRAGKLAYPVAAAAEMKDLRPFHIRLKADDQELALDVLQLVVGNGLYHGAGNMVAPDARLDDRRLDIYAIAAPSAASGHEGTGLGQLQDIATLMRVALSLRSGEHVEHPAVTALRAARLYVEAAPVQEVNADGELVGKTPMRFEVAPAALRVYAPAPS

SEQ ID NO: 15296 - protein, 182 aa, Myxococcus xanthus
MTRKWSASARSWTNTAASCSWTSSCRRVRPFPRVRELFQRLRAGGIRIVLASSAKEQELKHYVKLCGIEGLFETKTSADEVDKSKPHPDIFEAALARLGKPSPDVTVVVGDTPYDALAANKSSLPSVGVLAGGFPPDDLRAAGCRTLVKDPAALLARYEASRREWPWNESGTSQVAKDDERR

SEQ ID NO: 15297 - protein, 267 aa, Myxococcus xanthus
MRERLLLLCALTALTGCPKKGGDDAAMLLPEVKAGLATREAKLKSYRIAGTVQDAGLEPVTFTFEYRAPQRLRGTLGPPASRTFAWDGAHFFQQFDGEKRFATFTSELPPAKLAGFLSETFHPFMPEGFRTPLLLSHATVRRATHPLAPQAVELVQKLDGDAAGLEMVYVLRWPQLDFLGRRTVSPDGAAAEERVEEEHCDAALSLCVPKRLGRWQGGKRVGETVLTRVELNAALPNDGFTLTAPEGYDVQTRTLVESTPATQPTDG

SEQ ID NO: 15298 - protein, 115 aa, Myxococcus xanthus
MKKLVLSAVSASSMVACTSVESAVVSGTKIASNGEAVAVVQANALGLTAIFHIVDIVQSDLDTVINKLLIAEAKAMGASKVELLTAGTTARHGIYALTGTIIGVTSSSAVGVAVK

SEQ ID NO: 15299 - protein, 925 aa, Myxococcus xanthus
VTHRAVANHLRWRQATYPLGAADAFLQKASLSFDISVWEIFAPLIAGARLVLARPGGQRDGGYLAGLIARQGVSIAHFGPTLLRLVLDAPELERCTSLRHVFCGGEVVPVSLCERLLARVPARLHHQYGPTEATIDASCWDCVPGETRSYVPMGAPVANTRLHVLDARGHLAAPGEVGELLIGGVGLARGYLRRPDLTAAAFVPDPFSEEPGARLYRTGDLVRRMPDGTLQFLGRRDHQVKVRGYRVELGEIEAALLGHPGLREAVVVVRGEGEDEHRLVAYVVPARNAVEPLELTALRAFLERSLPDYMVPAVFIPLDGLPLTPTGKVDRGALPEPSEFNRLVPSGLHEAPRGALEERLSRLWGEVLRVALPGRHAHFLELGGDSILAVRIAARLREAGYRCRPSQLFSHPTIAELAGGLRAALQELPDGGKASAVPEDEWPSSAASEPYPLTPMQEGMLFHTLLAPGSRVYHEQLEFELRGPLVPELIERAWCEVGARHPGLRMRFQWEGLSAPRQVEARELPPIEWWDWRSQESLAFEERRERFLAEDRARGFALTDAPPVRLSVVQLEDGRYWAVWSLHHLVFDGWSAALVLGELFATYAALRAGTRRELPPARPYRDFVRWIRSRDFSAEAPFWREALGPGVSPTPLFADRRPTRRVPEPDAALRLRLNAGRTARLKALAVRHRITLNTLLAGAWAVLLGRYSGQREVTFGLAVSGRSIELDGVEGIAGLLLNTLAVRVEVPSQATADGWLHTLQARLTELLAHEQTPLADVQRWCAGKPGEALFESLLVFENYPAEAACWSPPGAGLVVERRFGAARAPYALTLTARPGEALELWASYERDRFSDEVIHRLLRHLEQSLWALAEGSSKVLASLELLPADELSALLARGRGPRVALPDEAELPALFEAQAARTPETVLRV

SEQ ID NO: 15300 - protein, 128 aa, Myxococcus xanthus
MNLVPFANEHLEAAASLLALRHRAHRATLPLLPGEPESATEARRILEALRQRPRTSGFAALQNGRLIGFALGTLRIDTTWGRSAWLFAPGHALAPGTSPEVYRDLYAALAAQWVQEGCFVHAALSPGP

SEQ ID NO: 15301 - protein, 411 aa, Myxococcus xanthus
MVPSENSMSALAKLPMLLDLHHRYFFNDGAEEEPWEFRGVQELSSLETELARPLLRELAGAEFVNVRALSGLNLMTLTLSALGGPPGSTVMLLSRAQGGHYATASVAARLGLKVCYATGPDAHTVDETQFAETLRAHQPGLVYIDQSNALFPLGVERLARAVQRDAPNTLLHIDASHWMGLVLGRQLPNPLTEGAHSFGGSTHKTFPGPQKAIFATNRRELFERFRATQQYMVSSHHFGATVSLALALLEFKHCRGEQYAAQVVLNTRRFGAALDRLGLALDGKERGFSAGHQLWIRTRASGVDAFTASQRLFDAGIRTNAYPSLPGIPEPVLRVGLNEPTYHGLMADDMEELAGLFVAAIFQTQPTEQIAGRVAALRARYRFPYRFPSDDPKLLEQAMRLVRLALTQPVE

SEQ ID NO: 15302 - protein, 99 aa, Myxococcus xanthus
MAGAEASEKNPATKRGKVLKIDREAERVTVEGLRLVKRHMKNTPQSPEGGIVEKPGTIALANVQVVCAKCDKPTRVGIRTEGEEGKKKRFCKNCDALID

SEQ ID NO: 15303 - protein, 244 aa, Myxococcus xanthus
MSGTGKSTTAAYIAARLRQVGRNVEILDEGELGEALWAGLGDGKEDRITVVKRLGFVANLLTRNGVAALVPCVSPYKPGREENRRSIGRYVEVYVDCPTEKLIERDSTGRYKKALNGEIPNFIGITEPYEPPNSPEVTIHSNVESVEDGAAKIFQSLLDLGYMSTEELKVITGKKMKANPLPAKGEKAEKAEKGGAKARRAEESKPAAKAPKADKGAKARPATRAARVAKPAAAAKKAAKRKAR

SEQ ID NO: 15304 - protein, 78 aa, Myxococcus xanthus
ADEKKAEQKEKKAKRGKKEEAKKVGFAANIEEGLESKPARLKVRFFKEGVPSLLKELSLKNPMQVPRLEKIVVNMGLG

SEQ ID NO: 15305 - protein, 393 aa, Myxococcus xanthus
ARAAIDQVRARHATPDAPAVTRWERETPVRVVVTDESNTSAVEPEVELPDATRDELPPSRRGPLSLVPPPATDAGESSYRESFSPESGRGEPEGIRPLAERAVGALSLARDIAGQALASESLARAMLAMGGLKDMLRAGLGTGGGANLDEYGKDPSLVERLEPVLEFLYSQYWRVSVQGVDHVPPGAAILVANHSGALPYDGLVMSMALTRERPDLREPRWLVEDQVFHAPMLGTLFNRLGAVRACPENALRLLDEHRPLVVFPEGYQALSKPFGERYRLKRFGRGGFVKLAVRTGAPIVPVAIVGAEETSPLLGRIPASFLGLPYVPLTPLGPLPLPAKWSIRFGEPIGVEDLAPEAADDLGEVQRLTERTREAIQSMLQSLLRERRSVFAG

SEQ ID NO: 15306 - protein, 101 aa, Myxococcus xanthus
MARSEPKSLESLLPRVLARLAGESGKGHALAPVWEAVVGPHLARHTTPQALHGTTLVVAVTGAQWAQSLESEAASLCEQLNARLGPDTVKSLSFTFQVARR

SEQ ID NO: 15307 - protein, 504 aa, Myxococcus xanthus
MMALLPLIAVLAATPPASAGMERSAAQHVSREFERVGRRAPVEDPKLTTAARRLAHEALTEYTTGAPGLFTLTSAVSDAGAADPSPRALVIRAWVPQHAVETFLDRDDFNSERASHFGVGVSVLGKRAALVLLLVDRKAELQDFPRLIANGERSTMTLCGALVPPLRRAEVYVTQPNGGVSLMPVQNRGAGGGFCSRLAFATPGTYTVEVVGRADGGPEVAALFLVDQGEPRKHAASEDTAEPTTLEDARRAVYERINALRRAHALPELSPDAVLEQVAQDYSARMSKEGFFAHIAPDGSTLTKRLPAGARYVRAGENLGLAPGPLAAHFGIEHSPGHRRNVLDPGFRFMGVGVAFHTVNGRQEAVLTEVFTVAPPASPELADPQQEAYDALSRRRASRKLPPLTRNAALETLARAHARRALELDQPSAQPGEAPVHDRVFELLPDAGTASVDFFVVSDPTAIPESRSMADATNNRVGVGVVRGDSRRFGTNQYWVAVIYAAVP

SEQ ID NO: 15308 - protein, 111 aa, Myxococcus xanthus
SLGQSPTALEAVRLHKPDAAALARAELTACAAKKCDDVGRLALLAGTLALSDGQAAEARELLAAWPAPPLLAPYHAFYLGQARFYAGDAAGAAEDLRECWNPRHPRNSRLV

SEQ ID NO: 15309 - protein, 159 aa, Myxococcus xanthus
MDGLTQIYNRRYFDEQLDREISRNRRYERMLSLVLLDIDHFKAVNDKYGHLAGDSVLKQLASTVRTKIRREDVFARYGGEEFAILLPEVSLSGTRQLAEKVRRLVEKQRFEFDRQVIPVTVSVGLAVLEPHHREPGELVRDADEKLFDAKTSGRNRVVG

SEQ ID NO: 15310 - protein, 846 aa, Myxococcus xanthus
MDMGPDNPVGPFPQVTYCSVDQDCPDPSLFFCDSATSRCEPACLTREDCGVARRGPHALAACDEVGGAGCQCDMNRCVPVVCAADTDCDSGTVCRDGACGSPPSESRAVACEVTPDVVVGTPGMTVDFRVWVRESTGAPLVLRDGVAWEVLSPSVVGGGGGHQASVVLSEPASEHQALAVRVGNVSCHARVTVLPAEVAPGGVRVLVVDALTGRPVPLAVVAVSADDGGLEAAMVTNADGAVWVPAEGEVALSAFHSDYGYLTLARHDASQFRDVRMALRRNPLDRFGGVKGPFPTLTETFSTAVSLRVGLMGLSVPGLPTDLAPESFLGPEHEVALPVGTGQDRLSLPSGSALWLTGSTAPDVAAPGVAGVCDSSLPGVLDAELAIRTGACGTRTAWALTGELPLKELPLNLMAPGTDPLLQLGQLLPGSTRFFSALSRDARFTLAPTPGILTGEPDTRAAEYAQALPFERETPGVRLSFPFAVRVPPLPQYRGAHLDRAYVLATVAVPGRGMVPLGLGAAANVAPADPNTDADARLGRPGLVPVRMAPTHRGLEGLPYRLVVSATSGDQAEDGTVATSTLVANLPRPEFDPDGVQPVDAGLSFLSLPESVRYNFDGAPRGELVGREFQAQVDGRASVVRAEFTNRAGRRWTVLMDPDDTDDGVVVPRPPPGFEDRTFDFDGVLQATRAKLQVEALRVRGLDRRVGQGPSRLVASEGLGAERLADLTDAVATLSVGRPEVTWRHPEADGQRLARGSAVRVSVSGFRLGTGSGGEGQVRVSMRGGSGCNDQALFASAPIAPGRGEVELQLPAQCSGLGVSLVATLVDLEGDPLRPLVTATRQVDIP

SEQ ID NO: 15311 - protein, 282 aa, Myxococcus xanthus
RAIAQRLLRQVVLVPVVAVASYFLMASLPLTTETDAKRQVSRELAASYRRDLGIGEPLGFLRPWEKLFRGERLGTSAQGITGDELLTKLSGSVGVGLMALPLSLTWALGFALLRTRWRKGPWAALGDVVPAVAFGTPVFIPALLLAPGVVERGHLLPELCAALVTSIWPGIFLGTLVGDSLEAELSRDYVRTALGKGLSRAAVLRRHVLPNVWPAMLDAVGPVATSLLAGSFAAERVLGLPYFGQLYVLDVLNKQVAVVVVATTTFAALLVIVSLAVEVLRY

SEQ ID NO: 15312 - protein, 213 aa, Myxococcus xanthus
MALREDQILRYSRQILLREVGGRGQESLLAGTARLDGIGASGLTAAAYLAGGGTPVTGAGSLTLGPWAPGFLMGPSDVGLPVTEALAREVPALNPDAGAVGQGGGLVAELPAAWSGEAPWVALGGDGMRAAVVFRGPEGCLWCFGETVRHLGSPPDGALGVAVGTLGALVFQRLRLGLGPALGGRWLVAPGTVEEMEMRRCSRCAGREPPAES

SEQ ID NO: 15313 - protein, 433 aa, Myxococcus xanthus
MADLEGASEALALQERGAPEAEVRAALERVGVEAVDAHTVRVTLARPRSYFLARVANVYLFYPAPSADLEGKSDEEVRDYFDRPRDGRPLALGPYRVERWDRAGERVRLVHNPASAFPPRMAEGETPVPVITLMKSEIGPALYERERVDFVFVDSAAALRIHRPDDLRREPLLSTYFLAFNTEKAPLDRPEVRRALSRALDREALLAGLLPAARPSHVLLPPELPGAATPEQAARLPRYAPEQARAELAGVERPLRLVYRSGDGFVPEVAIAERVAAQLARVGVRVVLEARSDFSAEIARRSAQGPRTYDLYLRRLGADYAHPNTFFTLFEREGNHQTGWETQAGGEPLARFERLLEAGDSAPDAATAQASYVQAQEVLVGEQAVIAPLYHPDRYYRARSRLRGLDVDPFNFLALRALRLGAASDAPWAGESP

SEQ ID NO: 15314 - protein, 721 aa, Myxococcus xanthus
MSLAACASQKEAARDELPAAASAAPVSEESPRMSYPATRAEQVVDTLHGVQVADPYRWLEDEKAPEVQTWMTAQNAHAREALAKFPGREALAARFKELFYTDSVSTPSRRNGRFFYVRTHKDKEKAILYWRQGESGQEKVLLDPNGWSKDGTVSLGTWAVSWDGKKVAFAQKPNAADEPVLHVIDVDSGEWSKVDVIEGGKYATPKWTPDSKGFYYEWLPTDPSIKVDERPGYTTIRYHTLGTEPSKDTVVHERTGDPTTFLQSDLSRDGKYLFVYILRGWSENDVYWKRPGEKDFRLLVKGVGAKYEVHAWKDRFYVLTDEGAPRQRVFEVDPAKPARASWKEIVPEDSSASLLSVSIVGGHLSLEYLKDATSEVRVATLKGKPVRTVQLPGVGAASNLMGLEDLDDAYYVFTSFTTPRQIYKTSVSTGKSELWAKVDVPMNPEQYQVEQVFYASKDGTKVPMFVVHRKDLKRDGNAPTLLYGYGGFNVNMEANFRSSILPWLDAGGVYAVANLRGGGEYGKAWHDAGRLDKKQNVFDDFHAAAEYLVQQKYTQPKRLAIYGGSNGGLLVGAAMTQRPELYGAVVCAVPLLDMVRYHLFGSGRTWIPEYGTAEKPEDFKTLHAYSPYHHVRPDVRYPALLMMAADHDDRVDPMHARKFVAAVQNSPGNPATALLRIEANAGHGGADQVAKAIESSVDLYSFLFQVLDVQGAQGGVAAQGR

SEQ ID NO: 15315 - protein, 165 aa, Myxococcus xanthus
MGGRSLGFGADVQSKKQRSLTELLKHVEPEDLLKFGMIPEFIGRLPIITALEELDEAALINILNQPKNALTKQYRKLFELDGVTLKFTDGALKAIANEAIRRKAGARGLRSILESAMLDVMYEIPSRKTAREVLISEEVILKKSEPVVLHAQPEKEAAEPKKESA

SEQ ID NO: 15316 - protein, 367 aa, Myxococcus xanthus
MTEDQDAMARQRVLEKQLTEVDTELEKLRTASEQRERHVEVRLSCPQGTRARVALTYLMGNASWTPSYEARANDSTRTVELTTLATVRQSTGEDWSDAKLVLSTAQPQRDATLPEIQPLYVLAEERPKERQVLVRRDEQPQHANAGGTPTATVTKGLEAIPQGLSVQFAAQARVSIPGDGNAVRIQVARTRFKAAFNWRTIPKLHPVVFRVARLNNAAAFPLLPGDVDLYRGAGFIGRQSLEHVAQGAPFELTFGVEEGLRVERRVVEELQRPKGLFKDTQRFRYAYQFTLNNLRGHPEEVEISEHFPVSELQDVKVAMEPETTAGYTLQSSDGIATWKVTLAPGEKRTLDFAFHVDVPSSYETKGL

SEQ ID NO: 15317 - protein, 379 aa, Myxococcus xanthus
MVDPAVDPGLLHSYTPVLIGNRLGAIEITESLGEQQKYVNTVVMGTFAATAAMAIGFIVAAMAMGRRLVGEPVDQLVSLAHRIGEGDLTARVPLPQRRGDELTTLAGAMNRMGEQLEETRSRLATETAARLSAVDHLRHADRLTTVGKLASGVAHELGTPLNVVMGRAKMISSGEAEGEEVGECAQIISQQAQHMTAIIRQLLDFARRRKPHRAPEDVQGLVERTLSLLRSMAARNSVTLETDIPAGLTVEVDAGQVQQVLTNLVMNGVQAMKQPGTVRVRAAHTRSTPPPDVGGPEADFVRLDVEDEGQGIPEDVLAHLFEPFFTTKDVGEGTGLGLSVSYGLMLEHDGWIAVRSEPGRGSCFSIYLPRGEDTCQAAS

SEQ ID NO: 15318 - protein, 439 aa, Myxococcus xanthus
MLEKGLTRRGFTPVALPSADEALVRLAAEDFDVVLTDLRMPGMDGLALCERIALNRPDIPVVVVTAFGSLETAVAAIRAGAYDFVTKPIDVDALVLVLERAVQHRALREEVRRLRQELGRREDSGTVVGESPAMKQAYALIDRVADLDSTVLITGESGTGKEVAARAVHTRGRRKDGPFVAINCAAMPETLLQSELFGHAKGAFTDAKAARTGLFVQANGGTLFLDEVGELPLTLQHKLLRALQERTVRPVGGDTELPFDARIVAATNRDLELAVEEDRFREDLYYRLNVIGVELPPLRARGNDVLALSQRFIEQFASRTGKRVLGLSPAAAQRLLAYGWPGNVRELQNCLERAVALTSFEEITVDDLPERVRNYSQPRVVPETQDASELVTLEQLERRYIHRVLEAVGGSRTLAARILGVDRKTLYRKLERDDDTRKG

SEQ ID NO: 15319 - protein, 266 aa, Myxococcus xanthus [sequence omitted]

SEQ ID NO: 15320 - protein, 156 aa, Myxococcus xanthus
MGPDEFTAVSDEVREWPLSTREWVSRRSAPRILLGEDQPEMRSLLRRALSRRGYDVVEAPDGPGLVKALVDGLLAQQTQVPDLIVTDVRMPGFSGIEVLARLRREGWTTPVILITAFGDAQLHQEAELLGAARVLNKPFAMEDLCEAVEMLVPPPR

SEQ ID NO: 15321 - protein, 81 aa, Myxococcus xanthus
MRGFTGNQAEVAAPGATVGEVLKNLDARHPGIGGRVFDERGAVRRYVNVFLNDEDIRALNGLDTPVKDADRITLIPAMAGG

SEQ ID NO: 15322 - protein, 86 aa, Myxococcus xanthus
ALRVADASIALSSQGPTIMIPRTALVESGMGTYVLRVQDGAAKRVPVSRGMRAGEKVEVFGAIETGDVLVLKASEEMKDGMAVAGG

SEQ ID NO: 15323 - protein, 94 aa, Myxococcus xanthus
MKTKLAAVTLVASLLASSAAWAAVTVRYYNRDSRDHSWSVVCSGVKTSVTFGKSQTASVTIQGSGPCSVKTDAGTVVLKGGEDLEIKDGRILVK

SEQ ID NO: 15324 - protein, 463 aa, Myxococcus xanthus
MKKWFAMALLVGVGVTGLLVEPAAQLKQGGPIDTSDTAWILTATALVLLMTPGLSFFYGGMVRLKNVVSTLLQSFIAMAVISLIWVVVGFSLCFGDSFHGLIGDPRTFFMFSGVGGETHPDLAPTIPLMLFALFQLKFAIITPALITGAFAERVRFKAYVLFMVLFTLVIYAPLAHWTWHPEGFLRQWGVLDFAGGTVVHMSAGFAALAGALVLGRRKVHVENTTHAPANIPFVMLGTGMLWFGWFGFNAGSAMSASSLATLAFATTNTASAAAMLGWIAFDWLRGRKPSAMGACIGAVVGLVAVTPAAGFITVGQSIFVGLVASFVSNAAVHFKNRTPVDDTLDVFPCHGLGGVVGMVLTGVLAKDVGLIHGETRTFMMHMLALVLVSVFSFAGSFLLYKLVDRIVPLRVTREHEEEGLDLSQHGETVGESIIAAAPQPALTATTAVATEPAPDASRLPQPA

SEQ ID NO: 15325 - protein, 642 aa, Myxococcus xanthus
MGSVYLAQHLRLPGKQVAVKVLRGGDHLTPEIFARFRREAEIASRLGHPNIVEVLDYDTLENGNPFLVLEYLRGESLQERLARGRLPMEDVVSFTRQMGSALQAAHGAGVIHRDLKPANVFLVPTDSGGVVGERVKLLDFGISKVLSSTTVQTQEATIIGTPQYMSPEQAQGKNRDIDARTDVFALGCIVYEMMAGKPVFGSGSLAQMIFRVVYEPPEPLAPLCPEATPEAISAVMRALAKGVDERYPDVSSFIEDLTGTPLHSLSTTAGNQPAPRPQAPASGIALPSTDPASLSATVPPGSLKVAPDTGREGFDSTMAPGTGQQGFSPSTTGQMGVAQAQGFSPSATGQMGVAQLSAASLIDPPGLEPTLISKQLPAIPVPERPAQHHTAVSVPVPIPGAAEADAAAALVSAPSTPVSPPPAAKGRGAFIGATAAVLLASSVGLVWWMKGGTSGTGSPTTPVADARAPQDARQANGAQQTNGQQANGTQANGTQANGTQQTNGTEQANGTEQANGTEQANGTQTPPDTENPQQVVVATVTPPDKPTSRPVTRPEPKEELPEQVRKLLKEGESALASGDASRAIALARSSQRTKRSIAAYSLLTRAYCQQKDLGGAVSEWPKVASAERAKVKKFCQKHDIEL

SEQ ID NO: 15326 - protein, 267 aa, Myxococcus xanthus
MVAVIVTAVALGASQALAAAPVEAGKVYSGTEGEEVAVVPLTPRSDKKFILRVKGTGSEFDGLVFPYEQNDWSTRSTEQFNYSTQWHGRKYTALHVRDTKYELYVPGRQRPIRLAYDEKKTAALKPEEVYALHQKQMKDGTLAKLMAFDRKGEESGHNKEFAATLQEMNNACGTSVAARIDWSSINEDQLKELSISSFCGTPLTSLKELCTASAIAKQTIQEKVKQVSCRFGSALEPKIEADRVIWTTSRDASNQDKFATKYFKQNL

SEQ ID NO: 15327 - protein, 67 aa, Myxococcus xanthus
AAEPIQPPWGKESNLGEKMMLEATSVCTDGKGHFVALTPDDEDTNAVLYYGDEKQFVQVPRPGPYTF

SEQ ID NO: 15328 - protein, 126 aa, Myxococcus xanthus
MRPLFVEELAVHPDYQGRGVGSFMLDQLQHLARTRGCTHLVLEVAENNESALTWYRTRSFYKLDAAIFMAQKVPGEPDLLPPRRLKRRQKPTVETGTPSTGPMPETAPTRAAARKGRAPAARKKSS

SEQ ID NO: 15329 - protein, 1178 aa, Myxococcus xanthus
ERVPGRDFPAIGFRWEDLPETPHEGAGVLRLESARAYADQSKLCLCCMRTRSALTLELQYDRSLFPLAAAEQVLGQLEALLEQIAGSPRARLDGLDAVSPRERARLLVDFNATDREHPARCVHTWMEEQASRHPDRVALVYEECTLTYAQLDARANRVAHALRRRGVGPEMRVGLYLNRSLEIMVGILAVLKSGAAYVPLDPGQPRQRLAGLLDDIQAKVLLTQRRLRETVPEAEDREVLCLDEESTFAGEPTSAPHCGALPEHPAYVLFTSGSTGRPKGVVVEHRQLHNYVASVMERLDLPEGAAYATVSTFSADLGNTVIFPALCLGGTLHVISAERVSDPAAFVEYLQRNPIDVLKIVPSHLRALASAGTAGALLPRQRLILGGEATPLAWAEELQAQAPGCRIYNHYGPTETTVGVMTFRLEPSRPFAANNTLPLERPIDNTQVYVLDARLRPVAVGMTGELYVGGAALARGYLNRPDLTAQSFLPNPFSTTPGARMYRTGDLARHLPDGTLEHLGRADNQVKYHGYRIELNELRHALNQHPQVRDSVMMLKRDTNGNEVLVAYYVSRQEQEHAQLRAFLAERLIEEVLPNVYVHLKKLPLTLNGKVNHEALPSLDEARRRQRSQLVAPRTPVEATLADIWCQVLNLKEVSVTDNFFSVGGDSILGILVVSKADQAGLKLTPRQLFKHQTIAELASVAAQAPASPDAEGPVTGPLPLTQIQRWFLEQEVPDLDGWGIVVPLEARQPLDPSRLQQALTALLNHHDVLRLRVTRNGSGWEALVAPPGAPMPFTRIDLASVPDALLKERFQALGHELQAKLRLDGGPVVTTALLELGPHRPSRLMIAAHRLVVDGVSWRVLFEQLQLAYEQLGGGGECKLPPRTTSVRAWLERLQGYAESPRLREELAHWTAQGKEQPRPLPVERPGPLVPTSLERELTHALSSEESRLLLNELPEAYRCEIGELLIATLAWTLHEWTGHPEVLLDIEGHGREDVFEDVDLSRTVGWLTSLYPVRLTPERVGPSATVRTVKEQLRSVPNRGLGYGVLRYLSPDAELRARLARAPQAEVLFRYVGQYHLAGPWFTVLDHPEQRAPTRQHKLAVIARVADGQLHVTWYFSSDMHETATVDRLSARYLDTLRTLLAERGVPERQVLAPSDFPLAGLDQSKLDKLLGKLKK

SEQ ID NO: 15330 - protein, 625 aa, Myxococcus xanthus
MVEVARALANGPELENTVLFNLNGAEEYGLLGAAGFMQHRWASQVRTFLNLEATGLGGRAILFQAGPDASWLLEAYARAVPQPFGDVLGQDLFQYRLVPAGTDGHVYRSAGISGLDLALFRDGYAVHSPLDRPERVEPGSLQHMGESALAVTRELATRPFPDGKGSGPSIYYDVLGRWMLQYGAHAAWAWAAAAALLVAGATVLATRRKLVRLSVAAEGLGFCTLSLAVALVVPVAFGFLPHYAFERPHGWYASPWLAVATFGTLAVTGALLPRALWAQRLAARGVAPQERVFTAWLGGLWLWVLTLGALQLLGLGTAYLALWWTVGGALGLIAATFLASPRARMMALYASWVPGLLLTVQMGRSLLELFVPVAGHLRLGVPLDPLVALLAALPVAMASVLGLAPVQEQSRFGPSAAAFATASVAFLAALLLRFPYTHERPKRLWLEHRLQEGRSELQYSSWDFPDPRAALSGQPGPLQTAARMPGFRGGYTAPVPPANLPAPQVDVLESQDDETTALRTVRLRLQLGAAYLGRVRIPRAALVGWSLPAPLPPLAPEDSVYVLDVLAPPGGHYEVSLRLRGQEEVPVDVQAFFAEWTPPLEEARSRLPAWTTANLRVSTYATIRL

SEQ ID NO: 15331 - protein, 128 aa, Myxococcus xanthus
FDARTGVLRTSVFKGLARDVYMYCAEIRRWDDLNQEFIEPGRATAQQIAELIEGWNQQGLLYREGERLEGGRFLSLAPAFTPELASRRIRAAHAAELQRRGARADAPKPHPMPPRAGDKAPPPVQVKA

SEQ ID NO: 15332 - protein, 76 aa, Myxococcus xanthus
MTARLDITREVCPMTYVRTKLKLESLEPGTLLEVLLRGTEPLKNVPRNARDEGHEVVSLDALPDGTHRLVLRKQGR

SEQ ID NO: 15333 - protein, 198 aa, Myxococcus xanthus
MHPRPLRLALLAATAILFAACGASDSDSDEIECGGYGHLHGDHCHCDEGYVADGLTCVIAEEPVEECGGHGHLHGDHCHCDEGYVADGLTCVIAEEPVEECGGHGHLHGDHCHCDEGYTEQDGTCVVAQEPTLDCGEHGHAHGDHCHCDAGYVEQNGTCVAETPVLDCGEHGHAHGDHCHCDAGYVEQNGTCAPAPAP

SEQ ID NO: 15334 - protein, 646 aa, Myxococcus xanthus
DGLRAGAVVFLACAGMLGAGPSWAQAPLEEEPGEVLSEDQLEALLDSPVAQPSDGELSTAAFGPERLAPYFVEGTLAKAHAEFRRGRYARARSLLAHEEATPQVRFLRAQCALLARNHAVAAEEFAALADGYGALRDHSLLRAAQANERLRKLDTAAGQYRGVSPGSPLYPEARFSLSRVLQRRGDIPGALTALQELIDSRQSRGPDALRMKALLAICDLARAQGQYNAEHRALLEVWATSPLSNEARRAEKRLKGLPLPLKWRVRRAEALVELHRNHAGMALLDKVLPHLEMPDELACRAHLTYGRALRKERKHRRAIEALEPMVVGCTASEQRPQALYILGYSQSVVEPKAAVTTYAMLARDYPEHGYADDALFFEAWLLQRTGDVETALARYEEAARRYPAGNFASESLFRAFWLHSRKANAPAALAALKAVENLPEAARTDEALWRSRYWRARMQESGASAQAALDAYAHIAAERPAAWYGMLARSRLALLSPERVARLYPKPVPPEAMEGTGGSGRDDAPADEVVEEVGEPEEIWPLPPGALAKDARFNAGVELMRLGLPGAVDEFLAVDARALPEAPARLLYQTLKRTGRNRAARQVARTSLKQEVHGPLSAASRPIWEATWPLAYRSSIARYARAHRVD

SEQ ID NO: 15335 - protein, 57 aa, Myxococcus xanthus
MIRAEHGLPLHQDSSGMRPGNNRSLRMFEQGPDNRNFFPRMSGQPPPIGKMLNDLEG

SEQ ID NO: 15336 - protein, 54 aa, Myxococcus xanthus
MRWLEAHHLLGAVRSVSEPGSMPMLHLRCAPRVLDQLRRAPEFEAGTMMPLDLI

SEQ ID NO: 15337 - protein, 475 aa, Myxococcus xanthus
MKSYLLVPKESIETQARVGPRGTEQGERVLSRTTALRFAVANKAPDALFALGLRSATLPGARPPVSGQEERRRKGKGAKSARTGTRGADSSTPPMPGATVAEQTGAEPGSYRYMPLIGATMAHFYEDHTEKEARGELERDFEFIPDVVPLSFPGPVSAGQPGPRNRGMSSLAEREWPDECGVPLAHAQGIRGAGVMLGILDTGVDADHPEHAARVIQFRYVSLFPNSPHNPARDIRGFDPDGHGTHVCGIAAGVHHGVAPEVDLYVASVIESETIRTSLGRVAAGMEWLLHQFSRPENSTRPAVVNLSLGFPLMPPPGISEADYNLNLRALQTMIRRLLDSNVLPVVAAGNSGPDTVGYPAAFPESLAVGAVDFERNVATFSASGTVGRRVVPDIMGYGVNVYSSTERRCNNQAFYERMSGTSMAAPYVAGIAALYRCRAPDLTALEVRDLILSNAVKLPRSGTHKTGKGLAVFR

SEQ ID NO: 15338 - protein, 140 aa, Myxococcus xanthus
MLSGCKTTVTVKLALAPNAPRSQPTAEPLRWQLPCEDVTETKVAASELGRHGIRVNVVAPGAIQTPLAESVGLIEVMGHEFLARTPLGKPCGMPSDVAGVVSFLCGEDAAWITGETLSVDGGNHIRGLHSYWDMLSRAAK

SEQ ID NO: 15339 - protein, 446 aa, Myxococcus xanthus
MTRGDVASLPTQLKNQLTRLACRPHSTLPIQFYSEADSPSQLFQYYLLDTNDFEPNVFTSLIPGVNNTAMLTATGANCDLPTVAAVRLVLEPKQGLPVDPNDPRAFIDIITDISGLFVINNESGWYEGWMIHDLRVAEVHEPGQDGSAIYGTITPNDAALLAQMGSGNNVPGNFFTVDGEEPRPPSASDNFPDRVTNLVPLQLSMGAYNSLQQSDAHQYWEFNYTTNWIHPLYELPFTGGFPDQSATDPATTYQEGKIGRKASIVPGNRIGLNKDPQRTIEFGDNPSLPRDPDRFDAEEDSQREFRQRFIPSGVAREVFLNVFQRLDSFQPGVTNLEQRLVAAYKAAITVADTNGDGIIQAAEGDIDTCNAKCFPATPSDECTDSDSSCLYLPATTYNRFAVTREINDGYLAPRFAPSQRGWVLSGNRVEVSPAVPASAGRDSDDR

SEQ ID NO: 15340 - protein, 129 aa, Myxococcus xanthus
MKLGYIILYVPDVSATIAFYEKAFGLARRFIHESGGYAEMETGTTALAFVEEGAAKEHGFTVRHLRPKEEAAAIELALVTADVAAAYTRAVEAGAEATQPPKQKPWGQTVAYVRDLNGVLVELCSPMKE

SEQ ID NO: 15341 - protein, 110 aa, Myxococcus xanthus
MQGQAMRVDPGGPCLRCLYEAPPPPDAVPTCAQAGVLGSLAGLVGAVQALLALELLSGAARGGQGEATLHVLDAVSILGRRTRVARAPDCEGCRVTAIPAYPESPEACAT

SEQ ID NO: 15342 - protein, 208 aa, Myxococcus xanthus
MTDQPASLSFFARFWLAWLCFWRCLVSREFAQAVLPTSKAYDAGQLAQLPSGGPAPTPLPKQEEVRPTPRAPEPPPALPPEREHASALSLLGMLQREGRFVDFLQENVSAFSDAEVGAAARIVHEGCRKVAQTYLTLERVLPQSEGDSVPVPVGFDAQRIRLTGNVAGQPPYNGILRHHGWMTTAVKLPTVSPAIDPRVLAPAEVELS

SEQ ID NO: 15343 - protein, 197 aa, Myxococcus xanthus
ARYSIGIDLGTTHSAASYFNLEEGKPRGGAQSMLPVPQLTAPGTVEARPLLPSFLYLPSEQEFPAGSLALPWKPEASTLMGEFARTHGAKVPTRLVASAKSWLSHPGVDRRAALLPWQAPEEVQRVSPLDASARYLRHLKDAWDHTFAREREESDNALAEQDVIITVPASFDAAARDLTLEAAKAAGIPNITLLEEP

SEQ ID NO: 15344 - protein, 165 aa, Myxococcus xanthus
RDIVRFFRQPSRVVGALAQPVLFWFVIGSGFAGSFRVEGAQGLGYQQFFFPGVVTMVLLFSAIFATITVIEDRKEGFLQAVLAGPGSRLAVVLGKALGSSAIALLQASLFLLLAPLAGVSAATLNVPLLLSVMVLSALALTGMGMSLAWGVRSSAGYHAGMSIGM

SEQ ID NO: 15345 - protein, 330 aa, Myxococcus xanthus
MPEVLLSTATSQPLLQLEGLTRRFKGRTAVDGLSLSVRPGEILGLLGPNGAGKSTTFQVLAGLLSPDAGLVRFEGRELSLSDPSLRRQMGIIFQRSSLDDLLTARENLMLGARLYGLGGERARERVEAMLSLIGLADRGDERVSTWSGGMRRRLELARALVHQPRVLLMDEPTQGLDEAAFRTFWAHLKRLRDSEGLTVLLTTHRADEADVCDRLAVLDAGKLVACDTPQALASRMGGDILSVEALEPEALATELRERLKLDAKVVEGRVQVEAPRGHALVPRLVEAFPAGRLTSVALRRPTLADVFLQLTGRALGADVPTAEPAPRRRR

SEQ ID NO: 15346 - protein, 253 aa, Myxococcus xanthus
MGAVNALVTLLATAGTVGAANALNCYWERHSDQFMDRTRNRPLPSGRMEPAVALWFGISLAAVSLPALALGANVLTAALGLVALLSYVLAYTPLKARTSAAMLVGGVPGALPPLMGWTAVTNQMDVGGFSLFAIMFLWQMPHFIAIALFRKEEYRAAGLTSVPLERGDESSRAQVVLYLVALIPMTLQPFQLHIAGAWYLAAAVLLGLSFLGLGAWGFFRRLGNTWARQTFFFSLIYLTGLFAALALDRVPRE

SEQ ID NO: 15347 - protein, 744 aa, Myxococcus xanthus
MEAMVVCKKGVKAHPNAADPRLLLARVYAEQGKDKKALEEALGALQVQPEDKVALRMAGALQLKTGEAEPGKANLLKAYTADPGDPDTVTLLQQHKIEPPRPAAPAPVAAPAAPVAPATPAPSATQQSASALSSVAATAGTEAPAAKPAATQAAKPAPTARAEAPAPRPAPQPRRPQVVVEEVDEDEDDEPVSRRSPSSGGKGSKMVTLGLLVAIPLFAIGYGWYSANARTKSRELKKSLDVASELLKHDSFDSYKKAVEAADQALEVDSDSAVAHGYLAYAWAIRWGEHGGGDDARRQAEEHLAVGKKSGDLSSHLIASEALIQTYSGKGKDALGQLEEKVKGLDAQGRSSSLLYLTLGLIQMNAGDLERGRDSLDRAQLLSPDDPRTYASLGAVYRRLGQDAAAWRNYDSALRYGKDHPESLLGRSLLMLEQDSPNFELAHTMLKKLLESDPPPSPRQLAAAHMARSLLISRVSTAMVDLKPDMQQKLAEATAVPQDKDKARTEMLKSEETGFSLDKQNPELHLIKGRRLLAEGNFDAAAEEIRKAIRMDASRAQFYVELAKSLMGKQGGEKDAAEALQTALKTMGDSPKLVVMLGNAYRRQGKLDEALAQYQRAVKDPKAKNPEARLAMGAIYRERSKWDLAQEQLEKASQEFLGQSDRAAIALTELGRVFQSKGDTAKADETYQRALNADEAYSPAYYFYATLLSKDSKQGAKAKMLAQEYLKREPSGEHASAARSLAGG

SEQ ID NO: 15348 - protein, 322 aa, Myxococcus xanthus
MAWHTWRISGVFDAGMLCASLGMVLAFSVVRYSWWHVLLSTVLSSGAYALLAWMTGHGSVARTSFVLICYAALGGLIALTNSEVGGMFLNLRRRDGLSRFLPRQVVERVMQLGDASLQPVQRDVTILFSDIRDFTTLSETLDPGQVLELLDDYFGHMAHIVMARHGIVNKFLGDGMLACWGVPDARENHAELAMRAALDMRAKLEDINAQRVQRGLPPLRIGIGLHTGMVAAGMLGGAEQHEYTVIGDAVNLASRVEGLTKSHGVDILVSERTWQMSGGHFTGERLGEAHVKGRRESVVVYSLHGPRTHEDVPPVLKAAAGT

SEQ ID NO: 15349 - protein, 228 aa, Myxococcus xanthus
PVNLMDFEPNPEVASFIPPKIAERLCVVPLSLDGNTLHVASGYPVPKKELDEVGFLLGKPLELWVATEVRVREWVSTIYRQPLALRFAKLAAALDPEAQAATTPPPPPAAATEEESLTADMVERLARSVAQEPLAVETSAAPQAAAPRPEAPASPQRPPPPPPEALTPGPEPLPPPGPPAFVRAPLRLNMPQAEAPARPAQRPTPQAAQIPVLPFTPAPGTGPSSANT

SEQ ID NO: 15350 - protein, 244 aa, Myxococcus xanthus
MEQAAPPAGLPRMEQAAPPAASTSGLPRMEHAEAASTDLPAMESPAAAPSALPHMEPLLPGVSVGVARSEAIKAPPSKAQVKSASGVTEVRARPASLWRRLLSFTIDTAAIAGVAALYITLASSVTGLKTPEAGLTGLDAFVAWLRAFHTILLPGFFLVLVLALVYCAVAAFLWNGRTLGRLLLGLRLVDTHGIAPAPGRAIVRALLSGVSFVFFLGGFWMALFDRRGQTLHDKLTSTFVVQPS

SEQ ID NO: 15351 - protein, 88 aa, Myxococcus xanthus
MGIIAFIVIGLIAGLIARAILPGKQSMGLIATTLLGMVGSLVGGLVGSLFQRDGRLFDVRPSGIIMSVIGAIVVLLLVGAAGRRRVHA

SEQ ID NO: 15352 - protein, 115 aa, Myxococcus xanthus
HPDPGARWIREHAAIARNLGKPLFVGELGLRNEGAFDVSQRRALYRGWLECMRKEGVGAGALWMFSTDARPEAWDDYTFYYRDGTQPGDPVNRYADLVMEAAAAERPGAAVSTGR

SEQ ID NO: 15353 - protein, 99 aa, Myxococcus xanthus
  unsure (1)..(99): unsure at all Xaa locations
GLLMALPLPPTLLPAEPVVARFPVGTAPXVAVGVMPVRFALVVGAHVVFEKKTHGLSLGGPLLFFIEPVYLLTVALFSLGMKQTLRAEVMTGPGESQPA

SEQ ID NO: 15354 - protein, 329 aa, Myxococcus xanthus
FLCLGLGGAVFLALMYVANAGWFTVFKRIPEAFAAYVPWGAVTILALLPFVSSLYPWAKPGVMETDHLLHEKAAFLNVPFFAVRMVVMLALWVGFTWMLRRISLRQDAERSLELAGRNVTVSAVFLVLFSLTFCLAAFDWLMTLEPHWFSTIYALYNIAGLLSSTVCAITVTAILLHRAGALPQLNTSHLHDLGKLMFGFATLWAYLWFSQFLLIWYANIPEETVYFVTRLHGTWAVAFYVNVALNWALPFVLLLPRPAKRNPSHLLRVAAILLVGRWLDLYLMVVPGGQPDGVALGVFELAGFVGMAALFTLAVTRTVRSTPMVPVGD

SEQ ID NO: 15355 - protein, 212 aa, Myxococcus xanthus
SNWWVQPALLTDAYWGLGVRPDGDVWVGGANRTTRYFYGTVANDFWEGQTRTESRASAWNRIDIWKDAVGEERYSRPEQRTDDLVSGIAVVGTSAWVGSFGHGLAELNDNGQVVRTLKNELAAPHVASVAADLANGSIWAGHSWGGGLSRVRGGSVSHYGLSVFGRELSSMRVPDIQVDRSGPRRRILVAFQGSTLSDGTVMPGTIGIYSGE

SEQ ID NO: 15356 - protein, 92 aa, Myxococcus xanthus
MVDIPELAGDTLLREFTREAPAAAGDSLPVEFTGPFKVCKDELIRAFEREYLTRLLGRAKGNIARAAREAELDRKHLYSLLHKYGLVQSETD

SEQ ID NO: 15357 - protein, 199 aa, Myxococcus xanthus
MSMHATGCFGQFQLTQKIWNFNKNISGNKFVQWLMFLVLTIIPVYGLGAFIDAIVINSIEFWTGSNPVASIDGAPETTRIVKLSPTDTLRLSRDVETGVMRMELAREGQETMVRYFEPLEDGMVVRDDAGAMLIQAQEATDGAVAVTDAAGTTLTVHARDALAVARRVYEEGGAQALAQHAVAQASVSQGLASNTCVAQ

SEQ ID NO: 15358 - protein, 87 aa, Myxococcus xanthus
MTVERKRVPGDDEHFLFVATLYSPEQQRVVLRNVHFLQGDKPLQYPYKEGVTQVPVQVYGKPGQAPIVIDAGWGFLLPANLTYPWYR

SEQ ID NO: 15359 - protein, 174 aa, Myxococcus xanthus
MAGAGLAACGLADNSLGGSVSELFPLEVSRVEVLRNAEAFQVSYYRNNDLDVDLVVRLTVSTEGLDLRPGTKVNLAGTTPSGQARATVVHLNAGEPARVFGPVNKGDLQLESGGNPGEPTRGDFSMSFSRGDGFGAGRNLEGTFSVVAQDASFGPDPGQLLDGGVPPDAGTPPE

SEQ ID NO: 15360 - protein, 334 aa, Myxococcus xanthus
SVAFGPDGQPVVTYLGGDREDPSSFWFQSDLAVSYRSASGAWTERIVVRQSNEAQPVNPAMDVGFLVGLNPAIVFNGSEAIVAYRDGKNGQYERQDFQSSDLEIASGGPTNWQRRVAVASGDTKMGYGGHISMVMAGTQPALVHDKAPEAAQATGTDVHFQRRNADGLTWSPVVRVQAVPNTQLGASLAYDSVEGFGVAVLNRNSNTLTFTECADASATSCTSERDWSMPDPVFNNGTGGWYPSLAFDPVHHEPSIAFYICAAESGRNDTSCNPNDDALVISTRIQGIWRETLVDAGGGWSPKLAYLSSGKRVVLYRAPVVAQDKGVLKLAVER

SEQ ID NO: 15361 - protein, 286 aa, Myxococcus xanthus
RSKRVVREASVPARIENLVEFVCADKDGKDQVLEPSRPHRIPYEMRNTCRVIVHRQRLKPEDGNQEVLLRISVTKPDGSVRGESGVEQRMFLRPQGEQRDIPVPGNMGQYDRITVQVSHVADESRYALSTTDRTGLPSAQWTAIVTGGLFRLYTTAAIPAGLYRATEPTGQLAINFGVVSRLALLNNEGQERLLGIEAGLMGLGLVPQSGDIQFPPTLAVVLGLGLRVPIGPGAAVGAQAWLAYEFRGDIRRRTGGDPTLDPIVPSSKWSFIFGPSISVGNVGFNL

SEQ ID NO: 15362 - protein, 363 aa, Myxococcus xanthus
MVHGDGWGFEAAFLSSIGSAFVPPEQSIAAYLAKEGVDVWGIDLRWAGVPQNTQDFRFMKSWTLETHAADVGVALGVAKLLRLAGGNFMGTMHLLGWSRGAVVGYAYLNREARLPRALRQVDGFIPMDMAVRFSPQDAQQQAWACERYEALSNARQEGQLEGGLLGPAPGIMLQAIGQLAAVQPAAPSPLVQDDIFGPGTGRPSNRKLALVAAGATSVLFAPLQPVVPAYHLMGSTPDTMGLPERLSFTHEGYLFEFGQRAAPYQSINEVVETEAWACGKHVPYGDRLRDVKVPVLYVGAAGGVGRYGEHSVTLLGSRDVTLLNVSTLPEAARALDYGHADLFLADDARMRVWKPMLQWIRAH

SEQ ID NO: 15363 - protein, 301 aa, Myxococcus xanthus
STGRARGRRHLGPRKNAGPGSPDLLLQAGFRRSTGDVHRPWAHVATPFPWSTVRATSRVRVLAWDDAAVRRVDLWVNGLLRASDDTHPFELDWDTREELNGPATLEVRAYDTALKAWRAAPMTVTVRNPDIADFDSTLQAPRCATLAFACDTGVLVRGMGTVGPERHAPNTLGASCADGIDGTYLITATLEGLRVSSQDGGPLTAGKPVKLTATAFGFLPFLEAVDLFHAPDARSPQWTHVARLPLEETGAQELSTTFTLPEGGLQAIRGILGTHPTPVSCAPGAWTDHDDLVFPVAPSSR

SEQ ID NO: 15364 - protein, 156 aa, Myxococcus xanthus
MGTLALTPLVADRVKVPVIAAGGIADGRGIRAALTLGAQAAQLGTAFLACEESGTTDAHRELLFSDRAKHTTLTRSFTGRLARGMRNRWTEEVAHQLSALAPFPIQGWFLSKLKPAAVKAGRTDLVSLWAGQATPNLRHRTVPALMDSLIKELSAS

SEQ ID NO: 15365 - protein, 213 aa, Myxococcus xanthus
MAQSDTPVRLDVWSDYVCPFCYLELPVLEQLHARLGSALDIHWRAFELRPVPARPLAPVSEPPRSAWARSVYPLAEQRGLTMRPPPVQPKSRLALEAAEFAKDAGSFSPFHEALFRAFFADGQDIGDLRVLGALAEDVGMDRESMTRALEAGRYTARVLADEEEAQRLGIRGVPAMRLAGNGPVLLLTGAQPEEAVRAAFARVRPGPSLSAVH

SEQ ID NO: 15366 - protein, 38 aa, Myxococcus xanthus
MELTAVGKALRHLERAPGPIHIHTDSTYVIQGATKWAL

SEQ ID NO: 15367 - protein, 86 aa, Myxococcus xanthus
MQGQQELSGSVVALRKDKVFIKDENGAVVAMGVNHSTQIDGKPIEKHRDIHSHLRREIKEGDQVRTKFNVEKTTENMASSIDKMNK

SEQ ID NO: 15368 - protein, 811 aa, Myxococcus xanthus
MTMTLGQDLRFALRRLRGSPTFTLVAVATLALGIGANVSIFSVVNAVLLRPLPMHDDARLVRMYSLRTQGPGPTSVLDFMDLREQSRTLKGLSAVAPVAVTLAADSADTLPEKVQAGMVTGDFFPMLGARVQLGRALHPDDVRPGAPKVAVISHALWQRRFGGSAAVLGRSVDLGAPEPWTVVGVMAPGFDFPARSELWSPLLWEEGMTKPEGRGAHWLEVYGRLGPDVALESARTELSAIAHRLAGQYPQTNEGKDARVEPLRDVLVGNVRPSLLLMLGAVGLVLLIACANLTHLLLARAASREGEVSVRIALGASRGRIARELLVECGVLAGLGAAVGLLVAMWALDALATWGPQDIPRIEEVSLDGPVLAFTAGLAVLTTLLFGLVPALQAGRLDLVRGLKRVVGGGGGGAQGHRTRSVLVVAETALAVLLLVCAGLLLRSFVHLQRAKPGFDPEGVLTVKVDLPPLHYGFGTAAPAAFYDTLLERLRALPGVEQVGAVNGLPLDGARWTVPVKDPMRPVPEGTEPWQASVRIVTPGALEALRVKVLQGRGISAADQGAGGRAVLVNAAAARRFWPGEEPLGRTLDTGMDWGSGAMGGRVVGVVDDVALEGLGAPSLPEVYVPYVQARTTSMVVLLRTKGAPLDLAPAARAEIRALDASLAPGSVRTLASVVDRTVAPLRFYLLLAGAFAALAMVLSAVGLYGVVAYAVLQRTRELGIRMALGARQAQVLGLVLGRYLGLTACGLLIGLGLAVATSRGLTHLLSGVRPTDPLTYVAVAAVLLAVAVLAVLLPARRAARVSPAVALRAD

SEQ ID NO: 15369 - protein, 741 aa, Myxococcus xanthus
RVLIVTQGGGADLAPVESWLREQGHTVVTVTREAEVPAAWRSGTCALVMVDARTDPSRVPLVRALRSLPGGEESVLLLLGHRGALGGLRPVLEAGADDLLAWPVDEEELALRLELAHRRFVRREGRKGLPFGDDLKETLLAVSPVPTSITTITEGRVVAANEAYFELFGYTREEVIGRTTMELALWQAPLNRSQIVDTLRRHGTVRGVDAQYRTREGELRHTLLFMGLVPYGGTPHIIAFFPDITPLKRAEESLRRSEVSFRTLIGSLPDMVAVFDTDSRVRYANLKVATALGYESANELLGKHFSDIIPKEDFASANARMHEAIRTGRAAHQERRLLKRDGSVLHVESTTFPLPFDGEDSIVAVSHDLTERYQMQARLMLAQRMASVGTLAAGVAHEINNPLAYLTANLAFAREELTGVLPTGTRNMEPRLAEAVASAQAALAEAQQGADRVRSIVRDLKTFSRVDSAESEEVDVRQVLESTLNLATTEIRHRARLVKQLDAVPTVVGNESRLGQVFLNLLVNAAQAIPSGTPERHEIRVVTRLSGNGHVCVEVSDTGAGIAKEHLPRLFDPFFTTKEPGVGTGLGLSICHSLVTALGGEIHATSEPGRGSTFQVLLTPSQRLGTERPPPAPPPAPTEKRGSVLVVDDEPLVCTALGRTLRPHHDVTLFTRAQEALERIEAGERFDVVFCDLMMPGMSGMDFYSALQARHPEQAQRVIFLTGGAVTPQARAFLESVPSPH

SEQ ID NO: 15370 - protein, 751 aa, Myxococcus xanthus
LQRWCKARGIPWDKPWGLLTPEQRESVLEGEGDYDEGRAYPGVRAWFRWMEGRTYKMHVRVLLARYRAYTLCESCGGGRLNAQARAYRVGGLDLPSWHHLELTDALARLDALRTITGQGELARRELAGRLRYLQRVGLGYLTLDRPARTLSGGEAQRVSLTAALGTSLTGALFVLDEPTVGLHPGDVPPLTEAIAELAERGNIALVIEHDPLVIRSAHRVLELGPGAGKQGGRLVFDGTPEALAKKQDLPTGRLLASVDEVPRTPRTRTGALVIRGAREHNLKDLTVEVPLGVLCAVTGPSGSGKSTLMDEVLYRHLARRLGVKDVEAPGAVDAVEGMEAVKAITLVDQSPLGRTSRGNAATYTKAWDRLRERFASEPDAEVRGLTAAHFSFNVDKGRCEACSGEGYETVEMQFLADVALLCAVCRGRRFKEEVLAVRHQGFSVAQVLEMTVDEVLQHFGGDTALKRTLGPVARLGLGYLPLGQPLSTLSGGEAQRLKLARALANEAQGTLFLIDEPSAGLHAEDVRHVITALNALVDFGASVLVVDHDVAVMKASDWVIDLGPVGGRDGGRLVAEGTPEDVARGKGATAQALRGERKPLGRAVKLRKPGKGEVPAIEVEHAREHNLHDVSCRIPLGKMTVVTGPSGSGKSSLVFDVVFAEGQRRFLETLSPYARQFLPSMPRPDVERISSLPPSVALEQRTSRAGATSTVATVTEVAHYLRLLFAKLGEPHCPDDDSPITSLAPDVLFAQ

SEQ ID NO: 15371 - protein, 63 aa, Myxococcus xanthus
MKMLLEPVQAGEWRIRVVDPDPLPDFVAGVVEGVLLRTKVLPQVEVLERQTAGYALRVRWTGA

SEQ ID NO: 15372 - protein, 404 aa, Myxococcus xanthus
DYPSLERKFQSALEADGNLAEADYNLGVLAERQGKLTEARNHYKTALTKKPSLRQASENLAVMEQNAGNVAGAVALYQEVLQRYPDDAQSRARLAEIFRQQGDHTKAMDLTRAALMRDPQSTTALKVMIRSYLDRKQLAMAKLVALRGVKLDAADPELHHAVGLILLQEGDVDDARLSFKKALEVREDYVPSHVELAQLALAAENYPTAEQHLRRILQADGKNAAAHLDLGVAYKGMGQFDKAMQEYDEAEKLDPELAAVNLNRAIILHKVKDAPERASELYRKYIAMAGGEVALPAEAPVFALLREVEVVVNAKREAKFAEEQAKQMEELQKQQQAQMQAAEKAAGTANPPATTATPASGTGPAPQVTPASGNTPPAPAPVNGNSDQKNAGSAEPGEPEDDLL

SEQ ID NO: 15373 - protein, 84 aa, Myxococcus xanthus
MLCAVLAVTPALAQDEGSNPGGPGEGNVRYSKTTNIDFEDDTIEGDLTKPDGEYIDARERVKHSNLIRIREDFEDKVMQSVGEL

SEQ ID NO: 15374 - protein, 229 aa, Myxococcus xanthus
MSFEDRVDAGRRLAQLLRERGYTGEGTLVLALPRGGVPVAFEVATALGAPLDVWVVRKVGVPGYEELGLGAVAEGGVAFVNRRLMDEVGVTEEDMQGLVRQKTDEVKVRVARFRQGIEAPRIEGQRIILVDDGIATGGTVRAAIQALRMHRPGSIILAVPVAASQTLAELAPLADDVVCVLSTPSLYAIGQWYADFQQVPDEAVATLLAQARLTLGHDRHAPPGDTAHS

SEQ ID NO: 15375 - protein, 640 aa, Myxococcus xanthus
MAVPLTLKVFKGDSLVASKDYERDIIKIGRLSSAHLCLEDEKVSRIHSVIEVASDGAMSIIDMGSVEGTYVNGKRVTKGLLSFGDEIRVGGTTIRLENPAAVAAVNLAAAAASSEVVTEKNPVIAAPAPAESLAQAAVAAPAVGAIDPSFAATQQNPVAAPAEPAPAPVVAAPEEAAPRVRTVRRTKSSGPLGVGLRFAWGDQRVGEFFMAPGRKGAFVVGSAAGVDFVMGDARLGAPKFDAVRSDGQSFTVRFTAKMKGELTRKGETLDLKAVIESGKASHEGEAYSLTLDAEDFIWVDLGGVTLEVAFQPVPKRIVVPLGESMDYTALNIFLVLFFIATAFVITAMNRTVAGDEYADELSADNARIAKLIIKPPEAQKNKFLERLNQQKEQKKSGEMAAKNRGDEGQMGKKEAPKTNNRTAPKGDPNKKDEARALTAKIFGGGKGGISTVFGKSGLGGDLKSAMGNMFGAKAGNSGGFGGMGLRGTSGGGGGTGDTIGIGGIGTKGRGGGTGTYGSGVGVLGGKQSVDVGITSSDPEVMGSLDKELIRQVIHRNRGQIRYCFESLLNRFPKLGGKVAVKFVIAGNGSVASSSVAQSTAANAELETCVAGRVRTWKFPEPKGGGVVVVTYPFIFKQSGE

SEQ ID NO: 15376 - protein, 138 aa, Myxococcus xanthus
MAQVEVGVDLGEHVSVGLFLMGSSVRTGAQYVGNSGGAVSGDFSTLIPGAVLRARLVGFADSQEVKRTWFYLRAGAGYAMFSPQRLLPDSDILVFAGPGVEYYTRLRHFSVGLEVTGQYLVSGGSFGFAVAPNIRYAF

SEQ ID NO: 15377 - protein, 68 aa, Myxococcus xanthus
MEAVGRARVGVVVTGVHRAKVLAVTDRVVLVAVAGPDAVTAVGVEMAVAAGVIAKRAPWALASASSPS

SEQ ID NO: 15378 - protein, 519 aa, Myxococcus xanthus
MRLKSLDDLDLNTRGRLITTLLRVQRQPKPAAPEAPAAAEAAAPSEAPAPVEAAAPTEGEALAEGGAPAEAPAAAEGEAAAPAEAAAPAVDAAREKFDAWTDVIFLVGQAWRAAGDAERAEAAFAASGRQPGPEAEEPVAAPRSEERRERPERGERRERGPRPERGERAASGERRERPERRERPARGERPERAERPERGERPLPELTGTWDEQAKQLETMGRTRDAGRLHERNNSFAEAARLFEAGGDLKSALRNALAGSDNDTARRLVGTLPPDQLAPTLEKAGAYELLMEHFVGKGDFENVARLYERARQFDQAALAYERSGKLTLARKSYERARDIASANRIRGLEVKSLVERGDRLGAATLLAAVGQRREAVEVLSPLPPPKAFHFMQRLKLDDEAKELAQKELARAEQEQKPAGRARWLELLGDLAAAAEAWEGAGRKDKALPLHEKLGNLPRAAQLAEELQQRDKAIALYTQLNDSAGVERAKALPETTAPAQAPRGGCGGRKRGWRRWRDAA

SEQ ID NO: 15379 - protein, 272 aa, Myxococcus xanthus
QQPTPSSRPTLRVSDDRTFVETEAALDKAGRVEELIRLYEGRSRDVVSDEAVRLLCRAAELAHDRQRNTQRAEELLKRALLVAKDPLPALRGLKRLHESRQDGAALADVLERLGGVTQGEECAGHYLKAADVYEQKLFRRDRAVLCLQRAARAKPDRATFRRVRQLLLSEERFQPAFEALERERAALGDAGMAEEYAALAERLVDDPTEHELAQRVVDVAQALEPQNARLEKTARALQRFEQTWRDRVRMLRSMSLEERDRKSAARLSLLVA

SEQ ID NO: 15380 - protein, 2517 aa, Myxococcus xanthus
EGLLGHLETLLDAAVTSPDRPVATLAMLPVEERHRLLETWNGANEPLPPDACAHALFEAQVARTPDATAVVSGGESVTYRELNARANHVAARLRALGVGLESRVAVCVERSVELLAALLGVLKAGGAYVPLDPEYPAERLGYMLEDSGARVVVARREYREKLGEAPGRVWLDVASLTPDAEGKTSEPTAVVPPEAAAYVLYTSGSTGRPKGVVVQHRSLVSFIRAEWQVCPVEPGDRVLQFASISWDTSAEEIYPCLTRGGTLVLRTPEMLDVPEVFLARCEAAGITQLNLPTAFWHEVTASLDEGKARLPSGLKWVVIGGERAVPARVSQWRQRVGHAVPLLNTYGLTEVTAVATAVDLTTDTEDSGREVAIGRPLTNVRIYVLDGELEPVPAGVVGELYVGGEGVARGYLGRPELTAERFVPAPQGDGARLYRTGDKARWRRDGVLEYLGRGDSQVKVRGHRIEPGEVESALLGQPGVREVLVVVREDAPGDKRLVAYVVPRDGRLLEGGEVRAGLESRLPRFMVPQAVVVLERLPLLPNGKVDRKALPAPEAVRESRKEAHVAPRTPVEQMLAGFWAEVLRLETVGLHDNFFEVGGHSLLAMQLVARVRESFRVDLPLRDVFESATVAALAERISRAVATAGIPAPPLKRMERGGTAPLSFAQQRLWFLAQLDPANTSYNLWAPVRVTGALDVGALARSFEALVRRHEALRTTFRAEGGSPVQVISAETQVPLEVVDLSVLPEGEREASAKARTEAEVGRPFQLEQGPLLRTVLLKLSEQEHVLVLVMHHIVSDYWSMGILVREVAALYEALSQGRPAQLPELSVQYADFAMWQRDWLKGQVLESQLAYWRKQLAGAPRALELPTDKPRPATQTFRGANLHVLWPKALWREVESLGRREGVTPFMVLLAAFQTVLSRYSGQDDVSVGAPIAGRSHSETEGLIGFFVNTLVLRSKLSPALSFRALLGQVREVTLGAYAHQDVSFEKLVEELQPERDLSRSPLFQVTLTLQNTPAAEVQLRGITLKGLAAEEKTSKFDLSLVVEEVLDGVVAMVNYNSDLFEAGTMDRMLGHLRVLLEAAVAAPEQRLAELPLMGSEERQRLVKEWSGTASEYPRDASLSVLFDAQVQRTPDAVAVEYEDRRLTYAELSRRANQLAHHLKGMGVGPEVRVGLCVERSLELVVSVLGILKAGGVYVPLDASYPLERLAWMKAEAGVALLVAQEKLADEVAAGGELVVCVDTEWDTQIALQPEVAPSTHVGGGNLAYVMFTSGSTGKPKGVGVPHRAVSRLVLGTDFAHFGPEEVWLQLAPISFDASTLEVWGALLHGAKLVVYPAGTPSLEELGRKLKSSGVTSLWLTAALFEQMQARQPKALDSVRQLLAGGDALPVSRVKERLAAGGLLINGYGPTENTTFSSTYRMERPEEVGASVSIGRPVKNTVAYVLDGVMRPVPVGVPGELYVGGDGLAVGYVGRPELTAERFVPNPYGEGERLYRTGDMVRWLGNGTLEFLGRADTQVKVRGYRIELGEVEAALAQHGGVNEAVVVAREDGGEGKRLVAYVTAQEGAELASSALRSHMKQRLPEYMVPSAYVVLESLPLTPNGKVDRKALPAPEAQGPKTAHFEAPRTATEQKLASIFTEVLNVERVGLDGDFFELGGHSLLATQLVSRVRESFQVELPLRDVFESPTVEKLALRLEEMQAGASSLHAPPLKRSPRLGALPLSFAQQRLWFLEQLEPGSPVYNIPLAIRLSGALRVDALERALRELVRRHEVLRTTFRSEGGTPVQIVSHQAENALPVVDLSSLSSEAAEAEVDRLLREESLRGFDLPSGPLLRTRLLKRSEAEHVLLANMHHIVSDGWSMGVIVRELAALYGAFREGQPSPLPELDLQYGDFSAWQRAWLESGALQRQLDWWRQQLEGAPHVLSIPTDRPLPAVQTFRGANLPVSIPPALSSGVKALAQRHGATPFMVLLAGFQVLLARYSGQDDLVVGTPVAGRNRAETEGLIGFFVNTLALRARASAEKPFLTLLREVKDAALGAYAHQDVPFEQLVEELQPERTLSHSPLFQVMFSLQNTPVPEALVPGLSMSAMDTEIGAAKFFLTLALEDLPDGFSGVFEYNADLFEPATVQRMAAHWLTLLEAAVASPDRRLSDLPLLSPLERHQLLVEWNDTTTEYPRDTPVHVQLADLATRIPETVALAWEGGQLTFAELMARSRLLAAHLRSLGVGPEVRVGLFARRSPELVVGLLAILEAGGAWVPLEPDAPRERLARILEDAAPAVLLTQRALRDLVPATSMPVVVFEDDLGSVAAGAWEASAVADNAAYVLFTSGSTGRPKGVLVSHRALARHTAWFIAALKLGTGDRVLQKASAGFDAAVPELLATLVSGARLVIAPPAAESDTEVLLAALERQQVTMLQLVPSQLRVLLAHEDVARAAGLRVLVSGGEALPVELVHQARERLPSTLIINAYGPTETTVDATAWLGGDLSEGPFAPIGRPIANTQAYVLDAQGQPVPVGVPGELF

SEQ ID NO: 15381 - protein, 128 aa, Myxococcus xanthus
TTGLLLFTNDERLVQHGTSPERLLPKRYVAGVVGPPPEDALRRLREGLVLEDGPTRPAGARLRAPDVVELTLTEGRNHQVKRMLAAVGHPVRTLHREAVGGVTLDVPEGAWRLLTDEEVSQGLSFSVS

SEQ ID NO: 15382 - protein, 435 aa, Myxococcus xanthus
MAWAALLWLGPDAAVITLHLLCFAVLAAALFSMAPEGQGARYIWTCAVLIVLYRPFGHVAAAAWSEPLCVALLALALAREVRGADSVGRSFLVGALLGLAVLTRYAALFVLPGLLLWRFVRAREAGVPRRHVVHALALGAGLGLVVAPWFVRNGVLFGRAMGPPRAPRGAGLLSSLLSGVETLLGEASFGAFGVLCVAATVWLLMPALRGVRGERPPDASLERLRPAALMAVSYVVGLFWTATRTQMDTLDGRLLAPLGVGLVPVTAAVLVSLVERSRLMSPPVLIITGVVVVAGHLWAPLHARVRQPRLGLQHLRERVAPLPAWVEAHVTERDLLLGPQLWWGHPFSRAPVVADGYPERGFLTRQTLGAYLLRHGAAYERFFWFDTRPPPVDAAAFEAVEVARLETNAYWSTVWEIRPVGRATPVDGREAIPAP

SEQ ID NO: 15383 - protein, 274 aa, Myxococcus xanthus
MFSTVAVDGEVRRWEELHLRDFAQGFFFGAGFFTTFRIEAGEPWFLARHLARLRASLAAFPGAVRTPPSEHLAKAAVREAIERCLRADAAMGPAFRGVGKLSASDGRVLLTFREHAPDLERMHREGRALDSQEPGAYRRGEPTLNHKGLAYFRQFSVMERLPLLGNEAGEVCELPTANVFFQCGGVLVTPPLSAPCLPGIIREVLLEAGHVGTLPIVERPVSFAQLAQVSACVFTNSAQVATGVPSLLGRPLPTSLALAQGIRSLVEAVAARER

SEQ ID NO: 15384 - protein, 189 aa, Myxococcus xanthus
MILVIDNFDSFTFNLVQALGAQGAELKVVRNDAITVAQVEALRPDHILISPGPCTPHEAGVSMDVIRALGGRVPVLGVCLGHQCLGQVFGAKVVRAPVPVHGKTATIEHSGQGVFRGLPAPFTAARYHSLVVDAESLPACLEVTAWQDGLIMGLKHRELPRLEGVQFHPESFLTPQGPQLLANFLEPAH

SEQ ID NO: 15385 - protein, 58 aa, Myxococcus xanthus
MPVYEFYCRKCKEPFTEIMSVKEHDERTPKCPRCQETKEVEKRISTVHTVTTKKWLTL

SEQ ID NO: 15386 - protein, 371 aa, Myxococcus xanthus
MPLFCGGAVGFFGYEAAHCFESLPRHPRDDLHLPEIDLSFIDTFLTVDHHEGQLLLVATGSDWEDCERRLDALEVHVRTATPTAPRVPPAMDGPTSAYRSNFTLDAYLDAVERVREYIRAGDTYQVNLSQRLEVDFPGEPLALYETLSAINPVHFASYLEGDGFHVVSASPERLVRVENGRATTRPIAGTRRRGTPEEEARFVHELRTNEKERAEHAMLVDLERNDLGRVCTYGSVEVTKLMDIVEYAHVLHIESEVVGQLAPGVEPLDVVGALFPGGTITGVPKIRTMQIITELEPHARGLYTGSLGYLSFTGDLDLNIVIRTLVVKDGQAYAQVGGGIVHDSQPRQEYKETLNKARSQLLALASVGRPG

SEQ ID NO: 15387 - protein, 917 aa, Myxococcus xanthus
MGGLGQALVLCVDQVEDVSDFEQRPQMENSFRRAMNSLAAIASKVPRAVVVFCCLADYWAKMKPLLNQGTVDRIENDPEPVTLERTVTAETARDLAARRLHDLFEQRGFAVSPSDPTWPIPANGFDALGGHRARDVLDECRRYRDRAIQDGKLPANFPLQRPQGPGVAKTPLAQQQQVSKLDMDQLWTDFRATLRIDPPEEPARVAELLAWAIEAGGKELGDAKRFDVKPKDKEMLDVQVHPEGSKLLVALCERDSRGGGLGRQMTEALKKAAGKTPVVVRTTDFPPARPGGVVAEQLGALLRKGGRRVVVGDTELRDLMALRNFRERHAGEAALLEWSRTARPITRLKSVSDILGLEKPDAPPKGGTGVPMGNVGARSTATKAQTELFNSPPTLPYGTPVPAQVLSGAKSTPPARAETSALEARGVRSAREPIAAQRARQGRAESLSDDPLQDITIESPMLTGRTMTPPQGMKPPIGFRGNASPAAPTPSPRPPETLTGPLRIGSSEGVFSQVVTVDPSELTRHSAFLGTTGSGKTTLALNVLEQLLLRGVPAILVDRKGDLAAYARDLSWEEHLDDPALIERRRLLRERVEVALYTPGRSDGRPLAIPVIPRGLESLSPEEREQGVQQAADAIAGMLEYKTSPNDKAARALLTQALRLLVQRPPGTELTLEMVQKFVAEQDESLRQETGGLPTKTFAKLAQDLEVLRLDLRPLLATGGERLDISELLGLGAASTPGKTRLSIISTKYLGDLSRVRFWVSQLLLEANRWTSQHPASRLQAVMLFDEADIYLPATSKPATKQPMENLLKRARSAGVGVMLGTQSPGDLDYKCRENVRTWFVGGVKEDNALKKLKPMFTEARIDAETRLPGQKPGQFHVLREGKVQQLKADRSAIRTDQLSEDEILKEARRTLERGSR

SEQ ID NO: 15388 - protein, 352 aa, Myxococcus xanthus
AERTPLEQILVHTGQHYDAKMSDVFFADLGLPAPDVHLGIGSGSHAQQTARMMVELEKVFLAHPPALVSVVGDVNSTIAAALVTSKLGIPLAHVEAGLRSYSPHQPEEINRLVTDRLSDLLLTPSRDADANLLKEGTDPARIHFVGNVMIDSLFASREKADKLPVLKDLGLIPHGYAVCTLHRPSNVDDPKTLGGLLSAVAHVATRLPVIFPVHPRTRKVISEHGLNTWFERTPSLRPVEPMGYLDFLALTSKARLVLTDSGGLQEETTAMGVPCLTLREQTERPITVEEGSNEVVGTDPVRIRLAADRVLDGEGKQGRVPEFWDGRAAERIADLFASFLGVEDRPIQAASA

SEQ ID NO: 15389 - protein, 329 aa, Myxococcus xanthus
MHSAPQEEAPEGYVDIRYVVEPNYAGWRLDEYLGEKLRRMTRERLQGVILRGVICEERRLKPSTPVYPGLAFRIRRRASEEPDTPTELPVVFQDDWLLVLDKPAGLPIHPTARYHKGTLVTLLRERFGERFAEPAHRLDRETSGLVVCGRTTESCRVLGRLFVSRDVHKEYLALCEGHPPEDTFTVDAPIAEGTELIRIAVRIDPVEGKESRTRFQVLQRFTRDGAPFALLRCFPETGRQHQIRIHLCHAGFPLVGDKMYGPDPGYFDRFSKHCLEPEAWPRLRLPRQALHAARIAFPHPGSGQAVAFEAPLPADLTDFIEGRPVALPA

SEQ ID NO: 15390 - protein, 149 aa, Myxococcus xanthus
MPRPDASRLVPALTRAAGDNLLCESAPRLAEVGALVLGPLKLVAVPGEPSVAAGMELLQRTGATGVLSLADGYVGYVETAANVQGGLGESKRQYFGPALLDRLSVAAEFVAGAAGFTPLGGRAPRRTFRGAAGLRLARTSRTWSPSCAY

SEQ ID NO: 15391 - protein, 462 aa, Myxococcus xanthus
MCGIFGIVGHAEASNLTYLGLHALQHRGQESAGIVASDGMGLRAHRQMGLVADIFDAPVLADLPGQAAIGHVRYSTAGGSALKNAQPLFVQYAGGQCAIAHNGNLVNAAELKQQLEADGAIFQSDADTEVILHLLARSKQATFEQKLVEALRKVTGAYSLLVLTENKLVAVRDPHGIRPLVLGRMKEGAYVLASESTALDLIEAETVRELEPGELLVIENGLLRTSKPFAEPPRQARCIFEHVYFARPDSTLFGSNVYEVRKEMGRQLAKEQPAPSADLVIAVPDSGVPAAIGFAQASGIPYDVGLIRSHYVGRTFIEPQQSIRHFGVKLKLSAVRQVLKGKRVVVVDDSIVRGTTSRKIVKMIKAAGAVEVHLRISSPPTKWPCYYGIDTPSRQELIAATHSLEEIATYVTADSLGYISQEGLGRAVGDPERGSFCTACFSGKYLIGDFGEERAEPSKLTA

SEQ ID NO: 15392 - protein, 48 aa, Myxococcus xanthus
VVQVPPNARQLTLKLKCHNEAEVDVPDAAPGNEPATASVSLKRQPRCR

SEQ ID NO: 15393 - protein, 694 aa, Myxococcus xanthus
MAGYDAMYGTDYAKVMPRDPGRALQILENFMRMRLSEGRSLALIVDFAETLVPGGEMSHLSSEDRFVVATLDKWAHDPQFLASDVSVVLLAENLADVSPRISRNPYVAPIELPLPTEEERLEYVRYKLEGKRLQSVSDVPLAGLAKMTAGLSRINLDRVLTEALEREVRITSELLKEKKREIIQAECHGLLEFIEPVHTLDAVAGHAKAKQMLRQAAGALKKGRLEVMPMGYLLSGPVGTGKTFMVSCFAGEIGIPVVKFLNFRSQWQGVTEANLEKIFNLLKALWPVAVMIDEADTFLGNRDSGGDSGTSSRVFGSIASFMGNTFYRGKIVWFLMTARPDLLPIDLKRQGRAEEHLALFYPQTDAERDELFQVMSKKTGVSVEGIESFSTLIPEGVRAFSGADIEAVMVRSKFRALAEGREAVTKDDLAAVLADFVPPSYPLEIELQNLVAVQECTSRELLPEGFRQLDRDYITRRVRELKALLESQYPVLPYAQALVLGARPAETWDMADGPTAPRSWFAYSLDLAPVIAHERLPGLPPIPDVLEGELAEALDVDVVYDVASAAWGGKVARLVDAPGHKLPGMLRRVPADAWDALVRLESAMASATEVRQVKVRTFTGAVLSAHVFTPTAPATPAQGLVSEAFLVTLALSAEEAGLSPDHVERLQAEARIVQALQKAGPEALNPSKAPGKKG

SEQ ID NO: 15394 - protein, 397 aa, Myxococcus xanthus
MQAADAAGSKTRGGNGQVSAAELERYLAAPEDGQYLTSTALQQKRSSLDAKLAQGNGSAVGVDAFESGWQATVARRADLLGGNGDGQLSAEELDAFIQASKAGKHADTRWVPDQQMAAFQSRVAEAAGELDPMRPAGALGSEGLSLVKEYSRLALDQGANVPTFVSYMLSASDIQETPATVSRLESTFVRDPELGRTGVTDSDYTRTGFDRGHMKPAEDSPTQEAMNESHLMTNIAPQHGNHNQQVWRTLEQGVSGLVNSQGGKAYILTGNLYLDDKGQPLPPEKRETTGAGERRIAVPTHNFKTVLHELPNGSLTMYAYLVPNTKDGPSKKEDILPLLDSHRVPVDRIEELLGQDLYANLPKRVQDKLEKGTSAEGVFQRNSLYFAASLFRFAPGN

SEQ ID NO: 15395 - protein, 50 aa, Myxococcus xanthus
MDLEVPQRSGGVRAVVSVCAAVQGEAHVEQGGLYGAEALALAAGAEDLGP

SEQ ID NO: 15396 - protein, 358 aa, Myxococcus xanthus
MTGRGIDQVLPHPAPPGLHEDYLKDARDYVRLAEERNGPIRTPVGFGELWGDALDEMERAAPDVRIINLETSVTTSEAWWPDKGIHYRMHPENAACLTAARIDCCALANNHVLDWGYPGLLETLATLRCLGIATAGLGEDQERARRPAILDVTGGRVTVFSFGDSSSGIPPVWAATEDRPGVDLLPALSPTAVRQLGERVAAVKRTGDIVVASIHWGGNWGYAVPDAQRAFARALIDEAGVDIIHGHSSHHPRGIEVHRGHLILYGCGDFLNDYEGISGHTAFRPDLTLLYLASIAPATGQLTGLRMLPMQLRQLRPHHASRQDAEWLGGVLDRQGRDLGTRTRLASDGNGALVLQWT

SEQ ID NO: 15397 - protein, 70 aa, Myxococcus xanthus
MEFVGLIQALPEEARAAWDGCTQRRFDIGIHVGLEPHSSAFPVPELVVQQLASVGAELAFTVYAPETTGR

SEQ ID NO: 15398 - protein, 72 aa, Myxococcus xanthus
MLDLSWADGRHSGEELHGTNAPALLGTDVSHGCIRHSNEAVRVLHDALSVGDRVAVVEHVDDPHLGVPRPVA

SEQ ID NO: 15399 - protein, 595 aa, Myxococcus xanthus
MVAEDASEQGEATRDAVESESAELEELRALEGAALDPASRSTAEVMQSLRRLGVANPLRMRMLDALDEHTFREDEELPEIPLITDLATFDVGQIQDRYDIPVEMQPLVAQYVQFFQGPGRRWFRKWMSRAARYVPVMHPILEQYGLPKDTVYLAMIESGFSAHAYSWAHAAGPWQFISSTGKQYGLKQDFWVDERRDPIKATHAAASYLKDLKRELGHWYLAWAGYNTGSGRVRRMVERHGTTNFWLLSEERGLAKETKHYVPKLIAAALVAKHPAAFGFNENEFDPEPVLDFDEVQLTDAADLDVVARAAGVPVKVVQDLNPELKRWCTPPATAKKPYTLRLPKGAGTQFADNYKRISPAERLTFRIHKVKRGDTLSQIAETYGTASEAILQMNQLKSARTLRVGGELVIPIPAGKSSGGALATKVAQARRSGVVVRPEDEVPAGTPKGPVAAGPVKKETINGRTRVTYGVMSGDSLWVIANKFNVSVDSLKQWNNLKRRNPTLQVGSTLFVWPDGNTATASVQERGGTVLAKHSVSVAKPAGKAGKVHALAEGETLWSVAQRYGVSVDDIMRWNKIKDHRTLPTGKVLLLSAP

SEQ ID NO: 15400 - protein, 96 aa, Myxococcus xanthus
EQVCGQFHLNCVGCHVTGWEQPGGVCRLDKVAGREDVGCESCHGPGSEHADAPGTHNIIASPGESVCVTCHNPENSPHFDFATYLPRIVGPGHGKP

SEQ ID NO: 15401 - protein, 225 aa, Myxococcus xanthus
HDLGNPLSSLQLRLRRLSMQSAGTSDTRMRDGLAGAEGETRRLGRLVHNLLDLSRLSAGRMVLDTEPLDLAHLVREVVERHRDQASAAGCALGIRVEEGATGQWDRQRLDRVITNLLSNALKFGRGHPVELRVQADTRCVRLAIRDGGIGIGVEAQQRLFRRFQRVHAGGQHPGTGLGLYIVRQLVEAHGGTIHVQSRTGEGSEFTIELPRRTNKESCSVNEVQV

SEQ ID NO: 15402 - protein, 452 aa, Myxococcus xanthus
MDLPSHFIVEPVDSRGRLTGVPILLNAGTEHQRRAGMDDFFIRRFRGIQTASGCATPDDCSASTQFEEEAILELRNAYEHAQRQTLTLRSDTRTLRLRWSLRPAAPYEIPVEQVRDARYTYGFRIGVEALTPPRPDGTYAPGTEISFQLTLRDGAGNRLHDKGYLPPYNEVAPDGTESGLQYYRAFFDATTTYYRRKHRERMLMTQIIGPAQNIQPIRSIVALEAFLDPEVDEQVVATPERDGVFSQFATLPFANVLFGGAFIDPNLWNQPNTDTWQFKLPDNAAPGTYLVTVKGRRVYLGEDLPGSTTIEIQVGTPQRTQPKHTTGPCTSCHSKGGELGVVLHANDNRAACAGCHAPLAFELEGPIFVRTHFIHSRSNRFDAPLQQCSSCHLTKESIQRTSKAACLSCHKSYPDSHVAQFGPIESMYVGGGAESFQQCTGACHTRHPGSGL

SEQ ID NO: 15403 - protein, 381 aa, Myxococcus xanthus
MQTARTTLREPDAAAEDLLSQLGSDTPRLVTMFASRERDQLALNRAVRQRLPADTRLIGATTAGELDNTGIHEGSVVMSALFGDFEVGLGLGTGLSVDAISAGAAAIKRACEDLGVRQQDLDPRRFVGLVIDDGFRYKKEELLLGILEKCQTLVLVGGGASDANRDPAKQSAMVHVDGEVATDAVLVALFKTSAPWAALRSHWYVPTGEKLTITKVDESHTRALEIDGHPAAKRYAEILGVGVEELEFGTPRGFAVRPTALRVGREYFIRAAWSPQEDGSILFANLLEEGTELELMKLGDMAGMTRSFFTDEVPRRVQNPQAALLFHCGGRMWYASATNTAQQLAETLKAAPTAAGMNVHFEIYSGFHINTTLTALVFGAN

SEQ ID NO: 15404 - protein, 214 aa, Myxococcus xanthus
GFAEVQALWSKHGKELPFVVLSRDWCEATLEASVRAGALDYITEDRFSRLAPVVQRELRMTADRRRHTATAVQLERTNYLMENIIDAIPFVLFVKDADTRRLVVANKTFADAFRVTKEWLLGKLDHDYFPKEQAESFIAIDTEILETKQMKSFEEVARADGVDRIFATRKLPLLDEHGVARYVMGVTEDITERKHHEEMLRASKAELEAANFRV

SEQ ID NO: 15405 - protein, 518 aa, Myxococcus xanthus
MGALLALLATTQLACVVGPRFTTCPGEGGRPWLRLDSDHYTLHTDLLAEEAREAMQRLERTRAAILTSMWPQSLRQQMTKLDVYVIQSPREFEGLYPRRVRAFFFRSDSEALIVLSGRPGTWEQTFSGLSLASSSPLNHELAHYLSAYPLSRQPRWLSEGMAEYLETLRISKDGRTAVVGAPHWTAIAHIRPRLNKVLRDVAQGWSMQQVLQWDRTLEAREQDKEVEANYAGSWLLVHWLVNERPQPFAEYLALLHQGVSPDEALTRTLPELTSPSLDGLLYQYVRKRHFVERTVSVPPIGTAFVEEYLDDAQVHAIRARLAALGAHLAHREPFITNRQKVARDELDEALRLNPTGLLALSAKLRGAAPSEQVAIGRSIVEAHPHESEAWLLLGMAMRHAPAATEEREATYREALRLDPRNANAARELAWMLINQDRSEEALPLARWAVALAPWSPNALDTLALALAGTGACEEARQAEHRALDFIQEDGAPELEYLLRQRIAGLEDGTLCVASPPGP

SEQ ID NO: 15406 - protein, 463 aa, Myxococcus xanthus
MSQCTHIVDNPFTGDVAASVEPTSPVKLDTVLERARAASRALRALSVAERVKLVLRACEAMEKNADAIARDITRQMGKPLSQARGEVGGMAGRLRHMAAIAEESLADIVLPPKDGFERRIAKEPLGVVLDLPAWNYPLLTAVNAIAPAVLAGNAVIVKHSPRTPLCGGHFARAFAETGAPDGAVQAIFLDYPGTEQLVGDARVDHVLFTGSVLGGHKMQTAARERFLHMGLELGGNDPAYVAPDCDFDKSVENIVDGAMYNAGQSCCAVERVYVHRSLYERFVAAAEPLVRAYVLGDPESEQTTMGPIAQPWHPAELQSFVQDATNLGARLVTGGRAAQVGGRGRFFEPTLLRDVSPQARLMREESFGPLLPIAPVDSDEEALALMNASRLGLTASVWTSDRERADRLARQLEAGTVYMNRCDALDPALPWSGVKDSGRGVTLSALGFDALTRPKALHYRLRF

SEQ ID NO: 15407 - protein, 601 aa, Myxococcus xanthus
MVAFISGFIGASRAQRLSLPEATIGVLYLGLPIPIVLTLMERLPGLQLALGYRLREVTYVAGLIGRPELGYWLVFMFLVLALVLGVNTGFIAAGSGRVDLKMGFELFVARRHVAVFRPSLLLGTLAVLMLGIIPPLLIYFIIRSAEAAVERTRIRKLGLKDPLAAASDLNRLKQHEQSPTMMMTALSVGGVGVGVMALIIVLSVMSGFEADLQQKILGTNAHAVVSKYAGDLPEYAKVMESVRKVPGVVGQTPFIINQVMIASEGNVDGVIIKGIDPGTVGEVTDLPKNILGGGSLDTLYTPEKIVHRGLPDEEPAEEGGVEEDEIIRRSGTPKKPQVLPGIVIGRELAASLRVVVGDRVNVVSPLGTELGPIGPIPKSRAFRVAAIFYSGMYEYDSKFVYILLKEAQDFFDMKGATGIELKVADIDDARRIASQVVKALGGYPYRARDWGEMNKNFFSALRLQKLVMGIILSIIIIVAAGLIVATVIMLVLEKRKEISVLKALGVPDGGIVKIFLAEGLQIGVAGGLLGLLSGLSSCFFIEKVGIKLDPGVYFMSALPVRIEPVQTVLAVVIAVLVTYLASIYPALKASSVEPVEGLKAE

SEQ ID NO: 15408 - protein, 307 aa, Myxococcus xanthus
MFIDLERDAWRALRAATPLPLKSEDIDGLRGLGEHLDLDEVVDVYLPLSRLLNLQVAAAQRLWAEQQAFLGGSTQKVPYIIAIAGSVAVGKSTTARILQALLKRWPDHPRVELVTTDGFLFPNDVLTERDLMKRKGFPESYDRRALVRFLAELKAGRAEVAAPVYSHLVYDVVPGEAQVVRQPDILILEGLNVLQAGAQEGKQMPATFLSDFFDFSIYVDAHEHDIRRWYVNRFLKLQQTAFRDERSYFRRFSELNHEQAIQLAESVWGEINGPNLAQNIAPTRSRARLILLKGPDHKVKRVRLRKL

SEQ ID NO: 15409 - protein, 68 aa, Myxococcus xanthus
MSEHFHKLQQGQRRERQVLDDYGGLNEAEFFAVATESFFEKPRQMQEKTPDLYEELKRFYGWDPAAGT

SEQ ID NO: 15410 - protein, 102 aa, Myxococcus xanthus
TADDGVHSRELWRSTGTGGKQRWRKPATAQDGRFGPHTRPANRLSELERRRILAVANSKEFRDISPKQIVPRLADRGEYVASEASFYRVLREAGQLAHRGCA

SEQ ID NO: 15411 - protein, 354 aa, Myxococcus xanthus
MKQKTWIAVIILGTLAANAVAYRVVRSRRDSAPEATPGAITHTPPTPPPTAPEEPPREDPNDGLARARRAAGLAALEDRDYDAAVSDFTEALRLRKDDQGDLVELLRIAAELRTREQARQQGEQARAQREPTPAPARSVQRTRPARGTARAQPRQESPSADEARGGLLLVTSTPPGLMVRVDGKPMDLTPARLPLRAGTYRVALAQGERTLAEETVALGEDDVRSLNRDLTAELAPAPRPAATAPASVEAPPPAAAPAATSPAATATRAESPPTAEPSVAPAAPTATGKGRLDVTSPGLYGEVWINNRPYGFPPLVAQGLPAGPARLEVRVNGVVKRKLTVDVVADQSTAVRIR

SEQ ID NO: 15412 - protein, 155 aa, Myxococcus xanthus
MDLLLQIPGFFFGVDTQGAVGPGFRGLWGYEGKVLLVVDGKEMNEQLYSTMQLGNEFPIELIERIEVVRGPGSVIYGGNAELAVINVVTRGVQGSTDLMVSGMYGQMGNVNGRRGLTVSGRKVFESAPGLIIFTSAGLSQAQRNNGVFQDFFGNS

SEQ ID NO: 15413 - protein, 427 aa, Myxococcus xanthus
MVQAGVGYKDLHLSVLYQRYGTSPIVAFDEVLEAPAPTNFDSLHAELSDRFRPDERVEIIPRLNLTFSKPFSDSDQDSPFFYDKQVLRLRGRTLARWAALDWLQLTGGVDVTSDQGWVNGPVGVGLQTGFGPEEADSVSYVNLAGFVEAFSVNPFVNVVAGARVENHSAFGESFVPRLVLLRSVGPFSGKALFSRAFRAPSIENISLGADVRPERTTVLELEGTLRMGEGHALSANAFDMGVADPIIYSYDAVTNTEAYRNLGRLGSRGVELDYHVRGSWGRAALNYSFYTPSGRNDVEDYQVPGQPNAFTGMPTHKAALTGSIKVLPWLTVSPTAVLVGKRYAVDVPDDEGNAAVEELPTQLLLNLFVRAQDVGTRGLEIGAGVYNLTGTNFRIAQPYNGGHAPMPVFSREFMVRISYLLDPVSDE

SEQ ID NO: 15414 - protein, 60 aa, Myxococcus xanthus
MNAADGFEVKEANVALTTTPTQYTIDISRVRYGQVVGGFGWTADGRTTPLVFFIDDIHWH

SEQ ID NO: 15415 - protein, 394 aa, Myxococcus xanthus
MRAQNSSLLLNMIWRERQISRAEIARRTELSPSTVSAIVADLERSGLVRSIGAGVSRGGRRPTLIGFCDDAFSLIGVEMGATHVTAALTDLRGRVRAYRHASHAVREDPKGTLQKVRELVQEVLDAERVPRRSVAGMGIAVPSPVHPSAPGKLSPLLVPAWRDYDVQESLRSAFGLPVFVDNDANLGALSECYWGAGVNGEDLAYIKLATGIGSGHIIHGDVYRGAGGTAGEISHMAVDSSGPQCVCGLRGCLVTLIGSAALLERARELMGRKDKRALTVRELVEGARAGEPAARQVIDGLGHYLGIAVAGLLNLLNPAIVVLGGEISSVGDLLLDPLRASVRKRALSTSMAETRIVTSALGDRAIAVGAATLVLQAALRDRTLFPLQHIGKPA

SEQ ID NO: 15416 - protein, 229 aa, Myxococcus xanthus
AVALTGLACDPAANRVNRPGTPPPHTNPQPSTDWELVWQDEFDGPEGTPPSPERWVHDVGGHGWGNEQQEFNTDRTENTAHDGAGNLVITARRERYNGRDYTSGRIRTQGRYETTYGRIEARIQLPVGRGIWPDFWMLGANIHSVDWPECGEIDIMEYRGQLPSILRGSLHGPRYSAGNNLGQDYVVSGVRLNEDFHVYAVEWEPNRIRWFLDGTAFLEATPAQLPEGV

SEQ ID NO: 15417 - protein, 600 aa, Myxococcus xanthus
AFICFVPKSFARRKSRSAMLQRFSHFARPDLRAQLSLQQVDMLQDAVTKVVVPSHVMEGVELLADALERALAAQVAKLPDYVPTKYFSQRSVVKALWALKAAVVRDQIYRRPERALEATVEDLDSLRWFFLLGGPPAGETEALLKSVVDPRERAQLEIVRLEQRAFDEALAQIQRELGGGVEREAQALGSSEEVSSVESVSRNWQPGVVSTTARALLAKLVPGPRHAQNRIPLVAAARALVAAQEQRLARGMAGHGEGRGGIALLVSFGDVLTLCRGVPELRPGYGALCEATARFLEGAQEMIALSAESVDFEDGLKLEGLVGLADNLEEELSQTGDLAGQLSDGAPAASERLRTTEAEVRSRVVSALRRRAVFSFQGNLARGRREPLEALAGDSRRLTQLENALAGLDPTQQGLKQELLLPLGIAYAREVLSSTPFERIEQYGRAVQSVAENLRREGVSSDAVFAECREIIESRLREHAHLLTRDVPSPPPASTSVLNGDAYVFYRGDFAAKAPDGELAALLGLDGQLAANHGGVAPGFLSEAVRSAVAQAELGFVQTRVKYLRSWLTQLLTSLPPPESMTERADATPGTGGRTASDAP

SEQ ID NO: 15418 - protein, 145 aa, Myxococcus xanthus
MREAIALARTNVKSGGRPFGALLVRDGRVIARAVNEVNQTKDPTAHAELLAIRNASQSLGSASLSGCVVYASGHPCPMCLAAMYLCGIQGAYFAYSNEEGEAFGLSTAPIYAQLAREPQAQSLALRPLRPADEHGLYDEWKRHQG

SEQ ID NO: 15419 - protein, 714 aa, Myxococcus xanthus
MLASLDRDLDRVGVHTSADARLLKELGLRKGRAGALAQGLLDRARQALEEVEACLVLVERAWRTGAPLPGAVAVLEKGFIQLARVVKVADLFARPPSEPEEDDAELEIYGRTDGSTPRLAPSSARLAVAEFFAERARANPTDVKQKRRDLDLAHELLIRLGADHDRERGMVLRRQVAEARERVRAVPAVRSMEELLRHVRHTARREPQVAYRSLKGLYERALEAGDAALADAARAALTPMLPAPSQLSSLMERAELDGLSHWFGEAPTAPDEVPGPPKADELLTDLAFSLEPEQLSTFELAAGCARYFDVEDALSEEIVLADTRTARAVSRRVPYPTQTMTYETTGSLHEVNNFVLTDPRMLLRDLAASHQLVRAYLDDEPPPRPRKVKRTAVRVYVCDASGSMHGARARFRDAIVIAELNNLRVKARRGEHFDPLYFSFFNDVPTELARVDSALEATRQLEKLFRDSPAEGQTDITLALMSAFDSIRAAQGRDPYLARATVVLVTDGEDRVDLELIRRTRAPMGALDIALSFVSLGEENPDLRLLVREQRAAGGRAFYHHLSDEEILWARTEFDTPWRTLLPRDVPASGDALEQLTPHLEALEAVAAGRAAPRTVAVDASFDALFPEKPTPPPGAEPTGKDVTHRVADILGALVEAASLAPADRRAAESLLLLQHLLGVYGLTPARYLSALSAGGQATQEALQRVRLLCRPFG

SEQ ID NO: 15420 - protein, 47 aa, Myxococcus xanthus
MGGLVTESLRERVARFDQALVVDAARDEIERAHALADIYREEKSQEE

SEQ ID NO: 15421 - protein, 109 aa, Myxococcus xanthus
MLEDSKASLLESAKKTLVEESSFDTDDLPDEIDLASSEYAQSMVFRLRDREKFLLQKIEKALVRIEDGTFGVCERCEEDISPKRLDARPVTTLCIRCKEEQEKKEKSYG

SEQ ID NO: 15422 - protein, 50 aa, Myxococcus xanthus
METCGREATLATAITIVPERSGEPQARQTEASRGFSVSQRGQYSIASMEG

SEQ ID NO: 15423 - protein, 452 aa, Myxococcus xanthus
MDYLAGYDLTHILSREWPLNAWRVVRIVSHVLSALSDAHGARVIHRDLKPENIMVEPRRNEPDFVKVLDFGIAKITDSTDDGPALTRAGFVCGTPEYMSPEQARGSQLDHRSDLYAVGVILYQLMTGLLPFESDSAVGFATKHLTEEPPPPTRRRPDARISPAMERLILRALSKNPADRPASAEAFKAELQAVDKERRRMDSAPRRSANSSAVLAPLPRKSAASPQSDVRDATLPGWGNEVTMEATVRALPGVLEPLPANADAMATTREHTDSLVHTQPGAGGSSGVAFFFKSLTILLVVAALGFFAYYFFMGAGSGGAQDLPYALPTNAPVPAGANNSAVGASPDVPLYDRAIVSGARNVERALELAREGDKALQRADVGLAATKYREAFSRSGDPELALKLGEVYWHRQNPDKEEARGWWNRHLREQPASKARALIEQRLNGAVAQPTSP

SEQ ID NO: 15424 - protein, 239 aa, Myxococcus xanthus
MPKLAEEHLAKKVRALVIPAYDYSRTERVKVALVSALSQGAFKEGDLVLCMTGKVGRAPDTLMQTRIGGSLDDRVAIEGVKLGDEFNSQVVDALIQLALQIGQEGFEGHPIGTIITIGAHNTVMEKSRQMTINPFQGLSEAERNVLDPKIREAIKNFSVLDGAFVIREDGVVLAAGRYLSAADEAVKIPLGLGARHAAAAGMTSTTGCIALVVSQTSGAVRLFKGGNIVLELHQTARRT

SEQ ID NO: 15425 - protein, 221 aa, Myxococcus xanthus
MAVASVASRPQVSIRVVRADGGPESVVRMQRDTLTCGQQADISLTDDPFIMPLQVRFFFSGIRLAVEDVGGANGVFVRLRQERELPPGGELRLGRQRLVLEPIPTAATGPGGTQVWGSPDPGYRLRLVQLLEGGLRGGAFPLREGDNLLGREQGDLTFPTDGFVSGRHAVLQVRQDRLQVRDVGSSNGTFIRLSGPTFVDNGDHFLIGRQLLRVEIQAPTS

SEQ ID NO: 15426 - protein, 152 aa, Myxococcus xanthus
PRGVFVTVGGTEALTRRTHFSAGQRLFRFTGRLEPQPPVTGRPAIYGAPVPLGQAVYGVEEMLVGARAGRAVMTAAPLLTIGLAHCDLSFPGDEGLAGRHCELSPTPTGALLRDLSGGLGTYVRLASGVERPLRPGDRVRLGQHVLQVETLG

SEQ ID NO: 15427 - protein, 401 aa, Myxococcus xanthus
LMYLPRIRAQVFREDDAELVRLDYGENEGPLPPPLVEGLIAAGVAPREPAPQTGLAEAVSAFLLESRAVRYAPDELAVAPGVWPLIHHLGVALRQRLGRTPRVYVSTPCYGVLPPTFVSAGCDVEQGPLSGLLARRGQGGGVPDAIVVSQPSNPSGVYLAREELVALATYVVEQRCLLVSDEIFGLVNLTSPTAETVPSPVTLEGAVPGIGARTVLLGGLSKEFAAGGLRVGWLATKDRALAAAVRDSGPGVLHLMTARAAAYLYAAYARSPDGQLLYSARHRTLRSYLVKMRRELAEKRELLAGALPGDGRSDAGDAGGLFLSPRMTTWLGQEVDGVRLTPENLPRVVYEHTHVVLNGGSWCGDPERVRAVFSIPRDALLRAREQLLRFGAKLRGGPSES

SEQ ID NO: 15428 - protein, 264 aa, Myxococcus xanthus
MAEPAQRNAIELVNVHKSFGAQHVLRGVDLVVPTGTTCVLLGVSGSGKTVLMKHLDGLLRPDRGTVRVDGEDLAWLDAAGLERVRRKMGILFQGGALFDSITVEDNVAFPLRERLHLVESEVRERVQRVLALVGLEDAAKQRPGELSGGMLKRAAFARAVVLEPKILLYDDPTAGLDPLRTQSVVDVILTGKHRLHASALVITPDVASAFQVGDNLALLHEGRIIEHAPPEAFRQSQHPAVQAFLHDWLARRARASGHTSPPLH

SEQ ID NO: 15429 - protein, 219 aa, Myxococcus xanthus
MLMTLFTMACSASAGAGDGGSPVPPEALLRAAEKGDAATVSELLRQGVAVHARDSAGNTSLLLATDGNHVAAARSLIEAGANVNLQNRQLDSAYLLAGARGYLEILRLTLKNGADLKSTNRYGGTALIPACERGHVEVVKTLLQAGVDPNHVNRLGWTGLLEAILLSDGGPRHQAIVRLLIDGGADVNLADGNGVTPLQHARERKQDAIAKMLVAAGGR

SEQ ID NO: 15430 - protein, 319 aa, Myxococcus xanthus
MDLRSRLSHSTLVSQLPRNVVPDSLSLSSPAPQDFALADPERVEGWRRACERYVRPGQVVMDACTGTGLRTFLAASRQPKKLYAVDGSRLLDTAQWVARRNGLENIDFVRAQPWQYQMPEKVDVLLHELLGDALFDAGLVPRILDLRNRVLKPGGRILPNRFEVFVEPVQLRDEACIPFIWSQRFPSVDYSCLQTLREAMNPSYFTRVIRSYEVDHLLCDPEPAFAFDLETMVADGLPHRVRFSRPVVDEGRVDGFCLFYKVAFDAELSFNVSPLRGQNYAGMMLLRVDSREFERFDTLSFELDMVEHADVRTWRWQFT

SEQ ID NO: 15431 - protein, 212 aa, Myxococcus xanthus
MRQDCEQALERLKTCTQKAGCAPNDTECGPKACLPICQRSFEPAPLSPEKEVPAPCEGVTAPGAAPPKALVGTWTLVAASLPEDETVREERIEARPRSDYARSLQVTPSGCFVLRTSLEAATLGQGNSLVVRAWGTLDVSGKDRVRLRTRDGQAVGPVCGDKRVIPLTGPKLKFLGNAYVWDLEKGVLTLMVDDETKQTFQFERATPESGKK

SEQ ID NO: 15432 - protein, 451 aa, Myxococcus xanthus
MSSVDALWFHMEEPANLMMITAVLWFEGRLDFERLRTVVRERLVERYPRFRQRAVAGLVGLPQWEEVAELDLDWHLSRLDVPPPGDRAALESLVGEWMSTPLERSRPLWQFHVMSAADGRDVLLARLHHCLADGMALARVLLTLTDGAEAEMAAEAPEPTSRPSTGGLASWVRGARAVAGTARAVWRKGAELAAEPILVGDLLVQGARGAAAMGKLLVIPPDPRTSLRGPLGTQKRAAWSDPVPLERVKAVGRALGGTVNDVLLAAVAGALRRYLESLGEPPEDLHALVPVNLRPLDVPVPRELGNHFGVVFLRLPVQLGTPQRRLQELVRRMERLKRSPEAVLTFGALELLGYTPAALERWVVDTFGSKASLIATNVPGPRAAVSLAGSRLEGLTFWVPQTGHLGLGVSLFSYAGQVTVGVAADAGRVTDPHALIQAFHEELDALATERD

SEQ ID NO: 15433 - protein, 368 aa, Myxococcus xanthus
AGAVDFVLKPFDREEILFTVRKALLRAQGEEARQQVRPTGGFIGRSRAMADVQAVLAKAAAGTATVLLRGESGTGKELAAKAVHDASPRRDGPFVKLHCAALPDTLLESELFGYEKGAFTGAATRKPGRVELAHGGTLFLDEVGDISPAVQVKLLRVIQERELERLGGTQTVKVDVRFVAATHQPLEERVKEGRFREDLFYRLNVVPVWIPALRERPDDIEPLALHFLEVHAKTNGRPPFTLMTDGLAALRAQPWPGNVRQLQNFLERLVVLSDTQVIGGREVLQELARQPGLAPAPFAATPSVSALEAPTVPVTDSARTLESQRKEMERQAMADALKRAGDNRTLAARLLGISRRTLYNKLEEYGLL

SEQ ID NO: 15434 - protein, 144 aa, Myxococcus xanthus
MLRFVSSALVVVLSTGCASSTVIRSSPSGAKVRSRSGEVLGRTPYEYSDSATVNNTESFTLELDGHAPEYVTIRRDQWSGARTAGGIVGGLFVFPVFATLFWAADYRESYHVELTALPDSEPEAPAPPVRARRTSSEKSPTSRR

SEQ ID NO: 15435 - protein, 291 aa, Myxococcus xanthus
MASGGDNKLTAPPAAKQKLFVDKPGSPFQKDVFGGTVSGNVGSMQASTSSYSGSGVHHYSAQAELRGPHVGYELQKTHAGRLGVTSGQVSAEANTFKAQAQAGVSLDRNEHAYTAALMAKAETGVGVTASASHDFNRHVGGYVKGEAKASASAYAEGVASLDPKMGTAMLSGQVGAAATAGAYVTAGGHVGRLHGSVTGGAVAGAAAQAGGKLGLENGFLKHSADVNAAVGVGTHVKADVAVDLRHHLKPGIAAGLRPALAGATSVASPASTIEPEKSRVEKFLAKAFHKA

SEQ ID NO: 15436 - protein, 340 aa, Myxococcus xanthus
MQHLWSAIIHQGTVFPATAPVALVILGLLDDARLDAGEEPVRAELLLFLARVVDAFERSGATMEDLESMARFDLGPLLDADDDDAIYEDEDASNALHAQSVLACARVAPFLTRSLLANLDHPDARVRMHAAMAATAHAASPASDVRPDELVERLTEMAMRTVDVAERCSLLLALGELNVSLENLLSDAEPSVRLCAAMAPSLARSEVATRELRTALEQHAAHINDWFPVKPPQLPMQPRFTVVQRLLERVPDFDLVVDAAVAVARTTKKSWVDFEWGPLLVHAFPSGDGVVRTEAQRRFLAALVDTSHLWDPRFGNAGGHFRKAGLPYEREACARLVSTA

SEQ ID NO: 15437 - protein, 386 aa, Myxococcus xanthus
LEELAPFFSRLRFYPVPHTPSTEDGLHVHLQSVAETTKQLQRVRLPLDIERGRESAEVWTPLYDELVQLFLETRTSEGVCRHFPATWSERGSKLLETVARARAKHLLCKWPHHSKSHFSKLCDVLAQAVKEPAALTPGQQRRVQHVLDDIARARGLPGSDRLHALRTAQQRLASRPTHQDLARVLVARLGAYSSGEGLDDLEQVTASVTEVEASRQGVAAGAEFPSSLIRKLVRCANASLEDLIARKVVTSSEVLARVLPQVSAHVAAQGVNDPELRRLYGHIYAAFRRRRSLLLLDLQSQVKLQELPWCRAIDAHRTPDLGQQEVAAQTFERISSLAISAFPAVLIPNKLLQELRALAQAAGLKVPLVEELAADIFMNAFSPKFD

SEQ ID NO: 15438 - protein, 211 aa, Myxococcus xanthus
RGMDDFYADVLDHVGRPPREFGSVHLHVEPVIRNPLGQATAVVWFQAAFEPLATTPSSVLVMGRQKQGSAHRMLGQFPLPPLAGGRVVRWRLPLELPPEFDEVHFQVESSLHPNAGRVRPAWKLFDTLEIPKESDMKAVSSEVSMGIDLGESLLNTVMSGGLSVTAYMKMGPQVSPGSLAVKRHAAATLPTAFIAAVVDGPLEPLSDLQCE

SEQ ID NO: 15439 - protein, 36 aa, Myxococcus xanthus
MKLRLDAPEAKAPAPGAFHMMEIRDHKRLYVEGDTA

SEQ ID NO: 15440 - protein, 487 aa, Myxococcus xanthus
METLPEVPQQLEPLIRQIGPALYELGQGFREDMRVPARIVADSELLQQMVQDRSVPQLVNVTTLPGIQGFAIGMPDMHEGYGFPVGGVAGTALPDGVISPGGIGFDINCGVRLLATGLRHEDVKEVLPKVAHDLARSIPTGFGRHGRLSLAPEQMDRVLTEGVPYLVDVLGLGTPEDVDYLEARGCLDGADTAKVSVRAQERGHDQLGTLGGGNHFLEVQRVERVLDSEAAPALGLFEGQLTVLIHTGSRGLGHQVCTDAVRTMDRALAREGIQLVDRQLACAPLSSAEGQDYFAAMCAAANFAWANRQVLTYRVREVFRRWFGDRSAAWPRIVYDVAHNIAKLEPHGGQRLCVHRKGATRAFGPGHPELPAAYHQVGQPVFIPGSMGTASFVLVGKEAAEAISLSSACHGAGRRLSRAASKRQVVGSELRAALNRQGIAVECPSNAELAEEAPLAYKDVDRVVDVVEAAGIARKVARLVPLAVLKG

SEQ ID NO: 15441 - protein, 86 aa, Myxococcus xanthus
MRTRIPYLTLLVPVLAFAQSRARAPIAGEPAPASSTWLWVLLLVVAAAVLAWGAVRMAGRKGPPTSGSGGIGVGKGTGLPQKPRSL

SEQ ID NO: 15442 - protein, 1890 aa, Myxococcus xanthus
MLVSATLAGCKKEQESTEPPAPQPQAPVAAQPADSGTAVAQAPTPPAPELLTPVVRAVSTSDVLPQDIVIEFPREVRPNDGSVLKDTVVTITPEVPGSLSWSSPSTLTFKPSGAGFAFDTKYAVSLASVGLDSGVVKPAAVGDWSHTFTTPPFQFVRMVPRQLDTVKGRVEVEVVFSGPVDIAAVRSRAGFRVGGQAVGDVKWRTLPTTRNVVSAQLTSGLLKQGRTVDFSLQAGLPAASQAKATAPAARSAFELRAGKRMDITRASVEQGTTGFYIEVSCRDVDGAEPPSPRETEGYDPYYWDHRNKGCTLDDGVAAEAIHLTPAVKVSVAPSRRGFRIFGDFKRGSYALRIDAGTSSVGGGMLLATYEEAFAVPARSPQLSFATSGRYLPRSAWRNLPLQHLNLDSVELTVRNVPPENLVFWMSDDYRERADERTSNVVAKRTLALKSQPDTLATTYVDVASLVPANTKGLVEITARQSHHAAASRILLTNLSLVAKRGEAAPGSSGAGEVWVWALGIESTDPLSGVEVSLVKKSGESVARCTTVAADGCRLQVPAPGVDDSAPFALIARDGEELTYLKYSELKTEIANADVHGEPYRSEKAYRASVWSDRGVYRPGDTAHIAAVLRGQDDKAPPAGMPVELVVVDPRERELKKVSLKTNEAGLVPLDLPFDSFQDTGSYRVVLNVADREVAIYSVSVEEFVPERMKVEARTEQAGYLQGDEVPVGVEAAYLFGGSAEGSPVELTCRLIPSAFKPKENAQYAYGLWRQDGREPRPVTLGQVQGTLDAKGQAVLRCPAQGAMGALRGAGALSALASVFESGSGRSTLGSVTVPVHPEAYYVGLQGSTGKVKAGKPFTVKGVVVDWDGKLLAASDKTPKTVDVEFLRLEEEYGSFYDENEGYERYQRYLRPVREGRSTVAVKDGRFSLDVTPGADSAGYIVRVRSGGAQTDLELEGEGRYYWWGEGSRVDQTPRPLKPTSLELALPAKGRVGQAITVKVKSPYKGRMLFTAETDRVLASHWVAVEPGEVTWSFTPSAFAPNVYVSAFLVKDPHLESAEAFMPDRAFGVGSVTLEPVEYTQSVTMNVPKEVRSNDTLTVDLELGPQEGPTFATIAVVDEGILSLTRFQSPDPQKQLFTRRALGVETYETLGWTLLVPPGGASRSTGGDGEGGADGRVQPVKPVALWSGLLPVPANGKLRVPFKLPQYRGAVRVMAVTAGPQRIGRASAQVLVRDPLVLQTTLPRFLAQHDEIQVPVFVTNLSGKAQDVKVTLNAESLPVPGLVMPAAATSPLQLLGKSEGTARVADGKSHTFVFQARAVQAVGAARLSVTVEGGGYTSSESLDVPLSPAGPRERLVQQIELAQGTTDVSQYLQGWVPTTERSTLWVTANPYARSLQHLAYLARYPYGCVEQTTSATRPLLYVSELVNDVDPTLTQGGTVGDMVLSGINRILAMQTPSGGFGYWPGATEPVGWGSAYAAHMLLDAQKLKYPVPQDRLNDALTWMSTELNKLESRQGRDDMYTDSAEAYMHYVLSVAGKGRKARVQKMVDALSERAKQKALTGEEQERDYMLKASLWLAGDRRYEKELRNPDLSPVTEERKNDWSFYSDRRRRGFMLSTYQDLFGKDAAGEPLARMVAESLQAHSSGWYTTQELVWGITGLGKRLQGTSTQFSAPVLKADGKVMTPVQDKTVRSSDRTWSLARASERQGLQLEVTSKDEGRLYLVLSSEGVRSDSKPRTGGEGLALTRTWRKLDGTVLAMGQAPVALADLVYVELEIRNTTGERVQNIALVDRLPAGWEIENARLGRGGSTDWVDPASLWSADYVNIRDDRMEVFGSLGPRESKKVVYAVRAVTAGSFTLPSAEAEAMYDPRLWAREPGRTIQVSGPWKDNLL

SEQ ID NO: 15443 - protein, 47 aa, Myxococcus xanthus
  unsure (1)..(47): unsure at all Xaa locations
QLEVRLSKQEVLAAYLQFVPYGRNVXGVEAAALAYFGHTAANLSPAE

SEQ ID NO: 15444 - protein, 70 aa, Myxococcus xanthus
SRKPDKPKPPPQHKRWEGKEKPDWLSRALARAGVFPQKEAEDAIRAGRVSINGRVAKMALTPVPPGALRA

SEQ ID NO: 15445 - protein, 240 aa, Myxococcus xanthus
MVLPVRFVLMRPRNAENLGAAARALKNCGLSDWVWVRPEVEDLEPARRLAVHAGDVLDAARRADTLEEAVADCVWVVGTSSRKVEGKRRLPPRAVGEELVARAPQGPVALVFGDERSGLTNAEVERVHDLSAVPTAPEQPSINLAQAVLLYAYEVRVAMLEAAATPPGPLPAAATDAELAQVESTLESVLTTGGFLVDAQPGRTAVRDLFAPLRRSRLTRKEARLWLAALHSLRKRQPAP

SEQ ID NO: 15446 - protein, 81 aa, Myxococcus xanthus
MDPGSDMERLGDAGIPIRLDRTSAHMHHKFAVFDRLRLVTGSYNWTRSAAEYNHENVLVSDDARLVQPFNRAFDALWETLD

SEQ ID NO: 15447 - protein, 98 aa, Myxococcus xanthus
ACSQGSRRMMQFQQEHGTGGSGMAQPPGVDYDEMGGREEPGSAGAPSVPSIASVHDSPEGVVIVYTAVDPARQDKLSSEIHRNAKYLATGKCPGMAAD

SEQ ID NO: 15448 - protein, 195 aa, Myxococcus xanthus
MEQSYTWEGGLGLAPDWASGSPATLAEQQVVSACLAAHANRLGEELLISILGLDGAGAVIPYTAQELATHSRQESCFFGNLFNAEGIHVGAERAPLGPQESTSRACAGLLHDGTETLVPCAPMVYVGACTSHCALDSSGLYYETCTLGGVTYRPITTRLSPTNVNVCGDSVCQATEQCGTSNRYDSCAQDCGPCP

SEQ ID NO: 15449 - protein, 194 aa, Myxococcus xanthus
HLTPSRPIPLGLPRALLVTSVLLASTSHAQTTPLEDNNRITAGYIELAYEVGGLLDPTLSPGGTSAVRPNWFVFAPHASRTGGEGLLGASLARSVIRAARGQPSLSLQQALGRVGLTGTLHLSVQQLGLQLVLSGLPFDVAASLASLTTALNGAALLDARTLLTTTARFAALYASAPGVLPLDKAERIVDTLSA

SEQ ID NO: 15450 - protein, 101 aa, Myxococcus xanthus
MARKFVDAMGLGPLLHHVQGTDGFPHKPAPDVIHHALAALGTGGLWMVGDTALDLRAGQAAGLRTYAVTWGTHPVDVLAGASPDELQPDLQRLLTHLPPLA

SEQ ID NO: 15451 - protein, 102 aa, Myxococcus xanthus
MLGEAPLPQPSPASAVEHVALVAADTEALLVDWLNELIARSDLAKRVYTDLVVDELQERSLRAHIRGVSPPVLKTAVKAATFHGLELHEHDDGFTATVVLDV

SEQ ID NO: 15452 - protein, 577 aa, Myxococcus xanthus
MRPALPERLRRIQDTVASFIVANAGPLGAAGVGLLAFLAIYGPAALNPTRLAWLIRDDFSQHLLGWLFFRNEPLRFPLGAIDGYLHPLGTTLGYMDAIPWVALLLRPFSSLLPADFQYIGPWMCMCLMLQGASSAWVARRMGATVPQQWLVGALLVLSPTLLARMSMAHEALCAHWTIVLLVGLNLIPQRDAREAKQALGIALALCVFAAGVHPVITAMVLPLALALCMRTALEQRLPWRWPLLGAVVNVGVVLVLFYVLGYLGTVRTLGADAFGGFSADLLAFVNPMGYRDSWSRFLGPLPRQGAQYEGFGYLGLGVLFALWAALILLVRDAPLVARQWRRLVPVGLVALGLGFFALSSRITLQGELVADLTGLYAPVMRWVEPFRSSGRFVWPLYYLLALGSALALIRLPRPAVAPSLLALALVLQAFDVNLGRGHQAKEGPAWNTQPSDALREAAAGRKHLVLYPPQMHDGSGRGCRAGPMDFHRWAYRAYLLGLTFNSGYVARLDDARAQPYCLGLDDDIRAGKLDPETIYLSIPQRLHEFRAIRGTRCVQEERLWMCVLEQAPAAPLEHASP

SEQ ID NO: 15453 - protein, 1055 aa, Myxococcus xanthus
MLRALPGQESQPASATPPEGSVALVFTDVQGSTRLWERCGAGMRDALEVHDRVLRSLLVGSTGYEVKTQGDSFMIAFPSVLDALTWCLEAQDVLLRAPWPVDILSQPEAAEEVGPGGLLFRGLRVRMGVHVGEPECRVDARSGRTDYLGRMVNVAARVAAAGHGGQVLVSGGAWAQVAQVLEPLGRPAVRPLGAFRLKGIDDAVALVEVLPAHLSERRFGVPRAPRDRQGNVPVLQEGLVGRGTELGQLRRWLADGARLVTLLGPGGMGKTRLATSFGALELESGEWEGGVWLCELAEAQTAEALCLSVGHALGIPLRADGDPTEPAERLGRALNDCGDVLLILDNLEQAVQHLPATLGRWLQLAPRARFLATSREALGLPGERLLDLAPLSVPEEGESRLEELVRSDAVRLFAQRAREARGYFELTAGEAPMVADIVRQLDGIALAIELAAARMALLSVSQLRERLTRRFELLRKGRPDGRARQATLRGAIDWSWNLLEPEERTALARCSVFRGGFTLEAAEAVLGLPPDGPAVLDVLQSLRVKSILRVLEAELPGGDSRLGQYESIRQYAAARLAEEGVGNAAALAERHADWYLSLAYRLRAQVRKPRAVRRPLQRLALERENLLAACDNALAVTPATSRSVERALQALVALQPEVVTRGPVRLLLERLDAALALTDRVMGAPRLVAEAVAVRGRVFLEAGDLVSARRDLECARASLRTLGAVAGEKRVLVDLSIVARHEGELSLAWALVREARLLSSEGDRWLDAYTVGNLGLVEQARCGAEAAIPHLRAAQALFHGVGDVTFEVGFLSNCAVAIGEMGRTREAMSLLEDAMARSASVGDRAGHALARLNLGCYLLEEGRPQEAREHLLAAARIGRQLGQRLLEGTALGELGRAELALGAWSEAWARLSEAVSDLGRVSRGQVLRFAVYRAVVEACVGDAAAAEASFVVLEGAPELRDDPVLRELAALLRAAVDLAEARAARDDVARAQRAFESVRRRIARARSAPPEAASSDLRGALGFLEEALWRLTSEPEDVEALEVEGRGAPVCAGAA

SEQ ID NO: 15454 - protein, 379 aa, Myxococcus xanthus
LSGGPRAPVMRKQLLRSSSPSPEVTPRPHWPRADPSVTKAHPTHLDTSERAGLAIRADVEEWGLDEGVFSLLFDAGTEVGASLVSHPAIRAVGFTGSRGGGRALMALAAARPVPIPVFAEMGSINPIFLLPEALAARPQAMADALATSILQGAGQFCTSPGLLVAVEGPGYEAFRARLAEKLGAASAAPMLTPAIAERFREGVSRLAARTDTRTCARGESRAALGAAALFEAEARVVLAESALTEEVFGSCAVLTVARDAAELVRVASRLEGQLTATVMMDAGDTALAAELLPTLSDRVGRVLMNGVPTGVEVCPAMVHGGPFPASSDGRFTAVGTGAIRRFVRPVCYQDVPDALLPPELRDANPLNLWRTVEGALKQE

SEQ ID NO: 15455 - protein, 253 aa, Myxococcus xanthus
MGFMGRVANPLFAEELFDRVPDIVFSVKDIRGRYVCMSEACAERCGLKSKAAAVGHTAHELFPQHMADRYVRQDEKVFQTGRALVDNLDLTLFNNRKPGWCLTSKVPLFDATGEVMGLACLSKDVHEPGRAGLVDERFAGTIDYIQANYGERLRIDSLARRAGMSAAQFERRMQRIFQLSAGQFIMKTRIDAAAERLVEDAQPIAAIALAVGFCDQSALSRQFKQVTGLSPRQYRQLVVATSVPGAPRGKQAR

SEQ ID NO: 15456 - protein, 225 aa, Myxococcus xanthus
QASNSFSSPDSLSTYLSEINQYPLLTQPQEQELSKRFRAGDLAAGHQLVTANLRFVVKVAYEYRSYGLKMSDLIQEANIGLMKAVQKFDPDKGIRLISYAVWWIRAYIQNCILKNWSLVKLGTTQAQRRLFFSLARTRRELEKMGAGDANVVNAEEIARKLNVKASEVREMEQRMGGRDLSLDAPMGEDGDATHLDFVESESVFPVDEVTDRKQANLTLVAIARV

SEQ ID NO: 15457 - protein, 592 aa, Myxococcus xanthus
MFLRAGYYVQYYAPDVVGSYGTALANAIRPALAAFVANSHFRDVNDDHGAVLQEFVTLIDSAGENARHLGTFKGLLDRFNDTTQAFWYMRSATNNVFVGLFRGHYNDDFVAAVQQDPSIIDSLDSFGLRTEHLLGTDNQYLSVNAARELSRFLQYAGTLQTKTRPKVKALITSHSMTGPTAGVWVGAAEMADFYDGANCAYYGICDFRRTLEQAVLRVTHNCGATLRMRAQEMTATQLAQSCDQLATQESYFHDKLKTGRLPVASDNNTSLEMVIFDSSLDYQTYAGALFGIDTNNGGMYLEGDPAASGNQARFIAYEAEWVRPAFEIWNLRHEYVHYLDGRFNMKGGFGDSISQPTIWWIEGLGEYVSKKDDNASAVELGTSKRFQLSQILRNDYNSGTERVYYWGYLAVRFMFERHPAQVDTFVSQFRAGNYTGYRTSLDSLGSANDAEFHQWIDCVSTATDPSTCANPDPGPGPGTGTQCTGADTRMLDNGCYRGPLAGNDIQYFYLWVPAGARNLRFQMSGGTGNADLYVRANQWPSTTAYDYRPYLAGNDEVVDIPSPLTGVYYYAMVRARAAFAGVKLEARFDTAP

SEQ ID NO: 15458 - protein, 198 aa, Myxococcus xanthus
MTPTSGQLSEMQAIAETADAKVVGIHNATQGLVADLAQCVADKLDKGHNPAVDALADTLYSELKAGREVHLMGYSQGGLITARALDDVAKRLRIEDGMSQAQVEKTLGKLSVETFGAASTRYVDGPKYVHYVNNADPVPTLTGLGGSVDPTAFLKDAGKGAVVHRFTDGNANPISNHMLDTLYMKHRVDFDQARAGRF

SEQ ID NO: 15459 - protein, 151 aa, Myxococcus xanthus
MGDLFQLFAVSAVVMGVSQTLSRERIFAPLRARLGGKDSWLGYLVSCPYCVSHYVAFVLVPLTGTNVIRVSVGGWPGYVLSWVLSTLLITVISAFFRVVFWFVDETQGLVKRRQRTEEEETATMRLHREQAEQTLNHHDPETREPSPPVSH

SEQ ID NO: 15460 - protein, 134 aa, Myxococcus xanthus
MDLTAPNLMSEGDASRTRSTSGLRTASYVALGTGVAAFSGAGIVRLLAQKDVNALEKRLDNGRILSSDKEAMGLRDSLVQKSNVLNGLLIGGSAAVVTGAVLYLLSPDSNSAPPVSVGLSADSHGAAASLSGSF

SEQ ID NO: 15461 - protein, 472 aa, Myxococcus xanthus
MMRALFVLLLATSASAASPRTLRVDYFHTGNATEERFSLDKVVIEPLPWPGHPERAIDETNLGKYLFEVRGRENNRLLFSRGFASIYGEWEVTNEARSSNRTFHESLRFPAPERPVQVLLKKRDAQNAFREVWSLVVDPKDMFVDASSPPAPGPLLKLLENGPSAQKVDLLILGDGYTKAEHAKFEKDARHMVDILFTFSPFKERKSDFNVWGLVPAAAQSGISRPSTGVHRRSPIGATYDAFGSERYVLTFDNKAFREAAAFAPYEFVEILVNGNTYGGGGIFGLYGTVASDSLWAPYVFVHEFGHHFAGLADEYYTSESVYAPAADRLEPWEKNVTALHSPEGLKWKHLVSPGTPLPTPWNKEGYEKHATAVQKQRGHIRAQRKPESDMDKLFLAQRDWEEKFLSSQKYSGRVGAFEGAMYESKGYYRPQVDCVMFTRDRVPFCAVCQSAISEVIDLYSGPPAMSPQANP

SEQ ID NO: 15462 - protein, 595 aa, Myxococcus xanthus
ATVLKGAGYQTALAETAADAQRELEKRRPDLVVLRAELKDQSGFVLCGNIKKGKWGQNLKVLLLSSESGVDGLAQHRQTPQAADGYLAIPFEMGELAALSHGIVPPGTDDTGASLDAALNGTREAPPPMPPSLKAAAGGPPKLPKRERRSAMTEEDRAFLDRTFQSIADRKAELLAESRQLKRPPPRRELMGTPEGKIQILRDELKTREAQLARLSEIWNVRERELLSGEDRIHEKDVELQGLKMQVDDLLRRFNEAQQATIQKEREHGATVDDLLLQKFSAEKDLIEVVASKEKDINLLRREVSRAEEELSRRAGELEHGRNEYDKLEKHLGVVTLEFEVKEQKLQDTVLANEGEIARLTKRGDDFEAELNRTISERDQRFAELDGEIQALQERLQQTEQERDTTVRGLEARAARAEEHGTQADAEIHRLNAERDALEAKLSQQVADLEADLARTMGERDQLRLDKDAQEAELTQRIEERDAKLGTLERELSETIARNEHTEAELNANIQQQLERIGELEGEVEAVKTHLEDRENELTAELQALGQAKDELETDLNDRLQALSQAKDALEADLSRQLEELRSAKAELEADPESI

SEQ ID NO: 15463 - protein, 261 aa, Myxococcus xanthus
ERELDFTVEARGFYIQGLPSGRTYRVEAHFVGRDGRSCRIGASSNRVTLPPAGVSTDLTVRFLRVPPLEAALPAAVVEAPPEEEREYVSWRRVNLPGSGGVLDVPEVHRERRGRDMTEAHLEGPARAPGASDQQYVESVERVPGASDQRYADSVGRAAGASDQRYLSVAALRNAREVRGPVTAPVSHYLETLGRAPGASDMRHAEGDAHEAGRGPGPRAYLDVKGVPGASDLRYAEGGAARQAGRDTSPHRYLDMKGHFRA

SEQ ID NO: 15464 - protein, 211 aa, Myxococcus xanthus
CRIPIPLLADFEMPAEEIAEGIAQASRFAEADPYRAATHNKGVMNGIDSVAIATGQDWRAIEAGAHAFACRNGQYRPLSTWYLEEGHLVGRIELPMALGTVGGPIKIHPGVQMALKLMQTTSVRELAMVFAAVGLAQNFAALRALGSVGIQKGHMAMHTRCVAVTAGARGDWVEKIANLLVKAGHVKVEKARELLASLPAEDAAAATGTTV

SEQ ID NO: 15465 - protein, 182 aa, Myxococcus xanthus
MEQEFHGTPSGVDHTTSAAEQLVLYWRKPGAAKGTGQVVESPRPLHVVVTLAGERSPTKKTVGALRERQARWPSRYERLFAEIGRVSSEGAKAVAAGDLEALGDAMNVNQGLLAALGLSSPPLEEMVYRLRELGALGAKLTGAGGDGGAVIGLFLEPKPVVTKLTRMGVRCFSSQLAGPRAS

SEQ ID NO: 15466 - protein, 328 aa, Myxococcus xanthus
MKATALAHPNIALVKYWGKRDDALILPHQSSLSLTLSPLSVTTTVEFGAASDQVELNGHTAKGSERDRVLRLLELVRAQAKADLGPAKVVSRGDFPMAAGLASSAAGFAALAVAGRAAAGLPSEPRAASILARMGSGSACRSVQGGFCEWQRGERPDGEDSFAVQRFDAAHWPDVRMVVAILDRGEKEVKSRDGMKLTVDTSPYYPAWVKDAEVEVVQVREHIARRDLQALGELCERNAWRMHATSFAANPPLSYMSPGTLALILHLKEQRKKGIPVWFTLDAGPNPVLLTDAAHEVAAEALARACGALDVIRCVPGGDAELKAEHLF

SEQ ID NO: 15467 - protein, 921 aa, Myxococcus xanthus
MGKTYEALGVLAARLHVLPDARALILTPGPDLNTKWSKELRAFCDTSRPMYRGFAGQSKTASTLAELVAATRETRITIAPVNIFAGSRSLADQAWLLSLWADAQGLAGNQVAAIFRRYREGAVARVDVEQQAFLDTFEWSVIRPHVREALKRHKQRAGEGSLDALWKSEEYDGFANQRWVDDALMDLRFRLVGQLIPDFDLLIVDEAHKLKNVDSVRATGVRTVFEGRFDKALFLTATPFQLSVDELKQVLSLFALARSAPADLMEQAQRLLDDVGDYKQAYNELERVWSQADEAVVSDFGALFARDPQLVEEPADASLRAVVLCARRLLSLKTERIEPGFRRWMIRSLREDKRVYRRSHRPRLRAQGGAGVPFMLYERFIAELFRGKSRTHKAAVQINMVSSYGAAREGALLSSERQALPDGDAEAYRGLLRSVVGELRVEQGGHPKVDHVVRDALEAVARDEKTLIFCARIETLRELKRRIEAEWEHHLLERWRKVFPAASHGDIFEHELDGKRVDGHHSRLRDRFGRAQDALYLALRERYTGTLLEGVVVEGAHLELVIERANGLLRQQRVSKTQAERMDWSLVKRCVEQAVALFVRDGVLAGDVDPEVLRRLTDARFVALGFDLVADDVEDSAEGDRTPSWTIDAGDAALVLRREHLWSYLKGALFEVPPELRVRTVERLASYLVARNVPFLPELLAFAKEQGVDVEAVESRALSSVVDRFWTTPRGRPWFELLKRFLIYAGKLDEERRREVLDDAVRAGALVRHTVEGESRERLREAFNTPLYPMVLVANEVMQEGLDLHHHCRRVVHHDLAWNPAQLEQRVGRVDRLGSLVQRLRARQPDTTLDVHLPLIANTIDERLERTVRLRERWLEFLLGAAPRIEEYGLADDPLKPLPDAFAQALRVELGPVAKARLPDG

SEQ ID NO: 15468 - protein, 409 aa, Myxococcus xanthus
MERALSAPGKLFLSGEYAVLWGGVARLAAVAPRTAAYVRRRADARVHVCLEEGTLAGSTTPLGVRWEREVPAGFAFVARALDEALRAHGRASQGFDLAVAPSAVGPNGQKLGMGGSACATVLAAEGARYVLEERYDALKLALLAHTQGQGGKGSGGDVATSFAGGVLRYRRYDVAPLIEASNTGRLRAALAESPSVDVWRLPSPRVSMAYAFTGESASTRVLIGQVEAPLEEAGRRSFVERSDTLGHAIEDGLSGGDFRGLLGGREGAARPAAGVGAAGDGRHAPRAGAGGHVRRRRQAVRCGRRGRLHPVRAGCAGPCGDVQGIGSPGLPHPAAGRRVWRARRGSGGGPSPDLGARAELSAFLLGLSAIWRATPGVYALEPGCFLRTAWAVNILGMGSLSAVWFSRKK

SEQ ID NO: 15469 - protein, 51 aa, Myxococcus xanthus
MAAVIRMLDELLAIIVQSMSAAGKMSFMAGVLVPEEDRVKYSAVTGLRWNT

SEQ ID NO: 15470 - protein, 59 aa, Myxococcus xanthus
MLYTFAASLELRTPTSERWIVQTERLEEANHGRVYLELSKGDHAEAMRGMALLNAVLPR

SEQ ID NO: 15471 - protein, 113 aa, Myxococcus xanthus
MSRPIVIVESPYAGDIERNVAYARAALSDCLRRGEAPYASHLLYTQPGVLRDEVPEERNHGIEAGFEFRRVAQATVVYTDLGYSEGMKLGIRHAEALGHPIEYRSLPGWATQA

SEQ ID NO: 15472 - protein, 92 aa, Myxococcus xanthus
MVGQRTARHGIPQPYIEVRFPKDTRQRTLDAALHRLYADIELATPESESWDVRIEQLPDVFSFSGGRVYLELAEGTPVEAERAMALLKRLVG

SEQ ID NO: 15473 - protein, 144 aa, Myxococcus xanthus
MPNRYDSSRYHGLNLNSLFFRGTIEFRYFNGSVHAGEVKAYVQLVLALAARALASKAASSKRRDFNPATAKYDFRVFLLHLGLIGEEFKTARLHLLKKLEGSAAWKGQRRDRRGSGGGEDGSTGSEGTQGGAGGSAPTEALAAA

SEQ ID NO: 15474 - protein, 146 aa, Myxococcus xanthus
MLYFAYGSNLDRAQMRARCPGATVEARATLSGHTLVFGGFSHRWGGAVANLQRVRGAHVEGLLYRLTPEDLRALDVFEGHPFAYRRAIRLVTDRAGHRRRALVYLQPEGRFESWPPAVRYFRVLWHAYGRLGFNRAALSGALGGAA

SEQ ID NO: 15475 - protein, 59 aa, Myxococcus xanthus
MLAALDRLESHPRFYRRTPITLDDVGRVEAYLFPKERLAGRPIIESGCWRRHLQERKPW

SEQ ID NO: 15476 - protein, 59 aa, Myxococcus xanthus
MQDIAFGVERLSLGEYIDWVVGNAQRFESVALRVQGETDEEKAASLVDEMLREGLATKG

SEQ ID NO: 15477 - protein, 124 aa, Myxococcus xanthus
MRRLAEAGRQAALGMGGYNSQGLCATGVSRAIQNAFGIKVWGNGNQIDNNLPRDKFKQVNMSLEQALKIPGLVLTWESTSTRLGSIYGHTAITTGDGHSSASDFIERNTTNSGRTGFKVFMPLI

SEQ ID NO: 15478 - protein, 287 aa, Myxococcus xanthus
MRLAPEGAEVASTEQELFGTPRERSVRLRTGVTLRYVEQGLPLGPAVVFLHGFSDSNHTWDLNLRTFPRNHHVYVLDQRGHGDSTRPACCYTQQSFAADVDAFLEAVGERSAILVGHSMGSFIAQQVALDFPRRVKGLVLVGSAPTVAGNPVALELKSIVDTFEGTVDPEFIRAFQESTFVRPVPASYINTMVSESSKVPARVWQDALDGLLAEDHSARLNHIRVPVLVIGGDQDGFFSVADQQALVDALPDAEFKLYPNTGHAPHAEQPRRFNQDVHRFLREVTRW

SEQ ID NO: 15479 - protein, 171 aa, Myxococcus xanthus
MRLDKHALLGQLADRLQQSDRLAHRAEAEAREAARSLATESEKKEDGRAALEFGSLATGQAQRARRVQEELQALTKFGQAEVPRFPRQGPVALGAIVDVSTEDEEGFSERTFFVLPAGAGTELTGPGGDGFLSVITPASPVGRALMGRKAGDTVEVMLAGEVREWTVLEVA

SEQ ID NO: 15480 - protein, 499 aa, Myxococcus xanthus
FGVLMTYVPYEFRVASFRPLYPYVRMLGLTYLTGSIMLMGALLYPRAPRWLDVTGRLLLGAAMALYWWVLNVLPGSFTGIILYPVLFGGVVLEAWPAMRQRPVLRTFAALTGAAFGVAMLVVPERFPLSVYAHLAPLRPLVGLLFAVCGVGLLLPSHWLHRRLPALFMGGLAVPFALLAYALGRGASWLGASVYAVLTLACVAQALDWRPRAPRTVGWKLLRGLAFAGLVPLLALGGLAAYLAQNAIEQQVRDDTQRAAAGEADFLRRYLDDAGESLALMLESPGFRAAFAAAAPERLEPYLVNLAAQERAFDAALAVDTQGHILAASPSVEGWNLEPRDFLPPAFTRGAEVSPPFIRPPGQPLVAVTQPFREDGEVRGMLVGLLSLERLSQATTPASRRFHVQVLDRRGLKVLRDTAPGAPLLGEAHLPDALSLKLLHPGIGVLEAFDAEDRRILAAESSRARHRVERAGDSRAGAGLLDDYAHLRQRGGARAAKSPH

SEQ ID NO: 15481 - protein, 285 aa, Myxococcus xanthus
DRSAREGLAQAVREHERFLWGLCYRMTGVSADAEDLVQETFVRALASPPARTEALRPWLTRVAVNLARDTLRRRKREGYVGPWLPSPLDTGEEELPPPGVEARLPGGGSTEGRYALLESVSFAFLLALEVLSPKQRAVLLLRDVFDYSVREVAEALNLRESNVKVVHHRARAAMAAYDRARCLPTREFQARARAALEGFLGALLTGDVAAAEALLASDVCALSDGGGQYRAARVPVLGQSRVLLLYRRLMEMRGAPSAVELRMLIGLPAVVDVFPPPQRDPQAGT

SEQ ID NO: 15482 - protein, 366 aa, Myxococcus xanthus
MRVLGELGVKPAGGMPGAGSYLLSGGRLHTMPRGLVSLLTTDALGLPGKLELAKLLAGLGRVDLAPLANITTRDWVEQHLSNADARAFILALVRVMTYCADVDAMSAQSAVAQLQAKPAVLYVDGGWSTLVSELETRARDAGTRLELSARVSAVLLADTGARVRGVRLADGTEHAADAVVVAGGPGDIAALLPADALLAHDAARAVPVMAATLELGLSRLPRPDALFALGTDGPWYASVHSAVAKLAPEGGAMVHVMQYLGGRGPEASEARLEEVMDALQPGWRTSVVARRYRPSLLVSHWLPTAETGGLRGRPSVEVPHVPGLYRVGDWVGPEGLLAEASFASAESVARALVPGQQVASRRAVGR

SEQ ID NO: 15483 - protein, 304 aa, Myxococcus xanthus
MSRTAGFLIVALSGVCFGALGLFGRLAYAAGTDVATLLFLRFSIAGAVLASVMVLRRQRWPRGGVLVVLMLLGAAGYFSQSGVYFFALQHAPAGLVALLLYSFPALVALVQRVVFKEHLGRVKWLAVVLSVGGTVLTADLSQGGATLPGVLLGLLSALFYTVYVVASGRVSGRAGPLASSTVILCSAGFSFGVAMLVRGPAFPGSVTGWAAVVGLALVATVAAVLLFFVGIQRIGPVNTSLVSNLEPLTAVVLGALFLDERLTPRQVLGGVLILGAAVMLARADVPRASPEPPAGGGAPGAVPG

SEQ ID NO: 15484 - protein, 93 aa, Myxococcus xanthus
MTPQELSEKARQLVAEGAVLLDVRTPQEFQEGHPEPARNIPVQELPRRLAEVGPPGTPVVVYCAAGGRSAQAVQLLRANGFPDVFDLKSVKNW

SEQ ID NO: 15485 - protein, 750 aa, Myxococcus xanthus
RPELRSTNEELQEKAKLLSVQKTEVERKNGEVEQAKLALEEKAEQLSLTSKYKSEFLANMSHELRTPLNSLLILSQTLSDNVDGNLTSRQVEFAKTIHASGADLLELINDILDLSKIESGTMAVDVGPLRFGDLREFVDRTFRQVADKKGLEFHIGLGDSLPGELETDAKRLQQVLKNLLSNAFKFTESGSVSLHIGLAKGGWSPDHAMLSSAPSVVAFTVADTGIGIPKDKHQIIFEAFQQADGSTARKYGGTGLGLSISREIARLLGGEIRLESDVGRGSAFTLYLPLAFMAERPPEEHARWDYNPLATTVLPAPIAEPVSESRVSSLSRMDIDDDRSSILPGDKVLLAVTHLADHAARLRAAAQGTGFKLLVSTEVEDALDAVRNTRPAAVAVDLDLPEMAGWVVLDRLKHDASTRALPVYTVSVEDHRERSLNLGAIGHLRAAADPEAAVAALESLKRFVERKGRGLLVVEDDPVHRQTLTELLGSDDVQTVAVGTAAEALAALAERRFDCMVLDLGLPDMPGTELIRRVHEAHGAGGPPLIVYTGRELTRAQETELRRVAEAIVVKDAQSPERLLEETSLFLHRSPSDLTEPKRRMLEKAREKDPLLVNRKVLVVDDDVRNIFALNTVLERYGMKVAFAESAREGLDQLEKDADIELVLMDVMMPEMDGYQAMRAIRRMERFVHLPILALTAKAMKGDREKCLEAGASDYITKPVDIEKLLSLLRVWLHAPRGMPPRGSRTEVSG

SEQ ID NO: 15486 - protein, 278 aa, Myxococcus xanthus
MTGPGARGAELEALEVDLLLEGVARQWGFDLRSRSRPQLLRRLRHHLREERLDSFSALQARVLHDAEALDALLRTLSCTPPALFAEAAFFRDFRTRVVPVLRTWPSVRVWHAGCGTGEDTYALAILLHEEGLWGKCRLYASDASEGLLADARTGVLPLPTQEDAQRYLEAGGKGALSDYYTRDGNWALLQPRLRDGIFFTQHNLATDGSFNEFHVIVCRDTLLTFNRALHDHIHGRLFESLARFGFLCLGRKESLARTPHAGAYEMLDDCGRIFRRVA

SEQ ID NO: 15487 - protein, 185 aa, Myxococcus xanthus
MNPLGLLVVGAPRCAAADVESVLALLPPHLPVPVALALHRGPLDALAAPLGRRCALPVVEPDDKDPLLPGAVYLAPAGYHLLVDRGCVSLSVEPPEHGQRPGLDALFESAADSHGPRAAGLLFAGHEDGVAGLQVLHARGARVAVVSTLQTGGAGEEGAMAQLTLGSVGGWLARLAYVPRSKVLP

SEQ ID NO: 15488 - protein, 141 aa, Myxococcus xanthus
MNWGTLSGYGDPVDWLDAFYSAYRAANGNRDPHIDYLGFHWYDYGLDYNLDRLTKYGKPFWVTEFANCHSQPDGAQIDSVAKQRVQMTEMVAVCERREDVFRYAWFTGRWTNDPCFASLLGAAGTLTELGEHYVSLPTGAP

SEQ ID NO: 15489 - protein, 308 aa, Myxococcus xanthus
MPDMDGFETAQLIRERERSRGTPVIFLTGLSRGPHPELRGYAMGAVDFLLKPFEPAILRSKVSVFVELYRKTELVRRQAEALREAQQREHARELLEAQRRVEAERLRSETNRNQQRWLEAAIAALPMPLALVEPGSGHTLLANRAAQGLAGGCLAYREARALHADACFRGADGRLLADEDLPLMRAARGEVFQAFPVEWNVGGQRGSVLASSERLPRMHGRPETMVLGLLDVTALRAAARHDWLPLPLTEHIATLEAQGEDTGPLTRLIEVLRNLPGLSTGSPGQEREEGSLLAEEGSQAGNPPRPAR

SEQ ID NO: 15490 - protein, 68 aa, Myxococcus xanthus
MLVSDGASPPSYRYGPESSEDVQAVTELAAVYSAKRVSVISFIFSRPLDKVRGFAEAFILKKDKDGHG

SEQ ID NO: 15491 - protein, 86 aa, Myxococcus xanthus
MAEAVYILCALTSVACAVLLLRAYKRTGMRLLLWSGLCFVGLVVSNVLLFVDLVLLPATIDLYMPRAIATLSSASVLLYGLIWDAS

SEQ ID NO: 15492 - protein, 79 aa, Myxococcus xanthus
MAWLASALFFLRFWVQSKDRLFAFFALAFTMLAGNSVVAALLDVDDERRHYIYVVRLFAFLLILYAIWDKNRANRHGSG

SEQ ID NO: 15493 - protein, 156 aa, Myxococcus xanthus
SRRPSSSSRPASVDEREPERSVSTEPDAVCPPRGLESQVGGGGAGNAVRLRGSDDAEERLAFLASAGELLSSSLDSGTVLKRLAELAVPLLADWCAVDVLTADGRVERVAAAHRLAEQVPLVHELARLQPLDLTAEGGIPEVLRTGKAALLPFRAL

SEQ ID NO: 15494 - protein, 53 aa, Myxococcus xanthus
DDLKRLFAGREAQVIPTATRSVLEAGPDTAALRQALERHLAPARAFRATARPS

SEQ ID NO: 15495 - protein, 296 aa, Myxococcus xanthus
MGVPPLWVLDVPGLRPLLPQRLPPGSSMETLYREAVKTRLENKKPAADPAVVDRAQKALRMGAKDAPVAAMYLREVGVLPLFRFSAAQVLKGALREEVEVDDLTGSIDPRTTGALLELRLTHEVVEHLQEARRRLAATQLYTSLLEAGFNPENNWDEALESSDASMELAQLATGEDRNALLEGFQVFAALPDEARLRRLAYLAESVTNLELVSRLPEGMEPSWLTGPETRECHEREMTYVQSLKAEEIPAKVAALAKEELGVPEGEVPEESDGDLFVHLRCDVCGKEKLIVQSPEE

SEQ ID NO: 15496 - protein, 587 aa, Myxococcus xanthus
MISQEEHDTANAEEVKVYPVEDVFHEFAPYFVEQVRKDVVDRYGNPVLLKAGLKVFTTMDSERQRAAQDAVLHGLLSVDKRQGWRGPVEQLASKEAIRAFVDRSKKLMGAKELVENRLYVAVVTSIDGDGKGADVQVGGHTGRLPLLGMRWARKVNPEGYYPAMMITSVKKAISEGDVVVVRHVTKRDLTDDKEQWDKKLADEIPSEGVKLFRLEQTPEAQSALVSIDPHRQYLTAMVGGYDFDDNEFNRAFQACRQPGSSFKPFVYSAALEQLNWTQATVLVDSPIVEHDPDTKVSWKPANYSDKFEGEVLLRTSLVNSLNVPAVKTFGAVGVKNMAAWTTKLGITTPMNMDFSAALGSSCVYPVDLANAYATFNRYGRKKPTYFIRKIEDRWGRTLEDHTAFDDAWAPLQDRVAAGYARLFEPGEQVMSPEAGFILTHLLRGVVLQGTGGPAQRLGKPAAGKTGTTNDSFDAWFAGYTRDLVTVAWVGYDLNPHPLGRYETGGRAALPIWLNYMKSALEGRPQSEFYPWQSMDLVRLHIDKKTGKIAPAGSRDSELMFFKKGTEPKDAVPDKNTVDVDQFMMGAQ

SEQ ID NO: 15497 - protein, 318 aa, Myxococcus xanthus
MIEYRIEADTAGMRLDKHLRKRLPNVPVSHLFKMIRTKKVRVNGKRAQPEQLLSEGDVLTIRGDEQQLVGAERPKVDPPPPPVDPSRLVILREDDWLMAVDKPSGMAVHTGSGITGGTLVDYVRAYLGPKAVRNDFAASPAHRLDRETSGVILVAKRRPAMVHFTEVFTHGLSRKRYLTLVKGKMPRDSGVIDLPLSEHQQTAESKARRGVNMQAAVTRWKVVKQSSEAALLSCAIETGRTHQIRRHLAAIGHPVAGDKKYGDFAFNRDVRARWGLKRLFLHAERIEFPHPEGGAKVAVEAPLAVELRDVLKRAALVP

SEQ ID NO: 15498 - protein, 197 aa, Myxococcus xanthus
MARKTPQWEGRIVRVLVCTERKSFVTKELPEARVSFEGLEGDRHAGLTRAADVRTPWFPKGTPIRNTRQFSLVSSEELAQVAETLGIPRVLASWLGANLEVAGVPRLTHLPPGTRLFFPEDTTLVVEGENEPCIGPGRVIEAHHPDVQKLASRFVKAAWQRRGLVAWVERPGIIRAGDTVKVVLPRPVTYVLPSSGV

SEQ ID NO: 15499 - protein, 316 aa, Myxococcus xanthus
MHLTGTPLSLDAKRKSPLCFVSHGHSDHIARHESTIATAATLRFMTHRLGPVREPREVPFRQPFELGPLVLELLPAGHILGSAQLRVTRPDGRRIVYTGDLNVAPSLTAEATEVAECDTLVIESTFGHPRYRFPPRPEVLGQVETWLRMQLERGAVPVLLGYPLGKSQEAMKHLAGRGFPLVAHSSIYEVAQLYAELGVPIENLRCYDGKVEPGEVLFFPPHHARGGALAPLWPRATAVLTGWAVDRGAVRRYGADVAFPLSDHADFPGLVSYAKSTGAREVLTCHGFAEELAQALRDAGMDARPLGGKPQQLGLF

SEQ ID NO: 15500 - protein, 306 aa, Myxococcus xanthus
MLGGGTEPSSRSQRLRADGALALITSFWGITFVVVKDALGHGDPFSFLTLRFIVGAVVLSVLAGRQVLIARNLRIGSMLGTFLFLGFSLQTVGLTTTTPSRSAFITGLCVLLVPLLSMVLYRKAPKFTSLLGVGVAAVGLYFFTQPDGGLGSGGLSSGDVLSLGGAVAYACHILMTERHAPKQGVMGLVAVQLWTVALLSALCLPFVERRVAWHPSFVGAVLVCGVFASAVAISLQTWGQARTTAVRAALIYSLESVFAALYSVLLGYETLGPREWLGGALILSGVLMSEVGAAAWVWWRARAPAR

SEQ ID NO: 15501 - protein, 392 aa, Myxococcus xanthus
MSEPLGFNNTYALGMKEAEAERLGIRRISDLRAHPSLRFGFSNEFMDRADGWPALRDSYRLPQRDVRGLDHDLAYRGMESGSLQLTDLYSTDAEIEAYGLRVLEDDLRHFPAYDAVLLYRDDLEARAPEALAAMLRLEGHVSEADMVKLNALARLERVSEGRVASGFLATALGVTSEVRGDGLASRVWKRTREHLFLVGVSLLAAMALAVPLGVLAARRPRLGRGVLGLTGVIQTVPSLALLVVMIPLLGIGSRPAIAALFLYSLLPIVRNTAAGLAGIPPEVRESAEALGLPALARLWRIELPMAAPSILAGIQTAAVINVGTATLGALVGAGGYGQPILTGIRLDDVRLILEGAIPAAALALLASGLFDAVERVVVPRGLRLGTAVRSTR

SEQ ID NO: 15502 - protein, 560 aa, Myxococcus xanthus
MDIKGEQRPIQKVFCDDFVLRVPHYQRPYAWKLENAQELLSDLLAFMGGGSTKVDELPPYFLGSIVLVKDDAWPEAEVIDGQQRLTTLTILLAALRASTGAAFGSDLTKYLYQPGSLVEGTPDQYRLRLRDRDAEFFREFVQAVDGPAKLKALTREIPDAQQRIRENALLFLRELDALPVERRQRLASYLVRRCYLVVVSTPDADSAYRIFSVLNDRGLDLSHADILKADIVGKIDGEALQKAYATKWEEVEEEIGRDAFKDLFGHLRMIHRRAKLEGTVLAEFRKYVVDKAPEPRKLVDDVIVAGAWAYDQIRRCSWDGQSDDATQAKIEELLEWLNRLDNEDWVPPAIRVMQLSADATKVLRHLEALERLAAFLLIKRSNVNERIHRYANVLEAIENGTAIDAGGPLLLSTDEEKQLVDALDGEVYLEQKVRVYVLLRLDRALGDKGAKYDVDTITVEHVLPQNPRDKSEWLTNFPRPEDRAWTHRIVNLLLLPRRKNSEASNWDFGEKKMRFFTSKKGVSTFALTWQVLKEYAWTPDVEARHQTEAIDTLKKVWSVM

SEQ ID NO: 15503 - protein, 71 aa, Myxococcus xanthus
MAGSQVAAEADAPDVDDAHNTNLPEWKRRCIATYCECKDDDWQGSCYACFRYCEGQQEWPINKCRPRRGKR

SEQ ID NO: 15504 - protein, 219 aa, Myxococcus xanthus
MMTEALVGAGIVLLKYVADNASVGRALWMGVHLVNTFLLVGAQTLVIWFSRGRAPLSLRGQGLPGALMGLSILGLLVLGVSGAIAALGDTLFPSTTLAEGLRQDISETAHILIKLRVLHPLLAVSVGAFLVLASRWVARVRPSEDVRRAASAITVLYAVQLGAGVTNLLLLAPVWMQLVHLLLADFVWMAVVVLCAAGLAADAPRVVAEASPASSAEPV

SEQ ID NO: 15505 - protein, 384 aa, Myxococcus xanthus
MPTGLADLVGVGLNCRVSVEAGVMWRYDDATNTPNPQTPYYPMPLVTAFSLSDFSVDCSGTAITLKVQTVVPLSPTQLRVTFEPGIDPVTLVDVETQFTFGDSVLTVSDYTLDEKTLVLTTTAQEPGTQYTLSVDPSVKSYTGVSVSGTATFKGYRVPALLVINEVNPNITTGVSATNNRDLIELKAVTAGAIEGITLTEEATSVSRLATLPDVTVAAGDLIVIHFRPNSAELAAGNDTLSKDEKTYETFYPGAWDVVTGTSSHPTFNDRLLRLANPQGDTQDVVAFSHKSMTAARPPNYPVVLRAAQEEGHWSPVDCRGETATPVPCAYDSAPLTALDVSVDWGVVEENTQSVSRYQGADTHSMVDWAFSETSSFGEENPARP

SEQ ID NO: 15506 - protein, 1670 aa, Myxococcus xanthus
MQCPNCALGTMRDLSVTPPRCLECGAVLVPAPPITPPFHGSIETEVERLESGDYDDVLDDFLDDEEPYRLSSNEMRDETLRASLVTDDISPPESPPSNTMGDDVAEERCVPLGSETTVSDKPVVPPSFPLRTLLWNIADLGGGPSGTLPVRKPWTIAALAHVIRTANADIVTILELKKKGGIRLVEPKPPVQMKQHTGRGGSGTKLPVLMRMASAFVEPNGYQVKTAPDTLVGQIAEQEAGLLNDLAKYFAEHVRRTIWPRDEQDTGAEAWDPSHIEWSETSQALGADKLGIIEGRLDAAWAACEPDLVNRFGRPPVKKAKGEDGEEDEEPPEALVATSIDVHGKKKAKLDAYCLLCVRLLVEEGYYDWLQPHENRYSSTEKDSKKGGAEAKEKAKRDDLAKLGVALLREHCGILFHRYLAVIAGLDAEDVPARQEQVLENILHRSNDAHLQRVYKKKLAEYLERKSEVEDAPESHAGLREFLRIRDALNDQCKARGEEVYASWPAEVPDKPVKGLYTQDEAYGVLWRKSKLDVDESAISYLSAYVAKRSPGGESSSMDIDTTMGDEAEEEQAQTVKSLYSKREPIRIPVRLAQVRNAPEVSVVAWHPPAPGDRNKNARGTDFRAFLQYCKDERREKVLGVVLSDLNIDTARPKAELAKDGTPYIDTCVERLSFHQFFQTLLGPGADASHLYAMAPQLSTIAKSKFGSWAVDSEKAFGDGSLKTLRSFVNSRVKPEMFAPFKMSTGHELRPMFSSAEDVLAHIESFITPPQQRYGASGYDKILVYSRRTDGWMLEQSSVYVIPFPMALADEKEKGLFFIHGDLLPRHLQPFWRLIQLEDAKLPEDKRLFDHLRAPGVKLTGSEDARWEEVMAAAKKLSDHMPLVSDLRLIYSGEEALVVEEVEVTTETGSSELGHLAALCAAYQKSQATDDEATEALGAILDAAEKVPASDHARSNALVAEAMQWRETFAALRSAGFDREAYWDHRPALESEMGTDQGGGQGISLDSYLGSIHQGRVHNAGGGDCLFRSLSQLFFGTEAHHREVRQAVVNHLEDLLAGQSLDDGGMVGPATAATFRQDMGLLLDWHREAWPHEPAYRRVAGMDPWRQYLRAMSRDRVWGDHVVLAAASHLFQVRFEMFARTGATSYWTDLVDFVPRTEGHAARPLLRLANLGNAHYEAVGPTDAPLPAAAAFPAELAALSERRRRDEGPTPPPGSKTVESPRSAATSTKSATATSAPPTVGPVCKWPHTCYFQFDTPTHHPHALFLFGENAVAKKARYPQPDTQAVIRMNSNALGIRTCWVPGKGMEDADLAKNQQAIDEDCAEAVQLLKSGKYTTLVVPWNHSRGHVDIGTGVARLPGNAPKTWAYLTKKIDELIGWANQHLGTVLVVPQVNVLVPAVVRQQASDLHVQEVSDVMSQSASMGDDSSTSVLWQPNVVSLRTLLFSGATSPETGLLSDKDYEKNKAMFDEDLDVLTQKVESGQYRRLVLERDDEGRIVLGTELGKLDKHAPRTLDYLRERLEALCRRCTEVHVKSATWKGQVVEESQYLDFLSAGDGRTSSEGIKRKKPGVVVEGWDDDDVTQAMDPAAWGTSAFSNSGFSGGAPSSQSFSGSGQVAPSNHKKRKFLGPPASAEENEEVQLMNGDDVPPPPPVWEEGDEADPKKQKKGPTG

SEQ ID NO: 15507 - protein, 136 aa, Myxococcus xanthus
VLRYGSHHPRAHQPYLLKVWLDDEEELPAREGMTDAEGRMAQVLPARAARGEVTVSPGRDDERKVTLRFAALRATSAPEGLQERLENLGFSCGGERGQFGPKTRLAVEWFQYALGLPLSGEADEATCAALGLLHRS

SEQ ID NO: 15508 - protein, 231 aa, Myxococcus xanthus
ALRLARSYQEGQARIDGFLEDYGDLASGLTALYQATFDVKYLEAADALVRRAVDLFWDAEKAAYLTAPRGQRDLVVATYGLFDNAFPSGASTLTEAQVELAALTGDKQHLELPERYVARMHDGLVRNTMGYGYLGLAADALLEGAASVTVAGASDDVAPLRAAMDRAFAPTVALAWKAPGQPVPALLQGTFEGREPVKGRAAAYLCRGFVCELPVTEPDVLTQRLAALTGP

SEQ ID NO: 15509 - protein, 57 aa, Myxococcus xanthus
HRAFDWQPFVKQHWEKAPARLALPGPILPVDQVFQAAISACAPFRHGTRFRALPDAR

SEQ ID NO: 15510 - protein, 431 aa, Myxococcus xanthus
MRIRDPIHGTIAVSDPEKAVIDSRHYQRLRYVRQLGFGDLAFPGATHTRHIHSLGAMHVASRVFGAVAARSSLPEDVRERFCAAVRLAVLCHDLGHMPLSHASERIAPKRSLLRLPSWLDGTAEGELATHEDYTAKILLDSSLTPIIEKHFGGMGITPMAAVALVSGAKPPKDPGFTHQGVDWTPLLRAIVSGELDADRMDYLLRDSFYTGVNYGRYDMDWIVSNLNPAMKDGRAYLALSRAAAFAFEDFLLSRYHMFVSVYLHHTSVNFDYMLRRYYEESPGEFEIPSDPEEFLLCDDSALWYTLRRSKNPWAQRISQRQGYKLLAQFTERDTGYDLDVLRSALVSHKFDHYVVESQNVLSKYTSGPSGRGPSLYIIDASTGRLTEVARYTPLYQRYSGAVRLVRLYVRPDQADKAHALMGRVLGQAVES

SEQ ID NO: 15511 - protein, 509 aa, Myxococcus xanthus
MSERLPSLGLGLDLLAHSPVEARPSSVALLYRRAGEGVEVFWVKRGKALRFAGGFYAFPGGKLDAADADVPVAGASGEEAALRSAAARELFEETGVLVAHGAEALSAAKVASLRKALLDGTLGWGALLKAEGLSLSADDFRAAGRWVTPPSLPVRFDTRFYLVEMPAHARAEWWPGELAEGAWVKPADALARWGDGTALLHPPAVHAFQVLGTFTDASDVLARLASPPFCPGYVSQRIEFQQGVRVVALETPTLPPAAHTNAYVLGNGELLIVDPGAADVKQYAKLLSLVSGLKAEGLRPVAVVLTHHHGDHVGGARAVKERLGIPLWCHARTADRLDFPAERLLEDGDVLELAGEVPQRWRVLHTPGHAQGHVCLVDERSRSAVVGDMVAGVGTIVIDPPEGHMRDYLTQLARLRDWPVSTLYPAHGSPIPDGPAKLQEYLDHRAAREALILQSVPPNGATLAQVVSLAYADTPPLLHPLAERSALATLEKLVEEGLVREESLQYFRA

SEQ ID NO: 15512 - protein, 499 aa, Myxococcus xanthus
MTRTHRPTLLALVPLCALLVGAPSALARAPAPAAKATATQAPVSDVVKAARPKGGEFFGLYLMDKKVGWLFTDLEVLPGQPARVKTTNQLVFKAMVGSRVSERMHDEERIYEAKPGGRLLSFVVKQTGDGGTQTLVGTATADGFQVVRKRPGRPDETLPKRPPTKERVEDADPPRVALLRKAKVTGFSLDGMDLESYGLSTTVEPEEQRTINGVQVKLGKAVTVSEKEKVPVVSYITQRGEMVLVDYGTTMQARKETEAVAKRLDLVEVFGLTRVVLPKPLPESARTVPGHVTLVVQGLPAKFQQQTYRQQFKPQADGSVEVTLSAAAPKARKPLPLKDPEGGENLKSTLVVESDAPAIRELAKQIVGTDKDAYRIAQKVNTWVYSNLEKDYGASADRATDVLSQKKGDCTEHSLLSVALLRAAGVPARRVDGVIYMMNQDGVPALYWHEWVEAFVGEWTQLDPTFNQVVADATHFAFGKEGNAEITPLIGALKVTAVK

SEQ ID NO: 15513 - protein, 58 aa, Myxococcus xanthus
MEGDLRRRNGRLIRVETSATEAYGPTRGFYASMKYGEEARIRDFYKVGDDLIILTKRL

SEQ ID NO: 15514 - protein, 327 aa, Myxococcus xanthus
MADALNRGDTLAEPLAIEGDRLDFMDTLRRCQPDLVVNLCESLAADSRGEMAIPCLLDVLGLAYTGSSALSLGLALHKPKAKEVLTARGVSTPPFHVVERLEDALAVDLPWPLIVKPAREDASMGVTSESVVHERAALVRACDAVLREFHQPALVEQFIPGREIYVPLLGNRPRQALPLTEIVFGRTFEDRPNIVCYNAKWEAASAEYRDTTSGLCRLDANLESRCVQVALEAFAALDCQDYGRVDLRVSPEGVPYVIDINPNCDLHPSAGFAKAALAAGMDYPALASRLVEVALERAHGHPSHRRKGSGANRRPDSKDRNLLAAGG

SEQ ID NO: 15515 - protein, 221 aa, Myxococcus xanthus
MLSHPNRPILLTLLLPALALAQPTDDAPRMPGPVTATQQRPAVGRPSPAAPRIHPSQDAPFPLGARLVGETVGGALIGASGLAVTFLGGVLVSDQVSCGYSECRSGRNLSLISASIGMGLGAASGVYLGGSLMDARGGFLPTLLGGLVGTAAPLAVVALSDEASWAVLTATFAVPVATSILAFELSHGAYERRRQQERPVVMVPTVSLAPGGGALGLAGRF

SEQ ID NO: 15516 - protein, 376 aa, Myxococcus xanthus
MAPFPIPMSLHSAPTLQASLDSRRNNLDFLRFAAATCVLLSHAFPLGEGKGTVEPLESFTRGQFSLGRLGVAVFLIISGVLITRSWERTPDAARFIWARVLRIFPGLGAMLLLTVGVLGPAFTRLSLGDYFTAPDTALYLLGNFALNWPQWHLPGVFEANAYPHAVNGSLWTLKYEVGFYLLTLGLGLTGLLRKGMVIFGLVGAAVATFVTGRLGFWPELYLYFGGGVALYQWREHVRMSPWVAAACVVGWLITARLGYGCRIATGLLGGYVVLYLAFRPMGALADFGRRGDLSYGVYLYAFPVQQAVTTLLGGPTAWWVNAAVAFPCVLLLAALSWRWVEQPALRRKDRLPAWVRRPAVSVTAVPKTPSRPAGPH

SEQ ID NO: 15517 - protein, 106 aa, Myxococcus xanthus
MGALGGLMSGQEGSTGGMLSALGGVAGQAGDVAAVVSLLGRFNIDASKASLVAPLLLNFLKSRLDPALVGRILSVVPLLAGAGGGGNTPGGGGLGGMLGGLLGGGR

SEQ ID NO: 15518 - protein, 495 aa, Myxococcus xanthus
MITLLVAFFVSLLVALALTRLVRDRALAWGWLDQANSSRKVHVRPIPRLGGVGIVGGFFAPLCALFLVDSGVGYHFRSHTELVVGLFLGGAAIVALGLYDDLRGAGARLKFAVQFAVAFGLYAMGFRIDVIANPFGPELVLGALSLPFTVLWVVGVVNALNLIDGLDGLAGGVAFFGVGTNFILALSRGDVLLSLLLAALAGAILGFLVFNFNPASIFMGDTGSMFLGFVLAAVSIKTSTKSGTAVAMLVPVMALGLPIMDTLLAMVRRSLLGRPMFSADREHIHHRLMSHLVLSHRATVLVLYGLCGLFMLVALALNFANSAQSAMLLCGMGVLIVLLMRRLGYLDLGRARGMHQVRQRNLWLRTMVKDVTRAVRASPSLEVVWNAVRPLADALGLSRQELHFQRVRPTGLADNVVFEAQRPAGSGVPFEVRITLEADGEVLGAMLLVWRDGRAAINRDEELALEQVADAVAEVAGRLRPRADAEPGRLVAMRK

SEQ ID NO: 15519 - protein, 165 aa, Myxococcus xanthus
MVAVATHLHAEGVSFTLTLYGTGNPEAEVLAAFPAGAREHVRVVPRYPRAELPRLLRDEEVLFFPSHSEGFGMALVESMASGLTPVSTPVGVAPQVVRDGETGWLVPMGDVAAQVVALRSLAEDRARLLRLREAAQAAVRDMTWRDIAERTSILYESLLRSPRTV

SEQ ID NO: 15520 - protein, 206 aa, Myxococcus xanthus
MSLIERLRDSRRHEERPSQKASRAARTSSAAPRPTVNRDLRTQLLRLDRIDSTLRSAWVATEFKDRALERKLNALTEAGIDWLRETIKVHGWPGHRLVGRSGAAAAWRLIQHADCSLAFQKRCLKLLRDAAARADVPIQQVAYLTDVVRMREGKKQLYGTKFRKVKGELVPYPIEKEAGVDLRRKEMNLPSLAAYARKIRRTFQPS

SEQ ID NO: 15521 - protein, 542 aa, Myxococcus xanthus
MLFTVTLHIRKVQLIDRPLMPWDFLEWRQVTSLAPTLLPGGGAVAAIGSCLLLVAMLAVMWRAVARGTPRYPLPKAGRRNLALAAVAYLLVIIFQQHLPVRRVFNRFGIYDQVWDQRSNFQMNGLTLMMLWNWEGLRLEPGSEYSQAQVHAALGGPPGVVPAAPQEPVDVVVFMAESLWDPTRLGIPFSEDPLPFVRSLMERHSSGNLISPAFGGGTANAEFELLTGMSSSFAPDGAFPYQHYVMRPVDALPSLFRRAGYQTLAIHPFHAFYWSRDVVYPLLGFDTFQSLTDFTSPRLEGPWVSDEEVVDHILHELSDERQPRFIMAVTMSTHGPYNLPLTGEERIEVQGEKLSPDNRLLLKNYVHKLRQMDSAVERLVRKLEARKRKTLLVLFGDHLPMLGSDYATYREAGYFQEPWTDAQRERMAEVPVVLWTNFPVPRQDIHLSISMLTPRILETAGLRPPGFFAFVSELSKVLPVVRGDLLRNASGEYLPAGDKVPKAQEPGSWEDWMRRYRLLTYDRLAGDNFSAAQPAGTASSEPL

SEQ ID NO: 15522 - protein, 340 aa, Myxococcus xanthus
MREANAVGSRGKAAERDTLECWGGVDLGGTKIEAVVVDRAGTVLGKMRQPTPADGEPGDVVRAIHDALEGAAHAAGLTSRQLLGVGVGAPGAVNANEGTLGHVSNVGRGWSTPYPVAGDLGARVGRPVVLGNDVQVAVAAEYRLGAGRAFRSLLGVWWGTGVGGGLVLDGVPWRGRGAAGEVGHMVVKPGGARCGCGRRGCLEAYAGRASMERRAHKAVRQGETTILFDLMRKKGRTRLTSSIWARALAQEDALATWLFGRAVRMLGAGLASAINLLDVEAVVLGGGLGTRLGPEFAGRIHEAMRPHIFVPERQPPVRVAELGELSGAIGAALLAQPPMK

SEQ ID NO: 15523 - protein, 227 aa, Myxococcus xanthus
RGTYVAFLDSDDVWFPWTLATYRRVLEAEGTSLVLGTAALFSRAETLATVSREPLQVLRFADYLASAEDRTPRTACVLAVRTEALRRVGGFTPLRISGEDYDLLYRLGTDPGFAWVRAPVVVGYRQHVGSTSTSLESGYRGTRYLLEQERLGRYPGGTARRRERLEMLLYSLRHVTHWLLSQRRVDLALDLYRRGLPLHLAVPRWRYMLGFPPWALATTVRQRVSGR

SEQ ID NO: 15524 - protein, 242 aa, Myxococcus xanthus
MSKLPEGARQQMVRALMNGVWDTLANEKVLGRENIPDQPCLFLCNHLSNADGFTLDRAFRPRKVVFLAGVKLKSTVMTRLASETMETIAIKPNSPDIEAMRRALDTLKAGKSVLIFPEGARSRTGTLTQAKKGLSLIAKRAGVPVVPVALQGTEKLMPINDSDMGGERLFKADVFVRFGPPFRVEALEAEVAGAEDPRQALVDAMMRRVAELLPPEYRGFYADTSAPAAPAPDLERPSAPAS

SEQ ID NO: 15525 - protein, 383 aa, Myxococcus xanthus
MDAPVTRARTDEQLFVSTLPGLEPALEAEASALGWKPRRVDGGVELEGPAGLHQDANLRLRCASRVLLRLGHFRAGDSDTLSDRLAELDLSHVWDGRSPPKLSVSLNRSPVPGPDVVFSAAAYAWNVPSVERAGPLDEEGGGPGLTLLVRVDGDAFTVSADTSGDALHRRGYRQEVSRAPLRETLAAGILRLAGYDGTQPLVDPMCGSGTFLVEAAWMAMRRAPGLLRAFAFESFPSFDAQAWAGRKARAEADALPAPGAAIHGYDINAGSLGTARRNARRAGVTLALERQDARTLKAPVKGPGLVVVNPPYGKRVGEAEDLPALYRALGNTLRQGFAGWRAAVILPDEAALVKALGLTGARSLPVKNGGLKCRLLLSGLDVT

SEQ ID NO: 15526 - protein, 384 aa, Myxococcus xanthus
MASDSLSEEAKRAALHALDQESRGDKAELRRLEAEHDEAQRALAPQRDRMERRLRAMERLRRIVCRALMKRLHDTYVVPNARGEHRHLRGLYARGEPPSGAADCAGPKLLAHALTQGFRPLALAEFWWGAPPPAGGRAAGAYYPACKDKCGPLLPYMLDGLPVSAPRPFTVPVLPSRGLDIVFEDEWLVVVEKPEGLLSVPAKDVSVEDSVLARLRARAPEAAGTMLAHRLDLDTSGLLVAAKDARTYAALQRQFAGREVHKRYAAWVEGNVQGERGTIDFPMRVDLDDRPRQIHDPVHGKPAVTEWHVLERSHGRTKVALFPLTGRTHQLRVHAAHPLGLGAPIVGDRLYGHPGPRLHLHAEALSFQHPVTGQRLTLERPAPF

SEQ ID NO: 15527 - protein, 60 aa, Myxococcus xanthus
MLILLGKKEEAAQVLSKLTTTQPNTAAARQAGERLAVLASEGVKVPAPEAPAAAPVPDAG

SEQ ID NO: 15528 - protein, 247 aa, Myxococcus xanthus
MDFENDAAGARAEINRWVEVNTRDRIQDLVNEESLPNATRLMLINAVYFKGAWSWPFREQGTRNAAFRALDGTSHQVPTMSGGRGQYMEGDGFEAVTLDYAGGTFRMVLVVPEWERFEEVESRLSPAFFKDVRARLENHQIDIQLPRFQIESELPLIPALQALGMEDAFTEGADFSAISPTKLRIATVNHKAFVAVNELGTEAAAATAVGMVPVSLPKPIHVNRPFIFVIEHVATQNVLFLGRFVKP

SEQ ID NO: 15529 - protein, 231 aa, Myxococcus xanthus
METALEALTHKTYVNETRDKELKDNQRLEFLGDSVVNLAVSHRLMARCPGLPEGDLTKMRARVVNEDGLARVARTIPLGDLLLLGRGELMSGGREKNSVLADALEAVFGAVFLTSGLDAAVTLVDRYFADLLDEVSSGQGRLDYKTLLQEMAHERLKLQPRYRVVSESGPEHSKVFEVELMLGETAFARATGRSKKEAEQSAAQATLEKLREDAACPTSPPPGTPRHDTPA

SEQ ID NO: 15530 - protein, 287 aa, Myxococcus xanthus
MDTARLEGLGLQLREDAAGTEAVLDLESSPLVNPVTRAFIPEVTFQVMGDRLIPIAPPAVVGLAPILVGALSDVADIEALLADAFNEHIFHVQRRSAELQVLGLTPRVEPETLELSTEVVDGELAVTLVSDRLGNFRVARVARGKEDLATGGGHTLELSEFRERAALTGYLVALFGEPAARPQAAPVGAGLVRFSDIVEKFGAEALLPPRSSLELLAQLQVEGRPYRFAAARVAGRTFRGLLAGPQGKEWAGRFELDEFPGIVRMVADLLKVPPAAVRLVGPDAPQE

SEQ ID NO: 15531 - protein, 331 aa, Myxococcus xanthus
MGMLVAEEFGGAAMDSLAVAVAVEEIARYDGSLALTVASHNGLGTSHLRVFGSDAQRQKYLPKLATGEYLGAWGLTEPGSGSDASSMKTTAMRKGDGWVLNGAKMFITQGTVGDVFVVLAVTSPQKRQKGITAFLLEKGLPGFSQRAIHGKLGMRSSDTAELVLENVEVPDSARVGELDHGFIDTMKILDRGRITIGALAVGLGRGALEESIGYSRERTAFGQPISEFQGLRWMMADMKTELDAARLLVHRAAKLADEGKPYSREASMGKLFASEAAMRACNKAVQIHGGYGYTREFPVERYLRDAKLCEIGEGTSEIQRTIIARETFKGA

SEQ ID NO: 15532 - protein, 336 aa, Myxococcus xanthus
  unsure (1)..(336): unsure at all Xaa locations
DLVIMVEGNASMYLXSPRMAEMVIGEKVTLEKMGGAKMHCSISGVGDVLVKTEQEAIEAAKKYIGYFPENFSQAPPRAEPKAPKAGGKKVEEIVPVDQNKPFNMHELINELIDEGSWFEVKKLFAQELVTGLARIDGRPVGIVANQPKYKGGVLFVDSADKAARFIWLCDAFNIPLLYLADVPGFMIGTKVERAGIIRAGAKMISAVSEASVPRICVVVRKAYGAGLYAMSGPGFAPDATIALPGAMIAVMGPEAAVNAVYYNKIQELPEAERPAYVQKLRDEYKQDVDIYKLASELVIDDIVPGDRLRQELTQRYSVYSQRHQPRAEKKHGVYPV

SEQ ID NO: 15533 - protein, 382 aa, Myxococcus xanthus
EYTPNVAGGVGTYVYELARGLARGGCKVTVLAYTPGEPAVLREPNLTVHMMPPSRGSLSQAGKLSLVGGIRVFNDDLIHRGRELIHEEKPDLIHFHQWHTHRAARALAHETGVPVLGTSHYISEPAERWWGQTPDPEILEEERSFYDGSTNVISVSDSMSELIRETYGMPASLLHTIHCGMDAGPFLQPSHAPEDYARLRATVATPDDPVVLYTGRLHPMKGISAIFAAAERVLERRPNVRFLLAGGTDSRESTQMVQTLTQRYAHLRHRIKLLGKLPRQQLGLLHRIADLALVPSLYEPFGYTAIEAMASGLPLVATRSGGPSEIVDHEKTGLLVPVLPGAPGGPREVDVESLAAAQLNLLEDRERARRMGLAGQQRVGEL

SEQ ID NO: 15534 - protein, 64 aa, Myxococcus xanthus
MPGIRVKEGESIESALKRFKKATEKAGILSEIRKREHYEKPSVKRKKKALAAKKRAVKKARKSF

SEQ ID NO: 15535 - protein, 152 aa, Myxococcus xanthus
MATLKERIDADLKDAMRSKNELTLSVLRMLKSAVKYKEVEPGASALDDAGVLTIIAGLIKQRRDSVEQFKTGGRPELAEKEEAEISILQNYLPKQLTADELAAEVRAAIAETGAKGPKDMGAVMKNLNAKIHGKAEGRAISEAVKSELAKLS

SEQ ID NO: 15536 - protein, 502 aa, Myxococcus xanthus
MRERQQIKEATDQAAEHFRAMLWQQDEGRSARAYIASRGVSDETAMAFGLGWAPLEWASLTERFQKLGMLEWAAKAGLVLKRNSGDGYYDFFRSRVMVPIRAPEGRPIAFGGRLIGADEGPKYLNSRESRLYNKSETLFGMDQSRDEIRKRKAAVLVEGYFDALGLHQVGVRHAVALCSTNLTAGHMQVLKRAEARELILLLDGDSAGLAAVERLSGPLLAAGATARVALLPQGDDPDTFARREGQEGVERLLEGAHPLTSHLFASLLPEGKAASFEEKMAALERLKPVVGQVPVGLVRATLFSAVAEHFGWRPADVEAALRSKVPLPKPAGGDAPPSSPNRPAPPLEKPPPALECFYVGAVLKEPRLMARDTFRVCDELSHMGLRMALAHATSGHGANDALFESSEAVKRGIESALRQLPSEPVPLEAAFLSICREIMVRRIDERLVYIKRATEQTPGAFDLTEETRQLLVERVELLALKKRVLEELKPASSGTKAPMQPV

SEQ ID NO: 15537 - protein, 708 aa, Myxococcus xanthus
MPTQKPSKASVKPTKKKVDPVIRKKKAPDGAAAKGAKTGAEEKEELVARDVVAEATEKLKKKKKGVAPAMGDDVDPEEAAEEAAAAVQVDPDAVEDDIEEDPVAERKEVKDLLAAGREKGFLTYDEVNDALPADIVSSDQIDDVMSMFGDNDIEIVDAQKAAQNNEIKPTVTVEEEKEDADEDEKDEDDEPGGKSNDPVRLYLRKMGSVSLLTREGEVEIAKRIEDGEKEVLRALLACKVAVEEILDIGNKLKTAKLRVRDVIKDAPEETQSEGAEEAPEEVGEGDAPAQLAQSELNKIEQICKQIERFRKFAQDCDVLEEELSSKKKLTEVRKKEVKQEIKDLRTKMMEVLEEMRLNKKQVDRIVINLKALIERVDKAEDELRDLERRYDCSMKELRPQLKESRENPNIGKKLQKQLNLTPEQLEVLDRDVRTAVRKIKKVEEEANLPVESLRRNYDAIRLGERRAERAKSELVEANLRLVVSIAKKYTNRGLQFLDLIQEGNIGLMKAVDKFEYKRGYKFSTYATWWIRQAITRAIADQARTIRIPVHMIETINKLIRTSRYLVQEIGREPTPEEIAEKMELPLDKVRKVLKIAKEPISLETPIGEEEDSHLGDFIEDKSLVSPADAVINMNLAEQTRKVLATLTPREEKVLRMRFGIGEKSDHTLEEVGQDFEVTRERIRQIEAKALRKLRHPSRSKRLRSFVES

SEQ ID NO: 15538 - protein, 69 aa, Myxococcus xanthus
MATLPQQPELPLPWWRVTRSDGTLAPQVAQEQARRLRAEGVEVTQRGDTFRVKVPREVPAPGLATKRQR

SEQ ID NO: 15539 - protein, 453 aa, Myxococcus xanthus
AEPVSSNLTACLTAARAAAEAGASSAKFLRDAGPRGANAAARVWGRRDAIREALELELYAEDLAVRGSALAHLAGFLSRKPARVLLDAMAARPESVDAVSASALKVVAGRSRSSVGRMLLDEAKPAEEARINRLFAVYSKELEGMQPELTVADPLQRRRAVESLRVYGPLAMRELERALGDSDRWVRRDAARALAEAEGVPLRTAAERRIESSDAMQARPWLEAMAREKGCVAFFLGTARDKALAASVRGAALAQLADCSEGARDRVSSVEPFLTDAQPLLRAGAVRALSGLTTRQPGVSEATTRALRDGAPEVVSAALELLTLQRQTSRGDEAAMLLESEHGVVRTAAAEALEQIGRASHVKALAGCLREDTEAPVRVAAATALGRIGGAQAAAALSDAAARDPDSHVKARIARGATATGLRPVGAGPAPETQSPLMAFASTRFRAARLARH

SEQ ID NO: 15540 - protein, 64 aa, Myxococcus xanthus
ALSYGRGTHFCLGAPLARVQFEITANILLDRLPDPKLVPGQDFGTWQSLVLRQMKHLKVEWTPT

SEQ ID NO: 15541 - protein, 350 aa, Myxococcus xanthus
MYAQVVDEADIQYAHRVDRKALAAITREMSKVNNGRALWAMAAQWLVIAAAFAFVLFVDRWWAWPVAAVLIATRQHALLALMHEAAHYHLLSNRKVSDVVSDLLCAFPLNMTTAGYRHEHMLHHRYVNTPKDPYLAGQLVDASWHFPRTPMRATAVFLADALGLYAPNHLKVVLPWTYWGRLVGRAQPRISAGEHLRYWLYVATLVTVLVTTGAWLHWLLLWVLPTTTVMMAFFRMRALGEHPIEETKSGDETRETRDILGTALENFFIAPLNVNLHLTHHAFPSVPFYNLPAMHAQLDKAGLLEDGVNQFDTYLGKENSLIQYLTREPEASAAAAAAAQPSRLSQPLHS

SEQ ID NO: 15542 - protein, 200 aa, Myxococcus xanthus
MRRQASLALLNTLSLTRLPLAVAFILVPDAWVRAGLVVLAAFTDFLDGWIARHKGLATRLGALIDPVADRAFMVTAILVCYLDGLISGVAVLLLVLRDVGTTVGFFVARLAPRLRSVELKARMMGKAVTSLQLVTLLCVLLFPPAVVPLVALIGVLSFASMVDYSHAVLKARQRDAGPRRMKPESGGATSSGSSLPPVRK

SEQ ID NO: 15543 - protein, 439 aa, Myxococcus xanthus
MSKSSVWVSLSVGLALGFAGGRLARPTELATGTAHAANLAAKAPAPGARPRAPISPTVYKVPVNDSPTAGAEDALVTLVEFSDYECPFCSRANGTVKQLQERYGRKLRVVMKHHPLANHPRARPAALAALAAGEQGKFWEMHEALFANPRALSEADMERYAMKVGLNISRWNQDRADPRLAERIRQDEALAMRLGATGTPAFYVNGRFISGAQPLEVFTGVVDEELSKAEALVRTGVRPTEVYARTISAGKDSPPMEQMMPEEPAIQQVDVGTAPTRGPANAPVTVVAFSDFECPFCARVVPTMKALEAAYPGKLRVAFKHQPLAQHANAQVAAEAAMEAHAQGRFWEFHDVLFANQRKLDRASLEHYARQVGLDVGRFNAALDSRKHDAHVSADVAQAMRVGATGTPTFFINGRPVTGARPVEHFRAIIDDELRKAAR

SEQ ID NO: 15544 - protein, 42 aa, Myxococcus xanthus
MPAQDFHVLSAGGDTGPWFPLEGEDVVTPFWKPFPWSSLRRF

SEQ ID NO: 15545 - protein, 38 aa, Myxococcus xanthus
MDEVWMEMSEGERSAIATERARVLGLPKAQPADSAAQP

SEQ ID NO: 15546 - protein, 168 aa, Myxococcus xanthus
MRLELVLRWRGLEESKRHIASPEDALAMGTAQEAVLAAFLDAVDGAGRRDLAGFLLEAARPLLEQPATRWVEGLSSSATLSSRATAARAAAAFLRALGRLSRWDAEHRAVRFFDDDYDAAQHLLSEWNAFGEAGFRRAEDHARQLATALTSASGASATPPPSSAGSAS

SEQ ID NO: 15547 - protein, 1543 aa, Myxococcus xanthus
SKGCTDPRMDVLADASTEELRDIRPRPVRVPLISSITGAEIDGASADAYHWVRNIAWPTLFTGALSHTMHEGYHTFLEVSPHAILGHPIDATLKHLGRQGRVVPSLPRQEDERPTLFDSLGVLYAAGQPVRWDALAARGVDHDGEAVHLLPLSARSPEALKALAADWRDFLAGEPGAPLDDVTYTASVRRGHLSHRLSVVGGSRRELAEALDAVTRGELPPGVSEGRVSPEGRAKVAFVFPGQGSQWLGMGRQLLREEPVFRSAIEACEQAMRPHVDWSLTAELLADEQHSRLQDIDVVQPVLFAMQVALAALWRSWGIAPDAVVGHSMGEVAAAHVAGALSLEDAARIICLRSQLLRRKSGQGAMAVVELGLAQAREALAGYESRLSVAVSNSARSTVLSGDIDALESLLPKLESQGVFCRRVKVNVASHSPQMDSLKDDLLRVLDGVAPQGAPVPIYSTVTGQTSDGADFHPAYWVSNLREPVLFHGAVEQLLADGFTVLVEVSPHPVLLAPIEETLRESKQGAIALASARRQMPERRCLLESLAALYAWGCAVDWKALHPVKGRVVALPRYPWQRERFWLPDEAEVDAQPEGVVLADRKGHPLIGGSLSSSVQPGTHFWERTVSTAAFPYLADHCVWGDVVFPGAGYVEMALSAGAEVLGETGLVLEDVSFSEMLALEPGQSRRVQVVLTEEEPGRATFQIASRAEGEMSWRKHAAGTVRRDARAAAVVESPEALRARVTVAVSAEAHYQRRQAQGLMYGPTFQGLRGIWRSEQEALGRLEVSDTVALEAGAYRLHPALLDAGLQVAVELLAPLTATSAPATHVPVGIGRIRFFQRPGRAAWARVKVRGEGAASERERTFDFWLLDEQGQVLLELEALRLFRLDAGASARKELGAWLYQVDWEERPLPAELAWPEQTPGSWLILQDGGGVGQRLSAQLLTRGETCVLVAPREAYRLTGPRSAEVDPRNPEHWRRLLTDLLGAGVPPCRGVVHLWSLDLASTEALTPQALEDSRRLGTTSVLHLVQALSGAGWRDAPRLWLATRGARSAGKVAERVAVAQAPLLGLGQVLAVEQPELRCTRVDLEGGADVAADALLRELSSTSFEDQTAWRGGTRRVARLARAADALSAREPATLLREDGTYLITGGLGGLGLELARWLVSQGARHLLLMGRRAPSAEAEQALAALREAGARVGSFQGDVARLEDVTGALARVEDAMPPLRGVFHAAGLLEDGLLLNLTEARFASVSAPKVLGSWNLHAQTRHLPLEHFVLFSSVAASLGTPGQSNYASANAFMDALAQARRAEGLPALSINWGTWTQVGLAAAQSIRGERLEARGLGGMAPDKALAVLGMLLGQERPQLSVMAFEPRQWLGFYLAAAQSPYFTKLAQEPSSRPSVSAGKSRIREQLEAARASERRGLLDAHLRELIGGVLRMAPARIEPRTPLVTFGLDSLMSMEIRNRLEAALGLKLSATVVWTYPTVAALAPFLAEKLALPLEDSRPEPALEVAPVKASQADVTASEIDDLSEEEVERLFAQRMAQGS

SEQ ID NO: 15548 - protein, 214 aa, Myxococcus xanthus
MLRKAILWVLGIAGLSILLCGGVVTAQGTQQVPARTEQVPTGQALTSTDAAALQREVDQLRAELLQLRQEVTQLRGQVTGTGGAGIPPGARVVSPRRDTADQQDTGTGGTGAAGVVNDVPPEGSGVPSPPGTAAVDAVYTGVVRSVGDTEVAIAIGDGPPLTLRVDPRTRVFRDGRNIALRKLEPGEHVRAVVNLLDEERTMEISVLPSTPAGK

SEQ ID NO: 15549 - protein, 429 aa, Myxococcus xanthus
LPDETALTDASGVVSFMAPGAGVMTVCARGAGHAERCERDVGVVAGGSLVVELKLPPGAIVEGQVLLHDGTPAEGVRLVASGDPMLLEMTPVWATTDAQGRYTLDGVTPGYPVGMTPFSPEGEGLHRSVGAELAAGEVRRFDFQLGAFVPVTVKPVMGRRRGTDSVESVHVNVQLQPQQDGTFTGITESGRHSVSVWGRRNGRAVSARKDVTLAPGAPAVIAFPFSALEEGGRVWQLYSSDPGEFEVSGRVFLPDGTPVKGAWIGSQKPGPRGRRCGNSAEDHAQVRFDGPEFVVTPRVGAGRIFAWLPDGRAGSAVVRGGKGERVSVDIHLEETGAVAGMMDFGDDHLWGYREEITVNHEWVGASHYTLLDGRIFVPGLKPGRHVLRTSLGTVEFNVNAREVTNVGVLRRPPEPEAAVSDSEAAASEP

SEQ ID NO: 15550 - protein, 451 aa, Myxococcus xanthus
WAAEAARDDETVARAWLELIWAVGEEQSRPDEAEKLIRHARAAVERLGRERFPDITTELHTRLSSLREAYGQIAEAEQEARQGLEFSRRRNHPDSLRTPNLIHQLGRIRFGQGRYEDALKLHREALELRERILGADNPALVTSYNRVATASLEVGRYAEAVSAWRKALALQEASSDPETTPMGTVLLNLAVVSRVAGRLEEARSMAERARAIFERARGPNHITVIFALSALADISSEAGQGDEALGLATEALERVQRSLGQDTPRAALPLTVRGQVYLKAGRHAEARRDLLDALQRLEKEHGPEGGKTVTVLLPLAEFALATRASKEALAYCERARKVTEKAGGAESPDGASALACSGEAHLALGTAAEAVPLLERARRIQTQWGEVKDPRVAGKTAFLLARALMETRASPERARALALAEEARARLESVGVRGQSELQTVLAWQRRETKR

SEQ ID NO: 15551 - protein, 297 aa, Myxococcus xanthus
MSDEQRTGSLAALLRAYVSPKLRAELEAEEGFEALLDKHVEAARTQWPTLSLPAETFVRHLARHLPEGKAAEVMRILQGADLYLACACTTGDPAALKAFEQHILRHVPPRLGKVSPPLVEEVLQMLRERLLVGSSNTPPRIASYGGRGPLRTWVSIVAARIASELMGQDERHQLVAEPPEELARMLAPSDPEYALLREDARQLLVESLRKAVAVLSEQERTLLRLHHFHGFTMDRLTLMYGGSRSGVARKVADAREQLLERVRMELAPRMKQDQLALESLLGLVSSRLDISLLGLLD

SEQ ID NO: 15552 - protein, 274 aa, Myxococcus xanthus
MGSVTAVGGSGAPKVDPAEAQRRAEEARQKAEAARLAAEARRKAATAARDNLTQAKHDAGAARRQKAAAEKTAAAARKAAERPGQTPAEAKKSKEDLAVAEKKLKEVTEASRMAAQKLQDAEEKAALAAKSAEEAMRKANAVAVEESKTPPYSQKDIDKVKPTKNELESAFEGTSRKAELEKLLGLTPPPPQEVIQTVGSGAAPGAPFDAMKTMDAQDVAHGPFGQTHMDSSTDAWFHQRQGSNTGVVPSDATRGNTVPIMPDGSAPSPVTSKQ

SEQ ID NO: 15553 - protein, 124 aa, Myxococcus xanthus
MVGAYGLEIKRTADAGQFKKDLAETIAGVALAPLGPAGEVGKVALKNFITEVLSSKDTSWTEQLREVSAAVKDKASAGLQNFDKHKDANGRDISGGKDWNTQTEHQFELGYDAILERLRMLSAN

SEQ ID NO: 15554 - protein, 177 aa, Myxococcus xanthus
MAPAWAHGADAAGSGPPRPSAPARHPHQGPFRSDAGEDVVYLQDGEATVEGLRFWGSPWQPAYNDWAFNLPRGAALASKWAAIPEGLDVLITHGPPAGFGDRSSVGGRGGCTDLRERVLAVRPRLHLFGHIHDDGGLWREGDTCFANVTTWECERAPTVLQLDARGVTEVSIPPARR

SEQ ID NO: 15555 - protein, 148 aa, Myxococcus xanthus
MKKITGQVKLQIPAGKANPAPPIGPALGQQGVNIMEFCKQFNAKTQAEAKEALIIPVVITVYADRSFTFILKTPPAAVLIKKAAGLHTEKKKGSGAKKPGKEKVGQITRAQLEEIAKKKIQDTTAASLEACMSTIAGTARSMGIDVVG

SEQ ID NO: 15556 - protein, 178 aa, Myxococcus xanthus
MKWYVVHTYSNFENQAKKSLEEKVRLEGLQDQFGEILIPMEQVVEMVKGEKKTSRRKFFPGYIFVQMELNDRTLHLVKNTPKITGFPGTVQNQNPLPISDQEVARLTSQISEGTLKPKPKVQFDDGDTVRVIDGPFANFNGTVEEVNAEKGRVKVLVSIFDRATPVELDFMQVEKTAG

SEQ ID NO: 15557 - protein, 132 aa, Myxococcus xanthus
MDPKRLVVIFYLLVGIVLALFLERLLGLLWARFSWSDPVLIEGLDWKVSTLVSYVLAVGLAVGAYFHPRTHALSIDVASELMKVTWPTWSETKASTMAVVVASLVAAVILFCIDTAAYNLMVEWLPAMWGKL

SEQ ID NO: 15558 - protein, 1269 aa, Myxococcus xanthus
MTTFAEKIAQYSPKRLALLAMDLKSRLDAVEGSRSEPVAIIGMGCRFPGGGNDPASYWNLLCNGVDAVTEVPSSRWTREDMARMDPEAQEKLGAKWGAFINAVDQFDADFFGISPHEAHRMDPQQRILLEVAWEALENAGQDMSRLAGSRTGVFVGVYSDDYALLQVGNPAARDSSSVTGAINCVVPGRLSYLLDFQGPSLSVDTACSSSLVALHLAAQSLRQQECTMALACGVNLILSPLSSSRVSRAQALAPDGRCKTFDARANGFVRGEGCGVVVLKRLSDALAAGDTVLALIRGSAVNQDGKSAGLTAPNVLAQKALIRQALQSANLEPADIDCVEAHGTGTSLGDPIELEALHEVYAQGRTAEQSLVVGAAKTNIGHLESAAGIAGIIKMVLSMQHGAVPPLAHFQRLNPRIDFGGEALTVPTKLHPWPARETRKRRGAVSSFGISGTNAHVILEEAPVAAAAPAAPSRGAYLLPLSARSPSALQALARKYADVLTSSPEMSLRDVCFTAALRRTHHEYRTAVAGDSADAVARQLREFALEGPAPAATDTDTRRKAVFVFPGQGSQWAGMGRQLLEQEPVFREAVERIDEAMRPHVTWRLIDVLRAPAEDSRLQDIDVVQPVLFAMAVALSALWRSWGVEPDAVVGHSMGEVAAAHVAGALSLEDAARIICLRSQLLRRISGQGAMLATELTLEDARKTLAGREDRVAIAVSNSPTSTVLSGENAALESIRADLESRNVFCRWVKVDVASHSPQVDPLRDELLSVLSAVRPGRSSVPIHSTVTGASCDGSGFDAAYWVRNLRDPVLFSSSVLQLAEAGHSVFLEMSPHPILLPAVERCLQHAGREGVTLPSLRREEAERTVLLESVGALYRAGLPVQWKRFFPGGGTPLPLPTYPWQHKRYWLDAVATPVAAMVEPVTSLKGRPVSVAHGVDGQVFELELGSNSLPWLGAHRLGGVAVVPASALVELGLSAAADALGPGGRGLSGVEFERALVLPETPRRLVQVHLSSEAGGKHEFHIHSRAVGGASSEAGWVRHCRGHVQVLSAAMGALASIDAVRARCVEHVPGAAVYGELERCNVQYDEPLRTLDEAWRRPGEALGRVVLGAERLQEASQYQLHPALLDAALQTLALALAAEPGQAALFMPLGLESFECVPGSADVRWAHVSISPASRPEERLGTLSLSPRRVVRSRWRAVYGCGTWRWSGCSRCWGKSARRTGSTTCRGSRGRRGHPSRPPRIGLCSRTGVVGARHSPRSCGVRTPLLSW

SEQ ID NO: 15559 - protein, 396 aa, Myxococcus xanthus
MAKEKFERNKPHVNIGTIGHVDHGKTSLTAAITKVLAKTGGATFLAYDLIDKAPEERERGITISTSHVEYQTSNRHYAHVDCPGHADYVKNMITGAAQMDGAILVVSAADGPMPQTREHILLARQVGVPYIVVFLNKVDMLDDPELRELVEMEVRDLLKKYEFPGDDIPIIPGSALKALEGDTSDIGEPAILKLMEAVDSYIPTPQRATDKPFLMPVEDVFSISGRGTVATGRVERGIIKVGEEVEVVGLRPTQKTVVTGVEMFRKLLDQGMAGDNIGALVRGLKREDMERGQVLAKPGSITPHTKFKAQIYVLSKEEGGRHTPFFKGYRPQFYFRTTDVTGSVKLPENVEMVMPGDNIAIEVELITPVAMEKELRFAVREGGRTVGAGVVAEIIE

SEQ ID NO: 15560 - protein, 282 aa, Myxococcus xanthus
MRERSSKGGRGGERASEEVPQRASRGERGGGEASRFVYGVNPVLAALRARPDEVERLFLVEGQLGARAAGELLSRAREFGIRVEKVTRERLGTLAEGGVHQGVVVELRGFKYAELEDLLEAAKALGQPPLVVVLDGIQDPHNLGAIIRSADALGAHGVVIAKDRAVQVTGTVAKASAGAVEHSRIARVVNISRALEELKEAGLWVAAADVDAKEPMWSARLDGPLALVVGAEGAGVRDGVLKHCDFRLRIPMAGQVGSLNASVSAGILLYEVARQRGTVSGR

SEQ ID NO: 15561 - protein, 149 aa, Myxococcus xanthus
MLRRQRLSSLAALLAAVTCSAPVLAADVDPASLYEVSTEGTSTQVKAGEKGTFVLAIKTKAGAHVSDEAPLKLEVKGSQLTPAKEKLVLADSVAKKAEGQAFADPRFEVPFTTAAAGKGSVDAKLVFFICTEKICARQQKTFSLPVEVL

SEQ ID NO: 15562 - protein, 295 aa, Myxococcus xanthus
MHLDGRSATLYYGRKKLAPTDVVLPRIAQSISNYGLAVVNQLGLARVSLVNHAQAIAQSRNKMRSLQLLSAHGIDIPSTVMARDAAHLKEMVGLLGGVPVLVKLLQGQEKHGVMVCESLQSLEAALEAVLGLGHNLVMQEYVKSTGIDVRVLVVGGQAVAAVRRRPRPGRLAHTLIKGARLEAHELSPAQRATAEKATRLIGLEVAAVDLLDVQGQPKIFEVNSSPALPEMEAVTGVDLASLIIIRAEALVAGEPPVSVPDLSPPSALPASSEPAQLPVDRKGTGRRARTGEGGA

SEQ ID NO: 15563 - protein, 256 aa, Myxococcus xanthus
  unsure (1)..(256): unsure at all Xaa locations
NEINTXLQGIPNGGEGRPLGGTPTSGSLNFVGGLEGLQDPDRENFVILLTDGLPNCNAANPNSGANPELCKCTIEGNQCQSGYLNRGCLDTDASVTAVRELHEKGIQTIVIGFGAETAVGDGPAVLEAMARAGGFKRTCSAERPCGEGDTCNPTTGLCNRSFFQAGNQAELASALEEISLAVKIPEPCLIRLDGPQRPTDPKLLVVYVEGERTPSSDSTWTLNDDGVRFTGQICERILASTPEAPVKIEVRAIRQR

SEQ ID NO: 15564 - protein, 1156 aa, Myxococcus xanthus
MDEQSSAAVREVFVRLYEEGLMYRAQKLINWCPSCHTALSDLEVEHQEKNGSIWHIRYPVKDTDRTLTVATTRPETMLGDTAVAVHPEDERYQDLIGKHVVLPLSGREIPIIADAELVDPKFGTGVVKVTPAHDFNDYQTGLRHKLPMLSILDESARMTKETGKYAGLDRFEARKQVLADLQEQGLLEKEEPHKLSVGTCQRSTTVVEPRLSPQWFVKIEPLAKPAIEAVEQGRTKFVPESWTNTYFHWMRNIHDWCVSRQLWWGHQIPAYYCTACSPRLGDDTDLPLDSATVKVGGVDFARAEPIVAREQPSSCPKCGGATFIQDPDVLDTWFSSALWPFSTLGWPRNTPELQTFYPTSVMETGHDIIFFWVARMMMMGLHFMGDVPFRTVYLHAMVRDEKGEKMSKTKKNVIDPLDVILGAPADKLEPTLRNKFPQGMPAFGADALRFTLASLTQQGRDIKLSMDRMAGYKAFCNKLWNASRFALMNMGEFTLDERPLKERPLTLADRWILSRLQRATTEARASLETYGFAEAASTLYQFLWAEFCDWYIELAKGSLYGTDEQAKDSARAVLVYSLDRILRLLHPFMPFITEEIWQKLPMSRSVDSIMIASYPEPDADLVDEAAEAEMAPVIASIEGLRTIRGESNLSPATKVKAVVQSPDARTRELLERWRAYLMPLAGLSDVEIGAPGTKPPQAAAFVGTNLEIYVPLAGLIDLDAERDRLRKEIARTEQEAAGVLRKLENPNFVAKAPPDVVEKDRARVEELKERKAKLQDHLQRIAPEPAMPAAPPSESRTPTESVEPTEADIVTEADVATEPITPPESAARLETPPPAEGGAEYETLAESTEEEEEAAAPAEVKAAPDAEAEGNVDLAEELKDELEAVGGVPEAADPQVQDALEKLRAGTKEGLSPADHHDLGVAYMSMGLVDDAMREFNTARAGGDAREAPAAAEQTVASTAKAVVKATLAAVKKASSIAKETVVEAVSASGEDEEPAAPAKARPAKKAAGKKAPAVAKEAPAQKAAGAKGAAKKAAAKKAPAKGAKGAAKKAAAKKAPAKGAAKKAAAKKAPAKVAAKKAATKKSAAKKAPAKGAAKKAAAKKAPAKVAAKKAATKKGAAKKVAAASKKPVKKAAGRKAPAKKGTGAKPKARAKARR

SEQ ID NO: 15565 - protein, 204 aa, Myxococcus xanthus
MRSLLAAERTALNIVQRAAGIATLAQQAVTSVRGSNLRVLDTRKTPPGMRTVAKEAVRMGGASNHRFGLFDGVLIKDNHIAAVGGSIAEALRRAKLNGPRLTKVEIEVTNLKQLAEAIEHGADVVMLDNMDDAQIREAVKLAAGRVPLEVSGGVTLDRLPRLAKLGIDFVSMGALTHSARAMDLSLEITAAAKRPARSKQPKPA

SEQ ID NO: 15566 - protein, 142 aa, Myxococcus xanthus
MVEARLRVIYGDTDQMGVVYYANYFRYFEFARSEYFRARGGSYAELERSGALLPVAEASCQYKASARYDDLLVIQTTVSELRRASIVFTYALFRDGAPRTLLCTGMTRHACVGRDGKPTRLPDSLIRLLETTGPSPGSSPST

SEQ ID NO: 15567 - protein, 155 aa, Myxococcus xanthus
MEVVRVTEMAAIASARLMGRGNKDESDQAAVDAMRRAFDALQIDGTVVIGEGERDEAPMLYIGEKVGKRGEGAPEVDIALDPLEGTNLCAYGRPGSIAVVAMAGKGGLLNAPDTYMEKMAVGPRARGAIDLRKTPTENLRSIAEKMKVYVEDLRS

SEQ ID NO: 15568 - protein, 537 aa, Myxococcus xanthus
MIRALSLAVALATLPAFARPPRLTLVISVDALGSDVLLRNRPRLKGGLHQLLNQGAYFPYARYGYAECRTAPGHATLSTGANPWRHGIVDNRWVDRSTMKRVMAFADAAHPVLEVPLKPGQDSGPAHLMVETLADRLRVTTQERGKAVALSIKPHAAIALAGRAGQAWWFDKGEGKFVTGTWYTKEFPAWLKALNARKLPEASFGKKWELMRPAAEYVGEDEGLAEADVYGLGLTFPHPLDGGLPSPGPAFYQAFALSPDSHDLLVEAAKAAIAGEGLGQDDVPDLLAVSFSSTDLVFHEYGPYSWEMQDTLLRLDKAMGNLIAAAERAAGGRGNLVIALSADHGGAAMPEQWAAKGLAARRVSSKELAESLTQALRQQFGGDVTATLEQLDVYLGGKTHQGGSVDAAVRRAAAAWLAKHPSVITAVANDDLFTAPDTEGYLTLMRKSYYPGRSGDVLFMLRPFHMLHYIPTGTSHGTPHSYDSQVPVVFAGKGVKPGMYLEEIDPVDFAPTLSALMEMGMPASAEGKPRAEVLTGK

SEQ ID NO: 15569 - protein, 417 aa, Myxococcus xanthus
MVTAGDAFQRLGTRSFVVDPQRPEDMARLLRELPALAAGHEGRALFLWGLDETLDGQTAVPASTVAALHLVKALMEVSGHARLWVVTRGAQVTGVGTERVSLAQSPLWGMGRSVSLEQPGVWGGLIDLPPTRSPDEVTSVLREVSAFGTDGEDQFAFRDGRSLVPRLTRGRAGTAEEALRLRSDATYLVSGGLGGLGLKVARWLVERGARHLVLLGRSGVSGADDAASVRRREELESIRVIGATVTPMAVDVADRERMAALLRDMAATLPPLRGVIHAAALITECRLEDLDVAATTAMMRPKVLGSWVLHDLTRGLSLDFFVMFSSTSTLWGASGLAHYAAGNQFLEALAHHRRAEGLPATTIHWGTWDEIGGERADNARGYARFGLNPMASERALDAMGQVLRSGASHKTADCVDW

SEQ ID NO: 15570 - protein, 131 aa, Myxococcus xanthus
MLGAIHASTTFPFRAEGGRVLYSCMVGGARQPGLVEQDEDALAALAREELKALAGVTARPSFTRVFRWPLGIPQYNLGHLERVAAIDAALQRLPGLHLIGNAYKGVGLNDCIRNAAQLADALVAGNTSHAP

SEQ ID NO: 15571 - protein, 139 aa, Myxococcus xanthus
MTGVATEMCISRYLSLLSTASEIQAFNRVTTALHQQDEASHVDLFGTLARDVFNALEPVQQEFVREILPLPWLWFSEGEADVWRSVLLQLGIPRADVMMDDCIANKLLSANERAMTDAQKFSEALGIDNIHWDRAAALL

SEQ ID NO: 15572 - protein, 1072 aa, Myxococcus xanthus
PHSIASTVPEAGPPLDVVELFVRQASRTPHRVAISTGTVQLTYQELERRARSLHARLGLLGAVPQTPVGVFAERTPEALVAALAVLMAGCVYVPIDPAYPTERIDYMLQDSGAPLVLGPHTHRDTRNLAARFLALDEENAPPTSLSEARQAPPHPESLAYIIYTSGSTGLPKGVMVEHGGLLNLVLDHVAAFDVVPEDRDLLVTSPSFDASMFQLFITWATGATLLLPPEHVVTDPDAMVGWLNEHRATLLSMPPAYLHALGRRPIPSVRLVNTGGDAPIEEDALHYARTCRYVSTYGPTETTICSAYHEVHADASFPEGIPLGRPVRNASMFVLDEAGGICPPGQLGELCIAGQGVSRGYHARPELTAQKFVPHPYHPGARAYRTGDLGYQRSDGVFFFRGRVDRQVKIRGYRVEPEEVESRLQALEGVERAVVLPVGANASSRRLVAHVVGRPGLEPVALRRMLARETPAYMLPSRIHVLDAFPRTPNGKIDLARLQVLEPRRSASHGEPRTPEEEHLCALLEEILGVSVEADQGFFEVGGDSLSAARFIVEARARHRYMLPIQALLQGATLRALARALVTAPQAPAPEVARLPEAPGYPASDAQRRLWLVHEVNGGSAAYNLVHAWWVDGELDVALLRRALDRLIQRHEALRTRFDLRDGVLVQCIEQEARVDWLEPQGTPAPELFLEAEAAHAFSLRTGPLVRAAVLAVAPQRWLFTLNIHHIVCDGWSMGVITRELEHTYRALRGGASPPVVPLPLQLRDFTAWQRQRVEGPAGRDAAHYWRARLAEEGGSPPLDLPLDRPRPARPTQAGRVHQVRVPPEQLRALENLAQRTRTTLFVALTALVKLLLYRETRQSDISLGAPLAERDHLDLAEQVGFYVNTIVLRTRLDGRESFVQLLERVRQGSTMAQHHGLLPFDRVVEASGLPREPSRSPLFDVMIALQQEEHRALRLAGTTCTRVEIPHHTSKFDLSFDFVRTGEALVMELEYATDLFDADRIERLAQRQLQLLGEVLCKPDAPLDALQPLPPAEQTFILEMFGGRRLPTPAPDGLLAGFRHAVAKDGGRPAF

SEQ ID NO: 15573 - protein, 93 aa, Myxococcus xanthus
MGSLAANTDGGAYAYRMSKAALNMAVRSMSTDLRPEGFVTVLLHPGWVQTDMGGPDATLPAPDSVRGMLRVIDGLNPEHSGRFFDYQGTEVPW

SEQ ID NO: 15574 - protein, 100 aa, Myxococcus xanthus
MWKSAATSRTSRTAGRSPASPTGDVGQAVTQLGGKVDIKATVQDKTTVKGDIGVGVHAGVVGAEAGVTTERTTVGEEHELTAAQLVELYLTQRWSAGVAS

SEQ ID NO: 15575 - protein, 66 aa, Myxococcus xanthus
MVTLHSLPRLQRLAVAATVGVGQPEGRSASERTLAAEWRVSVAEVSRLRELGLRRLRKALEKMPCP

SEQ ID NO: 15576 - protein, 66 aa, Myxococcus xanthus
MLYLHNTKSERSYFGGKIKSARQVRTNDRIPDRIVFRFVPLSEARGVRWRGIDHINAHQSGVVEDE

SEQ ID NO: 15577 - protein, 418 aa, Myxococcus xanthus
MVHTPLTEDDAAPVELDDDDFEEAVVALARDVRPFSNPLREARQRFGVPERSGVYLYQPRGPRLIPQGEAMDSDSPRLLDSYADDDLTRAYGRWCERKSQPGDCLHLLADGPLLASDGKYSLAMAIAMDSVWDETAEALRDMADPQALLATVSASVSMYLLLWSLPEPVSKGLAALLTATAIAYLGVDTVWRILDGWVTLVREVERATTFVQLSEAGETYGEVLGENAARVFVMLATAAIGNTAGLAANTSRLPGSAQAAIAVETQAGYQYVAMGGVQSVAMAAEGFTIALAPNAVAMANRGMGSGGSRGRSQEHHLATDKNSVSTARGGPWTPEFRRLFRKAGMELKDPENVVDVPGHKGPHPQEYHEAVYERLRDATRTCRTVVACRKSLSAALKELAEEVTTKGTRLHRLVTKGK

SEQ ID NO: 15578 - protein, 217 aa, Myxococcus xanthus
MPKRYFRLKEDMQAENWDLGDPLDEKGQEVDDPYLFAAGQPVRVAGRLTIPVDAPGRRLDFGTAGIGAAPIVHVRVATLFAELAPDDVQLIPVDIQGHPDQYLILVATKRIRCIDDEACEEVRYWKPEHGQPERIGDYKSVMGLRIDASKVGAAKVFRTEGWDIALIVSEDIKKARSARRLPARSSRRCSPCKRPPYSPRRPCTRRQGDLGVLTSST

SEQ ID NO: 15579 - protein, 36 aa, Myxococcus xanthus
MASAPTLDEAAKVLGIDAPTLWCKRKKYESGGKGEG

SEQ ID NO: 15580 - protein, 95 aa, Myxococcus xanthus
MTSQMSVELRNVLQRGLEKELPASLAFDHPTVVALAKRLAGSVTAVDIPLPTVAAAPVQKSSPVPADVGDLSERLAQVSELSDDEVERLIALKLS

SEQ ID NO: 15581 - protein, 812 aa, Myxococcus xanthus
VGNVEAGRQARYVVDTEAPQVAATPRGSTFTGTRAVTLACDDGEGSGCAAIHYTNNGAIPSLDSSVYEEPLVLTATTRVRFIAVDWVGNVSEVVSELYTRETSGEDRVAPTTTATPAGGVYWSAQSVVLGCADDAEGSGCAGTYYTVDGSAPTTSSIRYTGPITVASSTTLRFFSMDIAGNVEPVKSEQYTMDTVPPVTTATPVGGVYQDAVTVTLVCNDGGSGCAATRYTLDGSAPVSSALLYERPITITRNTMLRFASTDAAGNVEQAKQESYVLPDLDRTASEQIQAVRNAANGPVNLIINGARITFIKDAVGNAVNDAAGFFLQAERTGPAVFVPVDPATLSPVPRVGDRVRVTVNAKSVVNGQTRASLSGFNVLSSGHSVSELLQDVSDVDVTIGGTQPEYESEYISITGTIGAPGFSAAGLGHLQAPLTTVGVPAGSVAAAVLRLRVVEPLRDSLALTSGCSLTVTSPLWIFMSGTRMTPTIQPTVWTASQATVHSCPAPRVINAWATTRNTVMVRFGRPLDAASLVANGSQFSIPGLSVTQAQLQSRTEVALTTSNQTPRQQYTVTVATTVRDARGVALDPSATQTSFPGYVQTARLRLSEVAPAVPQNRDLVELVVLASGSVQGATLTDGNTVLATLPDVQVSTGDIIVIHLNPDRVTLGWDAPASETTSRAEYPRSQYAANHDTAWDFQGGTTGIFPGNRVLRIRDTFGTTQHALAVIETNDAFANYPTMLQSLQAEGQWWPADCSGVPCDYPDAWDVSVDWTQAFGTPGLATSLGRNGQGDTDSASDWSVSMSSFGYANPLP

SEQ ID NO: 15582 - protein, 359 aa, Myxococcus xanthus
MFMPVATHAGFRHLAMEEVKEAGASILLANTYHLMLRPGAEVFKRFGGIHPFMQWDGGVLTDSGGFQIFSLPEDRLITEKGAHFRSFYDNSRQLLSPESSIAMQQAINSEIMMVLDVCIDSRTDEAGTREAMERTHRWAVRSLEAKAARDTGQAMFGIVQGGVFPHLRDESAAFLTKLPFDGFAIGGLAVGETKVERESMTLRATASLPADKPRYLMGVGTPTDLVEAVLRGVDMFDCIIPTKMAQQGYAYTFSGLIRISRSVFRLSDEPLDAECDCYVCKRYTRGYLQHLMRGKHHLGSRFLSVHNVRHYQKLMGRIREGILSGTYAQVYRELKAAIATPKDLKDEANAREVTLKEVG

SEQ ID NO: 15583 - protein, 249 aa, Myxococcus xanthus
MHPSVGPWQEALRLYVEQARLADRLRQPGPPLVIHDVGLGAATNAVAALTCARSLGAEQRRLLEVVSFEVDLAPLRLALADAEGFPFLQPFRDAAETLMRDGVWEAEGLRWRLLLGDAVPHLDGTLPVADLVYFDPFSPASNPEMWTEAVLARVRRHCREDGEGTLLLTYSAATPTRVTLLLAGFFVGAGVSTGTKGETTVGATRRESLEAPLGERWLERWKRSSSRAPHGGQLTPDIEARVLAHPQWR

SEQ ID NO: 15584 - protein, 288 aa, Myxococcus xanthus
MHDALQMEDWGGTGPVLHLAHANGFPPGCYRKLIEHLKPRYHVFTLRTRCLVPGSDPRELRTWDDMADDLIHALRAHGVQGVVGVGHSMGGVATLLASAKAPALFRAVVALDPVLFTGAREWALRALTLLGLRSRVPPASLARRRRESWGAREEAARSYGKKPLFARFDPECFQDYITHGLTEAPSGGFRLTIPKAWEARVFETSPKDVWRELGTVNVPSLVIRGGESDTLTRDALERARLTLNDPQTEELPGTGHLFPLEQPERCAQRIVEFLDGLESARAAARAVR

SEQ ID NO: 15585 - protein, 532 aa, Myxococcus xanthus
MFNVINVSKAYGPKKLFEDVNVTFSPGRRYGLTGPNGAGKSTFMKILAGDEEADMGNIVRPRKLGILRQDHFRYEDNRVLDVVLMGNRALWAAMSEKNELLAKSDITEEDGNRLGDLEGVIAEEDGYSAESDAATLLAGLGIDQASHEEPMKQLTGGLKLRVLLAQALFGKPEGLLLDEPTNNLDIDSIRWLESFLHDYEGVLITISHDRHFLNAICTHIADIDYETIIHYPGGYDDMVRQKAQVRSRVESETEEKKKKIAQLQDFVARFHAGTRASQVQSRIKQIDKLKSDDLKRSNIARPFIRFDQKVVSGKQTLMVEGIHKSFEGQEVIKPFNALVCKGEKVCVIGRNGVGKSTLVKMIAGQLEPDGGKIGWGHQASVGYLPQDHHGVVRKGTTCFGWLRDLHDKLTNEEISGVLGRMLFSGEERMKNTDTLSGGETVRLLLSKLMIMQDNVLVLDEPTNHLDLESIAALAEGLQKYEGTVIVVTHDQELISEVATRIWSLQAGKEVLDFNGPYSEFVEKHSDVAARRR

SEQ ID NO: 15586 - protein, 395 aa, Myxococcus xanthus
MIFFPRPPHARMELLGDLLASRPAFMRGFTDPSARARIVRWISSEPRMARQPWPVPSLSTQAELAEWLGVTGAQLDWLADVPGIERTSSPGRWRRYRYTWIPKRSGGERLLERPGLDLVLVQRKLLHDILDHIPPHDAAHGFVAGRSVRRFAEPHARQAVVVRVDIEDFFFAVRPARIWAVFRTAGYPDGVVRALAGLCTNRTPSAVVSQARRPDSLADASTRWRLARRLESRHLPQGAPTSPALANLAAYRLDVRLSALAEAMGARYTRYADDMAFSGGDALARRTHKLLRYVSQILREEGFTPRTGKTRVMHRSTQQRLAGVVVNDHPSIRRVDYERLKAILHLCRTRGPASQNTEGHPDFRAHLLGRIAWVAHLHPARGAKLRATFDQIAWD

SEQ ID NO: 15587 - protein, 95 aa, Myxococcus xanthus
MPLEGMMVKRRLPAEPGEVPIHCDIHPWMRARVRTFSHGYFATSGADGRFQLEVPEGTHTLVLWHERLPEQARTVTVRAGERVQVDAEWPVADLK

SEQ ID NO: 15588 - protein, 41 aa, Myxococcus xanthus
MRGLEAPRKAAVRPIGMQEMGPTLYEQLRRALVELTPVSSN

SEQ ID NO: 15589 - protein, 460 aa, Myxococcus xanthus
MVRNKQEGPLDEGALRELVATNTVNGRSFFWQQGMADWKRGSDIPELAGLFEPPPAVEPPPPPPAIAAPPPPEPARPSRGAPVRREPEPQAFIPEPEPEPRHAESEQPWPDEEEEAPDNTYYGDPVQRAQPQPQQQAQVTRRAQQPQPQAANAAPLDDALFSDLDLPGNRNGGDGEEPQDDGGVPYPDDPRAALGGGEDDDEGKAVEDTRHFAKKSGVTRRNPVWKYALFALLLLIVPLGLAYVLSETLGVVPLRVQTVDASGNAVEQPVFSSEGVGALRDKLMGREPPPAPPKGKRPVPPSEGNRPAAAPADTGAVADPEAAAAPSKGALEAVYVDPDKKDVDPTVRSGEEVAAADTEEVGGPSDEEVERVLAKTQPAFRDCVEAELRKNPSFKGGKVTLTATVGNSGTVKAATFDRKDLNRNSPVGTCIRDRAKGMVFSAFAGEDVDLEIPLVLSKSM

SEQ ID NO: 15590 - protein, 362 aa, Myxococcus xanthus
MTTAKRRAIDELRRGKLLERKHEELGHELESLQGTAAPDLDAALDDVVGDDLLRLMFVSCHPVLSKETRVALTLRLLGGLTTEEIARAFLVPVPTVAQRIVRAKRTLAEAHVPFDVPDSEELAARLSTVLEVIYLVFNEGYAATAGDDWMRPALCEDALRLGRILAGLAPKEPEVHGLVALMEIQSSRSRARVGPKGEPVLLLEQNRGLWDQLLIRRGLAALERAEALGGAQGPYALQAALAACHARARTAEATDWARIAALYDTLAQVVPSPVVELNRAVAHSMAFGPAAGLALVGALTSEPSLQGYHLLPSVRGDLLAKLGRLDEARAEFEQAAALTANARERALLLERAAACARGSGRS

SEQ ID NO: 15591 - protein, 1630 aa, Myxococcus xanthus
MSKEFYEKISNLSPKRLALLALDLHAESEALKRARSEPIAIVGASCRVPGGVRTPEAFWRLLSQGLDAITEVPRERWDAEALFDPDPSKRGRTYARWGGFIDGVDQFDAAFFGVSPREASRMDPQQRMLLEVAWEALERAGQPPDQLAGSKSGVFLGIIGSDYAQLQARQLGDAPDIYHLTGTSLNAAAGRLAYTLGLQGPCMSIDTACSSSLVGLHVACQSLRNRECDLALSAGVNLMLMPDPTVALSSSRGLAPDGRCKSFDAAANGFVRAEGCVVLVLKRLSDALANGDEILSLVAGSAVNQDGASSGLMVPNGPAQERVIEQALASAGLKPSQVSFVEAHGTGTSLGDPIELQALARVLGAGRSADTPLYVGSVKTNVGHLEATAGLTGILKTALSLRHEAIPPNLHFHRLNPDIVLDGAPVVVPTALQPWPRAEQPRLAGVSAFGISGTNAHVILQEPPVPSPRPAVPARGAELLVLSARSPEALQAMAGSHAHWLAAHPEVSLRDVCATASLSRSHHEHRLALAGHTHAELEEKLGAYARGEPVPGAATGRASGQTRRRVVFVFPGQGSQWLGMGRKLLAEETAFREAMERCDAAIHACAGFSVLAELAAEEGKGRLHEIDVIQPVLFAMEVALAELWRAWGIEPDAVVGHSMGEVAAAHVAGALSLEDAAKIICRRSRLLRGVSGQGSMLLVDLTLEEAKQALHGWESQVSVAVSNSVRSTVLSGAPGALEDIAQQLKQRDVFCRFVKVDVASHSPQMDPLRPDLLAALQDLAPRASRVPICSTVTGRMTDGAEFRAGYWADNLREPVLFSKAIEKLAVDGHDLFIELSPHPILLPAVEQHLRHLGREGTVLPSLRRDEDERGAMLSSLGALYAMGHEVDLERQHPVRGRLAALPTYPWQHERFWIESSTRTRRARDAGHHPLLGTHLSLAGQDGAHLWQTELYADSPSYLADHVVHGEVVLPGTGYLEMALAGASEAFGPARLALEDVIFQEMMVLPREEALSVQMRVIPEADGTRRFQVFGRPVDGAGAWTLHAEGRMCESTSAEPFALDEARARCPELLEGEKHYQLMLERGVDFGPSFRLVKEMWKGEGEAVARLELSPSVAAEMTAHQLHPALLDACLQAINGAGLGDRRGETFVPVAVDSLRMHGRPGRALWSHARVRPGTGSGPGSIEADVTLLDAEGNVLMEARGLMARRLDAVRRRSADEIDQWMYRVDWQEAPRETPTAVSESTPGTWLVLADRAGFSGKLRAVLSERGERCILVSHGEETRLVEPGHYMVDPSRAEGFTRILDAEFGAGRPACSGVVHLFSLDVPGLEAGTDALVKARTLGAASALHLTQALVASGFRDMPRVWLVTEGVQAVKPGEQVAHVEQAPLWGLGRVLALEHPELRCCSVDLGARDEAQAGVLADELLVSSSEEQVALRGSARFVARLSRMERSTAAPAKLRADATYLITGGLGGLDLKLAEWLVDRGDRHLALLGRKGASSETQPVLHALSAVGVKVRVFKTHVKARPDLDRVLAEVSPDMPPLRGVFHTSPVLDDGVLVNLLHRASAHGDGAQGPRRLASAHADGIGAVGALRVVRRGGFAAGLAGAGQLRGGQRLPRRVGSVSAWARPAGAER

SEQ ID NO: 15592 - protein, 133 aa, Myxococcus xanthus
MQELVAGILRAMGYRTRVAAPGADRGVDIFASPDGLGLQEPRIFCEVKHRVGESMNSQSIRAFLGGRKQGDRCLYVSTGGFTKDARYEADRSSVPLRLLTLSDLRELLVEQYENLDAETRALVPLKKLYWPVG

SEQ ID NO: 15593 - protein, 109 aa, Myxococcus xanthus
MDPAGNVVARLGRFLGHQTNNCAEYMGLLLGLKHAQSLGARKVEVFADSELLIRQLGGRYQVKSPTLKPLYEEARKLLKGFTKVKLHHVPRAQNAEADEMSNRAIDERM

SEQ ID NO: 15594 - protein, 188 aa, Myxococcus xanthus
MEKQKAQLEQNITDEKDKVKKWETRLSEQRSTREYSALAREIDIAKKANLTMAEELTELTKQLGGAREAIKGKEADYATKQQGLSGRMTELRGKLGEAESQVKGLEGRRAEVASSVDATLLRRYEVVRKKKLPAMVGVVAGTCQGCNMNVPPQLYNQLRTGLGTDICPSCNRIIYAVEALQETPAASK

SEQ ID NO: 15595 - protein, 81 aa, Myxococcus xanthus
MTTRATLDRIEDDIAVLVVEGRELTRPLSDLPAGIREGDVLDLDTLEVDPEATEALREEVRRAREKATRGKKPPPAGSFDL

SEQ ID NO: 15596 - protein, 292 aa, Myxococcus xanthus
PSPATPNALQRLPLGAGVSLTVLWPRAPTEPLLDVPEAALEANSVILRLTYGDTAVLFMADAHARTVDHLLARNAPMQATLLKVAAHGTEGPTTAAFLTAVGPRAAVISAGEGNLIGAPAPAMLKQLEATGAQVFRTDLHGEVQVVSDGKTLVVTPQRLSAGVPEDTRYSYPGLGTPMPRDAALAGDSQRATGRSGTRDGSGKQPTGKMYTLSLDDPTDEGAPPSRAGSRSRSEASDSGAVKVGAYVGSVRSDVFHRPTCRNVVKIKSSNLVTFSSREEASRGRRPARDCNP

SEQ ID NO: 15597 - protein, 323 aa, Myxococcus xanthus
MRARETSLMDLRFRPYLGAFVSEEHLPAPDLPVARGLAAREQRMLRLALPALKEAAAGLERPLPLMLGLPEETELSARSEPVPFLKALGLASGIALELQRSRCFPNGRAAGLLALDAAVRFLDESKAPEVLVGGLDTLLDPTVLATLEGEDRIRRYGPADGLIPGEAAVFLRLGRKGEGKRLGRVPLARVLATATGKEPGHRYSREPYLGEGLAQTCRLLFDSTPAGLPPVRCVYVGFNGENFWAKEWGVTFLRSRERIAEAHRLEHPAENVGDPGAAYGPLMVGVAALGLRKGYREGPVLVWCSSDRESRGAVLLQREDPEA

SEQ ID NO: 15598 - protein, 224 aa, Myxococcus xanthus
MGWVAKAGALEEFEVEIGATPHHIIPGKASMAKSRLEQWTRAEKGKIKEDIGYSIDCARNGVFLPKLPDLYGTKHKVPGVTMAQFYGQTWRALSPASKEGVGFLVMKDTWLQLHYTDHSKPYKTSPTMNYDKETRLECDQLAHLAERFRIVCERSKDDDGKRYPPYSLVHLINQKSDFFKMRITGRPDQWKSWVSTLAEDLSMAVRQGRELLVSKLALTKKTRG

SEQ ID NO: 15599 - protein, 206 aa, Myxococcus xanthus
MFKGTKTHPEGDRERILGNFGYDDNAFTTDDITLYYSYGPTAGLPQLIEIEADRFRNLEYSQPSFQTEALAVLGEYHKNAAAPFLKMEEELNAAAFTRHTYQHTTMGFYKDIQAMPQAYDYSRTFFERWYTPDNTLLFIIGDFDDAKVMELVRQHYGPWDRKAAQVSVPAEPPQKGPRTAHIDWPQPTQPRQVIAWRTPGAGTSPV

SEQ ID NO: 15600 - protein, 459 aa, Myxococcus xanthus
MDRTARVWELTARRELHRLTGHGDKVESCAFSADGERVMTASADRAIRFWDARTGALLDVQRNTGALSAVAIDAGFQQLVQAGWEGRVQRVDVRGGGEVLERLDAHRTFVMAVALSPDGRTFASGGMDGVLKVWSRPEVPPDVLLRELPAWPEVLTSVGPDAFVSGGEDGLRSWSVSAGGELHSRLEAPDAVGAVAVSADRRLLAVGTLKGEVRVRDVRSGNQLMVIPAARESIRALAFSPDGALLAAGVAQDVVLWAVPSATQVARLTGHTGKAWALAFDATGQRLASGAADHTVRIWDVARGTVIRVLEAGDRVRAVTFLASGELLTAGMRQPIRLWSPDDGRVLTSMDSLTVGVLSLAMAPQGAFVASGGVGGEMKVWRLPDGALMGEVPGLQGFVSAVTFSSDGAWLAAAASDRTFHLLGFDAFALPPPVEPDLTRILRRHGLAWDDLRGAFTLH

SEQ ID NO: 15601 - protein, 184 aa, Myxococcus xanthus
APKVHGAWHLHTLTASAPLEHFVLFAAAGSLLGSPGQGNYAAANVFLDALAAYRRGLGLPALSVDWGAWAGVGLAAAAEARGERITQRGVDTMPPSQALEALSRILGSPLSRVVVMRFDLRQWSEFYLTAARSPFLSRLAREQASAANIPAVRGAFVETLRAAEVLKRASLLEAHLCEQAGHVL

SEQ ID NO: 15602 - protein, 262 aa, Myxococcus xanthus
MGMEDDYDLGLKLVHTQGPWDLQVAFYKNDEGSFTGRSTDSARYSYDVVQVSSSNPGEAYLGVDSANHESNKLNARAAYTFQHGDLGRTEVGVSAQTGQIYNSVTKRNGLNWAGAVHLDGYYGPFNLRMEVLSYGYDLKNPEGHDDSIVTMGAYDAPYKMATRGTVYAAGLSYDVPVSWGPITKLTFYDDFSLFDKANAAFETSMQNVLGMLVTAGPVYTYVDVASGKNQPWLGPAYGHALAEGDPNAPWETRFNINVGYYF

SEQ ID NO: 15603 - protein, 394 aa, Myxococcus xanthus
MEKIEVRGLRKIYGGNPERAIALLEKGQSKQQILEETGCTVAIQEASFDVKAGEIFVIMGLSGSGKSTVLRCLNRLIEPSAGSVHVDGVDVTRADRAGLLDVRRRKMAMVFQNFGLLPHRSVIRNVEYGLEMQGLERRESRSKAMQALELVGLKGYEEKLPHELSGGMQQRVGLARAIATDAEILLMDEAFSALDPLIRRQMQDELLELQSRMNKTIVFITHDLDEALKLGGRIVIMKDGRIAQLGTPEEILRSPADDYVRAFVEHVDRTKVLTARAIMRRPESVVHPKDGPALAVKRMRESGTSTLFVTNQARKLVGLVRIEDTLRLMAENKHSLEGALVTDLPTTSPDTPLAKLVAVAATTQIPIAVVAEDQSFLGIVSRATLLASIAGEQP

SEQ ID NO: 15604 - protein, 277 aa, Myxococcus xanthus
MSTLRIGEGFEELIDWMGTRGAPVFDAIRSGLTACINGLESALLLPPSYAIITVLMVLAWRLSGLGTAVFTALGMLLIQDMGLWKATMETLALVLSSAMVALVLGIPLGIWAAYSRVVERVLRPALDLMQTMPAFVYLIPAVLFFRLGKVPGVVATVIFAMPPAVRLTNLGIRQVPTEVVEAAIAFGATPRQTLLNVQLPIAVPTLLAGVNQTIMLSLSMVVISAMIGAGGLGEQVLKGITQLRIGLGFESGIAVVILAIVLDRLTHALGKPRTRSS

SEQ ID NO: 15605 - protein, 309 aa, Myxococcus xanthus
MKETRPVKISSLNRLPLLLTAVAGLLVAPGCKQENKAPAAGDTEAPAPAKKPVVRLVYVNWAEGVAMTHLVQAILEDRMGYEVKTTMADVAPVFASLANGDADAFLDGWLPVTHQSYMERFQGKVVDLGTNYEDARIGLVVPADLDITSIEQLNGKAKDLNQSIVGIDSGAGIMTTTEKAIAEYKLDLKLVPSSGPAMTAELKDAIAKKRPVVVTGWKPHWKFARWDLKFLDDPKGVYGAKESIHTLTRVGLEKDLPDVATLLRNFKLDDQQLGSLMGAIAEAEDAPEKATREWVKKNQALVDGWIPKS

SEQ ID NO: 15606 - protein, 270 aa, Myxococcus xanthus
MKTQPFKGRVVLITGASGGIGRTAARAYAAAGADVVLAARRLPELEDAAREVASLGVRALPVRCDVTVGDDVTRLVRETDAAFGGLDVLVNNAGQGLYGPLEGVGEEQLRQVFELNVFSLWRMTREALPLLRKRRGAQVVNVSSVLGHRGLPLLGGYCASKAAVNAMTESLRAELAAEGIRVLLVSPGFTESDFRENRLHAEGWRQDAIPLKAMSAEEVADAMVRASRSGRRDTVLTLPGRVMVVANRWVPSLFDRVARRMALASKKKDA

SEQ ID NO: 15607 - protein, 322 aa, Myxococcus xanthus
MLQQTQVSTVIPYWERFLARFPTARALASAPLDDVLAGWKGLGYYSRARNLHRAAQEVVARFGGTLPSTAAELLELPGFGRYTAGAVASIAFGEEAPLVDGNVARVFSRIFEVEGLPGDRQREATLWALATALVKGERPGDFNQALMEHGATTCRPENPLCLLCPVRGACVAFRKGRVDELPPAKVRATPKKLTLAVAVWPHAGTLLFARRADAGLFGGLWELPAAEIADDAPDSEARARLSAALGVDVTLEGALGTVKRQLTHRDLSLRLLRVSGPRRPASTPAFQELRWCAPDDAEKLGMSTAMQRALDIALGAGVLPGG

SEQ ID NO: 15608 - protein, 65 aa, Myxococcus xanthus
MDVGTAFEKGWGAEVPLAAGLEYRHNGVTAGLRATYRVLVARDFAPNSADVGNLFSADLSLGARF

SEQ ID NO: 15609 - protein, 208 aa, Myxococcus xanthus
RRPPLSNDFSWSKSRHEKFSECLRAYYLYYYRSWGGWEASAPKDVRELYVLKKLGNRYTWAGSVVHESIKDVLLDWRAGREVDPAAVEARTRKLMQDDFRHSRSKNYWSQKYRKQFTGLVEHEYAEAVPDEAWKQNWETVRSALSWFFSSRWKDLAHSLKPEQWLEVDAGFDFAHFTLDGLKVFAIPDFAFVDADGTPVVVDWKTGKS

SEQ ID NO: 15610 - protein, 243 aa, Myxococcus xanthus
MPQVTNDLSTALNRKGLFVRKEKDLLRAFRKYARSYSPQPVESVWDWLALAQHHGLPTRMLDWTFSPYVALHFLTENPERYGEDGMVWCVDYRQTNRHLPRRLKTLLQREGADVFTGEMLATTASDLSTFDHLAKHPFVLFLEPPSLDARIVNQFALFSVMNGPELRLDTFLEAQVDGVRKLIIPAALKWEVRDKLDQSNITERVLFPGFDGLSRWLRRYYGPRAPAHASDAPPVRKRRRVTR

SEQ ID NO: 15611 - protein, 363 aa, Myxococcus xanthus
MSAPNIRRAVQLLPACATTGIGSLPHTQVELGLQAALALDIPFLPQLPVGKPSELMIPAALEGLPGLAFDEEGLCTVDLAAWQAGRAAFEARLEAAFQSGQFEAFEPSPEACRAWRPFLWEVEARKLAFAKAQLAGPFTVRSVARTTDGQPALEVPGLDEAMYRLSLARSLAMVKALRRAGTTPLFYLDEPGLYALQRTNPRHLIAMQELKLLVVALQREGALVGLHCCGNTDWAALLDVQPDLLSLDVRLSLDAMVEAGAALERFLAAGATLSLGIIPTDLASTYEVGELVDSVEATLKAALPAGFTFAQVVSTVVLTPACGLAMRSVIDAERILEELKVAQRRLRSALSAERPSVDTVNPH

SEQ ID NO: 15612 - protein, 310 aa, Myxococcus xanthus
PRPGGIDAKYAWTVLGGQGQNVKVVDIEGGWRTTHEDMPDLFHMGGTQYTDQSWRDHGTAVLGEIVGARNAYGVTGIAHQAKAGYESIGAQSTASAITRAATAAGLGGIVLIELHARGPSDGTACSCNTSQCDYIAMEYWQANYDAIKTATANGVIVVEAAGNGSADLDAPAYGSAFNRNTRDSGAIFVGGSTATTRLPMCWTNFGTRVDVHGWGERVYSMGYGNVFGASYGEDQFYTSSFSGTSSASPIVVGAAASAQGVALANGRRLTSTQMRSLLRANGTPQPANTRQIGPLPDLAKVLPKVIAGDY

SEQ ID NO: 15613 - protein, 292 aa, Myxococcus xanthus
  unsure (1)..(292): unsure at all Xaa locations
PPXALVTRGRSAEVKVLDAVPTAPDWERHVLTNTPLDHIWKFINPVMLYGRHLGLRSSARVLGTPAEAELAKTEEGRKALALKEAVEELKGFLRGGLMQARAVFQFYKAGSDGNRVVLFDGASGKEAASFDFPRQDREGGLCLADYLRPLEGGAPTDNVAMFVVTAGSGIRELSEELKAKGEFLKMHAVQALALETAEGYAELLHTQLRSMWGTPDRQDMTMLERFRAEYVGKRYSFGYPACPRLEDQSKLFAALRPEDIGVQLTDGSMMEPEASVSAIVFHHPQASYFSVT

SEQ ID NO: 15614 - protein, 543 aa, Myxococcus xanthus
MHVLRKTFAVTAAAMALAACGPQPETSPEETAPESQVPAGAVDDAARAVADAARRTPNELDAQFTKAAGEFNVPVSLLKAISYAETRWEHVRGEEEFEGRPAAFGLLALRGQLITDGAALAGVSADAVRDEPLANLRAGAALLSKYADEAGIDRADLGAWAPVAVRLTDISDPDIQAHYIHNDVYSVLREGAGAFTPAGKVAVSLESTQVNPKFALPNMQALAAGPDYAASIWRPSPNYNARPAGIGQQMVVIHTCEGGYSGCWSWLTNSAAGVSAHYVVNESGTEVSQLVRESSRAWHVAAAYRSSLNGGVKSNLNGRSTNDFSIGIEHGGYASSASFSTGMITTSAKLTCNITRDQGIPRDSYHIVAHGRLQPETRTDPGPNWPWSTYISKIRSECGDGGGGTNPVIVVDSNNANNDSSKGYIAVPSTWARGTSAGYYGNDYYYASTQPVSEPAVFHFHMPAAGSRTIQAWWVQGTNRSPAAPFMITHAGGNSTVTVNQQTNGSKWVTLGTYNFNAGWNKVQLSRWATEGYVVMADALRIQ

SEQ ID NO: 15615 - protein, 72 aa, Myxococcus xanthus
MVAVAGGAPVALTDGKHRDDMPAWSPDGKYLAFVSERQGDTDVYVMRADGSGQTRLTTAKGPDWLPRWAPTR

SEQ ID NO: 15616 - protein, 263 aa, Myxococcus xanthus
MGLEGAALSEKHQRRAPEWDAAPFMWKPGVVEPSPAPRCGLTQRQRPLPPEEDDEPERPDGGALEPEDDFPLLLPPRPQPPLLELEPELLLELRLLLPELLPPRPQPLPLELELLELELLEPELLEPPLLPPRVFQPLPLLELPLLELPLLPELPLPQRLPLLLSRESSSFGAALFEVRPAGGLLHPLPELLLGAALFEVRPAGGLLQPLPELLPWPRDGRWLPPELEPRGVVQRVPPGGGRVPLYVLPGTTGRLEGRVAGRT

SEQ ID NO: 15617 - protein, 227 aa, Myxococcus xanthus
MHRFGWSEHPLPLQRAWDERVAPEDVVIVAGDISWATRAHEVMDDLAWLDARPGRKVLVRGNHDYWWGDSASKLRKLLEPFRTLEGFLHNNAVVMGPWVIAGSRLWTAPEAPPMPGGEMGDEAADTGYVERETRRLTASMEDAKKKEAASPTPLVRVVAVHFPPVYANEKSPPFSEPIEAFGPKVCVYGHLHAAGIAAGFTGERGGVRYVLASCDAAGFAPVLLYGV

SEQ ID NO: 15618 - protein, 791 aa, Myxococcus xanthus
MARGIAWLATLGAPLVGALYLLGWAWDVEMLRPGVAGIPMTPVTGIAMIFGGAALGLRLRARPFRHQESTATACALVMVVIGAVSLLRDITGWDVGMEHIMLRLLDGHASVLPLPSPLSATCLTLLGAALALPERSHSVRLRDTLVVLSLVTSTLGLNGLLMGPLLTVGTLPFLAERSMGLPTALTLMLLAVGTLCAWPGLGLMGRITRDSLGGFLARRLVPVTLLGPSVLGMVLMLLHEVRAINLEAKLPIFATFVSAGGAALVLLSARALDHIEAHRQQATAALEASEARYRGLLETTPAPLLTVDAQGLLRFVNTEAERVFGYPREELLGREVEVLVPEGLFGGRSLDTGLGERAIQGRRKDGSPLSLEVRLSPVSGPEGPSVLAVVRDVSERERYLSKVQRAREEAEMQRSQVQALLDHTPVGIVFAEADGGGLVANPVAEQLLGRPLKGVSLAMTGINPVVLTTDGKPARREDVPIVRALLTGQLAGPEEFLILHPDGSRLPVLMTAAPVFGPSGKVRGVVSTAQDVTTRHELDRLREEYVSLISHDLRNPLHTISLRVGLLRRALREQNLEREESMTEAIQRSVAWMNTMIEDLLEGSRLESQRETLRREPRDLARFLEEVMERDVAPDVRERFHLEVPGALPPIWMDAARLERVMANLLSNAAKYSPGGQPITVRAQLQPEQVVVSVKDLGPGLSPEDAARVFDKYFRTQKSGASDAKGLGLGLYISRLIIEAHGGRIWVESEPGQGSTFSFSLPVAPPGANPLPPQVPDDQAPAAGDGSAVSA

SEQ ID NO: 15619 - protein, 173 aa, Myxococcus xanthus
MHLSLAVGAEAAGLVPAHTVVYDAGFTGARPRTDIIGARVWALPDAFHDALRVCVGESAIRGHTDNRAATLRDAGFVLGRVVDASGHPVAGAKVAPDGEALAGRIYYPTADLQGVNQEGTGPDGLFVYVHSGADAEAFLLSVTGTDDYTPRNVGVAPGWGLVLTVHPGLHPPP

SEQ ID NO: 15620 - protein, 330 aa, Myxococcus xanthus
LMASGVAEWAQEKPALIDAFVAATLGESLRLSMGMSKTPLFISARDESQEARAIPELSLLAQTFWPRRDLGIEAWWAPKTLPVEAWVRVGNGSRSPLGNDNSLPALDARVDGRWGRARGDVDAFWGFRAGAGVHVENAYDRAGIGGIGPQNFVFYRAPPVSGPRSVVEAHARLDVGPVRVLAEGAAAWERRSRDTDGNPNTPREGLPRMESQGASLEVSWVVVGRPRGDGARWPVAPNDPTGMDAVNAGQVPTGAVELAARVERLWLGPGASDIQPGGTTGGALAVRWWVTSFFGLGAAGYAQGYDTAPLEDPGRRNSWLALARATVSVP

SEQ ID NO: 15621 - protein, 387 aa, Myxococcus xanthus
MHLPPPSEHTMVRTERVARRVFSRLNLALLLTGALAGCGGPMEPAPSALEPEGAQDVQAQALTYPSGSSQTVVSRRVVFRNGSGAYQAAAGFEHFRAAGAFDIALHNIRIAEVDAPATREALVLMSAGQKISSSGHSSGVTGQASNWDASCDSVSCPNVSLDGRSLAMKLRALGLFPSGKTYLSVVNDANFDHLFDSDTKQRIVNGFSNWLQAQVRPETRAIYLAGSSRGGCLMMRMAQALRANTALDGIDIYVSSFDGVCRNSQGELGTFDSKINNPVRPWGTFYGAWATNLTAQFPRRDRLHIFHVVGGQEVAPATGIRAFSGYAGSTPPSTGTNLDWGWYKQTWVKWQHKEIGNPYTDPSASDQAQAVAETVDAHLTWLDARLP

SEQ ID NO: 15622 - protein, 293 aa, Myxococcus xanthus
MLTNTNDVGTVRDSVISWAMKRGLEWELGLPVVAETWDGLLNDIYGFHVKATHAHRALDSAKSGPVAEGSVGGGTGMVCHSFKAGIGTASRKLPESEGGYTVGVLLQCNYGARHLFTVEGVPVGEEINDLRPCYTGPKKPSPGMFKDLPACSASRGDTQPRTPEGAGSIIVVVATDAPLLPHQLERLAKRVPLGIGKMGGLGGNSSGDIFVAFSTQRLKPPTGTDVAGVSTLDNERMTPLFEATIQATQEAILNSMLASDTMTGAESSRVYGLPQDRLIQVMKKYGRLAPPAP

SEQ ID NO: 15623 - protein, 524 aa, Myxococcus xanthus
MSAAPLLLAWLTLASTPAAAPPPVHDVFALDEAAFVAQAQTDLALLERHVRGLRGLQEAVKQSRAVYQQKQSVPYTPDQKQLLLSTWAAFFDYFVSVEVIRQRYWDFVKVPAHAHPKKHAWGFLLTHGALTTELAHGLTYAELTLGKKQLEVLLDEPAPEYGLPARAFARFKDKAIHVSTSTQLLTGDGYKEQLRPLLVKAGALDAPRVPWLLQEMKHNSKVAKGLLTRRGATLFAKATVDLTADTAQRAFFPVQRAVAEWMGDTRVRRVGQPLISREQALSLLEKMEPGDIVVARQNWYLSNIGLPGFWPHAELFIGTPAQLGAYFDDDSDVKAWVATLPGAPGSLTRHLARAFPAKWAEYTGKDAHGDPLRIIESISEGVSFTGLEHGMRVDYLGVMRPRLSRLEKARAIVRAFTFQGRPYDFDFDFFSDQTLVCTELVWKSYAPTGDMTGLRIPLVSVAGRRTLPANELVRLFDKEYGREDRQLDFVAFLDGREAEGNAREADATAFRYSYRRAKWDIAQE

SEQ ID NO: 15624 - protein, 95 aa, Myxococcus xanthus
MGQRTWSNHRFPLEVSVSQPFGETPSQRATWKAEFGVYPRWGAGFGVFARYVKGQDYYNILFLEPVALWQFGLAFELNPGARLRAAEEGRPPGFP

SEQ ID NO: 15625 - protein, 410 aa, Myxococcus xanthus
MALRAVLPCLKERGDTPTRQHAAQVLAAMQDPLPDEVRVAALSLLGDAHRAVRREGLHVLARFPRDEEVLTALEEQAIVDDENRNEALRVLSLLAPSRAIPRLLEVASSARSRRQEDGPPPPSWRGPLGETRRLEDGKRALLFIARLGVRGAEALAPLDALRSVEVLAPYVDAVMDDITRAVLRQQAPPLRTDRFQEPLCAALLTDVAWPVERTEEPSLALRPWLESLAAFGTEVEVRVALAAARHVLWLWESQDPNNDWSRRAVMAMDRWLCEPSEEHAAQVAEVGNFTPSQFCAPDAFSAAWSVNYACGCVPRPSAPVAPRPPEVDPLGACVHAACRALSRRSVITFALGASEESPEPLSPHASARQVHRAIVDEVLPWACGAWDPVKDTPRLRKALRADGWRIPGAP

SEQ ID NO: 15626 - protein, 336 aa, Myxococcus xanthus
VPDGAELYAFLARKFTTTGLGAEEIHALGLAEVQRLRAEMEAVKAQTGFKGTLAEFFRFLRTDARFYARDGDELLMRYRALSKRIDPSLVRLFKTLPRQPYGVEPTPEAMAPDATTGFYYPGASDGSRPGTYLVNLYRPETRPLWEMVPLTLHEAVPGHHLQTALAAEQPGLPEFRRYGYYVAYGEGWALYCETLGDELGLYTSPYDKFGQLAYDMWRAVRLVVDTGMHVKKWTRQQALDFFMENSPRQELDTTNEIDRYIAWPGQALAYKVGQLKIREMRTRAEQALGPGFDVREFHDVVLLDGSLAMDILEARVQAWVQARQRGAAAPTPQRAD

SEQ ID NO: 15627 - protein, 341 aa, Myxococcus xanthus
MSSTLLLTDPLFFQHDPGQGHPESPSRLRRILGVLASTPVKGTVMTAPRSATEAELASVHTPELLAYLQRINGHRAQIDPDTQVSPDSVDAARLAAGASVQAVEAVMKGEARNGFALVRPPGHHAEPDKAMGFCLYNNAAIAAEAGRKLGAERVLVLDWDVHHGNGTQAAFWSRRDVMYQSVHQFPYFPGTGAAPEVGVGAGEGYTINVGLPGGNSDADYGMIFEELLLPVAEAYRPQLILVSAGFDSHQHDPIGGMDVSERGFAAMCSAMKSLADSVCQGRLVLLLEGGYSLEGLSQSVHACVEVLAGRKDSFPTGDTHADAKDALRASREAMRPYWPRV

SEQ ID NO: 15628 - protein, 253 aa, Myxococcus xanthus
MAEMSYRTALVTGASSGLGRGLALWLARRGVRVFAAGRRLPQLQALRDEAQAAGVTVEPVELDVTKADATLERIRALDAEAGGLDLVVANAGVGGTTNAKRLPWERVRGIIDTNVTGAAATLSAVLPQMVERKRGHLVGVSSLAGFRGLAGHAAYSASKAFLSTFMESLRVDLRGTGVRVTCIYPGFVKSELTATNNFPMPFLMETHDAVELMGKGIVRGDAEVSFPWQLAVPTRMAKVLPNPLFDAAARRLR

SEQ ID NO: 15629 - protein, 148 aa, Myxococcus xanthus
  unsure (1)..(148): unsure at all Xaa locations
RRFKSVGTLTLLDVKRGDIGSTMEAYAETVFGEGSAYEADAATFTAYLGLGALLKTLERARASGAAAFLVVRSSNPEGTSLQMSRGEDGRTVAEALADGLRAFNEKPGQDAAPVAGAVMGATLPDSDRGVIERLGGALLLTPGIGXKS

SEQ ID NO: 15630 - protein, 209 aa, Myxococcus xanthus
MKQSRRHFRANLRYLRALVRRFRTTLVLSAVLFLGGPLLFHWRFRGPGGDRIDFGEALHHTYFLLYGQPSLPYVDDWMVELLNLVIPPAGIALVADGVVRFAYLFFARHKNDKEWIEVVSETMKGHVVVCGAGRVGYRVVTQLRDMAKDVVVVYKREDAAFVSALRDELVPLLIDDTRSPLCMPRTNVKDVFPHRVIEGAHHLTEQRVL

SEQ ID NO: 15631 - protein, 104 aa, Myxococcus xanthus
MHEQLSLVLLLILAFGIIFELPLVMALLGVVGVVKSSWLFRYQRHAFVVCLIAAAIITPTGDVVNLSLMAGPMLLCYELGVLLVWMVERRRARNSAETGITPAS

SEQ ID NO: 15632 - protein, 179 aa, Myxococcus xanthus
MQPVLDALPPENRSLIYTSGIEELNVLMKVGVYCGIFLTTPVILMQIWGFVSPGLYPEERRFAAPFVAFGSIAFLLGAAFCYFAVLPSMFTFLLNEEETLALEQRLDTARLRADDALRFFAGERERGAPKNEPHWARPGQHRAECAPAGEIRAVEAGRSDRGGGFAPSPRVAAVKAVRP

SEQ ID NO: 15633 - protein, 174 aa, Myxococcus xanthus
MVFILVAALLILGPQRLPELARGIGKFLREFRRQTDEVRNVVEREFYAMDQEIGEPPTAPLRPGTRFAPQPPQAVGGPEATLPPATDGASPPADAASPQPSSPAQVLEMDAQGPREVATSDVHAGETPAQDAATAEPGAEPTAEAPPEPAASTATSPTLSPIPGTVARNAPKRS

SEQ ID NO: 15634 - protein, 83 aa, Myxococcus xanthus
MLQLSSQLFEKMISQQQAKVLRLAREAVPNISPEEVRNSHDFPELKEHPTFEFEDGILSGLIAAQIALRAEIKGRLPLEPPAF

SEQ ID NO: 15635 - protein, 425 aa, Myxococcus xanthus
MPNQRQVSERAVVALIGAVQFVNILDFVMVMPLGPDFAKELGIASSHIGIIGGAYTAAASVAGLAGGYFLDRFDRRKALAVSMLGLVVATAAGGFATGMSTLMLARVVAGIFGGPATSLSLSIIADLVPVERRGRALGAVMGAFSVASVAGVPMALKLAEFGGWRVPFFAVAAMGLLVVLGAIFYLPPVRGHLDAGPRKQAGVLELLANRDIQLSYVMTALVMMAGFVLIPNLSAYLQQNVGYPRDLLWLPYFIGGIASFATLRVAGPMVDRYGSFKVGTVGSALVLLSTYVGFVHLPRWMPVPVIFTLFMVAMGTRNVAYNTLTSRVPDTPVRARFMSLQSAVQHMAAAVGAFLSARLLTDLPDGTLGGIPRMAGVSMVLTLLLPALLWVVERRVHSREQARALAVAPSQGMAVPLSPGADSHA

SEQ ID NO: 15636 - protein, 897 aa, Myxococcus xanthus
MTSRRDQNAACVPLPWCTSQSRTSTRSAPSFRPASAAMAALLYRQKPMALSGSAWCPGGRTSAKPLRASPFITASTACTEAPAASRAASTLSGDTWVSGSICARCPLMRWRYASSSGVWTEASSASVAERGAVITVPFTGVLASTPRMRRSREGDSGWPCPGSCWKKSGSVSSRVEDIGMTLRIRQAGSQRPPGDRPRWRPVLALPVFPSLQCLVLALRFKKPGLRSLLLGSFALVLTLILGTLLFVVPSRVEAHLEQRLQKRGEARASQAVSMLMAQPAAALPDSLGRLRAGDDDFKVLAVLSSEGQVLATHPAEPPAWFQAELKARQGQPLDGFRFANGDRSVARSVTLSGGVVGQALLVLDNSGLDAVVTELQRVVMLAFGIGLTLFLLVAFFISRAFILVPLDAMMGMARRLAEADLTGRVDVGTRDELGQLAEALNRIAQSWRDTLGRVRGVSDVVAGVVEQIHRTGTTVSSGAGTVQARVEETSSSMVEMMASLRGIAENVEVLYQSAEESSSSIMEMAATNDEVAENVQAMAASVEETTSAIEEMTFSIKEVATNIQELSASTEETSSAISQMDAAIGQVEANAKETARLSEQVFDDAQTGVESLRKTLTGIDRIKETSRSAAHVIESLGRRISEIGNILNVIDDVAEQTNLLALNAAIIAAQAGEHGKGFAVVAEEIKDLAERTGASTKEIAELIRSIQEESRNAVVVMNQGVRSVEEGVQLGREAEGALRKINDSTQKSTQMVKAIARATVEQARGSKQVTASIHRISETVQQISKASNEQARGGEQIMKSAEKMKALTAHVQRSSQEQAHGSKQITRSIESINEMVTHLNRAQKEQTKGSEQVLKAVETIKGVSEHQTRSVKQLEEAIDNLQRQAEILRAEVRRFRV

SEQ ID NO: 15637 - protein, 130 aa, Myxococcus xanthus
ANLNTAKDVLGVAVRVLKARVAQAEGRPQALTLWREAVDAADRLSYAEPADWFYPVRHYQGAALLEAGRNQEAEAVYREDLRRNPKNGWGLFGLTQSLEAQGRHEEAARTRSAFEKAWARADFPLTTTAP

SEQ ID NO: 15638 - protein, 124 aa, Myxococcus xanthus
MSDTPTLLLVDDDSFVRRILKDVIADTGIELRLLEAADGEEGLAVAAREKPAVMFLDLFMPKKSGLEVLGAIKAVSPTTRVLVISSMDAEPVVEQAMAAGAVGFVGKPFHPLEIASAVRQALAH

SEQ ID NO: 15639 - protein, 271 aa, Myxococcus xanthus
MQSLPAHEVFGLKPTASLDELRLAYFRMARRFTPDHVSPDTHPELKKVSAEIFDFLSRRMRDAEANWTQAAQAPRPPPPVVPAAPPRPPPVVHAAPAAVRAPVVPAAPPPRPVQAAPVMARAPIAPPPAPPPPAPPPPAPAMRRAAAAPTYSSAEFVGLERRSDDRIHADVKVTLQNAGIFTDHRIINLSSGGLFIATDKPLRLGTLVELTLRFDEPPRVLTLRSSVIWENSLEDGKNPRGYGLRLSHLRPEEKEFVQKYLARAKDLKKKP

SEQ ID NO: 15640 - protein, 542 aa, Myxococcus xanthus
MTVVSTASAEYRLLEAMPLPTALIRGEQVLRVNAALATLLGVPASELEALSLSESIRRFVPAERGWVEPLYESLVRGGPLPEGPVWVRVQPVNGPQRTLALRHAPGAHPDELVVVLLEAEAEDSVRRLTEALVAAAATMLRCRDERSVLETAVDAIYRQGFSVSVVYVDGDAFRYGPLRQSPFIVAEAEQLYGMPLADVRIPNAALPHFLEVLERRKAAFHHDMLGVARFPPSANGESPVCQLHPPDMRGLDAPILVDGHPFGVLSVQGPALTPAGASTLELFAQLVGGALENVRHHQMSAVRLEEVSRLQDELVARERLEVLGEAAGVVAHEVRNPLGAILNAVAVLRREAHLGPTGQAAVGMLEEEAIRLEDIVRDLLDVVRPLEPRPRPVQLGELVRRALGQMHGPPDAPTLRFSVDEAAETPPLEGDETLLQLAVTHLVRNAVQASPAGGKVRMTVEPADGGVRLVVEDEGPGIPDVDPQRVFQPFFLTRANGRGLGLAIVRRVVLAHEGSVRASSRTRGGARFELWLPRAPSRMSPV

SEQ ID NO: 15641 - protein, 48 aa, Myxococcus xanthus
GRVHAAYDPELDRKVALKLLNLARLGEDSLAQARQRLEREARTMARLS

SEQ ID NO: 15642 - protein, 298 aa, Myxococcus xanthus
MHGANAEFFEWVLQAAGEPSSARLRAAPSAREAVDRAVSLAAALQAAAPESKAFAHHLGTLLSRAVDPVLSLERLHARDVALALSCAQGLPAARALLEQEVLLKLRVPLARIHPSPVFADEVLQALRANLLMPRAEAPSRLLGYAGAGPLLHWVSISATRLALRMRKALGEASHVEAEVLAEHPAPGGLELGFVREEARGHVRAAFVRAVASLDDEDRELLRLHFVERLSLERMGALFDLHKSTLSRRLTAVQSLLEKRTRRALAERLSLPEPEVDSVMRAIHGRLDLSLSGLLEGRE

SEQ ID NO: 15643 - protein, 466 aa, Myxococcus xanthus
MSTDNALSHFESKKQTYLEDLKSLVRIPSVSFPGFDATQVRRSAEATARLLKDRGFENVQLLEIEGTHPYVYGEVLKAPGKPTLLLYAHHDVQPAGDEAAWKSPPFEPVERDGRLYGRGSADDKAGIVVHTSAVESWLKGAGALPLNVKVIIEGEEEIGSNFLGAFLQEHAALLKADAIVLTDTSNFDTGLPSITTALRGLVTVDVEVRALRQAVHSGMWGGPVPDPVMALCRMLATLTHADGSIAIEGIRERVKPLTDGERQSIESLPGDEAHFRAQSGLLPGAQVLGGGAHPWEMNWRQPSIAINAIQASSRKDARNIICDSAWARVGIRIVPDLEARDVEQRLKEHLRKVCPWGLEVHFDTEGASGWWYTDPSHPAFQAAFRALEKGYGTKAVAIGCGASIPFVEPFAKELGGVPALLIGVEDPYTYAHSENESLHLGDWEKSIRSAIHLYAELAEALSARKA

SEQ ID NO: 15644 - protein, 37 aa, Myxococcus xanthus
MMNFKNLMDRDDLELKAVMAVMAVYVMMGAVFLGQML

SEQ ID NO: 15645 - protein, 235 aa, Myxococcus xanthus
MLDVLACRVQVEAERLSEKGEVLAPLRALRHVLADIEGFRGNEDDYHSPENSFLDQVLERKLGLPITLSVVYLEVARRAGISLYGVPFPGHFLVAHDAGDHKLVMDPFHQGDILTEHGCEELLKRVAPQLKFDRNMLAPAPVELITYRMLSNLRRVYLGREDCERGLAVVDLLLLLAPDHPGELRTRAALLSNLGAYRAALKDVERCLELSPDAPDRDRLEMTARELRERAALLN

SEQ ID NO: 15646 - protein, 291 aa, Myxococcus xanthus
  unsure (1)..(291): unsure at all Xaa locations
ARASRAXKPVEYEVTVDHVRMDTHDTATLFLDFGGVPVDYKAGQFLNIDPHQFPALGRLSAYLQEQKGRKEPQRSYSLASAPHEPLVAITVKDEEFVPGLTRYPPLLSPYLVHGRLTGARMKVMAFMGPYVLPEDVEERTEHVVHLVAGSGAVPNFAILKDALHRGLKLRHTFLFSNKTWGDVLYGEELAALERQHPDRVRVVHTLTRETDESRFGAAVRKGRVHQSLLEELIQDRDTCLVYACGPAITPWDRRKALETRTPSTPRFMETVLGHLHALGIEDKRIKRETYG

SEQ ID NO: 15647 - protein, 497 aa, Myxococcus xanthus
MLEAILQVSPLAIHLMDVDGTVRLWNPAAERLFGWSREDVLGHRAPWATDARWEKFRRHQEQATQGMEPPCLELELHRRDGTPLHVELWAAPMPPATTGPAQCLGMLVDVTERRRGEAHRRLLSEASEVLGSSLEQDATLEHLVRLAVPACADSCRVFLEDAPGEVRCVASAGLDAREPLNAGTPLVPDEAAVSRIIASGEPALHDAEPPSWLGVPLAWPGRKGAALVFSRTGRTFDARDVALARELARRASLALDHVRQYHEACQAIRAREELLAIASHELKSPLSALQLQVQNLRTALERSPDAVPRERLHRGLDLMGRQAKRQAKLIDALLDVSRIHAGRLELNPEPVDLGALVREVAERLEPELAGAGTRLTLTLPLEAHGYWDRLRLDQVLTNLVSNAMKYGRGNPVQVTLSSTQAHVRLDVRDAGIGIAPEHLHRLFHRFERAVSGRDYSGVGLGLWIVREVVEAMGGHVTVSSELGVGSTFTVVLPRARG

SEQ ID NO: 15648 - protein, 318 aa, Myxococcus xanthus
MAPFQKERAMAETGNTRWGTARLDGGKVLRWSLLHVGALVGGTCFFSWSAVAVFAGMTAVTMCLGVSVGLHRGLIHRAFRASAPVERALALLGTLAGLGGPIAMSRMHDLRDFHQNQPEADCPPYFGYREGFTRAMAYALFHTWHPRSGAADVPAAPHVTQDVFFRGLERAGLWLQVPLALALYALGGAPWVAWGILVRLALTQDGFWCVHYVSHVEGEQPYELPGCAEQGRNAGWLALLSMGESWHNTHHVYPASAQMGLGWRQPDPGWWAVRGLAALRLVHDVKSLAHLPPRPGARTRRPEPHRTRRLCVLALRRA

SEQ ID NO: 15649 - protein, 422 aa, Myxococcus xanthus
DWTSGLHEVFGYAPGTIRDEHRWWEERLHPDDRARVVASLQATVEGPEHEWQDTYRFQRGDGSWAYVADRCHIIRDAQDNATQVVGAMQDVTERHEAEAARARLLELERGAREESDRQRAMLATLFEQVPALLGVLSVPDQRCVVANARLRQRFGQRQLVGRTLREALPELEGQNVLELLDTVFATGEPFSARELPVRIAQVPGALPPEGYFDFMYQPMRDASGRLAAVILFAVEVTDSVLARHKESELAQQMKARADFERQLIGIVSHDLRNPLGAISLAVSMMLQRGLLDERQARQAQRIRSSADRATRMIRDLLDFTRARQGTGLPVYPQPMDLHEVVRTVLDEVHAGWPDRHLETERTGDGVGTWDPDRLAQLIGNLVGNALQYSPPGTPVRVTSRGDDDGVVLEVHNLGPAIPLRAL

SEQ ID NO: 15650 - protein, 181 aa, Myxococcus xanthus
MKRMLMPLRRSVLVLGVVLGASVAMAERKQDAINMKIAYQSFNLEMTPEAVSGADFQVARSPGMLKGRGLKGNFALTLKDGAVEGAVGGAPVNLTVTKEGDAIVAKGGFGGRPVNLKLSPSELTIYVRDCTYRLKAANTNRFYTGRRSCDRAMTPDSEIWLPDEFLAASPEEKAAILFLAL

SEQ ID NO: 15651 - protein, 140 aa, Myxococcus xanthus
MPTEDDWVPSPDDLPYHRLGGTDAAMALAEAFYDAMDAHEPELARLHELDAEGRVNRGTRERFGLFLAGWLGGPQDYTERHGHPRLRMRHGHLSIGVAMRDAWVRSMQRAMDARGISGGLRRFLDARFAHVADFLRNVEE

SEQ ID NO: 15652 - protein, 230 aa, Myxococcus xanthus
MAANLECPKCGSELDVTGRGPGAIIRCACGNLSAVPKRSYWASPRGVALALGVFLLCPCVGILAAIAIPNYNKLPVRSKQQECKANLRGLYAAQRNHNAEHGTFEPRIVNAGFIPERGNRYAYFTGTGPLVTRDAEGDAVPADAGGIGVDRSRDASRRAITLADLPAWVSRQVGVFGTCPDCYVTMGCAGNIDIDDTVDVWLISTKPLKDEYGEAVPPGTPTNVVNDVDG

SEQ ID NO: 15653 - protein, 360 aa, Myxococcus xanthus
MMDADAMADMALPEEAVGTTASAVETASDFRFRTANRYAGIHGYAAGYGNFHEANYGAGVVRGTILLKPGTVAHYLAVPRSSLGNTALSNIPELFRRAQDYGNAHGLGIALPSFEQGLNGSVVEYGVHFLHPSVVEFRDVPGWAIGYPDVTDAGAMMRAASDYASSNGFAGGLPTFHSAIYSGTRVYGMHLIRPGYADSRDVLADVLAMQDRFSSDTATVTGDNWARTLRRHEAAQDSIQTCTHLTTLEKSALRSAYRKAIRHTGTNEAGINARAELGGDDVWINFGVLFPQGDTEIAQTLIHEMMHIAGYSHPDRRNGIDTPYDGGPYYNSAPLRAELCIAGFQSIHSTRESSREPQTR

SEQ ID NO: 15654 - protein, 136 aa, Myxococcus xanthus
MVHYAEHDAYEPVFAKLNHEIPRGNHFAFLAGVEPADARDTAGAAAVEDAVAVGVDVATNPALKAIQFGELPVLVAKQVGLSGECPDCAITAACVANLDRDGDLDVWLISSKELTGLDGQPVNPGEPLHFMNDLKD

SEQ ID NO: 15655 - protein, 321 aa, Myxococcus xanthus
MSLSIAKSILCNGFSGNTRGCGPTDRYQAAYQSMDPSKAAQTVLKHFDAIEGVGMNASGKGAGDNNIGTSELKRVADPNSGFPPDVRAAAKWMLDHPIALRSLDQGASKAHGGNNEVHLSKADLQARAGNASDSGAPHRPGFPQRPPLFGSGFGGGFGGGCGGGLGGPGGLPNPHRPNLPPRLDLCGPQSRPPFGAGRHEPMDVYKAAQTLKDHFHFAEGVGMNASGKGAGDNNIGMSELKRVADPRSGAPKELREAAQFLINHPTALRSVDQGASKSKSSKEVHISLQDLESFTAKAPRRETQSNRLDLAQFMGRASVWG

SEQ ID NO: 15656 - protein, 188 aa, Myxococcus xanthus
MSRAYRVSVSESLNRVVQAEDGLCSKLELLPLLSREELAGLLAAELANRGFTQEGDVALRTEADGVRIAIDVTTGDVSVTLSGEQEVELKARGELAVESPHEVEQAKLRAQDLARARLEDAADVATDKLRQQVTQKLEGRLKDLKSELDSISNKVTAEALKVRAGQLGTIEEVHEDAATGSLTIKVRV

SEQ ID NO: 15657 - protein, 152 aa, Myxococcus xanthus
MDAAVLKKVALFEGLTQGQLAKVAQIGHSRTYPAGAFLFREGETGQEMFVIAEGKVRISKSVPGIGEEALAILEPGQYFGEMAVIEDSPRSADAIAHVSCSVWVIERSRLDQLMFTDKDLAYVLLWTFVRTLSERLRETNEKIKGFFALSRF

SEQ ID NO: 15658 - protein, 80 aa, Myxococcus xanthus
ATIDITKANFKEIVSKEGIVLLDWWAEWCAPCRTFSPVFEQASTKNPDLVFGKLDTDAEVELAGAFAIRSIPTLMVFRDV

SEQ ID NO: 15659 - protein, 136 aa, Myxococcus xanthus
ALRPSLQDVLNALQAEGQLEPDSVDRARVALEAHQRQSVAVPWFVKAFAGVGAWLSAIFVLSFFACAGLWEEQVVMGVVGLGLCAGATMLRRTLRGVFVEQLALAQCLAGAAMASASFGIETENENVAATLVLVIS

SEQ ID NO: 15660 - protein, 313 aa, Myxococcus xanthus
MPTTLERALHLSVATPPRQDWRRFLSTTLMGLGALLVLAGVIYFFAYNWADMHRFAKLGLIAAAITGTAVGAWKQGATLGGQLSLFAASVLVGALLAVYGQAYQTGADPYELFIGWAVLILPWVAVSRFAPLGLLTLVLVNTGILLFWEQVLDTELDQTYWLAVVLGGLNGFTWATYEHFANLRVSWLQARWVPRVLAVMAVAPVLIASVPFIMHPARAPTGAVVALLLVLASLAAEYALHRHLKGELFMLTLGAVSVMTLLTSGAVSIVFDSYQDVEVLGLFVLPLFVIAQVALAVWWLRHEARVTGATEES

SEQ ID NO: 15661 - protein, 449 aa, Myxococcus xanthus
MDTEVDALVQTAPVPVARRGPLRLKLLMLSGEQAGHSHVLRPGVVRLGTSSTCDIVLTDRVVSRQHLQLEVTDERVVATDLGSRNGSFHEGVRFTELEVRPGASLTLGTVVLKVVPEDSRERPMPLSSRRNFGALVGASVRMRELFTVLERVAAGGGDVLVQGETGTGKELCAEAIHQESPRAGGPFIIVDIAGIPPSLMESELFGHVKGAFTGAQTERAGAFERAQGGTVFLDEVGELPLELQPRLLRALERRQLKRVGANDYRTVDMRVVAATHVDLEQAVQQGRFRKYLYHRLAVLKVVPPPLRERVEDLPLLIDAMLERLGRPPSALSEQTRALLAQYPWPGNVRELRNVVEQAIHLGEDTLPPMDAPSGSVRSPQGTLDAELPFKEAKERLIEVFERDYLQGLIARCDRNISRAAREAGIARVYLRKLLTKHGMMLVDDDDSRD

SEQ ID NO: 15662 - protein, 172 aa, Myxococcus xanthus
RGAAEVSGECENASVESQGSGALVRVCVPLRNDTGAPVEVEFPPGLVVVSTSEGRGQNGLLIERTILVVPPTRPGPGGRDDAGTPDGGVEENVYIVPLYMYCLNEERDPSNEFMTYAVGPITSDDALQELLRLLEGKVIDSSEDVGVVQNALYSITEGRGLTTPDRDAINDL

SEQ ID NO: 15663 - protein, 271 aa, Myxococcus xanthus
MLKGKTPLVVALVLGLLAGVIAYSAIKKKEADVRRGWNLVPVVVAAQDVPEGTVITFEMISQRSVPEQFVTSSVVRPDSASYIVNQKVLVALQAGDPLLWSQFETTKAAERLSSKVQKKARALTIEAKHTTSVGGWIRPNDHVDVIGTFRDPQTDENVAVTLLQNVIVVATGKITGTTNVNLIPENQREYNNISLMVLPEEAEILVLAVELGQLTLSLRNEDDVDLIEERGRATISTLLSGERTRVLEQKRREIIQIIKGGAERAAGAGAP

SEQ ID NO: 15664 - protein, 226 aa, Myxococcus xanthus
MLILNIACMCLLGILTYIIFNPIMAVVATVFGFFLPMLMVKHYRKRRIKKFNVQLVDALQAMANAFKAGLTFPQAIEHVAREAMPPLSQEFGLFVKEVKLGVPLEEALINMGRRVGSDDLELVVVSTNIARQLGGNMAEMFETISTVIRERFRLEGKIDALTSQGKLQGWIVAAMPGVLGMVLNYMRPDLMEPMMDHIFGWILVIIIAIMEVMGILIIRRIVNIDI

SEQ ID NO: 15665 - protein, 235 aa, Myxococcus xanthus
MNRRFMWPGYEAKARRNLIKAGEPQAYKPEDIMALQEVSAVVGLIMGLILLNGFGVSLVWAPLFLLFGMYYPLMWLNDQVKKRHLLISRALPYSLDLLTLSVEAGLDFTAALAKVVEKGKPGPLREELQLVLKQLKMGKTREEGLKSMIVRVDLPPLTTFVTALIQADKMGTSLGKVLRIQSTQMRIDRTQRAEKLAGEAPVKMLFPLIACIFPTVFMVLFGPIVFQFMFGNVAG

SEQ ID NO: 15666 - protein, 425 aa, Myxococcus xanthus
MGSSNGTVLNGGLLSGEQQLRDGDKIGVGPVEFTFVWVPPEGDEDATRPIRRGDPVPALDPDATRPIRLNDPIPAESGIVLPEGHPTAQQPAVVPVRPGTAAVAKAEPGAGQTAAERARRRRELAGSQAGRLLLWWGQLSTPARLGVGAVGGGLVLALVGVLAVFFMPKGEGRASGVEPEDLGFEVISDSFGVGEGVTWENPEHKSFAFQFVTPTRAVAVVHYMASGISKEEVALVVNGVDVGWVPPDVNAVTERGLEQILPPSALKRGELNSIVFDNVRNPPGQDTWRVWNLRLEIIPVPELPQDELLAKARQYVVAGARFYESRDVGAENLFKAWQQYRFAWVTLEALDTKPDIYQDVRFQLGEVATELDHKCSQLMLDFQRSVQYRNARTARAALQEMGRRFPTAEHRCHNLGLQLAYEHEL

SEQ ID NO: 15667 - protein, 494 aa, Myxococcus xanthus
MVRKSGAGWAVSDLGSGNGTLINGDVVNEETPLANGDVITLGDTELRFEDVANSTMMVGAPAPGPRPRPGASGSRGAVPPRPGPRVEGGRVRSARATAATAPTPEELKKKKLITLGVAGAVVVLFAGLGVVRMNVQKQQAVAAEEARQGKSHRERLGSLFQDAKNLVREGKWVEAKAKPGGSSRPRPPGYPGVADYLGHAAREIPVQEKLTAAKEALAKKELGKAGTLLASAGESQFLYEQVNSTKRALSEAADTRTREARKLLDENQLDMAKAITEDILVAFPEHRDAKLINEQAAQAIIVRDTPRPVVQGPAPKPWEPAVDRFRDGDMSGAVAILNACMARTPQCKKVLGQVTEFGNLYKRLEDLDARGLSKLMSLDKDITGGRPSKMARNAGTRAATIFYKGATAAKAAGQWSRAMDYSRKALQADPGHAGATNIISELKAKAKDVYLQAYSLKDGSPEEALPKFKDVVAMTPPDDEYHEKAKTWVEKLSR

SEQ ID NO: 15668 - protein, 256 aa, Myxococcus xanthus
MEQAAAGAAWAGEGSVRARGVGGAEESRERLFRLGAAALTDPELLCVVWSSGPRAPGAWAVAGALLSEGGGLKGLVQQEPLALSLRPGVGPVRAAQALAALELGRRSQRARERRPRLRTPKEIAAYLAPVLGALRREVFHVLCFNARNVLVHDARVAEGTMNTCPVDPREVFAAALTSRATSIVLAHNHPSGDPEPSVQDLGLTRHLVAGAQLLNIKVLDHVVMGDGGYVSMLERGLMPDEAQEKRRAWSANGGGG

SEQ ID NO: 15669 - protein, 323 aa, Myxococcus xanthus
TRRKVGGGTLPPVGLQGDLFGSGASTPRATGAARKAAAPPKPPPPPVDEDGTSLLGPMEGAPPPPPKPERVVLSVGELTRQLKQTLESRFARVIVRGEVTGFRGPNARGHWYFSLKDAGAAIDTKVWASMAARLRFALRDGMEVIAEGSVDLYEPQGRYSLIVQRLEPVGEGALALAFEQLKERLAQEGLIGPGRVRPPRPLPYLPRRIGVVTSRTGAALQDFLRVLHSRNPRQSVLVADARVQGEGSAVEVARAIERLARTDVDVIVVTRGGGSVEDLWTFNEERVARAIFASPVPVVSAIGHEIDFTISDFVADLRAPTPI

SEQ ID NO: 15670 - protein, 332 aa, Myxococcus xanthus
MSWGRIGHPSEMFNVGDEVRVVVLKFDPTQERVSLGLKQIQEDPWHRADEKYPVGTRVRGKVVSITDYGAFIEIEQGVEGLVHVSEMSWTKRLKHPSKILEVGQEVEAVVLDIDPKAKRIALGMKQIEQNPWTLLEDKYPIGSVIKGQIRNVTDFGVFVGVEEGVDGLVHVSDISWTVRIKHPGEMFKKGDEVEAVVLNIDVENERFSLGIKQLQPDPWETLSERLPVGSRVKGKVTKVTDFGAFVEIEPGIEGLVHVSELKEERVENPRDVVQEAQDVEVKIIDINTPDRKVALSMKALIGEGEDYREYLRKQAEGSKARLGDVMASKLKK

SEQ ID NO: 15671 - protein, 450 aa, Myxococcus xanthus
MAGEQVEIHNLDPWVQVHEVGHGDSFSWSPDGARYAVGSYRNVRVYETATHELQASWFGPWSVSSRMDWSPTQDWLVIVDLVHSLTVLNVNTGTVVANGTEVPPNPLDALGFSAVRFHPVHDSFVAVARRPASVSTFSVDAQQSRLQRHELVAHSSAINATKWSPAGDRLASAGDDGKVRLWGAAGQALATLDGHEGKSVRALGWDASGARLASGGADGRVCVWDAGTGRLTQPPLQMMQRAQGHTPKVEHVALSPDGRTLASAGATLFLTGSMTSVQVWDVASRTELLNIPETDSPVVALGWTPDSQSLIIVYTHAAWDVWNRSSGVLKRVESAPEILTTAALSPDGTRLACSDRLGVSVLDVGTGAVVAETPMWMRQLSLAWHPDGTRFSGGGAYQLVFDWQVHEHGQLLPSVMGVHDSTVLGASWRGDGEVLTTGGADMALVTWRAR

SEQ ID NO: 15672 - protein, 265 aa, Myxococcus xanthus
MRGGARMGNVEFKDAMIHDGLWDVYGNVHMGICAEECATTQDISRSQQDEYALESTRRAIQAQKEGLFKAEIVPVQIPGKKPEDVVTVSDDEGPRNAKPEKIPGLKPVFKKDGTVTAANASSINDGAAALVLMSEERAKAEGRAILGRITGYAQAARKPVEFTIAPTDAINKLLKKQGISAGDVDLWEINEAFAVVSIANNRLLGLDVSKVNVRGGAVALGHPIGASGARVLVTLLQTMQDLDKKRGVASLCIGGGEGIALMVER

SEQ ID NO: 15673 - protein, 30 aa, Myxococcus xanthus
MAVEFLDVDEDKRTRIAEFVERLRSELPPE

SEQ ID NO: 15674 - protein, 204 aa, Myxococcus xanthus
LPLPELPIELTIERLGQLGEGVASWQGRTVFIPGTFPGDTVRVHLETQGRVLRGILRQVVSPGPDRRDAPCVYASDCGGCDWLALAEPAQRSAKQEIVLSTLEHLGHLARDSFTVRPLLVAPRDWGYRRRAVLHPAGKGALGYFGRRSHERVPVEVCGALTPVLTALPGKLAPLLKPLAKDAEEVLLLAEGDKAAFEVNILESF

SEQ ID NO: 15675 - protein, 259 aa, Myxococcus xanthus
ATKKETYTGADIQVLEGLEPVRKRPAMYIGGTDSTGYHHLLWEILDNSVDEVINGFATTVEVTLHKDGRSVTIVDNGRGIPVDIMPKYKKPAVEVILTTLHAGGKFEQGNYIHSGGLHGVGSSVVNALARKLVVEIKLHGKKHVQTFARGKATSTLKVDGAARGTGTSVTFEPDPEIFGEKLKFDAELVRERLEAKSYLHKGMTVVWKDETSSPPTSVTYKHDGGIAEYLTKVVTERNKPLVPAGSAVFYHARDNGVRV

SEQ ID NO: 15676 - protein, 24 aa, Myxococcus xanthus
MSKRDAVKEVARAVTFIPLPEKKD

SEQ ID NO: 15677 - protein, 84 aa, Myxococcus xanthus
MMVSMVGLWGAVQVELLEDVRAQVVRLDTGQACTVERASLPKGAREGDVVVDGRLEPGQTEARRQDVARMRTRLAVPVPPGLDL

SEQ ID NO: 15678 - protein, 667 aa, Myxococcus xanthus
MGQYHPHGDASIYEALVRMAQDFSLRYPLVDGHGNFGSLDGDGAAAMRYTECRLAMLSSELLTELGKKTVAFRPTYDGTLQEPVVIPARVPQLLMNGTTGIAVGMATNIPPHHLGELVDALVALIENPQLLTKDLLKWVKGPDFPTGGQILNDKKELRDIYESGQGSIRIRGEYKLEDLKRGGQQIVITSIPYTVNKSTLVAKFGDLVRERKLPLITDVRDESTKDVRIVLELKKDANPELVMAYLYKQTPLQTNFGVNLTCLVPIKDKPELSTPERLNLRDILWYFLTFRFDVVTKRFEHELGELLRRVHILEGFEKVYDALDEMIKIIRASEGKQDAARKLIARFKLDEAQVDAILEMKLYKLARLEILVVEKELKEKRAEIKRIQGILKDKNKVWGTVRDELGEMKARYNDKRRTRIGGAGSEEMEFSAEAFIADEDAHVVITRDGWVKRVREVKDPSTTRLREGDAVMAVLAGSLKANLVLFSNFGTAYVTRFNDVPASTGYGEPVQKFFKFDDGERVVSALSLDARLPRPQKLVGVTKQGMGMRFLLEPHLEVSTRAGRRYAKTGEGDEIIGVQPVTDRDLLAVLTEKTSALVCKVAEVNELAGPGKGVTVIKVDGGDRVVDFLAVSPAQKDAKLEFETQKGRKLHLSPAKYEVTGRGGQGP

SEQ ID NO: 15679 - protein, 171 aa, Myxococcus xanthus
MRLRFDKVPWGDECKSRCANATLLLDTDNSKQTGLRLATKNAPGNGADVAVVIQGVRDYAKQEGAPPVSWLRVKVRLLGSEASSVDDGELLAEFNHRQDPERLHVDGETIYLLVDATSAALPSARKARVVYQPPGAKPLQATIPGMIGGGSGKGVRIFKDGSWGKARDATP

SEQ ID NO: 15680 - protein, 100 aa, Myxococcus xanthus
MFGPSIVGFGEYAYQYASGHRGTAPAAGFSPRKAATVVYLADGLSAHASALAKLGPHTTGTGCLYIKDLTKVDLDVLTGIVRASLKTLTAGTYGKRAHED

SEQ ID NO: 15681 - protein, 256 aa, Myxococcus xanthus
ARAKVIANRSSRARKEGIGPRLQTLDVRVEPEAEEDIAMREPYVRQLKLGPMDNFVYLVGPRDSDEVVVVDPAWDVDAIAEAVKADGKRVVGAFVSHCHFDHINGLPDLLSMWDVPVYAQREEVQFSPELRELGGALRPVGPGDDVRVGSQVFHALHTPGHTPGSHCLLAGDALVSGDTVFINGCGRCDLKGGNPEDMYRSLSQVLAKVPDTAKLFPGHDYADVPVTSMEAVRKKNPYFAFDNVDAFVAFRMRPRK

SEQ ID NO: 15682 - protein, 151 aa, Myxococcus xanthus
ALKVRYGSVVTQARPPSLRTRMAAGLDPYAQLTHTIYALMYGQTQRMPLTALPLHTPAQTAALVQAYGAMPGPTACDGIVPTRSQVYGRVLAAVRADHLDAIGHFDQPAHQPPHVDWLISGSGFRRPQFESTWKSIVDFMLEDERPGITGS

SEQ ID NO: 15683 - protein, 183 aa, Myxococcus xanthus
MNFPSHVNLPTDAREELIDSLNTLLADAIDLHWQIKQAHWNIRGRHFYSRHELFDDLAKHVRKQADEFAERAGTLGGYAEGTIRLAAKNSELPEYDLKAVDGDDHLKALVDRFARYGASIRNGIHRSDELNDPVTSDLLTQTLGEVELDLWFLESHLHGEPRAGARRGGDVRPQDTTTSPSNA

SEQ ID NO: 15684 - protein, 280 aa, Myxococcus xanthus
MDGKVCLITGATGGIGLEAAKALARMGATVVLVGRDAGRTEAAVAAVKEAAPSAQVDWLRADLASLKSVRELAQTFRSRYPRLDVLLNNAGLIIDRRQVTEDGLEATMATNHFAPFLLTNLLLDVMKATGPARIINVSSDAHAAGKLDFDDLQSERGFIGFRVYGTSKLANILFTRALAKRLEGTQVTTNALHPGVVRTGFGHNTQGFFRHLVKLGAAFMISAEKGARTSVYLASSPEVEAVSGQYFYKCRPKKPSSAARNDALAERLWQVSEQLTGVKG

SEQ ID NO: 15685 - protein, 208 aa, Myxococcus xanthus
MIDLYTFATPNGQKVSIALEELGLQYKTHVVDITKGEQFKPEFLDINPNNKIPAIVDHATQDHRPLKVFESGAILIYLAEKTGQLLPSNQRGRAEVMEWLMFQMGGVGPMFGQLYHFARFAPKKVPYGIERYHAESRRLVGVLDGKLGSGDYVAGRYSIADIALYPWVAGARASFPELFRGNSNVVQWLHRVGSRPAVERGMKVPQLK

SEQ ID NO: 15686 - protein, 488 aa, Myxococcus xanthus
MATLEQLRFDNTYARLPAGFGARVHPSPFPDAKLVSVNPAALKLLDLTPEEAQRPEFVAAMGGAKPLPGMEPFAMVYAGHQFGVYVPRLGDGRALLLGEVRDAAGAKWDLHLKGGGPTPFSRGGDGRAVLRSTIREYLCGEAMHGLGIPTTRGLGILGSQAPVYREAVETGAMLVRMAPSHVRFGTFEFFHYTEQTEHVATLADHVITEHFPQLAGQEGRYARFYTEVVERTARLIAQWQAVGFAHGVMNTDNMSILGLTLDYGPFGFLDDFEPGFICNHSDDRGRYAFDQQPRIGLWNLACLGEALLTLISEDEARAALATYQPAYNAHFMDRMRAKLGLRETRDEDRELVSDLFARMAEAHVDYTRFFRALGHFASADGADTRPVRDMFPAPEGFDAWAGRYRARLAAEGSVDAERHARMTRVNPKYVLRNWVAQEAISRAEAGDFSLVDRLLGVLSDPFAEHPDAEPYAAAPPTWGRHLAVSCSS

SEQ ID NO: 15687 - protein, 115 aa, Myxococcus xanthus
VTDLTRLPLRGKQGAFHVIVESPRGSTLKLKYDTALKAFSLSRPLPRGLSYPFDWGFIPSTQGPDGDPLDAMVYWDDASFPGVVLPCHALGVLQVEQNTGDGGRERNDRIVLESI

SEQ ID NO: 15688 - protein, 355 aa, Myxococcus xanthus
MPTGAGKSLCYQLPATLLPGLTLVVSPLIALMKDQVEQLTARGIPATFINSSLSDLERAERMRKLRAHEYKLLYVAPERFRSQSFLETVSALGVDLLAVDEAHCISQWGHDFRPDYALLGQVRKRLRPPRTVALTATATPEVRADIVRVLLMKDPQEFAMGFDRPNLFLGKQEVGGDADRHEACARLASAGGSGIVYCSTRRAAEGIFSELHGRGVKAVLYHAGMDDDARRRAQDTFMSAKEAVAVATNAFGMGIDKPDIRFVGHANIPRAVEAYYQEIGRAGRDGQAARAVLLFNHSDVFTQERLIQSSHPAEAIFGDVWNVLQSVEEFERGVHALAGTVNASEFEVSAALRIL

SEQ ID NO: 15689 - protein, 358 aa, Myxococcus xanthus
MLLVSGLLHVALFVALSGSEPNDRQRRVEPRAVEMEVVYQDVTPPPEPPAPEPRQPPPDEAPPRPPSKKEDPPRHAERPRPTTTEAPDASEEPPPEVAPTGSGEPPPALAQDVPRDVPQPQQRPNLESQGLLGGGMLRGGPPSTGRTLRPGEGPDSKALAARQAEEARVRVDGWAQDAAATARASSGATHPYFAKLREGFAKQLVNPPPPDLKVLGSRMKREQVDAIARFGKTGTPIAAEPRDHRLEQRNRMQAAVEAGRAANMYMVDVTTPVLALAAIVEVWQARDGKLLDLKVLEGSGDPKFDSWAVSQLRDALASAEAPKPGGGLGIRDDGMRSRWRLEEYLGNPRVQIHLMGVY

SEQ ID NO: 15690 - protein, 163 aa, Myxococcus xanthus
MLALDLVERLRQVSPSAANALLTVAVKNIIPLSSVMGVRVEDASDARAQVSVPLKRRTRNHVGSVYLGVQVTVMELTMGVWLFRRFPPGRYLALVNELQVSFHAKAKGGVRAICEPPPEVFNTLDAALRQKGDKAREWIPVRLEDFEGTHIADARFLAVLKKA

SEQ ID NO: 15691 - protein, 677 aa, Myxococcus xanthus
PVVVLTEAPLEVARRLGIRAGLIVPLLARGRVLGALSLVRGDSDGVPGASDLELALELARRASLSLDNALLYAEARGAQQRTERLQAITAALSRAATAEDVAEALMREELRPAGPARGAVLGMLEDGRLHVLGSFGYAPAVLDTLRGLWADQVPGVDRALEQLEPQWFSTHAAVPRAVPEWARDLVQGVGPGAWAVLPLKVEHRIRGFLLFTWDGPQVFLAEERGFLSSLAQQCAQALERAALYEALRERGGKLHVALEAGKEAEERLFFLLEASRALAEHLDDVEWTLEHLARVAARNVATYCLVELMGADGVPRAVAASHREPERDVSVLASLSLPWVEGTLHPARECFLSGETRFLPEVGPELRERMCQGPEHRAFLEALNPHSLLAVAVRMRGRTLGVITLGTAAPCRRLVTADVAMAEELARRVAVALENASLYRDAQAAVRLRDEFLSVASHELKTPLTSLKLQHGLIDRAALGDVGDKVRPRLATAVRQVQRLSALVDSLLDVSRISLGRLMLEPSDVDLGQAVRDAVDRMEEVFSQAGCPVRVEVPGPLPGKWDALRLDQVLVNLLTNAAKYGAGRPVLVEAAFEGEEMVRVSVRDEGIGIAAEDLPRLFGRFERAVSDRHYGGLGLGLYISRQIVDAMGGRIEVESRPGLGSIFTVRLPRSTAQCAPW

SEQ ID NO: 15692 - protein, 255 aa, Myxococcus xanthus
MVTVGRADVPKALSVAKLRKEYGGKAAVEGVSFEVGRGEIVGLLGPNGAGKTTTINMVLGVLQPTSGTIHIQDLDLAAQRSAALALTNFAAVYSPLPGNLSVYQNLRVFGLIYGVKSLGARIAELLEQFDLVKYRDVKCGVLSSGEQTRVALAKAMLNRPHLLLLDEPTASLDPATARDIRARIREFAARDAGGVLWTSHNMYEVEEVCDRVLFLARGRVLLEGNPRTLPGEHGQASLEELFIAVAREPLALERS

SEQ ID NO: 15693 - protein, 267 aa, Myxococcus xanthus
MHLHRAAAVALRHYYLLRGSLARFLPLFAWVAIDMVLWGFMSRYLNTVTSQEYNFVPVLLGAVLLWDFFIRVMQGVTMVFFEDVWSRNFLNMFASPLTISEYLGGLVLSSIATSTLGLLVMLVLASTVFGLSFAAYGVLFVPFLLVLFLFGIALGIFGCALVLRLGPASEWFVWPIPALLSPFAGVFYPLSTLPAWMQAVSHLLPPSYVFEGMRTLAAGGAFQVSTLLWGACLAVVEILLACAFFTRVHRQAVRTGLIARYSAESVS

SEQ ID NO: 15694 - protein, 211 aa, Myxococcus xanthus
MCKVVAEVVVDEARRGWQQSYTRTWSIPMRSLNPVFSSAVVMALCSLLAGGCGGSPSGGESDTQTPQSGGLGGKAGEGGPVFGDEPTYPGDDDATPGKVTICHIPPGNPANAHTISVSTSAWPAHERHGDTLGPCEGGGEEPDAGSGEEPDAGGGEEPDAGSGEEPDAGGGEEPDAGAPVCAPIGEACGESAACCLGLMCGEDNTCDPVIG

SEQ ID NO: 15695 - protein, 348 aa, Myxococcus xanthus
MSRSDVTTSVPVFTQTFRSPCGCVPAHGGACECPARAGARRVSMGCPPSFMVPPAREAPLPSSAASLVGQQVGHFRLLRELGRGSLGVVLLAEHALIQKRVAIQVLHTHVTQDPAQVARFLQAARTLTLIQHAHIVSLYDLGMRDGRPYLVREYLEGQSLTAFAKGPLASALVVDLLTQVCDALGAAHAHGIAHGSLNPASIFLIPDANGRQHVKLLDFGIAGLLPSPDGAADLSVAADLFAVGVLGALLVSGRLSSRGHAAEEPPHGHAREVPPLPAGIPSALSRVLLKAMARRPGDRYASAAELRAALQASVALDGGVAHPEALELERLPSWYTLRGPPGAAPASR

SEQ ID NO: 15696 - protein, 310 aa, Myxococcus xanthus
ASDPDDKLPPQGRFNRLRKLAGLSVQVGTDVLKSGAKRLSGSTPDLLSKEAAEKLVSTLGELKGAAMKMGQAISMDPDLLTPEVRQVLARLQNQAPSMSYAQVSRVVQAELGAPPESLFREFSEEPLAAASLGQVHRAVLEDGRAVAVKVQYPGIDVSLANDMANLGIVAKTASTVLRVSDAGAYFQEFRDEMLLELDYHREAELARGFPPNVAKLPELCVPPLIFSHNAKRVLTLELLEGLTLKDWVATNSFNQGRFPVGRPLILATYRAFFWAGEKHPDPHPGKFIGNPDRPVGFVEFWFLKGFFPRF

SEQ ID NO: 15697 - protein, 116 aa, Myxococcus xanthus
MFPDAGPGEVDGPVLRYAEPLSCPAAPEGRVWVAETQACDDAGCESLTTVWAGSWTVEDAGLEVRCETDRVVLAAGEWRMVLTPGAGGGLEVSELTPPEPESLSAARPSETPASED

SEQ ID NO: 15698 - protein, 38 aa, Myxococcus xanthus
MFDPPTAARALSDSAREEEPELLSASGELPTLRETRNR

SEQ ID NO: 15699 - protein, 36 aa, Myxococcus xanthus
TEYAYTDRDKKCRRSAILRYFGQRDTHTSCGNCDVC

SEQ ID NO: 15700 - protein, 180 aa, Myxococcus xanthus
MFAGCGESSANENTLGPQQAAAGHPVTLTDGQILGVLLVANAGEVMLGQVGQAQATDPTARDFNARMVTMHSEVIQRLEQLATAQGIAPAESPVSQHLEQTVQKTVDMVSATQAPAFDVSVMDAQVAAHAGTALLGDSLLAMQVQNPALKDELMAIRKTVQAHLQEASNIQTTLYNAKQP

SEQ ID NO: 15701 - protein, 93 aa, Myxococcus xanthus
ARETFSVVEVNPAHRFARLRPESGGPLLHAGLYPEEEAPEPQLQLREGDRVEGQRRGQSGADWGWVSRAEPPADLVERMGELLPKLEKYQLRV

SEQ ID NO: 15702 - protein, 889 aa, Myxococcus xanthus
MARLRTVDQPLRRDVRLLGRLLGEVLVEQEGQALFDLEEEVRRLAIQRRRGPVAGRRAVAAELAEVLQRLPLERAEPVLRAFSVYFQLVNLAEQHHRIRRARTHAEVASAKPQRGSLEATLQVLKEAGIPAERVREAMRTMRVTLTLTAHPTQAVRRTLLEKLYRMAGLLEERDRCELTPRESSVNLALLREEITLLWQTDELRRERPTVGDEVKNVLWYVEEVLADELSLLPELLDWAFERAYGEPLGPVDTPVRIHSWVGGDMDGNPLVTPDVFADTLRAHRARGLRRLLLDLERLGGRLSQSARHAKPSEELLSSVAKDAEELPDTERRYGPRTPGEPLRHKLRFMEERLHRALHYVTQQRAGTSVPMPQGAYRTPEALLADLDVLGRALEASKGTHAGLRDVRQVRERVLALGLSLAELEVRAPAEDAVSAAGSFNGGPAPTEGGARLLEVLARLKEAQSESGESACRTLILSMASTAEDVLAAFRCLKHAGLWDEKRGCATANVVPLFEQLGALDSGPDVLRTLFADAEYRKHLDVRGGQEVMVGYSDSGKEVGLLAASAALYRAQVALTEVSREAGVPLRLFHGRGESVARGGGPAQEAILALPPGAVAGGYKATEQGEALDHKYARPELARRTVELILGGVLLHTLDAQPRPEPEAERTFRTVFDTLAETGRKAYRALVWEDPRFLEFFTAATPVEEIASLPIGSRPSKRRAGGLDTLRAIPWVFAWTQNRAILPGWYGVGSALEAFSKEEGGAAQLKRMYQEWPFFRAVIDNVTMVLAKSDMAIAGRYASLAPPATRSLWRRIQQEHRRTRRQVKRLTGESKLLDNNPQLQRSISLRNPYVDPMSFLQVELLKRKREGQAEVDRPLLLTLNGIAAGMRNTG

SEQ ID NO: 15703 - protein, 849 aa, Myxococcus xanthus
MATPEIQAPLAALLPKKGEPPLDADEILNRFVGYVAANGLSLYSAQEEAILELLAGKHLFLKTPTGSGKSLVATALHFKAMAEGKVSFYTCPIKALVNEKFFALCDAFGAENVGMLTGDASINRDAPIICCTAEILANLALRDASARVDYVVMDEFHYYSDRERGVAWQLPLIALPDTTFLLMSATLGPTHVIEESLTKLTGREVATVRSAERPVPLDFDYRESPLHETIEDLIARGKYPIYLVNFTQRTAAEQAQNLMSVDFSTKEEKEAIRLALQDAPFDTPYGKEFQRFLRHGIGMHHAGLLPKYRLLVEKLAQHGHLKVISGTDTLGVGVNIPIRTVLFTQLFKFNGEKLTTLSVRDFQQIAGRAGRKGFDTQGSVVAQAPEYVIENIKLAAKEAAGKKKTPKAKPPQKNFVQYDRSTFERLQNGMPEPLESRFAVSHGMILNLLQSDHQTEGNGGYKRLVTLVQRSHDSDYLKRRHLKEAARDFRTLRGAEIIEVEKGQGGSGATVKVAGEMQHDFSLNHTLSLYLLDTLELLDPTTDTYALDVVSLVEAILENPDVVLYAQLNQLKGEKINELKAQGVEYDDRMAELEKLEWPKPNRDFIYGTFNKFAQKHPWVGEENIRPKSIVRDMFERFMSFPDYIREYGLQRSEGVLLRYVNDTYKTLVQTVPERFRTEEVEDFIDHLRATLRQVDSSLLDEWERMRNPDAAVEAKPVVELKPKELTDDPKAFAARVREELHRLLKALGQKRYMDALAMLDNALGEWTAPKLEQAMAPYFEEHKVVVLTPQARKPANTFLKESGTRLWETQQRIIDPEGHGDWMIDCEIDLRDRRLDEGPILMLRRIGV

SEQ ID NO: 15704 - protein, 264 aa, Myxococcus xanthus
LNTTLARRMMEQTRIYEALKGVRARPPVDLKALEQLMVRFSQLVAEQRFVKEVDINPLLASPERLLALDARVVLHPASVTEAELPKLAIEPYPDQYVAPYRLRSGEEILLRPIRPEDEPKMAEFHRTLSEQTVFLRYAGLMQLSTRVAHARLSRICFNDYAREMALVAERKDGELLGVGRLTRLRGTRDAEFAILISDPVQRQGLGAEMLKRLVDVGRDWGMERIVADILAGNRAMQTISRKLGFSILQHEELSPDMVKAVKVL

SEQ ID NO: 15705 - protein, 178 aa, Myxococcus xanthus
MEFNSLDAQRESCVAYVQRQPGWVLVEESYDDGGFTGANMERPAFQRLLQDVDARRVDVVVVYKVDRLSRSLLDFAKVMERFNAAGASFVSVTQNFSTADAMGRLTLNMLMSFAEFEREMISERTRDKVAAARRKGKWTGGRAPLGYEVKDKRLVVNEYEAVVVREAFELYLPTPAGL

SEQ ID NO: 15706 - protein, 57 aa, Myxococcus xanthus
MGQRFYETTMPQLVRQLGRLNDNVERLVAVAEQLAGQKEASSAEPARPTTTAGTEEP

SEQ ID NO: 15707 - protein, 185 aa, Myxococcus xanthus
MAKKGIARAARKELADVPRQLAALASMSVPDLAAKYLELYGEPTRSRNRDYLKKRLAFRIQELAEGSLSTRAVARISELGDKLPERWRMRQVEETKPSESPPPAAVDGRAAAADGRDVRLPPPGTVLTRVFKGAQHRVTVREEGIEYEGQLHRSLSSVAKLITGTAWNGFTFFGLKDGSPKAVTR

SEQ ID NO: 15708 - protein, 295 aa, Myxococcus xanthus
MRRLYRGETEERGRPDLTVSTYRLQAPLCVCGETRATEAALVERILPVSPEKATVQQPAYRAAFREVTSVRLALFAPRYIQFCLGRDFDADYRLARAVADDFVKGRQVPPRVVDNVTAMLLGIHLFEQFAEECGYPLPADLGAREAVDAVLKDVLEEEEGVRNALDVFIQKLSNMAIQGELKHRVHYAFVEGRLCLHLESAYDAFRMYCKRTDYRGEMVDTKALRRLIHENHRAGGYVVSPSERVCFAGKSLRRCALVIDVAKVPFISAEEFPHVEEASRGWRGQGYGFAEEGAS

SEQ ID NO: 15709 - protein, 463 aa, Myxococcus xanthus
MCGPVQRLWEQGAEDRSVAIFNMVRFFAHKGLGLDEITELVLEYDRRGLGKLKGRDGKVYISKAYEKVVATAREDGAVAPPCHSLQGLGFCRVNREPDVRCELYDVVFDIEKAVEALATVPAQEMAYRLKPILEAISHRPPSAQEKYLGLLEVRTGLAAQKLRLSMARAVRTSAAGEGEEGADSKGGGKSSSGDDTIDGEVYEDAYCYYTVTQRGDAKAISSFTFTPKAVVETEEGEVFLGDVRTDKGTSVEGARLPRRAFNSRKELLHHLPSIHTQWTGSDNNVQGLLRAVARRAVPRLPGTSVLGDFKQGAHHVWVAPGCTIGKEGFLSPSPVAYLPNGASLESRVRYEATDDDSFHDVARTVFEYLPRINTPQVVLPMLGWFFATPLKPRLLEKVGSFPILFSYGTQGSGKSSTCTEVFWPLAGVPASDAYSVTETEFALVKLLPSDALRAGGAGRVQAP

SEQ ID NO: 15710 - protein, 147 aa, Myxococcus xanthus
MSWEQNLIEDEAGVERVVKSARRVAVLGIKTEQQSGQPAYYVPDYLARSGVEVVPVPVYYPDVTHILGKPVFRRLTDVPGDLDLVDVFRRPQDIDGHVDELIAKKPKAVWFQSGIRNDAAAEKLAKAGIQVVQDRCLMVDHRRYGER

SEQ ID NO: 15711 - protein, 289 aa, Myxococcus xanthus
MTTPSDTTPSTPNPDAIRATWRWLAHAPHGVSEVRVIRPGGGGIVGLGFFDDEEAFVAACVAANAGGNVYVGIQPRPRRLLELAPNVLRPLRTGAGSKDIEAVTATVVDLDPVRPKDTASTEDELSLTLQVAEAAAAWCEAQGLVRPRLMMSGNGAQLWFALPPQSLEGESHERVQAGLKAFEAEVRARFASERVHVDSIHDVARIIKVVGTVSRKGRGDTGAASPSSSGARRLRARGRRRTPGAPAARAGAAARGEPGASSPGGDAAGAGCLGPAGDGEGPPDGGGGV

SEQ ID NO: 15712 - protein, 949 aa, Myxococcus xanthus
PPTAYLRNTRTVEDFSEMRGDGGRVVSRTHDSSVGAAPSAPTRNTSTGKRTLRVRVDAGLRLAAGDVPPKVLEALCRALSLPNPAYWKLVRLRKRPGAEPQTLYFFRQEGRELVLPRGAIHLLRRAADGAGLTLSFEDARVLPPKRLPKLPEVALRDYQAEAVERLAKATPGTAVLPCGGGKCVKNDSLIFTDRGLVTAAELAVGVPEEHAAFTEVGVDTSTGRATTNAVYNGGRSPTKRARLALGYELEATPEHPIRVLRDDALAWVRMDELHVGDRVALRRGSEVWGRSSLPEAFRWVKPKYAANLKLPKGLVLDEVAAEACGLLVSEGTLTKRLVTEFTNADADNVGFISRWAASIGIDLSRNGSDSIQYLLCSVVLREWLAWLGLDYTRAAGKCIPRAVRFGGRDIMRAFLRGLFDGDASVDPLKGVIEFCTASERMAREVQVALLGLGILASRHSRTVAGYEQLYWRVTVNDVATFEREVGFSSNWNRLRLREAVARAEGRCRNPNVDTVPINGLVERLYRTAQKQLSWSSQEGRIFGNYVHGEHAPSRAALERMVQRWGSECPTECLPIEAFLELPVAFLSVESIEDGEADVVDLSVPETHEFVANGVVCHNTMLALGAVARLRTQTLVLVHTLDLAEQWREHVRERLGLEAGLVGAGEEDVQPVTVAVVQSLTRWEDAKLDAFLGRFGLLVLDEAHHIGASAFHRIVDRCPARYRLGLTATPEREDGLTPLLRLYLGAPLAVVRHEELVARGVLVVPEVRVVETAFEYPYVGSADYAPMLGALVEDKARNDLVLGAVAREAWAGHLCLVLTGRVDHCELLAQRLSATGIPAAALTSAVPRAERKALLDKARAGRVRVLVATSLADEGLDLPRLSRVFVVYPGCAKGRTVQRLGRLMRPHEDKKSAVLIDFLDRKVPLLRRHHVKRRQQYAAVLGVAAAASAH

SEQ ID NO: 15713 - protein, 202 aa, Myxococcus xanthus
HPGTNIQINGQSLDITGTYKIAVNDYIAKGGSGFNVLKRNTTRIETGISLRDSLIGYMQGFCTCEDILAGRETSKSGHYCGNLVNGRWTVNEQVVGSCRAAADFKAALDKQVGSCDCKDLLSLPSDAAERCGVPGLTAEDIQSQCDVPEGPYTGRCSCRDVLAGNNPICGTVTNQLRNFCENPTSVSIADAVEDSRIGRRVK

SEQ ID NO: 15714 - protein, 561 aa, Myxococcus xanthus
MEKQDGSPPTLLFTDDGVGLTEDEIHRFLATIGESSKREALEARRNDFIGQFGIGLLSCFMVCDELLVVTRSARGDGRTLEWRGRHDGTYAVRPSEHPLAQPGTQVFLVARPDMAHWFTATRLRNLASHYGGLLPFPIHLTTDQGTERLDTSGAPWRREYDSASERRKALLAYGRELFDTDFVDCIPLRSTAGDVDGVAYVLPASPHFNSRQKHRVYLKHMLLSESAENLLPEWAFFVKCVVNANALRPTASRESFYEDDALAAARESLGQSLRGYLMELAREDPRALQRLIALHGLSVKALALDDDDFYRLIIHWLPFETSMGMMTLADYRRAHPVVRYTSTLDGFRQIAQVAGAQGLCIINAAYTHDTSLLEKLPHAVPDVQVEPFSSADLPQSFDELTLDEREATFPLLRMAENVLAPFRCGAVVKKFYPAEVPTLYSSDAEGAFRRDAERAREESDDLYAGVLDSVMAASGSEPAQLCFNLHNPVVRRLAAVADRDMLKLSVEMLYVQALLLGHHPLNAQEMVLLNQGLLGLISAQLGGDGGRGGEGSGGAGPRGLH

SEQ ID NO: 15715 - protein, 374 aa, Myxococcus xanthus
MSGDWREQVESLFAQADGLAEGESKVRLLEEAVRLADTHKDVGMGYRMRDALIDAATFGGFPDKALVAFAWCRGQQKKDPKRFDPEEMFWKQKWVVGRIKEFPHITRKQILDALDDVEQCFRATDSGVRAVLKMRYQAAREMGDAAEEVERLWNAWLETRRDHLTDCRVCELDDELDHHADKGEWQQVLRKAKPILDGRKSCAEIPHLTLGTVLYPLFKLGELEHAREIHRRGYAMVTKNREFLSTVGEHMEFLALTDNLARGLTLLEKHLGWALDHPSYRDRFTFYAAAAFLLERVLAAGDRDVVSLRLPKTFPNHQADGGYDVRALHAWTLGQARDIANRFDTRNGTDRFAKLLARNQVLAGEVRPFPIDAK

SEQ ID NO: 15716 - protein, 307 aa, Myxococcus xanthus
AVAALLHLPAATWVGMAALFVALVDRGGPYWDRALTMGAMTLLGSVVGLAAALHLPAWAAVIATLFWVTACGFARSYGDTPGLMGVVLANYFVVSLALPANDVADALLRSGLFLVGGAWAMFLALMLWPLVPYRPARLAIARCYDALADHAEEVGRWPLEGGASAAAGVLPEAPWQARMRQLIEQARTVLASTRMGRAGESGRGEQLLVLVEGADSMMVTLIALTEMLEVAPAEPRYHALRAEVQRALAELTADLRRVRFALEKGTEVSAQSVWNAERVKRALDALDPAGGVPEPVPPGISTSPPEP

SEQ ID NO: 15717 - protein, 481 aa, Myxococcus xanthus
MPLGYIPVLAPRMGLAWRSRGVPVLDFTKAGWLLPLLTETVAFEAGAPAPSAPPLGSGRARARAYLRRTLRASGLLYGTPADAPSAADVAQPTELQARVLEDQLFRAVVRTLALMALELGRLVGAPAAVRTEHLLVLFAVLTGELELAEAVDAAIASGRPVSRRLTAKVEASLVKRSPVLAGDPVYGLVLHNGAQYADAQLFCRQAIDYFSRGTLHRERAQRRLDFAARQKALLVDVLTGLACVDRVPGLPARRAILRQVESLRLPAAMTSELKAAVKQSFARRRPVQDVVRQVRSVDVRHFLLEQTLLAALVDGRKTRRERVFIRELAQALQVPDAELHRLELEMAEFYARHRAIVDVFTVSDAAGAMGEDLVAGIQEALEKNFYRLMQEVRETGDLAVLLTKAARRQALTGDERRRMRAQLVDVAKAIPALAIFAAPGGILLLAALGKVLPFSLLPSAFQEAAPAEEDFEGVGPEREAG

SEQ ID NO: 15718 - protein, 82 aa, Myxococcus xanthus
MSLIATQFKPSVALLPIGGHFTMGPAEAAQAVRLLKVKSVIPMHYGTFPLLQGTPDALTGELKKLRNTAKVVVPEPGATTAL

SEQ ID NO: 15719 - protein, 322 aa, Myxococcus xanthus
ALKSRRGPGLLKKKLGEVVDSCVNAVGVDVNTASPQLLEHVSGVGPSLAKKLVAHRASKGRFTTRRELLKVSGLGPKTFEQAAGFLRVRGTEPLDASAVHPERYGVVERMAKDLGVAVSALVGNAELVRKIDLKRYLGPDLGEMTLKDILAELEKPSRDPRGDFTAPQHREDLRSLEDVKEGMVLQGVVTNVTAFGAFVDVGVHQDGLVHVSQISTRFVKDPSEVVKVGDRLTVRVLTVDLARKRLALSVRAVQEGGAPQPSGRPPVGGATGPSRMTERGGGSGGPRQGARPASGPGPKPASGPGEKKGPEPFNNPFSKLKR

SEQ ID NO: 15720 - protein, 301 aa, Myxococcus xanthus
MRPGPLTSSLLLLLLATACSHKAPLSVSPSEPRPASVRLDFQPPVDRVLTETQRSVRSVERRGDTLREEVELTTQTRFTPSEGGWLLAQAVPRSRLTRNGQEVPTGVADVLARFTLQAWLAADGPFVKLVAPEAAQEALRQVAPSGTEAGVLERFFEPEALETRARREWEVKFAGLFQRNLVEGQQSWVVDLVPVGDSQVAYVLERTVQGTRDTPLGDAVVLGLRCLDAVPEDAPDALWEAWVMAGRPELTPGVSCEGEQLVGRGRFMPVSRQLTVRATVAGEAWTVTTESRAEGLQEEAR

SEQ ID NO: 15721 - protein, 681 aa, Myxococcus xanthus
LPLDHVVVPEAKALPAIIVTLSAGGRPHFVVLWNRVGPFIQVMDPAAGRHWTRISTLLSHLYQHTTSVPATGWREWAGSEEAVATFERRLLNLGATQARALVARALKDPGYLSIARLDAACRASEAMIRAGAVRRGRMAAGLLQSMIAKDDSSEVPIPAAYWSVRPNPEVEGELSMTGAVLMRVRGWREAPREGEDAPRAVLASDLATELIAKQVSPARTLLRLRGEDSWVVPGLIAVGLVFATFGRILQSLMLRGVLDLGRDLGTFAQRATGMAVLAGVALCFMLIQIPISLGLLGIGRRLEVRLRKAYFEKLPEMEDRYFQSRLASDMASRTHNIQAMRSLPPLLAQALVLSLEVASITAALIWAAPHAWRIVLALAAVTLLVPLVAQKLLFEPDLRVQMHAGALSGFTLNALVGLTPIRIHGAERSLRRAQETLLVSWSKARYWLQTLSVGFEGGLMLGSYGLVMLLVYSYLAGTDRASLVLLVVYWALRFPILGQRLMMLSRAFPNAMNRVRRLLDVIGDIKEPPARPEAPVQEPVAPADAASGVSIVMEKVRVKGGGHTILDKVSLNIAPGEHVAVVGVSGAGKSTLVGLLLGWLRPARGEIKVDGQVLDQAAVERLRRTTAWVDPAISLWNQSLIDNLRYGNDGAHGWSLSGALKSAEMLDILEALPDGLQTSLG

SEQ ID NO: 15722 - protein, 405 aa, Myxococcus xanthus
MAYPFERTLRSLNYESDTRLVFVALMVLCAGGLIAWSLFAKVPLVKASSQARIEPHNAVHRIEPPSAGRVVLSLLKLDQEVKEGDLLIEFDARAERLELERSNATLAATEKELAIIRQQITNKHEEAALTARVDEVAVKEALGREQELAPRHRLAVERAELAFKSPAGAVSEMEKLERTTDVDALRFAQTAQGLALIRLRREQNVRRQALAAQLLELEREALGAEGRIRELQGTIDRLEYQIERKLYRAPATGHLVDVAELGSGAFIADGQRVGTIVASNAEVRVRARFPKEVVGLIQPGQTARLKLDGYPMTIYGTVPARVTAVGTEPGQTATPEAIPGTVRVELKFAPPDDPRIQLRHGMTLSVEVEVARASPVALLMRAVGEWNPQPEERPTNVFRPEAEAR

SEQ ID NO: 15723 - protein, 67 aa, Myxococcus xanthus
MLALAHHLESAIERGLVASAADVAGQLGFTWARVTHLLDLRLLAPDIQEEVLFLEAVDGEEQVVALL

SEQ ID NO: 15724 - protein, 67 aa, Myxococcus xanthus
RILAVPITPSRAGHLTDYQQLPQREREELEHFFLAAVRFEDKHARILGWQGPQGVERMLRQHARTEE

SEQ ID NO: 15725 - protein, 298 aa, Myxococcus xanthus
MAQPTPIRGLGPDSRLGDAARRILAGRLADVRKPEAGFQDAVDDASVHDMRVATRRLRAALKVFRSLGGMKKLERDVKRIQDALGGVRDVHVQSAWLESVARKASKNPQVRAGIQTLRKKRLSELETHETRLHAELERWMDRTVPRLLRKLDGLDDGHRFAGRRVRDALRQRLKRVQKGIDTYVDAADAASAHELRKELKRLRYELEIFQPAIRRTLDALLEVLVPLQDGLGELHDADVRLELFERLAAESAPRERKSARALLPLVREERTKRAAETAREVQRWRTEEIPKRLRRMLT

SEQ ID NO: 15726 - protein, 418 aa, Myxococcus xanthus
MRACGLDFGTSNTAAALPDGTVLSLQPNTSEARLFRSVLFFPDDEQDIYAGAGAIQRYLEDNTGRFIQSVKSFLHSSSFRATQVKGRTYTIEELVAVLLRRVRDAAASAMGGAPEAVVLGRPAVFTPDPEADALAQQRLLRAAELAGFQHVQFLIEPIAAALAYEAQLTRDELVLVADFGAGTTDLTLMRLGPSRRGNPDRRQDVVGSTGVRIGGDRFDAEIMRHKLLPRFGAGSTYQVRGFSDKRLPIPQHIMAKLLTWHEMSFIRERSTQELLETMLNTSDRKAEIQALYDLVMDNLGYRLFRAIEAAKVRLSQEDTATVDFEEARITLHEPITREEFDTFSQPLLDELDACTAGLLEKHAEAKDIDAVFLTGGSSQIPAVRQLYMRRFGEGRVRTADAFTSVAEGLGRAAAHLSV

SEQ ID NO: 15727 - protein, 230 aa, Myxococcus xanthus
MRTENWLPLIGLLLVIPCHTVEARPVRAEAQLWYTVSAQGGIGEHLLYYLEAQPRFGKDDARGILRSAGGVRLAQDMSLWLGQGWFPSWRWEGDPALRQGESRLFQQFLYTPKFAQVRGTLRARLEQRFLPGTTEVSHRGRVMLRGAHPVAAEGRLSLIVWDEVFYHLSSVANGPSAGFDMNRVFVGAGWKYGDHSSVEVGYLNVFTRRPYAETEQLIHTLSVAMPFNYM

SEQ ID NO: 15728 - protein, 64 aa, Myxococcus xanthus
MVDGRQASAGEIQEGSQVRASYRTDEQSGEPQAVRIEATSQVQPTAPAAPESGQSTPGSQQPTQ

SEQ ID NO: 15729 - protein, 289 aa, Myxococcus xanthus
MRSILPALVVVLLAGCGPDFELQSEIRRVRVLAIQAEPAELVVDPDASTLPGPMTFNALAVTPDARPVTVRYALCRFTGNPYDGRCPGDDSVPLPDGELSLSDPDVQAVLLEALAAGNPGGGGTLDPEDPALREALARGIPLFIGYEATDGSGTPEGTERGVRRVTLRATTTPNQNPVVSDVLWDGAPLTGPLPVSREVTFTPVLAEGSVEIEETDEGSRPEQVFFSWFATGDGEVKEFRSQEPVEGRPGDPTSAYDTPATPQRVTFWVVARDGRGGVGWLSRTVDVGP

SEQ ID NO: 15730 - protein, 874 aa, Myxococcus xanthus
APLMKILLAVLCFLAATGAAAQQDAGVTDADAGAPQGVLTKPPALMRQVEALYPPEAAAQQLEGTVVMWVDISETGAVSNVEVSQPAGHGFDEAAVEAVRQFQFEPAEVDDVPAPVRIEYAYQFVFRPPPPPEGEDAAAVEPEAPVNFSGRALERGTRDALLGAEVVLPALERSTVTDEEGRFSFRGIPLGTYEVLVVQSGYERFRTEETFTEGQETRATYYVRKRIFGAFETVVRSERERKEVTQTTLQLAEVQRVPGTQGDTLKVVQNLPGVARPAFNGGQLVIRGTGPQESGVFLDGQRIPLLYHFGGLTSVYNSELLEAVDYLPGNFSAYYGDITGGVINVRSREPRTDRLHATVGVSLIESNAVVEGPITDTLSFAVAGRRSYIDLVLGLVPQGDNGPSLQVAPRYYDAQLKLVWKPRSRHTFTLQGLTSRDRLGLVFDRPADDDPTVTGGLNVTTGFNQLRLRHQYRADALTLDTHGLVGNTLVQFGIGDRGLRIASTDLNLRSTVEYAFGEALTLAGGIDVVSNFARVTARIQGLSREGEPPTPTVTDDVLTADGDFLQYFPSTWVEARWRPVPRLLLVPGLRAESYIFTDQTQARRTFNPRLAVRYGLTDTLTLKGGAGVYHGPPVQDEPSVAFGNPDLRAKRSLQYSVGAEWQARPEWFVGGEVFYNDLDGLIVRSNATVVRNGQRVPERLSNGGVGRIYGLEVLVRRALTDRLFGWVSYTLSRSERQDAPGVGWRLFDNDQTHVLTAIASYKLPAGWEVGARMRFASGNPTTPVVGSVRDDGSDVFIPLYAAVNSRRLPSFNQLDIRVDKNFAFEKWALNVYLDLTNAYNNPAVEGIAYNYNYTQSAFFEGLPILPIIGARGSF

SEQ ID NO: 15731 - protein, 106 aa, Myxococcus xanthus
MAYGLAEDPALSITPHLDAVEYPVEREQLAAAAADAGAPPDVINLFKCLPRREYATREAVQRDLSEASRRSALGGSRDDDDGVNRDRRNIGRDAVEDAPDGQTRHP

SEQ ID NO: 15732 - protein, 569 aa, Myxococcus xanthus
MAFAASDGLPPPLALQVRAGGLAGLRAGLMTTLARRTLAPPRRDARRRAFVVEAPGTSVTLPKLYVQWTGARASLLAGTYRLGFGQRLTLDTTALPSPDGFLPDDDVRPPAGLERSCLVGSAGCEPEERLSDVTPDFRWDEGFRGVAGTVRGPLGTWAALSLTGFGSYQSRALARHAVLDRSLCPSSARGACKAPDVWVSVAEGRWEKLTARTLSGMFRELAGGGNATLAMSSRSHVGLTGWMARPMWGQEGAKLDFQPNARYPAGGAFGAFGLDAAWGRGALDVFLEGTRSFDAAPGGGGDFGAVQRTVLSGGARELELSLRYYGRGFANPYSGAPSGPDALEGLRVRNELGARLRYLHREEGAWRLRGQVDAWTLPADGAVSGSAGTLHARASVRGDLRVRPWLQPSLQVELRDNGVGGMGACADDSLSAQDVADLCASARYGVTARVRSDVAKGLTVSLQYGHARVQAPETKGLRYDAQAVLDVRAQPLSSLKLHGRLVWKDQDLSERSRLQQELRTALDVAWRVSSAVSARGRYAWVLDLKDARVARVPPDPPRHLFHLELETRF

SEQ ID NO: 15733 - protein, 233 aa, Myxococcus xanthus
MANPRGDDTLGEWVELRATAPVDLNGVTLVAEAGEATLKAGGCLSLSAGEYAVLARRTDATLNGGLPPPVATFNMDLRNAGGRLQVKAGGVVVDAVDYALAVDGVATQVSAPLADAVQNDAPSAWCAATAAYGSRGNVGTPGRGNRVCEGDGGTLGGVGDGGTFDGGVDAGTLEDGCIDRTTGRTRARRGARWGLACPHRIHGGPTGGSGRHGGVGGGARAARRGPQWCVAVQ

SEQ ID NO: 15734 - protein, 156 aa, Myxococcus xanthus
MADPQAVADAMGEWVEVLALRDVDLNGVSLSNESGGRSTFDSALCLAVKAGGRAVLARSEDASLNGGLPAVLGTFNFNLANTTGSRKLELSVDGRVLDAVSWTGAAIPGVSSQLDPGRSDPQRNDWPGSFCPTPDSARYGRGDRGTPGGVNRACAL

SEQ ID NO: 15735 - protein, 157 aa, Myxococcus xanthus
MKGALACLLAACGGGDAEVSCGPASGRVAEVLDGDTVVLESGERVRYLLADAPERTGTGGDCFGPEAHAFNRGLVEGRRVALTYGEACEDRFGRLLAYVSVEGREVNTLLVERGHACVLHVPPAGRSRRAEFQALEAQARLARRGVWGACAPVSCQR

SEQ ID NO: 15736 - protein, 755 aa, Myxococcus xanthus
MSPSVTPTLSLPDVLDVLREDITRRLMAGVGAALGALAPLAIAEAGALHKLVGRLGALLRIPSMAARLAEARTLGRDYGRERYLAGFGISSLVLEYGALREAILESLESVGWVPELAGLRALAQVLDAGLVEAVGQSSLEDERTARATGAWLHGLLDHAPTLIYAKDTAGRYLYVNHGFERASGKLRRDVMGRTDFDLFSAEVASTFTGNDRQVMDSGQQLTVDEHVPLLDGLHVFQTLKFPLPDAQGRVVGVCGFSTDFTEAKRLERERDEAREHLRRIVTQLPVILWATDAQGIITLFEGERLSALGLDRGAYVGRSAFDVYRDRPDLVAATLRAQEGQSFTLEVEMAGSYFMTGVSPVIGPDGSVMSVAGVSLDISERRRAEEVLRQSEMRYRLATLATSDVIYDWDLDAGTIEWSELAAVQFRLASRAPPRDIAWWTEHIHPEDRERIAREMQAVIDQGASHWADEYRFLRGDGTWAVVADRGQVVRDAEGHAVRMVGAMQDITERRATELEAKRRAEFEQLLIGIVSHDLRNPLAAISMSATALLRREGLDERLRKGLGRILSSAERATRMLRDLLDFTQARLGGGIPMEPRWLDLHELTRQVVEEVRLTRPERTLKLECRGDGYGLWDADRLAQVITNLVNNALSYSPEHCPVRIRTHGLRDDMLLTVHNAGGPIEPELRARMFEPMKRPERKGARGGGLGLGLFIVKHIVDAHGGVVRVHSTEQEGTTFQARLPRQPMPPARPDVDAP

SEQ ID NO: 15737 - protein, 276 aa, Myxococcus xanthus
MKKVLIGLGIGCGVFILAGIGLMLAGGIWAKNKFGGSIEAMQSIQAQEQELTQLNASNPFKAPPEGQVLPLDEPRLLAYLTVRESALPAFKAFEAKSKEFEAQHAGDGDEKPGFNAAVDAASLFMGLMADVRKAYIAGLKAQGMSPAEFQSITTTVYASMVADSLEQIGAAAEQGRKMMVTQLAEVDKRLADDSLADEERAQLEEARAQLQDTLDAIEEPGANEEQPLSEASKKAAAANVELLKKHKERVELMANVAFDGFVLGGAGADGQAAGLE

SEQ ID NO: 15738 - protein, 135 aa, Myxococcus xanthus
MNKVIFACVRNAGRSLMAEAFFNVMVDPQKARAVSAGTQPGDKVHPEVLAAMRDIGIDLHDVKPRLLTDDLTQDAQWLITLGCGEACPQVPGLQREDWPLEDPKDKSDVLVHRIRDELAARVAGLLEREGWMRAG

SEQ ID NO: 15739 - protein, 368 aa, Myxococcus xanthus
MAETSSLNIPTVDLADLASDDSARVERAAAAIREAFGVFGLVYLKNHGVDTQALNRFYDAFAAFIARPAEEKKPYGRADIWYQRGWTPPNTEVAVASNGQPDFKECYFVAPYPNDAQSALEFPELYPENVWPQNAPPYFEDGIMTLDRSLHEAGLKLLRGSAVALGLPETLFTDLCDRAAHVTRALQYLPLTNTQVNTDIVWGEEHTDFNLLTLLPGGRFLDPDGSPAPGPDNKSGLYLRTRATPEAPNGLKVRGTAPAGCIVAQVGQQLEILTGGTFLATPHVITAPGVPGWQRQSAAHFMHVHTNTVLFPLEKFRSADAVRNYAPPVLAGTYDIKTLVDIGLAPASALDKLGYRHYDRLNRQRAGT

SEQ ID NO: 15740 - protein, 195 aa, Myxococcus xanthus
SDLLRRMLFLPEAASSLATRVDQLHFFIICTTFVVGAGIGLTGLFFLVRYRRGRAPSEAPAMAAPTWMEAAFAGVPLSFFLLWGALGFRDYVWARTPPRDALDVYVTGKQWMWKFAYPDGPGMVGVLHVPTGTPVRLLLTSRDVIHSFFVPAFRLKMDALPGRYTEIWLEVLRPGRYQVLCAEYCGLDHSHMRAE

SEQ ID NO: 15741 - protein, 120 aa, Myxococcus xanthus
MSEGFIPPPPEPRMLPTRHIAGVGCAWLFVVGIALLLIRWSVREYAPWAPAGFPPTLGVSEVADVNQRLFKREDAAPRLREAQRARLRGYGWVDRDAGVIHIPVEQALEQVLSTEEGARP

SEQ ID NO: 15742 - protein, 162 aa, Myxococcus xanthus
MVDVGEKPKTGRVAVATALLRMLPDTRERILAGKVEKGDVLAAARLAGIMAAKRTPDFVPLCHPIALSGVEVTLAPEDAGLRVRVQVKTVDRTGVEMEALTAACAAALTVYDMCKSVDRGMVLDAVQLEHKSGGRSGTWQREEATPVEAAAPRRRTRAKKAR

SEQ ID NO: 15743 - protein, 627 aa, Myxococcus xanthus
MSGRLALVVFGLVGVPACVDLDPMRVQARDGAFVANPYFADARSMRPLVPGTVAREWYFQEAAYIRRGSPDGGWVEVEQLPVPITPDTLREGRAHFETWCAPCHGLLGDGQSIVAQNMGARSPPSLYGEAHSHPEHGAVMPADAGEGARPVSPGWDALPHSPGFYYSVITGGYGLMPSYADALTPEARWKVVAWLRVLAYSQRAPLSAAPDDARESLMRAPEGGHAMTATVLTRLNLGRRVVWGAVTVGGLGLLATLLGGVAAPREAAYGYLFAFAFWLTLSLGALIILASFHASRARWPTVLRRPLEVMAASSPVFVLLFVPVVLTMPHLFPWVAIPADLSAHDVHLLAHKKPYLNVPFFLGRAVFYFAVWSVVGLLLYRWSVRQDAEPAITERAVRFTLYQRKLGAGSLPLMVLCLSFASLDWLMSLEPLWESTVYALTLGCGAVVGALALVAVVAATARGAGQFGALMGPAHFLRLGTLLLAFVCLWAYGAFSQLLLIWIASLPEEVTWYRARLDGGWLAVAVVLAVGHFVVPFFLLLLRRLKQDPRALAVVGAWLLLMRALDVYWLVFPALHPGTASFHWTSVTAWAGVGGWTVAAWWLLSRGGYTVPVRDPFLPHSLRVPRS

SEQ ID NO: 15744 - protein, 64 aa, Myxococcus xanthus
MGVIVACGLPRVTHPFLGLEAFRSASIDGFWLAVAVDDAEGADAAQGALRRLGAEVVLAVEGRS

SEQ ID NO: 15745 - protein, 474 aa, Myxococcus xanthus
MSEPLPLAPVTADPLVVHPLLEERRPDAQLSEALLRPVLTAPGKGWWALVGVCAALTGLLVVAITITFATGVGTWGNNIPVAWAFGIINFVWWIGIGHAGTLISAILLLFGMKWRSSVNRIAEAMTLFALICAALFPLLHLGRPWKFYYLVPYPSSLRMWPQFRSPLTWDIVAVTTYLTVSVLFWYLGMVPDLATARDTAKQLWHRRVWGVLSLGWRGSARHWRHWRIGYLMLAGLATPLVVSVHTIVSLDFTVAQLPGWHSTIFPPYLVAGAILSGLAMVLSLLIPARRALHLYTVVTQAHLDALARLLLVSGLFVAYGYVQEHFFGWYSGDPYEMHAMGMLRTGPYAPAFWTVFTCNVLVPQLFWSARMRTRPLVLWFAALLVNVGMWLERFVIIVSSLSEDFLPSSWRHYAPTWVDLSLLSGTVGLFGLGFLLFLRFLPPVPISEVKELQHQVEASEAFAHEVSAREGGAR

SEQ ID NO: 15746 - protein, 715 aa, Myxococcus xanthus
MPPALNRLWVVETRLSLTGAFADERLRARPSRVPWVAQALAVELGRMLGREEWTALGRGASALEDSERRWVVGAARDLMEQGRRAFIVVGESQPAAVHALAHLLNATLHGGKVRCVESLLAPAPDAAALPALVADIQAGAVDTLLITAWNPVYRAPTDLPLGEVLGRVEDAVYCARHDDETTARVSWSVPSTHPFEAWEDGRAVDGTATILQPLIAPLLEGAVPPLEVLAAFTGELATTPYERLRAQWREHAGATGRFEDAWERWLAEGVIPGTQLPVQQVAVDTAAVLAAVRALPPPGDGLELHFAVDTKVHDGRYGANPWLQELPDPVTQLTWDNAVWVSPATASRLSLARGNRVRVELRGRAVDAPVLVVPGQADDTLTLPLGYGQRMGSPVARGVGFDAQALRFQDSPWWAAGGQLTRVQGHHDFALTQEHWHMEGRPVALQTTAARFAAQGDARLPDLQAPKEHLYPPRPAPEEAGHRWGMAIDLHRCTGCSACVVACQAENNIPAVGKDQVGRGREMHWLRIDRYFMGDADNPSVITQPLMCVHCEYAPCEYVCPVAATVHSDEGLNQMVYNRCVGTRYCSNNCPYKVRRFNYLEYNRGGLLDRMYRNPQVTVRSRGVMEKCTYCVQRIESARITARVEQRAIRQGEVRTACQQACPTEAIVFGDLSQPEDPVTRLHQDPRHYALLNNLGTRPRTVHLIRLKNPSEVSG

SEQ ID NO: 15747 - protein, 136 aa, Myxococcus xanthus
MPPLTEEYPLPVLTEPEPWRSLEERQGIAPAPEPGEFPQEADAPPQGLSRRVLLELAAFGGAAAGLAGCFRSPPEKVLPYSRPQPEITPGIPLHYATGIALGGFVRGVLVRSQEGRPTLVQGNPSHPKSLGAAGAQ

SEQ ID NO: 15748 - protein, 197 aa, Myxococcus xanthus
MVVLPVATSMALLLLARNPLGTGAFEPVQQPVQFDHRHHAGDEGIGCRYCHDGAWRGPSAGIPPTSRCMGCHAQIWNESALLAPVRQSYFEDRPIPWNRVHRLPQYVFFNHAIHVHKGVGCVSCHGRVDQMPLVEQVAPLTMGWCLECHRDPAPHLRPPEHVADMTWSPAGPAREVGLVVMRTLDVSPRTECSTCHR

SEQ ID NO: 15749 - protein, 129 aa, Myxococcus xanthus
TGAGGETLVFVSAGQVGSMLARAAAVPAWLPVPGELAETRTVNFNLEGASHHVVTGQLQADSPDAAARRYGALFRERGWQVGTLAPVAPNGIAFEVLKESVSGRAVLRDLSPGPGVEVQLTLLRRSVAP

SEQ ID NO: 15750 - protein, 44 aa, Myxococcus xanthus
MVEYAIVTAALLGFSTMGWPFLVQLLNALHRYFNSIYYVIQAPI

SEQ ID NO: 15751 - protein, 394 aa, Myxococcus xanthus
MSSKQKTVAVHAGTRLAGSKAVPVSPPIYPAAVNWFDSSDDLDSALDGKDYAYARISAPNTTLLEEAVAALEGAEDCVAYASGMAALRSVFEAQGFRAGDKLVMPADGYGVTRALYKSLCATLGVELHAFLMTDPEVPERIRALKPRMVLAESISNPLLRVPDLRVLARACQDVGATFVVDGTFPSPVGQRALALGADYAVQSTSKWLNGHSDALGGTVSASRERMAPLRAARVLAGDVLGPFEAWLTLRGLRTLPVRMKAHVEHAAHVARRLMESPLLERVIYPGLTSHPDHATAQELLLGGGPMVAFEIKGAGRPESMRFLEALKVGRPGPSLGDVCTLVMHAASASARRFTPEEREAAGIRENLIRVSVGLEDPDDIVDDLLAAVAQGVRR

SEQ ID NO: 15752 - protein, 169 aa, Myxococcus xanthus
MSKMTDYGIVLMTELARAEGDTRTTRELAARTRVPLPSASKVLKSLLQAALVVSHRGANGGYGLARPAHELPLAELVTALEGPVALTECGVHTSGGAPCELESVCQVRGHWRLINDAIQEALGRLTLADLIAPAPRVPERLVGLGTPSRPAPSPAAGHPPPASATGVRS

SEQ ID NO: 15753 - protein, 478 aa, Myxococcus xanthus
MSTETLQELTRRPYAAGFVTQLESDTFPPGLDEDVIRQISAKKGEPEFLLDWRLKAFRHWKTMKEPTWQAVTYAPIDYQAIRYYSAPKQKPVKASLDEVDPEILRTYEKLGIPLHEQKLLQNVAVDAVFDSVSVATTFKDKLAKAGVIFCSFSEAVREHPELVKKYLGTVVPYSDNYFAALNSAVFSDGSFVYIPKGVRCPMELSTYFRINAADTGQFERTLIVAEEGSHVSYLEGCTAPMRDTNQLHAAVVELVALDNATIKYSTVQNWYPGDAEGRGGIYNFVTKRGIAHRAAKISWTQVETGSAITWKYPSVILKGDDSVGEFYSVALTNHMQQADTGTKMVHIGKNSRSTIVSKGISAGRGQNTYRGLVKVLKSAENARNYTQCDSLLLGDKCGAHTVPYIEVKNASAQVEHEASTSKIGEDQLFYCRQRGISQEDAVSMIVNGFCRQVFKELPMEFAVEAQKLLGVSLEGSVG

SEQ ID NO: 15754 - protein, 262 aa, Myxococcus xanthus
MALLTVRNLHARVAGKDILKGIDLEVAPGEVHAIMGPNGSGKSTLASVLAGRDGYEVTQGEVLFDGKPLLELSPEARAAAGVFLAFQYPVEIPGVGNIHFLRTALNAQRRAKGLEELDAMDFLQLAKEKSKLVQLDAAFMNRSVNEGFSGGEKKRNEIFQMAVLEPRLAILDETDSGLDIDALRTVAGGVNALRSPERGMVLITHYQRLLDYIVPDKVHVIAAGRIVRSGGRELALELEEKGYGWLGLDGGKAKAPVAEARR

SEQ ID NO: 15755 - protein, 446 aa, Myxococcus xanthus
MTTALAHYLDVATRFQAAPEQASAPQWLKRLRADALAHFERQGLPTTRDEAWKYSRLGAIAEGTFIPRTDVSRDTAHLSAVVERLGLPGPRLVFVDGRLAPELSSVAGLPRGLTLKPLRDAVREDGELLESVLGQRALANEHAFTALNAALLEEGVLLRLAPGALSEVPVQVVFLTRGDAPVLSSPRILVVAGESSEATLVETYASAGPAGSAATFTNAVTEVTLGDNASLHHYKLQVEADAALHVGALHARQGRDSRFASHAFAFGGAMARNEVHAAFAGEGGDATLNGLYVGQGAQHLDNRTALDHAVPRCTSRELYKGVLDGHSRGTFHGLIRVRQDAQRTDSRQQNRNLLLSESAQADARPQLEIFADDVKCAHGAAVGRLDAQALFYLRSRGVPQAEAERLLTYAFAREVVEAVPAGPVRANIEALLALKLPGAAQREVTA

SEQ ID NO: 15756 - protein, 407 aa, Myxococcus xanthus
MSGFDVNQVRKDFPILDQEVRGRPLVYLDSAATAQKPQAVIDALVRFYQHDNANVHRGVHVLSERATEAYEGARETVRRFINARDVKEVVFVRGTTEAINLVAQTYGRKHIGAGDEVLITQMEHHANIVPWRMLCEQTGAVLKVIPVDDRGELVLDAVDALLTERTRILAVTHVSNALGTVAPVKELTRRAHAKGIPVLVDGAQAVTHFPVDVQDLGCDFYAFSGHKMFGPTGIGVLYGRKERLDAMPPYQGGGDMILSVTMEKVTYNRVPYRFEAGTPNLEGAVGLAAAIRYLEALGMENVAAHDRELLAYATQALESVPGLRMVGTAREKSGVLSFMLADIHPHDVGTILDREGICIRTGHHCAQPVMQHFKVPATSRASLALYNTREDVDALVRGLHKVLEVFQ

SEQ ID NO: 15757 - protein, 76 aa, Myxococcus xanthus
MTGAVKDRTRAEAEDLFERVHKLVTEGPESVDVDALGKLAVLSGVSEFPARVKCASLAWHTLRAALEGRGEAVSTE

SEQ ID NO: 15758 - protein, 176 aa, Myxococcus xanthus
MAVLERDVSATIIPSGDRVVLPEGAELRVTQTLGGNITVQDPYGQLFRIDEKDGGALGEEYAPKEKAAGDLSEFNEEQVWEQLRTVYDPEIPVNIVELGLVYACKAEPLPEGGQRVDIQMTLTAPGCGMGPVLVEDVRTKVGSVPGVAETRVELVWDPPWGQERMSDVARLQLGWM

SEQ ID NO: 15759 - protein, 389 aa, Myxococcus xanthus
MLLATLALAVVACEKKNAPAAPSPEGQATGVPAAPVDSNTILLGEVGSLTGSEATFGVSARNGIELALNEANEAGGVKGKKLQVRVYDSQGRPEEGAQAVTRLITQDKVVAILGEAASSVSMAMAEKAQAGKVPMVTPTSTAPEVTQKGDYIFRVCFIDPFQGLAMAKFARENLQLSRVAVLRDNKSAFSMGLADVFTARFKEFGGEVPGDESYSKGDTDFRAQLTSLKRLKPDAVFVPGYYTDVGIIARQAREIGLKVPLLGGDGWDSDKLYELGGSALEGSYFANHYSPDNPDPVLQRFLARYKATYGGVPDSVAALAYDAARVTIDAMKRAPDLSGPSLRDAIAATKEFPGVTGKITLDANRDAVKEAVVLKVSGGKAEFVTTVTP

SEQ ID NO: 15760 - protein, 223 aa, Myxococcus xanthus
MKKLKGLRVAVLAADGFEQVELTAPVKKLERQGADVTIVSPHKGRIRGMNLLIPGKRVSVDASLREVKAADFDAVLLPGGFVNPDLLRQSALALDFVRDADALDMPIAVICHGPWVLISAGLVEGRALAAWPGIRDDVRNAGGRWVDEPVMRDGNWVSSPGPRQMFAFIKGMVELFAEKMPEVSARAPMVPVRQAAPSRWPKLLAGTLATAALGLGARRLALR

SEQ ID NO: 15761 - protein, 357 aa, Myxococcus xanthus
LSRMPVLLGGFLVVLFMPVQDSLCQKLGGRKSLSAGVSTVTVFVLILAPLALVGWMVAREVFQFVGQAQVLLEQQHLRHPFLASLPLGLERYLRLGVDSAETERALLAAMTGGASLLRDVAAAGTDLVINLFLMSVAMYYFFLDGRRLVAEVMRLIPLDRRYFEAFAREFTDVAYAIIYGNTVTALIQGAVGFVGLLIAGVPHAGVWGAAMVLVALVPVGGTALVWGPIGVVLIAANQVSEGVFLLAWGAFLVGSIDNVIRPRLCGSRMALHPLLVFLSMFGGLAVFGMMGLLVGPLIASIFMAMVRIYRRDFLGIGRAEHLSAHDENTSAPPMSEPASSRMSPAAPAMGPAATLNA

SEQ ID NO: 15762 - protein, 566 aa, Myxococcus xanthus
MVWVGFKDPSFAVPRVIENLFPHKESILGVGRDRLRYLITQRECRKFGRGLQPYALYKHVSGINAVRLRRLLGAITGEDYPANPKPAYAQLRSATLTGSLSVPELELHADIGGYAKVKQRLQQEILDVLAHKDTLSDPEAVKRVEALLPRGMIFWGPPGTGKTLFAKAMASSLGAAVQVVSGPELKSRWVGESEENLRQIFVRARQAAPSIIVFDELDSFASARGTYTGSGVEHSMVNQLLTEMDGFRKEELVFVVGTTNFVESLDPALLRPGRFEFQLCIPYPNSADRRAILSIYNQKLGLEMTERALDYAVKRTGDRVEGTGTRFSGDHIQALCRALARRRLREGAQGPTEAVDVERALTEFLDRPELTPMEERVVATHEAGHAVCALFCEHAPAIDRISIRGDLAGSLGHVQYADPAHRYVVTRGQLLDSICMLFGGREAEALLLDDLSLGSAHDLERATEIARELVEDLGMGGDGVPVRRFDAPGRQADRHALSDATRSTLEAAIQEVLAVQRARARDILQREKERVVALRDLLIERKVLDREAFTHLVPAPVAPKKEPALG

SEQ ID NO: 15763 - protein, 268 aa, Myxococcus xanthus
MVTTDVENYPGFPEAITGPELMDRFQKQAERFGTTIHMENVVKVDFSQRPFLIQGESVSCRSETVIISTGATAKWLGVKGEDTYKNRGVSACATCDGAFFKKQDVLVVGVGDTAMEEATYLAKIVNHVTLIHRRDTLRASKVMQERARQNPKISFMWDSAVEEVLGDAKGMNGAVVRNLKTGDSQQVKATGLFVAIGHTPNTELFQGVLETHQGGYLKTVPGSTRTNIEGVFACGDVQDHYYRQAITAAGTGCMAAIDAERWLIEHGE

SEQ ID NO: 15764 - protein, 344 aa, Myxococcus xanthus
MVRWGLWCALVVALASPQALAAAAKRKDSGPAKPSVVVLEVEGDARQRQAPFLEVALDTGSGGTVGDAPARPPLARLTLGGTTTWRNFCARPGVKSCGEYDRLPANERLGDTVSYASSVPYLGIAAELELLPLANSESLLRGLGLSLGYRRGYSSTNVTLVSDAGRSTTREAVATDSVLTAQALYRYFFGMGEANASLGHAGLRAGLLTRAFDVDASSNSPLTGTHRLFPAVGLEVSVPLVRWVRLEGAGQFFLSPKPGKGLGAGSAALDAEVSDYGTSVSSFGWEAELGVGGDIWGPFGYSVRFRLSRFQDTFSGAGTKLGWDEGGVAAETYSSLHWGITASY

SEQ ID NO: 15765 - protein, 55 aa, Myxococcus xanthus
MALLEEAWAGWIHALGAQGQLEAALEVEERARSLFPSSKAISQAVAFARAQSGTR

SEQ ID NO: 15766 - protein, 254 aa, Myxococcus xanthus
MGAGLVASLLAGTATGLGALPVLVTSELSRKAQDRMLGFSAGVMLAATSFSLVIPAMELVRGQGHDGPSAALRVAAGVLLGGLFLRVWHDLMPHEHALKGHEGHGGTKWNSALLFVLAMTLHNFPEGLAVGVSFAAPQPELGLSVALGIGAQNIPEGLVVALALRASGASASRAAFLALLTGMVEPVGALFGVLALSLSSALLPWGLAFAGGAMLYVISHEMIPESHRGGFEREATTGLMWGFVLALVLDMSLG

SEQ ID NO: 15767 - protein, 111 aa, Myxococcus xanthus
MIQDPSLIICHDVDGAPVRIGAKVKVVPHSEDGTISQRFLGQTGIVVGLVFDDPATQYPDDPLIQVLVEGLGEDLFFPEELELAPEWARNRIAQHRQAVRTGGRSSLERLP

SEQ ID NO: 15768 - protein, 217 aa, Myxococcus xanthus
MDLDSLLTQTPAKDNAALERVLAAARGELALRRPVRRWRTQAVGLMAASAGLGLLAAVVLLAVGAVTGPLLLARAPLLAMLVGTSAVCAWGALSPKGRWMRRLGVGLAVVSAAALVLARGAPHSPPSFPGWVCTVSHLAIGVVPLVVALFALRGAFFQPLRAVVAGLSVGSTGALLGELACEQDWRHVLSHHLLAWVVITVVLVVISKSLKPRSYAP

SEQ ID NO: 15769 - protein, 174 aa, Myxococcus xanthus
MERFRDGAQDAFEDLFARHAPRVQGFLARMVRNGALAEDLLQATFLSVIRSRGRYEPGTRFIPWLMTIAANAARDALRHQRHVDAYASREDTATPASAAPDDSDPSLRRHLLDALQQLHPDHREAVVLSKVEGWSFEEIGALRGISPGAARLRAHRGYEKLRELLGELELEVAR

SEQ ID NO: 15770 - protein, 440 aa, Myxococcus xanthus
MAKPAPARRRGKGARGVPMPPSRLPPWNPGARRERIRYAGFPMPRWVSLLLFFIPVLAVLSVGHVYLYRRLVRDVTKRKWLRRTAQGLFAVGFVGALSARAIGSVLPSEGARRLGIVFLLWIGLVLYLLMFTLAVDMVRALAAWRERRKARAETTAPTAPASPERRALLGQGLAVGAGLAGVATSSYGGWRAYHPPDVRDIPVRLPHLPRELEGLTLVQLTDIHIGGVIQRRFMDELVSRTNALKPDVIAITGDLVDGSVNALGGFAASLGKLRARYGTWFVTGNHDYYSGADSWVAFLEGLGIHALRNRSVSIGDGAASFQLAGVDDWSAHRMGERGYDLDAALRDVRPDRASVLLAHQPSNFDEVARRGVGLQVSGHTHGGQMFPGNLMGDLIWGDRNAGLSRTGDSLIYVSRGCGFVGPPMRVGAPPEIARLVLLPA

SEQ ID NO: 15771 - protein, 593 aa, Myxococcus xanthus
MRARCLRRVPFEKERLMKRWGLMGLLALAACGPDDASDKGAQSQVCPNIIAGSLSEPVETRHVRAPLTDDDGRQRVIIRYRNQGVMATARVHQVGGQVTATFRSTPAVAARMSLQEQRALLAEDPTVESIEEDQEWHALAPATAPIHPVLASVARGATPREFTPGLRKVQAHEVWDVDGDGLPDPDRPTGAGVRLCVIDSGLDLEHPELRDAVVAGRDLLENDDDPSDFSSDNGWGTGHGTHVAGIIAARPGHGGRGSPQLSDTGVMGVAPGVELIIARVLDIHGRTHMSFVLAAVEYCAEQGAKVISLSLGGGVPSKTTLEVFAAAHAQGILVVAASGNSNAQRVDYPASDPHVLAVGAVDSLDQRATFSSGGSQLALVAPGVDVLSTFPRGQGAFSTVDVRDTRPLSRSLLYAPIENKWGKLVDCGGGATLDSCKGSTCSGFVAYVRHGEVPTDMAMVNVMKQGARAVIFGNSSWEGGVDILAMPRRGQWVPAVTITQAGGTVLHRMLGELARISMSPADYTYMSGTSMAAPYVSGVAALLFSARPSATPDQVKHALLSSAKDLGPSGHDEDFGHGLVQARGALEVLTQLP

SEQ ID NO: 15772 - protein, 225 aa, Myxococcus xanthus
MKALVRGALCAAALWGGAALAQAEDRPIAEPRMRSAETVEFNASGRKRADTGIYAQLGGGLEGYTGQLAPEVTPGFSYGAAVGYRPHAFFAVELGYSGGLSDIDSRMGLLDDGEGGPDIVRNAGQAVVVGSFTDTRLQPYVLTGIGLDRYNVRNDARGAIRGFSDDTSGYVPAGAGLRYQMGNLITADARVNYNFLFDQDFAPGGRAPGALDGRYSAMLSLGGTY

SEQ ID NO: 15773 - protein, 136 aa, Myxococcus xanthus
MYRIAVAALVLAASGCATTGGGGGREGNATIAGVIRLPESGLRADDACGQLQVIVASPDAPTNGLGRTMVKPSRGNRCSFTVSGVPSNTDLQVGLAAGGGLKCETGATPTITPEPSTVKVSDYGTATRDFALSCGA

SEQ ID NO: 15774 - protein, 432 aa, Myxococcus xanthus
  unsure (1)..(432): unsure at all Xaa locations
MSKANNPWPRAEFVKRAPGLAWKEFFDAAGLGTQEQVIVWQPSALTVLSKLAQSEPLQAWKDYLAFHAVARADPYLPKAFVDESFAFNGKTLSGTPAQKERWKRGVDATNLSMGEAVGKLYVAKYFPPEVKAEAEAMVRNIITAFEKRIDALTWMSPETRTRAKEKVGTLQASIGHPEKWRDYSGLDIVAGDAYGNAERAVRFEYQRNVAKLGQPVDRKEWYMVPQLVNALNSPQQNSIIFPAAILQPPFFDANADPAVNYGGIGAVIGHEIVHSFDDVGAKFDARGKLENWWTKEDEAKFQAAGKALAXQYNDYRPLPDLSVNGELTLGENIADMAGVAVAYDAYQLSLGGKPAPVIDSYTGDQRFFLGFGQVWRAKYREPYLRRIIMTDGHAPGPYRTATVRNLYAWYGAFDVKPGQTLFLTPEQRVRIW

SEQ ID NO: 15775 - protein, 380 aa, Myxococcus xanthus
MNPYRLRAVTLALALGGSGMACESEEPFPNLDELDQLRSLHSLGRQPPKDSTNRMDGLARAEALGDVLFHDSGLSRCGTVSCASCHGGEGLTVPTAKAKGCDGHLSERNPPTLLNVAYNRWFMWDGRADRLWNQAILPLLNPVEMNADAQVVRARLTSVESYTTEYQALFGKAPADETDSALLANVGKVMAAYQRTLVRIDAPFDTDVRRFITAAEAGQAEADPAYLGLKTFLRKGQCIVCHKGPALTDDLFHNIGVQDSSSGAGGQWSALTPLLDWEFNAASRHSDAPTGTIATRLQTMRTQADPATLEGAFRTPSLRNVALTAPYMHTGAQATLEKVIDFYNEGWHAARSFMGQKTVTMATLELTNDGERALVTLLNP

SEQ ID NO: 15776 - protein, 111 aa, Myxococcus xanthus
MTFIYRVTTNVCLNMLRTRALRDVAPEDAGSEGAVDALAATECRDFLMKLARELDERALTVATLHYLDGMSQEEIAQVLGLSRKTIVRDVQRISALARALGEPEGIRRGAG

SEQ ID NO: 15777 - protein, 151 aa, Myxococcus xanthus
GEVYLAKISGAAGFEKPCIVKTILPALLKDRQFLDRFHHEAKVLVHLVHSSIAQVYDMGEADGTYFMALEYVAGVDLAYLLEQARSQGVAVPVPVALFLGQRIAEGLGYAHRKTGPDGSPLGIVHRDVSPHNVMVSYEGEVKVIDFGLAES

SEQ ID NO: 15778 - protein, 152 aa, Myxococcus xanthus
MSIQKQERTPSWTGLGVGTDRKSFLDAISSQIPDYEADKAAEAVFCALSERLSGSWVAHLREQLSPDVRELLRGCHRHRGEAPAKLDRDDFYLMVANHLNAEPENVRLVLHGVFSALHAQITEGEAKKLEQQLPAWLQGTWAAARMHVDRPY

SEQ ID NO: 15779 - protein, 50 aa, Myxococcus xanthus
MPKVLDSQRWPDLTVDELEGLLVAIQMEGGSQDGVTRNQFLKRLTQQRLV

SEQ ID NO: 15780 - protein, 82 aa, Myxococcus xanthus
MQLALDDFLPLDVKPHDGATDVERCLYRRESYEVIASPGPEGVTFVRVTLRPDVCEKQNIIMDMEATYAIDVEGRRILARQR

SEQ ID NO: 15781 - protein, 146 aa, Myxococcus xanthus
MQLPRAQGREYGQEYCGAIYSLGDGTYYASLPSTLGPLLKATPEPQKACFAPRFVNDSRGRTVVLADYHSHSWANSRMSSADRRQSRQRFSIRIQFDTGCRVMKLVPYIGEARPGELFERRERKWVRIGVIKPEHKAAGIVTWMDG

SEQ ID NO: 15782 - protein, 668 aa, Myxococcus xanthus
MRNTLLGAWVRQRKSEYVRRLFDMFEEGNLDEALRHAIPLSKELSEDAREALGLPGPRAQLTLQTEARGAAGSVFGGGANLYSALQQRYREAFRRFEREGRIDEAAFVLAELLGAVEEAVSFLERHGRFKLAAELAEGRKLAPGLVVRQWFLAQDVARAVAIARRSGAFGDAVARLERSNPPEALALRLLWAETLAEAGDYARAVQVVWPVAKNRAPAREWLERGVASGGATGARLLAMWATAFADGLTVAGARVRELLDDDAPERASERFVFGLALVEEPPSANRTALVVPTLRALLRDRAAGNARFTSDLSLIKRLLGAAPDGTLRTDLPSLADNIHRAWRDTHERPRIDVTVRASEAGTFTLHDVVVLPDGRLLYALGEAGARLVREDGRTVAHFDVPAFHLVPSIHGDRVLALARRDEVWRLSRLDLVARRCSPWVDMSLTDWSRSYDGNVWFVSSENMVMMVDALAADCRALWRVPELASRAFPIAADATHMSFIVGTQERWTYTLADGPTLRDRSELPPEVSDPKMVSWHQSVVPDGEAAVLCMEYPSNPEDVARGWNNLRSSLAWVQPVTLRNRVRTERDHETLKGIFLSREWFLELMDLGTDWQLHLTDRRGFSRAVLTFEGNVRPRVRLTDSILLAFDEGGRGVWLDLESGEVRHLPVP

SEQ ID NO: 15783 - protein, 126 aa, Myxococcus xanthus
MAGSWSLQGFAMFSVLEKSTGAWVGRVGPWQPEGWPGTEIGWGLLREYWGRGYATEATAATMDWAFDHLGWTDVIHCIVPENTPSQQVALRLGSRVLGQAHLPPPHDMLRVDRWGQSRDEWRARRK

SEQ ID NO: 15784 - protein, 643 aa, Myxococcus xanthus
LSANMPLTRMDSSRAAYNVTTTVFCVDTGTSGDRPRARSLMRYSPWEAILAKIPLEAALNLGPLVARLSVALGPLRAPSEREGGEPQGYDGLSRRGSFDRLLVSEWLWAMEAPDELVRRAAFGELSYLKPSFRQPQRAHRTVMLLDAGPDQLGAPRIAHLALLIVMARRAEAAGATFAWGVLQADPRRGWFTEVTPATLGAWLNARDTAPPSAERLSAWCEALELGARTADAWLVGSSRLSRLVGAETLSRIEVSEVLAPEVRQLAVEVHPAARAPRSVLLDLPSPDDSVRLLRDPFRARVAVPVKTVQHSRVSGFAFSADGRRLMLFYEGGGVGAMALPNSPRATLARPQRMMPRSDETFLGAGWRRQGGLLVLMRRQGAYAYAFRGQLQHQSRTRGPKAFPWTLRDTQAHPPNPARGQPPGRLTTYLDAFNRECVLLSGLDDRLYFFEEDASSRRVVSAQVAQRVIAAAHVKGSSIVVTRDENGGAASCMRLGIVSAKEVRQVRLQDSRGDTLWFGASHHSGHPDAGLLAVNKIPGMWCLHHRDSVQLVALRSGLRAVGVGVCPQAKGDAGLLALDADQRTFWNVGLQHQFRLAVAAADVVHAEASHAVPVLGWLTTEGELVLYHLEHEAVLCRIHTGGGG

SEQ ID NO: 15785 - protein, 35 aa, Myxococcus xanthus
LYPTLASGKAWYAQWDSTPRSFNGVDPKDSGSLEH

SEQ ID NO: 15786 - protein, 240 aa, Myxococcus xanthus
MIEVQHLTKRYRDRVAVDDLTFQVEAGEILGFLGPNGAGKSTTMKILTGFLPPSEGVVRVGGYDVEAQPLEVKRRIGYLPEMPPLYVEMTVRGYLRFVASLKGLSGSALKAELERVAALMGVTHVMDRVIQNLSKGYKQRVGIAQALLGSPPVLILDEPTEGLDPAQRAELRALIKGLAGKHTVILSTHILPEVTMTCQKVLIIHQGKMAAYDDISQLARIHGQAENASLEEVFIKLTAA

SEQ ID NO: 15787 - protein, 267 aa, Myxococcus xanthus
MRTALAIARKELSIYFTTPWAYAVFTAMAALTAFYFMDLLQAFNDVQGVARRVGWAQMSPDFNMYRNLTDGVVVELWGSVLVITLVVTPFLSMRLFAEEKRNRTFELLMTAPVRPIEIVLGKYLGGLGVISATLALTLVFPLLLSVLGHSESGLALEWSTVLLGYGALLLWGATCMAVGLFISALTESQMLAAFLTFCVLLAWMLLGQVARRAEEPLRSALSYVACDLQLQGMIKGVLDAQSLVFFASVIGFSLFLTHRTVDAQRWA

SEQ ID NO: 15788 - protein, 523 aa, Myxococcus xanthus
MKAAHVGKVLGAFGLLLLLSSPFTLFITSDSAVTAAVKAGAGLVLVGIYGATNYRQFGQFATRRSSSFFATTVLTTLGVFAALVAVNYLAFKQNRRWDLTQARIHTLAPQTVSTLAAIPDQVRAIAFITPAHAQYGQLEALFALYHAEAPGKFEYTFKDPRRSPDLAAKYQVREGQTAVVLVRGEGEYATHTLLATVSEQELTHAVLKLNAVGTQKVYFVTGHGEWPLDKEQAPPQDPGASLSEFRRQLLQEGYTAEPLNLAGVQDVPRDAALVIIAGARGPYTAPEKELLQRYLASGGRMLYFADAGLRDGLDGLLAEHGVQVDEGIVADAQYNSGNPFVVLSLFYSDHEIGKPLHQRGLNVEFPTPRSLTLLRMGMAPGVQVQPVVLTSQYGWVESTPEENAVPSDGEKTGQLVLVAAVTRDTQASPGKRFDEARLVVMGDSELLLDPNWGHEPNRNLVMNALGWASNQLTKITIRPPDREVSTLELDAATLSRIRFFATDLMPLTLLGVGLAIWLSRRNK

SEQ ID NO: 15789 - protein, 512 aa, Myxococcus xanthus
MPARGRWRWNILTVVTVGLGLTACTGEKASEASEARRKADAQQRLFITGMEETRGQDNGAPAAKPVFTHLTVRARGDTTELVREQDGTWKLTAPVSARAEAAVVETILGTLASSSFSATVKEAPTDADLDAYGLKPPLFTVTAQAFVPDAQGQGAQDPARQRTVTLHCGKENTYDGSVYVHRDTEPAVHAAAGTVRWALDRDTFALRAKDLLTPLDERTLKGIEVKAPQGAYQLARDADGAGWQLVAPVAANANAMRVAELLKALVEQRALSFPEDTPESRKRLGLEAPVVDARFTGGPGEPVRVRMSRVTDDGAVRAYALREQGTQAVLGEVPEDALGVLDVSVRELKDRRVLEFRRQDVRRIVFHPGGGAPAITVVSASEANEGAGHWDMEAPQRGKAQHFKLASLLRALEGLKATGYGETNPKNWARYGVTEDSPGAVLLGADGRELARLWLGTEVPDEPGTIYARGSGPDVLKVPESRLTLPTRPEDLQEAAKAPDAPKPPAKTEQAP

SEQ ID NO: 15790 - protein, 190 aa, Myxococcus xanthus
PIVVQKYGGSSVAGVEKLRKVAQRVKDKREAGYQVVVVVSAMGDTTDELLALAKGVSVDPPRRELDMLLTCGERISMALLSMALQEMDVPAISFTGSQSGIITTDAHAQARIVEVRPYRIHDELARGKVVIVAGYQGVSFKKEVTTLGRGGSDTTAVALAAALDAEACEIYSDVDGVFSADPRVVPDLRA

SEQ ID NO: 15791 - protein, 113 aa, Myxococcus xanthus
LRKSLLCAALLVTGCDNATSDEGTFREGLPSQAMVEMRSPSRNNGQGLTAFYGEGPQAEYYPEGHGGQEAMETPDLVRRLLVRVDVETQAAAIHSHVDGMTLEEVAALVSRSV

SEQ ID NO: 15792 - protein, 1666 aa, Myxococcus xanthus
MSERNDVPRTTVPVAPLPVSGAPASPNAPVTETQAQAATTAPSTAANTRAEDEARERIASLEREAKALSTAEPHTAALLFHEVGLLWEEPLKNPRNAAVAFQNAYKLAPRYLVNIRAARRLFADVGNWQMVLQLIDAELAATDDARHQAALLFEKGIILQERLSRDEESAACLKQCLERRPTDVVVLTQLESVYAARNDALALVEVYRLIAATVQQPSLRAHYLTAAGLLLEERLKQKEGAAALFREAFALDRSDLQLLAAMKRLAEREGRVDELLAALGAEAAALGAQAAPAYLQIAKVYERNDRKDDALAALLAARQVSPNEPLVLSELAGIYETQGRFEELSDVLLARVGSLNDESELVATNLRLAALYEEVLKRESDAAARYQAIVARIPGHAAALAGLGKLYYRMQDWERLVAVFDAEVAAAEDAKQKAARMYKAAEILEERLGRQEDAISRYNACLQLQPGYLPAQKALTRLYERQGRFAELVAMYEQDLLQTSDRDQLITTLNKMAVVYEDRLGDLDHAIECMKRILDLASDHLPTIRNLARLYERASRFRELLETHDLEASLAGDTKQVLSLLHRNAEILDENLKDRAGAISAYERVLALSPSYLPALKALGRLYAQDGRWEKLVDMYRAESESSASTEQAAALIYKIGELYEQRLNQDNEAIASYNEALMLAPSYFPALRALARIYRAQAAWESLVEVLRAEAANRTDPLERANALYQAAAIWEEQLLRPELAIDTYQEVLRLTPGHAATLRALERLYLAQDNVKELVGILDRETQVGSTSAAKVTAYLKLARLYLDRFQEPSRAAQCCEAVLALDAGNLTALTLLERIRASDRPRRAELRQRIADRVNDPRLAMALRLSAAVDLDKSPAEGTLEAYKRAFDADPGDARLAFVLERGLRQAGDAAGLARLYTMRLASAQDADEALEMLLRTAELADTRFNDLERAAALYRQALELQPQCLPAMQGARRVALKRGDFAGARAALEAEARVSRDPRGAIEALIGAAKLAVGRLNDADGATALYRQALEKDPLHAGAQAGLEELLAQRGGSADLAALQERRAEAKLAQRDGLAAATAFVSAARLHHTALNDRARALALLEKALSAQPGHPEALELRGALLLEAQQYPEAAAMLSQRVQLGGDPRVLAQFHMTLGNLYASHLNDPSRAAAHYQTVLATLPRHLEALERLAGLHTQARNWAGAVDCLHKLLQQELPPEPRARFTLELARTYDEGLGDAGAATPLYRRALELSPGNPALVDRLVVLYERARNLPELAQLLEAQATGQLAVEPKRAATLRMRAGDLYAGPLSEPARATALYRQVVDGDGTNLQARAVLAELYARDSSSVPMAIEEHRQILRQDPTRVDSLHALFKLWEGLKQLDKAFCAAAALHFLRSANEVELAFYMEARTRLAQEAREALTQTDVDSVLMHPGARGPLLEVLRAMGEHLEKVYPPNFEIVGVNPKADRLKPDSAVYKAIRAVAQVFGVETFEAYQARRGLTVLETTEPMSVCIGQDVVRRFNAREQKFLLGRAALGLLNKTAVLEKLSQGETADLFGSAVRLHAPQFSALGRRNDESVKQLKRGLPAQGAQGAGESGDVAGRRTEGGPGALAGGPRLLGGPRGPADVRRCGGGPGHGAARGPELRGCPAGYARAHDPGRARR

SEQ ID NO: 15793 - protein, 299 aa, Myxococcus xanthus
LRYALIAEPDPQRAAGLLSLMTEEGLEGVVAKDGADAQDVVRQRGAPLLLVTDLALPRLDGFALLTWLREQEDSAATQVVVVTAFDELRVRAWQLKEALGIHALLSRRASAEVMRDTLRRVLAGQLAPQPPPAEGAAEQERQRLASIAAMHLVDNGPPEAELQQLVKEVAQAFGVPVALLTLVLGERQWFKAHVGLPPTLAKDRGTPRDWAFCHHVVQGREPLVVPDARRHPYFRDNPLVRDGIVGSYAGAPLLTSTGEVLGSLCVIDTRPLVLGAEDLAALRELANRVAEDLEQRARM

SEQ ID NO: 15794 - protein, 253 aa, Myxococcus xanthus
MLVDGDGVIRRYPYAVGVSGQAWPSLALATALHLTPERAEPLRELAAWDHGAPLMRLPAPNWLPRVSLADLLHADPRSVGLDLALRGKTVFVGVTATGLHGQSTLPGQVAVPGVEIHAFALDNLRSGRLMRSSGLVALLGVLETAAVLAAFVWLCRRARTSGAVLRWAVTLAVLHTALVAWLASDPGWVIPLVPSWVGLLLMLVVDAASRAQEMGRQRGALRRLFIRYPQASVEPAAPQRDAQRARADAMHQD

SEQ ID NO: 15795 - protein, 378 aa, Myxococcus xanthus
MLAGPPALAAQTQAPCGGLRFDSGRIVFGRPLAPQGAETDACLAHVAQALLARPAIRSVTVAAKLPDAERLDGQGLAAAKRAADVLVAAGVPRTRVSAMAPPSVEGEPAQLQFAYVERPAQPAVARLRAASGAVEAGATEAQLLARTVGDALYPGELLRTGEDARAELALADGSMVRVVENSLIKVGAIELMANLQRKVQLDLLRGTVETDAAPGGAGSIFEVRTRGAVAGVRGTRFRVSAQDDGTSRLETLEGKVALSAEQAEVEVSGGHGSRAKPGSPPEPPRPLLPAPTLVGPRGGAFATAPKVSWRTLEGAATYRVEVARTADFAASVQTYDSASPELAIPGPRQGKWFWRVMAVDGDGFVGFPSKIYAFDVQP

SEQ ID NO: 15796 - protein, 544 aa, Myxococcus xanthus
MHGARIAPHLSWNLGASLNYANDPLNLVDPRADRFLYRIVDSQLTLDLMGAISLFDRVELGVALPISHTTSEPAAAVAPDLSNGVGTTGVGDLRLVPKVRLLSTDSGIHLAVTAPLTLPTGGGSKFLGSDTVTFQPRFVAEWATTAVRLLANVGFNVRREEQLRNLRVGNEFAYAVGAEVPLTQALTAQATLAGALGLKETSAEERPMEVLAALKYRFTPGLAAHVGAGPGLSRGYGTPSFRVLAGVAWTPFESKGGPASTAPVCDLGPEDFDGFQDDDNCLDPDDDGDGIPDVTDVCPTEPETFNSFQDEDGCPDDPNAHQPPTEAGQPAPAPAPLALPPAPVDTDKDGVVDSEDLCQTEPEDLDGFEDEDGCPDPDNDQDGIPDAEDQCPLEAETINGVQDDDGCPDKGKAQVRVEGARIVILDKVYFGTGQDVILARSHGLLRQVAATLKANPRILMVRVEGHTDDQGNDMKNLDLSQRRARNVVAFLVKEGIAAQRLDAVGYGEAKPVDTNETAKGRENNRRVEFNIVKVAEPSTGGGTR

SEQ ID NO: 15797 - protein, 61 aa, Myxococcus xanthus
MLADFVRRYTPQTRVVLLTAFATQELTDRAQALGVDLVLSKPQPLPTLAEHVSRLLAAAAV

SEQ ID NO: 15798 - protein, 455 aa, Myxococcus xanthus
MTRTRILLVDDEPGIRLGMRGFLTAHGFDVDEATSLAEAQEAFRTSRPDVAVVDYRLTDGTALELLPRLKDIDASVPLVVLTGHGSIELAVQAVKEGAEQFLTKPVELAVLKVVLDRLVSQRRERQRLLAERSRILRGTVNPFMGGSATIRALQAQAERIIESDSPVLITGETGSGKSVLARWLHEGGPRKDAPFVDLNCAALSKDLLDSELFGHEKGAFTGAVAAKQGLLEVADRGTLFLDEIGDMDSAVQPKLLKVLEEKRFRRLGDVRDRRVDVRLIAATHQDLAVAARDKRFRSDLYFRVSTLILHVPPLRERPEDIVGMAHQFLAELGAARGRGSVGLRPDAEMALTCYAWPGNIRELRNVLERAVLLSGGGPLSRGDLRFEATAGEPASDADDHLTLEELERRHIERILRREHGHVERAAARLGIPRSSLYERLKRLGINRSGFQKPDP

SEQ ID NO: 15799 - protein, 124 aa, Myxococcus xanthus
MDARRLFHVFRNVVENAVQHSPAGSAVRVATEEVKEAGRAWVRCTVRDGGPGFRAEDLSHVFEPFFSKRRGGTGLGLSIVQRILEEHQGIIRLRNHPEGGAEVTLLLPAVSSRVSTQHVDSLTS

SEQ ID NO: 15800 - protein, 583 aa, Myxococcus xanthus
MAPSAAPATANAPPAFPAFTRSQKVFTLLGAVLGLLLAALDQTIVATAGPAIQADLRIPASLYPWLTTSYFVASTTMVPVWGKLSDLLGRRAVLAAGILIFLAGSFLCGVARSTVALILFRAVQGLGSAALFTAALAVVADLFEPRERGKYQGLFGAMFGLSSVVGPLAGGFITDHLGWHWVFFINLPVGAVALALVLSRMPRLKPQRVSRGGLDLVGAFTLAVALVPLLLALSLGQTDGGDWAWTSWRILGLFALSAVGLVAFLWAERRAPEPLLDLTLFRLRAFSAGNAAVFIVGGAFLSGIVFLPLFMVNVVGLSATRSGLTVMPLTLGVVAGNVLSGQLVSRVGRYKALLLGSLVLLMAGFAVMAFTLTPDSTQAEVTAKMVLVGLGLGPSIPLYTMAIQNAVPPDQIGVGTAAATFFRQLGMTLGVALLGTVFASTLSSELEARMAQATSALPDSVKAEVTRAAPGVSGEGGPTGQVFRADEVKARVRAEFDAERRRAETTAAPEARAKVDADERQALAAVDAADRALKMAFTRGVSAVYHVALFIAGAALLVTLFLPEQHLRRKRRRIESRASAPEQ

SEQ ID NO: 15801 - protein, 232 aa, Myxococcus xanthus
AHDAEQSPALTDAEAAERIHARFPALATARVVRLGEGTDHQAFEVEGRYVFRFPKSDEAAEHLKWEARLLAWLGPRLPLPVPDYRFLAHPAADLAAGFAGYEKLPGTPALLVEPERLDLSDLGRRLGAFLRALHALDPAEAAALGVPADDDPELEAWSAAAVDDLRLAVEHSHMEPHRAADWEQRLRVRPTEGRGAPRLVHGDFAAEHVLVDSHGAPTGVIDWSDACVGDPL

SEQ ID NO: 15802 - protein, 529 aa, Myxococcus xanthus
MTVSTGDVDGDDSADVLVSGQYGALVFKGQTDLASVFTEPAFVVPGGGVYNNAVFADVNGDGLDDVVSVKGLVLSVFLATPGAPGGPFTLVERTEPLYTGAVHRAGDVDGDGAQDLLLLDSMGDVYSLLHGCKAGSPGPCDGGLAAQPFWTVDSRTLSLFPDVNGDGVPERFTGPGGGTVRLHLSEAGGGYASAPTWTAMGDPVFANFGATITAVGDVDGDGQRQDFVAGSEGRLYFYSPAEGVSSALSPVWSWPRADALPQGYEGFHRFTVIAPGDLNGDRFDDLVAGVAPSPGLVDGPGGRVVIFGGGRVPAEPTTAPHLPPVAGCGLTLDPVHGKPDLSVDADVLARTLYVERRTFAADSCEMLEGCVPAPGERRLLRFSTSIQNLGAAAASVPNMDERPDLYVWDECHGHEHLTNFAQYVLRDAQGNEVVEGRKQGFYLVDYQRQCDDAAPFHFPLDRMSISAGWADIYVADIPCQWIDITDLTDGTYSLRVGVDEQDIIEEADVLPNEAILNVRIQGDSVTVVP

SEQ ID NO: 15803 - protein, 382 aa, Myxococcus xanthus
MTVGLAGVHAGFTIREFINDGLMTLFFFVVGMEIKRELSSGELRTFSRAVLPLIAAMGGMIVPAALYAAFNQGTPAQAGWAIPMATDIAFSIGCLTLVKTRVSHGLVVFLTALAIFDDIGGILVIALFYGSGLHVSWLVGALGVLAVLACLNHFQVRNGVAYALAGAALWYTMHHGGIHATLSGVVLGLFMPARPLRPGRHVLEELRLYVDRALQTAMDEATRGAQILYLEERLEELEPPLNRFVHLWHVPVAYGIVPLFALANSGISLEGMGWADLLRPLPLGIIAGLFVGKQVGIFLFTWGSLKLGVADRPGGATLPQLHGVAVVAGIGFTVALFVAGLAFPTQPELLTEAKLGILVGSLLSAVVGYALLRFVAKPAVPA

SEQ ID NO: 15804 - protein, 507 aa, Myxococcus xanthus
MLLNDLGPTFVKLGQVLSTRADLLPAEYIDELAMLQDHVEPISLEDVRAQIEGSLGASVESLFATIDSAPLAAASIAQVHRALTLEGEEVVVKVQRPGIAERIDSDLGVLRSLARLLEAVVEETGVYTLTGIVDEFDRAIHEELDFINEATNIRAFLENHRERPYLKIPRVYSGLSSRTVLTMEFIRGVKLNPAELSEPERKAIAQNILDASFRQLFEDGLFHGDPHPGNLLLLEDHRLALLDFGVVGRLSRPMQETLVMLCLAVALKDSESVARILYRVGVPDARANLVGFRNDIEALLGQHLTTTLGQVDTRSLLRDLLDLAVKYRIRIPKEYALLSRASVSTEGMLRSLYPEMNIIEVALPYAKELLAGRYDPMQLQGGLMRTLLRFQAMAQDLPTQLSQILLDMESGKFTVTVRADQFEKLNENLRSAAVIAFMGLCACGFIVGAFISFAPKPWMYGNVPVLGVVGIAVAAAFFGAAITWYLFGGRGLGKVRLSRFLKKPKRK

SEQ ID NO: 15805 - protein, 146 aa, Myxococcus xanthus
MALGVLLAAPPAWAEKPAKPTSRPADRHYIRKILPSKLPPKDKNTVIESRIDVSRDVKEINEGKAKKGNESGTVTWTIHKRTYGAHTNGTLFPIRGVGFHELNRGGFKALEVYNQFKDTPRATEIMDKIGIPPADRKAALKAHKAG

SEQ ID NO: 15806 - protein, 142 aa, Myxococcus xanthus
HPERLILGFLVRGDVSEARLFEGIARALGVPPDGTARFDIDRPSDAAVLVDVTLRPAGFRTDVSLYVDVSRASGARGLTSVAVATRVAALLGEEVIVSPPADDPAVASTWFLVTPDGKRFRATEASLGEDEDAVDIDRATGV

SEQ ID NO: 15807 - protein, 900 aa, Myxococcus xanthus
MTPEVGPVNEGAGAREIASLTPMMRQYMEVKALHPDSLLFFRLGDFYEMFFEDAVKASEILQITLTARSKGADKVPMCGVPYHAARRYIGRLVSEGLKVAICEQVEEPGNGPGIVRREVTRVITPGMVLDEEVLEPQASNFLAAVSWNDKGWGAALLEASTGEFMALEAPGIAELAESLSRVEPRELLVPDGKRDAPEVAQLLARLVRTPAVAEGEAASFEPTRAAGYLRSHFAVQSLSAFGLDDAPLAAGAAGAALRYLKDTQKTAAAHVDRLSRQERGGNLLMDESSRANLEVLRSLRDGGRKGSLLGVLDKTVTSLGARKLARWLASPLGSLPEIHARLDAVEELSGRSVWREELAGILKEVGDLERLCGRLSLGAGNARDLRALGLSLAQLPRVVAVLARCESPLLKSLTGPLSALPELAELLSRAVAEEPPVTLKDGGMIRAGFHAELDKLVALSTSGKDLLLQIEQREKERTGISSLKVRYNKVFGYYLEVTKSNLDRVPKDYIRKQTTVNSERFVTPELKEYEEQVLTAEERRCALEIQLFEELRAQVVSAAPRIRSAAEAVATGDALLSFARCAAEYGYTRPEVDASVALSITAGRHPVVERMLGAGDSFVPNDVRLDPAEDAQLMVITGPNMAGKSTVMRQVALTALMAQAGSFVPAKAARIGLCDRIFTRVGAADNLARGQSTFMVEMTETSHILHHATNKSLIILDEIGRGTSTFDGLSIAWAVAEHLHDTVGARALFATHYHELVDLARERPRVKNLCVAVKEQNGKVIFLRKLVPGGASRSYGIEVAKLAGLPPEVVGRARELLQNLESGELDDAGRPRVAVRQPQGGRRGASTGQLGLFGMEPAQGGTGVTPAQQKALDALKGASIDRMTPLDALNLLAKLQRELE

SEQ ID NO: 15808 - protein, 154 aa, Myxococcus xanthus
MAEYTDPPINNATPVKERDEPQDLQGFLDELGNSREFQVNGVDARKGAEAVFCTLARRLSDGEDLKLLWSLGKGGIGTLLGTCNIHRGPSHAKRMGRAEFITDVADHLRIPGDQALRVLTVVFTAIRDRIPDDEVAAVASQLPADLADLWRRPV

SEQ ID NO: 15809 - protein, 372 aa, Myxococcus xanthus
MVQRLSEAVPIERCEVSAYEVPTDAQEADGTIEWDSTTLVVVELTAGGTRGLGYTYADASAASLIRCSLIRALEGHDVMDVPARMRSLLRQVRNKGRPGLVAMALSAVDVALWDTKARLLDVPLVRLLGASRDAAPVYGSGGFTSYSIERLQAQLAGWVEQGIPRVKMKVGSHPEEDPARVEAARRAIGPRAELFVDGNGAYTVPQALLLAERFVAHGVSWFEEPVSSDDLEGLHRLRARVPAGMAVAAGEYGDSGLYFRRMLEAGAVDVLQADATRCLGISGFLQADALCDAFGVPLSAHCAPALHAHVACAARRLVHIEYFHDHARLERMLFDGVASVRHGTLAPDLSRPGLGLELKRADAARYEVGAPS

SEQ ID NO: 15810 - protein, 468 aa, Myxococcus xanthus
SATVADYLLYRLTQWGIRRLYGYPGDGINGIIGALGRTTELRFIQARHEEMAAFMACAHAKFTGEVGVCLATSGPGAIHLLNGLYDAKLDHQPVVAIVGQQARSALGGHYQQEVDLTTLFKDVASEYVTMVTKTSAVRHAIDRAVRIALNQRSVTCVIIPNDLQELEYQKPPRKHGTVHSSVDFSPPYVIPQEKDLRRAAAVLNAGKKVSILIGAGAMNAANEVVEVADLLGAGVAKALLGKAVLPDALPFVTGAIGLLGTKPSWDMMMDCDTLLMVGTSFPYSELLPPEGQARGVQIDIDGRMLAIRYPMEVALAGDSKETLRALIPMLQRKQDRSWREQLEKGIRQWWKMLEAQAMNSADPINPQRVFWELSPKLPDGVILTADSGSGTNWFARDLKMRKGMLASLSGNLATMGCGMPYAIGAKFAFPHRPVLAMVGDGAMQMNGNAELVTVAKYWKEWKDPRFFR

SEQ ID NO: 15811 - protein, 147 aa, Myxococcus xanthus
MRVVAVVNGADAYVSPDWYKSHDQVPTWDYESVEIVGSLTPVDDTLLRDILAALSAEHEARIPDKAPWTMNKLRPATLDKMLTGIVGAALSIESIRGTQKLSQNKSDDDFDGVVAALERSPSQHDRDVAARMALVRRRRAEALTGRA

SEQ ID NO: 15812 - protein, 137 aa, Myxococcus xanthus
SAEGSPFSRVAAYEVLPSGFSAVGDGMPERLPGMRVTADFFETFGVRPRLGRGFLPEEDVVGGPRVVVLSESLWRRRFGGAPDVVGRSIVLNDEPYTVVGVAPASFAYPTGVHLWTPLPARPHGPDQLPLPLRGRQA

SEQ ID NO: 15813 - protein, 106 aa, Myxococcus xanthus
MKPIDWHGLWVPDLHPFEVIIRVSLVFLFVQFVLRLVGRKELSRYVSFDLALVHGNLRKTRISHKELLSHLRAHGRGDLSAVHAAFLEPNGKVTFLFREEGSATLR

SEQ ID NO: 15814 - protein, 882 aa, Myxococcus xanthus
MAGPVSHNVRALDVLTHDGLRLKVGPTSDAELEALIRAGGRRGDIYRKLRELRDRYAEEIRRRYPPIPRRISGYNLDALLPEHGFDVARALVGTEGTCVTILEATLKLVPSPPHRVVVMLGYPDIYIAGDHAHELAERFHPLALEGLDDELIHNVVLKGRTSQMESLHPMSSHAEFLDILPQGQGYLMLELGGDTREEALERARELMDALRTGRGAPVDMRLFSDREHIEHAWKVREAGLGATARVPGKPDSGPGWEDSAVPPEKLGAYLRALRKLYDKYGYDASLYGHFGQACVHTRIDFDLTSSRGIQQYRAFIEEAVDLCVSMGGSMSGEHGDGQSRAEFLPRMFGLELVQAFREFKSIWDPQGKMNPGKVVDPNPIDQELRLGRDFRARTWKPRTHFKYPDDDGLLYRATERCVGVGKCRRDGGGTMCPSYMVTKEEKHTTRGRAHLLFEMLQGEVIKNGWRDDKVKESLDLCLACKGCKGDCPVQVDLATYKAEFLSHYYQGHLRPRPAYAMGLIMLWARAAMRAPRLVNVLTGFPPTRMLLQRLAGMSTQRKMPRFAPESFQRWVARRPVSNQHGHQRVMLWPDTFNNHFFPETAAAALDVLEDAGFEVVVPQGFLCCGRPLYDFGMLTTAKWMLRRTLESLRREIEAGVPLVGLEPSCVSVFRDELRNLFPDWELATQLRRQTFLFSEFLTRYAKDVPLPHMAKKAVVHGHCHHKSLFQMTDEKAVLDKLGLDYEFPETGCCGMAGSFGFEAGEKFTVSQQVGERVLLPKVRATPRDALVIADGFSCREQIAQNTNRRALHIAQVVQMAKAYGSTGPSGDFPERGWVTKGLGRPPLRRPRTAVVLGGLLLLGLRRLSTSRARPAPRRRLSRVYSG

SEQ ID NO: 15815 - protein, 292 aa, Myxococcus xanthus
LYAAGTPVNGSEASLPGLSREDVLAYAKNHLGADRLVLSVVGDFDAKALAKKLESSLGGWARAATPAPTVPATAASKGRRVLLVDKPDATQTYFWIGNTGISRDDPDRASVRVAETVFGGRFTSLLNTELRVKSGLSYGANSVFIRHTRPGPVIIASYTKTESTGRAIDLALETLAGYRKSGMDDAMLASAKSYVLGQFPPTLETGTQVAGKLSELAFYGLDASDVDGFASAVSATTREGVHGIIQRKLPAPEDLTFVLIGKASDIREAARKYGTVTEMKISDKHFAPPAKR

SEQ ID NO: 15816 - protein, 293 aa, Myxococcus xanthus
MDAGTLPDGTPLAYSALVRSVEMGAFDFVPDGITPMPLTGVMRSVPMTEFPIEWRLPDFTRYVHAVHPLATASYPSFFVMPAAHGLSDGWVGYSGEALSLTLPRGTSFDFTRRLSYGNPFPSSWEMVGGAQYSFRVQAEVPGGSGLRLYLSGSMYTYERLDSLVAGPILPRVSPPRELTIDGLPASDSREVGSASPVIAWLPPTVGSPAAYRIAIYRFREDFRTTVLHGTVNVPGSVTQVRLPPGTLAPEGIYYLRVSAVDAPHYEMERFPFSTVDRLPQARADTLSSFFTTP

SEQ ID NO: 15817 - protein, 71 aa, Myxococcus xanthus
MTRRPYGRGTLGMALAGKDTGGSQFFFTHAPQPHLDGRYTAFGEVVSGMDVVDALLEGDVIREARAVELAP

SEQ ID NO: 15818 - protein, 333 aa, Myxococcus xanthus
MAKAPEGPVPVVVMGLGFIGQEIARAAMSSPEVELIGAVDVQSGLVGRPLGDVLGSPAPRVKVSASLAQAVGKRKGVVVLHATGSRLPKVFDQVMEAVKLGLPVASTCEELAFPYLKYPELADELDQAAQKAGVAVVGTGVNPGFVLDRLVAVAGQVCGPVRRATVTRVVDARTRRPSLQRIVGAGLSEEEFFELVDSEQLGHVGLVESAALAALGLGLDCDDFEEEVAPVFAEEDISGGAFPVRKGRVAGMFQSVVGLEDGQERVRLELTIAMGADDPKDRIEIDADPKLVLEIPGGVAGDRATANALVNAAPRLTAAEAGLLTVLELPAGR

SEQ ID NO: 15819 - protein, 34 aa, Myxococcus xanthus
MDIAVIEDEGRDEEGNLVFRARRTLVVRAAKETP

SEQ ID NO: 15820 - protein, 194 aa, Myxococcus xanthus
  unsure (1)..(194): unsure at all Xaa locations
PARKLYFEAIRVGDELPALAKAPVDRVQLSRYAGASGDFNPVHVDELYAKSVGMPSVYAPGMLVMGMLGQLISDWARGGQMRRYNVRFIKMVWPGDTVVCKGRVSDRHGSGGRYFVEIDLWAENQKGELLMKGSSQIQLFYSLEDENRQRSGQSPIVVEVPRESLSSAXAPASATSAVPSEGGDQADERREGVT

SEQ ID NO: 15821 - protein, 350 aa, Myxococcus xanthus
MPPQLQDREGWARDVLAALEVEEIAPSPPAVCSVLAVIEQESGYKVDPAVAGLPKMVRTRLEEHANKLGPLGRKVLASVLEGRAKGSKKTFDERLRALRTERDLDRLFRDMLAYYENEFPSAFKVVDFASGVFASGNLHEFNPVTTAGSMQVSVRYAMQKAGEDADPAEVRESMYTRAGGVRYGTARLLGYEAAYPEPLFRFADYNAGVYASRNAALQSQVSRLTGHPLAPDGDLQLYDKQGQPRSEDSKSLLALLAFRQRFAPEELSERQVRRDVRKEKEPDFESTDTFRAVKRVYQRETGESPSYAQLPRVTLQSPKLKRELTTAWFARSVDQRFQKCMTRYRALTAK

SEQ ID NO: 15822 - protein, 314 aa, Myxococcus xanthus
MYVAASPDQSVYVVAIAGTNASSQYDKNIEDNSVNTTKLWTTAFPNLPSYGVPSGINPWPVLSTGTALGVNNLLGMTDTLMTQQTLVEFLRSVSATGSKTLIFSGHSLGGALAPTLALALFNPSGGPLSTGDWDHVYVLPAAGPTPGNQGLSEFFERVFPPVSLNLPQPQYAWNQNIWNSLDAVPHAWVVDSLKEIPTLYPANWEGGQVPSDITKLVNLAVAASELGGALPGPYTQLPNVKVPGTFHGTNPITTEAQFWAEVGYQHLDAYQILFGVQSLVSEGSQSALQKMFKRWLGSFSRMTTQSVSRAAAAR

SEQ ID NO: 15823 - protein, 371 aa, Myxococcus xanthus
MDRILVVDDDVLILAALSRILQAEGYDVVTHSDPAVAAREVGFQVVLTDFMMPYLNGIELLSALREKNPKAVRLMLTAAADFRTASEAVNRGEVFRLLGKPWSLSDLTNSVRQAFAHYRLVDANERLSREVAEKNAELVAINRDLERRVVERTAGLLDGLISALDYRDTETQWHSRRVSLYSRRLAQEVGMTGAALDVVEQGALLHDIGKIGVRDSILLKPGPLTPEEWVEMRKHPEFGYRMLAKMPYLHEAALIVLQHQERWDGKGYPQNLAGEDIVLGARIFCLVDTVDAITSDRPYRKGRPMSVARDEIRRCAGTQFDPALAEAFLNIPETEWQRIRQEVEALEAAENERWNSDPLGPPAPLARASGA

SEQ ID NO: 15824 - protein, 93 aa, Myxococcus xanthus
LHSGFIADAEAVDARTGGWPDVRVPTLIIHGRQDDTCDVQNSRQWSEGKRHVRLVEVDDGHELTASLPLILEETEVFLQPWGARGPRAQSSMP

SEQ ID NO: 15825 - protein, 342 aa, Myxococcus xanthus
MTTALNTLFITAEGTRLNKEGECVVVTVQDQKKAEVPLRHLRSVVCLTRAWLTPELMESCLEAGIHVSFFGMTGRFLARVEGVPGGNVLLRRQQYRAADDIARSVAISRALVVGKLGNARQFVLHARRDAAPERQEALSETARRLSEHLRALTRVEDLVQVRGLEGIAARDYFESFPALLKKSAQGFEFDGRNRRPPRNPLNAMLSFGYALLAQDCAGALTGVGLDPAVGFLHEDRPGRLSLALDLMEEFRAPVVDRLVFSLVNRGQLKPGDFRTESAGAVLLKDDARKTFLVAYQEAKQVGVRHAFLGQETTWGMAPHLQALLLARHLRGELDGYPPFAMR

SEQ ID NO: 15826 - protein, 213 aa, Myxococcus xanthus
MSTDRETWVALSALQHLLYCERQAALIHVERQWREDVNTASGRLLHERVDLPGHDARLGRRVERAVLLGSQRLRVSGRADMVEYQRDAKGAGWRPFPVEVKRGRRKAGEADRVQLCAQALCLEEMHGVDVPEGALFYGVEHKRAAVRFDAELRQRTEDAIARMHEVLRRQEVPVVARAPRCDKCSLEPLCLPGVTAGQRSAQDFLMQWMALDG

SEQ ID NO: 15827 - protein, 304 aa, Myxococcus xanthus
MTDLKQRHDFVLFFDVLDGNPNGDPDAGNLPRIDAETGHGLVTDVSLKRKVRNFVLLTQEGKPGLDIFVKEKAILNNRIADGYKSLGIDLNEKPARAEDGKKRNDKGRAQGSEVEKGRAWMCKTFFDVRTFGAVMSTGPNAGQVRGPVQLTFARSVDPIVSQEHSITRMAVATEDEAEKQGGDNRTMGRKNTVPYGLYRAHGFVSPHLAKQTGFGTADLELLFQSFTHMFELDRSAARGLMSMRKVVVFKHGSELGNAPAHALFDRVLAVRAQPEKPARSFSDYEVRVDKAGLPQGIEVLELVG

SEQ ID NO: 15828 - protein, 467 aa, Myxococcus xanthus
DAEARAVESFLDSEAERSKALADRGAEEWTGSEMLAFVVGEATTPVHQNPAIRACWERRAGAQRALGRRALCLVTGREGVVAVTHPKLKNVPEAQPSGASLVSFNAPAFSSHGLEQGENAPISQEASLGYVLALNDMLRRTEQRRFRQGIQLADGSVMVFWTRASPSEESFLLSLLDPTEDDLKRFVESPRKGVEPGELDDRAFYAVTLAGNAGRVAVRDWFESRVGEVKQNIRRYFDDLRMGDAPAGPIPVYRLLKAVEAPSGRGLTPDIAARMLGAALRGQPFPRQLLVAALDRLRLPPADGGVEREQLRLRVALIKAYLLRDRNRGSTPLEVTVSLDKDNPSQPYVLGRLFAVLERLQGVALKDLNATIRDRYFGAASRNPVTVFPRLIQLSVHHASKAGENGRWLERTKGEVMALLPSKDPFPPVFQPEQQGLFAVGYYHQREAFFTKREAAAAPADSTASST

SEQ ID NO: 15829 - protein, 260 aa, Myxococcus xanthus
MASALMTLSAMPALAQLKLPASSPAAKVTQEVGVSEISVEYSSPAVKGRKVWGELVPNDKAWRSGANSATKITFSHPVTFGGKAVPAGSYAIVSLPSQKGWKVMLNTDLGLWRGGAPYDTSKDVASVSATTTEIPSRERLTYLFTDTTDNSTRLDLEWEKLRVSVPITVDTAAIAKGQHRGRAEGHCRHARERRLLRGGGHQGLRRRAEARRRGRGRQRHLVQPLGSRGRPVADGQVQRGPQGRADRVGPGAEGQELLLP

SEQ ID NO: 15830 - protein, 41 aa, Myxococcus xanthus
MGKYSEARKAAQTAWDLGQKDKNFFYRDQVSKALAEWKNKK

SEQ ID NO: 15831 - protein, 151 aa, Myxococcus xanthus
GLSLIGAERGEPGGPTFTGWNPAEGVALEPRFHGARPQEVERACVLAEQAAPTLAALPSRQRAVFLEHVAEALLAAEADFLAVTPKETGLPPARIQGELGRAAGQFRQYARLLAEGSWVDARIDRALPERRPLPRPDLRSLLRPWGRCPIR

SEQ ID NO: 15832 - protein, 182 aa, Myxococcus xanthus
MKAHISAVLRATKLPCLLYNNPVAYKTDFTPAHLAELAAEHDNAVAVKESSTDARRVTAIRALLGDRLAVGVGVDDCLVEGVDAGARFWVAGLVNAFPAESVRLFELALAGKKQAAFELYRWFLPLLRLDTVTKFIQLIKLVQQEVGWGHERVRGPRLELAGAEREECLRVLREALANRPAL

SEQ ID NO: 15833 - protein, 138 aa, Myxococcus xanthus
MGLAERRRIAAIKDSHSARFQSELNAAIGFELPFEIDVASFPEDKTILDCYDSYYESYGPGLVVTVMKEICKDDMGREAVRAKFNRIVFLNVAKSADDPGTKSIEIKDQTLFVRESFYGYSDQLYGDSELQSALEAIL

SEQ ID NO: 15834 - protein, 425 aa, Myxococcus xanthus
MREACDLVVVGAGPGGLAAACRAAEAGLEVLVLDTQPEPGGQVWRGEARKGANRLARRWLTRFAASGARFRPGARVVAAPEPGVLLVEEGSSSFAVRYSRAVLATGARERFLPFPGWTLPGVLGVSGLQVLIKDGLPIRGKRVVLAGTGPLLLAAAATIHAHGGEVLYIAEQASAESHWGFALQLWRHPTKLLQGALMSAALIRVPTSTDAWVIAAEGEGRVESVRLSVRGREEQLRCDYLGAAYGLVPNLEVARLLGCETSAGTVVVNERMETRVPKVHAVGELLGIGGMDQALVTGELAGLVAAEQPIPVELERTWHRVRAFAAQLARHDAPRAELRRLATPDTLLCRCEDVPLSALEGCQNLREARLYARLGMGACQGRTCGTAAQTLFGWSGEDVRPPCLPARIGSLRLPSDVSSTHTRES

SEQ ID NO: 15835 - protein, 378 aa, Myxococcus xanthus
MSAFDCVIVGGGIVGAALADVLSADGVSVALVEARSIGAGTTACGMGHLVAMDDNAAELALTSWSVSLWRELADGLPRAVEYDACGTLWLAADDEEMAAVSAKVANYRAAGVRAEVLDSAALHEAEPALAPGLVGALRVVDDAVLYPPLAARTFALRAQARGARLMTGSPVRELRPGSVVLSHGEVLTARHIVLAAGVASPALCPGLPISPRKGHLLITRRGAPVVHHQLVELGYLKSAHGTDGASVAFNAQPRVTGQLLLGSSRQPGDATREVDAALLERMLKRAAMFLPGLDGLQALRVWTGLRPATPDGLPLLGPHPEKPWLWLACGHEGLGITTATGSARLVADQLLGHTSAIDARPYSPARFLTVSSRELAHA

SEQ ID NO: 15836 - protein, 311 aa, Myxococcus xanthus
MRRIRVIDSHTGGEPTRVVTDGGPELGTGDLASLRERFREKFDAFRKAIVCEPRGSDVMVGALLCPPVSASSVAGIIFFNNVGYLGMCGHGTIGVVKTLEYLGRIGPGVHSLETPVGVVKATLHPDGRVSIANVPSYRWAHDVAVSVPGHGEVRGDIAWGGNWFFLSRATHLPLELSRTPALLAYTSAIKQALSDQGITGEGGAEIDHVELYAPSPTPGVDARNFVLCPGLAYDRSPCGTGTSAKVACLAAEGVLAEGATWVQESILGSRFEARYVRDGARILPTITGTASVNAEATLLVDPTDPFAWGIG

SEQ ID NO: 15837 - protein, 430 aa, Myxococcus xanthus
  unsure (1)..(430): unsure at all Xaa locations
MKLTRLEVHHYRNVVPGTSLVFSPSYNLVLGENGTGRTTLLELISTVLGSDFSGRIHEPFALEYDLAFPGMKLHVFVRNEENAPAPDTEAPPRKGSALMPLRTPALDSSLHPRIEVDVQLHSPSARLVMRADAAGMDCKVDGEAVWSRSMHWSLLDRSVWTLLFMTAQYIDAGMKERLKELLRRTFLLAPQRFDEALGMFERIGAIRYAMEVRDGEVFPLGLMALPTWMPGWLREQMEQPAVTDVLELTHDAREGSFLAKFVALAGFEAGRFRVEVLEKRSFENGGRVGFGGFGFEFTRRDGRVLTHEALGFGQKRLLSLLYYLDVNEDFAIADELGNGLHPRWVEASMRELGARQVFLTSQNPLLFXHTLFPSAEALRASLLLCGNTREDGPERIAWKNPTHEVAGRLFDAHGLGAHPLAELLRQQGLW

SEQ ID NO: 15838 - protein, 315 aa, Myxococcus xanthus
YPIALASKMIEVASYERLDILHVHYAVPHATAAWMAREVLGHKAPRVVTTLHGTDTTLVGIDPSYLPITRFSITRSDAVTVPSAYLRRATWRGFDIPESVPIDVIANFVDTARYAPVRDRACLRALFPALRDHEPVLIHVSNFRPVKRITDVVAIFTEVHRHRPCRLVMVGDGPERSPAERMLREMGLEGRVAFLGKQDRFEELVAASDVFLLPSEQESFGLAALEALSCGIPVVASDLGGIPELVTHGETGFLAPLGDVPAMARHVLTLVEDAERWQGFSHRARAQVLERFQKEPAIDRYEALYRRLLTGPLRR

SEQ ID NO: 15839 - protein, 202 aa, Myxococcus xanthus
LKSIEGAERLAVKSDFVLRGMEVTSDLGEALKDCVYAVGTTSRTQLKGRTVLTPEEAMQRLAEESVRGRVALVFGGEQRGMSDEDLARCTDVLAIPTSAVQPSMNLAQSSAVLLYLCHRQGLTPTAAVEEAPGAKLGTLGALAKRMRDVMLRAEFLNPQAPQHVLNELEQTLMRARLTQREAELWLTAFKHLERAVTRGAST

SEQ ID NO: 15840 - protein, 190 aa, Myxococcus xanthus
MSARLQPEELFQAARERAAQLDVGRGDAAVERVRAAASALFVRIPEPPVYRRAEDPSRKAAQALLPEVERVLAEALAAGRDVSAVAPLEKLVAALLAHGEALCHTAAGRLEAAETAWRRAQELERAAHPTRHLVTSPPRPPPVFDKGSRVSRYDPRPAPQASVKLVCPNMGCKPVEDYAFVTSHAYNRCI

SEQ ID NO: 15841 - protein, 85 aa, Myxococcus xanthus
MWVSPASSCFVATVAFGAGAPELVAFRAYRDDVLRKSAPGRVFIRGYYRWGPDVAAWVSRRPAAREGVRWVLRRVHGRLTRSGFE

SEQ ID NO: 15842 - protein, 126 aa, Myxococcus xanthus
MKLEDLKGQVVMLDFWATWCPPCREEMPALVKLAKEYEPQGLVFVAASRDDGDRAPKLVEAFMRNHLPELAPYVVYADDNVARAFQVSALPTLYFLDRDGKVIDAQRGALSEDGIRRRIERALKQP

SEQ ID NO: 15843 - protein, 200 aa, Myxococcus xanthus
MSWFLALSLLAATPEGGAAKKAEDAESLRLRATKLYRAKKLGEACPLFERAAKLAPEHGPTLADLGLCLQKQGRKEQALAVYLRALKASGADAKTRANVYFNLAAFHDVTPEALTLEHQPTPRGHYLAIRGAGPCADLPSSEPSCGTVLQACLSEWVAPVEAVYAETPPMFYAETGFNMQVNRTGARKKSSVPTRRGEAG

SEQ ID NO: 15844 - protein, 88 aa, Myxococcus xanthus
MAETQTTQKRTSWPRFAKSNGKKACTVEGCKRPYRAKNYCYFHYKQWRQGDLPHSRYRTCSKPDCRVKTFKGGLCEKHHGEAFKKDAA

SEQ ID NO: 15845 - protein, 419 aa, Myxococcus xanthus
MGRARGKSVILFAALVCALVLPAQATGRERNRLWVESQNRALQKQRSTLSDVARRAMPAVVSITTQQAADVQAVAAGEEAQKGIGSGFIIHPDGYILTSAHVVEGAAEVIVSVLHPRGYVEEFEAIVVGEDARTDCALLKIAAPRKLPVLKLASASHVRSADWIVVIGNPFGLTHSVTVGVVSYMGRTDVTPNGRDGDFDYMQMDASINPGNSGGPVLDLHGDVVAVANAVNVAGQGIGFAIPIDIAKTVIPHLKSHGRVRRGWLGMSVQDFSPEVAEAFNLRRGRGVVVTDIVEGGPAERAGLQVGDVIVRVDQRSVRRAHALRWQVAARGVGRDVKFQVHRLGRPMKLTLKLDEMPSEETPLPTVASTAPGRHAGAPQPVLDDLLSPVPRSKGRRATPPSGEAAPGTGGSGQDAPAP

SEQ ID NO: 15846 - protein, 60 aa, Myxococcus xanthus
MERAWSRSVSPSTVDRLKDGLEDAYEDAKDAVAGNKDSSPRERISAEDREAVNRIIAQKK

SEQ ID NO: 15847 - protein, 342 aa, Myxococcus xanthus
MELNVGRGINLSSGYGREALRVMFAVRYDETFIDSDGDGVPDIRDRCPNEPEDIDGFQDGDGCPDPDNDGDGIPDGEDGCANEKGPKHTKGCPDPNYDTDGDGVVDGEDACVDKPGPKSNKGCPEDENDADGDGIPDKLDKCPDKPGPKDYDGCPDTDGDEVPDNEDDCPEQFGPPENNGCPYDSPPYVVVESDRIRIKGNVLFETGSAVIQKQSYPLLDEVATVLRKNPTLGPVLIEGHTDNRGSRALNMGLSDRRAKSVLEYLVAKGIARKRLSSKGFGFDNPIATNDTALGRAKNRRVDFRLVRAELETEKKETVVPAGQPPPPGTTPANAAPDKDGKP

SEQ ID NO: 15848 - protein, 602 aa, Myxococcus xanthus
RRGHPARLVRRCHGLARRIPAPPAEPAQGDARPVVRLRQALPHRQQAHPAQPHPQDGRPGRDEVMKTRALLSLTALLGLAGCATTPQAPPPDENAPPPAVPAQAAAPEPAPQPTRPESVPATPLRQPKPMELVVLARPDTPIVSFRLVFHTGSVDDPKGKEGLTALTAQLMAEGGTQKLSASQLLEALYPMAAELDVFVDKELTTFSGRVHKDFLTRFQDIFTDVLLAPRLDKAELERLRANAISDVENGLRSANDEALGKVALDALLYQGHPYAHFTGGTVQGLKAITLDDVKAHAQRVFTQDRLVIGLAGAVDDALAQALSSRLSALPAKGAPRVELPAVPTTAGRTVIIQKPTLSTAVSMGFVSTIRRGDPDFFPVAFAMSNLGEHRQSIGVLFTELREKRGLNYGDYAYAEHFIESPGTTYNRTNIARTQQDLSLWIRPVVPTNGVFATRGAVFFLDQMVKEGIPQERFELMRGFLQGYTRLWEQTDQRRLGYAIDGLFYGTPDFLEQYRQAMSKMTPQSVQEALRRRVQPEALNFAFVTEDAEGLAQALRSGAPSPITYASPKSEELLTQDQAISSSKLPLRPEAIQVIPAQQFMEK

SEQ ID NO: 15849 - protein, 198 aa, Myxococcus xanthus
GVAPLWPLLSLGVTTATAAARFTLHGLFLFFVKVGSVLYGSGYVLLAFLRTGLVERYGWLTEAQLLDAVAVGQVTPGPVFTTATFIGYVMGGPSGAVVATAGIFLPAFVFVALSGPLVPRLRRSWVAGAFLDGVNVASLALMAVVTWQLGRAVLVSPLPVALAAVAAVLLIRYRVNSAWLVLGGGCVGVLAAGGLSAG

SEQ ID NO: 15850 - protein, 108 aa, Myxococcus xanthus
MDVKHLSSFQDFSPEKLLKHNVFQSGRFFLDVYCLQPGQAQKPHRHATSDKVYVVLDGRCRFRVGAEEEVHGPGAAIFAPAGAEHGVANDGPDAARLLVLMSPPPEHA

SEQ ID NO: 15851 - protein, 181 aa, Myxococcus xanthus
MLVEELSALKKRVPEGKMSLEARQFPLDGACNPAIPRRGPDAPSVRCVAARAQICLEGAPDYWELREKMFAAQAVLDTERAVEIASSGSVPRSQLEVCMNSPATAAKIQEDSRYAMRHHIQGTPLVLVNGRETAPSAPFLYALVMAEGNPSAPGFDVLPPPRPRPVGGHGHGHDDHAGHNH

SEQ ID NO: 15852 - protein, 126 aa, Myxococcus xanthus
GKRDKKGEPPAAPAAPFNNPFAALVAQREALPQAPAAPVAHAPVKAEPKGPARAVVRMERKGRGGKEVTVVEHLELPAAQREVWLKALKNSLGCGGVVEDDTLVLQGDQRERLPALLQAPSVRKVT

SEQ ID NO: 15853 - protein, 156 aa, Myxococcus xanthus
MNLAATGALATTAVLLVADSGEKGCHQPAQSVTFDVGHNTCGAPGILRVSTPQDTCRLDVEAEERTGLPMTGDVYDGSVDLRQGDNWYLADMNVAIIVDADGGTLPGDAGTGTTVEVNRACEVLREGEVLRLKCTARRADLANEPVSACEAVLTPR

SEQ ID NO: 15854 - protein, 146 aa, Myxococcus xanthus
MPEFLAPLPLFAVALMAVNDRWLKPTFHNALTGKLSDVAICFFLPLYVSALLALVTRWPRARRVAVGAGFTACLYTALKVSQPAADLFCELLRPLGLPLGIRSFRAWADPTDLVTLPLVWAAVRYSRAAAREPSSLPAAPSTGVST

SEQ ID NO: 15855 - protein, 383 aa, Myxococcus xanthus
MVVAMPPLLVLGAVGPYVLRVGLAGVESAGAHAGRLSSASTVGSITGTLLAAFVVLPLLGTARTMALFAAVLGLTASWRLGWRWRLPAVGVPMVALALGAHALPRAPKAVDVAESPYAFIQVVKDEHGTRSLVFDEGYAVQSVHRPGLPVRGEVFGHYLLVPAMAQAAPRAPRVLVLGLGAGTSARGLRETYPGVEVVGVELDAEVVRLGRAHFDLPSEVEVHVGDARAFLASDTRQYDVILVDAFRFPYVPFHLTTREFAAAVAARLNPGGVACFNVGRYAQERAVVEAVGATLATVFPEVRAADARNHSNTLLFAGAPGLAERLAERTASLPASLRPLAERVAGELKPVPAGEPLTDDKAPVEWLTDAILLRALSSGEKLQ

SEQ ID NO: 15856 - protein, 228 aa, Myxococcus xanthus
MGVPRSLTALARLGNAPVSKEQWLASARAVEQALRQDPEVSQVMLRDYEKDGQVHLVYDVTVKDVTQLPELYRRAAEQHTQGQPSSPKDAWDFRIERQGGDYVYTQRFNPEKAFATPVGIGDEAAEQAAQELAKGMVKAMLVNNRLTLRIHGPGIGETNGTVNEQKDTVEWKLNLAELMDAPAEGREFRAVIHGGEPLWLWPLVLGVPMVVLLLTVTAARKRRGVAAR

SEQ ID NO: 15857 - protein, 289 aa, Myxococcus xanthus
MVTQEVNNLPVGTAAYAAMVTVKGAMVADARILKREPDLLLDLEPGTGAKVREFLDKYLISEDAELHEATGELALLRLLGPRTEDVLSAALGSPHAPLSHHAARTATLAGQEVWLLGSTAIEPHGVDVWVPRTGLEDAWRALSEAGAAHGLKPLGLEALDLLRVEAGVPRYGQDMVDTTIPLEANLANAISYNKGCYIGQEVIARATFRGHMNRKLTGLLLGDADVAPGTELRRGEKKVGWLTSVVQSPVAGQRVALGYVHRDSLEPGTELTLAAGPATVKVASLPFSA

SEQ ID NO: 15858 - protein, 32 aa, Myxococcus xanthus
GFIHDVRRVIKALPPKRQTLFFNRPLHNNTQH

SEQ ID NO: 15859 - protein, 322 aa, Myxococcus xanthus
MRRIIALLAALNLVACAHGGGAAPEAASVTKPTAPKPVATPEAKAAASEASGLAMKGDNARALPLFRSAWEGGGRSRNLAYNAACAASLLAEREEALVWLERAVEEGFDDAKHLQKDPDLSNVRSLPGYAALEQRVIAAEAKQYEAADPVLRDELLKRMEEDQAARGALVASNFQDEAAKAKMMDVDARNTTWLKGVIAKHGWPGSALVGRRGTFAAWLLVQHADQDVAFQSEVLPMLEKAVARGEGTAKDLAYLTDRVLVNTGKPQRYATQLEEVDGKTVPKALEDPEKVNERRAAVGLDTLEEYIAAFERMKAAATQQKP

SEQ ID NO: 15860 - protein, 109 aa, Myxococcus xanthus
KSQPKTDGESASKLISDRIAELGDWRGEALARVRALIKEAVPDVVEECKWRGTPVWSHGAGLCTGEAYKSAVKLTFFKGASLEDPSKLFNSSLEGNVRRAIDIQEGERL

SEQ ID NO: 15861 - protein, 391 aa, Myxococcus xanthus
MVCQGCKNAKDGSEQYEMPEDTASAVTVTDEALLRMATAGPNWRCAYCESDQRALDGGCKHCGASAVEGSIPAEPTRPTPDEKKGAKSNRRLGCYILSIIAFFGCCCPMWMSSGKKGTAPATAATTAPKTEPERTRTLQVKEVSWEHTVSVERYRLVNDEGFEEDRPEGALLVKAHGKRHHHDDQVLAGYTTVRYTERVQRGFTTETYRAKEACGEDCTTTPKKCSEQCTSNRNGFATCKTTCTGGGRSCTTRYCSVTKKRQEPRYVDEQRSRQEPRYRSVPRQATWYTWKEWRWMHDRDVKANGTTLEARWPTDAELRPAKALGKGEKERNARDARYSVVFHGDDQPAITYTPETLEEFQRFAPGSTHTLQQEQGKVSVVPQTPPAQATP

SEQ ID NO: 15862 - protein, 430 aa, Myxococcus xanthus
MPVAQTEPFADVMARMKAEKPKITARHQQLLEHRYDLGNRPARGVTMSRGKAVQEGVRVKLPQGVTWESLAAMSPEAIRDRGLFPAGFMPLPHPNHPEGGMVFPKFHIDEIKRQEGRDLTRFDLDFDLPDHLLPEFPPPIFLTTRPDLGDVSQGKLVTIMNVQELFNGLLNPKQLEGLRLLVTPFPQQQFNQTADRRSELPSRGVSCFDCHVNGHSNGATHLVGDIRPQEFRHRIDTPTLRGVNIQRLFGSQRALKTVEDFTEFEQRAAYFDGDPVIATKKGVNILERGSQVHFMAEVQALLDFPPAPKLRFDGKLDPKKATQQEMRGQTLFFGKAQCSVCHLPPYYTDNLMHNLQAERFYKPRLVNGAVMGSDGPIKTFPLRGIKDSPPYLHDGRLMTLEDTVEFFNLVLETRLNAQEKKDLVAFMRTL

SEQ ID NO: 15863 - protein, 57 aa, Myxococcus xanthus
MEHEDEHRRLVDSLIQGGTLKASELGRVIVQRDTPSGKAAEPTSTAEDASEKVSQKA

SEQ ID NO: 15864 - protein, 277 aa, Myxococcus xanthus
MRRRSGAVLVLAAVVLLSGAAPESAQEQVLGSAGSDPRIEAVAMPCKGGQHALRVRRGGAKSTATLSEPYDALTCNVAKSTAPGWSWTGGDESTSWDLHLRAVELQGGPTALLITHAAGYEHVHRQHALFLADAKGVTRAWEGTEGQGPTSSSVEVQDGRLLFSRTLDIGVGESADRWALTELRWDAGRKKVVERPAEAWAVILRTEDSVPAARVAEAQLEADCKGATLLMVDTNDFARLTRDKWVVASFLPTRQGAEAALRRLRPCAPDAYLKRVQ

SEQ ID NO: 15865 - protein, 451 aa, Myxococcus xanthus
DKCTYIKEVKVGSRVVTPTYTDGYWYSAQDSSYQPADPSRYGYNLWIFFPYLGDGSTNQVTITVGRTFGSGTATYSFPMVQVDSVEASYVPAPIGFSRAELLNMFGKALYTKFNGATNSTVLRSSDGSTRRIYGYDPNSLQLSVTSSGVGFSFKFKTDINNWCDPTIRAYGTFKLNANFSGISVQWVNAPQASLDWPFLCQAVQVVPILGLIPALIYDIIESEAANSITSTIESSIIDSLPETADVQLFLDGSTTRNNELLVNLKLPAPSIKINVPYDAFDMNRSATLFPSGENLTLLASGLGVNDYVAGVTPQTTLYSGPNGVPRYGSTMWPNAQTLSRATNPVWNGLPIARLLARMSPTVVSTSTYQYTPGCTFKANNKFGQASVRFGVNDTATDAQRLRGIFGAAPGYSLRVVFLNDFSTSIADNASRCGVTTYSPVYGSDGPVLANP

SEQ ID NO: 15866 - protein, 443 aa, Myxococcus xanthus
CSKVPVVLPPEAPEAVAALNGSGGTVEFRWAAPPANPDEEGRDAPTGYRVYQSADGLGWDDGTDAAGTSFRTTLAPGTVRYFRVAAHNAGGEGFPSVTVGVRTPGGAESPVLVVNGFERLDASQACAEPLDAYDLHAPVRLLVETMNDGTYVRRHGAALAHAGTAFDSATRAAVAANLVTVGAPYRLVDWFTGRGGAGGARPTREEQDALRGFVMQGGHLLLSGSHVTSALAVGSAEDQAFLADILRAAPGSGTPPFSVEGMPGDWLAQLTGVALDDGTRGGYAVGVTDVLTPASGGTSVLRYLGTDLAAGVMSAPNGRVLLLGVPFEGIVSPVQRAGLMSSFLVQAGLLTELPPPPAEESGAASLLSACVAARGVDPHPPPEPEPEPEPEPHVVGVLPQFYPLGDSGCGCGAGGGTGTAVWLLLGVIVQLRRARRRGDVAGR

SEQ ID NO: 15867 - protein, 336 aa, Myxococcus xanthus
MATRIAINGFGRIGRCILRAVLSRKEDLEIVAINDLDKPAALAHLFKYDSVHRTWPGEVKATEKGIVVDGKEITVTAEKDPTALPWKSLNVDVVLECTGRFTARDAAEKHLKAGAKKVIISAPAKGPDITIAYGINHNEYDPAKHHVISNASCTTNCLAPIAKVLVDNFGIEKGLMTTVHSYTNDQRILDLTHEDMRRARAAALSMIPTSTGAAKAIGEVIPQLKGKMHGLAVRVPTPNVSLVDLTVNTEKKVTAEAVIEAFRKAAEGPLKGVLEFSDAQTVSVDYNGNPHSAIFDSTNCFVMGDNLLKVMAWYDNEWGFSNRMVDTAKFLVSKGV

SEQ ID NO: 15868 - protein, 132 aa, Myxococcus xanthus
MLTFVTIVHVLVCVFMIFVILLQPGKDAGMGSALGGGAATSAFGGRGAVTFLSKLTGVFAALFFFSSLGLSFVGLRSSVAAGGSVASPPAQSAPATSGDAAPGSMEQPRGEQSTPPAEGGGNPATGEPAPAQ

SEQ ID NO: 15869 - protein, 142 aa, Myxococcus xanthus
MTATWRVPRATMSRRRARLRTVATPAARRGPKTALTDEALLEAIRGVLAAAPFLGEGHRKVWARLRAQGVRTSKARGLRLMHEAGLLAPGRTRRLLGPHNHDGSITTDRPDVMWAPMPPARRQPWKDRQPSSSPATMALPSA

SEQ ID NO: 15870 - protein, 584 aa, Myxococcus xanthus
MARLDPHSYNDSTQPETETLDWRARVDFKTQRLHAEVTHTLKEASAGPLDLDTRDLEIRDVIDAAGRPLPYILSPSEPILGSRLRIELPVGLRQFTVRYRTAPHASALQWLTPSQTAGGKHPFLYSQCQAIHARSVVPLQDTPRIRIRYTASLRIPKALKAVMAASFLRREEHGVEAEEHYEMPQPVPPYLLAFAVGSLAPKELGPRSRVWAEPELLEDAAEEFSGVDDMLRAAESLFGPYDWERFDLLTMPPSFPYGGMENPRLTFLTPTLITGDKSLVNVVAHELAHSWTGNLVTNASAEHFWLNEGFTVFAERRILEVLEGPEVSALHGALGRRALDSALQHFRAHPQLTSLRTHLAGVDPDEAFSQIPYEKGYLLLRAMEDAAGRPAFDEFLRRYLATYRFRALTTEEFVAFAEKELPGVLTKVDAEAYLHRPGVPPGAPSPRSLRLEAMDALRGKVPTPEQAKDWTPAEWQLYLESLPWDIPRDVIQQLDARFSLTESRNSEVLVAWLVVALRADWEPAVARTETFLGEVGRMKYLKPLYGVLSASHAHRSLARALFKKHGERYHPIARQGVELILSRA

SEQ ID NO: 15871 - protein, 281 aa, Myxococcus xanthus
AGRVVIASAVRTPFTRAHKGEFKDTRPDTLAAVAIKEAVAQVPGLKPEDIGDVVLGCAMPEAEQGMNVARVATLLAGLPVTVPAMTINRFCSSGSQAIAQVAQAIQAGMYDVGIGGGTESMTMVPMGGNKASANPEAMERLPEIYTSMGATAENIASRYGVSREDSDKFAAESQRRAATAREQGKFKEEIVPVTTTYYDDDGVAQNVTVTVDTILRPETTQEGLAKLRPAFNPKGVVTAGNASPLTDGAAAAVVMSEAKAKELGVKPLGYFIDAAVAGFRA

SEQ ID NO: 15872 - protein, 577 aa, Myxococcus xanthus
MRIRVTSRPSATTGWRGPTSSNSWVAGCGRAARHPRHRPRSLPNAYHLGRPAHPRSQHHPGRPRGTGRMSPMARRAPMSTRTTETERAPGREDDAPGARERRGAPGNSPAIGAEGTLTRRSMLATAGATLTGGSLLLSGSAARAQSAVSGARGPREGSAADTGQRYARQDWLRPGMPDRDYRPVVVPNGSKLPWKVVDNVKVFHLVAEEVAHEFAPGLKAFCWGYNGRVHGPTIEAVEGDRVRIYVTNRLPAATTIHWHGLLVPSGMDGVGGLSQKSIAPGETFRYEFTLRQASTNMYHSHHDEMTQIGLGMTGMFIIHPRRPVGPRVDRDFVILLHEWRIDVGTERPNPNEMTDFNVLTMNAKAFPGTESLVVRQGERVRIRLGNLSPQNHHPIHLHGFHFRITETDGGRVPESAQQPEGTVLVPVGSTRVIEFVADVPGDWALHCHMTHHMMNQMGHAFPNMIGVKPGSLDARVRTLLPGYMTMGQTGMADMGQMAMPIPPNCIPMLGAQGKHDYITAGGMFTVLKVRERLESYADPGWYDNPPGTLAVAATSDELRRDGIDVNAPALVDPGAPA

SEQ ID NO: 15873 - protein, 777 aa, Myxococcus xanthus
MGSGIAAHLANSGVRALLLDIVPPKAAPGEDTSSKAFRNKFAQGALANLRKQKPSPIVSGEVFTNIEVGNFEDDLHRIAECDWVVEVVKEDLKIKQDLFAKVEKLIRPGTIVSSNTSGMSIVGMTEGRGAEFKKNFLVTHFFNPVRYMKLLELVAGKETAPEVLKTLHRFGEEVLGKGIVYGKDTTNFIANRIGVYGMMRTIAAMDKAELSIEEVDKIFGPAMGRPKSAVFRTADIVGLDTFTHVAKNCYDTLTHDEERDVFASPAFLQKMVEKGMLGDKSGGGFYKKQGKDILALDLKTLEYRPQAKVRYESLGAARDIEDVRERVASVMNAEDKAAKFAEGVTLDVLAYTSRRIPEIADDVVNVDRGVRWGFGWDLGPFEVWDAYGVKKGVERMKALGLKPAAWVEEMLAAGRASFYGVENGKDTYWDIPSKSVKVVPENARTQRVEYLKRGNKKIAGNDGATLWDLGDGATLLEFHTKMNSIDDQIIEMMNTALDETEKNHKGLVIGNDGSNFSAGANIVALLWAAKSGEFESIRKLVTGFQAVNQRMRYSPVPVVTAPFNLTLGGGAEVTMGGNAIQASAELYMGLVEVGVGLIPGGGGNMQLLRNVYGPFGTDKDFDFFPFLKKIFLTIGMAKVATSAEEAREAGFLTQADGISANRDFLLSDAKARVLGMADAGFKAPRPTRFRLPGTSGAATIDMMLYDMELNGQVSAHDRKIAQKLAKVLTGGNTSPSLLVTEERLLELEAEAFLSLCGEEKTQDRLQHMIEKGKPLRN

SEQ ID NO: 15874 - protein, 255 aa, Myxococcus xanthus
MSQFEPQTFDMIFADPPYFLSNGGTTCKGGKRVSVAKGGWDVSRGVEEDHKFTTEWLAACQRLLKPTGTLWVSGTQHVIFNAGFAMQKLGYKLLNTVTWFKPNASPNLACRYFTHSTELLIWASPKSGGKLQHTFNYARMKAENGGKQMRDAWALPPSGDAELTADGEGRMWTLTVPRGGEEKAFGSHPTQKPVALLERILEASCPPDALVLDPFNGSGTSGVAALKLGHRYVGIDMDEKYLALSEKRLNAAASK

SEQ ID NO: 15875 - protein, 73 aa, Myxococcus xanthus
MKPEIHPVYPPSRVTCMCGNVVETKSTRGSFSVEICSNCHPFFTGKYKLVDTAGRIDRFRKKYGASPTSAKKA

SEQ ID NO: 15876 - protein, 153 aa, Myxococcus xanthus
SQEVEGVDFVVQSHEGRGQGIAQRQALATVIPSGARGRELAKLLLQLEGTGRFADASVQERTRQQLRLLEGNLTRAKARLAGTQDPAEKQPLEATIARLEASRAAYQKALAGGATDAGRTHLLSYIQLGSDVPADPVVQKWVERVEPPGSAAH

SEQ ID NO: 15877 - protein, 240 aa, Myxococcus xanthus
MSLNDILHYLRLGGVTLAMLIFASVAALIVAVERIIVLWGVGERSRALGETVNKHLLRGDVAAARTAAERSDAVAADIFLAGFDRMERSRTAGGAGIEAAVERERAQVALKLRRYLWILATIGSITPFVGLFGTVAGIMRSFKDLGLDVEAGGTGGSSAVMTGISEALVATAVGILVAVQAMVFYNYFQARLSRVLVELRLIGDEFVELLKERAAGLPPSEPMPPEPQAAPATRTDAQPA

SEQ ID NO: 15878 - protein, 150 aa, Myxococcus xanthus
MGMGKTPGSDDGSEDGVFAEINITPLTDIFLVLLIIFMVTSSVIVQQGPGGGAKAGLKVNLPKGGAADVTARTTDLSVAVLADGRFMLAGNVVSQDELQQAFDDARQKDEETVVIVQADEGVPHGTVVQVMELAKKAGLAQLAIGVREGE

SEQ ID NO: 15879 - protein, 124 aa, Myxococcus xanthus
KPQNPHAQEDRLLDFAYGELPVPEARLVEAHLESCARCTQALDDIRGVRATMSQLSVEPAPDAGLESLMAYAQQAARRAAAGPAPKPSRWRRWLLPVLGLASVSTFGLLTLEARSPDLTRPDLS

SEQ ID NO: 15880 - protein, 199 aa, Myxococcus xanthus
MLAFQAGDARAFEALVRKHRTPVFNFILRFTGHRARAEDVLQETWLKVVRSAGDYTPKAKFTTWLYTIARNLCVDSARKESYRQASSLEAPAPGAERDESRPLGEGLPDAGASPERGAYNARLRPLLERALATLPDEQREVFTLREYSGIPFKDIAEVTGVSENTVKSRMRYALDGLRRRLAEMGVDGDLAEDGRTVVG

SEQ ID NO: 15881 - protein, 98 aa, Myxococcus xanthus
MVGLFAVRAPLRWALDVPAVLALTVPALADWAVGRFRPASGSNAVRTLTGVLLGAALGRSLYVHLQQPLPAVLLAQGALVTAVAVPVILATYQRPRRG

SEQ ID NO: 15882 - protein, 416 aa, Myxococcus xanthus
EGGNPLSDRRSVEFRSRDALFNVIPLPPAEAALDDSGYSLHGTGADAITCSVGTLDGAIGVVTRLSPTVVWVMPKGEVDTSDARALPVYLSGCGVTLGPIRGAFIRTDAETAGTPVGLQLANVSLEQGRQILTLLADALKRGVAEPAASALPVQDTIDEAERIRAILLAISTAGNKGVLRRMGRTVRLVLERYNAETEQLEWHAEDPVTDWGEAPYDIDVIGHNSAYRMRLEAGTPGGQRFTSPLPDVLFRIRHRWHRRSPAPEGVRVTFHHPLWREQGEMERAVLDLSFSGMCIRCRPEDLLFPGLLPPLLELHTPDGQSISLRGEIRYVTSARADGTVLCGLSVSPYSSDEARWVRFVSQTTNPNTCTSDVQEEGLWDVFTLSGFFSLANKSSQEFDALKQAFSHMAKRAAGSF

SEQ ID NO: 15883 - protein, 338 aa, Myxococcus xanthus
MRKKIGELLVEAGVVTEEQVRVALGRRGAFGSHRLGEVLVAQGLCTPTHIAQALSAQHALPFVALPEEIPANVAGLVSVDFQSEHRILPFRMEVEGRSERILVAVDDPADVTLVDELRFQLRKQMRVFVAASDDLDAALARARGEPLDIVEAVALEDEDGAPPPPVAAGAPLEWDFPEAPKPVPKSVPPSPPPAARPPSLRGSASPPPPPPEATDGDAGADALDDLLGRKASPPVRPPPPPPPDAEGDGAEGRPRVPVVMFGGAAQGSRPSVPLTPTPQFSDEDLAILDDIERISRGEDASLDTEKVKPARMVASLIRLLIRKGVIQEGEFLEELAQK

SEQ ID NO: 15884 - protein, 251 aa, Myxococcus xanthus
MAQIKLGELLIKANVLQESQLKAALAEQAKWGGKLGEILVRMSLVSEDILVRALSKQLGMPAVNLDAVQMVQPHVKAKIPAQTARDFSVLPLQVRDDGKSLVVAMSDPLNVRMLDELRAITKCRIIPNVAGRTSIARAFARIYEQNHELEDADTNFKVVDAQGRTVVKNLKDLDPAAAATSPRGAPASARPAPASEAPAARPAAASGSPAELLRNVEEVQRKEVAALKAMVELLIEKGVFTREEYLAKVKR

SEQ ID NO: 15885 - protein, 152 aa, Myxococcus xanthus
MLPGEELVPIMLGQVPLIPPERMTLELDRKKGVYVLTLHRGQATQVLDVHTKYLRIMKSQVRGIPGYDLGFEDFLEQGGLIFPGRVSLEAKQAKTKLQVRYQQIKLNARPDLTLYELVPPEGARVVEVDEAGRELPAGAPASGSSAPLAPGS

SEQ ID NO: 15886 - protein, 63 aa, Myxococcus xanthus
VIAEKAKGSVSADHPDHAFYEGKKYSALWYARNVLPNVEQAAKMLTIEDTSPMDISDAAFASV

SEQ ID NO: 15887 - protein, 370 aa, Myxococcus xanthus
MVEGRRPLGLISNIASWNYPLSVLVHAVLVQVLAGNSAIAKTPTDGGLYSLTLCMGLARRCGLPVSLISGSGGQLSDALVRNPEIACLSFVGGKANGRDIAASLYDRNKRYMLEMEGVNAYGIWHFSDWDGLAKQLKKGFEYGKQRCTAYPRFVVERSLMPRFLETYLPVVSALKVGHPLLAESPDGEPPALDFGPLINSQKVEELHGHMSEAEGRGAVPLFAGRLDAERFLPDQDVSAYLAPHALLHVPRNCKLYHGEPFGPVDTLVVVDSEEELIAEMNVSNGSLVASIACDEPDTCKRVSTELRAFKVGHNGPRSRGDRDEVFGGIGGSWKGCFVGGKYLVQAVTEGEPGERLHGNFHDYTQLPDTR

SEQ ID NO: 15888 - protein, 545 aa, Myxococcus xanthus
MKAADLFVKALEAEGVRSVFGLPGEENLDVIEAMRAAGMRLVLTRHEQAAGFMAATYGRLTGRAGVVLSTLGPGATNLVTAAAYAQLGAMPMVMVTGQKPIRAGKQGHFQIVDVVGMMRPLTKLTRTLVSAEHVPSAVREAFRRAEEERPGATHLELPEDVARESTDAVLLAPSAHRRPVADEASIALAVEAIASARRPLLMIGAGANRKLTSEMLRVFVDKTGIPFFSTQMGKGVVDESHPLWLGTAALSEGDFVHRAIEASDCIINVGHDVIEKPPFFMRDSRRTVVHLNFSSAAVDPVYFPQLEVTGDIANAVWRIGEGLGPRAHWDFVPFEKFRAGLEAQLAHGGDDDRFPIYPARLVAELRRALPDDGIVCLDNGMYKLWFARYYRTRRPNTLLLDNALATMGAGLPSAIAAKLVHPRRKVVAVCGDGGFMMNSQELETAVRLGLDLTVVVVRDDGYGMIRWKQGEMGLPDFGMALGNPDFVRYAEAYGAHGHRPTSATEFGATLARCLASSGVHVIDVPIDYSDNARALGAGAEELAAL

SEQ ID NO: 15889 - protein, 477 aa, Myxococcus xanthus
MLAERYPYYLANRPRQPNAELAVTHKYSGEVVTHVAVADAAAVEEAIAAAVRAAEPMRKLAPYARQAVLEHCVRRFRERAEELALALCIEAGKPLRDARGEVDRLIDTFKAAAEEAVRGGGEVLNLEVSKRAAGYRGFTQRVPVGPCSFITPFNFPLNLVAHKVAPAIAAGCPFILKPSDRTPVSALIMAEILAETELPEGAFSVLPVRLEDIGPLIEDDRLKLLSFTGSEKVGWELKARAGRKKVVLELGGNAACVVDEAPGAPLDFIADRVAQGAFFQAGQSCISVQRVLVHASLYDALREKLVERAKALRPGHPSDEATTLGPMIDEPAARRLEGWIQQAVQRGARVLAGGGRRGSVLDATVLEGVPEDASLSSEEAFGPVVLLQPFDSFDEALAQVNSGRFGLQAGLFTQDLSRAMKAWDELEVGGVVVGDVPSFRVDTMPYGGVKGSGIGREGVKYAIEDMTELRLLVLRQA

SEQ ID NO: 15890 - protein, 208 aa, Myxococcus xanthus
MDEKRYPIPAGLHRVEQDIQKSRFITTAAHAPTVEEAKAFIARVREEFADATHNCWAFVVGPPGSTAQVGMSDDGEPHGTAGRPMLTALLHGGVGDVAMVVTRYFGGTLLGKGGLVRAYTAGVQQALESLPTTERVRKTRLAVEVEYTHVDGLRRLLPSYEVQVLAEEYSATVGYRLELPVTQVEALRTALNDLTLGQVLVEPLDSDD

SEQ ID NO: 15891 - protein, 35 aa, Myxococcus xanthus
MDLRGRGTYGAVYRARHITGTHTVALKLALHDHGT

SEQ ID NO: 15892 - protein, 177 aa, Myxococcus xanthus
MSASASSEPALVTSAPSPGADVHAQVVALLDATTRTGAPSDDAWKRLGPGAAPVLSALVVDKGTPTARRTLAVSSLALVDPSGGAVTIRDVLEDAKAPAVVRASAADALRQCLGLDAIPTLISRLQDPESQVREAVAVALGRLGGQQARQALEDRLPIEERALVREALQRGLTLVEP

SEQ ID NO: 15893 - protein, 294 aa, Myxococcus xanthus
MELRHLRYFSAVADTLHFGRAARRVHVSQPTLSQQIRQLEEELGAPLFERARSGVRLTQAGELFRTYASRALEDVDAGRVAVGALRGLTTGALRVGYPPSMRGVVLPALAAVLRRHSGLVLSAEEAVVRRVERRLADGRLDVGLGYAPARSPDLEAEPVFDSKLALVVAKGHPLAKLETVGAKPLAQEPFALLSRGLRVRARVDAWFAAIRIAPHVALESNAVATVLATVRAGLAVTVLPEPQLADAAGLAVKRLSPAPRAELAALLWRKGAPRTPAAELFAAEVRGARRPSRR

SEQ ID NO: 15894 - protein, 59 aa, Myxococcus xanthus
NTGSRNDADQWDIVHVDTGDRVTLTMASFWSNKVFAWVDKRRPIWESQGGMPPCGASCR

SEQ ID NO: 15895 - protein, 413 aa, Myxococcus xanthus
MLKLQWLQVHQFRSVKPGTRLLFSPSLNVLLGENGTGKSTLLDLAAAVVSSDFTPLRHEAFDLEYALAADTGRITVRVRNVPSGAEGTSGLSMDITVAPRDMAWPLVIHREGQQLRVSREDDTTDVVHERIAPEVGGRLWLVLMTGGIAWVEKTGEGTASVEPMLAMAREVSAQADLHRFDEGLAHFDQLWRAELRLSRRTEGVLATGTGVASEDLLDGLRKVAAAQWGASRYVLSSENVPFLRDAARLLGFASAEALLSPLETQPQGKYETLSLGNLDLCFVTAAGQRLSARQLGYGQKRLVAFLHYLAHARAVVIADEVAHAFHPRQVRAILEQLEPRQALLTSQSPELLDSLTFDSPEQVRSTFVRCRREEDTGRLVWENLSPEAAGDFFTAWRAEPRRVGELLQAKGLW

SEQ ID NO: 15896 - protein, 275 aa, Myxococcus xanthus
MPMLTVNRTDLYYEDSGGTGVPVVFSHGLLWSCRLFDPQVEALCGRYRCIAYDHRGQGQSAVPPARVIDMETVYLDAVALIERLGVGPCHFVGLSMGGFVGMRIAARRPDLLRSLVLMETSADREPLHNVPRYTLLNLTARLAGLRPVADPVMRIMFGRSFMTDPNRAEERSRWRTRLMENRRDIWRAVNGVIERRGVAHEIPHIRVPTLVVVGAEDTATVPAKAQRLHRLIPGSRLVTLPRGGHSSTVEEPALVNATLGTFLDAQLETRTSRAV

SEQ ID NO: 15897 - protein, 1019 aa, Myxococcus xanthus
MWGHVEGSQVPNPVTATASCPKGFTPKQVFGTSGVDAALHLCEPRSDVLDFGGAFGRLNNGTLSPNPATGAASCPDGYTQTQVLGTWGRDWDVHICQRPSREGSPPLYDFGGMWGYVNAQPVVNPITQAARCPAGYTAQQLLGTYNQDYGLHLCYRPHVPGRIPENRFGGIHGHVNQLPVANPATGTTACPPGAVETQVLGTQGVDHPVYYCMTRAPKWDFGGVFGYLNGGSPVSNPATGATSCPDGYVQTQVQGSSTMDAPLFLCSRPSWDNAEPALDFGGMWGIVNGSWVNNPYTNERSCPAGFAALKILGTAGQDSELHLCYRHHAPGTVPPYPFGGMWGHVNDAPASNPTTSTTSCPTGFIPRQILGTAHIDHPVYFCELPAKSLDFGGAFGFFNNGTLSPNPATGAASCPEGYTKTQAYGTHGRDWSVHFCHRPSLEGGAPLYDFGGMWGYVNNTLVRNPITNSANCPAGYADQRLLGTNRLDHELHVCYRPHAANTPEMARFGGMYGTVQAAPVPNPATATTECPSGFEKTQVLGTSNVDHPLYFCMAHAPGWDFGGFIGSINGGETVPNPVTGTATCPDGHVQTQVSGTDSVDWPLSVCTRPNWGDTEPALDFGGLWGYVNHNAVNNPYTNAQACPAGFQSQKVLGTHGQDYDLHACYRPHVPGQRSPYAFAGMWGHVNGVQAPNPTTSAVSCPRGFAPTQVSGAQGTDNPLYICEPLQSKFAPRLRFDGSARGYPMSAQVFYDAAVVNPQQGIIQNTDASTLGTGTIPTYYQLIECGQQVRIKYWWFYGYQSACDEYGRGTHHGDWEDVTVTLSEDKSTIAAVTFSMHGKRYTRLASRGGFQVEDGTHPVVYVGKNSHAAHYKQGGSGVGDNCLPWEEYRNNSTGTHLDSWLNLVSLDTDAEPWMVADRIGNFVWGYDGVSTHPTRSGPSCRMNAAHWSFTVPTWWHSQCKTGDRDDGTSCHSACRSGYTDMGLTCTNWSITSLHTYRQHIYGYDYTLPTSDRGLMIGEPH

SEQ ID NO: 15898 - protein, 112 aa, Myxococcus xanthus
MMGFPLGTLAMLIAFRGVWAIFIHSNVRLPLGPLGFLFGAPELHHWHHARERHTRHNFGNLAPWTDWLFGTYYRPTGPEQYPLGLVEPFPRRFWAQLLSPVTRATDSRNTPR

SEQ ID NO: 15899 - protein, 375 aa, Myxococcus xanthus
MRALAEQAAALPHVSLAGITHEPAALLASELAAIAPGSDRPGLPSSERLSRVFYSDNGSTAVEVAIKMAAQYWAQNGQPRRTRFITLSGAFHGETMGATSVGGVPLFREVFGPLLFDVVHVPSPAEEGGWARAFEQVQSTLRAHPEVIAGVILEPVLQGAAGMVMYSPDFVRAVREATSEVDTFLIADEVFTGLGRTGARFAVDLAGVVPDMLCLAKALSGGILPFGATLASERVFSGFLGASNRALYYGHSYCGNPLGAAIAREVLAVYRDEDVMGQVARKAPRVKAAFERMAASIPGLVRPRAVGMVGAVDLGGGGYLARGGWRVYEAARRRGLYLRPMGDTVYIAPALTISDEALEELLSGVEASLQEVAGG

SEQ ID NO: 15900 - protein, 189 aa, Myxococcus xanthus
HLLTYLVQGSSYLSPKAYAILHREHHAFSDTEKDPHSPHFFKDVARMMWHTKARYDDYAAGRGQPEARFLGGYPEWPLVDTTLRTSWFATLGWVAFYSAFYVMFATSPWQFLLLPLHFLMGPVHGAIVNWCGHKYGYRNFDSTDKSRNSLPMDFLCMGELFQNNHHKYGSSPNFAARKFELDPTWQVMR

SEQ ID NO: 15901 - protein, 73 aa, Myxococcus xanthus
QVYFCDPHSPWQRGSNENTNGLLRQYFPKGMDLSGLSRAQLDTVALQLNTRPRQTLDWRTPAEVFAQSVAMTG

SEQ ID NO: 15902 - protein, 414 aa, Myxococcus xanthus
MKAMDFEPSERAKDYLERVKRFMSEHILPAEARYHEELRATAQGGDWKTWRVPPVMEELKALAKTQGLWNLFLPDEKLGAGLSTLEYAPIAEETGRSFIAPEVFNCSAPDTGNMEVLWKYGSEAQQERWLKPLLAGDIRSVFCMTEPDVASSDATNMAATAIVDGDEVVLNGSKWWSSGLGHPNAKVVIFMARTPDTGGDRHHQHSMVLVPLDAPGVSIRRMLPVYGDYDAPHGHGEVHFDNVRVPRDNVIAGPGMGFEIAQGRLGPGRIHHCMRCIGAAERSLELMIDRGMKRTAFGKPLLNLGGNREKVAEARIAIDQARLLTLYAAWKMDQVGALGAMTEISAIKVVAPSVLQKVVDDAIQLHGGAGVSQDTPLAGFFAQARSLRLADGPDEVHKGLIARIELSKRGFSRS

SEQ ID NO: 15903 - protein, 185 aa, Myxococcus xanthus
MTDRAIVRKAMHIIGVEDSAAAIDAVIDAYVAHLAEEVHKVDDQRYLVFPGMREAVKEARSRSGFAVGLGTGNVREGARVKLERVSIYDQFDFGGFGCDNEDRTELIRCGAKAGAAKLGVPVEECRVVVIGDTPKDVHAAQGVGAECIGVGTGTFSVQALLDAGATVAFPDFSHPQALEILLGGR

SEQ ID NO: 15904 - protein, 274 aa, Myxococcus xanthus
MATQRIFITGGASGLGKAIAVRFARAGWKVCIGDVNDTRGEEALKELSALAPQAHYLRCDVRREEDLREALDWLTAQWGGVDVVINNAGVAQAGAIEDVSIDDWQWIIDINLLGVVRGCKVFTPAFKKQGHGHIVNVASMAGLLDVPLMSSYNATKAAVVSLSETLHNELAEYGIGVSVVCPSFFKTNLGDSLRTTDPRLGATMARLLERSAITADDIANDVFDAVAERGFYVLPHADGRRTWALKRLLPRELYSWMLRRNTRGMRPGSQPKAS

SEQ ID NO: 15905 - protein, 279 aa, Myxococcus xanthus
MAREYTVQQALKPAYPVVPTMVGLCQDPAVLGSDFYVMERIEGLIPRKHLPRGLALDAKQTRTLCLNVIAKLVELHAVDPVAVGLTSLGKGPGYPTRQVEGWSARYEKARTWNVASFRYVRDWLKANTPADIATCVIHNDWRFDNVVLAPEEPTRIIGVLDWEMATLGDPLMDLGSALAYWVHADDDFLMRSTRRQPTHLPGMLRREEVVAYYLDQTKLKPANWTFYEVFGLFRLAVIAQQIYYRYHHKQTRNPAFKNFWVLVNYLGWRCHRLIRKGAR

SEQ ID NO: 15906 - protein, 230 aa, Myxococcus xanthus
MGVVYLVRHGQASFGAANYDQLSETGLVQARVLGESLRERLPRVDAVVTGTMARHRQTAEACLAALGCGTVAVQTAGFNEFDHEEIVARHTPRYADPEVLRAELSQTESPRRAYQALFADAVARWVAGQHDAEYTEPWSAFGERCRRAMDALIQEMGASKNALVFTSGGTITAICQELLHILDEHAFRLNLTLANCGLTKVIYSERGRYLSTLNEHSHFEGAQRALLTYR

SEQ ID NO: 15907 - protein, 122 aa, Myxococcus xanthus
MLPEEDFLAAEEALRRAMLSSDVAALDALLSDDLLFVSHTGRVLDKESDLESHRSGALRLTRVDFTDTHFRYLSAGAVVVVHAALSGEFQGTRFEGNFRYTRVWQVVDNAPQVVAAQCTAVG

SEQ ID NO: 15908 - protein, 245 aa, Myxococcus xanthus
MDALGLDDVELVTGGSLGGMVVLCLTALAPERFARLFPIATTESATAWVVGLNHVARQALLMDPGFPESPHRGLELARQLAMLTYRAEPGLEALQGRPAEWSSRALHPMHSYLEYQGQKLESRFDARAYLAQLGAMDHHDLSRFPGGGLARIRASALCVGIDTDQLFFPSHMATLTRRLREHGLHAEHATLSSQHGHDGFLLEWDAMAVLLARALALPTARGPEHAFPRWPEVRPALNPPCGTKA

SEQ ID NO: 15909 - protein, 301 aa, Myxococcus xanthus
MNPVQDSARLARLDLNLFRVFDVVLRERNLTRAAEVLFLSQSAVSHALARLREQLGEPLFVREGRGVAPTAFAERLAPEIREALALFEQAVHRGRGFDPRRDVGQFTVAMNDVLEPSILPLLVARLRAHAPEVRISSVRLDRARLERDLASGRLDLSIDVEQQTGAELKRTALLQDTFCVVSRSRRKLDVAKYMAARHVTVSSRRTGLAVEDLVLSRLGYQRDVVVRCQHYEAAFKLVGDSNLLLTMPRRRAAELHALLGNHLLPMPLSLPPLELHVYWHRQTDADPRNRWLRGELLALTG

SEQ ID NO: 15910 - protein, 286 aa, Myxococcus xanthus
MASSDYARIEQAILYLDAHAREQPSLDDVAAHVGLSTFHFQRLFSRWAGISPKRFIQVHTLSSARRLLDERRSVLETSLEVGLSGSGRLHELFVTLTSMTPGEYKLGGEGLTVRHGVHLSPFGACLLAVCERGICSLHFLAGESEEEALASLRKQWPRATFEASAEDTAPWMERIFQAGHGGSESSPLSVLVRGTPFQVQVWQALLRVPSGEVTTYEDLARAIGKPKAMRAVGSAVGENPVGLLIPCHRVLRKTGVFGEYRWGASRKRAMLAWEDLRYDGAPLSGM

SEQ ID NO: 15911 - protein, 138 aa, Myxococcus xanthus
HLSGKVRETFKAEALSSSSLAAPAMALAAMDPRIVHSFHLAKHLMVVSLFEARLGLPGLTISDVRDRFGCLALSLQRNGEERLHPQGEEVIRPGDVLSLQASYPEYRRLRAFTHEAEPPLWSHHAPVAVVTPSSRKVG

SEQ ID NO: 15912 - protein, 62 aa, Myxococcus xanthus
FGSEVSGLAPEVMEGGTGTAVTIPMLEDRRSLNLSTSVGIGTYEALRQVRFTGAGRQAPPAS

SEQ ID NO: 15913 - protein, 545 aa, Myxococcus xanthus
MEEALRRSKSLPLEPWLADEPPLSTPPTRTQDRVPIQDEQWHTEAISLSAASDTESELPLLEVEPEPELWAVAEPLPAPATRPAAGEPPVLTPVAEDDADILLEATPDEEDDASWATQPSAPPPRPATPKTGDEDLWRIVAFDKDEGADTLTASFEAALLQVDTHLESLVRSDVNQANVDFDEPPVEAIVEATIEPVAPDSSGAFPGDNSWPTGQTDWDEPSGDLDDWDFDEDDLAADPSNPDEAAKLRRQRLLRRAMENMGVLGGRPPSAPGATPSPTSEPAAAPAPAASEPPRPDEARLAQQLEQRFADVQAKRDHFYVLGVSQDASRDQVKTAFLNLAKIFHPDRLPPSLPHMAPKITAVFEAIREAYEVLYDDTRRKTYQQNLQAQQTLPKPPSSAPTAPVLRPQGRADSNADDLYKMGEVFFRKRDFTTASDHYDRAHALEPKPLYLAARAWAIYMDPARKADMAKAKQMMADAVRADPNCDRAHYQLGVIARVEGDMDRAERCFREAVRANPKHLEANQELRLIDMRKKNPPKKGGFFR

SEQ ID NO: 15914 - protein, 467 aa, Myxococcus xanthus
MSSTLESYELIRFAEAFEARLATAGEMLTGRPGLDAEKGWLTTALELVRTARAPTEGVLDRVKDLPELEEAREEYAFHQQGMWVDVLEKLLAGITFTASSRAPVIEALFPHLKFPQLRRAPREAVLEYATSYERRTKSAYVTRIFARDDFALVRPVMEQVLTAHTAWRSSHEPSPLTLEQEALLREELVSLGRKLEQSLRQARLLAEAALVPAPTVYEAAGLNLKPKRRAGRGLTLSDDALAGFDEPTDSMEPTEAELAEVAALDSGGDIASPAAVAPSAARGDTAAEGGDSSASAASPEVLQDSGAERSDNGGDSGPVGGAELKAEGLSSTTETGVASASTASESNDGAVAQPEAAAEGAELADKAAVDKAARVDGGDASPQATDGAVTNDSRPATTDEAAAQARNEASSTAPRGARRGRKKADAAEPAATEATEPPASGAAQVPRIRKKKASSQSAPPTPDADTP

SEQ ID NO: 15915 - protein, 545 aa, Myxococcus xanthus
EVSLKKAGFSVTTAIHGKDALEKVQISPPDLVLADTKMPEMDGFELCKTLKSDERFKFIPFVFLTSQKSVEFKVRGLELGGDDYLTKPIYIKEIVTRVKMILQKAEKERIEKRETTKGGFAGSLADMGVVDLVQTFEIGRKTGLINIQGERTGTVYFKDGRVIDAELGRLKGENAFYRMLNTFEGQFEVQFSALDRPERIEISTQGLLMEGMRRLDEWGRMLEQLPPLETVFEIDYHQLADRLSEIPDEVNGLLRLFDGKRALSRVVEDSDFEDLAALGIISKLYFEGLIRELGNAPLEPVQSSKPGIEQWLNTAPPASATVEPAPPAPESPPQPIPEAAVPEAAPEPVAAAPEPSPRPMPQSVLAPPAGVEDEPAAPSPAAPAQPADVVVFHARPKRSDTPEYTPEVPVTEPVPEAPAQEASAFLVEPPPAHRAVEHARRSLLLDWSRVDTEGISAPTTWGPGSGWSHTPRAHGAASSAFAASAPAFEPVPSPRAPIFGGAAVAPNPFPPVPPPTPAPPSSEVTLVSGSGYVTPPIPSVQVDAD

SEQ ID NO: 15916 - protein, 178 aa, Myxococcus xanthus
MLFFEPRFFRQPSLFSETRLFGYASLFCETCLFRQTALFFETCLFSETCLFRQATLFFETSLFRESSLFRETSLFRQSSLFSQSTLFFETSLFRQTSLFRQTSLFRQTSLFRQSSLFRQSTLFFETSFFGEPSLFRQSALLFEPLLFRQAGLFREASFFGETGLFREASFFGEPRLFS

SEQ ID NO: 15917 - protein, 178 aa, Myxococcus xanthus
MLFFEPRFFRQPSLFSETRLFGYASLFCETCLFRQTALFFETCLFSETCLFRQTTLFFETSLFRESSLFRESSLFRETSLFRQSTLFFETSLFRQTSLFRQTSLFRQTSLFRQSSLFRQSTLFFETSFFGEPSLFRQSALLFEPLLFRQAGLFREASFFGETGLFREASFFGEPRLFS

SEQ ID NO: 15918 - protein, 141 aa, Myxococcus xanthus
SRAQPPDTVVLFDGVCNLCNGTVLFIIDRDPEARIRFTALQSQRAAALLAPHGVVPKEEPDSFVLLQDGKLYERSTAALRVARMLKGPWRFLYAFIVVPRPLRDLVYRIIARNRYRWFGREAQCRIPTPELRARFLPETTP

SEQ ID NO: 15919 - protein, 454 aa, Myxococcus xanthus
MVKLPIYMDNHATTPLDPRVLEAMLPYLREDFGNAASRNHVFGWKAEAAVNKARQQVAELIGAAEQEIVFTSGATESDNLAIKGVIEFYKSKGDHIITLKTEHKAILDTCKRLERVRQERLDELKLLRLAQLAGQDVTEDNQSELLSKYDVDSDETYRKWAELPTGGARVTYLDVEPDGRVSLEKLAAAMTPKTVLVSIMFANNEIGVVQPIAEIGALCRSKGVLFHCDAVQGIGKVPFDVEAMKVDLASITSHKMYGPKGIGALYVRRRPRVRIAPSIDGGGHERGMRSGTLNVAAIVGFGVAAELARKELPEESARLLRLREKLRKGLTDALDMTVINGSLEHRLPGNLNISFAHAEGESLMMGIKDVAVSSGSACTSASLEPSYVLRALGVDEELAHSSIRFGLGRFTTEEEVDYVVNLVVDKVRKLRDMSPLYEMAKEGIDLKSIEWTAH

SEQ ID NO: 15920 - protein, 133 aa, Myxococcus xanthus
MAYSDKVIEHYENPRNVGTLDKEDPNVGTGLVGAPACGDVMRLQLKISEDGLIEDARFKTFGCGSAIASSSLVTEWVKGKTVDQAMTISNKDVARELSLPPVKIHCSVLAEDAIKAAIEDFKKKRAARQAKAS

SEQ ID NO: 15921 - protein, 132 aa, Myxococcus xanthus
MSEQATQETTQRQAPATAPVAKPPKGITIADSAVARLKELLEQRQTPEAGLRLAVKGGGCSGLQYSMEWSEKSRERDKIFEKDGVRVFVDPKSYLYLIGTELVFEQTLMASGFKLDNPNIKAACGCGESFSV

SEQ ID NO: 15922 - protein, 86 aa, Myxococcus xanthus
MDLRESLDTAMAKKDLGRARAMADDVEARKKAALTEAAESLRTLEAGEPGDGGQEQVRKASHALGRVRYFTRFLEQVDAFEEEIQA

SEQ ID NO: 15923 - protein, 298 aa, Myxococcus xanthus
MKDAGVTAGELDGVILVGGATRVPAVRRYVAELFGREPLGDIDPDQVVALGAAVLANLLTTADRQDDVLLLDVIPLSLGLETMGGIVEKLIQRNSTIPTTAGQVFTTFKDGQTGLDVHVLQGERELVEDNRSLARFTLSGIPPMAAGMARVEVRFQVDADGILSVSAQEQSTGVSQSITVKPSHGLTDEEIEQMLLDSIDYAEDDIQARQVREQRVDAERVLAEADRQLGEHGSLLQEGERATIDSAIARVRELMKGEDHLKLKEAVHALDEASRPFIERVMNQAITQVVAGHSVEDY

SEQ ID NO: 15924 - protein, 125 aa, Myxococcus xanthus
MPKVTFKSPLAEVSADVPTGTTLLDAAEACGAQVGHSCGGVCGCSTCHIWVRKGLDSLSEQTDAEADRLDMGFDVRPYSRLSCQTELGAEDILVEITEESLTAFMDENPVLRRSLEAEGKWPLKK

SEQ ID NO: 15925 - protein, 854 aa, Myxococcus xanthus
MADVALPIDPLLPDIVSTLRGARSLVLEAPPGAGKTTRVPRALLQAGLGQGKEIIVLQPRRLPTRLAAQRVSEELGERVGESVGYQVRFEDVRSAKTRLSFVTEGVLGRRLLSDPKLRDVGIVVLDEFHERHLSADISLALLRRLQETARPDLKVVVMSATLEAEPIRAYLGGCPSLRSEGRRFDVSVEYLPAPDDRHLDQQVLSGIKRLFTQGVDGDVLVFLPGAGEIRRARDACAEFAERHGTDVLPLHGDLSPAEQDRAVRRSSRRKIILSTNVAETSVTIDGVAVVIDSGLARVASHSPWSGLPTLKLSKVSRASAIQRGGRAGRTRAGHCLRLYTQHDFDGRPEQDAPEIRRTDLAETVLSLRASGITDLAAFPFFEPPPAASLDAAETLLRRLGAVDPAGTVTEVGERLLRFPVHPRQARIIVEGERRGVGAEAAVLAALMGERDIRREARANLGQGGRPAAVVSGPSDLLELFERFREAERANFASGRMHSLSLEAGAVQSVDRVQKQLRRAVRGQGPRPQRPEDVEQALMLSVLAGYPDRVARRRRPRAPELLMFGGGSATLSDVSVVQDADLMVAADAEGRPGKGAVVRLASAVEPEWLLDLYPDTLEEVDTLQWNAEARRVERLTRLSYGNLVLEETRTPAPASEATARVLVEAALAAGPGKFADPEALEQWRTRVALLAGAFPEAKFPTIDDTFLRDALASLCSDARSFKDLEGVSLLDALYARLTSEQQRLLATHAPERVTLPGGRGVKVHYEPGKPPWVESRLQDFFGMAQGPNVCAGRVPLVLHLLAPNMRAVQVTTDLAGFWERHYPAIRKELCRKYPRHSWPEDPQHAQPPAPRPPRR

SEQ ID NO: 15926 - protein, 472 aa, Myxococcus xanthus
MAVLAGVAVAVVPWLLPTGPNANLDAARFLEAGSLAVGAAVVFAGGLLTALTPCVYPLIPITVSVFGARKTEGRGRALLLTSSYIVGMGVVFSALGVLAAKTGQAFGSMLGHPAVVTGLAVFLLLLATSMFGAFELALPSSFQTKLNAVGGAGVAGAFLMGSVSGFLAAPCTGPVLTGLLAFVAKSANTTLGASLLFVYALGIGVPFFLIGVFTVRLPRGGVWMEWVKSVLGIMLVALAFSYLKDAFPWARDVVKGLGLHVGRVPGAVIAALLVAVGVALGAVHRSFKEGAREFSFKALGVALVVAALVLRGGALDGGPVGTLWVSLGLAEPARAPAWQWHHVMPAKQATFSPEAFDQVLAQAKAEGRPVLIDFFADWCAACKELDRDTYPAQQVISESDEGRFLNIKIDATNSEDSLDALLERFGVEGLPTVAFISPEGKVLTQPRVTGFLAPSPFATEMKKARCTDANAC

SEQ ID NO: 15927 - protein, 633 aa, Myxococcus xanthus
MSAKQTARTKEAQETGEGGGRTHLVRMDGGGGGKLEQPRYVDGWRAGKPAEDPEKMKRWGLVTARPSEFLVHMRRGRVREVSGQGASCFKLPGDSVAIVPTSIQRLQFTADQVTHEKVGVQVTGLAVYRISDPLVAFRMLNFSFPERAQEKLAELLREMFVGAARRLVANMSVEECLSKRKEGIAAELVREIAPVLSGRGRLEDQTDAGWGVILDTIEIQDVRVLSSTVFANMQARFRHEQERQAREAELAKERFVHREETEAERQLSLQRLAAEEEVRQKKQTAEEQARLEALAVEARVAEAKLAQERTLKQEQATVEREVALAKMAAEQEVRQKKQVADEQAKLDALAAESRLADAKIVSERALAVSRAQVEMEKLQREQDAEVARQRVALEKLKREQDTEAGRAKLELEKLKLAQESEAAQAKIELVRLQRAQEAENAKAQMELARQQREQALELSRQRHEQEVELAKLRREQEEAGAKAQLELERLRREHEQATVWHEVQMAAHQQEAERLHAELQVVQARRSIVETEVVIAELSVRKDRAQQDLELGKARALRDIENSVSPEVIQMALAQQLPQVAAAFQQKMGEVHVTAVDGANPFGYIAAAVEGVMGLARSAGLKTPASPLAPPAQ

SEQ ID NO: 15928 - protein, 237 aa, Myxococcus xanthus
MKRTLDAAIAEGVERIVFIASVYPYGRPRTDVVNESHPRVPHTNKGRLRKAQEDLLLAADKAGSIQVTILRLPDFYGPGVENSFLHRAFVAASQGKRAQLIGPIDTPHEFVYVPDVGPTVTALMDHPGAYGRFWNLGGAGVTSQAALVEDIYAQAGHPAKYSVLGPGMVRLIGLFSPFMRELGEMHYLHTSPVIMDDSALRALLGDIRKTPYRDGIRQTLAALSPAPVATGHPHPAP

SEQ ID NO: 15929 - protein, 80 aa, Myxococcus xanthus
ALKPLSPSILGVFRGLAVGERSVTNAFDHVPASIVLYQKNLERFARTREELIEQIGITVMHEVGHLMGLDEDDLWQRGLD

SEQ ID NO: 15930 - protein, 495 aa, Myxococcus xanthus
HPAFDPAERLGPRINKDRPRLFFTNHAPKWPLGAGYTQLVSWDTEENRLNHWKLMDAATGEPVVASSLHQIAATRDYVVLLDSNFPINFWQIAAQAAVPFLPRVQRAVEWLTASPAAPQAVFWVVRRADLQTSPGTLDPENPPFVSAHRFQAGGGGLHFAAIYENPDDVITLVAAHSPTEDLSHTLQPGELLINGNRVQDWQAGMPTAVPVTRSSMGVHRIDMKRLRIQSNLYSHDDFTWGLTVFSNAGLVNGELEAHFRLLGHVMNAKLPTKELALYLNSDGFTADMVPEALYQLYKPVVGDKSALPIRDGRAASFCKFFVDSGRFEGYVLPTGWFGFAPQFVPSARFPQVPHWKGYVVALVVSDPTPDLPENSTGDEVWIFDSEDLAKGPICRLGSRNFDVGMTLHTTFLPPGLADLLEGQPPGNVAPYCVDVRQDLDMDAIERTYLEWPQTMLPRVPRVLFAPWRLGVKWALNFPKLRQVLQEDVYPHFPRK

SEQ ID NO: 15931 - protein, 768 aa, Myxococcus xanthus
GRLVVDAVPRMALVLGDQPPVPELGPAESELRFQLVLRKLVAALATREHPLVLVLDDLHWADSTSLQLLRLLLTDRDIEHLLVVAGCRSEELSPDHPVESLARALHDHGTPVHRIDLAPLSPKDVTRLVADVFPPAEGQPDAQLDDLVLSLTEGNPFHAVQLLRTFYERGLVRFDAEGGGFRWDASALRGQDFSDGVVALLTSRIRELSSAAQALLPIAAALGHLFDLHSLAIVLERTDEEAEKGLVEVLQAGLVAPIDDADLDSGGTYQFTHDRVQQAALELIPADVHPEIHARIGRLLLRHTPPERLDEELPELVSHFHLALPVLHDEQERHRVAELDLRAGRSAKSRGAWSAALRLLNTGLSLLGDDGWRKDRRLTFDLHVDAAEAAYLDADFDLMERLAAAALAHAVDSAEEVRVQEVRLQCLAHRGEHSRGVDLGLEVLRKLGQPLPANPKQPHVLAAVAKTKLRLGLRKPEDLAALPECTDPLLLATLRLLVKLSSLAFMARPLLFPLVVLRVLQLTIRHGATGVAAFGYVGYGLMLSVHLGNPEEGFRYGRLALKTLDRFQAESLRAMVTFVFNLFIRHWKEPLSACVGDFLAAAQKGQETGDIEYFGYASSAGCATALIARDGLADGGPRMDRYRDILATHRHKNVLFTEYMRHTLDSLTGAFTGNVEAREEELVTPYRQLDYGNGIATCDVLRTLRRWLWGDARGALESAAAVDAQVELIAGQIYLPWYKFFQGLALMAVHPTLGPLDRIRSSRALESI

SEQ ID NO: 15932 - protein, 683 aa, Myxococcus xanthus
MGWDAFGLPAEQHALETGTHPADTTAKNVATFKRQLKSLGFSYDWSRELSTTDPEYVRWTQWLFLKLFDRGLAYQAELPVNWCAALGTVLANEEVIDGKSERGSHPVVRLPLRQWTLRITAYADRLAEDLSGLDWPETREKQLHWIGRSEGAEVDFAIEGSADRLRIFTTRPDTLFGATYMVVAPEHPLLERFATAERRAEVLAYREATASRSELDRTALTKAKTGVFTGSYALHPLTGARLPIWVADFVLGSYGTGAIMSVPGHDARDFEFARAFGLPVVEVVSVDGALNETGTWTEAFVGDGVAVRSRFLDGLRTPEAKAAMLAHLEREGLGARRVQYRLRDWVFSRQRYWGEPIPIYFPVELAEGSSDPRIHPHTIRYDQPLPVSEDELPVRLPELEDFKPSEDPAGPLARALDWRFFQRDGKWYARETNTMPQWAGSCWYYLRFIDPKNTQAIFSQQAYDAWMPVDLYVGGSEHAVLHLLYARFWHKVLFDCGLVTHAEPFKKLVHQGMILGENNEKMSKSRGNVVNPDDIVRQFGADALRMYEMFMGPLEAVKPWQTNGVIGVRRFLDRVWNMLAFVTEDAGGAPAELTEDARRLLHKTVKKVGEDIEALRFNTAVSAMMILANALAELPRVPLEAARVFARILSPFAPHLSEELWHRWGASESISLQQWLEYDPALP

SEQ ID NO: 15933 - protein, 417 aa, Myxococcus xanthus
MADHVELRPVAPLYRMRFPDGSTFDYHTDREAMRQSVRRLSPRDEAGFLALCARVERMYEAGIGPLMSTPVPDVLSLAPFTPALVRDEAFRSMFGLVSKHIRDERLQQALSFHPLLIVGSPFPTASAVYTSIQFVERRWGAFFPVGGTGALVRGLVELLESLGGEVRYGSEVTEIALEGRKATGVRLGDGTGLAADVVVSNADAAWTYRYLVPGHVRKHWTDERINRARYSMSAFLWYFGTRRQYPEVAHHTLLFGKDFRGMFSGLEGPGQPSADPLLYLHRPTATDAALAPSGHDAFYVLAPVPHLGTGAEWKQRAEAFRRELEARLSRTVLPGLGSELMTSRMATPEYFRDELRSFKGAAFSFAPTLWQTTFLRAQARSEDVDCLYMVGAGTHPGAGLPAVLCSAKIVDTVIPPT

SEQ ID NO: 15934 - protein, 62 aa, Myxococcus xanthus
MVESVLAMSASAHLADGLGGFTYADLDTPLFIASHPFQGGARYAGARLELPTDAPGHGVTLA

SEQ ID NO: 15935 - protein, 122 aa, Myxococcus xanthus
MTLAVCVRCGNSKVGAFTPCTGCGLAPAAHGTERELQARSLLLTERYLPGGELEEIGRKIRKGEPVTYDAGLLAQITEDLRTQKLPIVSKSSPGCSVALWAVVGVLLVLAVGFLLMSRLRGP

SEQ ID NO: 15936 - protein, 349 aa, Myxococcus xanthus
MRFNRLLALALALSAMPATAQPELFFGNGQAPVFREEDLDKRFARSKLNQGLKQGTQDAGCAQVLGAMLTLMGETGVLLHKRDENFMLDPVLVNALNTQLVNQRFPGNAFLVAMVRRVLIDRKLPQEWLVTAQALAPYYPAIDMGRLRFLANGVQPLDSFLVTLPALRERYAQEVQRATSVGASTAEALFRENYLDHEVAFGALELVDVKLEKPKKKRLKKDEEPEAPYMLARLLWVEPEAPTTERFEFNFGKAPKRPRVEITAKLQDTQYTDLNKLLKGSRVLVRGRFWEYKKGLTSIELRDALIFPERDWTKTPSLADPAAVASCPLAVNDLTGLAPMQPGAFGTHR

SEQ ID NO: 15937 - protein, 511 aa, Myxococcus xanthus
MANQDWVTRLLTGRATADKQLNVHLSERDGGSLHDKMRQAYWWITNNAVICPYYDLEFGSSASLKTPAGDELHLPEDTSYSSFVLIPLLTLFTCRRALLVGGPGRGKTTSAILMALLSGMGRDEVHRGIQRGHPQLSIADLLGAPLPSDMLKAEDLSAVKVSWRKWIGQRVKIIDEYNRIPTKTQSALLSLMAEGYAEMMDQYVYAGRSSWFLTANDDQGGGTFQVIEALKDRIDVVVRAVPFNSGFMDQLLQRLEADKSPEELLPKEIVFTPGELERAYAAILEVEVPKDVLERIAFFLGQLDFCRMASPRFEFKHKDTLKLAGQTVAAVCNEQCPLDKKVHLCTQTENGVSVRAYQTILHFAKAMAFFRGHSAVELEDFRQIAPWVLHEKLVPNPRSAFFEVKGHRMLLQDRVAWLRNMFDMAMGHYDTHAPIRRKVTTLRHELDKGLSGVDLRTTEKRMNQVTVLMKELLTRHELSGPVYEDVIHLKSLYSRYRNYATWLKENPGGRP

SEQ ID NO: 15938 - protein, 275 aa, Myxococcus xanthus
MSTFTDELEANARARFVRWDSALWRELTGGAAQRLGQALFEAGTPAAQGEELLRAYLQLGAEAIGLGYLYPTSAGRQNFFTLAWSDLIPRLLAAVPSAERSQVFAQLWNLGENLESAPPWVQRIFWRVGRELTSLQDIEARLRETSSVALEPPDAPLAARAQAHWVDLSKEDSRFLPGPIHFLSPTVVCVHDRHRQAVAGRDAATQGIWLAETPVRLGAMGCREVPEQTHVESPHLDEALREDPRADAWFATLSNDWRVVATLHTSQHVLVFVPE

SEQ ID NO: 15939 - protein, 374 aa, Myxococcus xanthus
MEQRYPGVRAEARMFAQTFYALPSGKLQFLYFCATFIRYIEKPADLEFSLPLGGDVSVPDVDDLDAAIHGSSRWDDALDEAEERGWLAPLSTRSKEKDELDSIHRVTEHLPGKQGGRLRQALVAKHYRRLVDQHILKLPTTPSQPEPYLRTTPQAWEYGDDPSSIDWTLTVLSQGHLAAVSPLRRELEADLPPPSELGAPSVEIYLDTSGSMPNPELSLNAMTLAAQVLSASALRKKATVRGIVYSHGNPQVSPWMYDEEKARDFLLSYIGGGTQFPFDVMDALSRERPDALRIIISDSDFLANVTAERPLAPVLESIRRSRLVVAILALPDELRARQALAPLLRERRFRLVVVRWPSDFAKAAADLAQALLEN

SEQ ID NO: 15940 - protein, 187 aa, Myxococcus xanthus
MAFDIREIQTQLEAAPIVSPYSHDLALAIICDTFRLAKVRPPSRADWGALEDQARSPLWREQVVMLAHVLVSSALRQETVQALNKNDDATTLLQRFFQDVAPLTAEMIRSNTFRREEFIRKWVRVVGGECKGESPKGSVARIEQLDYRKAEAEMRRAEEARKKEADKRQQALREAEQRATEARGWRE

SEQ ID NO: 15941 - protein, 293 aa, Myxococcus xanthus
MWAVLRFLVARAGAVLPSHPRVVLLDALPGGLEYSVRLPILHDGALHRISVLREDALQRLRRVRPAVLFSDPEGLRWLAAQRDVPSPELVLTSAQHLPAGLRAELANAVPAPVLNYYATTETGPLAWECLRPEAPGRFHVLAPDVWLEPEQDEVVVTRLRPSVLPLLRYLPGDAGSVRRDACACGFHGWTLEHFGGRGASHFATPSGREVDAWALAWVFKHHALRGFRLTQVDVSHFQLELAGASHADVAPLRERLTGALRNLGWTQARLDVCHVEVSALAVGTKPQPFRRLR

SEQ ID NO: 15942 - protein, 429 aa, Myxococcus xanthus
SFIPATPFLFFFGAVMVSGWWGGWGPALATTLLSVVVVDFYFLEPLLNLMPGTGGAVSLAVFVVLALLMTKLNVMLRKANAERARLLERERAARSEAEAGQARLHALFRDAPAAIILMHGPRHIYSFSNTMNNTLMGTDTLVGQEASKALPWAESRGFITLLDEVYRTGVPFTGNAVPFPRKPPHDEIQETYLNIVYQPTRNEQGEVDGIAGFGFDVTDLVRARQRAEALTHELQLAEARDWLLAESGAVLASSLDDETTLRNMAKLVVPTFADWCLVDVAEPDGTFRRLEAAHFRLEDDALAEDILRFGMQPSGNPGHPPTGALLKAETVHVERLTRERIHELAHDAEHARVLEAIGPVSFIAVPLIARGQVLGVLSFIHAHSGRHYSTSDLAFAKELAHRAALSLENARLYAEAREAIRLRDEFMSI

SEQ ID NO: 15943 - protein, 178 aa, Myxococcus xanthus
MADPNLPLFCIGDVSSLWLVVHAFERDAVRIQRGTQARITFAAFPGQEFMAKVGHVGQRVDATSRTIPVRLELDNADGQLRPGMSASAYIPLGDPGAPITAVPAAALQRLEGGWVAFLPTDTRGVFERREVGRGRTLGGDVEVLTGLKPGEQVVVEGAFLLKAEAEKLSGGGSDGHAH

SEQ ID NO: 15944 - protein, 295 aa, Myxococcus xanthus
MATAHQRDAERRVLGDVAARFLQALHARERLSLAREAEAAARETANSAQRRFEAGDVPVVDVNVARVSLARMRAEVATAEGDEAVQLHQLRAMLGLPLTHPLAIRGELRVLALQPVTEAKTDTVAARPDIAALEAELAQADADRRMGRASVWPDITAGFLYQREIDEIAYLGALSVPLPLFDRGDNARVTGEARVRRLQSLLAAARLEVDVQVEAARVQHRKRLEAVTLLEADALPLLSDNESLARRSYEAGEMGLAEFLLVRRDTLEARAAYLDSLLQAALSRVQLAVETGALP

SEQ ID NO: 15945 - protein, 84 aa, Myxococcus xanthus
MPTLTGAVGEVCTQSCPDDDDQGQCAPDCIDCTCCAHVRTVAAHAPPLSFVLLVSRPLRVAYEKAEPLSADGRDILHVPIAPLA

SEQ ID NO: 15946 - protein, 135 aa, Myxococcus xanthus
MHHTATNNGAGDLSWMRNPQSKVSAHYMVDRDGKIYQLVGDDKRAWHAGKGELHGVPSDINNRSIGIEIVNDGSGKTPFTEAQYKSLTQLTGYLKQQHNIPMKNIVGHADVAVPKGRKNDPAPNFDWNRLRKGIS

SEQ ID NO: 15947 - protein, 76 aa, Myxococcus xanthus
MALIERIEVFVKSQRPALSMSLRGHLDATVEVERTGPREVSLRIQGRHRPVAAEDLSRLRDALESLGLKLSSLRAE

SEQ ID NO: 15948 - protein, 989 aa, Myxococcus xanthus
PISSSLLSAPKVKAVRGQSMFGMSFIYVIFEDGTDMYWARSRVLEYMETARGRLPAGVTPMLGPDATGVGWVFQYALVDESGKHSLADLRSLQDWNVRYALSSVPGVAEVASVGGIVKQYQVQVDPNQLRAYGVTLGEVTRAVRESNEDVGGRVMEIAGHEHIIRGRGYIRSTQDIENIPLKVSADGTPVLVRNVATVSLGPDIRRGVAELDGKGEVAGGIVVMRYGENALTVIEAVKERLEEVRAGLPEGVELVVTYDRSGLIEESISTLSRALVEEMLVVSLIIFLFLMHARSALVTIFTLPLAVLLAFIPMYYQGLTANIMSLGGIIVAIGAMVDASIIIVENIHKKLEAWEAEGRPGERREVIISAMQEVGPSIFGTLLVLTVAFLPVFTLEATEGRLFKPLAYTKTYSMGFAAVLAVTLTPALAVLFIRGRIRREDENPLNRWLVALYMPVVRFVVRHAKVVVALSVVAMAMTVPAFMRLGHEFMPPLNEGAILYMPTSPPGMSITEATRILQSMDAELKRIPEVVSVFGKAGRAETATDPAPLSMFETTVVLKPKSEWRKGLTWEALLTEMDETLQYPGMPNIFWMPIQTRTEMLATGIRSPLGIQVFGDNLDTLEQAAVAIEKAVAQVPGTRSAFADRSTGGFYVDIEVKREEAARLGLGVKDINEVVMGAIGGENVSQTVEGRERYPINVRYAREYRDSPELLKEVLVPTPAGAQVPLAQVADVRFVQGPPMIRSEGGKLVTYVFVDTARPIADYVKDAKAAVAREVKTPTGVRVEWSGQFKYFERATEKLKVVIPVTLLLVCLLLYFSTKSVVEMGIVLLAVPFSLIGAVWLLYLLDYNMSIAVWVGLIALAGLDAETGVVMLLYLTLAHKKADQEGRLRSMADLTETIVDGAARRIRPKLMTVMTDMIGLLPVLWSTGTGADVMKRIAAPLVGGLVTSFLLELTVYPAIFALWKRRHLPQEQPEEGTGEPPLPAETQTA

SEQ ID NO: 15949 - protein, 204 aa, Myxococcus xanthus
MSKRDKLQDSELVVAARALDAELARFESQAEQLEKAPLQSEKHLERASAMLQGLADLDEQLRGRVTALVGAISKVRDRQQAQAEAIHLRAQELQRRTEVFKDLLVRYGALGQNAGELNVQMQQFAQQRQAAKTPEENAALAGTFQALQERMSLVADEAHSLAQAAEEQAFLDVAREADSLRQQLLSARNKMSLLHNSFGGGAAS

SEQ ID NO: 15950 - protein, 90 aa, Myxococcus xanthus
DTMFATATPFGPGGVQAEVRHGKNLADAARLARVQHYVYSSVAGADRLTGIPHFDSKHRIEMHVRRQRPALHHPRAHLLHGELRQKHVRR

SEQ ID NO: 15951 - protein, 133 aa, Myxococcus xanthus
MRYFSVEEANRLVPLLTRTFERVRPWVERAQQLADELGAAPKPNDPSLASLRDERDTLLERIRGELLQLQEMGLEIKGADGLVDFRAHRGGEQVYLCWRFGDPAVSHWHALLDGFSGRRPIESPDDFAPTYLS

SEQ ID NO: 15952 - protein, 167 aa, Myxococcus xanthus
MAAYAGRADAQAGEVLESYAHAHNERVRRERRPGKPLRTRGRCFDLQAIFTRLNASWFDGRVQVDVGWARKPAGTKRRSIHVGGYDARLREIRIHPALDRPHVPAFVVDYLVFHAMLHADLDDGTGNEGRCAPEHTSAFREREALFPLRDTAQRWLGDNHASLLRGR

SEQ ID NO: 15953 - protein, 164 aa, Myxococcus xanthus
MLACVDVDYRPELTVAGCVLFRNWTDGHEVSHLVEHGPPAAPYEPGQFYRRELPHLLRVLARVEVPLEAIIVDGYAWLGEDRPGLGAHLYEALNREVPVIGVAKTAYVTTGPSVPVLRGKSLRPLFVGAAGMDAATAAEHIRRMHGASRTPTMLNRVDRLCRTS

SEQ ID NO: 15954 - protein, 399 aa, Myxococcus xanthus
MRQVEALLRADPAVEKVERRTQDYGLDITRAGSDGTFFLDNLFADTRELPPEQRVQLIQRYLRALWQESPDSLHWEQARELLLPVLRASTFGMSLQKPAEADREMVGRRTLPFLRELLVMDLPESAMFVQRRHLETWGVTEDEAFTAAHANLARLPDEGVELYDEEHGPLWTVETRDTYETSRLLRPGFLASFASRVEGRPIAILPERSTLLIGGDARPELVARLTESAEREYAAASRCLTPALYTVDDAGRVVPYVHPGQDVLANRVRLAHVRLALAEYSAQKEELDALHAEQEVDLFVASYSATARKRDEFPISWCVWSHDVDALLPEADMVAVRPAAEGDEFFTVPWREVQRIAGRCLTPVPELWPPRYRTTETPSLEMVKQLRAAQVTFENFQAP

SEQ ID NO: 15955 - protein, 174 aa, Myxococcus xanthus
MDSGYTLYDSAFRESWWGGFETRLLDAVNFCYVNFMRGVTPLPKDSPQSRALYEYLVSISPSPSAPARPFTVVKDIVEVTRGDVTRGQQVYVEACQSCHGEPHTGAGRLTELASILPEVTNDYDTLFPGVPKSLVVIEKVRHGQFFGVGGNMPLYSLESLSDEDLGALLAFLAL

SEQ ID NO: 15956 - protein, 102 aa, Myxococcus xanthus
MFGAFTADGRTLYMPYQLVDALAVIDPETGTVLREVQLADAGCLNVHQVTLTPDERIGLVVCEGDHVGPGTLHAVDLTEGTVVGTVEVGIFPDSVSILRGQP

SEQ ID NO: 15957 - protein, 224 aa, Myxococcus xanthus
MSDTRSPQVLPTRKHTQHLERFSEADIPTERGSLRTIVFRDKRNGREHVALVVGQVSGHEGVPVRIHSECLTSEVFGSLKCDCREQLDRSLDFITQAGQGVVLYLRQEGRGIGLGNKIKAYALQSKGLDTYEANRQLGFADDLRTYDIAAEMLRSLDVRSVDLMTNNPLKIAGMVEEGIPVRRRIPSRTEHNPHNVDYLRTKRERTGHLIELFAEDDDTEAKTG

SEQ ID NO: 15958 - protein, 130 aa, Myxococcus xanthus
MAGRVLFFLQHATYEPAFQAATMGITAAAMGDEVYFVFAFDALRQLVGGAYGQPSSAREHEEFARAESLGVLAPPHMLAEARTLGARLIACDTTVRICGYKPESLEGTLHEVMGMASIWRLTAGARVLTL

SEQ ID NO: 15959 - protein, 166 aa, Myxococcus xanthus
MVPPYFPVTADGVFRAQLTYTDLAATQTLKLGPATVHTIELNHPGGNMGYRVECQGRSVVYATDLEHGSDMDAAFYAFAQDADVLIYDAMYTEDEYHGRTGPARTGWGHSTWQAAVHAADEAGVKKLVLFHHDPSRDDAGMDRLLRQVRKHRPDAIAARESLVIKL

SEQ ID NO: 15960 - protein, 357 aa, Myxococcus xanthus
MNTITVYRLGRVEYEDGLALMHLFSESRRQGLSGDVLLLLEHPPILTLGRAAKRENIVASDAQLAKEGAEVFETNRGGDVTYHGPGQLVGYPIFLLPEDRRDVRRYVRDVERSVMQVLAQWGITAGPIPKWPGVWIGAEGAPDARKIAAIGVHLSRWLTTHGFALNVNTNLDHFQLIVPCGIREAGVTSMQRELGRALPMAEVEEAIANSFCTVFDSERVDAPPPMRTVSIAVVKGRGPEARVLLVRRRPERGGFWQVLTGRLEAGESPAQAAARELEEETGLRVPLVDLDYRHAFALGEALPPQLVEENGFAVHVPPDADVRLGAEHDAFEWVDVPTALERLPFQGLRETVKRATA

SEQ ID NO: 15961 - protein, 530 aa, Myxococcus xanthus
MAENPRELIRAAQSAETQGDVARAVECLQKAAELCRQAGNPSRALQLLRHAQRLDGSRADIADAVNRLEWMPEPSLTRSGADADDEEALPASGVVHSLESEVLPDVVHRQRLIEDALREAALHAGDDAPRDAAQAWVIETEVAEDLQRLEAQIARIAGVVAGAEDSSSPPDATVDVRGGVASIPGDGVGEQELLGVEEPTTQLASSRMAGEAEEAPAGEDILTDAQPRRRREARLVERGPTRADAALDAWCSFCCRPRTDTGGLVAGPAGAFICKNCLFESQSLLGDVTLVPPPTVSRPERPVTPALGLVGQGVTQALLTQSLEAHARTLLVIGPEGSGKSVWFQQLQREAVGVITPVADLDLTASSRTLLVEDVDRLDATSHAALQAFLARDSRPVVLLSARGMRTEARGLSLRGDAYSVSVSTTAALTQAVRGTVPTDILEHVQVLLSLQVPTPSEFVEIARQRLASREPAVSVSEEVLMALAQEASRSPRAGHELHALLNRVPTGTWSLAPTVKPSPTRKARKKRTS

SEQ ID NO: 15962 - protein, 416 aa, Myxococcus xanthus
MAIFEFKLPDLGEGVMEGELVKWHVKAGDSVKEDQVLAEVMTDKATVTVPAPKAGRVVKTHGNEGDMAKVHQLLVTLEVEGAAPAQAGGHSEASAPAAAPVAGGHVGGAPASASKVLATPVTRRMAREHGLDLASIAGTGPQGRVTKADVVAALEGGEKNVVAAPAEQKARPAAPAVSSGAADERVPLRGLRKKIAEKMVRSKFTAPHFAFVEEVDATELVALRARLNAQLAAAGENIKLNYLPFIIKATVAALKKFPHLNANFDEASQELVVRGEFNIGMAAATPDGLTVAVVKSADRLTLAELARETARLGAAARDRKLKMEELTGGTFTISSLGQSGGLFATPIINHPEVGILGVHRLKKRPAVVGDQVVVRDMMNLSLSCDHRVIDGSVAADFTYEIIKYLEKPDLLFLAMA

SEQ ID NO: 15963 - protein, 309 aa, Myxococcus xanthus
MATPDRFPLPQVTETTRKPEWLKVRLPHGEGYERVKAIVKRTKLATVCEEARCPNIAECWGGGTATVMLMGEVCTRACRFCHVKVGAPPPLDPMEPIHLAQAVKEMDLEYIVVTSVNRDDRPDGGASHFASAIRELRRESPRTIVEVLIPDFKGVEKDLTTVAEAKPHVVAHNVETVERLTPTVRDRRAKYHQSLRVLEYLKNRPEGLYTKTSVMVGLGETDAELEQTFKDLRDVGVDVLTLGQYLQPSQYHLRVERFVTPAQFEAYKTLAESYGFLYVASGPLVRSSYRAAEFFMKGLMERERLERLG

SEQ ID NO: 15964 - protein, 186 aa, Myxococcus xanthus
CVLKRHIHAERGYIKVDSMLRTSEPNVYAVGDIIPTPMLAHMASAECVVAVEHIAGKNPQPINYDLTPSATYCYPEVASVGLTEKKAKERGYDVKGGIAPMGAVTKASISNEATGMIKIVSDRKYDEVLGVHLIGPHATELLAEACVALKLEITTEELANTIHAHPTLSEIVHEGAEATLGHPRHF

SEQ ID NO: 15965 - protein, 113 aa, Myxococcus xanthus
LRGPSTAWAKHRTVENGLTVDASGAVELSTGTIPFTGAAALARVLATSDDVGDCVPLQLFRFAMGRDESPVDEHMLADMRSMFRANPEWRMGEALVGLVRSPYFVHRRTSSPE

SEQ ID NO: 15966 - protein, 405 aa, Myxococcus xanthus
MLAPLQPHRDRLLVLDGLDYQVLYEQGLTGHEGGPVTFLTGSKVNTGSGDHLPESASLDQVLGNHIGGGTRFRSLQLNAWEQFGGQHVYNSISFTANGSRVPFERDPANVYQRLFGDAPSPTADPAQVASNRARRKSLLDFLMKDATRLRNRLAGAERQKLETHLEALRDIERRLGALAVDPTPLPKQQSGEAACGGGAAPPSYGLGGLGNLNNMPTLTRLHMDLIARAFACDLTRVVTMTIPGPSMPWLGIHEDTHNDIAHLLDVQEEPRRTTIRGKMVQVQRWYAEQLAYLMTQLASIPEGSGTALDNTLIYWGNELGDASGHMNVRVPTVLAGGAGGRFRMGRFLRVRPAGSNPLGGWAGPGTRLSGAVAHNKLLVSIARAFGVNVNTFGHPDYTGELPGLT

SEQ ID NO: 15967 - protein, 223 aa, Myxococcus xanthus
MAVNAWRKGLPGLVVATGLVVAALVYALRQDPEPVTPGSPAVIEQAATPLAPASVARTPPPPPQATPPPLDLTRPPEEVPDENAPKVHPVDLQVIRAKLPDNLYWRMGAPTQDPAELERREAESRRWNELYGKVLSADATVEQIREYYGHRRQVSEDFITFSTEVLSRFGDVLPERDRGLYELSINMHRTRLAELPAQEQDALDRREAQERRREAWRQGLQSP

SEQ ID NO: 15968 - protein, 387 aa, Myxococcus xanthus
  unsure (1)..(387): unsure at all Xaa locations
MAHLAVPILGDACSVDLPMPDGQVRRAAAAFSRQEMVAPAQDFQTRYPIRLEXAAGIGKVLRTGVTEFTPDFPAMLAAAQGGSSAYRRDVEALGISAYIIVPLISRGRVLGALTLLNSESRRRYTEADVRLAEDLARRAATSLDNGRLYTEAQEAVRARDSFLSVASHELNTPLTSLMLNIQALRRDMEPRASNGPASPEALSTKVVAVQRQVSRLSSLVRELLDVSRITAGRLRLEREDLDLAALTREVVPRFTEDLARAGCALHLEAGGAATGHWDRLRLEQVLQNLLSNAIKYGRGRPIEVRVGADASRACLSVKDQGVGIPPEGRARLFQRFERLASERHYGGLGLGLWIVKQIVDAMEGRILVESVPGQGSTFIVELPRHPA

SEQ ID NO: 15969 - protein, 595 aa, Myxococcus xanthus
MRFFRLIALALACGATSACSGFWTRGAPPEPIHITLVGINDFHGQVEPHRTPLKDGQVVEEGGAATLAAYVARLRAANPGGVVLLDAGDMFQGTLPSNLTEGAVVIDVYNHLGVDAAAIGNHEFDYGPVGPGSMAQRPGDDALGALKARIGQARFPMLSANLRDASTGARPAWTGNDGTYLMKVKGVKVGIIGLSTEDTPKVTNPANVSSLRFLPLAPAALEASRSLRARGAEVVVVVAHAGGKCADLSNPRDTSSCDEGDAEILSMLKRLPPGTVDAIVAGHTHQTMGHFFAQVPIIETTGLARSLGVVELFVDPDSRRILPERSRIQAAIPLCAKVDATQGTCDGRRLRNEPQVRLEPASFMAEPVVPDAQVAPLLAPALELAREAQNRQLGLVAATPLARGYTEEGVLGNLVADVLRASANADVGLMNPGGVRADLAAGPLTFGQVFEVLPFDNTVAVATLTGPELSRLLHLAYGNDMGSVFAVSGLEVTLERCPGPGRLSGVALAGGQPLVVDSRKMYRVALPDFLARGGDGLEPLLSTVPPERIEMTPVDGLDLREALVAYGKARGGTLEAPDLGRVRYTGVAGCQQEAR

SEQ ID NO: 15970 - protein, 363 aa, Myxococcus xanthus
MSMLVFTSEEALHLALTSGLVPAEVQAAPARYHRTPDGALHVLPEVMPAKDVLAHLASLGVHVTRSRAKEATPVLCWAELVTARRVPLESAPTGPVLFLPPSADALLPLAGEMLRLGCDRQEVCFAQASGGSGQRALLRAMAPPYFTLTSALDASGPLRAFVPAVPGQHAVWVEVGYTHPLARTLQAPAGTLLLVRGEGPWLTAPDGPWTDLYQHTDLRLPAPGKDWTPAPTPGRLTVPLRLTRAARTEPASLWVLLENALAQVESLVHTVPEPLLAQLRFAVTGPPEAPCIVLRARAGRERPPELGLSGMAYAPLPQLADLFLPCDGLLEPPVRRARLRALLVPQADTVTWLHPTGGGGFRA

SEQ ID NO: 15971 - protein, 158 aa, Myxococcus xanthus
MASPTDTSAPVTITQIQSEAELMQALAIREVVFIEEQAVPEGIERDAEDAHAYHVIANQGGHAIGTGRLVMLTQPPANQEGTWGQIGRMAVLQAHRKARVGSMLLTSLEEEARRRGVNGIMLHAQLYALEFYKKHGYLPVGGVFEEAGMEHLEMHKRF

SEQ ID NO: 15972 - protein, 269 aa, Myxococcus xanthus
RGVTQRLLLMGLVVLACTASASRKVLYEKESPYTLISVTEDEEGRRYLGFDASGALQSVVRPGKPLDLVLPYTQVSMVGLAYVPAPKRILIVGLGGGAMPMFLRKVVPRAHIDVVDIDPDVVTVARRYFGFREDTHLRAHVGDGRRFIEAERPAYDLIFLDAYGPDSIPEHLATQEFLAVVRAKLSPQGAVVGNVWAFPPNRHYDAMVHTWQVAFTQLYEFIVPQSSNRILVGVGYEEKVAAKTLEARAEKLERTRGVPFDLSGLVDRV

SEQ ID NO: 15973 - protein, 336 aa, Myxococcus xanthus
MDNLTHGLLGLAIGAMRKPDVRPGAPERASPTDRAVLVASVLAAELPDLDTLLARGDAVTVALQAHRGLSHALVAAPLVALTATLAARALFRGARLAPVFLTSLASVVFAHLLPDLWTGWGTRVLLPFSDSRLSLDWTMVVDPWVTLPLLAGAILAWRRRADWRRTLLWSAACSVAYVGFRVATWAVLTQRVEAAYPAAQAVRVFPLPFSVSTWRYVATLPGDVFAAGEVPLAGPPSEARRAEATGSTLPEHVQAVPTVREALAWARFPLVHMEPLAEGGQKVRIADLRYHLRGEPTLAFVIHLDASNAVTHAQLERGGSASELLRKWRSADTAAP

SEQ ID NO: 15974 - protein, 412 aa, Myxococcus xanthus
MSSIVDVLVDGGNNYNWQKVELPGTKCGNGSQFKFWVHRTGSPNLMFLFEGGGACWDYDTCSGRAGLLGAANPNGIADDYITQFTAKYVSPLVNGADPGLPGRSKTDLVTKGWNIVYVPYCTGDVHVGNNVATYVDSTGQNPPLTWHHSGYTNTLAVANYAKTQFPNVQKMLMTGYSAGGTATAAGYYFLRKAINPARGYLLNDSGPIFLAPNANFRSRALHDKIRQSWDLNSVFSLLPGTFSQSDFGTINRMVAQEFPNDQLAYTGYSRDYNYSRFSYDRFHSPNDKESVLGYWKQDQDALVTELNKCNNFSYFIPHERAINSSHCSTIITFIGAHACQQMEKKRYWYEYLEFPWSQTYKCYSEFVGMDTFLSRWINGNQRVRIYEPANGYNAEDPGMQIVAPLINGALGG

SEQ ID NO: 15975 - protein, 706 aa, Myxococcus xanthus
MSHVEASLPDHARAIIAEEEALLARVQSTLEAARRKSARGQDAQGLVAQLQVLRDDASTAAVADLPHIFAQMNQMRSLLERQEGVKLPDPQAPYFAHLRLNGEGGPRDYLLGRTTFADVGAGVRVIDWRFAPVARVFYCYEEGDDYEEYFGERLAEGSVETRRLVIIERGVLTRIISGALVLERLADGTWRSVSRDFATLQSGGAGTAARPEFLGTGKGARRIEDAFGVTAMLDAEQYEALSTGPDRPLLVLGSAGSGKTTVALHRLAKLAFDDPRTFPQARMKLIVPEEGLARLSRRLLAPLGLGNVAVQTRDAWLLATARSAFNVPGIKLWNDTPPLVSRLKRHPTLRRALAARVGVPKTDAGTTLERLRTRMADAYMDRRFLESVVTAAKGEIPRTAIDETLEHTRLQLATPLSKVLKDITDAERLITVDGRSIEDDTPDAMAGTVDLDDLPVLMFLKAQHTSLGLERLAHVVLDEAEDFSLFELFAVRQLLGKGKSCTLAGDEMQQTDAGFAGWPAVLNELNIRDAATCRLQVSYRCPRPVVELARQVLGAQAPEAAATGRAGAPVGFHHFPDEAQAQLFIGEALRDLVAREPHASVGVIASSPESAQAIYRVVADQRWARLVSDGEFTFEPGVDVTDVGSVKGLEFDYVILPDATARAYPVDDESRRRLHVAVTRTSHQLWVVSSGVRSHLVTQGGAAAPR

SEQ ID NO: 15976 - protein, 1058 aa, Myxococcus xanthus
GTLEGHVEPAHFEAAWQHVLDQHPALRTSFTWEELEEPLQVVHRAVSVQLTRRDWGHLAPKAQRRELTALLDADRQRGFALDQAPLMRLLLIRTGPRTHTFVWSCHHLLLDGWSLGLLLEECLDAYHALVRGERPSRGVTRPYRDYIAWLQQQSSGQAEHFWRERLAGFSSPTPLPVARATKAEGSWHGRSSLILSEETSEQLRALARTHALTPNTFFQGIWALLLSRYSGQSDVVFGTTVSGRPADLPGAQSMVGMFINTQPVRTRVDPDGLVLPYLQQLQREQAEARQYEYSSLVQIHGWSEVPRGQNLFETLLVFESFPFSHAETSPGGGATVTDVETYDFTSYILHIDVVPGPAFTLLASYDRRQLDDATLARLLTHYARLLEELAHHPERRLDELSMLPDAERRQVLLDWNQQRADYPFNSSIPQLIQEQAARTPDAIAVTHRDAQLTYRELNARSNQLAHPLIAEGVGSDIVVALLGDRGVDFLASIVGILKAGGAYLPLDPDHPAERLAQILGQSQTPMVVVSRERRALLDAALALLPAGARPRALEIPELLERQAPADDPPCRSHGRNLAYVIYTSGSTGAPKGAMLEHAGKINHIRGMIDFLRLGPADVMAQTASQCFDISVWQFLAPLMLGARVQILDTELTRDPASFLAELDRTGITVLEVVPALLTAMLEQLERMDPARLPMQSLHCLIPTGEVLPPALCRRWVKLYPRVPLLNAYGPTETSDDTNLYTVSQPPPDDEKRVPVGYALPNLTMYILDPRLRPVPVGLAGELYIGGIGVGRGYLNNPARTAASFLPDPFSALSGARFYKTGDICRYRPDGSIEFLDRADFQVKIRGFRVEPGEVESVLARHPTVRQAVVVARELPTRGKQLVAYVVPYEGTWPGAAGGGPRDGHEGITVLREFLQGHLPHYMMPSVFVVLPALPLNANGKVDRKALPMPDAAAAQEERAPSPPRSDVEERLVALWQEVLSRQSIGVEDDFFELGGHSLLAVRAHSRLRELFGIDLPLRTLFELTTVARLAEKIEALRWATSGPPKDEPEDVEREEVEL

SEQ ID NO: 15977 - protein, 185 aa, Myxococcus xanthus
  unsure (1)..(185): unsure at all Xaa locations
MAREESSRPFDLTQGPLVRTTLLRLAPDDHVLLLTLHHIVSDGWSETVLVREVAAHYTAAPGTGPALPELPIQYADFALWQRSWLQGEVLTAHVDWWKEQLAGAPXVLDLPTDKARANQRSQFGELYPIHLSKDVGGPFLALARQEGATPYMALLAVWQVLLSRYSRQERPAGGIAHRGPPPRRG

SEQ ID NO: 15978 - protein, 1803 aa, Myxococcus xanthus
QATGLTLRPADVDIATSRFDLGLALMDDADGLRGAIEYSTDLFEPATVARLAGHLRVLVESVAATPDQPLFTLEMLTPGERHQLLREWNDSPARYDGAGGTIAEVIARHASLRPFAVALECGDETLTFEQLDTRANQLANLLRSRGVSTEVLVAVSLERGTAWVIAMLAVLKAGGAFVPLDASYPAQRLAIMLEDAPPHLLLASRANHAKLPLPDGGLPTLLLEELDLSEWPTTSPVSDVGPNHLAYVMFTSGSTGRPKGVAIPHRGVLRLSHSEPFIRFGVRETGLVMAPASFDGSVMELWLPLLNGSGVVLYPPEAQASDLDTLSRVVERHGVTLIHFPAGLFSQVVEHRSDLLKKLRAINVVGDILSAPHTRRTLTTTGVPVTNGYGPTENSIISTSYTAYEASQVGASVPIGRPVSNTQAYVLDSQLQLVPVGVPGELYVGGEGLGRGYVSRPDLTAERFIPAPFATQPGARLYRTGDLVRWRPDGTLEFIGRIDNQVKVRGFRIELADVEAALRTQPGVLEAAAVVREDIPGDKRLVAYAMGRDDAPLDVAALRAGMRQRLPEYMVPSVFVVLPTLPLSTSGKVDRKALPAPDSASTGRDGHFVEPSSPLAQQLAALWAKELGTERIGLHDHLFDDLGGTSLSVVRIAKRMRETLNREVPVVWLFEHPTVDALAAVLERDAKVDEVPAAPARPEPASEPSAEAKHATGSGLVAIVGMSGRFPGARSVQDFWRNLRDGVESISRFTPEQLERLPGLPEGLELSQHPAFVPAGGVLDGIDGFDPGFFDLSLREAQWMDPQQRLFLQTAWSALEDAGIDPERTPEAISLYAGAIDSGYKDAVRATLPLDGAALFELYGTATHESLATKASFKLGLTGESVLIYTACSTGLVAVHLACQNLLAGRSGVALAGATRIAVPQRTGYVYQEGMILSPDGHCRSFDANAQGTVSGNGVACVVLKRLEDAQRDGDSIYAVIRATATNNDGRYKSGYTAPSVQGQAAVISQALARSGVRAQDIGYVETHGTATPLGDPIEVAALQRAYGLGVEHRGTIALASLKSNMGHLDTVAGLAGLMKVALSLHHGEVPPSLHFERPNPQIDFDASPFFVNTTLRPWPRTETPRRAAVSSFGIGGTNAHAVLEESPMAHSGSTTRSHQVVTLSARSAEALEAAARQLAGHAEAHAADLSLADVAFTHAVGRKAFEFRRTVVARDAADLTARLRKPYTPVKVADADVNRRRVAFIFPGQGAQQAGMGRELYEAEPAFRAHADACLALLEPALRERVREVLFAGPGMDAAAVADTRAALPALFTVEYSLARMWMDWGLRPYAVLGHSFGEYAAACLSGVLSLEDAMRLAVARGELMHRMPPGAMLAVAMPESQVLPLLTGRLSLAAINAPDRCVVAGPIAEVDRLQEELRRSEVGTVRMPAPHAFHSADVEPLMPALAEVVASLQRQAPTLRYASSVTGRWAQANELAQPDYWAAQMRQPVRFTNAVGALLEEGCSLLLEVGPGQDLTPLVRACLGRDKERVKAVATLRRGGTTTEHASLMTAVGELWTLGVSVDWSVFYGHEQRLRLHLPTYPFQEKRCWVEAPARPAPVAMPSLANGAGHGSLAAPHATSPRQVQVQETPVPAATPEREDAPRGDIEERLASLWRERLGLPFVGRDDNFLEIGGNSLMAAQLLNQVRSTFGVQLPLAALFEAPTVAGIAQRIESLLRQAPVVESSRELPIVPLPRNEPLPLSFVQERVWRLEQHLPGLSAYNIPFVLRLEGAVDAVLLERAVQEIIQRHESLRTTYDVVDGPPVH

SEQ ID NO: 15979 - protein, 479 aa, Myxococcus xanthus
MDAKGLRTFLEIPYDELEERNLKVKEQRLKHTASEKLRDERIEYLTKERAIKAVTVCFTDLEGRLHMLDYDKKFLIKSADNLTFDGSSIRGFSAQQESDLRLNIDWSAFYWLPSDIFGPGKVLVFSEVHERDGTQYHSDLRGRLKLLTESMYQKDGTVVHAAPEIEGFLFKGRDAEHHFHEKGHFDFISTGGYYHSLPGDVLRTFIDKVAEAQRAMGFQNEKDHPEVAPSQFEINFSYSEALIAADQIQLYKLLSRQVAAQLDCTASFLPKPVTGVNGNGMHMNLSLSKGGKNLFHDQNGPDGLSPMGWDFIDRLLTSANDICLTLNSSVNAYRRLDPHFEAPNQIKASANNRGAMVRIPFGNERSARIECRSVAPDANPYLVLYTLLRTGLEGPQPQEDAEAKRSRTRFLPDNIFDAIRIFKGSQFVASILGEGVQSKFAELKTTTAERSPKQLGTRVKYSEVKFHHEVTNQFLWNQF

SEQ ID NO: 15980 - protein, 495 aa, Myxococcus xanthus
MCAGCATLSRGFGATANEDTGEYETPEEELVYIVPAEDAMMVARRILEEQRYDVMEKEGGLEMFSSAHEPGKNMPGLRTIERYYIKGERLGPRQTVVRVFRLSYNEMETQLEIPPQAAGKREAAMFAVLDAHPFDATRDAFTYANGPNGPRAVPMEDPFKNAPGMERMRMVRGVRDLDIERTLLQRLEMVPALELVGSNAPVPIRSVTPEGGQTEQAQQAPECGTPVDGAGPLMAPGHVLLLADPLGTRELPAAALRMLCEATAQGLPVTLALSLPASEQPLLETYLASPGQFQDLQTMMSESPFWRRTYQDGRSSSAMLWLIEQARRLRASGKDISVVAFDAEKAQGNEREAEMARHLLAHQQTRAQAWTLVLAGGTHVRTAGVNWDSDYAPLGARLAQVLPSVRALDVGFTRGTQFSCRFNVWDPVECNVFAISPTKEVRQKPDIASGVRLFPQPLAEGFHGRLYVGALSASPPALHRLAPTTAAQTPPATSP

SEQ ID NO: 15981 - protein, 170 aa, Myxococcus xanthus
MKKSLSFVSKSVAALAMLSTLPAFAGTATYSGALCTSVSGFHSPTVFRSGRLLNSNANTLEVVCPIQRNVAVPSLNESLSVSVTALDPHLTENVCCTATVAEKDGTSLASSSACSSWGADTANHNSFSINLPSVFANINGYVSLRCVLPGQYTSGSSTYASVLASFVVTE

SEQ ID NO: 15982 - protein, 111 aa, Myxococcus xanthus
MAYVVADPCIKCKYTDCVEVCPVNCFYEGANFLVIHPDECIDCGACEPVCPTKAIFPETELPEQWKEYKALNADLSTKWPNIAEKKSALPEAEEFKSKDGKRSLLDPAPGS

SEQ ID NO: 15983 - protein, 203 aa, Myxococcus xanthus
MWGATPEATPARAEAAEARPGSPADLTSEVRALRAELEALRRGHGHLLQRVESVGRPAPLPGPEEAAAPETRAAAPTAQTLATLEVAREERRQELEAELQAAAHTEPRDREWAGPTEALVTRAFSGPDFAGSRLTRVDCRTRMCVLEVEHDAAEARAELLSSLLMVNGLQGQAVMRLADDGSRLASRIYLSRAGESLPMTLRP

SEQ ID NO: 15984 - protein, 120 aa, Myxococcus xanthus
MAHSQPSARDTRPLGSAPESSDSGASYLLVLEGDSTSRFALPAEGVVLVGRDEQADLCLRDDSVSRRHARLVLTEEGARLVDLGRHNGTTLNGRPVDTAQALLSRDVVSFGAVVAVGRTR

SEQ ID NO: 15985 - protein, 105 aa, Myxococcus xanthus
PQMKRHLIWGCAAMWAGPLLAGWVQFELFRDPIVMFSQSTLVGGILMTFGVCSQLMVRWRMPWVGTMVTVALVGLPLGWLSSDLLIAHFNHHLTTVVVPLPKEVG

SEQ ID NO: 15986 - protein, 265 aa, Myxococcus xanthus
MWVLETPAPTADARMAYGREPHQFGDLRMPEGPGPHPVVVVIHGGFWRAKYDLEHAGHLCADLTRRGFATWSLEYRRVGHDGGGWPGTLEDVARGTDFLRTLAQAHALDLSRVVALGHSAGGHLAAWLGARHRLRPGDALYSAAPLPLHGVVPLAGVVDLPRAFAHRLGDGIVETFLGGTPSSVPERYRTASPASLQPLGVAQVLVHGTEDDTVPVSMSEDFCARGRELGDDVRCVTLPGAGHFEVIDPRSREWPHVVAAVQSLM

SEQ ID NO: 15987 - protein, 235 aa, Myxococcus xanthus
MFAYQGFEIVPVIAGQVRSSSRTVPLATVGSLLVAVLLYVGLVWACVAALPELASQAAPLAAAAGVWGGPGLEGWVKAGTSVSALGICLGMMVTTPRYLSALASGAHTLLGLDGMSAGGVPVRALAVTWALVLLFVNLGDLSELFALSSIAVLMQYGVTSAALAALAWRRERGLRPLHALLAVPTLGLGLTLVAFGANPREGVTMALTLIAGVVLLRLSRPRASEPSAALRGEPL

SEQ ID NO: 15988 - protein, 2214 aa, Myxococcus xanthus
MRLTAALEANPEGPLAAEVLESLAELELERGEKLEAARLYARRAALMPEARAGAKLLFRASLLAAGTSREEAFLADALERDASYAPARQRRGELRLPTDARAALEDFEAVLALPPADGDAPRESERVALTRKAATAAVRASRTDAARRLLAEYSARAPEDLDARVELASLHRKAGAREALADLLVELWPRLSGEPRRAARRELAELSLGLGRATSAVDALRSLRLEEPQDTWAAQSLLDLLPPPGTGTPEEETERLELLSTLVAAASGEARAELLARRAVLHRAAGRVAAARDDFSEAAKGSRRPASLLLALTELARESGDEAAELDVWRRAVSADANLAARARERLLALSATLVEKDERALAREALGAAIGLELSAAERCDAFFSLAELARRDGQPEDEAAALAEAALQGPAPRRVEALLARAALLESSGRMADAGQSLEAALALAPRHAQATAALQRVLRTREDWAALAELLSTEAPHVAPAEAAAMYAELASLYLDRLSQPVPAEAALRQALRLSPSDAAVRRRLVSLVAERGELREAAALLETAAESATAHDAALLLREGAGYARGAHDLDKALKLARKAHALVPAQGPELASLAELLYLRGAVIEALPLQDALAAAADFRSAPEAAESTWLRLAELAEQTGETKRAVAAYRKLLVERPLCEAAVMRLAALLEKDDPRGAFDVRVTHAHALAPSEDTVQRLVELSARAREVLADAGVAASLLARAASLASEPLPLRRRLAALHRETGRTVELLAELRQVATLSLEAGDPDAALEAYQEEARLAVDLGRADDALRALADARDLLEARGQQSEAAACERYRAKLLRDVKLDPAGAEVALERAFALAVDLGTAKLGAALAERRDDAEAEARWLERALPLLDDAGEAAAVLLRLARLNLGVLSDVAKAEELLRSALRKDRALTEAEGLLEKLLESDGRLAELAAWYEECAEGEPDAARRAELFLRAAVLYRDRAGRPESAAAAFIAARGARPDDLELTAQAAELLHEVKRHADAAEFDAVLLEADPFREPVFARHLAFLDEAEDHQALAELMLRRAQRQEAAGAAESYLSAARAFRAAGARERALLCEDQAFELSPASAEAFERVRERAAGDVRRLADLLSQRAAALSTSEALPLLRERAARLLDAGEALLAAEAFDEYLSLAGDDVDALSARAELAAKGGGPVAARPYDRRLLDVGGDALPVPVRTRTWLRLGHASLGAGAFHDAADAFESVVALEPEGERGREALSLLAEVHSRTGNAPGLYRASLQLARHAEDAATAEVLYRRAADLFDDPKDAIDALLPLARLRPADASVIDRAVAGLHALGRHGDLLDVYASGAEAAGGRRAAELLLAAASVASSSLADEDAAWTLTQRAAEAAPEDLTALQALVTGLRQRGDSTRLLEALEQWVPRVEDADEAAVLRLELAELARDAGRVDVAREALEEVAARGASGAGYADALEALEPLLKDAPARRAEVQVARAELASGRERQVLLMAAARGFESAGQLPEALKAAKDAASVEPDVDAALRVAHLYRASGEAPRAARALLQAARLAAPEERPPLLLEAAGLWEKAGEHGEALEVFERIATEASDMLAPSELAERFGRLGAFARALEVGFAPAMASGDLTDALAMAAQAGDTARTREALWALAALADADPAHASALADGLRAEGDAEGLLELAGLSAARDAAFAVALRDEVLRSAAASVLPRLRALEELAPEPGFAARLTLLLPTLEKLPEALAEAVLTQVHAQPGTVRVEALAMAADGWPSRRKSLLRERYALELELGRYEACVRTLSQVAGEESDAVARAVLHLERGELLLSPLEQLPEAREAFEQALKDDPAQLHSLRHLLSLVDLGEEPAVFVSLVERLEQAAGVESGNTYRERLADAYEALGMVADAAAQLERLPETDERLARRARLAEERGLTGEALRLRERLTDEPAVLEAILRGYLDAQLVSPGARLAARLFEAGELSPEVTRMAAEHLSTVPEGVSLAVRIWPHLLREHPLDVDGWTLYAEALRALGRTEDSQRADGVGAALSSSDAAAPQAPVSTLPVPSGFEHRVPAGAVPVTAERLPRLAAALRPVLASLGAGSLQLVVDPVGGVEAYLASGDVLVLGAGALSCFGASELSYLCALALALGEDGVKLARPGPVPAMEAAAVAAFRAVPASLAAGRVLARLDAEVRGGDPAQVDVGAVLARGDTFRALALCVLDGV

SEQ ID NO: 15989 - protein, 201 aa, Myxococcus xanthus
MHVKRLALAALPVTAVAVAMACYSEPVYPGDQVLGSFRFEARLDAARTTCDASVPDFAQLNDAGVFLFEGTFSRDTDAGTGFFTVQGYSRDAGYEGQVATSTLKAVAPRASCGTGCEDSSIEETLRVTLFSDSQARTLSRDCRQFDGGIPDGSVPGPTENGYDVSLACGSLTDIFLPGTRNCNCQPTTCTTVYTVQGERRD

SEQ ID NO: 15990 - protein, 230 aa, Myxococcus xanthus
MVKRAVVLISGGLDSTTCLAMAKAKGFEPVCLAVAYGQRHAVELEQARKVAAAMGVTDFRVVSIDLRQVGGSALTADIEVPKDRPSDEMSHGIPVTYVPARNALFLSLALGLAEVVGSTDIYIGVNAVDYSGYPDCRPEFIRSFESMANLATKAGVEGAHFTVHAPLSGLTKADIIREGVKLGVDYGLTHSCYDPDAQGRACGRCDSCVLRKKGFEEAGVPDPTRYTESA

SEQ ID NO: 15991 - protein, 102 aa, Myxococcus xanthus
MPVPGYVANPRTGSNHNRGGAVDLTLTTLEGQAVEMPTPFDTFTRAAHHGYEGGTEASRKHREILREAMEGVGFKRNRMEWWHYDLPDAKKRPVLDVPFSPP

SEQ ID NO: 15992 - protein, 31 aa, Myxococcus xanthus
MPSSTLRSDYARAAPFTRLAYVASAFAEKLR

SEQ ID NO: 15993 - protein, 308 aa, Myxococcus xanthus
MTAWFVPEPLPAELAGMKVVAGDALEAKDYDLVFSAVEADVARELEPRLAKDIPVFSAASAFRYEDDVPLLIPPVNAAHAPLIREQQRRRGWKGFIVPIPNCTTTGLAVTLAPLVERFGVKAVLMTSLQAMSGAGRSPGVIGMDILDNVIPYIPKEEHKVEVETKKILGALRPAGDGLTPHDVRVSCTCTRVAVMEGHTESVFVSLDKKATVAEVTQTLREWKGAELARNLPSAAPRWIEVLDDPFRPQPRLDRDTHGGMATTVGRIREDGVLENGFKYVLVSHNTKMGAARGAILVAELLLAQGLVG

SEQ ID NO: 15994 - protein, 702 aa, Myxococcus xanthus
MRYALVPILLLCVALTTVGVGVFTLLERNREAQWHQFAVERQAQLDEATRGVAETLEDVAEDLRFAGELMSQPGTLAEHRREMRALLEAVGQYKVLIAYDANGKEWLRMLDRRMGKQVARAPVLAQMAEAARRALLRPPGDVTLSPPMEDGGLDSLRVMATALPVDEQGRPEGAVAVLVDTTSFFTPLRIVTSDPDARLLLLGTYGHPTSASDATLADWFRRLETEGAWVPGFTTLAARMREGERGALPLRAEEAERLGLGRSEAIAVFTPIRVRGGSHWAAATLVSTETLRSHQQALIWRLLAAALLVALFLVTFAVYVVLAQRRAAALRESRQHADQLAHLHDKTQKILDHIPSGVLALTVDGRISAVNQVLRERMPPDAIGAPLETAFPQAPAPVVSRIRALVEAAASESRAHGILGETLVLFGEEGRFNLHAVPLEARHPEVQTLLVVEDLSNVRALETQLLRAEKLATVGVLAAGIAHEIGTPLGVVRGRAEYVLGKLGREHPQGPGIAVIIEQIDRVSRTLRQLLDFSRLQPTAVRPVPLISLLQDVQELLRMEVERRGVRFEVTVPETLPPLAADPDQLQQVLVNLALNACHACGEGGQVTLAAAVPEAEPWGLVALTLRDDGCGIPREHLNQVFDPFFTTKKRGQGTGLGLTMVAHVVRNHGGRLELESEEGRGTCVTVLWPIAKPSAEERHVG

SEQ ID NO: 15995 - protein, 434 aa, Myxococcus xanthus
MLREPLTDAGYVVDLATGGEAAIRMARAQAYDAVLCDLRMEGVDGLDVLEAVRALDSDIPVLMMTAFGGVESAVEAMKRGAYHYFTKPFRLDEVLLFLERALKERRLQVENRALRRAAAERSGLGALVGRSAAMRNLYELIDRVAYAQAAVLLRGPSGTGKELVARALHFQGPRASGPFVAVNCTALPHDLLESELFGHLKGAFTGATHARRGLFVEADGGTLFLDEIGDMPLELQARLLRVLEDGEVRAVGADGSRTVDVRIVAATHQDLDARVREGRFRADLFYRLNVVTLLLPPLAERREDIPLLVEHFTARARARNPRSRMQSLSPEAVAALATLPWPGNVRELENLIERLAVMVASEVVGLEELRPHLPPEAPEVQPLVMAQHALWPLRRLEAEYIAWMVTRCGGNKTRAAEVLGIDVSTIHRRERERG

SEQ ID NO: 15996 - protein, 115 aa, Myxococcus xanthus
MDVLAELGIALESGAPAGGCPDLVLVHVERGESLQRRLQRARELSPQGPIIVLLPFADERLMGLALRLGARDCFALGGPLGELRRVLLAHVPGHPSSVFISPGGAVPPSTESPHD

SEQ ID NO: 15997 - protein, 165 aa, Myxococcus xanthus
MIEPLAVSAVPATPAFPDRPLVAPPAPSEVPLFQDAGLRVTTERIVARGKTLLLADVQRVETVRRTPRMVPVLATLGLCMSVGLPALSALSVSSSTAKGGYEAALIAVVMVIFGCIARLVLAEESYRLVLHTRAGSWRVRASKDPKSLMLLAGLIQDAVAARGQH

SEQ ID NO: 15998 - protein, 263 aa, Myxococcus xanthus
KAVVLRSFGEAGNLKMETMPMPRPGRGEVLLRVHACGVCYHDVINRRGNLPRTSVPAILGHEAAGEVIEVGPDTPGWKTGDRAATLQRMSCGDCALCRSGRNSLCKTDNRFFGEELPGGYAQFMVAPVGGLGRVPASLPWNEAATVCCTTGTAVHTVRTRGKVRAGETVLITGASGGVGLSSVQLARLDGARVIAVTSSEAKVQALKEAGADEVIVSRGLDFASDVRKRTQGAGVDVAVEIVGSATFDQTLKSHGARIPRGGG

SEQ ID NO: 15999 - protein, 246 aa, Myxococcus xanthus
MSATLDITPAETVVSLLARQIDDGGVVATGVASPLAILAIAVARATHAPDLTYLACVGSLDPEIPTLLPSSEDLGYLDGRSAEITIPDLFDHARRGRVDTVFFGAAEVDAEGRTNMTASGSLDKPRTKFPGVAGAATLRQWVRRPVLLVPRQSRRNLVPEVQVATTRDPRRPVTLISDLGVFELGASGARLLARHPWASEEHIAERTGFAFQVSEALSVTSLPDARTVAAIRAIDPHGYRDALVGA

SEQ ID NO: 16000 - protein, 265 aa, Myxococcus xanthus
MKTARWCSLEEAVASIPDGASLATGGFMLGRAPMALVMELIAQGKRDLGLISLPNPLPAEFLVAGGCLARLEIAFGALSLQGRVRPMPCLKRAMEQGTLAWREHDGYRVVQRLRAASMGLPFIPAPDADVSGLARTEPPPTVEDPFTGLRVAVEPAFYPDVALLHARAADERGNLYMEDPTTDLLVAGAAKRVIATVEERVAKLPRATLPGFQVDRIVLAPGGALPTGCAGLYPHDDEMLARYLSLAETGREAEFLETLLTRRAA

SEQ ID NO: 16001 - protein, 193 aa, Myxococcus xanthus
MQEIAAACRMTKAGLYHHIQNKEQLLFAIMNYGMDLFEEQVLSRVQDIANPVERLRACMRHNILLVTRGWSKEVIIILHEHATLTGETRAFIDARKKKYVDFLEEAFSQASQQGLIRPVDPTVGAFSFLGMVLWIYKWFKPDGRLTDEQIADGMVGMLFPPFAAAGDTAGQAGPSPLRMVPSVSATGTDSEDA

SEQ ID NO: 16002 - protein, 220 aa, Myxococcus xanthus
ALKDPASTLRQLDLASESSRGLRLTLVLERAQPHRLRWVARPFAIPGGMAQMLTLTDIGHTRPAREEREQQHRVDALTGLVSRRAGEEQVLREIGRCRRDGMPFSVLLADLVGLGRINTTRGFDAGDATLRDGARITEALGVPGGFTVRWEGGAFLLALPGVDAARAEPLRQKLRDTPGAPDVVSATVTVEGEEDPQGTLARAQAALIRAKTEHRPLRLA

SEQ ID NO: 16003 - protein, 269 aa, Myxococcus xanthus
RENLNVRSVIFRHALRLGVAAALATALVGALGLNHGYWVIITVTVVLQPYAGLTFQRSLQRIAGTLLGAALAAGLVALVRDPAIILLAIGGLFAVAMSIQPLSLSAFQVLLTPALVLLAELQSGDWELAGVRIVNTLLGGLIALTVTRLLWPSPEHLRLPEQVAFALRADREYLMAVAAAHSDSEPAVREARRKIGLALLAAEASFQRLLSEWTGPAKDLEPVMALLVYARRFTSAVTTLAASRADPASPRELSEVVRFAGGVLDELAA

SEQ ID NO: 16004 - protein, 383 aa, Myxococcus xanthus
MLHGQGLYLEEHDAFRRTVRAVVEKEILPFVKEWEAREAFPRELFTRFGELGFLGLKYPVEYGGSAAGELYEAVLLEELGRCGSGGVSAGLGAQFTISTGPIHQFGTDAQKLRWLAPAIRGEKIGALGITEPDAGSDVAGLRTTARREGDSYVLNGSKTYITNGVRADFVVLAVKTDPSAGHKGLSMVVVEKGTPGFSVGRKLDKLGWRASDTAELFFEDCRVPAENLLGVEGQGFAQIMGNFQWERLSLALGAVGAMEHMLETVLAQVKSRRAFGQSLHQFQVVRHKLAELFTARESARQLTYHALRLHVAGEWAVAQTSMAKKVATETCCRVADECLQLHGGAGYMMEYDIQRHWRDARLGPIGGGTSEVMNEIIAKQLGL

SEQ ID NO: 16005 - protein, 240 aa, Myxococcus xanthus
MYVGPLAPTDPHAHPTFQVLLSLDAPVRLRDARQQEVACQAAVVPPDAEHAIVEGALAAVLLHVPAEDLVGRRLATLGIGADAAAWGAAGERLRACGIGRLPVRWAEAEAQTQVLLRELQADAGVAKPTHPAVKKLLRLLPEALEEDVRLATLAPRVGLSVGRLSHLFSAQVGFPLRPYILWLRLHRAAEHLQQGASLTEAAHAAGFTDSAHLNHAFRRTFGLKPSEIAGVVEWVRPPSR

SEQ ID NO: 16006 - protein, 117 aa, Myxococcus xanthus
MSMKPKLRAAFEAELREAHEAESRSEHVRTWRHLERVHVLSQAHAGPHVRVHWRMLGFGWRRRNAAEWVGQVVRLLVAAPGSWLGRAPLGNTGGANVGILTPMPIPDDLRALLDADR

SEQ ID NO: 16007 - protein, 416 aa, Myxococcus xanthus
MLANMRDMAFFDSALLPEGVYYVSGFRTLEEHGLPGLLELLRREVRNHNASILVLDGLVQAQEAAGSSRDFKKFIHELQVAAGLTRFTALLLTSANGPAVHPEYTMVDGILELRERTQGVRSWRELQVRKFRGSPTLHGVHAFRITSDGLEVFPRLESRVQRTPPPDPGAHRLHFGVPSLDALFPEGLAAGSTSLLLGPPGAGKTLLGCSLLAEGLKQGEHCLYMGFYEPPNRLLGKVASAGIDLGGAMADGRLNFIWQPPSECILDVLADQLLSDVRRRNVKRVFVDGLSAMQQASPEPARINSFFAALTQELRCTGTTTLFGMETPRLFGPVLDVPMEVGPSAVAENLFFLRHVELEGRLRRLLSIFKMRDTHYDPTLREFVITPQGIEVLPPFSVAVDTLLTGLARHPGTGHF

SEQ ID NO: 16008 - protein, 121 aa, Myxococcus xanthus
METVLVVDDEQGILEALADLLREEGYRVLTASHGREALERMAELRPDLVLTDWMMPVLDGPALIERIRAEPAYKDVSLMGMSAVDVSALRHRYPGMPFLQKPFDIHALMRQVRKALDGKQG

SEQ ID NO: 16009 - protein, 274 aa, Myxococcus xanthus
MFYLLKLGPVPLSQGNTQVQVYLRISDSGEPAAPVFESDDGAGLRALLEGVDAAEVRCAPALAAAGAELGLAVAEPSPQALSSCAAIATFVAWGQRGLSGLGSDKALLFVQASTEYWDARPWTHWDDSQPFEVAVTGPMNHTFEGCVFHMGDGRAGLALYFKPGALQMLMEMQARGQGDAATSLPAIAVTLDTSPSYAVDALTAAGRAPRLPLPLKTGPDGISVPSPLESLVLVASLRAVARLSPEQREVLSSVVAGDEQMQVRVRAPAPRVRH

SEQ ID NO: 16010 - protein, 1173 aa, Myxococcus xanthus
MPVDKVGSAGKVADTLNEIIELSERMAREFERIGNVVGKEGRITQRGNVVGALGSWGDCVESVNMLVADLVQPTTEMGRVIGAVAKGDLSQTMALEVDGRPLRGEFLRTARLVNGMVEQLGAFASEVTRVAREVGTDGKLGGQAKVKGVAGTWKDLTDNVNSMASNLTAQVRSIAEVTTAVAKGDLSKKITVDVRGEILELKNTINTMVDQLNSFASEVTRVAREVGTEGKLGGQAVVRGVGGTWKDLTDNVNSMASNLTSQVRNIAEVTTAVAKGDLSKKITVDAKGEVLELKNTINTMVDQLNSFASEVTRVAREVGTDGKLGGQADVKGVAGVWKDLTDNVNSMASNLTSQVRNIAEVTTAVANGDLSKKITVDVRGEILELKNTINTMVDQLNSFASEVTRVAREVGTEGKLGGQAVVRGVGGTWKDLTDNVNSMASNLTSQVRNIAEVTTAVAKGDLSKKITVDAKGEVLELKNTINTMVDQLSSFASEVTRVAKEVGTEGKLGGQAIVRGVGGTWKDLTDNVNSMASNLTSQVRNIAEVTMAVARGDLSKKITVDVRGEILELKNTINTMVDQLSSFASEVTRVAREVGTEGKLGGQAVVRGVGGTWKDLTDNVNSMASNLTSQVRNIAEVTTAVANGDLSKKITVDVRGEILELKNTINTMVDQLNSFASEVTRVAREVGTEGKLGGQAVVKGVAGTWKDLTDNVNSMASNLTSQVRNIAEVTTAVAKGDLSKKITVDVQGEILELKNTINTMVDQLNSFASEVTRVAREVGTEGKLGGQAEVKGVAGTWKDLTDNVNSMASNLTTQVRGIAKVVTSVANGDLKRKLVVDAKGEIAELADTINGMIDTLAVFADQVTTVAREVGIEGKLGGQARVPGTAGIWRDLTDNVNQLAANLTTQVRAIAEVATAVTNGDLTRFITVSAQGEVAALKDNINEMIRNLKDTTRKNTEQDWLKTNLAKFTRVLQGQRDLLTVSKVILSELAPLVDAQHGVFYISERADGGDQMLKLLASYAYRQRKGLANTFKYGEGLVGQCALEKEPILLSDVPDSYIRIASGLGEEVPRNIVVLPVLFEGEVKAVIELASFHTFSEVHMGFLEQLTESIGIVLNTIAANMRTEALLKQSQALTDELRKQQEELTETNKRLEQQATSLQQSEELLKRQQEELP

SEQ ID NO: 16011 - protein, 299 aa, Myxococcus xanthus
LAADGRVVWLRDIVTVLSKDGRAHRLQGVMVDVTEQHQAQERLEQTVSLLEATLDSTADGLLVVDRDGHITACNRQFEQLWGLTGLAACTHDATLLAAVREKLKAPDAFLSRVQSLYEEPSQESFDIIELRNGRILERYSLPQRRRGLITGRVWSFRDVTERVHAQRTQERLLAEAHEAIRVRDDFLSIAAHELKTPLTPLRLHLELLKRALAAREPIAPERVDKAMAQVDRLSALVNDLVDATSVEAGRLKLQRKPVSLLEVANEACSEFRGLSAEHAFMCELPQEDLLVMGDRGRRS

SEQ ID NO: 16012 - protein, 572 aa, Myxococcus xanthus
QASSSRAGHGQAPQLENRVVADQPPGNIGIGHTRWATHGRPSDENAHPHTYKDVAVVHNGIIENHLSLKEQLRSRGHVFSSETDSEVFAHLISEELERGLELPDAVRAAIAQVKGTYALAVLTASDPSRIVCTKDASPMVLGLGQGQNFLASDVPALLEHTRDFVYMEEGDLAVITAAAVDIFNRQGQKVNRPTRRIDWTPMMAEKGGHKHFMHKEIWEQPRAVADTLRGRMLLSEGDVHFEGWNLSAEKVRSLTKITILACGTSWHSGVAGKHMIESLARLPVEVELASEFRYRDPIVDGTHLAIAISQSGETADTLAAFKEAKARGATAMAICNVIGSAMTREADFSVLTNAGPEIGVASTKAFTTQLVALFLLAVKLGRMRGTLSVPAAQEHLTQLTKVPKMIEDVLKCEPAVTRVSREYMDSQDFLFLGRGPMHPVALEGALKLKEISYIHAEGYAGGEMKHGPIALIDEKMPVVVIAPKQPHVAYEKIIGNIEEVRARGGKVIAIIDEDDEHVATLADQVIRIPAACALLAPVVATIPLQLLAYHVADLRGNDVDQPRNLAKSVTVE

SEQ ID NO: 16013 - protein, 247 aa, Myxococcus xanthus
MEGEDEAPLGEVAPWEAPPEPAPLEATPVPLLRGTPTPPLDLPLPVLVLTEQARRVPEAERPLVAARLNLQLSRMARTGGDRLVADTFLRLLESGRLTGLVDAKGRTCRAAAVEALLSLGFPYALEVQPEDLAHLRANTLQRKAHRLKPGTSMAVLVGGIGVQFVHEALVHKGDASLLTSQVGLSLLAMAALWLAPPRTPVYRVGLLMLSLVSLAGAVFALLGVAHTGLWVGLAGLVAAFLAALREG

SEQ ID NO: 16014 - protein, 363 aa, Myxococcus xanthus
MAVNQEKEKAIELAMSAVERQFGKGSIMRLGNDEPMMRDVQAIPTGSISLDIALGVGGVPKGRIIEIFGPESSGKTTLCLHIVAEAQKRGGICGYVDAEHALDVGYARKLGVRTDDLLLSQPDTGEQALEIAEMLVRSGAIDVLVVDSVAALVPKAELEGEMGDAHMGVQARLMSQALRKLTGTIAKSQTCVIFINQIRMKIGVMFGNPETTTGGNALKFYASQRLDIRRIGAIKNGDNVVGSRTRVKVVKNKVAPPFKEVEFDIMYGTGISREGDLIDLASNENIVEKSGSWFSFNGERIGQGRENVKEYLREHPEIAKDIEGRVLEKYGIGKSGAPVAAAPDESAPAEGGSEKRGRVKAVK

SEQ ID NO: 16015 - protein, 146 aa, Myxococcus xanthus
MTEAGGGEGTGIRLENSAGTTVVNNTVTRAVTALIIGHGTGGPTQSPVVQNNIFADAPIAVNMGPMAPGMKMGNNLFPAGAQFKKDGKPVDLTAYQSTSGDTTSRLGSADLGAAFAPGPMALDSGVDIGIPFCGGGPDIGAVELGC

SEQ ID NO: 16016 - protein, 259 aa, Myxococcus xanthus
GKTGLFGIQGSRYVVVKPIFDLYAAIKYMGTAGASEGIFGNEQQAWLQESVQADNAWKIIVSSISLTSMVFKLSEKADVPDPTLRQDFYFNVDQWDGFPTKKQEFLKFLRDSQVKNALFISGDIHASFASVESGIPALTTPAISSGSIKELAGLAVIGAGFSTGSTVYRYIVTELDKSLKEAHPGMAFVDGDAHGFVVLEVGGTEAKAAFHLIPSTEIAKDYSLRQPSELTGEVHPPRLHHQGRHHHLRLRRECLTCSV

SEQ ID NO: 16017 - protein, 579 aa, Myxococcus xanthus
MSEALAEYTLGWRSVWAAVSAATTTATPRTTHLRRHTARTYCMRPAGVRPPAPPAGSKPVPSTSRLPAVSRATPRPGGTPPTYTHTLGDRDERAVSPRGCPSFRGRLDALHPRFIADAGAHGRAACASQPGVTPPLSFVLPFTPETAAAASRFAHALPPGAEVVLAGEGSVDAASSPNVHVLTAPGGKGAAIRAALEKVSGAVTVLQDPDTSYSQDVYDALVRPIQADTADAVFGLRTAQGLAPELLADRALGHVTRFVTDVPLTDPLTGLRAFRTEALRSVTLTSDDDAVDAELVVKLAAQLFRLTEVTLPPGAVPRRTPAAHLSRLKTLVRYATVRDDADNQHEGYTTLERMDGAVHYNQWLGRRFREHLGRRVLEIGAGIGTITRELESGLELLIALEVDRFYVDRLKNLFRGKPHIRPYLSDVALADWESLKTERLDTIVLSNVLEHIPDDASAVRRFKQILAPGGRVVILVPALQQLFGAIDEAVGHYRRYTPSTLRAVLEENGFQVETLEWMNLAGLPGWFVNSRLLRRRSVPKLQLKLYDTLAPLIARAESHVKLPVGMSLFAVARATGGDA

SEQ ID NO: 16018 - protein, 564 aa, Myxococcus xanthus
MNSTPLPADAPPEPTTAPTPERQALPSRGAPRAVWAALAALYVLLFPYHPGLRSPNELCRLWQTRALVEYGTLHINQALNDYGKVGDLSVKDGKYYPSKAPLLSFAAVPLYAALRAVGGGHRHAVPEVPLVFFSRLLLTVLPTLGLLWLVRRYLRASLEPLVADALTVTYGLGSLAFSYSLLFMSHQTTAVLLFASFYALWRCARGEWRERGYVLAGAFAGATVAAEYTGALGALGLVLYAVLTIAFQDAPVRVRWARLGRAAGLATLGALPFLVALMAYHQVTFGHPLTSGYKYLNDAGYQPWHLGGFLGIRTPDPRAFALSFFSPLRGLFTLAPFLLLALPGLVLVWRRRSQSPEARALAWLSLALLLGYTYFTSSFSYDSWGWTTGPRHLTGLVPFLLLPAGLFLERLRAAGQGAWALGVAALLCAVSIVTTGVATFINYIPDDVSNAVGALALPLLRAGYFPPGVLTFLGLPAGLTGGVLAGLLLGTAAWVFVSLARKPGQTWPAAPALGASLAVLLLLGTAHVFTSRHDTADRNAVRFLKSVWLNAPERDVTFWPRGRG

SEQ ID NO: 16019 - protein, 174 aa, Myxococcus xanthus
MAEGRAVVLAMMNNPVAGGVGSYSQDVLQRLQVVAEQGLPDVAAGGVPWRELIPQTPYTLARGTAIDDTVPGASVEINDVEGEPIRAYPEARSVSFRVFVVEDDDDADRNADANGRIWLVSVGEVQPPGPGLPYRTIVRSLLEHSSTPGGLACSYGTKMGCRGTGTSSSGLPTF

SEQ ID NO: 16020 - protein, 499 aa, Myxococcus xanthus
MAAVAVAAAGAVLAQSPGGDTGSGGTDGGASSLALCIDTTDQDKQPDFSRDAGIPSAIIVTDDNPPKLRLNTNLNVLDPEKIILPFEQELTALIVDDRAGSGASSTLGWFYYDELIDAEYIDDNGTRENSDDDRLLDKNNNGVPDFHEDLYNINPSRYIGVAPRCPNRTFTHRRWGDAGTVTLREPDLLMGPCNSGSNYTANTGPRRWQGRADYPTRPSTGGVVGRAVRDFTSALFAYDPYHGRDNLQQSAVTSGIIDTYFSDQGLFPHIPNLLEPRHALNGNRGIGNLVFLSTDDDETSCHESESAECFAPRQGWTLDGNGQFMRTGTAWDKSDVADGIPDYKASAFDSAGRLITGKSTTAAITKAEDQVVPMGRLAGRREIVFFLVTYVEQVYGPATDSCFITRPTTDGREVQCDLWMHGDINVFFTKTPLNMDLRQGNDPLVVRQKNLRTNWGESRGVPPAGERPGLWRRRLPVRPDAGCPLREPPRGAHDCGRAA

SEQ ID NO: 16021 - protein, 214 aa, Myxococcus xanthus
ESPGESCQPTIHNINVSYKAQRSGEYGRASLIPMANAVIHGVYETPGRAWVADGGVDQVSIRTYDNRPDTIDRGHIYLKKLYEPATLAPYEPTQEVWDSGKWMRDLMRTLETRPGEPLDTRRLVTLNPANQQAIDVKDLMARANTTSPVFPDTYCTRRNGSVYLYDLDGRNGCTADDRVALRDWLYGWEDRQSSVIRNRMRTWPLGGVNLSLEH

SEQ ID NO: 16022 - protein, 162 aa, Myxococcus xanthus
DAMPDLPRMLGRALSRGVDIVHLHTPNPTWVLALDVVRRLPPVFITHHSDVIRQRVAGALFKPFEALLYARARRVLATSEAYVSGSPLLRAFRGKVRALPLGLDLAPYLHPCAAAREAEAHWRAQAAGAPLWLMVGRLVYYKGLFTALQALRRVPGRLVVVG

SEQ ID NO: 16023 - protein, 710 aa, Myxococcus xanthus
MQYVRAVWRRKWVVLGVAVVVAALTAAHTLRQPKVYSASASLIIDVMAPRFLDGEVKEVMGEERSNYWFNKEYYATQSQIITSRAVAGRVVDKLGLSTDADFLGMAHITDEKTRLQAMQGADAVALVQSRIRVIPARDSRVMNIAVDDFDARRAALLANEVAAAYMAENLALKLRTTEDARDWLEIRLAELESQSKTSELAVYDFKKDADMLSTSLESRMSIVSERINSFNLKLTEVRIQIAAQQARVEAIHRLRKASPEDETWAEALSGASDGPIQDLRRSYTELRMTCAELGERYLSEHPKLLECNRKLSVVREDFLKSLSNVVRSAETSLAESVAQEKNLVRLLDAEKSEAFLVNKKAIEFDRLKRDSDNNQRLYELVARRLKDIELSGMLRTSNVRVLDPARPILVPVKPHVRRNLAVGLVMGLLAGLGVVLLLELLENSVATQADVEERLGLAFLGVMPRLDGSKAPRERDLHVHREPKSTAAECCRAIRTNLLFMSPDNPFKTLVVTSSGPQEGKSTTCINLGVAMAQSGNRVLLLDTDMRRPRLHRAFGVPNELGISSLVVGEGTLDAAVKSTEVPGLFVLPCGPLPPNPAELLHTQAFTDLLKAASERFDRVILDSPPINAVADAAVLATKCDGVVLVLKAAKTNRESARRALRSLADVQARMYGAILNDVDLSAPRYGDSYLGYQGYGQYAEDSKDGVAQS

SEQ ID NO: 16024 - protein, 1371 aa, Myxococcus xanthus
GLIGGILQPLYAGFPVALMSPLAFLRRPRFWLESLSRFGGTISGGPCFAFDLCVRKVPPAEREGLDLRRWELAFCGAEPIRPEVMTRFSEAFAPVGFQREALYPCYGLAEGTLIASGGRKGEGVLTRMWDAQALERNEALAAEDGPGARPLVGCGQTLPEQTLLVVDPETRRACPPERVGEIWVSGPSVAHGYWERPEESEAAFGARLADSDSGPRFLRTGDLGLLKDGELFVVGRRKDLIILRGRNLHPQDLELTLERSHSALRPGCGAAFSIDVGGEERLAVMYEVDSRKPWTAEDVVGAVRRGLAETHEVQLHTLVLIEPGALPKTSSGKIQRRACRAELLAGTARALLTWSESEADAPQAKAPAPDITASQPLTVEALEAWLLARIASRLRVRPEELATDAPITSFGLDSLGAVELANDVETLGVVLRMEVLLQGPTVGALALTLFAARGASTGAELTRGEERTPAPLSSAQQRLWLFEQLAQGSAAYHLPAAVRLTGALDDVALEHAFAAIVQRHAALRATFRDEDGTPSQVTSSVPVSSLRRVDLRDVPVDAREEAALRLAHEEARAPFDLERGPLLRATLFQLDAHEHLLVVVMHHIASDGASFAILARELSALYAGDVSLPPLAFQYPDFARWRREVEADGALATSLDWWKARLAGGAAALELPADRSRPPMPSYRGGRVAVRFPEALTARLEALGRSEGATLFMTLLAAFEVLLARHSGQADFCVGTAVNGRERAGLEGLMGCFLDLIVLRASVSGSSRFRELLGQTREGVLAAFAHRGVSFERLVDAVQPTRDPSRAPLFQVLFVLQPEPGAGLALPGLESRRVEVDPGATPYDLTLSLARGPEGLGGWLEYATDLFDADTAARLVARLGVLLESIVADPDQRLAMLPLLPEAEQRQVLVDWNDTRAEFPEACIHALVELQAQRTPDAVAVVCGDGVLTYRELNQRANAVAWRLREQGVGPECIVGLFADRSADLVVGLLGIFKAGGAYLPLDPSYPEARLALMLEDSGASVVLAHRHLAGALPFGDRTVVPLDVAGEADAAPPGAVGPDNLAYVLYTSGSTGKPKGVAVPQRAVVRLVRNTHYVHLGPDETLLQFAPLAFDASTFEVWGALLNGARLAIHPPTTPSLEELGSFIARQGVTTVWLTAGLFHQVVDHALESLASVRQLLAGGDVLSPAHVRRVVERYPGCRVINGYGPTENTTFTCCHTVSPDEPLVNAVPIGRPISNTRIHVLNAALEPVPVGAPGELCAGGDGLALGYLNDPALTAQRFIPDPFSPVPGARLYRTGDRCHVLPDGAGRIPRAPWMNRSSSAASGLSQGKSRRPSRSIPPCTKRGSWPGRTAPERSNSSPTSSPGRPGNSR

SEQ ID NO: 16025 - protein, 242 aa, Myxococcus xanthus
SEDNLSEGDDLAIAIVGMAGRFPGSPDVETFWRNLCEGVEGIRFFTDDELKARGVPEERLRQPGFVRAGAVLDQVDAFDASFFGYSPREAALMDPQHRIFLECAWEAIERAGHGLDTESRSVGVFAGTSLSTYLLFNLRTHPELLESSDSFQVMIGNDKDFLATRLAYHLDLKGPSLDVQTGCSTSLVATHLACQSLMGFQCDVAIAGGVSVDVPQRTGYVHQPGGIASPDGHCRPFDAQAQ

SEQ ID NO: 16026 - protein, 392 aa, Myxococcus xanthus
MKIRHGNCLKLMFLAASLLLLSSVACSGSDSGGTPEPVQRLTPRPVPTPAPGPAESPTPTQTFATRPPVGVQAVAGTPVAALPDHTDHVNIEDPSPQPAVNATAMAVAAEAPVYTREWVVSTSGNDAGDGSAAQPLRTLNKAIGVASPGELIRVLPGTYAERVIIGDNAKPGTADAKITLQGEGSPRIVLGPGEHGLMQVRQPHWIIDGFEIDMEGQTPFAVTFEGDVTGSMLVNSDLHGGTGGGAVTTFNNATGAIIENNHIYDFVKTTDNEDSHGVVVQPTSRDVTVRNNDIHDNSGDSVQCLGPEGFSNLPPAENLLVENNHFYGNRENAVDIKTCYGVTIRNNRMHRFLPTSTARGDVVVIHYSASNVLVEDNEIYDGAKGNRGGRHP

SEQ ID NO: 16027 - protein, 219 aa, Myxococcus xanthus
MNNENFPTKLEDLVAFLSGTTPATPEFEKLSLKTMAPGMPQVWALGSGEQSAALAARLGLSFCFAHFFNPIHGGPVTRGYRERFQPSHVQAAPNSAVSVYVICAPTEQEARRIARSSDLLTINTRRGRPEAPIPSIEEAEAYAYTPEDLATLEFDRKRVVCGSPDQVKEQLLRMAAEFQADELLVTTIVHDHRARMRSYELLADAFSLSSTPPAAQAAS

SEQ ID NO: 16028 - protein, 427 aa, Myxococcus xanthus
MYYELHRWPLLIDSRRDRELEEVSVKLCRLVKRGPRLLLDGDPRRIADYYGVSQERARVAAEVLANTEDARGALSRGDFIDSADGLKCLEVNMMAGLGGWETGLKAQVVMDQPVLQRFTEEQGLRIQLQDTLRAFLSHVVEDVRRTVAWEGECNLAVLFPDNELPEAAGREMATLLLNSTLSELLAAEGAKGEVLIGTYSEVKDAEGHCFTMRGRRLHAVQEHDARDRLEVVGPDFDARVRAALAARTLCLYNGPAQELLDDKLNIALLSENEASPALTPEERELIRRHIPWTRRVRATQTTRDGASVWLPDELTASKREGLVLKAGRAYGGKSVLIGRAMTAEDWDAAIQEALEHGGWIVQERVEPRPYHFLRDDGAVGAHILIWGAFVFGERYGGTMVRLNPTGQGKDVVNATQGALMCALVVVE

SEQ ID NO: 16029 - protein, 109 aa, Myxococcus xanthus
MEKAVLEARGYEVIATSTLMEFEKTLQTWRPDLILTDIHMPEAKGTDICRTLKNEYGTQDIPIVLFSSLPDDELSKLAEQVGADGSLSKVNGLEAMGEKIDELVQSILW

SEQ ID NO: 16030 - protein, 281 aa, Myxococcus xanthus
RGGIARAAAQVQSARKGSLPVLYVDGGNSLFGEQRLKPGQVPQEERKAKALADAMRHMGLAVRATGPLDDTQGVDFRKGLGLPELAPGAVKLLPAGERKVGVVAATTAAQLAEASAQARAQGADFVVGLLDVTLDVAQQAVEQPGLKADVVVATRTATEFSGEENRLVRSAVPVVALQSKGRSLLRVDLAYAPQAGPFALHKGQDDLEREAAALEQRTALLDKDINLPGTDPKLKALKQGKRDELVARRQALLDAPPVTSDGVNAFTLRFVPLESSLPSDA

SEQ ID NO: 16031 - protein, 294 aa, Myxococcus xanthus
MEKRTDWYEHPQYYEAIFGTDTVREVDFLQTLNERFGTGGKLWLEPACGAGRLVEEASSRGLRVVGYDISEAMLAHARKRLTPAQRRRVKLGPSRMESFSDPSLEGQVDLAHCLVSTFRYLDSEAAARQHLLGTRRLLKPGGIYVLGFHLTDYARARPEHERWVGQVGEDRVVCNTNEGLPEQRARRSPMRNRLRVTGPDKDWLIETQWYFRTYSNAQAAKLFRDAGMRVLAGYTFDYDINAPVERGSLRLDRVFVLQPDPESPSVDPAEPGRASARKAPKRASTPQKSRKISR

SEQ ID NO: 16032 - protein, 262 aa, Myxococcus xanthus
MSPVLATVALYSLIIVLGALAGAVVVVLNDRPTHLVRFLAFAAGVMLGAAFFHMLPEAYLGGGWWAFALVPAGFAFLLVLERYLVAHAGEDISHGDTMAGTGHSVHPGHVLGLTAFLGLSTHTLFDGIALGSAVEEGVGGMALLAIVAHKVPSALSLASILKTEGRSKVSILSLSTLYGMMVPAGALLYFLFDAMLQFESLAAKALAFSAGTFLYIAVSDLLPHVHRHGKDQPGRNVLALFAGLLLMFLLARLMGHPEHPGH

SEQ ID NO: 16033 - protein, 418 aa, Myxococcus xanthus
MSIHSRSPVRLSGWGALALASVLLLSSGCAGDYVARTRGVRSAYQQGDYSRALSSLEAAAKEGPEQDRLLVLMDKGMVLHAAGQWAESNAVLEEAERLSEQIDSVSVSEEAKTLVTNERQRTYRGEDFEKLMISVLQALNYAELGDDEAAMVEVRQVNERLEKMIAEEKKPYEQLAIARYLGGVIREDQRDWDSAYIDYAKAYEIAPREDALAEPLLRLAKKVGRDDMYAELLAKYPDVPHAPLAPDEGQLVVVVEAGLSPEKQRGSRDPGGGGDLIEVPTYRNRGLAPPVSVALEGQSQQAVTVTSLADVAVVHLNDRIGRMLAKQLAGVAVKAGVAAGVGALTKSDELGVLTFLVLNAMNAPDLRSWLSLPAEFQVARFRVPAGNHTVRVTSWGQVTEHPVEVKPGRVELLVLRRY

SEQ ID NO: 16034 - protein, 202 aa, Myxococcus xanthus
MNTRRLILSACLAASLSACTGPRAFTRGTYEDPNTIEMLSDRFNENDLQLIAKKMAESLATSPRFSQPRPDGSLPIVLVGKLKNSTSEHIDMRSLGDKIQTALAQTGRFALVDQQARQDIAEEYEYQQSGYVDPNTAKGPGQQTSVDFLMTGDLASIIQEVGRDKLVYYKMTAKLSNVRTGLIEWTDEKQIRKKFEKRGVSW

SEQ ID NO: 16035 - protein, 275 aa, Myxococcus xanthus
MIAQLLAATLALTSSQAPVSVSGRGSPQVNLPFPSGDVQTYNIIQWDPNQLPRIYERSDQLPLTDEELTKLSQAGFEPAQLVKMIEERRCACDASADGLIRLKKAGVDKDVLAAVSRHGLAPNRGLNLLVTLDFTGESRNAREAFLYFFVDDGDITRVFTANIPELLRRRNSHETTVDRSDILVARTVRRVQLAGQVPLRTYGKHNVLVVASASPTLTHPSQLTAQELSRSQRYTFDYPRASLQNVCRLTAGYRRDAVLAYKWNFEGSRFECEWN

SEQ ID NO: 16036 - protein, 176 aa, Myxococcus xanthus
MVAATVPLTASAQSRGRTDGPEESEYGKGGYSGPGGRSVSLQLDWGAAINSRKPPRGAPEGPPLFVGATLSLWGADWYQLDVSGAYVFDGGRFVGMVGPRFRTWGWPLVFTAGLKAGAIVIPEGEGLRFGISPQLGAEILLGDRENILMALNYTPDIPIGGGGVTHRLGMSVGYKF

SEQ ID NO: 16037 - protein, 238 aa, Myxococcus xanthus
MMSSLDFTSWRGLAATLTSLVLVSLVVVSIRLLVMQTVQRRRERENRQINERLKTLISAYKTLGGSFTGELVVDPTHLRDMRRRLAAGEPLEQEPDQGLVLASSLDHPALERRRRTRDAVEAALSDVMLLGTEEQVRLAAEAAADMVAGRKVGTARLVVSLRDFIRRALDLEPIPHGLAIPDQGPVRPSGGGGGKGGDKGSGRGGGGGGAGGGGAGGVGMGGAGVHADTDDTEDGHRA

SEQ ID NO: 16038 - protein, 411 aa, Myxococcus xanthus
MVWVFSESTVRQVDPLFAEYGPRLVGLLPAFFFSDTVLGLEPWQWLGLLVTVLGSLGLAVLLERLVLAFARRVARWTRFTWEENVVSSGKGPLKLLTFSALLVVGTLLLRLPRPAQGVFIRIGYSLSVVALAWAVLRILHVSVAFVQSRVSSEMKDAARARSVSTQLVVLRAIFEVATYVIAAALLLIQFEVVRNVGVSLLASAGIAGLVLGLAAQKSIGTLLAGIQLSITQPISIGDTLITEGEWGTVEKITLTYVVLRTWDQRRLVIPIVQFLDKPFQNWSKGNPEMLGPVILQVDFQTDIDALRAELRRILENEGKALWDGRVATVVVLDVLDRTLTVRALVSVSDFSKLFDLRALVREKLVAFLRAHPLWLPVTRTEARPFPPPELDPARLSTSPDSPPAPPTPPRV

SEQ ID NO: 16039 - protein, 129 aa, Myxococcus xanthus
MPEPGPPARARAIGALIALAIGTYDGFFGPGTGTFLIVAFSSLLGHGLARASADAKVVNFASNLASVALFAFKGVVLWKVALPMAGAQFAGAYLGAHLAVKGGDKLVRKVVLGVVLALVLKLGHDVVTA

SEQ ID NO: 16040 - protein, 290 aa, Myxococcus xanthus
MMVGGVSELTEAPPRPRDEALMAAVGPLTSILLAVLLGGATWLLQEVRSFNLQFAFFYMASLNLFLGVFNLLPAFPMDGGRIVRASLAGRLGMVRATQVASWLGRGFAVLFGVWAVLSLNPFLVVIAFFIFMGAQGEAQQVRMKMTLERVPVADLMTPRRVGVDAGASLEQALWDLRRARLLLLPVTEDERPVGQVSLETVRAVPDSERMTRTVREVMVPAVVVRLDEDGWTALRRMAEEERPQLVVVEADGVLAGTLDVNDVQRGMALYQAREERSGQQDRRWRQERPA

SEQ ID NO: 16041 - protein, 416 aa, Myxococcus xanthus
MAEGEVRQYWVRNDRGTMWGPLTLPTIELLIESGSIQGRLQMSEDGLNFAFPWRFPEAREVVPRELWGPGAPPVSAAEQAAPGAPMGVAPGAPVMARPGVRPAAGPGVAPSAGPGVRPGAAPIAGPGVRPMAGPGAAPIAGPGVRPVAGPGAAPIAGPGVRPVAGPGAAPMAGPGARATVDPAQRPVAPAQQARPPGAVPPPPVAGAARPPSAPPASPAPASAPVAVPAVEGDDAAPEIPALGQLEQLSPIRLYGRIAAREQTGLLSLTLADRVVQIHFRKGNPEFVDSSHPEEALGPSLVAARLLTPEQLQRAEPTLERFGGDLLTALFGLGLLQPATAFAILAQRAGGILSRGLRAETGTFTFELKDLSSHKAMPLGHRWAVLSDTVRRIPSADLKRRLTPVLQLPIMKSGGVL

SEQ ID NO: 16042 - protein, 121 aa, Myxococcus xanthus
MELTCGYGCINASEGVRCARTPAGVCKLASGRITCFDPSPAALCAWKRELPAPQCKNTEAGPVCGYNCTTAFSKSACASTPNGLCKVFDSEVYCFDPPAEQKADAACLAALGLAALDGAAP

SEQ ID NO: 16043 - protein, 171 aa, Myxococcus xanthus
MEMLCTLRSATEAQRVALLQAPEQLEDFVDDDEDFGDPKGSAFLELDIGEAWHGLQYLLTGTPWEGSPPLDFLVRGGEDVGDIPSEEGTARVFTPAQVQALATALQQVTQKTLRARYDASVMQAQDIYPGTWDEPESEVDLLEELLSYFEELQKFMAAVAKRREALLVHIG

SEQ ID NO: 16044 - protein, 169 aa, Myxococcus xanthus
MRYFTKQQGQKEAVPVDLEPLGNDQFKITVGATTYQVDALALEHGTLSMLVDGQSYNVEFEENGDELGVLLRGQVNRIDVADERRLRLRAANAAFSVEGKQLVTAPMPGKVVKVLVKVGDEVKEGQGLVVVEAMKMENELKSPKAGKVTELFAKEGTAVENNAKLVMVE

SEQ ID NO: 16045 - protein, 336 aa, Myxococcus xanthus
MRKVERMEDFESSWRAAKSEALNAFGNDAVYIEKYLEKPHHVEIQVFADQYGNTIHLNERECSAQRRHQKVVEETPSPILTPELRAKMGEVAVKAAKAVNYVGAGTVEFLVDVHRNFYFLEMNTRLQVEHPVTEWVTGLDLVAMQIKAAEGEKLGLTEAPTPRGHSIEVRVYAEDPSRNFMPSPGKITYLRVPGGPNVRDDSGVFPGYTVPNVYDPMISKLSVWAPTRREAIARTQRALSEYVVKGITTNIRYLKAILAHPEFIEGDYDTSFLTRQHDALLGAEDPKLSEMALLASVVHTYQKDQKRAKTLPAASGGQGGGNGGVSPWKLALRARR

SEQ ID NO: 16046 - protein, 122 aa, Myxococcus xanthus
MSQALAQDFRDRALGLFVDREHSYARSCISGPGRPSKAVEGEVLDVIRQAARWLDVETGMLARLFGGGNAARNLLAAAVDFGNEPGRSGPPAPPEPDEDDRFVEAKLTQARAYMEQYLNTRK

SEQ ID NO: 16047 - protein, 520 aa, Myxococcus xanthus
MDQTPEKDPLRARLEKMEKQAELGGGADRIAKQHESGKLTARERIDLLLDPGSFCELDKFVTHRSSEFGMGDKKIPGDGVVTGYGTVEGRKVFVFAQDFTVFGGSLSGAYAQKICKIMDLATRVGAPVIGLNDSGGARIQEGVESLAGYADIFVRNTLASGVVPQISLIMGPCAGGAVYSPAITDFIMMVKDTSYMFITGPDVIKTVTHEEVSKEALGGAVTHNQKSGVAHFAAENEQAAIVMTRELLSFLPSNNQEEAPVQPCEDDAFRAEESLKTIVPSNPNKPYDIKEVIKAIVDDKHFFEVQEHFAKNIVIGFARMNGRSVGVVANQPAVLAGVLDIDASIKAARFVRFCDCFNIPLVTLVDVPGFLPGTDQEWGGIITHGAKLLYAYAEATVPKDTVITRKAYGGAYDVMASKHIRADMNFAWPTAEIAVMGPEGAVNIIFRNELAKAPDAAAERARLTADYRDKFATPFKAAELGYIDEIIRPEETRAKLIRSLELLKDKRQENLPRKHGNIPL

SEQ ID NO: 16048 - protein, 122 aa, Myxococcus xanthus
MVALIARISQYAKARNPAFKVMPQNSPELVDDPAYLPAIDGLGMEDMYWSDDNACDEGWCEENRTNAARVRAAGKLVLSTDYAIQAAHIADAYTRSRAAGFVPYVSVRALDRMTVNAGWDPQ

SEQ ID NO: 16049 - protein, 228 aa, Myxococcus xanthus
MARALRDPEKLQDVLGLAPVLAPPVAMRRLVERLMSHASAAQAFIERPRVGLLHLAALRALPEHTLGRAFVDHLEANQVNPDALPYLEARTDEEYVRAHLLESHDVWHVLTGFPTSVAGELGIQAFSLAQVGSPFALGILAGGLTNTLLYAFSQREERMRAIVRGWLLGQRARPLFGAPWCQMWESPLAEVRQRYGLDLAAVDAVLDDPMRPAMEVRNPGSASPPQSC

SEQ ID NO: 16050 - protein, 336 aa, Myxococcus xanthus
MPLALLLSVAGCSRSSSDASPDGTVTLLNVSYDPTRELYEDFNAAFAKHWAATRGQQVSIQQSHGGSGKQARSVIEGLRADVVTLALAYDVDMLHEKAQLLPADWQERLPHNSAPYTSTIVFVVRQGNPKGIRDWDDLVREDVTVITPNPKTSGGARWNYLAAWGQALRGEGGSEARAQAYVEKLFRNVPVLDSGARGATTTFAERGLGDVLLAWENEASLLIREVGQARFEVVIPSVSILAEPPVAVVDPNVDRKGTRAVAEAYLAYLYSDEGQEIAARHHFRPRSEVVAARHVSDFPGLKRLTLAEVAGDWRRAQATHFADGGLFDRIYAPRAD

SEQ ID NO: 16051 - protein, 235 aa, Myxococcus xanthus
MVQLEHLGGRYPGQLSGGQRQRVAFARALAIRPRVLLLDEPFGALDTRVREELREWLHALHERTRLTTLLVTHDQQEALEISQHVVVLSEGRVAQAGSPSDMYDRPACPFVDSFIGGASVLRGHVQAGRAAMGALSVTAPAGVREGEPVHAFVRPHDIKLAKAVAGAASASTATGRVERLKPVGGYVKVFLRLPSGDEVTVEVPRSEFDALGVAEGDSVRADVRSATVFVGDYSI

SEQ ID NO: 16052 - protein, 470 aa, Myxococcus xanthus
MGEGGYVPGEPLEQDMHKRHALRSMLWAASSLALVGGCSPEPELSDAEALPLVTQEQGERAYDPGPGWNLAWQDDFTGNSLNSANWTVLTSNFDPVTNNCNFGTGELEFPRAQNVTVAGGKLILTAQRTADAPFDSRCAGYGPRSYYSGRIHSKGKVERRYGKLVASIKVPSGYGMWPAFWTLGANISNVGWPRSGEIDILEWHSNDASWMKSAAHWFANGAQQSWGTGANRGYSIADGFHTYEVEWTANRMIFRLDGEIRGNEFAHNEAAFQQNHYILLNLALGGNWYGHPHPDAIGLPWGHTKTMEVEWVRWYQPGSTPPPASLTNASFENGMTGWATWSPNGTEAADFSETYNGGRTGAYHLTHWTNGTPFEVWTYQPVPGLASGTYKVRAWVRKSGGFDLSRLQAKTCGECAPVFTNLGNHGDWTMVETPPISVTGGYLELGFHTRATSGNSANFIHMDDVELIRL

SEQ ID NO: 16053 - protein, 514 aa, Myxococcus xanthus
AEATEETWAQVEQRNTSFARLFSVVRVAEPTPDALGRIVAKVAEDDALAAAMQVQPDALDEARFLCRRFLPYGAQVGNTVAFVRRLLASCAQASRTSVTRLEATRQFASESGIPEHLLRDDQPLASAHVRDFLASRVMGQDAAVERAASVVSVLKAGMSDVRRPLGVLLFVGPTGVGKTELSKALAELLFGAKERMVRLDMGEYAGPDALLRLMGDGETPGYLTSAVRRQPFCVVLLDEVEKAHPAVHDALLGVLGEGRLTDASGRFTDFRNALIILTSNLGADTLRARVGFDASGGAPDMASLRAHYLSEVQRFFRPEMFNRMDDVVVFSPLSAPLLRRLVVRELEAVCRRPGLSLHDALLEVTPAAQDWLALRGFDARYGARPLKRALERELVVPVADWLAAHPRMGPANLTVDAGTTGLELRAESLGGAAEGGGREAIERILEEAATVRAEVQRWSRCAPMHSLRRVLAVFDKVSRHTAYWEERALAEENSRKSSEARALEQSLRECAQQA

SEQ ID NO: 16054 - protein, 92 aa, Myxococcus xanthus
MESSNLSQLRKLAGDSAHVVSVAVAYEDEEAVRRFAQEHAVDYPVLLGDDAIQSAFRVNSFPTVFFISSEGRVERAAVGYTTLAGLFWRMVL

SEQ ID NO: 16055 - protein, 121 aa, Myxococcus xanthus
MRVEIRARNIPLTETLRTYAERRVRFALDRLSDRVKEVVVRLEDANGPKGGVDQVCRVALRLEHGRELAIESSDTNLLAAIDRTLERASNAVTRAVGRAQRQDGTRLRDAAWQPEEAAALT

SEQ ID NO: 16056 - protein, 137 aa, Myxococcus xanthus
GLRRKFELTSTLTFGEEGISVQEQVQVSDSAPAQPDVAPRLYRRAQDTRNLELAKNALVGNKASLWSRMVEQQVRIGARAVPEAPIWAMPAKKAPTDAAAPEAASKAQAPATTGAASPPAKAAAKKPAGSTATSSGP

SEQ ID NO: 16057 - protein, 113 aa, Myxococcus xanthus
MKKLLLGFMLAVVPAVGCGVGADDAPTDTVETVTTESGESINLDYSPLTSEEEPLASMGDADGEVSAMGPNCWVTLLYCKDPRYNDWATCKQNGKCTTKQFVDNCLALYKKTC

SEQ ID NO: 16058 - protein, 250 aa, Myxococcus xanthus
ALQRHLYAGRFVRKGARQLPASPQVNPDNLESRYNLALTLMKMGKMDESKKELRTILAVNPGISDVHHLLGIISYSKGDYDEAGEHLARATQLVQDSPLLWHDLGTALMELGRYQEARESFANCAQLDPSNSSCINNLSLAQRKTALTDAAFKEIKDTQQAENSAPALFMLARQYREKGLLAEEEATYRKCVKLDAKYAACHFGLYELFFEAHKREHAQIACKNFLKYGTSEEFPTEYQTCERFLSDATF

SEQ ID NO: 16059 - protein, 356 aa, Myxococcus xanthus
MSVRLTVTQRSEAGAAQSTEFVLDDAVITLGRDKACQVVLAQQAVSRNHARICQDGPLFFVEDLGSSYGTQINGKPVPKGEKRLLRNGDVIAIATFDVRFERVMDLNPESGGEKTSFIARGMVKDAMRGLAGGGEERYLRFMNGPREGERIELGDAKEVILGRDEKDADIILKDDLVSRKHAKVRRDWSGTHVEDLGSRNGIKVNKKRVNRRQLKDGDELEVGATRFLYVDPTEPAEEPVQLAAEVKAPPPPSPRRPRPEPKPVEPPPEEEPAPPPEEPAPAPEEPPAEEPAPPPEEQVSEEPPPPVSAEYPMPDEPAQPSAMAALKDKGKLVPLVVMSVVGLVFLVLMIAVLAGA

SEQ ID NO: 16060 - protein, 249 aa, Myxococcus xanthus
MLLGASLACSACSDGGTSGPGPSGEREKNVVKGKATDTAGKPLAGVEVVADNQVLYDSNVVGVTGTDGTYRLELGQAATTWNASARLKRDFNGRSYTFELHPSNATPFAGNEGAVRDFSWKLTGAKPEGGAYGSGVYFNLTDYVDPADPDQALQREHVELTLTPVGSLVDGSAGTPVTARGTNTPDGFGFPDLPLGRYTVTGRYAPPGQAVRPLLVRVQDQGTYAESVTADFQPVMEGLYRLDVELKFP

SEQ ID NO: 16061 - protein, 74 aa, Myxococcus xanthus
MTTATTAAAAATKALGASQGLSALEQKSLSGLTGPDRERAEAQLMLQKQQEATAFVANLMKKLNEIAMSVIGKI

SEQ ID NO: 16062 - protein, 74 aa, Myxococcus xanthus; identical to SEQ ID NO: 16061

SEQ ID NO: 16063 - protein, 707 aa, Myxococcus xanthus
MAATNSNSFLSKYSDIVLAVVVVAIVGMMIVPLPTLLLDVLLTLNISISVVLLLVSLYVPAALHLSVFPTLLLITTMFRLALTISTTRLILLTGDPGEVVVAFGNFVVQGNFVVGAILFIILVIVNFIVISKGSERVAEVAARFTLDAMPGKQMSIDADLRAGSIDQDQGKKKRRDLERESQLFGAMDGAMKFVKGDAIASIIITVVNIVGGLIIGVTQKGMSAGDAAQKYTLLTIGDGLVGMIPAILVSTCAGIIVTRVAGEEEGNHLGMDMGSQLTAYPKAIAIAAGMLIVLGLVPGLPKIPFFLLGIGAGLGAWTMLKKQQQAVEAEDAGPAMETDLGTPMASEPAPKEALNPDSELFIPVVTPIVLEVSDALVPFVDSRQDNGKFLFELIPFMRDGLFVELGVRFPGVRARGNGSLPPGAYQIQINEVPVVTGQATLGHVLVNDTVDRLRLMNIQGFEAVNPATRQPAAWVPEQYRDTLEAAGLTTWDVPGYIILHTAAVLRRNAREFVGVQETQTMLEQLEKAFPAIVKEVVPKVVNVLKLTDILQRLVEEEISIRDLRGILQALAEYGQVEADNVMLTEHVRAAQRRYISHKYARGTGTLVVYLLDPNIEDAIRGSVKRTSAGAHLALEPELAQEIVQAVRSECGHLPPSAQRPVILTAMDIRRYVRKLLEYEFNPSFSVLSYQELSPELNIQPVARISTR

SEQ ID NO: 16064 - protein, 154 aa, Myxococcus xanthus
MTTESKATVTNDDVKPLSGPEMLERATEGFNLFQDGRFRESLTLFQSLAAMDPTEAYFQTALGACHLALEDLDLAESYFNRAIELDPSDLTPFVNRGEVHLRLGKVHEAARDFNHAVGLDPEGQDPLSARARMLAAAALESAEGAPSSESDGAA

SEQ ID NO: 16065 - protein, 83 aa, Myxococcus xanthus
MTLERFDEAFDAFRLALQFNDGHVDALVGRGEIQLRRGNVPEALADLSKAIQLDPGLKRRATQRAHATLRTLKQQADQVKKSR

SEQ ID NO: 16066 - protein, 388 aa, Myxococcus xanthus
MSNGIGGVGGNRQLTTTQGVGNVNTSTIARNAQLIESTLNLVEKAVDLAGKAVNVAGKAVDQMSQAAAPTKQAGATGTNAAFPAERPNPLDAVREANSLKVEEGTGKITTPGGYTIEQLGQFEWRVTGPDGKNTRVWGDPHVDESDGGKFDFKRDTSFVLGDGTRINCSCKPWGNGMTVTGQLDVVYGDSHVRVTDIDKGKGKVGQVTNKGMDEVVRFHSNQSADVFHMGQNAADWTFHGKEIVGHENGGDVHKVGEAVITERRTMAFNYSAAADSPAAGEVAQNWDMNTNLPQVKPLPWDMSSAKPELNKLNETFDSISKVFDQLKNTNANGFNPFRKADDLFGAYDKNQHKSGLTQSFKALGDMFGTLEKLSKLNDMVRFRGPQSF

SEQ ID NO: 16067 - protein, 59 aa, Myxococcus xanthus
METFLKSNPNASADDVKSHAESTTKKHETNAMFQKMRDDNFFGKLMSRRKELLKDMWGE

SEQ ID NO: 16068 - protein, 278 aa, Myxococcus xanthus
MDADEGLVALGFTEVEARVYCELLKGAPATGYRLAQALGKAPPSIYQALASLEHKGAVLVEEGEPRSFRPVPPDEVLTALQRGFDTRRREAADALRKLHAPVQDDRIYHLKSHAQVMERARAMIAGATERLLFDLFPPPLAALAPALTEASARRVSVVGLVYDEPPKAPFASVRSSSADFVRERWPGAQLTLVVDAREFLVALLTPDGTGVKQAIWSDSVYLSCLQHSGLAAEIQLSAPPSARARMARSFSLINSSPPGLRQLVGRQPRSSSKRGDTP

SEQ ID NO: 16069 - protein, 343 aa, Myxococcus xanthus
MSGGCTESKVAEDQDIVLSGRLVDEAGAPLSDALLKLYRSENSACAFAAFSSSWRSVKTRVDGTFEVDLLGADTRNGSIARCFVARSPEQSQGRRVSAFFLIQQSEVALPVIQEWTGTMTATAQAQGVSVGFRPLSATHGAGNNEHVLSLHPSSAREAWQVLKATSPVLLSDYVLEDAEGLKASIITTRDVNAGGVTVGLTYTSDDVVLPRRALVPASRGAACTYLNAETPCRVTNGDLGGIVLFQEGVREVAVQLSRPVVPRKAVLRNFGVTGTMSELVLEGSADGAQWMPLANLLDGASVQSFMEVDLTGTTPVSQVRVRATPQESVGALRSLGQLSLFEE

SEQ ID NO: 16070 - protein, 127 aa, Myxococcus xanthus
MHFAVLNCAGNGPVTFNFSRGTGADSVQLNPGQMGNVKLGAHIAPALAATRVTMGRWTEGLPASGSSYVSNAMSVADNSGTADAVLACGDIITRYTMSDLTVPACHNYADLALCNGTNCSNACYYTW

SEQ ID NO: 16071 - protein, 341 aa, Myxococcus xanthus
MPSQRGEGESSGGLRLISESPVALGDAVDVYVTKNHAYVVSIDDLGGIGNGGLTVFDVSDRAHPIFKASISLPGDSSWNGVWAKEDALYIAGNRAGVVVYDISNPAQPEYVRHLPAGQGAHTVLVDGNRLYAMSPGEVTYVHDVTSPLAPVLLQLITVPSEFSSGGAHDAFAYEGRLYVSNGFGGYSIMDVTDLDNVRHLGQYVHGFNAYAHHSAVGTFAGRTIAFEGTEFNGSHLRVLDVTDPANIVKMGEFRLSPVTSIHNLILKGHLLYIAWYHEGVRVLDVSNPTKPRQVAHYNTFRESDPGRTDNLFEGTFGIRVPGDGYVYAADSVRGLLILNEL

SEQ ID NO: 16072 - protein, 259 aa, Myxococcus xanthus
MFGGWLLFVVWLSVEYVRLPDVRALQTQNPRTTALITQRAEEALAEGKKPRVRQAWVPLEAVAPHALDAVLSSEDARFYKHEGVDWIEVENALEQSVRKARLGRGASTLTQQLAKNLYLSTDRSLLRKGKELLLARQLETHLSKQHILTLYVNVVEWGEGVYGIEAAAREHFGTSARALSVAQGAMLAGMLPAPRRWLPAQKPETLRIRAGAIIGRLQREGRITATQAREAQAELSRFFGETSVPGSVVEAISRLSSES

SEQ ID NO: 16073 - protein, 517 aa, Myxococcus xanthus
MGLGAGLAVIASRATRSAEVEARIAARQEPVLTPAPGPAPQGLPVVTPAGREEGKVPQGHVDGVALRSLLLRRQFEELTLAVEQLQWGMESNPQDEHWMTDGILALGNGSSESTELLDAWVEASPRSFAPYLARGTHWVSVGYLRRGGKTVGATAKEEFAGMHEAFERAVPDLVRAWSLQPKAVAAARPLIYVANALGDDEARERAYTRAMEQCPTCADVRAVYLHGLAPRWGGTYEKMDAFAEAQSLAHPKVGFLRGFADFDRAHDLVVQGKNDQGLVLLAQALSAGDYWEFRLARAKQLRRTKALDAALEEANRAVALRPARASVYFERARIFSNSRKWEPAGKDLLHALRLDATDSDGRALRDHVVKGVIYDAWEAHKAGRREEALGLLELAGELAPGNPEVARRRAWVVKSPQQAEARAEEKQGEGAEDFRTVQQRDYALARERRFKEILPLWDAFIERNPDHGLAYMERSGTHYHLRDLKSALSDLKKACDLGVNEGCARARQVERAKAAAR

SEQ ID NO: 16074 - protein, 360 aa, Myxococcus xanthus
MLHSRRFVLALSSVVAVATACSSPDPVPDRPNILRFEANPATIAPGVSAELSWEVTGAQDISIDYGVGEVTGRSVQVRPTATTTYTLSATNESGSTTASTTVAVSTSDGTNLSGSLTTRTLTRAGSPYRVTDDLTVPAGSRLTIEPGVHLIFMGHHKLAVHGRITAQGTAASPIVFTANNPTRGWAGLRLAATSDAGSDFLEHCILEYGNKIDGENGAGAEGSYSENAGGALWIGSRANVNLNHNEFRFNKAPAFGGALMLIAPTSSGVATGNIFHDNECTGPRTQFGGVGGAVNTAHLPASNQWTFRGGEFRNNRAPEGGALYFFDSNVLLDGVSLSGNSPQNWATPEPHRLTLINTPR

SEQ ID NO: 16075 - protein, 462 aa, Myxococcus xanthus
ARPGNVAFISQSGALLTSILDWSLREAVGFSAFVSVGSMLDVGWGDLIDFLADDPMTRSILLYMESIGDARAFLSAAREVALTKPIIVIKAGRTAQAAQAAASHTGSLTGSDEVLSAAFRRTGVLRVDSIADLFYMAETLARQPRPAGRRLTVLTNAGGPGVLATDALVSGGGELATLSASTFQALDAFLPTQWSHSNPVDILGDADPERFAKALEVTGQDEGSDGLLVILTPQDMTEPTQTADRLKPYAKLHGKPVLASWMGGSEVAAGERILNDAGIPTFGYPDTAARIFNYMWRYTYNLAGLYETPALAQAVSSARDEVRQWVESARAEGRTLLTEYESKKLLAAYGIPTVETRLAVTEDAAVAEAAALGFPVVVKLHSLTVTHKTDVGGVRLNLPDAESVRAAFRDIRTRLEALGQGRAFDGVTVQPMVRLDGYELILGSSVDAQFGPVLSSARGALV

SEQ ID NO: 16076 - protein, 113 aa, Myxococcus xanthus
MGSLSADPVYFELDSATLRPESRDMLAQLATGLRERPLTRVTVSGHTCELGTTEYNIALGHRRAAVVRDYLRNLGVESSQLSIVSFGEERPLSDAHTEDALRRNRRAEFTFSS

SEQ ID NO: 16077 - protein, 439 aa, Myxococcus xanthus
MLKEPLTDDGYKVDIATGGADAIAQLRARVYDAVLCDLRMQDVDGFDVLDAARKLDPDLPVVMMTAFGGVESAVEAMKRGAFHYFTKPFRLDEVRLSLERALEQRRLRTEHRTLKQQAADRGGLGALVGSSTAMRDLYALIERVAWSGAPVLVRGESGSGKELVARALHFEGTRRAGPFVAVNCTALPHALLESELFGHVKGAFTGATTARRGLFVEADGGTLFLDEIGDMAPELQARLLRVLEDGEVRAVGADGSRTVDVRVVAATHQDLETRVKEGRFRADVFYRLNVVTLRLPPLRERREDIPALIEHFLQQAKARNPRSVVQRFSPETLAALGALPWAGNVRELENLVQRLVVLGSTEVVDLPQLRPHLPSDTSQENHPLAAAQRTIVPLRQLETEYIAWAVARCGGNKTKAAELLGIDVSTIHRRERAEGNPQR

SEQ ID NO: 16078 - protein, 704 aa, Myxococcus xanthus
MRLPVLPVLLLCLMLSGVIAGVLHFMQRDRQALVDQMARERQAQLLEAVRGVSAALESAEEDLRFAGELLAQPGTAEEHRREMRALLEAVGQYKAILVFGTDGQERLRLVDRRSAAAMTHQFTAEDLALTVAQARSHPPGHVISSPPLPRAQSGWLRAFATALPEDAQDSGGVVVVLVDAEPRFAPLKLLASDSETQLLVLGVHGTPTALTHPNLADRYRRLDTDGHQTPGLAALARALRAGESGTRIIERKEAARLGLGDSEVVATFSPVRFKNGAAWPVATLASTRVLRIHERGLVLRLSLAAVLVSGFLIAFGVYVVLARSRAEALRDSQLHAQRLAHLHDKTQKILDNIPTGVLALSSTRHISAANRALSARMPADVVGQPLTAAFPQAQAPVIQRLEDLVHAATSDGRVRSLHGEPLCLFEEPGQYNVHAVPLEPNTPEVHTLVVIEDLSSLRALEGQLLRAEKLATVGVLAAGIAHEIGTPLGIVRGRAEYVQEKLGREHPQAAGLGTIVGQIDRVSRTLRQLLDFSRLRPADAQTVPLEPLVHSVRELLWMEAERRRLKLEVTVASPVPAVAADPDQFQQVLINLVLNACDACGAGGRVRLSASMDTGDTPGAWGMVRVDVEDNGCGIAPRHVHQVFDPFFTTKKRGQGTGLGLTMVAHIVRNHGGRIELDSAPERGTRVTVRWPAAAPAGEERHVV

SEQ ID NO: 16079 - protein, 234 aa, Myxococcus xanthus
AELNGRLGRKRDASLCWTRALWSASDTEATELALRWSDSENEGGATPAERMASPAPTGDDVRSVASSLVRAVCVPGAPAPVDVAALQRWLDRHDAELDVRALWLTRTALDTLAGGDALGLARAGDRLLEMLQRGLSLARDVPRFLRGGTDSAHAPRVLAQLEALLERFEHTPRRRSSIEAAPALTLAYVRYVFAVGLARLGQADRARTLASAAGEAVDAKEPSTASFPSVRRAR

SEQ ID NO: 16080 - protein, 525 aa, Myxococcus xanthus
MTITPDGGWKLNASGQVEDASPTDARDVRHQVALDFGAALRGSAGATLALQPDAERDGRAWKVVRVTFGDEDLYDLFLNEADGALHGLRIREDNVTRFVRLGDWRQVQGVRIPFLEEVLTDNPDSDSRTVVEALELNVPIPSAVFERPQDVRKAIFAKGHHSTGFIPFEFFDENRVYIPARVNGQATQVLLDSGAEMTVVDTAYARELGLKTQGQLAAVGSGGHAQAQLAGGVDITLGNLRLTGLTVAVINLSEVARLIGHPLPVVLGKESFNQLVVDVDFPNRRVAFHDASRFKAPPRAVRLPLVESAGGQRAVQISIEGRPPIPVLFDVGNGGALSLFPAYWQQAGLLTERRSSRTLSGAVGGLRERDVATLKDIQLAGITLKDVPTVFDDAGKSISASDRLLGNLGLAVLGRFRMITDYATDTLMLVPDARALRQPFRKDRSGLIALPAEGRLVVKLVAPGSPAAGSGWKEGDEIIAIDGKPIGPDYAGTELARWRYRAAGQTVMLTLKDGSKRRLTLRDYY

SEQ ID NO: 16081 - protein, 264 aa, Myxococcus xanthus
MSNPEVVTKTQRRMHWGVGVAALVMLFAGVGTWLVLRQSATELPHPSMAVIPKPSHPGLAPRAEPPLPSSAEMDALLRTRLARASLMPEFATWLKEQDLLRRFVTVVGNVAQGDSPREAVSFLAPAGTFEARRKAGKLVIEKQSYARYDVIGKVVGSLDMGVLVSTYREVRHLAERLHMETARPGSTLDATLHLAFEQVLAVPVIDGDIEVVPKGAMFVYADPKLEGLTAAQKHLLRMGPQNLRRIQGTVREASQQLTQQASRR

SEQ ID NO: 16082 - protein, 94 aa, Myxococcus xanthus
MGFRAGNNFSVVEIVERSPTSVELRMNDVLADLPTFSAGLLARAVELCGGGRVVSIPEEFDGTAATFHIRWSEAPAEAALTATDDDSGASRPRA

SEQ ID NO: 16083 - protein, 391 aa, Myxococcus xanthus
MLWLANGLVFYVLLFATGEWRRIVPTNWQVFPDAASALLQYLSLRWPQNDGWVAYNGLQIIAYFITVFIAAPLALMTGLGMSPALSTRFHGISKRLSIQTARSLHFLVLCWFILFTFIHVTMVFATGLLRNLNHVYAGTDANDWVGFGIFAVSMAVVVIAWVAATPFTLRHPRVVQRVGYSLIGPAQRLFEHLDAKPGTYTDKDISPYFWHNGKYPETPEYRALFDNHFADYRLRIHGLVENPVELSLDELRAMPRHEQITQHFCIQGWSGVAKWGGVSMQTLLELVRPKPDAKWVVFYSLGDGSDGGRYYDAHPIAQMHYQLTMLAYDMNGEPLSYGHGAPLRLRNEVQLGFKQVKWIAGIEFVADFFEVGGGYGGYDEDHEFFGYRQSI

SEQ ID NO: 16084 - protein, 546 aa, Myxococcus xanthus
RIPRMGAAGTRFGRNVPLENAWPEPEPALLEPSPRVISNRLLARQSFVPATSLNLLAAAWIQFMTHDWFDHGSPKRGGEFKVPLDKERGDSWSEDPMRIRRTPEDPTRIPGAKDGPPTYINQHSQWWDASQIYGSNEEETRALRCTDDEDGGQRRGKLILTGEGLEAQLPVDPNTHLQKSGVTHNWWIGLSLLHTTFAKEHNAIVDRLRLEFPDWNGDRLFHTARLINTALMAKIHTIEWTPAILAHPTTETALNTNWWGLVGQRVTRLFGRMSRSELISGIPGSEVNHHGVPFALTEEFVAVYRMHSLIPDTMRLHRMRDGVQVREVAMVDLAGPNTLKALEDGLTMVDLCYSFGISHPGALVLHNYPAFLRDLHRQDPDGAESRVDLASIDVMRDRERGVPRYNAFRKLMHLQPARSFKDITRNEQWARELREVYGHVDRVDLMVGMLAEDPPRGFGFSDTAFRVFILMASRRLASDRFFTNDQNVNLYTQPGMAWLNENTMASVLLRHYPGLAPALRQTRNAFAPWEPVSMVATEPPAGSLLH

SEQ ID NO: 16085 - protein, 1139 aa, Myxococcus xanthus
GGEAVREMLKSLDVEKLSEELRKDMRETTSEAKRKKYAKRLKVAEAFRVSGNKPEWMMLDVIPVIPPDLRPLVPLDGGRFATSDLNDLYRRVINRNNRLKRLQELNAPDIIIRNEKRMLQEAVDALFDNGRRGKTITGPNKRPLKSLSDMLKGKQGRFRQNLLGKRVDYSGRSVIVVGPELRLHQCGLPKIMALELFKPFIYNKLEEKGYVTTIKSAKKMVEKERPEVWDILEDVIREHPVLLNRAPTLHRLGMQAFEPVLIEGKAIQLHPLVCAAFNADFDGDQMAVHVPLSIEAQMEARVLMMSTNNILSPANGKPIIVPTQDMVLGIYYMTRAREFAGGEGRVFASPDEVRAAYDHGEVHLQAKVVCRIDGKRKETTVGRVLLWEVVPRAVGFDAINKVLDKKSLGGLIDLCYRLTGEKETVLLADRVRSLGYYNATRAGISIALKDMIIPAKKQEFLDFARKEVSEIENQYLEGLITDGERYNKVIDIWAEITEKVAQEMMQQISQEETTGDRDGKRETRKQPSFNPIYIMADSGARGSAQQIRQLAGMRGLMAKPSGEIIETPITANFREGLSVLQYFISTHGARKGLADTALKTANSGYLTRRLVDVAQDAIINEYDCGTMDGLFIGALVEGGEIIEPLGERILGRVALDDILDPVTGEVLVRANEEIDEDRVRRIENSGMDKVKIRSVLTCQAKRGICVECYGRDLARGRKVSVGEAVGVIAAQSIGEPGTQLTMRTFHIGGAATRRAEQSSLENRYAGSVKFAGLVTVQKTDGTLVAMNRNGEIVVVDDSGRERERYQVIYGARILVKEGQRIEPGVLMAEWDPFAIPLLTEVGGVVRYEDIIEGVTMSEALDEVTGLSRKTVIESKDPEARPRVTIRDANGNMMDLPSSRNPASYFLPQGSIITVNDGDEIHPGEVIAKVPRETTKTKDITGGLPRVAELFEARKPKDAAAIAEIDGVVSFGKDTKGKRKLIITPEVNGEQRTDLAKEYLISKGKNISVHSGDRVKSGEAMMDGSANPHDILKVLGEKELARYLVDEVQEVYRLQGVKINDKHIETIVRQMLRRVRVTDVGDTNFLVDEQVEKWVFEEENEKVMSEGKRSAVGEPVLVGINKALVFPESFIFGVAVPGAP

SEQ ID NO: 16086 - protein, 1315 aa, Myxococcus xanthus
MTYSAPIKVVVRLVVWDKDEETGAQSIRDVKEQEVYFGEIPLMTQNGTFIINGTERVVVSQLHRSPGAFFDHDKGKSHSSGKLLYNARIIPYRGSWIDFEFDHKDLLYVRIDRRRKLPATVLIRALGAVPDTAKKNPLEFKGSTEEILNYYYATETIYLHSAEEFEKSVELELLPGQRATRDIKAKTGELIVKKNRKFTRAAIKKLEAAKMKTLPIDADELFTKVSAYDVVEETNGVVLLECNEEVTQEKVDELLKHGIKEFKVLFIDNLNVGPYLRETLMLDKLETPEQSIMEIYRRLRPGDPPTPETAINLFTNLFFNPERYDLSKVGRLKLNFKFGLEEPLDGQILTKRDILEVIRYLIDLKNGKGTIDDIDHLGNRRVRAVGELLENQYRIGLVRMERAIKERMSLQEIETLMPHDLINAKPVTAVIKEFFGSSQLSQFMDQTNPLSEVTHKRRLSALGPGGLTRERAGFEVRDVHPTHYGRICPIETPEGPNIGLIASLSTYARVNEFGFVETPYRKVEAGVVTNDVAFYSALEEEKHTIAQANAETDKKGKFANALVSSRRGGEFVQARAEDVDLMDVSPKQLVSVAASLIPFLENDDANRALMGSNMQRQAVPLLRTAAPLVGTGIESIVARDSGVTCVARRDGIVESVDAGRIVVKADVPASLSDVTSEVDIYNLLKYQRSNQNTCLNQKPIISKGDRVMKGDVIADGPATETGELALGQNVVVAFMPWQGYNFEDSILISERILKDDVFTSIHIEEFECIARDTKLGKEEITRDIPNVGEEALKDLDESGIIRIGAEVKPGDVLVGKITPKGETQLSPEEKLLRAIFGEKAGDVRDSSLRVPPGVVGTVINAKVFSRKGVEKDERAKQIESMEEAKLLKDQNDEIKVLQDSAFGRIRGLVRTKEVQGKLVDDKGKILLKKGDILDDELLSTVPYKYWGEISVGDPLDSRLRDILRNLEETKEAVKLAFGEKIARIKKGDELPPGVIKMVKVYVAIKRKLAVGDKMAGRHGNKGVVSRILPEEDMPYLEDGRPVDIVLNPLGVPSRMNIGQILETHLGWAAKGTGEALQRYVEANWSSDAIKERLKVIYSDPAFGEFLDKLDDEEIKQLCLRSKRGIHVATPVFDGAQETEIHALLDEGQLPRSGQMVLFDGRTGEPFDQNVTVGVMYMLKLHHLVDEKIHARSIGPYSLVTQQPLGGKAQFGGQRLGEMEVWAMEAYGAAYTLQEFLTVKSDDVVGRTRMYEAIVKGDNVLESGLPESFNVLLKELQSLALDVELLESAPPERQRSFGGDFLGGGDGEERKTGTEA

SEQ ID NO: 16087 - protein, 122 aa, Myxococcus xanthus
MADLNAIVDQLSSLTVLEAAELVKQLESKWGVSAAAVAVAAGPAAAAAPVEEKTEFTVVLANAGANKINVIKEIRAITGLGLKEAKDLVEGAPKNVKEGVNKDDAKKIKDQLTAAGATVDIK

SEQ ID NO: 16088 - protein, 131 aa, Myxococcus xanthus
LSEGNVEYKVIKNTLARRAAQGTSVFFIADDFTGPVALCISYGDVVAPAKILVEFAKDIEDKIKIRTAVVEGRKVDVAGVKALAKLPGLPELRAQLLGVISEPASKLVRTIAAPGSQLARVVQANADKAQG

SEQ ID NO: 16089 - protein, 285 aa, Myxococcus xanthus
MLLALVAMLLGGSQAEPLTHQPRALSAGLDYFALELLVLGLLFIPMERLWGLHPQRIFREGWQTDLKHFFVSHVGVQLISFSVMIPVQVFFSWAVRMDFQAHVAAQPVWLQFFEILLVVDLVSYWVHRAFHQVPWMWKFHAIHHSSQQMDWLASSRSHLVDVLVNRFAGFIPVFLLGFSPAAIYGYLVFVSFHAVYIHANVSHRWPYLRWVFATPEFHHWHHTSDEEGIDKNFAVFLSFIDVIFGTAHLPEHWPSRYGTTKFQPPETYLGQLAYPFQRHEETPYG

SEQ ID NO: 16090 - protein, 364 aa, Myxococcus xanthus
MSWHKRLELWAKLTLALVASALLWRPGRRRRPGTPLPGPRKVLLVRPDNRVGEALLTTPLMRTLKAHLQSAPEVHVLVHAKVARVLNGHPDADVIIPFDRRRIWMGPLAPGIAALRRARYDVVVDCANWESPSVTSALVSRLAGPEAVVIGPDLWPVSRLHSLPVPARTDTRNEAVQRTHLLTPLTNGAVARVLSFREPSVGPAIRAYLDALAGKPFAVINPGGRLGPRRIPPAAFAAAARALVALGRTPIVTWGPGEEALARGVVEAAPGSELAPASNLDELAALMRAAGFTLCNNTGPMHLSVAVGAPTLAFFLRMDMERWGHAYAPHRMVDLTPLVDGAGGQGLEERAAEEVRTFAASLPS

SEQ ID NO: 16091 - protein, 209 aa, Myxococcus xanthus
MNANTVLPPGLLLVLSAPSGAGKTTLAHRLLKETPDAVFSISVTTRRPRGKEREGVDYNFVDVATFQSKIERGEFVEWAEVYGHFYGSPQSVVDEARARKSAAIFDIDVQGGQAIKRKHPDAVTIFVLPPSMEELERRLRDRQTDSDETIRRRMLAARSEIERGIASYDYVVVNDDFERAFSDLRSVVVAERCRRERVDVSKLGLGIGG

SEQ ID NO: 16092 - protein, 39 aa, Myxococcus xanthus
MHREVNTTGSKSQHAEISVRVVAMKAEVERIREQVQNVE

SEQ ID NO: 16093 - protein, 169 aa, Myxococcus xanthus
MRPEDTRTPQSTTHLLVPTEARSERFSDTLGGWLPSSPGIPRVRTRYRPTAWVDPEGNLHPVTALTGQPVFALAGLARPGGFLKTLQSLGTDVRDAALFPDHHRFTADELRDVQARAVRLGARVVTTEKDAVRLPQGFEAWVVRLGVEVLEGESHLRRALGLEDAPRGL

SEQ ID NO: 16094 - protein, 267 aa, Myxococcus xanthus
MWRDLRRLKARTVDVVHSHFSHDHLLARWGRPSGAVLVRSLHAPRSLRSSLPAADAYTVPASALLPRLLEKGATAQVLPALVDARFQPAPDARSLRAELGLEGTPVIGMVSTFQPSRRHAVGVDAFALYRKQRPEARLVLVGDGGLLEQTRKQVQDLGLADAVTFAGYQQGDAFARWLRALDEVWLLGLGNDWSARAAAQARACGVRVVAVDEGALPDLTDVRVERPTPDAVVAAALSDQRAPVRHPTNEQIAAEVLALYARARRTP

SEQ ID NO: 16095 - protein, 335 aa, Myxococcus xanthus
MTLIVHPHFHHRYTGVTRHVETVVPALVRDSGSETRVIGSGLSEGLPRITWPELLRRLRREPVVWHAHRNNELLVGMLLKLLGREVRLVFTRHTSMAPSGFTRFIARGADALVSLTKQVADVIALPSTVVSHGIDLTRFHPPEDRDAAWRKLGLGGRYGIGVIGRIRKEKGQGDFVQAIRPLLPAHPDWQPVLVGLAKGPDLDWLNQQMAGIEDRIALPGEQSVIEPWYQGLSILVHPSYAEGYSLVHVEAMASGCCVVASKLPYLDTLIEHGRTGFFFEPGDVQGLRELLDMLMREPERARQIGQNAAEEARRRCGVEHEARALADVYRATVER

SEQ ID NO: 16096 - protein, 622 aa, Myxococcus xanthus
PVHGVMLLVAPESEPTARFLELSSERPRVAFCAHDAHGLPPYRAVFESLAMYLPPEQVPFPLPPDAKEAAEQVSRALGGGQSLCAFRALGEPGGFALEGLDGVRREAHVGDTLTVRLPGLPDAESVQVRVWGSARLGADGRSVELTEPGVAQVEVWVRAPGRFFGTEWRPWLVPSPVRVLPPGPGIWIDGATSRPCASSTSSSPTCSWQSCVPVLALHRKTRHGLMERLGFYGPHSHLPPGDGPVLWLHGASAGDLLALSPMFGPLRARFPGCRLLLSTMTDSGYAMAKGRLANDIDGVVYVPYDLWGATRRAVRAIRPDVLVLEYTEIWPNLIRAAKRGGARVVMTNGRFSPANVGKYQTLFRLIGNPLRDLDLLLMREEDEAVRARQLGARPDWVKVTGNTKFDALAAGPVPEDENLRTALGLTPGERVWIAGSTHEGEEAQLLGVYARLRERWPELRLVIAPRYVDRAARIVTLAREAGLSVGLRSQGNPERGQVVVLDTIGELSRAYRLATVVFVGGSFTTRGGQNILEPAGQGKPVLYGPHMDNFRDSVALLTGQGGLQVQDAAALEQALVSLLESPERLASLGAQALETVGRISGASERNAEAMTTLFPHGRPDPR

SEQ ID NO: 16097 - protein, 418 aa, Myxococcus xanthus
MRATQRALRWSRAPDVATAALLAEGALAHPDNPVLARLGERLAAQVAAAQLPDGTCQGGNGWTLQRLLVATADCTRAVNAAAVTPEGKRRAAFFTARASGALERNRAHVKDGYTAAALLASGAVTGSLRDSLREQVRDAVQRRDEGAAFLPVEAGVVDAAGGTPTEAEATALAVLALEGDAKAPVADLGAALLASYEPVNGWGNGRANRLALQAVVSLFREPLPAQVRVVLERDGQVITEGTFDAKALREVLSLEAAAPGSGGAHTWTVRAEPAVPGLGFALALSAAVPWTQQAQAGLELSVQVPSDAKVGQPSEVMLQASTPSGLPLVIRHGLPAGVQVDTASLEALVREGKVASWQSEDGAVTLRLPPRGPGEPFQARFRVIPTLAGTLQGGASSLMALSRPDLVSYVPPATWAVR

SEQ ID NO: 16098 - protein, 212 aa, Myxococcus xanthus
MFAASSAFAQDVEMNIHADDIGMPSTSISVEGMSPDGNAAGVNMEIRGGGARMEVNVSGTGTPPPSGRHERRERREYREEVAPRETPVRHVRHHSEPAFRDCGTNQDPGCTMQRNGHFAMDAETFHGFMQSLKSTRNELTREDMVEKVMTRAFLTAKQFGLVLDLFQNEITRLDVAKTAAPRVVNPQHALGFSSKWRNSISADEYVEIITEQ

SEQ ID NO: 16099 - protein, 345 aa, Myxococcus xanthus
MELDGAERDELQRALTSAFASVEHLRRVVAATCRRDLEALGVSGGLRERVFALIHMAEAEGWLRELIRGVYQALPRHPRLQRFVQVYLASIQRSIPRVGLERIFGSGRADAEREHWRKRLTSIERQVCRVEPEVGAALGTGFLVSPSVVLTNFHVIENRLLESLRVRFGRKVLQDGTLLHPGTVYRVTRCLARSPYSPADLMHPRPRDATSGELDYAFLEVAGVPGEDLVDGEPRGWLEPPDSRESFTPGSLVLIVQHPAGQPMSVALDEFLGVNPGRTRVAYRACTGPGSSGAPCFTQDLRLAALHHSGGPRVPSASVGHNEGIPIDTIRGSLSGSMLSQLGWG

SEQ ID NO: 16100 - protein, 413 aa, Myxococcus xanthus
MLGQVDGLALEIRRPVRGIRVRDGDLTALEPRLRLYGAWCDTSRKLDALPAELRPEQASQLLAEVEGALRTEDTATEQLDRLAAKVRELDVDGLARAGLEARLQDIDRQARTLVEQHGEDSLGFRLKYELLSLLSTVREELARGALDAARRQLEFARRSYFDILCEELSAALASRTPPRGFTEEEWEALTRQVNTLLERARERANTSVDDAVRMYQGAHAAYVRQLIVELRGAVDEARHVSESEAQTQALDEVEALLREAMGLLVAESSHEAAGKYGEARVRFVSASQSQRMAKSFHLESLASDDGVDGAPSVPPPTAPSGGSMPRAAGGARRRGTRAGRLRGHAAAVAASHVAGGAGRAGAAHHGGGGVGASVAQCLLAHVGRFRRVHDRPSSGASACTRWATPPSRESPGC

SEQ ID NO: 16101 - protein, 226 aa, Myxococcus xanthus
MPSIAVFAQAHPEQLGWLSSKLLGVTLTSAEWVLWVLVCLSVLSIAIMLERTVYFARHRLPDSEALAVRLSRGELDAVKAAIQGRQGMEAAILREGLACADQGADTVEQVIASTLSRERPRYERFLSYLGTLGNNAPFIGLFGTVLGIIKAFNDLGKMNAQGGGGAMQQTVMAGISEALVATAVGLAVAIPAVVAFNVFSRQLKTLTSRANALGHALVGSLRSEAR

SEQ ID NO: 16102 - protein, 144 aa, Myxococcus xanthus
MAGSAQDNDDEITGINVTPLVDVVLVLLIIFMVTANFIVRETVEVDLPRAANGGETVQGLVNVVLDKEGKFFFDGTEMTEKELEAKVAEAVAKDKDTRAIISADQSLPYGRVMRLIDVVKGQGIAKFALNIEKDVAPAAAPAAP

SEQ ID NO: 16103 - protein, 266 aa, Myxococcus xanthus
MRGKTVVVTGASAGIGEALAVVLAGRGANLVLAARNEEALQRVKARCESAGGRAVVVPTDVGDAEACRHLVERAVEAFGGVDVLVNNAGVTMDARVDEVKDLSLFDRLMRINYLGAVYCTHHALPHLKARRGLVVAVSSLTGKTGVPNRSGYAASKHAMHGFFDSLRIELRGTGVDVTVVCPGFVATNIRDSALGADGQPVRQSKHDESAGNMDVDTCVAIILRAMERREREVVMTTKARVAQFLKLVAPGVVDRITAKTIQDRRR

SEQ ID NO: 16104 - protein, 566 aa, Myxococcus xanthus
DVRFECALCLQDEDGLLAAEESTVLARAAEARRALASRGSVRLLERMASRGDADFALDVLRRLPAQAPPGALSALLAVSDRVAGGLAEALHGWARGRPFAELPPEERALWADWALARLARLSAEDALRFLEWAAAARDADRVEETRAFVSAVSESLAREPPSLRASRFQDAAFSRFLSLADEEDAPRLHTWSREAPCTEPLLEAVLSLSSRLRWGDALAPGQGARLLMALWTGEGRERLLAPLAKVVRAWSGGSQHAGFIDAVWRRFQQHPDERTDLLATFTPWRAEIWERQQAAEPDAVVCFQTWWPVEDPEQLPARVDALVRQSPSEDLSRRLEPVWKAAEVRVDAWPRATSLAVSYAAAVLSATVRRDVDALDPDAERFLAWFPSFRERVVAASPTSSERSYSRDFLKDIEVDVRLIREHLERKRQREDQAHEAELRRMVEASRQRDLERQRELMARQVEASPPAHDVEVAPLHTPLVLLNPRGPVQPLDLEVCFPEARLRTLLDYTRLLKVMSVNNDVMAVFEAHGLSVATWTSEATAWGTLLVRRPELALRFGVLFQGPWG

SEQ ID NO: 16105 - protein, 233 aa, Myxococcus xanthus
MAPAGRAAAEATKAALLSPYMGGGTATAAAATSQAASLAAGGFISFPCALASYMLTGMSLFTMLMLAHGGLLVLVSVGVRACMRAKRPGAWLVCRFSRWALHAEQFKASARCGSLLPWSPMLAFLCSRLFQVAQYGVLTYAVGIDTSLVQAFFAQGLYLCALAVGSLVPGQVGVSDGAFALAAGVLDTTAARAMSVALLGHLVQLLFVLVGALIPLVWRIRAPLPVAPAPACR

SEQ ID NO: 16106 - protein, 51 aa, Myxococcus xanthus
MAARLAQAGVPHTLFTLPYAEHGFDIWDGGFGRQLARAQVGRFLQQHAPVN

SEQ ID NO: 16107 - protein, 332 aa, Myxococcus xanthus
MERPMKAVRFSAFGQPLKVVEVVEQPDVALKPGEARVEVLATPINPSDILTLSGQYGQLPKLPAVPGNEGVGRVVEVQDSSAVKVGDIVFLPLGAGTWCTHLVAPADSLLRVPPGTDLRQAAMLFINPPTADLLLRDFIALQPGEWVIQNAANSAVGRSIITLAKQAGFKTLNVVRREELAPELTALGADAVLLDSDELPERVREVTGGAKVRLAIDAVGGESTQRLGDALARGGVVVNYGAMSGKGPRLSAAATIFKDITLRGFWLVTWTKKTPREEQGALFARLAKQVAEGALHVPVEGTFPLESIQEALTRAMEGGRAGKVLLTPNGPL

SEQ ID NO: 16108 - protein, 64 aa, Myxococcus xanthus
MPEDGLPEKVGRYYAVDNLRIDAKRTGDTKVFRTEGWPLALIVSEDIKQALERVKATGVKFTPV

SEQ ID NO: 16109 - protein, 448 aa, Myxococcus xanthus
MRAHAVIWLSLALAVTGCSTTRLVRLDTGDGPSRVHTPFTDDDTGPVELDDDEFEEAMVELARDVRPFSNPLREARQRFGVPERSGVYLYQPRGPRLILQEEKDPDGPRLLESYADDELTRAYGRWCERKSQPGDCLRLLAEGPLLASDGKYSLAMAIAMDSVWEETAEALEDMADPQALLATVSASVSMYLLLWSLPEPVSKGLAALLTATAIAYLGVDTVWRILDGWMALVRTVDRATTFVQLSEAGEAYGEVLGENAARVFVMLATAAIGHTAGLAAKASRLPGSAQAALAVETQAGYQYVAIGGVQSVAMTAEGFTVALAPNAVAMAARGMSGGHTEDHHLATNKNSVSTARGGPWTPKFEKIFRKAGMELKDPENIVPIPGHKGPHPQEYHDLIHERLYDATRRCRNVSECREALTRALRRLAAETRTAGTRLNQLVTKSAQP

SEQ ID NO: 16110 - protein, 718 aa, Myxococcus xanthus
MCGLRIELDAGRITSIRGDAEDPFSRGHVCPKALALEDLHQDPDRLRGPMRRTASGWEPVSWDDALDETARRLHAIQREHGRDAVGAYLGNPNVHNLGNMLFGPELLRTLRSRNRFSATSVDQLPHQLTAYLMFGHQLMVPIPDIDHTGYMLVLGANPLASNGSLMTAPDVRARLRAIQQRGGRIVVMDPRRTETAAIADTHVFIRPGTDALALLALLHVAVVEHAPRLGPLDAFTDGLETVCALARDFPPEKVSPHTGVPAHTLRRIARDFLSARAAVCYGRMGVSTQSFGALCQWLITVLNVVSGNLDRRGGAMFTLPAFDVVGGPRALAVGRGGFGRWKSRVRGLPEFAGELPTAAMAEEMLTPGPGRIRALLTVAGNPALSTPDGARMEQALAGLDFMVSIDPYLNETTRHAHLILPPVSPLERSHYDIAFHALAVRNTAKYSPALFEPGPGSRQDWQILLALQHRLLTLRKGRPSVRATLKYQALSRLGPERVLDLGLRLGPYGARFHPAKQGLTLEKLRQSPHGIDLGPLQSCLPQRLQTKDRRIHLAPELLVADVRRLQAAFPQDTVPEQHSGELLLIGRRHLRDNNSWMHNVPGLLKGKPRCTLMMHPEDAARRALADGMEATVTSRVGTVTVPIHVTDEVMPGVVSLPHGYGHGRQGTRLAVATAHAGASHNDLTDAQAVDALCGNAAFSGTPVRVLRAAAPESATPAG

SEQ ID NO: 16111 - protein, 570 aa, Myxococcus xanthus
GCFTRLPARLDEMQASSGISPRYARWFSESVAALVRHGVLSTRDGKTYTRSGPPSRPDEVWQEWEGSRSRWTQDPNTRALTTLAETTIKALPDILVGRQLATDVLFSRGSMSLVEGVYKHNPVADFFNDALARSVVAYVQLLREQSPGARVRILEIGAGTGGATAHVLAMLRTCALDVEEYCFTDVSPAFLQHAEKTYSPGNPFLTRRLLDIDVPLEAQGIPRAHFDIVLASNVLHATPDIRRTLRNAKSALAQNGLLILNEISHNTLFAHLTFGLLDGWWSYEDEDLRIPGCPALAPETWKAVLESEGFSSVFFPAADAHERGQQVIIAESDGVIQPISPRAQRQRAPEPRPVITDATSIEERVRDVIKACVAKSLKVPESQIQVDYSFADYGVDSIIAVNLSNAINDACGTSLPTTVLFDYNSVAALSQFIARNHGAEASRLLDDKPREAPVPPREVLRDDREAPLPVAVSSLRKTVAVATAEEPIAIVGMSARFAQSDSVEALWRHLEAGRDLVEDVRRWDLASHYASTLSGEGDRCMRGSFIEGKNRFDPSFFNISALEARCVDPQ

SEQ ID NO: 16112 - protein, 2559 aa, Myxococcus xanthus
MARAALQLAEGEEAAVVRPVRVTNVTWPQPQVVEGPTTELRVSLFPEDDGRVRFDIHSGSDDTHVCHSQGLVTFFEPKPAAAVDVAALKSQCQRGELSAEQCYQAFASLGAAYGPGHRALRAVYQGVDQVLARLVLPEGLGSTVAPYVLHPSLMDAALQATIGLSAQESPAPIGLPFSVDAVEVLAPCPPQLWVWIRNAAGSTAGGAVRKLDLDLLADDGQVCIRLKGFLMRPVKELRAAPAPRILAPAEEVDASPADAGPLGDPSSVRDQIRSVLITEVARAVKVSAGDIEINTEFSEYGFDSISLTEFTSRLNHGYGLSLTPTLFFELPTIAALSEHLAEKYRQNFDRYMVVAKRGADSGNTPAPTKAVGPKAEARRLRRMPRPSRSAEPLTYGNDEPLAVIGMSGRFPMAEDLEAYWRNLRDGVDCIQEIPASRWDWREIYGDANQEPGKTLIKWGGFIDGIDEFDPLFFGVSPSEAELMDPQQRLLMTYVWLAMEDAGYSASSLSGTRTALFIGTGQAGYGSLIEQANAEIKSYASTAAVPSVGPNRMSYFLNIKGPSEPIETACSSSLVAVHKAMLAIHRGECDTAIVGGVNTLPTPAGHIGFDKAGMLSPDGRCKTFSDQANGYVRGEGVGMLMLKRLSLAEADGDHIYGVIRGSAAGHGGRTNSPTAPSPKSQAELLHATYTQAGIDPRTVTFIEAHGTGTSLGDPIEIDGLKSAFTALDPTLGAGPVDRAFCGLGSVKTNIGHLELAAGVAGVIKVLLQMKYKTLAKSLHSEQLNRHIRLDGSPFFIVRETQPWPALEDGAGNVVPRRAGVSSFGIGGVNAHVVVEEYLPSSAPAAEVPQDAPHLIVLSAKNEARLIERARQLLHAVEQGEVSQADLPSVAYTLQVGRDAMEERLGLLARSLEELKEKLLEFTEGRGLADSVYRGHVKRHKEFLSVFADDAEMQEAVAKWMARGKLSKVLEVWTRGMPVDWAKLHGGAQLRRRSLPTYPFAKEKYWVAKPARAENRVRAGSRAALHPLVHENSSDLRGQRYSAHLTGEEFFLRDHVVGQDKVLPGVAFLEMARAAVVNASGLTPPGKVTLRNVVWSRPIIVTDAPVQVHIGLEAEQDGSVVFEIYGGTDEAPLLFCQGRARIGAGTDEEATAPCVDLSVLQSGCQDRRQSGAAVYQTFASAGLTYGPTLRALQELSVGRGQVLARAVLPEQVLSSQGQFVLHPSLLDAALQAALGLHSDEGGQLSLPFALDALEVWDGPAPSDVWIHLRDETDGAAGKNRQKISISLCDRDGKVWVRLKGFSTRPVPAAGVRAGAENHVLLFAPIWEETALASAPITAARRRVLVFCGATSAVAEAAANRIQGAQKVVMGTSAASAPERFRELVQKLFEAIKGMALQAGREATLLQCVVSTQDTERDSLRGLLGLFKTARLEHPTLQLQMVEVDAPTDVERVVARLQSSSTAPELPHLLFQDEKVLVTRWRELTAPAPEAPLWRKGGTYLITGGAGGLGKRFAQTIVEATEQASIVLTGRSPAGDAQRAFMESLRRPGVRVEYRPCDVTRAEDCQALIAWVRDTFGGLNGILHAAGVIEDSLLKNKDWEAWERVLAPKVQGLTCLDEASRSERLDFFVMFSSFAGAIGNPGQSDYAAANAYMDAYARQREARVARGERFGKTLSINWPLWREGGMHVDAATEQMMTHATGMAVLETTAGVQAFQHALEHAQSQVMILAGQAERIRKWLGRSGLLEGTSVSPSPSASATSSTAEPGDEVRARVSAMLCSEIAVVLKVDAAAVDADSELSEYGFDSITLTEFANRLNRAYELDLTPPVLFEYPSVDTLAGYLLRAHRESMVHHFGEQERGATPEVVSLAERMPAAEPVTSALRTRERRGGSRGRSVEPARTDAPSTSTPARRGPTPLAVVGMSGCFPGARDLEQFWTNLAGGVDSITEVPASRWDWRELYGDPRKEGNKTKVKWGGFIEGVEEFDPLFFGISPVEAEVMDPQQRLLMMHVWRAIEDAGYAPHSLSGTRTGIFVGTGITGYNSLVERANLAIQGYSSTAVVPSIGPNRMSYLLNLHGPSEPVETACSSSLVALHRAMEAIDSGSCDMALAGGVNTIVTPGGHIAFDKAGMLSEDGRCKTFSATANGYARGEGVGVVFLKRLADAERDGDPIYGVIRSSAENHGGRANSLTAPNPNAQSQLLQDAYRKADIDPRTIGYVEAHGTGTELGDPVEVNGLKSAFAAQIEARGGGTSLEKHCGLGSVKSNIGHLELAAGMAGVIKVLLQMKHRMLVKTLHCERLNPYIKLEDSPFFIVQQTQDWPALMDERGQPLPRRAGVSSFGFGGVNAHVVMEEYLGNARANAAKADVPRGPVAIVLSAKNAERLREQAAQLLDAVRSGRWSDAELPSLAYTLQVGREAMEERLAMVVDSLAALETRLQVFLTGGREGLFVGGRAGRAHPSGKGSAEAEAAVRDAVTAWKAGDASPLLGLWATGGTVDWTQLYAAPLSRTHVPAYPFARERYWISPAPPREQQTLEKPVAQTRPSLIGQLRTRIGAAAIEGETVND

SEQ ID NO: 16113 - protein, 677 aa, Myxococcus xanthus
MTHVWRAIEDAGHAPQSLAGSNTAIFVGTGNTGYASLLERSGVAIKGSTATGSVPSVGPNRLSYLLDLHGPSEPIETACSSSLVAVHRALLAIELGLCDAALVGGVNTIVTPDAHIGFGKAGMLSEDGRCKAFARGADGYVRGEGVGVLYLKRLSLAERDGDHIYGLLLGSAENHGGRANSLTAPNPKAQADLIEAAWLRAGVDPRTAGYIEAHGTGTSLGDPVEINGLKSAFHSLYEKTGAAEGTDAHIGIGSVKSNIGHLELAAGVAGLVKVLLQMRHGVLAKSLHCEELNPYIALKGSPFYVVQEGRPWLALKDASGRPLPRRAGVSSFGFGGVNAHVVVEEYVPSHEATPTPLRGPAICVLSGRTEEQLRQQARQLHEAVEREGYRDEHLPALAYTLQVGRDAMEERLALLVDSIAGLQEKLRAFVDGAGAGDAVFRGHVKRNKDALSVFTGDDDLQEAIASWLSKGKYHKLLDLWTKGLSFDWNRLYGAQRPQRLSLPTYPFSRTRYWVPEGEQPAGVPTWGALRAGGVDALHPLLRRNVSDLRQQGYEAVFSADQFFLADHVILGKRVVPRRRLPGDGACRAPARRRGGGGGRPARSRDERDVAPAAGGGGAHDRAARVAVPRGRWARAIRHPQRLRRHARLPQPGPGDFLRAEARGGGGCGRPEVAVPAR

SEQ ID NO: 16114 - protein, 158 aa, Myxococcus xanthus
MFLDELDHRIIDMLQRDGRATQLELSRAVKLSQPAVAERIRKLEERGVITGYSARVDAAKLGKDITAFIGVSIEHPKYFDEFLQKVLLLPDVLECHRVAGQDSYLLKVKTANTRSLDSLLVGTLRTIAGVTRTQTTIVLTSMKEDTHVRVPPDTPKGA

SEQ ID NO: 16115 - protein, 161 aa, Myxococcus xanthus
MSLTSVELESDRTIVISRKFNAPARIVFDAWTRADLVKRWWAPKALGVTMASCEADVRVGGGYRYVLRNPDGGEVAFSGQYAEITPPSRLVYTQVFEPMADAGSVTITVTFDERDGKTHMVSRELYPSKEVREAVLASGMEHGLRETMEQLDALVSSPGLD

SEQ ID NO: 16116 - protein, 248 aa, Myxococcus xanthus
MQLKDLKIIVTGGAQGMGAHFAQRLHEAGAQVAVGDVAEERLAALPAGIHRRKLDVSSEEDIVSFVNWAQGAMGGLNGLINNAGILRDALLVKKDRTTGEVKKLSTADWNAVIGVNLTGATLMVREVVAKVAESGQKGGVVVNMSSIARHGNRGQSNYVSAKAALAANTVTWSREFSPFGVRVGAVAPGMIETPMTQGMNQKARDALVSNIPVGRIGVPEDIWLAVKFILECDYFNGRTIDVDGGLNF

SEQ ID NO: 16117 - protein, 207 aa, Myxococcus xanthus
MKKKLLLSAVMTSALSLVGCGESDPVDNTPNLSTPQGILAFVEGKTLTMTGANIPSHPNGFSEDINFGASSQCYQSVTMTVQGGNFRVDSIPGTIEGAPNAGMSGTCNPELPQNALSFTSTVVSIENVQGDGECFDVAFTYPGFRQVGRGAFSADRRTLDLELFFEGGATGANCAAGGVGSATVNQVIGGESRPFDGKAVQRYTIGG

SEQ ID NO: 16118 - protein, 525 aa, Myxococcus xanthus
MTEGAHMFIGDWMGRGALYWPDSVAVVDPSRGDAGRFTYRAMNTRATALGGWLRDVAGVQKGDRVGIVAHNGVEYLDALFACAKIGAVFVPFNWRLHAAELADLVRSIRPGVLFFGDDFRDTVADVRERLGGGPRLVSLESQGLPGADAYAATLAHVPGSPVTQDAVSEEDILCLIFTGGTTGRSKGARVSYRMVAWNTLNTLVHEVRPGDVTVTHTPMFHTGGLLVYTLPLLTVGGTVVLMRRWEPEALLDLIPREKVTLFFAVPTQYQQLLESPRFKTTDFSSVRFMTSGGAALPVPLIQAWQAVHPVPFKQGFGMTEFGPGLFSMGPEYAVSKAGSIGRPNYFIAAKLVDDDGREVPTGEVGELLLKGPSMCSGYFEDEAATREAIDAEGWLHTGDLARVDADGFFTIAGRKKDMFISGGENIYPLELESALYEHPAVAQCAVVGVPDAKWGEVGRAFVVLKPDGKVSAEALLEHLRGRVARFKVPKRVELMERLPISAAGKILKRELRDAAVAADRDSSRH

SEQ ID NO: 16119 - protein, 331 aa, Myxococcus xanthus
MRYAQILSTGRYVPEKVLTNADVEKILGEKVDEWLQQNVGIRERHMMADDQATSDLCVGAARQALERAGTKPEELDLIIIATDTPDYLSPATASVVQAKLGAVNAGTYDLNCACAGWVTALDVGSKTIAADDSYQRILVVGAYGMSRYINWKDKKTATLFADGAGAVVLGAGDTPGFMGAKLLANGEYHDALGVYTGGTNRPATAESLELTGGKPAVQFVRKFPATFNTERWPMLLDQLLKRQNLKLDDVKQFVFTQLNLRTIEATMKILGQPMEKAHYTMDKWGYTGSACIPMTLDDAVVQGKVQRGDLVALCASGGGLAMASALYRWTA

SEQ ID NO: 16120 - protein, 100 aa, Myxococcus xanthus
MEAGQVRRMDPEALAYCLMGISDFLGMRWVLWEEDPGLERVLDTAMTLISHGLDPRASTGRNTVKSSAASKPKPKLKPKPKPLKKNTLRPARRPARGARS

SEQ ID NO: 16121 - protein, 39 aa, Myxococcus xanthus
MSAVYLPVYVQDALEASLERITRIRAGALRATGNHSGRG

SEQ ID NO: 16122 - protein, 154 aa, Myxococcus xanthus
RVDPDLLQGFIREESRFNARARSATGALGLAQLMPTTARQVADSLDMPMPGESALLQPHTNIRLGAAYLGQLVKHFGGNVAYAVAAYNAGPRAVERWRHALPEAELDEWVEHIGFEETREYVKKVLGSYSAYKLLYADEPALLRDLRLSDASRR

SEQ ID NO: 16123 - protein, 144 aa, Myxococcus xanthus
MAFIVDIEQPLSPFISVFAGGHVGVNLKATGLQAGGRVYLTGRPFQGPFLSVQGDGTFFDADDDVSKLRASVSGLVGYSQQLGNQWHIALAGGAGFSHLRQETELPRSATCTLFSWCLLSTPERTVETTQTLHPVVRLTAVHRF

SEQ ID NO: 16124 - protein, 64 aa, Myxococcus xanthus
VLYVRPTRREHERDAAFAELAALATPLDRDARPEEVARQIGFLLSDDCALMTGTTLLSDGGRTL

SEQ ID NO: 16125 - protein, 72 aa, Myxococcus xanthus
MVPLTDRASLPQEARSALEKELASLTLLQDVVRWGFASSPPRDVTEVIVQDEFTHDVVMPWMEGSYLVFDTT

SEQ ID NO: 16126 - protein, 36 aa, Myxococcus xanthus
MNEGTWAAAVNAANKDTTAHNETARARQQFLRTPTC

SEQ ID NO: 16127 - protein, 515 aa, Myxococcus xanthus
MREGELASVLHWTAKLTAQEVIRSPAICVGHIACLILSRRFAHATAALRDAQHHLDTADEVSAPERERLTKRLAHLTLLHAVLSDSAPDTGMDLDASPGSEESDVFIAGAVLAAKAYRALRMNRFDAMRRLALSARETLQGHNNPFLVGYTDVLVALADRAQGNMKDAAARCEEAFERASRGRRNPVWANAATALANARYEQNRLDEAEALCVEVLPLLPQASVFETFALAYLMLARIKTVRGKYAEAYRLLDYLHGVLECGHQTRFLAHVCGEKIRLYLVEQAPARMRVVAQEFGLGERMRRGEWSEKRFYDETWERLGLAQAWVLMARGRHDKAHAILEVLRASAHEVGYVSRETALLATIAVCHWRAGDAMAAFAALNRGFALAQRFGFGRSVFDETPGLQEVVIAAARQRKLSYAFPDRYATRYQDLLSAGTRVPREFAAPPSAPLEPLTERELQMLKLLAQGLSNQEISERSNVALSTTKWHLRNVFAKLDVTTRTAAIVKAQERLQRHL

SEQ ID NO: 16128 - protein, 42 aa, Myxococcus xanthus
MQPPLSAGPEAGWVLAPGFHGKGYATEAVRAGAGLGRCPAQP

SEQ ID NO: 16129 - protein, 86 aa, Myxococcus xanthus
MTMAPVKRPTLKRAVNPMPANVRAALLQRGLMDAYKARPPYQQNDYLGWIARAKLEATRQKRLDQMLDELAGGTKYMNMAWSGGRK

SEQ ID NO: 16130 - protein, 580 aa, Myxococcus xanthus
  unsure (1)..(580): unsure at all Xaa locations
MRITVISGGTAYPRHLNKHIDYSKLAGKPGFDPSVKNHSLSTPTEMVVSQDGTKLYVAAFSSSKIGVYDTASLESNAFDPRTASANHIPVSGGGPSGLVLDEARNRXYVMTRFDNAVNVIDLATKAQLSSVSLYNPEPASVVQGRPFLYDANFSSANGESSCASCHIFGDKDELAWDLGNPDATVTANPINMRLASDLEIGIFRSFTGHPSSPINGTGKQNEFHPMKGPMTTQTLRGMSNQGAMHWRGDRSNGFFGVDAGGEEMSFKNFIVAFPELLGRASMPTEAEMDTFTAFQLQVQLPPNPIRRLDNALTASQKAASDFYFGSRRVDGIAIGDDNGFNCNGCHTVDGARGFFGTDTRSSFEGISQIMKIPHVRNMYTKVGMFGFPDSSFFLHPETGQLGDQVRGFGFTHDGAVDTMFRFFSAIVFSNTSIGGPLVGFRNDTERRQMEDFMLAADTDLAPIVGQQVTLTASNAANVGARIDLLIARARAQFTSKVLGGATYEADVVAKVAVGSRVKGFLYERGPGTWKPDDGSANISTAALRALANTAGQEVTFTAVPPGSGTRIALDRNLDGRLDGQ

SEQ ID NO: 16131 - protein, 176 aa, Myxococcus xanthus
SPTVYFFDSLGSNAQKLGVVRRIIENTQLLSSPTLVDLSAAVQTDGHTCGTWMLEAARLILQLRLSGVDLADIGTFHAELLALQEQIGDLHAQNVQFQEDYAAEDSIDEDSHDTTGKASMGASKNSDVELMSEEVDPFAEGEVDPFAEGEVDPFAEGEIDPFAEEVEGMSEDDSSA

SEQ ID NO: 16132 - protein, 242 aa, Myxococcus xanthus
MRIRVFDSEREAAATCAQRIARAAAAHPSLVLGLPTGRTPLNVYRELVELFTRGGLDWAQVRTFNLDEFLGVSADDAGSFRAYMERHLFQHVNLSPAHIQFLDGAVEDAEAECARYEARLAEAGGLDLVLLGLGSNGHLAFNEPADGLRARCHRTRLSRQTREANLMLFGDDPSRVPMEALTLGMASILQARQALLLAFGEAKAEAVRGMVEGPVSPRCPASFLQLHPDVEVWLDPAAARAL

SEQ ID NO: 16133 - protein, 137 aa, Myxococcus xanthus
MVDDQYMRSLWSWSAQTKELMGLAVLALAHAPLLPVAPFFVGTVWACAANYYFVHRRAHLDPKWAREHLPWHYDHHMGKDQNANWCVTHPFFDLVMGTRREFLNVQPPASKQPAPVEQPVPAPVEARKRTAAASGLR

SEQ ID NO: 16134 - protein, 542 aa, Myxococcus xanthus
MMDFPLTLSHLMERARTFYPRSEIVSRNPDKSLHRYTYADFYARTCRLANALTRLGVKAGDRVATLSWNHYRHLEVYYGVPCMGAVVHTLNLRLHPNDLGYIARHAEDSVVVVDRSLLPLFEKFKDAVPSIRHVIVVPDAGPAPEGTLDYEALLAAESPDFDFPQLDENSASMLCYTSGTTGNPKGVLYSHRSTVLHALACCMTDVTGMREADAVMPVVPMFHAAAWGLAFDAVLTGAKLVLPGPHLDPPSLLDLMAAEKVTLAGGVPTIWIGILALLDQAPNKWDLSSMRSMLIGGSAAPPSLIEGFQQRHGLEVVHAWGMTEMSPVGTMAKVKGPLRQAAHEAKSSARASQGFALPFVETRVASDDGTLLPWDGETMGELEVRGPWVASSYFSDEGADRYTKDGWFKTGDVVTIDSHGYVRICDRSKDVIKSGGEWISSVALENALMAHPAVLEAAVFAGKHPKWDERPLAAVALKEGQQVTKEELTAHLAGQFAKMWLPDDYVFVPQVPRTSTGKFLKTKLREDYGDHLLKNPKADAAT

SEQ ID NO: 16135 - protein, 48 aa, Myxococcus xanthus
MGIILLVLWGLGLTTGSTEGYWVHLLLLFAMVALLLAVVSQGRRAASA

SEQ ID NO: 16136 - protein, 345 aa, Myxococcus xanthus
MKVAVLTGGGDCPGLNAVIRAVVRRANAHGFEMMGLRDGWKGLLEDNHFRLTRETTSGILHRGGTILGTSRVNPFKVENGLERVKRAIERNGIHAVIAIGGEGTLSAATRMSQEGLRIVGVPKTIDNDINATDFTFGFDTAVAIATEAIDRLHSTAESHKRVIVCEVMGRHVGWIATYAGIAGGADVILVPEIPADLAKVAEHIQRRHAGGRTFSIVVVAEGTRIKLSADQQEQLVTSGALDEAGRPRLGGVGTILAHEIERRTGFETRVSVLGHIQRGGAPTAHDRVLATRYGVHACDMVARGEFGKMAALRGNDIISVDLADATRELKRVPQEFFEVAQVFFG

SEQ ID NO: 16137 - protein, 315 aa, Myxococcus xanthus
MVPFAHATDSGGSIRIPAAACGLFGLKPTRGRNPMGGDIADAVHWLVTEHALTRSVRDSAALLDVTCGADAGTPYQAPAKARPYTQEVNTPPGRLRIRVAVRNPMGAAIHPECLAAIHSAARLLEDLGHHVDEGSLEVPGDDAVGQHFITVWTAGVVFSIDAMAERLGRSPEASHFEPFTWALYQYGLDQGLSAYLRASAELQRHSRAALRHFDDVDVWLMPTLNELAPPLGTFSSPPGEPMAPLLRAGAFASHCPMANITGLPAMSLPLHWSPDGLPVGVQFMGRFGDEATLFRLAAQLEAARPWAQRRPAVFG

SEQ ID NO: 16138 - protein, 123 aa, Myxococcus xanthus
MPGTAAMLGVKDPFDPEPAIDGSARYLAQQLRRFGDVRLAVAAYNAGPGSVNGRVPRNGETEFYVPKVLAAWELTRPPPPRKAPPAVKPVAKPKPVAPARTKAPASAAKEPKKPAAPAENGRS

SEQ ID NO: 16139 - protein, 242 aa, Myxococcus xanthus
MASRDGTRAGGAQETGKPPARPGGRREAHRREREQTLEDAALKLFLARGLDGVTIDDITQAAGVAKGTFYRYFDDKAALVDGLLEPVRRELLAGLETCGHSLAEARNVEAMFDAYRAVAAVIASALLQYPGVVRLYLQECRGPAVGARTKVAELARQVARHAVDITQKAHTSGLLRPIRPAVSGLAVVGAVERLLLAVLSEEDIGNPLELPDALTTLVLDGLRLPPEVRPGRRKLDGGPKRP

SEQ ID NO: 16140 - protein, 166 aa, Myxococcus xanthus
MLATGCESLFFIEAEAEEICKTERDLAFPAALPLTVNVERSITFPLGDISDPLPEDTDIETELRLRVFEVTADTDLSGVERANVSVRQPGSNDTHVIGEYTRTSTAPTRTIQLTSTGPVDLMDLARQPELEFIFDARGTLPSEDWTASLRACAGVKAHANYFDLVF

SEQ ID NO: 16141 - protein, 133 aa, Myxococcus xanthus
MLDAGAPHGVGLSAVLRPLPWLRLQAGPTTNTLSFGLRGGLSILPMQTFLAPSFNVEAGHYFGSDYNDVVDWLGATPSRASAAIRDVTYNYVTGSVGLEVGAASRFNFFTAPGPQLRGPGRGRRERPAPGRHG

SEQ ID NO: 16142 - protein, 229 aa, Myxococcus xanthus
MALLPGSGPNKDEVIVVMAHLDHDGVDRRGNVLNGADDNASGSAVLMAAVPELAEAAKRGELDRSVLLLWTGAEEKGLVGSQYFVDHPIPGLGMEEIAGVINVDMVGRWDDQRLSVVDTNSRGQPNYFREVLDQANAKLDDPFDRINRDINVFRDRQDGASFGRKGEDVLFMFEGLSNPNGGGDLIPEYHRADDDIDLILRDNGGEKPRRIKDLMVNVIGLAANRTAEP

SEQ ID NO: 16143 - protein, 50 aa, Myxococcus xanthus
MAFAGPTKELLAIPGLEEAIRKQLQPLFIELLREHPVTPALLARRTSGSR

SEQ ID NO: 16144 - protein, 38 aa, Myxococcus xanthus
DLVLFVGLQGSGKSSLYRQRFAATHVHVSKDLWPHAVR

SEQ ID NO: 16145 - protein, 351 aa, Myxococcus xanthus
GARLEILSCEGCTPATVELKGNSVASAFVFDPAPVPFDLIPVHERTQSYTRARNITWRPVTIERLVTSDHAFVPLSRPEGSSVAPGEVVEMQMEFAARYSGPNVGDLTVHYTSDKARNSQVILDARGGRPTLAVTPVSLDFGEVPVGGKVERVIRISNAGTNGPLQFLGVAAGGDSPQFSVDVPTRGTEAYPWSGGVWPVLEATPGLPIAPGTDALELKVYFEPTSVGTWTAALRVRSDDLFNPEREIILTGRSRATAPCVYELTPQPVMDFGNVTPGRGAVQGFYFRNPGSAECAVKNIHISNNGGGVFFMPGGRLTGGVVPYDSGFSAMVAFRPQAEGDFTGELQLTVS

SEQ ID NO: 16146 - protein, 188 aa, Myxococcus xanthus
MRRGAPEVTGVELPRDSVGFTRRECPECQRPFKTRPGPMDSRAVLHKLLGFYPFENAHECVEGIPVWGCPYCGYRAEADAFLTPAQQGHLEAVARGWANHVRYEQLAHVARTLSVNPRPTFVAVEPEALPGPMEPEPDELLRVMPMLCCGEEVKVIWEWDQALHCFSCGARHDPMSGRQQVELRFVSE

SEQ ID NO: 16147 - protein, 221 aa, Myxococcus xanthus
MGRSAHVGPGATYQFSDYALDVEATLDGLGLDAVHLVGHSLGGIVSQAYAAARPGRVKSVTLIESLGPAGGPAEGALGRLRSALDDARRPPNRKRYPTVEAAAARLLENSPTLTQDAALYLARHGTEPYEGGFAFTFDPRHRRRFGMGYDEAQWMALQAGVTCPLQLILATGGLRHDEALMRNRTQALQTLAHPPLHLPGGHHVHMEQPKMVAEALIRLIR

SEQ ID NO: 16148 - protein, 211 aa, Myxococcus xanthus
MLREQYRMNARIMDFPSREMYGGELRAHPSIADRTLDAVLTPGADVDAPPVLYLDTAGKGFDEEVEPTTRSLFNPGEAGLVEARVRALLAAGLAPRELAVITPYSAQAHQLRERIEALSPEVEVDTVDAFQGREKDAIIVSLTRSNSEGQLGFLTDLRRMNVALTRARRHLFVVGDSATLSGHPFYARFVEGTQTHGGYRSAWEWPDAQDT

SEQ ID NO: 16149 - protein, 275 aa, Myxococcus xanthus
MYHYDNTNRGDDRWNGGASVGPAADGRLKPDLSYYYDLIRSASNTSNTSYTNFGGTSAATPQTAGHFGLLFQMWHEGVWAGFGGGADVFASRPKMATAKALMINMAHRYNWLAGGSNGDLTRARQGWGTADVKRLYDRAAVTSIINETDTLLPLGTNTYNVTVAPGETELNVTMVYTDPAGTVGAAHARINDLSLRVTSPTGVVYWGNNGLTASNVSTAGGVSNKVDTVENVFLANPAAGTWTVEVIGDEIIEDTNLATRVLDATYALVVSGGKI

SEQ ID NO: 16150 - protein, 166 aa, Myxococcus xanthus
TLSRVKSGAPNAVGVDIPQELWIAMGISTTSLLGTPLVLGGKRARSPDEKLVQNTSVQLAEAPADIDAHRQGVLYANANMTDARMADMFQGDEVGNTAHIDLAKVQMFYFTLIAAVGYFMDVAMSVARGTTHAMPALSQGMLALLAISHGGYLLGKTGDHSNSKQT

SEQ ID NO: 16151 - protein, 361 aa, Myxococcus xanthus
MLSFMAALAVLLSATPSSAFKIPISEESYLNVAILLQPQLQIVDEGAPSGGPSSDMFLRRTRLLVFGHITQKLSFFAETDQPNFGKNGDWNVAFFIQDAFISYEVAEKVWIDVGMLLPPLTRHVLQGAVALQAVDYHSSLVRWAPGVGKVWRDIGVQVRGFAGPLGFRAAIFNGVNGKTTPDGTVLNPDDLPRITAMARWNFFTREEDLFFQGIYFASEPRLSVGIGADYQPKAVSTESGLHDSLGTAADVFLDVPLANDQEFVFNATLFHYRQGLDNPQSGTGLYAETGWRFGKFQPLISGEYFKARVDGQDLLALKPGFNIWFQKHTLNLRTEVAVAWTGDISQARAAVTGTSQLQLFY

SEQ ID NO: 16152 - protein, 654 aa, Myxococcus xanthus
MAQTQEALIPTKDAFSRKAHVKSLEDYQRLYQRSIQQPEAFWSEMAEQLTWFHKPDAIMDLDAEQVDFSWFGGGKLNAAYNCIDRHATERPGKVAIIWAKNEPGEYESITYRDLQHHVGRVANVLKAHGVRKGDRVCIYLPMVPELAYTMLACARIGAVHSVVFAGFSSEALRERILDSGAKVLITANEGPRGPKFVPTKAIADEAVEGLSLVESILVVRRTGKEVPMLAGRDYWLDAEMAKHRGVCPAEWMDSEDPLFILYTSGSTGKPKGVLHTTGGYLVYAATTFRYVFDIQPEDVYFCAADLGWVTGHSYILYGPLMNGTTTVMFESTPTFPDAGRLWRVVDDLKATILYTAPTALRSLIKEGDAWVKKSSRQSLRLLGSVGEPINPEVWRWYHDVVGEGRCPVVDTWWQTETGGILIAPLPGATPTKPGSATLPFFGVEPVLVDDEGRVIEGNGVSGNLCLARSWPGQARTLYGHHQRFKETYYARFPNLYFTGDGCRRDEDGYYWITGRVDDVLNVSGHRLGTAEVESALVAHEAVAEAAVVGFPHDLKGTGVCAFVTVKPDWQESASEQMVGALKEQVRHVIGPIATPDRVVLVNGLPKTRSGKILRRMLRKIASGEVENLGDASTLADPSVLDELLAKATPPQAKR

SEQ ID NO: 16153 - protein, 94 aa, Myxococcus xanthus
MSTNPNEEALEALAAARWRVAGVLTVTTLVAYLGFILLVAFDKPLMGQQLVPGLSIGILLGALVIVAAWALTGIYMLWANGKYDRALHQLRGGK

SEQ ID NO: 16154 - protein, 544 aa, Myxococcus xanthus
MNPAETTTQLGQPNATAILFFLLFVGVTLAITYWAARKTKTTSEFFAAGGGVSAAQNGFALAGDYMSAASFLGIAGLVATSGFDGLIYSVGWLVGWPVVTFLIAEPLRNLGKYTFADVVAYRLKQTPVRLSAAVGTLTVVSFYLIAQMVGAGNLIHLLFGLSYEAAVVIVGAVMILYVLFGGMIATTWVQIVKAVLLLAGATGLAGMVLSKFGFSPLRLFNEAATQYGAEVLAPGKLVNNPLEAISLGVALMFGTAGLPHILMRFYTVPDAKAARSSVFYATGLIGYFYLVTFILGFGASVLVGRQAITGVDKGGNMAAPMLAEVVGGTGFLGFISAVAFATILAVVAGLTLSGAAALSHDLWSSVVRKGQAPEAEQLKVARLASLFLGVLAIILGVAFKGQNVAFMVGLAFAIAASANFPALLLSMAWKKFTTNGAVASMLTGAISSVLFIFLSPTVQVDLLGNTSALFPLRNPGVITIPLAFIVGAAVSLLFPEHESAARFAEVKHRMHVGVPQPAPAVATVASKPADEPSRPAATGSEAKA

SEQ ID NO: 16155 - protein, 348 aa, Myxococcus xanthus
MLACLLLAAGAAAAHDADILYIEAHRARAEAPEVRQILTMTPETLALLLADADGGSLLTRHGLDARRDAIATDIWDAMPLASGGLPCVRTAHATAPRQSFVELSATFTCPPGGMRQRFRVLTRLPPEYRVILGSVREGEVPGAVFADATRPEVDVPEGGRGTPLLSRFAGWVGLGVRHIFEGVDHLAFLLAVLLVGGGWRRVLLLVTSFTVAHSLTLGAAALGWVVLDGVQARWVEAAIAASIIYVAVENLVLREHRHRVLVTFLFGLIHGFGFAGVLAGYGLGESVVTALLGFNVGVELGQAVVVAVLLPVLRMVQRRPALHTRAVRGLSIGILAAGGYWMVERALG

SEQ ID NO: 16156 - protein, 101 aa, Myxococcus xanthus
MYVVEGQENGFDSIPRAMYWAIVTVTTVGFGDITPKTAPGQFIASILMVMGYGIIAVPTGIVSVELAAATRHAVDNRACPACGQQGHDLDAHFCKHCGHGL

SEQ ID NO: 16157 - protein, 237 aa, Myxococcus xanthus
MLFRQLFDTTSSTYTYLLGDEEQGTALLIDPVAEKLDRDLTLLRELGLSLTHALDTHVHADHVTASGLLRARTGAKVVSGITGAPCADIHVKHGDTLRAGTFTLQVLATPGHTDDSVSYLLGDRVFTGDALLIRGNGRTDFQNGNAGTLYDSITQVLFALPDETLVYPAHDYRGLTVTTIGEEKRHNPRVAGRSRDGFIQLMNNLGLPKPKLIDVAVPANRACGLTAPVRARGSFTH

SEQ ID NO: 16158 - protein, 299 aa, Myxococcus xanthus
MPRTAHRPLEVDEEKLVLQFPSLDRKAVGAFFTPAPLAERTLALALQHVGGGPLTVVDPSCGAGAFLTAASRLRPGVRLCGLELDPEVARLCQARVPEATVRAGDALRDGLEPLLATTPPDHQELWVGNPPYNGTSSVLKDPGTYARLRALLPLALMPGTSLRDDFAFFLLVAAHRLATRPGALAFIIPASFLDAFMYAPLRQSLLETLSLREVVDLGPGAFAGTQVRTCITVWSSLPGPHPAPRFERGGIGQHFTPEPPEWRLAPTAPEASALDARWRERGEPLTRVVPVSLPGVKTR

SEQ ID NO: 16159 - protein, 184 aa, Myxococcus xanthus
MKIRALLTAAALTAALPALAQEGAGTPPPADKKTQPKGQTAKAQVKDSEGKDVGEITLEQTKQGVLIKGKLSNLPPGQHAFHIHEVGKCEGPAFTTAGGHFNPTKKAHGLLAPKGKHQGDLPNLYVAQDGTVQFDIFSQNGLTLKSLFDKDGSAVVVHAKEDDYHTDPAGDAGGRIACGVVEKT

SEQ ID NO: 16160 - protein, 235 aa, Myxococcus xanthus
LVAVWDYGRGRSLVMATDASWYWAFAAHKHGSPSRAYDRFWGNALRWLVRDPDLTTLKVTADPPSVEPGRPVGVVVQARMADYQPAQDAQVRVELFSVATQKPVAVQTGTTGTDGVVRLEFEPPAPGPYKLLASAKKGETDLGKGEDAVAVRAVGPELSDASVRPELMAQIAKETGGKSYTLPQDGLPDVPLLDPPVVEVGRARDQPLWDRWYYLVALIALLGAEWFARRRFGYV

SEQ ID NO: 16161 - protein, 759 aa, Myxococcus xanthus
MVGEKALRIVGVALAALLTAGAAENPRSAILGTVIDAQSRQPVAEVVVTASLSAQGGERIAVTQPDGRYRIPDLPPGDYALRFERELFEPYSLPLSVSEGRTLRVNVELQPTEPGEAVGLFCGGPTVDTSSSTLRFIQWREDVSRVPVSRPTKWAGAMRTSDSLAEWVPGTVDSVDGRSFSGATPFENEYLLDGLSTRDPTTGRNLLPLSQELVSDISVLTGGYMPEYGRTTGGIIDLEPVVISNELHGEVFANWAPGALEGAWRPATGPRPALSSDGALRHLGDFGGTLGGPLLKDRLWFFAGIVPALSRVEQDAGFMDQRSLQALARLTYALKHRHWTSLTVVTTPALMRGMEGAQAPRAVDSDTVMTVLAYNAMVLDGRVTLDAKASWLGHDVTRLSPVAPASVDTDRFQAKTQASYWLKALGHHALETGLELEHVVQRPSQVADITSSNLSGFVQDRWTLNDRLTLNGGLRYDAQFLDADVRGNMTHHQLSPRVGLVFDPGGNGRMKLFAHAAKYQGMVPLGLLTPDARIASRLGPTSSSEFIAGAEHELSLFAKAGVTYTRRRLDDALATIADDGAGGFLIVNPGAGPAASLPKATRTYDAVTVELGRSFWDGWQAQLRYTWSWLHGNYAGPFGTDGGRPLSQSRLLAADRPHVFKAFASKEFTLTRKLTLNAGLAYLGAAGAPREAASTRTPWVHTIDAQLSARYDTDDQHIVTLRIDAFNVLNAQTTLREETLLPLQYQTPRQLRLGVRYSF

SEQ ID NO: 16162 - protein, 1121 aa, Myxococcus xanthus
EEIASAFNAVVSLNATLTQEVVRVERVVGREGRMGERVSLGDVRGDWAHSINSINSLIGDLVQPTTEVARVLVAVAQGDLTQKMALEIDGQPVKGEFLRIGTTVNAMLDQLNSFAAEVTRVAREVGSDGKLGGQAEVRGVSGVWKDLTDNVNLMANNLTAQVRNIAEVSTAVANGDLSKKITVDARGEVFELKSTINTMVDQLNGFASEVTRVAREVGTEGKLGGQAAVPGVSGTWKDLTDNVNFMASNLTTQVRGIVKVVTAVANGDLTQKLMVPSQGEIAALGATLNAMTDTLNVFAQQVTSVARTVGVEGKLGAQAQVPGAAGTWKDLTDNVNLMANNLTAQVRNIGEVTTAVAKGDLSKKITVDVRGEVLELKDTINTMVDQLRAFASEVTRVAREVGTDGKLGGQADVKGVGGVWKDLTDNVNYMASNLTTQVRNIALVTTSVANGDLSKKITVDARGEILELKNTINTMVDQLNSFASEVTRVAREVGTHGKLGGQAEVRGVSGTWKDLTDNVNVMAVNLTTQVRGIAKVVTAVANGDLTQRLKMEAKGEVAELADTINAMTQTLSIFAQQVTDVARTVGVEGKLGAQAVVPGVAGTWKDLTNNVNLLANNLTDQVRNIAEVTTAVAKGDLSRKITVDAKGEVLELKSTINTMVDQLNSFAAEVTRVAKEVGTEGKLGGQAEVRGVSGVWKDLTDNVNFMAVNLTTQVRGIVRVVTAVANGDLNQKLTMDAKGEIAALADTINAMTQTLSIFAQQVTDVARTVGVEGKLGAQAEVPGVAGTWKDLTNNVNLLANNLTAQVRNIAEVTTAVANGDLSKKITVDAKGEVLELKSTINTMVDQLRAFAAEVTRVAKEVGTEGKLGGQADVKDLSGVWKDLTDNVNVLAGNLTDQVRNIAKVTTAVANGDLSQKITVSVKGEVLELKNTINTMVDQLRAFASEVTRVAKEVGTEGKLGGQAAVPGVAGTWKDLTDNVNVLAGNLTDQVRNIAKVTTAVANGDLSQKISVEARGEILELKSTINTMVDQLRAFAAEVTRVAKEVGTDGKLGGQAAVPGVAGTWKDLTDNVNSMASNLTAQVRNIALVTTAVANGDLSKKITVDAKGEILELKDTINIIFR

SEQ ID NO: 16163 - protein, 553 aa, Myxococcus xanthus
IAGLVLFLGGARAQGRGVLGASILLLVHALAHREDIFELWPGPVLALAGLAVVTLGPWFVRRRGLSESAARMRIHQAMAIYLLAALVYALATNGTPSSTLAALNLLGEMLLSMGGSWMVSPALPVTLALVAASVLVAAFQWKGTLASLVATLGAWVVGGTFVASLMAFLSMRASLVGPWLRYGALFILHGAALSLAASVGVLALHAAQEWVRRRRSDVAGGLSWGRDTGFVVSGLMLAALAVGGSASDGALPLEIASIGILVLVALHCAWSQHTGRHVYFVQTAVVGVYALVRNLYAPGLRAEHDAFFALALGFILVGVTVLARRAGVQPVEAATRRFAALLPVGMALVLPGEATQEAALLAGGSGLLYATLGAVERSRLFGAFAAAACNFALLISALAFGLEGLEIYLAPMGLLLLMLGQLFAESLPHAARNTVRILGGLLLYVPASARIAVQVGQSPDGTYALVFSGVCLLGVVAGMVFQIRAYLALGTLFLTLDVAATLLDAGLRDHRIGFLVMTLTGLTLIGGRVLTTLKRQEWEMLVRRVRVQLRGWD

SEQ ID NO: 16164 - protein, 161 aa, Myxococcus xanthus
MGGFGAISYAARRPDLFAYAASFSGALDLGDAAIRATVTEEGTRWLQNPDGAFGSPFWPFDQAWNMNNPIPRAASLRGVAVALYAGSGIWDGDVLERVPGASTDRFHHALNAAGVPHHYEMYGRPAPGQKPFGCDGGHNFSCWNYAFFDVLPRMLAVLDGP

SEQ ID NO: 16165 - protein, 233 aa, Myxococcus xanthus
MSDIMDAMDRRDGGNNSATPRIKPDVPLSRRENFAFDAIQPGYGTSKSAIDKHGKLQPAGDSVTTSASDHVDGEKSIKAKTPYTSFSGPPVGVDGTATGPLVDNPLYGKDRIVTNPAKDPKSGVVLDQFDIQRDLRTSTRPGFDETAVLRSEPRPQPLWQPTPEERAVMPQVGVDPEKPSFTFRERAMVNSARDKEYLVKGTIHEFDFFQGQPDGSLKPLSKQEVIDEARKKS

SEQ ID NO: 16166 - protein, 130 aa, Myxococcus xanthus
MTALAERIVDARVRARLMVLAAFCRAHASRLLARLAALGRGPLPVPPEDIELDSDTLLELRREGAFARASAARYETTAELARQQADLSSAWVCELNRTEEQDRSRELLSLGEGGPGARGPRRRAGQRRPG

SEQ ID NO: 16167 - protein, 335 aa, Myxococcus xanthus
MLLHGDFANFVTNFVPTLGNPASSAPGLAPYLAARDIDVWGVDRRWTLPSAYGDISDLGEMGVAQELGDITVALTFARAARLSGDRDKGRIVLGGFSHGGELAYAYAAANGRHVSAVAVLDAYYDIAPEHAELRELACANAAAGREALAQGVTDSDNSFFITLGELARSAPQAQSPVFSSYTNRGALLAMNGLTYLLAPYTPLYHLSAPILDANGDVAALRESSEDSVSAWFASAPPHQSLRETVELDEIWCGATPRPELSNIRVPLFYLGAAGAFGDYGLYSTTRVSSTDVTALVVRRFGPERVSEDFGHGDLLYAADAPTLAWQPLATWLLSH

SEQ ID NO: 16168 - protein, 155 aa, Myxococcus xanthus
MALGVGVSKHFFSSPVLDVLEVVEMNDFSRYDVEVPLYLSADWGDVFKLYAAPKYIYSRTRLDARLVDYSQQGKPVSGFDARLPATVGSHFVGSTLGIAVGYRYVHLFAEVTGGYFRSRPQLFGMERNLGGVTVMPSVGLAIRAGGSDRKPTAGR

SEQ ID NO: 16169 - protein, 422 aa, Myxococcus xanthus
MPAFLAQMDQVPQNFRPAEQVSDVEALRRDYEKLRIAHEFHRQVSLQGSQTGLFEQILKVAFQLLAADHGVILKVAADGEFIPSAVHHRSDKAVNVMLSDTVLKRVVETGKAVLTADAIIDERFSAAESIVAQGIRSAMAVPLKVNGKIQAVLFLDSRQQINAFSEKDLTILSGIASQASIALENAALAEQIRAEAVTRAELSRFLSKAVADAVIAGETEDLAQSRLAEVSCLFADIRGFTTISENDSPQEVVDMLNAFFTAMAGVVFRHEGNLDKFIGDCVMAVWGPPLSHPDDAARALRAALEMQDAVHELNRRRVAAGKQPIEVGIGVNTGQAVVGYMGSAERHEFTAIGDTVNTASRLCGMAKSGEVLASESTVRRAGAGFDVEGLPALQVKGKEKAVPTYRVHGLEYTTAASSSRRA

SEQ ID NO: 16170 - protein, 747 aa, Myxococcus xanthus
MSPTTQACPNCGHLHDIRVYVSGQRVQCRCGIRFEARRGDVAAEVARNTMVPTGSGIQEQRPPANGTSGVVTVVPHAEPEPGIDISLSRAPEPVRSAPPGGVNGLPGVAAPGTSGVAMPSSNGASDASVDQTLVRSSAKTGSDTAHSELNAQENSTFVGAGKVDLPGLELLELLGRGGMGEVWLARQQSLGRTVAVKLLPPRLAKDPEFVTRFEKEATALAALNHPHIIQIIDRGVAGEHYYFVMEYVEGRSLREAMSAGLPPEKGIKLLLAVARAIECAHDKGIIHRDLKPENILLDGRGHVKVADFGLAGIRAPDSRLQLTATSVAMGTLNYMAPEQRRDAKNVDGRADLFSLGIILYEVLTGELPLGRFKLPSSKVPGLDPRVDPVVDRLLEQDPAARYEKASELCAALEAMISTSSAPGIPQSDLDGRMVPAAARSVRPGRQTALSRQLRSGWRRVRGGLSVVGGLALLGFAVRWFVGPVSLHLGDDQRVIIGTKGIQVKPGNRVLPPNTYGEVFSSLSFAAPAKAGGTSRLELGFNEGNEEVNVHSGQWRLVDGELQALQAGKETNGRRLIPRAYIAQRYFSSNDFTAEVLMDVARLGPEYAQEADAQHYGELAFRIKDLQVSAFAIPDVGMRLSWRYFMPDGREVVGNSAQDTEALVEDEMPLPAHGPYQVRLQMRRNSSGVLVEAFLNNERYARKLLVGLEDRVGKVALGCRNLSCSFDDLKVRGHLMPRPVRRVAASPE

SEQ ID NO: 16171 - protein, 292 aa, Myxococcus xanthus
MALTPVYAACLLGLLVVAFAYGRKDVTSRPYRVPLLWFGLLAGVSLVVLRHVQGTGAVLASETAVKAMGSVLLMLAAGLALRGAWARTRANVLRGSAPVPLDEAVEALRAGASPGWGVYHGVLDAESTLTSPGGVPCVFFDAEVREVAADGRRGPLLSRERAYAPVLALRGQRLHASVSFSPASLMAPVEVRRCKALPGTVPASWYQTAHPEALSWERVGAVGESCLVVGELRRGPVEGSYALVGREGGPAMLVLGPQAPATCGTLARRAWRHFAAAGVLSMAAAVVLSGAL

SEQ ID NO: 16172 - protein, 93 aa, Myxococcus xanthus
EQDLYRLADPLPPPTLVASVMARVSAEPVPRRREVWSGLAILLTSMLGGLGYLVMSDQALGRLGTGLASVLVQGRPFVEGVLSGAHALWSTAG

SEQ ID NO: 16173 - protein, 189 aa, Myxococcus xanthus
MAEEAPPLPWKADVQAARRGDPSAFEALVRSVQRPVYGLALRLLQSEAEAAEVAQEALLRAYQNLHRYDDARPFDLWVLAITRNLCLDLLRRRTKVRTEELEPMKEVLPSGEASQEEGAIAREERQSLEEAMATLSVEDREVLALYYVQKRTTKEIAQIMGCAPGTIMARLFRAREKLRKKMTAEEAPR

SEQ ID NO: 16174 - protein, 514 aa, Myxococcus xanthus
MDKQKLSTFDAVTRLRDAFGLKPGAISYCGLKDKQGRTEQIIAVDGADVDMQEPDLRLKYLGRTDKPLSAANITSNRFSVTVRALQPESLGPLNVAAAEVNRLGVINYFDSQRFGSLKHGQGFIAKDLIRGDFEAALHNYMAKPSELDRTEDAKIKAFWKENWGRWDARVPYEGTRKYHRVLKSLRDQPGDYLRAFMQIDADYRAMLIFTYQSFLWNEGVRRYLQLMLPREHLFPMRYQAGTLLFHRDASPEVLRTLRDASFPLLAPNSTFSDPKVEEAVRWVLGREKLQLSDLQVPGAERRLYFKHEERPLLSFPHKLVVGRTQADELNRDDIKVNIAFTLPPGAYATLVIKRLFHFDYAEDSAETIRASQRPKLAEAEAAAAHEPSSRRGPPRRDADGARASSRSAPGTETRRRSSGDRDTRAPAGNRDARGAGAPGRRRTGPREVELLEPASGRARTLAAKAPAPAKAAEPAAPLGFRERQRQRKDARSAARAETEAKRAAKAKPAKSRKK

SEQ ID NO: 16175 - protein, 785 aa, Myxococcus xanthus
MKVVNKLLEKLPDVVAGKVPDVKLQDQDIKVPLAQGTFTEEKILPPKLAMHGFTLSFEATGEASIRNFNSLGDVDENGIIGEPSPESAEPGPRPQLLLGSDIGWMRYQVSARVKAAVSASLSFLASENQTELSVTLSDYRAHPLGQNMREAVRSDLSELRLMQATDLAKLTTGDAVAWQVRGALHTRLELNWADIFPTNLNRLGFLRGNELLALKTSAKAGLSARVSLTDDYQLSFSRPRAGRIQVAVRKVKSHEQALSAGLGITVELLDPATVKAQLGQLLEALLGPVLRDLVKKGTTAVEIMDGLVDKASKAKLDDNQKKVLGLVLERLGIDPQLADPANLPQAWADFKARVAESLENAVRTQVAEGFEYEYLRLSETSTLLEVVVEDVTAMRFHESLLKGNLVELLKWMKSLPAQQSEFELRNYLHATTLTRQQAIGFSLGLGSFELLKAKNVSKQSWVTQENFQGARRMAFLGRRGYEDKLLGTRGQWVVDLKADMTRFSPTPVASDFGYGLHLMLWGRQKKLSRKDLQQAVDDAVVWGVLDAKDAATVISTMQEDMGKHPIETRLELKMADDSFRALVPRIQTLELSRFSRALARALPWSEQLPRASAEFRRAVYAPIWEAYLREVQEQGSLMLNDLSPSRAAQIAKWYFQKDPTVRDLGKDLQLIESEWRPGGGNFSFAEVISKNPNTLMRCRNFVSGMVRLRRAIDERKAPDELRTVFGELEGMWTTGFHLRAAGSLLSDLAQSTPLGLAGVERTLTVRVADSEEQLVFSTARSTGAA

SEQ ID NO: 16176 - protein, 176 aa, Myxococcus xanthus
MVAEGRFREDLYYRIKVVEVVLPPLRERGAEDIERLARHFVAAVARRHRLTPPRLSAAAVERLKRYRWPGNVRELENCIESAVVLCEGEILEEHLPLPDVDRAALPPPAAAQGVNAPTAPAPLDAGLLPLAEVERRHILRVLDAVKGNRTAAARVLAIGRNTLARKLKEYGLGDEP

SEQ ID NO: 16177 - protein, 281 aa, Myxococcus xanthus
MFEQRFQRNLGVVDAETLDKLSRTHVLVAGVGGAGGQCAVDLARLGVGGVTLADFDVYERHNMNRQVGCFESTLGRSKVEVVGRMCRDIHPALRLREVPEGITEANVEDVLGGGGVQGPVDYVVEVIDIAGAHEKQVLHRACRQRGVPVMTGLMLGFGAALHVFQPDAPLYEALYILPDGRIDLPAIIPHLGSYMLREYMDACFQGRGHAPTCVVGATSAAGMMVTELTRAVMRGPRSMVSWPEYLYVDFFDHSFVRGTAASALARRVDPASRAGGAPAAS

SEQ ID NO: 16178 - protein, 256 aa, Myxococcus xanthus
MAKESYNDLIFQLGDLARDRLPGKPTCPRSMDRVYRAEEAVVARRDELAALEQEMNDEDAAYSDFLAEQGEERAKHAVIVKKWKKAVDAIDGKVKELRKTLASRKAEQRYAEDGLVKLEKKISDMELTGEPPDKIELARGNLKKNRLQQMRLGRQLEDLESNLATALTPLPGQPGAAGILAHKRMLEMEDEAEERKLDHEHRMAELDQAIAAKEEQVQASEDYLDQALFLLGEDVYAQRINDAQLAPFYPRLDRAQ

SEQ ID NO: 16179 - protein, 62 aa, Myxococcus xanthus
MTGYRTTSLLPLPLGDGDGSLYGVIQVLNRRGEDRFTNEDTQRVTVIASQVSTELQSTSLYQ

SEQ ID NO: 16180 - protein, 314 aa, Myxococcus xanthus
MADPARTKFFHAAQGDLQFLAEVGVRVQGLFDTHRAATLLGWPKVGLADLARERLGVELPKEHQQSDFSIRPLPPGMREYIANDVRYLCELGRQVRDACREADILEEVLLDCVRLCDEAAARPDVGADFKPKLPRAGLNPTQMTLAHAIAHALHRKRLEWAEKDNVPMGRMLSNMALGDIAVKLPTNPKELARMAGVRGSFIRSHGEELLAVVRELLEKSRRGELAPEREPKGPKDTNKRKREEALKTFRVEKATERKVTPSVVLTNPLMDALASQPPKDVEALTQVPYLGEKRVRLYGPALVELLAAYPVLNA

SEQ ID NO: 16181 - protein, 912 aa, Myxococcus xanthus
MEMLPVRCRHFIYPLLVLCLGACAGSRPQPAPTRSAPARPVTQAVTPEKEAPVLTPPGLRLSPAVRPVRQTVTLELDPRRKMFSGTTDIEIELPQATHEVWLHGEELSVKDAAFIVAGARVKTSTLPIGDMLVFLPREAVGPGTVILRVAYTGRARARESSGVYREQDAGRWYTMTQFQPLAARRAFPCFDEPAFKIPWRLTLRVREEDGAFANSPVEAETHGPDGWKTVRFQTTPPLPSYLVAFAVGPFQAVDAGVAGQHRVPVRMLVPQGRAAEAAWAAQATPPLLEHLETWFGTSYPYAKLDVLALPGTQGGAMEHPGLITFSAPLMLGPVEGDSLWRQRYFALTQAHELAHQWFGNLVTPAWWDDLWLNESFADWLAYKVVTQWKPEWRGDVRRVEARGDALVEDRLVSARSVRQPIEAPGDVHSAFDGITYNKGAAVLAMFESWVGPDAFQQGVRHYLDTHARGTATTADFFEALTQATGKDVAPAFSSFLDQPGAPRVAMTLECPKEGPPRLTLEQRRYLPLGSPGGRGEEQAWQVPVCVRYAAGGTEGRACTVLSESTGTLSLDGAKSCPDWVHPNAEGRGYYHALLRGDAMERLTRQGGRGLSIAERRVLLDDAEALVASGELDVAQALTLATRLLRADDPDLVMGAAALVASVRDDFVPRAAWPNRARFVRGLFGGQARQLGFVPRPGESDDVRMLRPRLVWMVAQSGEDVLLRTEAGKLALRWLDDRRSLSMDAAQGVLGAASASGDAVLHQGMLEALRTTTESRERDVLFTAMGGFQDSALASASRALLLAPDVDTREALPILFRQLEEQPTRAGAFDFLREHFETLRERLPRDIAPWLLGTGGFFCDAEHRARFADFFAPYAPTFEGGERALAQALERVDLCIAQREALRPGLERFLRRY

SEQ ID NO: 16182 - protein, 80 aa, Myxococcus xanthus
MLLGFAPAEQFNLQKGAEHITDYQFGKKSIHHLFCDTCGVRSFGKGTMPDGKEMRAINVRCLDGIELDGLPVMKVDGKNL

SEQ ID NO: 16183 - protein, 197 aa, Myxococcus xanthus
MEAMGVRVVVRGVRRGMSSYRSALVCRAGAGLTVERLKGTTATWVDRDSVAGYLLPTAYLKTQGLEPTRAFFAQHFAGSYQGALESVLDGKADVTSVFCPPASTGLTFATGVEDVLGAGAGRRFELIAYTDEAPNDGVPVAMGLQPQLVSSLESTLLSLQTSPDGQALLKDIFNAERFESAPRMGYRALYRVALASL

SEQ ID NO: 16184 - protein, 274 aa, Myxococcus xanthus
MAREQAVKARNDRNGALVEAMLLAAMADGRVSQREMQTLLSRVLERPEFEGTRPDELNALVETSAARLSEAKNLDDVLASLRRRLPDHKNRMLAFGLAAAVALADQRATRDELGLLKTFQAALGISEDEVAQIIDVIENGGSLREALGEPLERLFAEVMVLVSAADGKLQEAEARALVESFAADPLFENVSPERAQSFVSESVTALAAEGLPQRLHVLAHGLTTHAQRVKAFRLAIKIAHAGGAPSHPEQRILDMLQATFGLADDEVARLSREG

SEQ ID NO: 16185 - protein, 123 aa, Myxococcus xanthus
MFAKGELVDVTGITKGRGFSGVMRRWNFKGSQTKTHGTHEYQRHPGAIGQRKTPGRVYPNKKMPGHYGVDQVTTQNLTVVDVDVEKGLVLVKGAVAGHNNGVVYIRPSIKAAMRAQHKAARGA

SEQ ID NO: 16186 - protein, 266 aa, Myxococcus xanthus
MGRAIADHRLIEDGDRIMVGVSGGKDSYTMLHLLRELQRRAPVKFELLAVNLDQGHPGFPADKLEAYFQREGYPYKLLKEDTYSIVLEKTPPGKTQCSVCSRMRRGILYTAAVELGCTKIALGHHRDDLIHTLLLNLFFAGSIKAMPPLLRSDDGRNVVIRPLCYAPEKDIAKFAELMAFPIIPCDLCGTQENLQRKRMQRLMEELGKEIPNVRQSVLNAMANVRPSHLLDKTLNPDPLHASEEGATTTEPKDTQGSASPWLESRQ

SEQ ID NO: 16187 - protein, 213 aa, Myxococcus xanthus
MPKFTLVPPEIEAYADAHTTAPAPLFDELRDVTYARMSSPNMQVGSVEGTFLRMLVALTGARRVLEIGTFTGYSALMMAEALPDDGALITCDIDPEATDVARAFFLRSPHGRKIDLRMGPALDTLKTLQGPFDLAFIDADKPSYAAYWDAVLPLLRPGGLIIADNVLWSGRVLQPEGPSDHAIVDFNAKVAADPRVEHVLLTVRDGMMLARKR

SEQ ID NO: 16188 - protein, 455 aa, Myxococcus xanthus
MRGIATQYNPETGQYETPTHEVVYQVPAEDAMMTARFILEKSRYDVMEKEGGLEMFSSFIPDVIPPERYYIQGTRLGPRQALVRVFRIRYTQEGGGYTAEASGRSGGHLSVADAFTNIPGLEGYRPAHGYRDLGIEQKLLERLEMAPALELVGGNSPVPIRSVVMENWGEKGGTTATSAAPACGAPLAGASSLFSAGGVLLVADPLGTQEVPSAALRMLCEASAQELPVTLALSIPVSEQSLLDSYLASDGDSAAVQELLSGSAFWRRTYQDGRSSRAMLWLVEQVRRMRVSGKDVDVAAIDSDKAHGNAREAQMAQHLLNAQSKRPQAWTLVLTGSVHARTTEVSWDGDFEPMGSRVVRALPSVRALDVGFQRGTQFVCRYSVWDEEVECNVFGISPTLEARQSSKQAVGLQLFTSQQPHGFHGRLYLGALSASPPALQAPRQDTTVDPVSSSK

SEQ ID NO: 16189 - protein, 258 aa, Myxococcus xanthus
MLHLELASNLFNALFAPKGYSPKFTGEWAPRYDKFPSWIAVNKPVKLGPVNPEQMSLLAAIETPEPKTDGAPNGPQDVYDSIGQFYKAIEQGINQRWNELYQPDADHRQKSEFANPQYKGDDYARFSSTIGGDSRTALKQANEVLQAIVGQGEGNLGPVIDPELRPEDANDLEDQFSHFARFRMVQAMLKFGGPLETYPTTGGSGLAAAQQQLTAGFTSLLTALEKGYAGDDELDLGSMWALPKQIVSVWSAGGVPQF

SEQ ID NO: 16190 - protein, 177 aa, Myxococcus xanthus
MEQARAEKNAEAIRDLDSIAPYAVGKTPVPLKDIQLQRRWLNFFGGAAYRRPDASFEGAAVNLSPEYTDEEVRQVWKAQDFSVERLLAAILTADLSHVKRLKTPLLLFLGRHDRNVSAMVAAEWFAGVKAPSKRLVWFEQSAHELMAEEPGKVLLSLVRYARPIAERAGDVAPASTQ

SEQ ID NO: 16191 - protein, 114 aa, Myxococcus xanthus
MIRRGTAYGPELPEGILEDDGAERGLMFAFIGAHLGRQFEFVQSEWVNGGDFLGLGDAKDPLVGANDGTGVFSVPKRPIPRRMQGLPRFVVTRGGEYCFMPGLRALRWLADLRT

SEQ ID NO: 16192 - protein, 40 aa, Myxococcus xanthus
MPPGDGRAGDVLVADSTIFSTLFGADDSLLRFWKNLATAH

SEQ ID NO: 16193 - protein, 173 aa, Myxococcus xanthus
PQAMAIPRSTDHLERGKYGPIFPKTPACYGFTIVANVKPGRADAMRGYGQRVAEALKANPDLLAPLKLHYLRWVLFDDDTRFMYQGIFDTDFDKYTEDAVVLFTQSGINTAFENLEGFPMDWKTNTPAFIQFIRDHQCNSFLEYGEYPFFTGDEIKKALKIKAALAEMLEQMQ

SEQ ID NO: 16194 - protein, 571 aa, Myxococcus xanthus
PDGTACEPDNACITGATCQAWLCRVEERACDNGNACTTYVCHVLDGCQSVPAPPCPASGPCQVGTCDPRMGCATAPAPDGTLCGAAQGTCEDADVCLDGACVKRDLPEGFLCEAASPCQVSGHYRGGVCARPAAQPLKVDWEHDARAGEEQLQDLLVGPEGDVTLSGFYGTPVLDAAGKGPLVRASKPARRCMLWNDRILCMDMPMDGTVSLLERDTGTPRWTFTLADARPDFRDRTQTLFLARLAVMAPDRLAALFEAYPTDQRRDTACRMYFLVVLDAFGHMVSARELTDPMLAECNHPHPYGLASDAVGDLYVAFAPTLNTGAPLASGTPSLLMAFSSDGVPRWRRTEPLRAGELAVVNGLLLPEWGFQALSTRDGTPVGEHLAQQLGRAVATRDVVVPSASGTTVNADVDSLSFTPAATQLKGFRLPDLEPAWLYSLKEGQHLTSKELRLATWPRGAGLPPETLVLTHAVAADNQRLLVGVRARDGAEAFQCPLDYAPRTVPQLMELGPGALYLMDGALSCGECDPPFANSQPRFMRFPMPGLLPANAPWPGTFGGPGHGHHENAAH

SEQ ID NO: 16195 - protein, 220 aa, Myxococcus xanthus
MDTSVSPRTVTGRLDVHPRGFGFLTVQTPGSPEVLSAFVPPPDLNPYFAGDVVTATVTAGADGRWSASQLSLVERPRTQVYGEVVLRKGVTLLHVDREVANADWVLDAAGTQVQAGDAVVARIDEGKVVLLYRVEEGEDRSLERVIARHGLRKDFSAEVVEEARGARAVPHAVGARKGLAGRAHGDGGCAVHAGHRRRDFGAAGGAGRGAAASGVHRGRG

SEQ ID NO: 16196 - protein, 273 aa, Myxococcus xanthus
MIARTLCVFASLAVSLAAPVAAAQDDENVLDKVVVRNRLYEPGGKLEMSFGVGLPLQTHLTAHYVFNAGVAYNLFNSFAVEARAGYAASRHTGLARSISESFLNREDKRVTDELEDLWQMNLHGVAGVRWAPIYGKLSLLSDLPVHFQAYVWAGGGLASFKRNSVIQCTQVVNRELGICDNRTSVDDRGSATQNFWVNESRVAPVVSAAVGFRFFILDKHGVRLELRDWAFRDNYRVNLERDAWEAGQATGEPARSPGLTHLVQFDLGYTFSF

SEQ ID NO: 16197 - protein, 243 aa, Myxococcus xanthus
MRFLGWDLTDPYARIPRPVDVAEVDARGQVRFSELRWPVPSKALGFTPELLRASFPLNPEDVLVIDGPQALARPGASVREAERCLRAPGRTPDVLPEPGRPFAGFVRGGVLLFAALHARGGHPLLDVDTDSLEEARLFEAFPGATWRALSVEKLGKKTSHAGRTRRQAVLEARGLRFPPGLLPTHDQLDAALCAWLGWLTRKAPTHVTAVGAPLTVDNQGWLREGRILSSAHKFSTVKGLAAQ

SEQ ID NO: 16198 - protein, 269 aa, Myxococcus xanthus
MLALGSPRLDADKALFLLRQVPRLEDPSLFVAVMDVLRGEALPQSSHDEARTVFRQKLEALAAANPRAMQIQLLLLLGDTEPGSEMSAAEIDRLEQVAALPVWREGVFTRTYEEARKLLEGSGVPDVSATAMAVAAHSVTDRGSWVLRTRNVGTRGSLSPEGRKRLGRITRDIGTRMAEQPTMVERVVGLQLVRGGAQEMGDEAGREQALARIEALEGAVTLFRKASMDRWPLHALTEALIQASTRDEPAYLLSFTRVEANQAAETQQP

SEQ ID NO: 16199 - protein, 166 aa, Myxococcus xanthus
MDVHDGTLRTRVDKKLFSGFKGGSVRLYVSSPRVEGIHASGGSHVDADATRTDEFDVEASGGAIVNVRGVDARQVEAEASGGSKVTLAGRATDFDVEASGGSIVRALDVKGVKTLDAEASGGSRVEVDASDRVSGEASGGSVLQLVSRPSQSDVRASGGSKVVYKD

SEQ ID NO: 16200 - protein, 935 aa, Myxococcus xanthus
MSGNTLPLAPEARSLGKYEVLCRLSTGGMAEIFLASQRGLAGFHKLVVLKQILPDIRGEEEFVRMFLDEAKVTAAFNHPHIAQVYDLDIADGELFLSMEFVPGATLVEVARACRQANTPIPMGYSLMAVRDTAVALHYAHTFTDPLGRPSPVIHRDVAEKNIMVTYEGVTNLLDFGIAKSLARASRTAVGMVKGTSGYMSPEQIMGEPVDARSDLFSLGVVLHECLTGMRLFYAKQAEAMMNAVLRCEVTPPSRTNKHVPPELDAIVMRALSKRREDRYASTLEFARAIERAVGPLIWHPEQSSELMLRLFSDRREQTRQLLMSGQNDTGDTTGVVNLAKVMAMGVEPSELPTGGVTLPPAPRASGTPRNAAPSPAPRRPTTGAPAASPEAGTVRKAVLQAPPGKRLASRASPADAHAPPPPPAEATTLPPSGGQHVRTQPGMPAHSPEHTVRTQLPGTGRDAGASASTPGEASSRQGSRASAADAQAADREQTQVRGVRSPESPAPPAPGDSRARPIRTPDTLPAADDAHRARSSRATEPTPAGDDAPRTRSSRAHEPAPTSDDAPRARSSRTPEPSPSVNEPPRAEARSRASRTQDGLRASVPTPPPAERDLQTAMIRMPVLPPERGGDTAPVTPSPRRPIPPRRRQGGSSTEPTTQPVRVQDMPMEEDEEESTVQGRGSDTTGPRRARAPQFQPQPARRSRAWMAVTAVVGVLALGVAVVMLGLDGGVVSSRLKPLLGQGAAPSPSQQTAGTRPPVNADKDLAAATATPVAPPVNDGPKDTGDSALVIADVDPATLTDQVPVPDESAPDSDSATEDDAPLKEPRTFKRVRNGTQRSKAVATAPRKAPATPPASESVPAGEPGFLTLVTEPKAQVFLGGQDLGKTPLFKVKLPAGQHNLKLVDATTKAHQVPVDIKPGETTSVRGPLSLLSDP

SEQ ID NO: 16201 - protein, 274 aa, Myxococcus xanthus
MQRILVAVLGVTLALGLSTGCTKQRISAEKAVARTLISDEQEEQLGKQVKAELETKEKIKYVQNAAVVDYVRGISTSILNQASKDRPGVKWKINVIDDPKTVNAFATPGGYLYVYTGLILAADTEAELAGVMAHEAGHVVGRHSARAMVNQMGLQAITQAALGQNPGTVAQIAASLVSGGTLLAHGRGEEIEADEYGARYASGAGYDPRGLITFFEKLQKEQGDTPALMKWLSTHPTNRDRIVNIQKIISQKNLRGSNNGPGGLPAIKQALGGK

SEQ ID NO: 16202 - protein, 75 aa, Myxococcus xanthus
MAAPEPAPAPAAPEPVKPAPPAVSASPAKKDPLLDEDVSDAPPPVVKKPEPSKSSKPALPPEPKYDISEWDPNGD

SEQ ID NO: 16203 - protein, 456 aa, Myxococcus xanthus
MRVRLAPTFNISEQVALKMEVLGLDNFIMGAMPDTLLPGNTRNIFGIFSESQDPLADALQDSIKLRRAYGEVKTPVGILRFGRMGSQWGLGMLRNDGTCFDCDFGDTVDRVQFVTNPFEGWYVTPMLDFNSEGVTDTRGTVGEPIDLTQSDDAHSWVIAIARRDTDQVIRSKLDNNQGVLQYGLHFTYRTQKWEYDGSTTNGQNTGFIPRDATLFVPDLWLKYEEKNWRLEFEAAAQLGRIGNRALDVGAINDPTLNQSLTVAQFGGVAQGELRLLDQKLSLNMELGFASGDKAYGFGNQPGRPGSGANGQTAPGDFEGPQYDCGTGGCRDNAIRNFRFNRDYRIDLILWRELLVGVTDAFYVRPSAKYTITEGFDIYGRVIYSQAMYAQSTPSTTRKALGLEVNVGADYKTEDGFIAGIAYGILFPMSGLQEFDATLRNDLDTPQTIRAWLGMQF

SEQ ID NO: 16204 - protein, 290 aa, Myxococcus xanthus
MPELPEVEIARRNLVRWFSDRRIVRAESENTRIFRGAERQQFDALTGRLESLVRRGKYLLFAFEGGKGLMGHLGMTGKFVRRTEGQVAPYSRARFHLDDGHVIHFSDPRMFGRLEPAPAARLRELDAVRILGRDPLADGLTAGQLQQAVGSSRKELKVALMDQERISGLGNIHAAEALFRAGLHPSRQPGSLTPDEWKRLVQAIRATIDFGLKEQEGEEPVYLEEGRSENPFQVYGRAGSPCSQCGTRVESFTQGGRTTHFCPRCQPEDGRRSEAGAPAVDGAKARPGKR

SEQ ID NO: 16205 - protein, 348 aa, Myxococcus xanthus
MRLPRLKHLSWREFSRRFVREFQEDSVTDIAAQLPDYLLFSLFPFLFFLVTLVAYLPFAPGAVDAMLDRIRPLVPGDAMGLITGHLQSLVNQPQPKLLTAGLVITLWSASRGVNALRTALNLAYDVSESRPLWKTQGLAMLVTLLGSLLIPLSFAAFLLGGRLGLWLAGKLQLVDAFHLVWSWLRWPFTASLVMLVLALCYYLLPDVKQRFKYITPGSVLGTGLWLTSTWGFTQYVEHFGKYNVTYGSIGGVMVLLLWLYLSGLIFIVGGEVNAILEHASVEGKSKGARGFGEPAPLEPPLKTPGAAKSASSAMRSKLARFRWRRRVARGQEPEPTVEEQDPRSSTLH

SEQ ID NO: 16206 - protein, 300 aa, Myxococcus xanthus
MLASDLGSDAPRTTDAQQQRLVNGAPLYNPNVSVHIVQKKRFADEGRHELTVYPATVQVNGKYTDHAGTAAHYTYHLQENFALQVMGQYNWYSNESAFNLELIDKVREQAQAASSLLLVWGAHAGVEVTPLYGKFAFLNNSLAQFSVVLSGGAGVGSTRHLIRPAVTNDVEGESFRVPARFGDTGTKFMGSVGGGFRLQFGESYALRVEVRDLIYTARVDRVDGCNLADFEALEAARSTNQDFASLNLSGSCRYEKFDGIDPKTKKNYREDIILGRDLVVEPSSDVLNNVSFYAGFSVLF

SEQ ID NO: 16207 - protein, 295 aa, Myxococcus xanthus
MAVRVGIIGSPGLAQALGIPGKGESHILETPFGPHAGPIVTTELDGVSVAYVARHGTGHVYNATRAPYRANMYALKVLGVTHVLATGTVGSLREHIHPLHLALPDQVIDRTYRRPCTFYDDVAVHVDLGNPFCGTLRQVLEHARDPLGPTVHAEATYVCIEGPSLSTRAESMLYRTWGGDLVGMTGMPEARLAREAELHYAMVALPTDYDSWQPRAPGQEHDDLLAQVSHNRKAVTASGAALIRRALPRIGEARAICRCDTALALAIGTERSRIPDEVRGRLRPLLGRYLPPNVA

SEQ ID NO: 16208 - protein, 282 aa, Myxococcus xanthus
MLRPGEDLLQVEERLWLLSAPTGQGTYDFAFDRFFACRRPYVLPESMEVVARVGVWNDYAERYRELAEAGIRLVHTPEQHLQATELPHWYPKLTDLTPRSVWFDERPDAETVERLLGWPVFVKGERQTSRHRKSLSIIEGPEQFRQAMAAYAKDPILHWQRVVCRELRPLRRVEEGAPDRIPSSFEFRTFWWKGQLVGWGPYWWQGTPYTLTPEAQREALGLGREVARRLDVPFLVVDVAQEVSGRWIVIECNDGQESGYAGICPFALWRAILDVERGTGAA

SEQ ID NO: 16209 - protein, 165 aa, Myxococcus xanthus
METPGGFRMSVAMTSCGSWGWVTDRTGYRYAAVDPVQGRPWPEMPAIFLRLAQFAAAKAGFEGFIPDACLVNRYEPGAKMSLHQDKDERDFTAPIVSVSLGLPAVFLFGGAERADRPARVRLSHGDVVVWGGPARLRYHGVTPLEPGHHPQVGGHRINLTFRKAR

SEQ ID NO: 16210 - protein, 138 aa, Myxococcus xanthus
MGIEVRYPESHAAYLERCHAAGQVRPTPLLLRYEADDYNCLHQDLYGEHVFPLQVAILLSEPGRDFTGGEFILTEQRPRMQSRAEVVPLRQGDAVVFAVHHRPVQGTRGVYRVNLRHGVSRIRSGQRHTVGVIFHDAA

SEQ ID NO: 16211 - protein, 301 aa, Myxococcus xanthus
MLQVLISAGTYLAGKRAMSELAPLTVVLWRFVLSGSVFMLLLCFLPGPRLPPRNEWGRVLMLGLLAGPVNQVFFFYGLSQSTAAHAALLYALTPLGVYLLSLGRGHERASFRAMGGIVTAFAGVVVLLLGRGLADASGSLMGDLLILGAVMSWVVYTTEGKPFVAIHGPIRATSWSMVASTLMMMLMAPFFAKPEAVLAASSAARYSIVYLGLLTSVVAYLLWYFALSRVPASKVAVFSNLQPAATALAAWVILDEALHWEIAVGGVLVLLGVRLTQAAHVRPPAVAPAAPERPPVSSSVG

SEQ ID NO: 16212 - protein, 293 aa, Myxococcus xanthus
DCMGERAAERLDVSLLLPGAKTVISFANNYWRDDAETVDSPIARYARGRDYHSTLRDRMKAFRKALNVMYPGLGSYGGVDSGPLMEKVWAARAGLGYVGKNGCFITEPYGSWVLLATLVVDAEVDDYGNGPAADRCGACRRCLMSCPTGALVGNGRVDARACLSYQTIENREQQVPEAFRFKFDNLIFGCDICQQVCPLNRRPVFAEHPRFAPRAVAELGVRELAGLTVEQYEHLIPGTALARARYDGLRRNAVYALGVAKQADAKSLLEKLCGDSSELVRTAAQWALLQLDP

SEQ ID NO: 16213 - protein, 113 aa, Myxococcus xanthus
MYEALGGILPWNASSLDRARQDARVRDRLVQALERRELVALRVQRRAAAWAWPEPALPPPRPEPEVIPLARPPVEVFTLFPDPARQAEALRQAAAAGVPFCEECEKQKQRAAA

SEQ ID NO: 16214 - protein, 175 aa, Myxococcus xanthus
MRQATEEAPTSALYAILDGARAPNIHRLVLTCGLTQSCLYAGKLPPELVEVAPYLVQLRPGAPATEQLLAAGWGKSWGIFVQSPAHPDALRRHLRRFLKVKDANGKPLVFRYYDPRVLRVYLPTCTDDELDFLFGPIEQFFAESEDGGSMLAYARRPEEAPLDAPPLTVLPTPLM

SEQ ID NO: 16215 - protein, 512 aa, Myxococcus xanthus
MKRLLSLFVALAPLAVSAQPDSGGYNRALAAFNAGDMDTAAPLFFELAESASDAEVKGKAEYFLGQSLAQKGLPVAAFITYAAIVNAGPSHPSYLKAVEGLVDMQQQLDEHNLIPSILNQAYTDEVRDRWVTLPKEVLARINYLVGTVSQRKSRFEEARSLLEAVPQDSRVYAKSRYLLGVVLADPRFPGRPSEASVLDKDALAAFNAVLAAKEGQLDLRATQHLALIALGRLHYRRGEYTDASAAYERVPRYSRYWDQALFENGFARFQNEDFGGALGSLQALHAPQFAGAFQPESWILKATVYYYSCLYDEVKTTLAAFDEIYAPMERQLEPFTGEDVPLVQSFNLVAAENRRLPRPVYLWLRNNERIREVMRMLERVDDEKRALTNGRWRGTPLAAQSTASLEEVRGTLLQVGGTLAQSRIREAADNLRTFSDQAEIIRVQTALDEKDLLQAGVDQKALLTRQSLYRPKMPSAAWNYWKFQGEFWIDEIGYYQYTLKRGCPAKTAEQQP

SEQ ID NO: 16216 - protein, 591 aa, Myxococcus xanthus
MKQSSKKFPGVLRTWSGVVAASLLAGCGGSESLSSEEPAAAAQEQAQTGAAPILDSMDAIALDGELTSKTRSLIRAKLAQGQVHQQVPVVSDSGQALVLNDQGLDGDEQAGDGVFSAIGDVDFVTHRATQDRIREFQERNPQTPLTVATFDNRVRVSERVLTPVSPDVFRPGVPIPIFPAGISHAVKPENSLIITHPNVVNDPTRTYDPCTNAGNPNGVWTFNHLMREMASSYVSPANLTEHWLRQWTVNQNINGWTVPARPAMTARILTPWPRSSGALELARSPFKLVAIVNRLDLGASAGPSAYASGNAGELRFVFAAVDRSSGTCGVRPFLVIFEYGVPHASCDAVRTWAQGWLNLSAPSMILGSSAYNAALTSLTQQVVVRNAAPRKPNGSAINQIRTNEEWLRYPWELREFHLMGSGPSVNRLQGQPTVLTPGDSHNNTTVLRDFINANTPAILANSYTVPPTYPTSSTPFLGAFPWISSPTDSYWRASGISVNDARHVFSRNTCNGCHGREARTEFTHIDEYGALSPFLATGMASPSTAFWVQDPVVTSLSRPFYEIQMRNTNLDSVANQACLARAFDRPKLSAH

SEQ ID NO: 16217 - protein, 410 aa, Myxococcus xanthus
MRAFLDNLRLALGTFLGNPLRSLLTLLGIVIGVATVITMMGLIEGLRVKVNNDLGRMGAHTFQVTKWPAGGFGRINWAKFAKRKDFEMPDSRAIEESCPSVGTVVPTDDEGGQKLATASSETRPSVRVFGTPANYPLVSGVSVQAGRYFNEVEALDGRYVALLGTDVSDALFPGMNPVGHEVRIKGRPFRVIGLLQKRGSMLGMFSLDNQVMIPLSVFHQLYGKKRSLDISVQAKSPELFSKAQDEVASLMRRRRDVPANMPNDFELHTNESVTASFNQLSQVITIAGVGVCLLSLVVGGIGILNIMLVSVMERTREIGVRKALGARKRRILGQFATEAVLLSLMGGALGLGLGFGLVFLGNWMMGFPMQVPPWAVGLALFMSCGVGLLFGIYPAARAAKLDPVEAMRAD

SEQ ID NO: 16218 - protein, 412 aa, Myxococcus xanthus
MSQRSAFRVDVLEGARIAVFSLKANRLRTVLTTLGIGIGVATLLAIVGIIQGLNTSFHKQLATFGANTMYVSKWPWMIKGDWWKYRNRKNFTLEQMQRLRTLAPFVTAMSPAVSRLSDVAHGGEQMSTVRIQGVTHEYLNISGYEITGGRFLTEADDATTRPVAVVGADVVDGLFPGVSPVGQSIRIDNRTFQVVGTLSRKGKMVGESMDLLVFIPFKTFYSSFGKGRSFEIAMAVEDASQMRSAEDQLTGIMRRVRSTPPGAEDDFSINRPEAMAQTYEQLTGALYGVAVGVGLITLLVGGIGIMNIMLVSVRERTREIGVRRALGARKRTIVFQFLMEASSVSAVGGLLGTTVGLGTAKVVSLITPLAADVQPMTVVAGVGFAALVGLLFGIWPAARAANLDPVEALRYE

SEQ ID NO: 16219 - protein, 179 aa, Myxococcus xanthus
MLNGKDVSRMSDDELAVIRNVEIGFIFQTFQLLPKETALANVELPLVYRGIGARERRERAKAALDKVQLTHRMHHRPNELSGGQRQRVAIARALVSEPSMLLADEPTGNLDSATGEEIVRLFEQLHKGGHTLVLVTHEPKLAARCPRAIRLSDGEIVADGDGRTVAMGTATDVLNAGGA

SEQ ID NO: 16220 - protein, 244 aa, Myxococcus xanthus
MLARNMAIVDQAQTDLTRTTLVSPIDGNVIELSREVGERVRGSDLSEDVVMTIAALSAMEVKFEVGEHEVVHLKPGQPAEITLDALEGQTYSGSVVEIAQKALIKNEGTEAEVTSFPITVALDTRPPNVLPGMSSEVRISAETHNDVVLVPIQAVTVRSERSLPDYKAPIEGGGLTAKRTESLAKVVFVVDSSNKAQVRRVQTGIGSDTELEIVFGLNDGDRVIEGPHRTLLKELNDGDLVREP

SEQ ID NO: 16221 - protein, 448 aa, Myxococcus xanthus
MNAFVIAVALAAAPSDSGTPITLDQARAEGRQNVAAIQAMLDVAIADEDVNLSRSVLLPQLSLDASAGKIWFGRRQEFTTVPDPANPGSFIRNAVETPSTSTQNYDLGLSLTQVIYDRARWKQLEQSGVVRDAQKGQAREEADTSELEAIRRFFTLYRTQATLQVLKATVERSEQQVERAQALFHAGRTGKNEEITATVNLGTDRINYTAMLGQLVNDQSQLAVWLARPGTEVLTAQDPGVLTTEPPPAPSVNEALASARAYRPLLRTLELRIRAAELKQSIARSEYLPRLMAQGLYNRGGPDASLVFTEPRLQNRFTAAVGLSWDLFTGLSTGASSRRAEADIRKAQLTLEQTAREIEGEVRAAHRTLEAQLEAARLAAQNVEVATQGLEMQEARFRAGAGSTLEVRDAQLSLTRAELALLENRIDVEIARYSLQRAMGALSPGESK

SEQ ID NO: 16222 - protein, 169 aa, Myxococcus xanthus
  unsure (1)..(169): unsure at all Xaa locations
MGLSEADLTDKIQTESRKALVGGIAKGVILMPLMALLLACILWVVSWLFDRPASFEQLLSAAVLALLPIALYHLILTXCVAAQHSITMARVMNLVPSNLGAVLQGLSPKMQRVASTVDFFNLWSTGLLGLGFSAATGMSRGRAVLLAVALYAMYAGIFLIGLPAQAGAQ

SEQ ID NO: 16223 - protein, 225 aa, Myxococcus xanthus
SKAAHELRTPLTNLRLQLQLLYRQLRREEALDVEKLAQRVLSCERQTSRLATLVDSLLDVSRLARGRMELNLEPVDLDELVREAVRRFETEARTAGVQVTVDSPAPVTGQWDRMRLEQVLTNLLSNALKYGHGAPVDVRVRSDETQAMVEVEDRGIGLPPEDAQRIFGRFERAVSSRHYGGLGLGLFITRQLVEALGGHISVASTPGQGATFTVALPLSGPRAEA

SEQ ID NO: 16224 - protein, 60 aa, Myxococcus xanthus
RKGTRLRLVLRDLGSGSAFASMAVSGQLPIWSLVLYGVAQVAALAGWRPFANRVKLTLRA

SEQ ID NO: 16225 - protein, 45 aa, Myxococcus xanthus
MVNGNDALRCTLDRTIGYSEAVGKSATFTRSTNTSPNDRQWADYK

SEQ ID NO: 16226 - protein, 159 aa, Myxococcus xanthus
MTPAPTEVLLFTLNGQRYGLPAPDVRELVRAARLTPLPRAPAVVEGLLDLRGELLPVLDLRLRFRHPPRPLSPMDHFIVASAGDRCVVLRVDRAEGLRVLTPDEWDATPRQLPGVGYVAGAVKLKDGLVLVHDLRTFLSEAEALELDAALAAPQEPEPA

SEQ ID NO: 16227 - protein, 529 aa, Myxococcus xanthus
MERAGLKDFDAYRVRLAEEPSALDDLLIELTVGETYFFRTPEHFEHLRSVVLPELRERHGPDHTARMWSAACSSGEEPYSIAALLLGEGWDEHMAVHATDVSRGALARARKAHYGDWSLRGGWADRMRAHLRAEGRRYVLSPEVRKRVRFSYLNLALDTWPSADSGIWKLDVIFCRNVLIYFNRPTIEAVARRLHDALDEGGYLFTGPSDPPLGGLAPLESILTEWGVLYRRPLPGATLSLPVPAAWSPSSTGVPGTATGTTSLGTTAPGLPSGSESSTRTALPGASAPSHPGGSAARTTTPAWSPPGAGGTSAQAEGTRAAGQPQASAGSVLGNTAGTGAPASRSGALPRAETPTHAPSAAAMHAARQALARGHWREAAQHLGALDSDADTAALAVRALANLDAAAAVYACTEAATRHPLVAGLRYLESLLLLGQGRAADAERAVRQALYLEPTLVVAWLILGRVLRRHGDTSGALKAWREAEQLCNALPPDAPVPHADGENASRLAEVARGERSRMEAALAAGEELS

SEQ ID NO: 16228 - protein, 200 aa, Myxococcus xanthus
MPDVDWEATRARLARLADLVKEQGTLSPEEATALLEARARALSREPRPQVDPGTLREVVRFKAAGQRYALESRFVLEVVRAPELVTLPGAPPALRGLTLMHGEVLPVVELAPLFGRAPSDAAGPVLVVGVGRAELGVRTEEVEEVTVLAGSELLAPPTSLNDDAGHLVSAADREGTLVLEGEALLGDSRLMFDMSGEGAA

SEQ ID NO: 16229 - protein, 547 aa, Myxococcus xanthus
MSIGNRIALGFGLSLLMLLIVAGVSFQGANQLTTSTAGLLTAHENFRIIREVRALLMDAESGQRGFILTGDESYLVPYREAAVALQNDLSRLRDAMADHPNQRARLNRLEPIVTQRVNRLEEGIRLRRQEGLEAGAKFIQAGQGREVMLQVKQIIDEMLVAEQERWDEHATAARDMAQRILWVLGIGTLLGVVIVGGGSYIITRGITTPLRALMVGAEQLGRGKLEHRIDVKGQDETAQLARAFNDMAEKRQQNEVQLEKESEQREHTLRTVAEFVNQLAGASAEILSSTTEQVAGAQEQGSAVTETVSTIEEITKTSEEAAGRARAVSDSARHAEDVGRSGRRAVEEAVGAMGAVREQVESIASRILALAEQAQAIGDIITTVNDISEQTHMLALNASIEASRAGEHGRGFAVVASEVKALADQSKKATGQVRQILGQIQKATHGAVMTTEEGTKSVATATRVVSEAGANIQTLSDLLAQASLTAAQIAASANQQATGIGQIRQAMHDVNQATQQALISSRQTERAMQDLNGMGQKLKGLLGEYGR

SEQ ID NO: 16230 - protein, 108 aa, Myxococcus xanthus
MVGKAAREARARLGLTQVEVAALVDMHPMVYSRVERGKMVPSAGMLRRLSMVLRISTDELLGLARPGKDERRELEKEPPLLRRLVTLARQLDDVNLEALVTMARALTR

SEQ ID NO: 16231 - protein, 89 aa, Myxococcus xanthus
LALHALGKSHEARAMLERALALRTAHPGPAEDLASTRFALAQTLVKQDGPRARGLANQALHFYAAEEPTYAMEASSVRNWLQDLRRRRR

SEQ ID NO: 16232 - protein, 165 aa, Myxococcus xanthus
MPSFDVVSKIDLAELDNAVNQTKKELSTRYDFQGTHADVVLAPDNTAITVKANSEDRVQAAKEVLLTKLAKRNISLFALEYGDIEKTGLHNVKQVIKLQQGIPVEKSKELVKLLKDSKMKVQGSIQADQLRVTGKNRDDLQAAIALFRKEQDRLKLDMQFINFRD

SEQ ID NO: 16233 - protein, 96 aa, Myxococcus xanthus
MKSASAGKLLRVEREHEERRTFVLSVADGLDAEALERRCEEVAALAHRLIEEGHEVGLDTPEDRIRPAAGAAQERRLLRALAWLGHERPRGGEEAA

SEQ ID NO: 16234 - protein, 367 aa, Myxococcus xanthus
MRAAALSFCLLFCAPGVASAQADRPSKPVPSLAKPPRIQGGLKAFASPMVLKPVAVEGATASFTAKVGARKDTLYVGVEATDDQLQAGDLLTLSLYFPGTGPTAAGYTWRFAFDGKRASGAESGTPQFAQDLVTAAVQRQGNTLLLMASVPVRAFPRFPAVDPLVMDLCLTYEDRDSADGKATSISNCQSGTMVGDALRLPDEPRKGLKLKLPENVTSLEPKEDGLLGWDYMSYPAWAQADDELAPASLRRLVAPDAVVPSSVDLNVPDTLTLEDGGRVVTVVTGKNPYAVAGQCDADDELRLGLYLVTGKTAQRVLEWPAATCALGRTSSVELEEEGVLSIRYSNGTSMNFAWSGTHFSRTELGKR

SEQ ID NO: 16235 - protein, 466 aa, Myxococcus xanthus
MMTLGCPKNRVDSEVMLGTLRHRGYTLVQEASDAQVIVVNTCAFIGPAKQESVDSILEMAELKKSGACKTLVVTGCLSQRYGEELSKEMPEVDHFLGTSAYAQIGDLLAAEASPRQVIPDPDYIHDANTPRINSMPKYTAYLKISEGCDNACAFCIIPTLRGGQRSRPIDDIVAEAKQLADSGVQELNLVAQDLTAYGHDLPGRPKLHDLLKALVQVDVKWIRLHYAYPRIFPDELIEVMASEPKIARYLDMPVQHVSDKLLLSMKRGRNSEFLKGLLTKLRERVPGLVMRTSLIVGLPGETEEDFEMLKEFVKTQRFERLGVFQYSDEEGTAAYDLPDKVPQKLIERRWREVMAIQKRINREQNKKLVGKRLEVLVEGPAPETEHLLVGRHQGQAPDIDGMVYINDGLAYPGEIVTVEVTEAHDYDLVARVVERPDPKQREHTARDAHPAPLPVAAMQRPAPRAE

SEQ ID NO: 16236 - protein, 321 aa, Myxococcus xanthus
MRPSPTEFDRQYTEQRRSIELARRYLEKEGVSRMYDALSKEVERGRLSVQDASGAIRFGLLAVIERVAERVGHTHYVDMLKDEEMLNALRSTLDDICRRKGVDTFEFRQQWAHTNLQAVLRDWHLVVHEERGRQRYEVAADLARRLVKETPGTVLAQTLKLPADAFVLLVSPEAGLVGLGPDGTPAPITEIYAVESPAPEGKAWFLWLNMRDAGNRAARALINVYLQDGKTLDDAIAFTREQGGPQQDAGWEDCCRLLAGVARHMAESGPVREVWYDATARELHEKLAATPKSAKADREKLRERLRAVSPGRTLVLEEPSR

SEQ ID NO: 16237 - protein, 281 aa, Myxococcus xanthus
MTQGGAELTGPFVLGSREPFSRVSVRLAEAQGLQPLETAANLPPRTFVLDAVEVAEGLGVHPLVVEAAGRWDSPSSLGRLGPDVWGRFTATLDAKGGVLVLRRPRVRPSEGSATSHCAAPDGSFREEACYGLHVRREPDGSVSISGAVYRDLPEGGRLHLEPLGPDGQKLVSGCGVGLSFPSTSRGLTTQHRVPWRSLAQALPACHAALSTARDFTLSLFEEGRQPECPTACAFVTETASRRTVCECQPTPLGEGVAMPARGASSREPPPGERELEPEDPR

SEQ ID NO: 16238 - protein, 177 aa, Myxococcus xanthus
RAGFRQDYKYKTFRRTQTSEGTVTYKKPGLMRWEYLKPSPRTFVLAGNKVYAYDPAAQSLTVANVDTSQLSASVTFLFGQGKLADEFNITKGACKDCKGTLLVLDPLKNEPRFRQVRLEVDPSTAQVLKSTVVDPDGSENTISFLNLKTNVGLDADSFKLDVPDDTRVDDFTKAKKQ

SEQ ID NO: 16239 - protein, 365 aa, Myxococcus xanthus
MSGRLGELLVRENLISVQQLRKAQEEQQKNGTRIGTALVKTGAIEESKLTDFLSKQYGVPAINLKDFDVEPDIIKLVPKEVAEKHLVVPVNRAGPSLIVAMCDPSNIFAVDDLKFLTGYNIETVVASEVSIREAIERYYAEKGPSLEDIVGDVGDDIEVTKEETENIDEMAKAADDAPVVKLVNLILMDAIKKRASDIHVEPYEKDFRVRFRIDGVMYEVMRPPMKLRNAITSRLKIMASLDISERRLPQDGRIKIKMGGGKEMDFRVSVCPTLFGEKVVMRLLDKSNLQLDMTKLGFDAQPLAWFKEAIDRPYGMVLVTGPTGSGKTTTLYSALSSLKRPGHQHLHRGGPGRVQLRRHQSGADA

SEQ ID NO: 16240 - protein, 179 aa, Myxococcus xanthus
MIGEIRDFETAEIGVKAALTGHLVLSTLHTNDAPGTVSRLLNMGIEPFLVTASLNLILAQRLARRLCPACKKPAENVDEQALIDAGVPPDKIGTFTMYEKVGCRDCNDRGYRGRVAIYEVMPFWDGLKELVINGASAAELKQEAIRLGMSSLRMSGLRKMMDGATTLEEVVGNTAPDRF

SEQ ID NO: 16241 - protein, 229 aa, Myxococcus xanthus
MIDKINTERHEHIMTIEDPIEYLHPHKNCLVNQREVGADTRNFKTALKYILRQDPDVVLVGELRDLETIEAALTIAETGHICYATLHTNSAVQTINRVLDVFPPYQQPQVRAQMSFVLEGVMSQALVAKAGGPGRILALEVMVPNPAIRNLIREDKVHHIYSSMQVGQAKFGMQTFNQALAALLLRRLITQDEAFGRSNDAEELRNILATGGGGALPGMQRPGGGAGGR

SEQ ID NO: 16242 - protein, 380 aa, Myxococcus xanthus
  unsure (1)..(380): unsure at all Xaa locations
MDVEAVNARLKSLGLNPVKVRKKSMLDGDITIPGFSGVEGKDXLVFTRQFATMIDAGLPLVQCLDILASQMDNPSFKKVLFAIKSKVEQGSTFADALKEHPKVFDELYVQLCAAGEVGGILDAILNRLAAYREKNEKLKSKVKSAMTYPIIEILVAIGVTAVLLLKVTPVFEKMFADFGSELPGPTQMIVNFSHMAQEYFFHVAGSIVAVVMSFTWSYRQPRGRKFWDKVFLFMPVFGPVLRKVAVARFTRTLGTMISSGVPILDALDVTAKTAGNRTVEDAIIYVRGKIAEGKNIAGPLAETKVFPSMVVQMIGVGEATGAMDTMLNKIADFYDDEVDAAINSLTAMIEPVLMVFLGGVVGGFLIGMYLPIFSLAGAIQ

SEQ ID NO: 16243 - protein, 374 aa, Myxococcus xanthus
MPPTRVLFVLGSNSLALGLIAVLSGYLSRQLSATGGALSAREADLQRLGRLQQQILSSMPSGLATCDAQRRVTYVNPAGCGILQVDPTQVAGVEVEALLPGVSVLAPRSPRSELVVGKGAKRRILGLSVTPLEGEPGALLMVFQDLTQLRRMEDDLKRADRLASLGALSAQLAHELRNPLASMRGSAQLLAQDARDDVAQKLTNILMRESDRLARLVEEFLRFARPPVPSLRRVPLASLVTETMDMLRVDPLARDVRVEVTAPEPLPVSVDPDQLRQVLINLVRNGFLAAGPRGEVKVALTRSENEARIRIWDSGGSITEEMMGHLFEPFFTTRDGGTGLGLSTAHSIIRAHGGSIRVRSNRDEGTEFVVGLPL

SEQ ID NO: 16244 - protein, 306 aa, Myxococcus xanthus
MERIATQLGRAVQGKSSQLQLVVTSLVAGGHVLLEDVPGVGKTTLAEALAKACGLSFARVQFTADLMPADVLGAQVFHAQTATFQFRPGPLFRQLVLADELNRAPPRTQSALLEAMAQGQVSLDGATHALPAPFTVVATQNPVDFSGTYPLPDSQLDRFMVRMSLGHPTPEVEAGLLVTRDGTPPLDAVETVSEPEELASLRSFAAALRLDASVADYVVRLATATRSHGDLERGASTRAVLALGATARAHALWDARDFATPGDVRAALVPCWAHRIMLRSAVQGVSARDEAAHLLEEIARKVPAPR

SEQ ID NO: 16245 - protein, 376 aa, Myxococcus xanthus
MREGAYDYICKPFDNEELRLLVQKALEKRTLRQENSGLRARLFPGLDGAVGQSERMQAVWALVEKVASGRSTVLVTGESGTGKELVARAIHMRGTRAARPFLPFNCAALNEGTLESELFGHVKGAFTGATTDRSGLLVAAGDGTVMLDEVGEMPLATQVKLLRVLQERKVKPVGSAAEIPFQARVIAATNRRLEAEVKAGRFREDLFYRLNVITLELPPLRERSGDVSLLANYFLSRLSEELGRPGLRFSPETLGLLERYPFPGNVRQLQNMVERAATLSDSDLLGPSTLPPAVRGDTDPAVRPVEGSEPGLVAGFNLERHLDDSERRYLVAAMKQAGGVKTRAAELLGLSFRSFRYRLAKHGLTDDLEPGSASDA

SEQ ID NO: 16246 - protein, 220 aa, Myxococcus xanthus
MRVSRFNPRNRGFTLIELMIVVAIIGILAAIAIPNFIKFQARSKQSEAKTNLKALYTAQKSFFSEKDRYSDFANEIGFAPERGNRYGYRVSAAAGDCEVRNAADLPVPAAGVPCISNDSFRFGANSAIDDPTPVVARFVPQGAAGWNTTLGVQPTIADCPNCNFFAGARGNADNEATFDDWVIAGFEGSGQVGPCSEAGNVASGTPYNTRNDVACDGAAQ

SEQ ID NO: 16247 - protein, 288 aa, Myxococcus xanthus
MAEKPAKPLRTKDGPILPRREFLEIVGAAQKPLLADFYWLQSIQQVGRANTDTEYRDVFFYADLATDLDPKFRYVYEWGAITTPVNLGRDEWANTDLSSRLLSKGLVEFPDDRRFLFQLAYNKMTYDRDYKTAADQLMKLSKYPETPPYLLQLATRLYAQAGSIDMGLQLAQMLRDGAEDDESRAFYEHRIKELLRERLLTQIDEAVAAYQRDRGERPKAVPVLVRAGYLRAMPIDPLEGQFFIDRQGRARSTSGIYRLEMFDQKKKDELREDIAAGGIQFDLPEEMP

SEQ ID NO: 16248 - protein, 290 aa, Myxococcus xanthus
TVAGASDPNLPVSIRGLSKTYKVGFFLNKQVKALQGLDLEIAPGQVYGLLGPNGAGKSTTIKILMGLVRASEGQALLFGEPPDRPHVRRQVGFLPENPSLYEYLTGREFVTLAGRIFGLSGHELDQRVERVLGDVGMGRASDLQIRRYSKGMVQRTALAQALISGPRLLVLDEPTSGLDPLGRRQMRDLILAERAKGTTILFCTHIISDVESLCDRVVVLVGGRRVQEGSVQDLVSAKAPSVEMVVHGLPLEVLQSLGFSYEHAQQLDSRVLLRIPSADSHGGLRTVINV

SEQ ID NO: 16249 - protein, 482 aa, Myxococcus xanthus
MGTAVSHWWGWSLGAGLVFGLALSTASTVVLLRALEERGILDSVNGRIAVGWLIVEDLAMVLALVLLPALGNVLGSADTQTPATAAAGDSLIWTLAFTLGKVCLFVALMVVAGTRLVPWLLTQVAKTGSRELFTLSVLAVSLGIAFGAAALFGVSFALGAFFAGVVVSESELSHRVAEDSLPLQDAFSVLFFVSVGMLFDPMVMVKQPLEVLAVLGIIVLGKSLAAFFIVLAFRYPVNTALTVSASLAQIGEFSFILVGLGVTLGLLPKEGQSLVLSGALLSITLNPLVFKTIDPLLAWLRRHPRFAARMDPEEDELSDLPIGMGDVQLREHAVLIGYGRVGGVIGQSLTEQKIPFVVVEQNREYVERLREEGVPAIYGDAAVPGILEHAHLDTASILIVATPDALQARAIVEQAKGVNPSLPAVVRTHGDEERDYLVSLGVDRVVMGEHALARSMLDYVLERLSALKAGPLLPAPADAVVP

SEQ ID NO: 16250 - protein, 234 aa, Myxococcus xanthus
CFWGVALVLGPNYNMPMLAESAPAAWDALQRARQLAPRTTPVEQALITALVQRYPGPNALPPEKMAPFNEAYASAMADVAARYPEDLDVQTLHAEALMDRNPWKLWSLDGAPAPGTEQIVATLESVLTRAPYHLGANHYYIHAVEASPNPEKAEPSADRLGALAPKAGHIVHMPAHIYQRVGRYADASESNRKAAAADLAYQKQAKPRGHVYPMYTSHNFGFLAYSASMEGRKQ

SEQ ID NO: 16251 - protein, 1114 aa, Myxococcus xanthus
MQSSGAEIIHLGHNRSVAEIVDCAIQEDVQGIAITSYQGGHVEFFKYMIDLLRERKANIKVFGGGGGTILPSEIEELHRYGVTRIYSPDDGRAMGLQGMIDDLISQCDFEKRPADFAPLLDAPSMREPSRIAPLITIAENFASQGAALREAMSHIQARGPRVPILGITGTGGAGKSSLVDELVRRFLADFPDKTLAVLSVDPSKRKSGGALLGDRIRMNAIDNPRVYMRSMATRQSNLALSKHVGDSIEICKAAGFDLIVVETSGIGQSDTEITEHSDVALYVMTAEYGAATQLEKIDMLDFADVIAINKFDKRGSLDALRDVRKQWKRNHNAFTTADDAVPVFGTIASQFNDPGMNQLYRALMDTISTKTGAPLKSGFELTPGMSEKKWIIPPERTRYLAEIVEACESYDGFVKAQAAIARRMYQLHGTIEALRTNVGRKRLEIVEPKDPSDTVQVTERVEGEPAYLSELVELYKDLESRLHADCRRLLAEWPATKRRYAASKYQFQVRDKVIELDLYAETLSHLRIPKIALPRYEDWGDILTWLLRENAPGAFPFTAGVFPLKREGEDPARMFAGEGGPERTNKRFHYVSRGLPAKRLSTAFDSVTLYGEDPDHRPDIYGKVGNSGVSIANVDDAKKLYSGFDLADPSTSVSMTINGPAPMLLGFFLNAAVDQQCEKWIRENGKVDEVEKKIDALYRERGLPRPRYQGDLPQGNDGLGLLLLGVSGDEVLPRDVYERIRAKTLQSVRGTVQADILKEDQAQNTCIFSTEFALRVMGDIQQYFIDQKVRNFYSVSISGYHIAEAGANPISQLAFTLANGFTFVEYYLSRGMDIDDFAPNLSFFFSNGMDPEYAVLGRVARRIWAKAIRDKYGGNDRSQKLKYHIQTSGRSLHAQEIAFNDIRTTLQALLALNDNCNSLHTNAYDEAITTPTEESVRRALAIQLVINKEFGLSKNENPSQGAFIIEELTDLVEAAVLAEFRAISERGGVLGAMERMYQRSKIQEESLYYETLKHDGTLPIIGVNTFLDPKGSPTVTPPEVIRATTEEKNYSITSRDAFWKRNEATAPKALEAVRRAALDNGNIFAALMDACKVCTLGQLSRALYEVGGQYRRNM

SEQ ID NO: 16252 - protein, 308 aa, Myxococcus xanthus
MLARTITLVESELPRHAALAQEVLTRLLPATGGSRRVGISGVPGAGKSTFIDALGMHLVKAGKRVAVLAIDPSSTVSGGSILGDKTRMARLSREEAAYIRPSPSSGTLGGVARKTRETLLLCEAAGFDVVLVETVGVGQSETVVADLVDFYLVLMLAGAGDELQGIKRGILEVADMLAINKADGDNKPRAERARSELRAALHLMRPGAEPEITTCSALEGTGIEKLWTSVETQLGRSAVSGAMERRRKAQQVQWMWSMVQDGLRAALRAHPEVSALVPTLEADVREGRATPTSAALRVLGAFLPETRA

SEQ ID NO: 16253 - protein, 730 aa, Myxococcus xanthus
MRPHVPDFSGIDFDAPETHSAAPMRDQQLRQAGEATRNAERWDTPEGIPVKPVYTREDMEGVEHLGSLPGLPPFVRGPYSTMYVQQPWTVRQYAGFSTAEASNAFYRRNLAAGQKGLSIAFDLATHRGYDSDHPRVAGDVGMAGVAIDSIKDMRILFDRIPLDQMSVSMTMNGAVLPVLALYVVAAEEQGVRPEQLSGTIQNDILKEFMVRNTYIYPPAPSMRIIGDIFRFTAEKMPRFNSISISGYHMQEAGATQDLELGYTLADGVEYVRAGLAAGLSVDAFAPRLSFFWAIGMNFFMEVAKMRAARLLWAKLIKGFSPKTDKSLALRTHSQTSGWSLTAQDVFNNVVRTCVEAMAATQGHTQSLHTNSLDEAIALPTDFSARIARNTQLYLQLESGTTRVIDPWGGSYYVERLTHELAHKAWAHIQEVEALGGMTKAIEAGLPKLRIEEAAARTQARIDSGRQAIIGVNKYPPEREDSIEILKVDNSAVREAQIARLRELRAERNAEDVRRKLDALTEAGRRGEGNLLALAIDAARAKATVGEISDALEKVFGRYEATVRSVTGVYSSEAGKDAQGIIDAREKADAFLARFGRRPRILIAKMGQDGHDRGQKVIATAFADLGFDVDIGPLFQTPEESARQAVENDVHVVGASSLAAGHLTLVPQLKQALKALGREDIMVVVGGVIPAQDYDALRAAGAAAIFGPGTVISKAAIELLDKLAASLEEEA

SEQ ID NO: 16254 - protein, 338 aa, Myxococcus xanthus
SNACGGSPEAQAMVLHARTASTTKTQRDPWVNILRATAESFAAVVGGADSVSTSPFDEALGTPDASARRLARNTQLILRDESSLNRVADPAGGSYYLEQLTQDIARAAWTELRRIEALGRMEQALTSGDVARVLAETRAARDKAVRTRRLPIVGVSEFPHLGETPVQRKSRAEASTAPATSGPLPLRPARVAEPFEALRDASDRHLAAHGARPKAFLASLGTVAEHTTRSTWTANVLAAGGIEPADQHGFADIADAVARFQASGAPLAVISGPDALYPEWVPALTAALKSKGARAVAVAGRPGDHEAAFRAAGVDVFFYAGADLFALLSSLHQQLGVA

SEQ ID NO: 16255 - protein, 107 aa, Myxococcus xanthus
MSGLQIHREESAGSVTLRLEGTLDGKTAEEVRTSLSALSGCEVVLDFAHLREFKDSAVGVLTRGLVERPVQLRGLATHHERMFRYFGVGTGTSPRPAYYTPEDVFLA

SEQ ID NO: 16256 - protein, 380 aa, Myxococcus xanthus
WSGVLDGLGQGSARGFFRRDGLEVTGHIPGAGGAQRHSVGGVELEGRRPLGEYQALTVTVATSGETVTQEEGAQASSWWRASVMAMDEVRLFGGTLDVVPSMRLERVGPYWLLSPKLGASVELGRGFGLRANAGQSHRAPSFLELYIRQGTLLPNPGLKPERALYADAAVTWRSGPEDSEEAAPRWGLTLGGFAALYENLIAYELYPPLMARPYNFDTARVWGLELEGEARPFSWLLASTGYTYLRTENRYGDPRFFGKDLPYRPRHKWVGRVRAGPDWLNARAEVLYQSAQLINRTGSLDLPSRTLVSAGASSTFLHGPDLTLSVELKNLLDVRTFDFTGFPLPGRAVYVTLAVALEPGASPSSSSTREPHDSPASPVP

SEQ ID NO: 16257 - protein, 231 aa, Myxococcus xanthus
MFQFGNAVARVDISNPEQPRKVDTISLTGLDLKPFDGGTVLPLPYSVAATEAGVYVSLTNLNPYNGYKPNGPGMLAKIDPASGRVSAIDLGAADCLNAGYVEAVGDQLVVACLGEAEYDEANGHSASAVRASGLVLVKNDAPVAAYALKAGCEPGTLGCNLSVASRFAVAEGAVYLADTNAGRVFVVAVEDGRLVERRGFSSPQALGPALEACPTDPRRPVSNAIDVTALH

SEQ ID NO: 16258 - protein, 285 aa, Myxococcus xanthus
MSVLLATVLCLLTGTVSAAETSSLRTLGPPAPSKVRRVVTLAPSLSEMVLSLGAGSTLVGVSRFDEAKEVAKLPRVGGFTDPSVEAVIALKPDLLLVQPGPGNQRPVEKMAELGVPVLLLPLHSVADVLAAMRAVGKALGREKEAEAVVVGIEATRTRIREAAKKLPAPRVLFVYGFEPLVVAGPGSFADELLRDAGGINVAADASSAYPVYSVERVVRARATVVVDAADVDVGKDKLRALPGLSNARWVDLPSMSLLQPGPSLGRGLEELFRLLHPKGTGKAAP

SEQ ID NO: 16259 - protein, 338 aa, Myxococcus xanthus
MLFGGFLVLAVGCLAVAVRFGEQSISLTAALTEPTSTDAVIFWSLRLPRALLGAIVGAGLAASGATLQGLLRNPLADPFVLGVSGGAAMGATLALAVGLATVGEVAPGLGGAMARLSAPALFSFLGAGAAILFVLSASRGSASRAPYAALLTGVVFNAFASAAITLVKTLSAPDRLGEILYWLAGALGYERGGTLLLSALLQAGAIGVMWVLSARLNLLSLGDDDAASLGVPVAATRRWLLLAASASVAGAVALTGLIGFVGLIVPHLLRLAFGPDQRLLVPLSALGGAAFLVLSDLLARLAFPLFGAEPPVGVVTALLGGPLFLALLRRRVRLGTSH

SEQ ID NO: 16260 - protein, 429 aa, Myxococcus xanthus
MFATASLVLAVATTGCGSECVDVYDCRNENGPAPAGQEWTCASEKCETRPIQQLPGEDAGTDPETDAGTHPEPDAGTEPDAGTEPDAGTEPDAGTEYTCETAPYDPVLGTLQLQAGFETANSAPMPDDVLAVAVTPGPTYAVYAVQGGTSADVYSLGIWPDLTPSSSPLFNVLAPEDRGATSGIYPNRFLVHGAERLLAGYTKSGGAGTVSLYDIVTPDNSSYVNSPGNMSAAAFTSGTTSAFLINSMGLSAIDGFGIYALVTSAEPVASVKVADFPQTAGGNGFSAVATNGVSVLGFVVPPDYANVAYAVAPSVVSAALSSNTPFALDAQPQIDVGSDFNAASAFGDGVVVKRGAYDDTWQFITTDVSRYSLSADATPGEVVIGERTPVLTLVDQCTSVTQLTHLGSDLLVGIEDVNGERLVRIRVVQ

SEQ ID NO: 16261 - protein, 167 aa, Myxococcus xanthus
MTGEVDRRAALGTLLKGTCALAAVGAGCGDGWREAVVLDPPDAGGPGPSCAPPVPSGPPGEGWVEVPLVEHPALEVPGGAAEVRIPQALLDVVVVHTSPGCYAALWRICTHGDCAVDWVPADGVMECPCHGSRFTQEGQVLNGPATRPLAAFPVVRQGASLFIHRPR

SEQ ID NO: 16262 - protein, 561 aa, Myxococcus xanthus
MWQIIINGPGYFDTSYDLPEGVTSLGRADENDIVLGGDLVSRRHARLFVDGDVLRIEDLGSRNGSRINGAPLQGSRQLVAGDSVALGENVLSVRQPNTVENAATEMVDLGAGGVVRFGHGQDVGPSVLMAKNVRDADVLRLLDNVGPVSFDDSFSASAPLPAASPRVGQETLVLLFRTAEALSSAATLSSFLDTTMDRLLEVTDATTAVVLLKHATGAMVPAAVRHRGRLAKGEVPVSDAIVEEALRQGRALAVGDVRDDRRFAGRESVILYGVDRVLCIPIGTEPPYAGVLYVNLSAKGDASVESMLDTCTAVAHLVATGVQKFSPREGSPAADRLRRDLERFHPPDVAERRAAEAQKQGGKLPGLEERSLTILHAELVGFSVLCMRIGAARATQMLNDFHARMSGIVFSFEATVEGFRGESLRALFGVPYAKGEDSIRAVRAALALRSEWERSMARRPLDERCELRIALHSTRALVGMIGTEVRPDYTVVGDGVGIAGWLAGTASPGQVLITGKVLATVGARFDVQPLGERLIRPPKDKVAAFEVLEEDVGQLTNPGFR

SEQ ID NO: 16263 - protein, 191 aa, Myxococcus xanthus
GEIYLARLEGAQGFEKLCVIKKILPQLAADTDFVERFVGEARTLVRLSHGSIAQVLDMGLHEDEAYMALEHVDGKDLRKVAARVRDRQMPLPVTFILYTMGRVLDALAYAHRKKDDDGEDLKLVHRDISPQNILISYEGEVKVIDFGLAKSRLSAAKTNPSIILGKFLYMSPEQARHQPVDRRSDLYAVGL

SEQ ID NO: 16264 - protein, 268 aa, Myxococcus xanthus
MSGGVMYLAHRGTSQAEALAEQSRQSALDAATRARDAEAARLQLEQKLAALEAERAQLATEKEQLSSEKEQLSQTVQEQEAELAKLKATYDDLQDKMKAEIAEGAIRLSHAEGRIQVDLVDKVLFDSGDASISARGQEVLTRLGSVLAKVEDKSIQVSGHTDDSPPSQKLQSTFPSNWELSVARAVNVVRFLQDTGGVPARRLVAAGYGQMRPVSTNATPLGRARNRRIEVLLMPDLPSKRTPTAAVQRAVAGGTATKAQAKPARGAK

SEQ ID NO: 16265 - protein, 994 aa, Myxococcus xanthus
MRKVLFLGAFALGASACTPDIAQDPPRSPEDSVVAEFDPTGSPPVVPSPNDLAIVNGLVNAPINPQAPAAEQEFTRDYVNTLNGFPTTVTATTRIRGLEAGTVNTNTVKIIDVYAGTPLAKPATPSYIGYNEETNLVTIIPPLPGGWPKGGRYAVAIIGGENGVKTTAGKPVIPSATWAFASSAESLVTCDDLAAPNCQTTTELIPSTVTEPAARLADQTASALRLEQLRRGYAPILKLVSEQFSVKREDIVLLWTFSIMDHPEATFDPGNGVVPFPNDLLRNPETGLLALPEPTEAGPAQMLIKGLNTLDGWSTTAPIVSENGAKRGPIDTGSLLDANTVRMKIGFTPDTEEEQKTTLRFVKLTNPTSGTNPQVKLCFNCEPVVEGLTPAPNSPQQLQIVPEVPLDEATQYGVVMLRGMKDTLGRTVAPTAAQALMRMVNPLVDANGKSQVAAVPDTLARDLERARVGMKPLFDGLEAAGIARKDINLAWAFTTQSTRSILERLNAAPTQVPVPADPVYLLDQTATIKGTMAGLTLDNDAVGRVFIGAYHSPFFLDDAQGTLNRATPRIDRVPFMLFTPAGAAPADGYPVVIYGHGLTGNRTNILTVANNFNAAGYAVAAIDTVFHGERASCAGISEDAPVVVDENRDGVPELTITTPDAACDDGDTCDVTAGSPTFGRCVSNIQPACDVGPTASPHGDLFCSSQGRGRCVVTEPDSTTGTCEGGDFARPGPNQPPYVSGAGFLNLVNLFATRDNFRHHVVDFAQLARALDTDTLNGRLAAAGAGTLNTSQFSYVGHSLGGMQGVLSASVSPVVGRTALNAVGGDLVDILLTATDSTFVRYRSGFFETLENSGRAPGTPEFYEFITLARTILDPASPRNYGRYLENAPSAPANRNAFIQYIEGDMVIPNAVTEGLISAANRPLVGVSEPRTVQTYLAEDGMGLPTNVRHAFFGIVDPSLDPSSAASQFLRSVRNTAQNQVIQFLNTGVASPTP

SEQ ID NO: 16266 - protein, 232 aa, Myxococcus xanthus
MVGTGAVAFPVQVPDGAQGEGPEVTELRAKLAERDAELKATLAKLHLYEDEAHYAEAEALGITEMVKASGLPARQQRRLAVAIVREAARNDIDPLLVVAVIRCESSFNNYAVSHVGAMGLMQVMPDTGTWLADKAGLQLGRTSNLFDSETNVELGTAYLADLIQRFGTVEKALVAYNAGPGLARRILAKKEARTKFLAGYPAKVVKEFRKLKAAQEKQLTLREAQKTNGQKS

SEQ ID NO: 16267 - protein, 397 aa, Myxococcus xanthus
MKKTLSLITLLAAGTTQAAGFQVNTQSARSSGMANAAAAWLDDSSAIYSNAANILGVEKLDVTAGVTGILPSLQFTPTGGSVQGQKTTLSPPPHVFAVYKITDSLAAGVGFYTPFGASSRWKDDFVGRFRAQESGLSIYNINPTVAYQVHDRFRVGAGLNITRGTLEIKRALGFVTSEGQVHLGGAGWGLGFNAGVQAVVVPKLVTLGVQYRSPISMTFKGDADFRDVPPAFQGRLPDTRVEGDVKLPQSVVAGIAVTPLDRLTLAFDANWVGWSSFPELAIEFPDNPAINNPLPKNWRSTWNFHLGGEYGITDALQVRAGVLWDPAPSPDETLTPDLPDANRFGVSAGVGYSFGAVRVDAAYQFVNLFDKDSTAPGMTGVYNGTAQVFGLTLGYSM

SEQ ID NO: 16268 - protein, 36 aa, Myxococcus xanthus
MGDDGWTFQGEPGSDPEPFCGFEFLREPHDRTLGFG

SEQ ID NO: 16269 - protein, 175 aa, Myxococcus xanthus
MNRLLGVLVVAVAVVAHAEDAGGLKWTAPADWAVQGARPMRAATYKIPAAKGDTEGAELAVFYFGQGQGGAVDANVKRWVGQFQTADGKPIPQEKSKTKAEKVNGMTLTTVDVKGTYTGGGPMMGPSTPKPGFRLLGAIIEGAQGAVFFKLTGPEKTVAASEKSFRKLLESVEKQ

SEQ ID NO: 16270 - protein, 405 aa, Myxococcus xanthus
MAHVHGADRQRAVQLASEGRLEEALAEYQGVVKDGPDDAEVRQKVAELLEWLGRSADAVAAYQEAALAWTKAGQPLRAVAACVALPRLGAPQAALVRTARVLAERFALPPGAAVPVEATRAHVAEDGATGLPILSQVSRETFVALLEVLQVRAFFPGQTVVEEGTPGASMFALVEGRADVVRALEDGQRRSVGTVTPGDFFGELALISEGPRLATVVATERAVLLELTRQHMEAVAARHPDVTAVVDAFYRRRMVENLLRSNPLFNQLSPAQKAAVSRDFELRSFAAGEALMTQGQPGDAFYVLLRGRCTPWLEQPHGRRVALSALREGDVFGEISLLLDKPVSATVRADVAGVVLRLERDAFQKHLLSQPGLKGQLMRMGTERLQRTAQALASGRVLHDGDLRV

SEQ ID NO: 16271 - protein, 312 aa, Myxococcus xanthus
ADGAAADVAQLHEQAGALLLAAEAWLRAGEPARAAAAFERGGALERALSLYESLQAREAMARCLTRLRRPMEAAAVYRELGNPHAELESLRAVSPDIAVARREAVLRMSALLDAQGESWRALVLLADALQAPELRGDIALQAEHSRLLRHLNLNGGPSVEPARAPPLPPPPPDGYEYLKAIPLFGELSLVDMKDLYQLARPLQFAQGATVLEKGAPGSGLLVLLEGTVDVLAGPEPGARLLNTLGPGAFIGEVSLILDGDTSAQVCARTDVRALRVTRVDFQHYLDTHEAAALRILRLFTEKLAERVRALSA

SEQ ID NO: 16272 - protein, 524 aa, Myxococcus xanthus
VWAYVVFTDNQPPAVRSAVMATVVLLGLALWRRADGLNGLAAAAVVLVAWAPSSVADLSLRLSFLAVLGLVLLSPPLRQALPLAEPDPSEPHRVRRWWGQAQETVAQTLCASAAATLSGLPIVAATFGRVSIAGLISNVVALPLCGLLTGLAAGGAALFVVAPVLATPVLWAGAWASELLLVITRLFAAAPLASVEVPSLGFLSALYAAGLLTWALGTGRWRLGGLLAPAAVVAAILAPVLTPQPGLRVTFLYVGQGDGVVVSSGGEHMLVDGGGVPGGMDTAERFILPYLKHAGISQLDLAVLSHPHPDHALGLASALKQIPTQRLWMPAGDGDGPLSRQVVAAAGTALVEEVEVGHPPLRLGEATIEVLGPPALETRDLLEGANDRSVVLLVRHGDVTVLLTGDVEADGEESLAELLGPVTVMKAPHHGSRTSSTEALLARTRPRHVVFCVGRRNRYGFPHDDVEARYRALGSECWRTDQHGAITVESDGQDVRLLTFLPHEPSPRATPVARAGDPSPDWGR

SEQ ID NO: 16273 - protein, 84 aa, Myxococcus xanthus
MIPEDIDLQQLTADLKNALGPGEPIGYLRGKSVMRNLLVDMRGFSQLEAEELIDTMETRGFLRFLGDPTERSVAEAHWDISPHA

SEQ ID NO: 16274 - protein, 177 aa, Myxococcus xanthus
MRGLTFLVGGGVEGYTSALGSDINPGLGYGVTVAIKPTKVLGIELGYSGALNEFDQRVVTGARSGPDLVRNGAHVVATLGLGAAPVQPYVLGGVGISRYNVRAPTVAFADDTAGNIPLGGGLRVHMGNFTADARLQYSFLLDQQFAANAPPGDVTIGDRNFSSGGSYAGTVNIGATW

SEQ ID NO: 16275 - protein, 243 aa, Myxococcus xanthus
MLNYEVDPEVLRPLVPRDTELDTWQGRTFASMVGFRFLDTRVRGLPVPFHRNFDEVNLRFYVRHLGPEGWRRGVVFVKEIVPRQAIATVARVLYNEPYVALPMRHVVEMEGAHTGAPGRVEYAWKAGGKWQHLAATTLGPPQASEPGSAAEFITEHYWGYTAQRDGGCAEYRVEHPRWSVWQVDTTALEIDVEGMYGARFVPFLRGKPSSAFVADGSAVAVYPGTRTGSGASQSPASEKPRAA

SEQ ID NO: 16276 - protein, 236 aa, Myxococcus xanthus
MVEAARTFSVNGVLVPPGVPRLVIPGEALGLPDDMGLRVLQEAVSERGLGTVALLKGLLTGTDEPAPSRAATLTCLTGLDVGRVHALAEEQTDIGRGSDVAMRLRDRAVSRTHARVLHGEGGFSLEDLGSPNGVFLNGQRVDSRVPLADGDVIEMGRSLLRFQAAVEEPPPPASPAGEQEPPSGAVSPASTEVTLEPTPEAPPSVPKPRGEWWLIGLGAVAASVGVAVTWLLATGS

SEQ ID NO: 16277 - protein, 344 aa, Myxococcus xanthus
MALELERSLLRERALSQKLPPAPGGRGGDEVGFRSAAMQRVMELVRLVAPHRVAVLLQGETGTGKEVLARILHRLSGRGDVPLVVQDCGALSETLLESELFGHVKGSFTGAVADHPGLFVLANGGTIFLDEIENTTANLQAKLLRVLETGDVRPVGGTQVRHVDVRVVAASNKDMGEEVRAGRFRADLFYRLNSFTVDIPPLRDRPEDVPELALYFLEVFNRTLRRSASGIAPDAVDALRAYAWPGNVRELRNVMERSVLLSRPGEVVSRRLLPPVLGSTLALRNEPGGDGSLRARLDRVEREFIREALERHGGVLRRAAVALGMDPVTLGRRVRRHGLWKGDS

SEQ ID NO: 16278 - protein, 153 aa, Myxococcus xanthus
SCYVEALDFTRDRIDMRAVQGQWNTFGMEREREILIARRNGVAVGAAVLELGQQGTNLYSLLDMARLFPLSDAGPSTYVALVDAARRWYAARHRRSFHYLCEDDGGQYVQDAGIHAGPDPYMWIISAKLIPDYLEHISEVSIGRRSAPNTRQG

SEQ ID NO: 16279 - protein, 400 aa, Myxococcus xanthus
MRLPSSVLAPLLAVTCLATACRDEHAGPRQQTPRIPAPTQLRTLDAAPADLTFRSGATFAGGAVVYLGSKVSPEKAAPGTQVRLAHYFRAVRPPPQGFAFFVHVVDPASGGMLTNADHEVQGGAAPLASWPVGKVIEDVHSVPMPGTPARVMLGFWRGGSRLPVDDANAHDGSQRMLGPQLGGAAQELPEYSVPRVSQPPTIDGVLDDAAWKQSKPVVLRRSFDGSAARQRTEARLVHDGKFLYVAFDLDDPDVWGTLRKRDDPIYEEEVVEIFLDANADGRTYNELQVSPHNVIFDAYFPARRQGMDRSWDSGMTSAVKVRGTLDDDSDRDEGWSVEMQIPFDRLAEVPHIPPQPGDRWRFNLYRLEHHDRRTVEGQSFSPLFVGDFHALPRFGWLVFE

SEQ ID NO: 16280 - protein, 80 aa, Myxococcus xanthus
MYYGRTHIVVDARGLTYRGMVRTRRFTFADIRKLDVLPGPVTVYAIRGKAGLVHFTSFFMHHQQLARLLVERAGLGPIPG

SEQ ID NO: 16281 - protein, 438 aa, Myxococcus xanthus
MVVLRSFVIALSAAMLLGAAEPSAAARAAFVRGESALARGRWDDAATAYREALADTPGYPSALNGLGSVLFRKGQVQEALTLFRDAAKADPGFKMAWFNLGYAARKTGDAATAAQAYERYTELEPGDADGFYGLGESYRQLGQKDKAIPAYQAYIAREQRKGEQVWVRKATEHLKAMGAEPLAVATAPASATPSAAPAAESVTSNPALAASRIRDGDALMKERRYREAAFAFLDASHADGGHVEALFKLGNALAVLGYYGQAVAQWERATALTKDAAIQQSAKENIDRARAKMVQAGVSPQAAGQAPGSGPVSDTTRALARRAYDQGVQRIGSKDFSGALTSLTQSIQLEPMLTVAFVARGSANISVCRYSEAAADYQYALELEPGSASPLYGLAESFRAMGRTLEARDLYERYAASSSADVRPQLQEESRQKAARLR

SEQ ID NO: 16282 - protein, 436 aa, Myxococcus xanthus
MPNVVVIGAQWGDEGKGKVVDLLTEHAQVVVRFQGGNNAGHTLVVGGQKTVLHLIPSGILHPGKTCVIGNGVVVDPAVLVGEIDALKVRGFLKDDAQLLISDNAHVIFPWHKLLDSFREKARGGSAIGTTGRGIGPAYEDKVARRGIRVRDLLNADRLRTRIEARLPAALDELKDLCAQAGDPVPQLEVPQILAEFTGLGERLKPFVHDASLYLSGQVRRGARILFEGAQGTLLDVDHGTYPFVTSSNCVAGNAAVGSGLGPTAIDKVMGISKAYTTRVGGGPFPTELHDAIGDQLRKMGDEFGTTTGRPRRCGWLDGVVLRYASRVNGLWGMALTKLDVLSGLKTLQICTAYELDGQKVMELPGDYEDLARVKPIYETLQGWDEQIAGVRTFDELPENAKRYVRRVEEVSGVPVVCVSVGADRGETVLLQNPFRS

SEQ ID NO: 16283 - protein, 425 aa, Myxococcus xanthus
VVVVPSMGGRRRGTSGRAHFERTHGISLRPWVPDSLDDYTSSRFDAVRAELKAREDAEYRRLLYVALTRAKDMLVLAGGAEPRGGKDSWWHLIDGRLEVDADLRDLVDELDVDTLPPPADPEPPGPEALLLAEARVEAALLRVRGQRVAQAESLGAAVASAEALQDFIACPRRFHYVHRLGLRGAPWPWEVLPRGAPPLVEPDGWLPAERPEDLVQRLLRGVDLRLAAPDVDASERRAHLETLLRDAGALPDEEGMDAVLNTLERFLTSAFARELARAPSQTIHRSLPFMLALEGEVGVEGAVDLLWESPQGEAVVVAFKHGGRHPLGAAAYTYELAALGLVARRMVREGVPVRVGVVFLKESQPEPEWLSGPRGLEEAAGRLAGAARAVARGEARGEWDGREKAACQALHCGFAEHCHPAPRAC

SEQ ID NO: 16284 - protein, 243 aa, Myxococcus xanthus
MWTAALVFALGATGAQAQDSKSAKKPAAKAAPATPAAAPAAPAALSEEDQQTLYTLGLSIGRDLSLFALSPEELKVLQQGLSDGLGGKTSDIDPKEQAQRIQAFAKSRQALAGKAALERAAKEPGAEVLPSGVIYKQVQAGTGRSPRAVDTVKVHYEGRLVDGTIFDTSARRGIPVEFPLNGVIPCWTQGVAKMKVGGKAKLTCPGNTAYGERPPSGSRIPPNAVLTFDVELIDIPGDTSRQP

SEQ ID NO: 16285 - protein, 117 aa, Myxococcus xanthus
RVKKGVKARRRRNRILKLAKGYRGRRKNCYKRANEAVERALDYASRDRMQRKRDFRRLWIVRINAAARTVGLSYSKLIAGLAKAKIGLDRKVLSDMAIADPSGFAAVANIAKQALPT

SEQ ID NO: 16286 - protein, 642 aa, Myxococcus xanthus
MSDIITVTLPDGSQKQTARGTTIADFVRESIGPGLAKAALFARVNGQDMDLARKLDEDVKLQIFTPKSPESLELIRHDAAHVVASAVQKLFPGTQVTIGPATEEGFYYDFFREKPFTPEDLEKIEAEANAELKRDMAFVRTEISMDEAVRLFEEKGEKFKVEIVKDIAAKGAKTLTLYTHGDWVDFCLGPHAPSTGKIGIIKILSSSGAYWRGDHRNPMLQRVYGTAFFDKKQLAEYLTRIEESKKRDHRKLGKELDLFHFHPYSPGSAFWTPKGTTLYTTLSNWMRQLTQNDGYVEIKTPLMFNKGLWETSGHWGKYKENMFLVLDSESGEHDFSLKPMNCPSHHLFYGFKKHSYRDLPLRYHTQDVLHRNEAAGSLGGLTRVRQFAQDDAHIYCTEAQITDEVRRFVKLLDHVYKAVGLTYAVKLSTRPEQRLGDDSLWDRAEGGLKAALESLGLEYELAPGDGAFYGPKIDFAVSDSIGRRWQLGTMQLDYLAPERFDLTYVGEDNAEHRPVVLHRAIFGSFERFTAILIEHFAGAFPAWLAPIQAVLVTVADRQNDYARKVRDSLRAKGYRVEFDERGLSMNAKIREAQLQKVPFTLVVGDNEVSGEGVSPRRYGGEDLKTMKVTDFEALLAKEAALP

SEQ ID NO: 16287 - protein, 163 aa, Myxococcus xanthus
MFTGDRSGDFLYAGLHRAGFANQALSEHRDDGLRLKDAFIVSAARCAPPDNKPLPEELARCAPFLDRELALLPGRVMLALGAIGWNAALVALARQGMEVPSPRPAFGHGAELRLPGGRTLLGCYHVSQQNTQTGRLTPAMFDAVMSRVHTLLETADPKARGKS

SEQ ID NO: 16288 - protein, 248 aa, Myxococcus xanthus
MSKQLVEELYTPNLTATRERIKTDPRLKVLLDDKADPALFEAFLITWNSLGVYMTEPVDGWIRRAGEATVKAGLDDVGQKLIAHAKHEAGHHLMMVEDTKHLVARWNERRSPKLNAEELIAQPPTEAMKEYREIHENTITGEMPAAQVAIEYEIEGLSTVLGPVILEQAKRVCGEEILQGMSFLKEHTEIDVGHTALNEVMLNKLLSQVPDKAPIIAKTGASALDIYLRFMGDCVERAGKLVQSAAAA

SEQ ID NO: 16289 - protein, 287 aa, Myxococcus xanthus
MLVGAVLYLIPVFREEASKLPDFFHRASTQVVPKVEGLVGHSLPDLVRQRTTELGKQASELVQSAGPAAARILASFAGNTARLVVTLLGLSVVPVLAFFFLQDYPRLMGMVKDLLPRRAVGLVSRRFAEVDEVLSAFVRGQLIVGGVLSVIYAAGLSAARIDMAIVIGVIAGFGNMVPYLGTGVGIVLSLVGLMLSWQGPWQLAAVAATFVIGQMLEGFVITPRIVGEKVGLAPVAIILAILAFGELFGFVGILLAVPVAAILKVVLSVVVERYRRTRLYTGEPKSP

SEQ ID NO: 16290 - protein, 120 aa, Myxococcus xanthus
MRKVLLLVMVSTFAGCAKRQEPESLLKARELMAEAQNPSGNLALLCEPVDAEVYLDGVWQGLCSDFSGSPKALRVGSGLHEIEVKKQGYWPYTTYFEPSRARARLTIQLRASGPKAGGSE

SEQ ID NO: 16291 - protein, 188 aa, Myxococcus xanthus
MDQAGRLHISAGRTVADELARDDVRKRVEAAMGGYKVVARRFFSDSGVEIDVEVPLSALTASLFAPPAADTVIAINGAGAKKYTGLVVDARGLGVQPVLAPRLLDDSGKALYGAAALASERRAATAVAAWFQSLDAAKKASLVGDKPLVVKAKGSKGSDLVLASEDAKALVEANTRFLAEGRVVIVTQ

SEQ ID NO: 16292 - protein, 111 aa, Myxococcus xanthus
MSDKRKNKRAPLDIYLNKYMGGVPYMSRAADISQEGLSLARLLEPQHEAKRIGLQFQLPGSEEIIYAEGEVVREWAELGAKRERSGVRFTLLTDRHRKMIDAYVDRHGNEN

SEQ ID NO: 16293 - protein, 660 aa, Myxococcus xanthus
MTSTFDAAALKAELVTRHGEAQRARIERGVEQVAAMWRPEDGDLAAFAREQFLSDPNALDATFQRLERLFEQLDGHLYEIGRELQWYTDLDLGPLLPVEPLVAAYDPAAHVTTDLFRARVGFVVLLNFPLTTLAERVEQGPSWTRRQWAETRLAGRFNQRVPAEIEQASSRAIAAANLYIAEYNIWMHHLVDAQGRRPFPKGLRLISHWNLRDELKGDYSDAATGALKQRMIVQVMERIITQTIPAAVIDNPRLDWDPFTNTVTVAPPQTVEADAPARTTKPDASPEPDTRYTHLLATFHAARQADPYVPVAPTRIARSFELGRELPEARVRALLTQVLESPLVPRVAKEIEARLGRKLEPQDLWYSGFNPGGKRKESELDALTRKRYPTAEAFAKDLPRILQGMGFTKAKAAWLAERIRVDASRGAGHAQPALRRGDFPRLRTRVEKGGMDYKGYNIAVHELGHNVEQVFSLYGVDHTLLAGVPNNAFTEALAFVFQSRDLELLGLGKPDAASERERVLGELWQTWERAGIALVDMSVWHWMYAHPDATPVQLREAVVGIAREVWNQYFAPVLGGEGSTLLAVYSHMISYPLYLPDYPLGHLIAFQIEEHLKRKGPLGAEFERMATYGSVTPDQWMIHATGAPVSAEPLIRAAEAALSR

SEQ ID NO: 16294 - protein, 67 aa, Myxococcus xanthus
MATGTVKWFNDAKGFGFLTQDGGGEDVFCHHTAINMDGFRTLQEGQKVEFEVTRGPKGLQAQNVRAA

SEQ ID NO: 16295 - protein, 689 aa, Myxococcus xanthus
GPLLAPAGRSRKGTYLDIFAAAARAGISRAIVDGKLASTDDPPRLAKTREHDIDLVMYEGKLSKLERDVFEKALGWGQGAVKVDAGKGETLLSTERTCPKCGTAVPELDPRWFSFNTKQGRCESCEGTGIQGGAEAMAEGEVAPCRTCGGSRLAPVPRGVRLEGARYHEVVQQSVASTLTRVRGWKFKGDRALLGEPSRQELLRRMEFLERVGLGYLSLDRNAATLSGGEMQRLRLSAQLGAGLTGAMYVLDEPTIGLHPRDTHRLLDNLRALVATGSTVLVVEHDSDTIRAADHLLDLGPTGGRGGGHILAEGPPDVVLESDSPTARALKESQVRPPSGRGEAKQWIELKGARANNLKRVDLRLPVGRLNVVSGVSGSGKSTLIRQVLYPALREKLDRVTAKPGPFTSLHGAEAVKRVLSVDQSPIGRTPRSVPATFLGIWDELRRVFAATPEAKIKGFTPTRFSFNSDSGGRCTACDGQGAISHEMSFLPDVVTPCEACNGARFDAATLEVRYHGLTIGDVLRLSADEAKDVFKALPRVAAPLECLADLGVGYLQLGQGSNTLSGGEAQRLKLAAELTASARHEPTLYVLDEPTTGLHLGDVEKLITFMGRLVDRGDTLVVIEHHPSVIGAADHVVELGPDGGEAGGHIVAEGTPREVAKQKTPTGRVLKSLFSDEDTRSRAAARRA

SEQ ID NO: 16296 - protein, 157 aa, Myxococcus xanthus
MSFHHLSANRLDGKPETLSGYQGKVVLVVNTASECGYTPQYAGLEKLHQEYKDKGLVVVGFPSNDFGGQEPGSSEEIKKFCELRYKVTFPMFEKVKTKGDGQSPVYAFLSQHHPAPKWNFHKYVVGKDGQVKAGFPSAVTPDSAELKAAIDSALAQP

SEQ ID NO: 16297 - protein, 324 aa, Myxococcus xanthus
MDTRDTAWPPLPLEAWQDTYATLHRYTQVVGKVKLALTPPQNHWWNVAFRVTARGMTTGLIPFGNGAFEVDFDFLSHELHVHATRGPSRVMALEPRPVAEFYRDFMATLRSMGIDVRIWEQPVEIPDDTTPFGKDWHHASYDGEAVERWWRALLQATLVFEDFRARFTGKCSPVHFFWGSFDLAVTRFSGRPAPARIGADPITQEAYCEEVSSAGFWPGMQATGGAAFYSYAAPEPEGFARASVRPAQARYDANIKEYLLAYDDVRRAEDPKAYLLDFLQSTYEACADLGGWERERLERPLIVPESLRAARAVEEGTVAEQPAP

SEQ ID NO: 16298 - protein, 172 aa, Myxococcus xanthus
MLRQHGGQAGVDAVLRRLPAEDQALLRQMLLPVGWYPLELNLRLDAAIAGVMSPEDKDRAFLEMGRASAHEALHGPQHVFVKAGEPHFLLSQAPKIYRFYYAVGSRTYEQTGPCAAVLRTFGAENVTEPDCLTIIGWHERAIELCGGRAVHVTHPMCRARGAPHCEYHCTWE

SEQ ID NO: 16299 - protein, 192 aa, Myxococcus xanthus
MPIISEVMESAQIPLMEESTDILQVGARNMQNYSLLRALGKVRKPVLLKRGLSATLQEWLLAAEYILDGGNEQVMLCERGIRTFETELRNTLDLAAVAWAKQRSHLPVIVDPSHATGDPALILPMSLAAAAAGADGLLIEVHPKPEQAMCDGHQALTPERFETLMRRLPAVLDAVDRHLWRPESPAQVVRAR

SEQ ID NO: 16300 - protein, 57 aa, Myxococcus xanthus
MPDLGAKGAAAGQVRQVLAKLQRAGFTRAAAVAMSSPVEGLHVQKVVVPGMRISELL

SEQ ID NO: 16301 - protein, 387 aa, Myxococcus xanthus
MKRRADKLVVFLGPSLPEAEAKRLAPCTVLPPARQGDVWRAQRLRPRAIALVDGVFEAQPSVWHHELLAALEAGVAVFGGGSMGALRAAELAPHGVVGVGRIFEWYRDGDVVDDSEVALLHADGEHGWRPLTVPLVNVRHAAACAAQARVLTRDAARALVDAGQSVFYQERTWARVLETVAPRWSASTRAAWDAWFPHGAEDLKRQDALACLRTAAEWVASGAPAPHGAPREPSSLVRRRRLVDDVTATQAGAVSSGQVLDVLRASPNAPALAEAGLRRALLAGWARTLGLGVSDAEVAEEEARWWQAQRVPVSRREAHLARLGLDAVGLRRLCGELALERLVLAHSARLLPDGPSWDEALAAEARLSGAWADAAEAVDPTERVGSS

SEQ ID NO: 16302 - protein, 118 aa, Myxococcus xanthus
MALRPAGLHAAEEEDINGRLAHEVAALLACAPHPNLPALHAVDRWPEPPDGYLYFVTDYIDGETFHEWRWRVKPTAAHLLTVFTELVRVVADLHRRGVHHRDMKGDNVLIRREDERPT

SEQ ID NO: 16303 - protein, 65 aa, Myxococcus xanthus
MPETELREYEEGSLILDIVDPQSRQLVWRGTAQAELDENASAEKQQRRLDESVKEVLERFPPKAK

SEQ ID NO: 16304 - protein, 149 aa, Myxococcus xanthus
MLALLPWVAVAAPTGREARVEERMERAEQRHRLRQVLELSDVLDLDNAQALKLEETLQRFDERRRPLRKQVREAARILHRAARGDSEALAQVDAAALGAFEARERIAALDKELYLALAKSLPQEKRARLALALARSEGRQKMKREPGKD

SEQ ID NO: 16305 - protein, 173 aa, Myxococcus xanthus
MAACPDQEERLDLHAAGALEDDEALGLIQHLEGCEGCRQALAASKELLSLVALPALSPQEKTELQELPRRTLSEWRRGARRQGLGLKTLGALVATVAAVTLVLLVPGAWRVPGLGLKAPVTATAAPATDVEELDAETMAAIEAWAGLEPLDAVLFEDSQGWDEEFDIDVGETL

SEQ ID NO: 16306 - protein, 197 aa, Myxococcus xanthus
MARAGLERAPDEALCRAFLEGDPAAFEVLVTRHRSLVFSLVRRYVTRPEDAADLVQSAFLRALEASRRVFARFTPSGPAPFRAWLVRIALNLAKNHARQVQRWRPVLVASGPDDVVEDPSESAQDRLERAERERQVRAEVLALPRRQREVLTLRVDGGLAFKDIAETLGITENNAKVQFHHAMKRLKARVGAPEEKH

SEQ ID NO: 16307 - protein, 1820 aa, Myxococcus xanthus
TRLEILQALQSGRMALADAKKALAAIEAQVQPEDFGLVVAGVGGVEAARLSAWAVAPPSPGDITIQVRASALNYPDVMCVRGLYPTMPEYPFVPGFEVAGVVSAVGPGVARFAVGDEVIAVTGPLLGGHASKVNVPADNAVRKPATLTFEEACSLPVVFSTVYYAFEMGKLAEGEHVLVQTATGGCGLMALQLAHLKRCICHGSSSRDDKRKVLERIGVPHVIDYTGDFAPEIRNQTGGRGVDVVLNMVSGEAIQKGIDSLAPFGRYLEIAVHALKTSPKLDLSRLVQNQTLHSIDLRRVGFAGRLGAHRLLDEMAAMASAGEIVPIVSRVYPVRKLQDALQYVSEGKHIGKVVLSHTAEEVVDRTEACIEAMVRHRKRFESSAPSKPTVPVSPPEVRTERPVTQDMEPVAVIGMAGKFPRASDLAQFWQNIARGVDCISEVPAGRWSVAEHYDADGNTPGKSYSKWLGVLEDAESFDPLFFGISPAEAERMDPQQRLFLAACWHCIEDAAIRPSSLSDTRCGVFVGCGPTDYGRDLRGGDLNAQALMGGATSILAARISYLLNLKGPCLAIETACSSSLVAISQACDSLVLRNCDLALAGGVNVAFGPAMHIMSSDAGMLSKDGRCFTFDARANGFVPGEGVGVLLLKRLSDAVRDDDPIAGVIRGWGVNQDGKTNGITAPSAKSQAALEREVYRRFGIDADTISLVEAHGTGTRLGDPIEVEALVESFREHSARKHYCALGSVKSNIGHLMTAAGVSGVLKVLMAMRHQSLPPTLHFEAVNPHLALEGSPFYVNTELKPWTGVPVRRACVSSFGFSGTNAHVVLEEAPSQSRTVAGDAVSPAAPVVFTLSARTEVQLKELAQSMAAFISATPDVDLRDLTYTLQVGREMLEHRLAILAGSREALQEALAAYLSGRPSAAVLSGQAKRTAASISALAADEDGRVLFESWLHKGKLRRVADLWTQGVDVDWRRLYATHTPRRLRLPGYPFSKKRYSPPVVEAQAVSTVRGGAVLHPLVHRNSSVLAEQRYSSTLRGDAFYLADHQVNGRKVLPAAAYLEMARFAASDAWADEAVGRIPVLRNMVWTSPLVVDDAAEVGVALHAQDAGRLTFEIHSAPDAAGERTVHCRGLAELQERVAPRHDLRRLEADCTLRVLSREQCYETFARLGLNYGPGHRALVRVRVGHGQALGEVELPEHLVGDGRSFVLHPALVDSALQAVVGVLGDEGGTAPALPFAVEEVVVHGPCIPRMWAVVRSGTGEGMARKLDVDLCDEQGAVRVSIHALSLRPLPEQPSASVATGLFQMEWVPRELPAGDAGTFEHRVVILCGMQGVDVAQLSSRLDGAECVAVDASHASVADRFLHASAQLLGVLQRVTTSRLSGKALVQMVAASGADLLLYGLSGMLKTAALEDDKIVGQTVLLAHPASSIDQMVEVLRNEARGLGSNSVRYDEGRRLLATWKARSTDAVATASWPDSGVYVISGGAGRLGLRVAEEIAQRARGASIVLVGRSAPTSEVAARIERIAGTGTQVVYRQADVGDLTAVDALVREVRSAFGPIKAVVHAAGLLRDRYLRDKTSEELQAVAWPKVRGIVNLDLATRGEPLELFLVFSSIAGAIGNIGQADYAAANAFMDGYAAHRDALVRTGERAGRTLSVNWPFWEEGGMQVDAATAKRKVREWGLAALSSTQAFDALYRGLRTDAAQLMVLSGHLEAIQRRLTLSEEGGAHRAATGAARAVTIDDDTLRTQVRQVLMSVVSKVLKIPFEELDADAELKEMGFDSISLTDLAHQLAGEYRLDLAPTVFFEHPTINALVGRLVSELQ

SEQ ID NO: 16308 - protein, 412 aa, Myxococcus xanthus
MGFFGTGGCSVEEIGRAIDEIQSQLTKGEPFGMNLLASHGESSLELETVKLYLARGVRNVEAAAFTQATPSLVFYRVKGLRQDAQGRVVCDNRIMAKLSRPEVAEVFMSPPPRRLVEQLLRDAMITPEQAAMAERVPLSHDICVEADSGGHTDGAIPTIILPTLLRLRDRLVSRYGYEEPICMGQAGGIGTPEAAAAAFIMGADFILTGSINQCTVESGMSSDAKLLLQEMGVQDTDYAPAGDMFEMGAKVQVLKKGVFFPARANKLYALYTHYDSVDDIPEKVRKQLESSFFKKSLSQVWEDTKVYLRRKGQQATIDKAEAHPKQKLALIFRWYFAYSTRLAFAGTGEDRVNYQVHTGPALGAFNQWVKGTELESFSNRHADVIAMKLMTEAAEYLNRQYPRLAGQEGGQS
